United States Patent 11,078,247 (RNA ENCODING A THERAPEUTIC PROTEIN) - sequence listing, part 6

SEQ ID NO: 13099 - RNA, 3966 nt, Artificial Sequence
  ABCB11__Homo_sapiens__NP_003733
augagcgacagcgugauccugagaagcaucaagaaguucggcgaggagaacgacggcuucgagagcgacaagagcuacaacaacgacaagaagagcagacugcaggacgagaagaagggcgacggcgugagagugggcuucuuccagcuguucagauucagcagcagcaccgacaucuggcugauguucgugggcagccugugcgccuuccugcacggcaucgcccagcccggcgugcugcugaucuucggcaccaugaccgacguguucaucgacuacgacguggagcugcaggagcugcagauccccggcaaggccugcgugaacaacaccaucguguggaccaacagcagccugaaccagaacaugaccaacggcaccagaugcggccugcugaacaucgagagcgagaugaucaaguucgccagcuacuacgccggcaucgccguggccgugcugaucaccggcuacauccagaucugcuucugggugaucgccgccgccagacagauccagaagaugagaaaguucuacuucagaagaaucaugagaauggagaucggcugguucgacugcaacagcgugggcgagcugaacaccagauucagcgacgacaucaacaagaucaacgacgccaucgccgaccagauggcccuguucauccagagaaugaccagcaccaucugcggcuuccugcugggcuucuucagaggcuggaagcugacccuggugaucaucagcgugagcccccugaucggcaucggcgccgccaccaucggccugagcgugagcaaguucaccgacuacgagcugaaggccuacgccaaggccggcgugguggccgacgaggugaucagcagcaugagaaccguggccgccuucggcggcgagaagagagagguggagagauacgagaagaaccugguguucgcccagagauggggcaucagaaagggcaucgugaugggcuucuucaccggcuucguguggugccugaucuuccugugcuacgcccuggccuucugguacggcagcacccuggugcuggacgagggcgaguacacccccggcacccuggugcagaucuuccugagcgugaucgugggcgcccugaaccugggcaacgccagccccugccuggaggccuucgccaccggcagagccgccgccaccagcaucuucgagaccaucgacagaaagcccaucaucgacugcaugagcgaggacggcuacaagcuggacagaaucaagggcgagaucgaguuccacaacgugaccuuccacuaccccagcagacccgaggugaagauccugaacgaccugaacauggugaucaagcccggcgagaugaccgcccuggugggccccagcggcgccggcaagagcaccgcccugcagcugauccagagauucuacgaccccugcgagggcauggugaccguggacggccacgacaucagaagccugaacauccaguggcugagagaccagaucggcaucguggagcaggagcccgugcuguucagcaccaccaucgccgagaacaucagauacggcagagaggacgccaccauggaggacaucgugcaggccgccaaggaggccaacgccuacaacuucaucauggaccugccccagcaguucgacacccuggugggcgagggcggcggccagaugagcggcggccagaagcagagaguggccaucgccagagcccugaucagaaaccccaagauccugcugcuggacauggccaccagcgcccuggacaacgagagcgaggccauggugcaggaggugcugagcaagauccagcacggccacaccaucaucagcguggcccacagacugagcaccgugagagccgccgacaccaucaucggcuucgagcacggcaccgccguggagagaggcacccacgaggagcugcuggagagaaagggcguguacuucacccuggugacccugcagagccagggcaaccaggcccugaacgaggaggacaucaaggacgccaccgaggacgacaugcuggccagaaccuucagcagaggcagcuaccaggacagccugagagccagcaucagacagagaagcaagagccagcugagcuaccuggugcacgagcccccccuggccgugguggaccacaagagcaccuacgaggaggacagaaaggacaaggacauccccgugcaggaggagguggagcccgcccccgugagaagaauccugaaguucagcgcccccgaguggcccuacaugcuggugggcagcgugggcgccgccgugaacggcaccgugaccccccuguacgccuuccuguucagccagauccugggcaccuucagcauccccgacaaggaggagcagagaagccagaucaacggcgugugccugcuguucguggccaugggcugcgugagccuguucacccaguuccugcagggcuacgccuucgccaagagcggcgagcugcugaccaagagacugagaaaguucggcuucagagccaugcugggccaggacaucgccugguucgacgaccugagaaacagccccggcgcccugaccaccagacuggccaccgacgccagccaggugcagggcgccgccggcagccagaucggcaugaucgugaacagcuucaccaacgugaccguggccaugaucaucgccuucagcuucagcuggaagcugagccuggugauccugugcuucuuccccuuccuggcccugagcggcgccacccagaccagaaugcugaccggcuucgccagcagagacaagcaggcccuggagauggugggccagaucaccaacgaggcccugagcaacaucagaaccguggccggcaucggcaaggagagaagauucaucgaggcccuggagaccgagcuggagaagcccuucaagaccgccauccagaaggccaacaucuacggcuucugcuucgccuucgcccagugcaucauguucaucgccaacagcgccagcuacagauacggcggcuaccugaucagcaacgagggccugcacuucagcuacguguucagagugaucagcgccguggugcugagcgccaccgcccugggcagagccuucagcuacacccccagcuacgccaaggccaagaucagcgccgccagauucuuccagcugcuggacagacagccccccaucagcguguacaacaccgccggcgagaagugggacaacuuccagggcaagaucgacuucguggacugcaaguucaccuaccccagcagacccgacagccaggugcugaacggccugagcgugagcaucagccccggccagacccuggccuucgugggcagcagcggcugcggcaagagcaccagcauccagcugcuggagagauucuacgaccccgaccagggcaaggugaugaucgacggccacgacagcaagaaggugaacgugcaguuccugagaagcaacaucggcaucgugagccaggagcccgugcuguucgccugcagcaucauggacaacaucaaguacggcgacaacaccaaggagauccccauggagagagugaucgccgccgccaagcaggcccagcugcacgacuucgugaugagccugcccgagaaguacgagaccaacgugggcagccagggcagccagcugagcagaggcgagaagcagagaaucgccaucgccagagccaucgugagagaccccaagauccugcugcuggacgaggccaccagcgcccuggacaccgagagcgagaagaccgugcagguggcccuggacaaggccagagagggcagaaccugcaucgugaucgcccacagacugagcaccauccagaacgccgacaucaucgccgugauggcccagggcguggugaucgagaagggcacccacgaggagcugauggcccagaagggcgccuacuacaagcuggugaccaccggcagccccaucagcuaa

SEQ ID NO: 13100 - RNA, 3843 nt, Artificial Sequence
  ABCB1__Homo_sapiens__NP_000918
auggaccuggagggcgacagaaacggcggcgccaagaagaagaacuucuucaagcugaacaacaagagcgagaaggacaagaaggagaagaagcccaccgugagcguguucagcauguucagauacagcaacuggcuggacaagcuguacaugguggugggcacccuggccgccaucauccacggcgccggccugccccugaugaugcugguguucggcgagaugaccgacaucuucgccaacgccggcaaccuggaggaccugaugagcaacaucaccaacagaagcgacaucaacgacaccggcuucuucaugaaccuggaggaggacaugaccagauacgccuacuacuacagcggcaucggcgccggcgugcugguggccgccuacauccaggugagcuucuggugccuggccgccggcagacagauccacaagaucagaaagcaguucuuccacgccaucaugagacaggagaucggcugguucgacgugcacgacgugggcgagcugaacaccagacugaccgacgacgugagcaagaucaacgagggcaucggcgacaagaucggcauguucuuccagagcauggccaccuucuucaccggcuucaucgugggcuucaccagaggcuggaagcugacccuggugauccuggccaucagccccgugcugggccugagcgccgccgugugggccaagauccugagcagcuucaccgacaaggagcugcuggccuacgccaaggccggcgccguggccgaggaggugcuggccgccaucagaaccgugaucgccuucggcggccagaagaaggagcuggagagauacaacaagaaccuggaggaggccaagagaaucggcaucaagaaggccaucaccgccaacaucagcaucggcgccgccuuccugcugaucuacgccagcuacgcccuggccuucugguacggcaccacccuggugcugagcggcgaguacagcaucggccaggugcugaccguguucuucagcgugcugaucggcgccuucagcgugggccaggccagccccagcaucgaggccuucgccaacgccagaggcgccgccuacgagaucuucaagaucaucgacaacaagcccagcaucgacagcuacagcaagagcggccacaagcccgacaacaucaagggcaaccuggaguucagaaacgugcacuucagcuaccccagcagaaaggaggugaagauccugaagggccugaaccugaaggugcagagcggccagaccguggcccuggugggcaacagcggcugcggcaagagcaccaccgugcagcugaugcagagacuguacgaccccaccgagggcauggugagcguggacggccaggacaucagaaccaucaacgugagauuccugagagagaucaucggcguggugagccaggagcccgugcuguucgccaccaccaucgccgagaacaucagauacggcagagagaacgugaccauggacgagaucgagaaggccgugaaggaggccaacgccuacgacuucaucaugaagcugccccacaaguucgacacccuggugggcgagagaggcgcccagcugagcggcggccagaagcagagaaucgccaucgccagagcccuggugagaaaccccaagauccugcugcuggacgaggccaccagcgcccuggacaccgagagcgaggccguggugcagguggcccuggacaaggccagaaagggcagaaccaccaucgugaucgcccacagacugagcaccgugagaaacgccgacgugaucgccggcuucgacgacggcgugaucguggagaagggcaaccacgacgagcugaugaaggagaagggcaucuacuucaagcuggugaccaugcagaccgccggcaacgagguggagcuggagaacgccgccgacgagagcaagagcgagaucgacgcccuggagaugagcagcaacgacagcagaagcagccugaucagaaagagaagcaccagaagaagcgugagaggcagccaggcccaggacagaaagcugagcaccaaggaggcccuggacgagagcaucccccccgugagcuucuggagaaucaugaagcugaaccugaccgaguggcccuacuucguggugggcguguucugcgccaucaucaacggcggccugcagcccgccuucgccaucaucuucagcaagaucaucggcguguucaccagaaucgacgaccccgagaccaagagacagaacagcaaccuguucagccugcuguuccuggcccugggcaucaucagcuucaucaccuucuuccugcagggcuucaccuucggcaaggccggcgagauccugaccaagagacugagauacaugguguucagaagcaugcugagacaggacgugagcugguucgacgaccccaagaacaccaccggcgcccugaccaccagacuggccaacgacgccgcccaggugaagggcgccaucggcagcagacuggccgugaucacccagaacaucgccaaccugggcaccggcaucaucaucagcuucaucuacggcuggcagcugacccugcugcugcuggccaucgugcccaucaucgccaucgccggcgugguggagaugaagaugcugagcggccaggcccugaaggacaagaaggagcuggagggcagcggcaagaucgccaccgaggccaucgagaacuucagaaccguggugagccugacccaggagcagaaguucgagcacauguacgcccagagccugcaggugcccuacagaaacagccugagaaaggcccacaucuucggcaucaccuucagcuucacccaggccaugauguacuucagcuacgccggcugcuucagauucggcgccuaccugguggcccacaagcugaugagcuucgaggacgugcugcugguguucagcgccgugguguucggcgccauggccgugggccaggugagcagcuucgcccccgacuacgccaaggccaagaucagcgccgcccacaucaucaugaucaucgagaagaccccccugaucgacagcuacagcaccgagggccugaugcccaacacccuggagggcaacgugaccuucggcgaggugguguucaacuaccccaccagacccgacauccccgugcugcagggccugagccuggaggugaagaagggccagacccuggcccuggugggcagcagcggcugcggcaagagcaccguggugcagcugcuggagagauucuacgacccccuggccggcaaggugcugcuggacggcaaggagaucaagagacugaacgugcaguggcugagagcccaccugggcaucgugagccaggagcccauccuguucgacugcagcaucgccgagaacaucgccuacggcgacaacagcagaguggugagccaggaggagaucgugagagccgccaaggaggccaacauccacgccuucaucgagagccugcccaacaaguacagcaccaaggugggcgacaagggcacccagcugagcggcggccagaagcagagaaucgccaucgccagagcccuggugagacagccccacauccugcugcuggacgaggccaccagcgcccuggacaccgagagcgagaagguggugcaggaggcccuggacaaggccagagagggcagaaccugcaucgugaucgcccacagacugagcaccauccagaacgccgaccugaucgugguguuccagaacggcagagugaaggagcacggcacccaccagcagcugcuggcccagaagggcaucuacuucagcauggugagcgugcaggccggcaccaagagacaguaa

SEQ ID NO: 13101 - RNA, 3840 nt, Artificial Sequence
  ABCB4__Homo_sapiens__NP_000434
auggaccuggaggccgccaagaacggcaccgccuggagacccaccagcgccgagggcgacuucgagcugggcaucagcagcaagcagaagagaaagaagaccaagaccgugaagaugaucggcgugcugacccuguucagauacagcgacuggcaggacaagcuguucaugagccugggcaccaucauggccaucgcccacggcagcggccugccccugaugaugaucguguucggcgagaugaccgacaaguucguggacaccgccggcaacuucagcuuccccgugaacuucagccugagccugcugaaccccggcaagauccuggaggaggagaugaccagauacgccuacuacuacagcggccugggcgccggcgugcugguggccgccuacauccaggugagcuucuggacccuggccgccggcagacagaucagaaagaucagacagaaguucuuccacgccauccugagacaggagaucggcugguucgacaucaacgacaccaccgagcugaacaccagacugaccgacgacaucagcaagaucagcgagggcaucggcgacaaggugggcauguucuuccaggccguggccaccuucuucgccggcuucaucgugggcuucaucagaggcuggaagcugacccuggugaucauggccaucagccccauccugggccugagcgccgccgugugggccaagauccugagcgccuucagcgacaaggagcuggccgccuacgccaaggccggcgccguggccgaggaggcccugggcgccaucagaaccgugaucgccuucggcggccagaacaaggagcuggagagauaccagaagcaccuggagaacgccaaggagaucggcaucaagaaggccaucagcgccaacaucagcaugggcaucgccuuccugcugaucuacgccagcuacgcccuggccuucugguacggcagcacccuggugaucagcaaggaguacaccaucggcaacgccaugaccguguucuucagcauccugaucggcgccuucagcgugggccaggccgcccccugcaucgacgccuucgccaacgccagaggcgccgccuacgugaucuucgacaucaucgacaacaaccccaagaucgacagcuucagcgagagaggccacaagcccgacagcaucaagggcaaccuggaguucaacgacgugcacuucagcuaccccagcagagccaacgugaagauccugaagggccugaaccugaaggugcagagcggccagaccguggcccuggugggcagcagcggcugcggcaagagcaccaccgugcagcugauccagagacuguacgaccccgacgagggcaccaucaacaucgacggccaggacaucagaaacuucaacgugaacuaccugagagagaucaucggcguggugagccaggagcccgugcuguucagcaccaccaucgccgagaacaucugcuacggcagaggcaacgugaccauggacgagaucaagaaggccgugaaggaggccaacgccuacgaguucaucaugaagcugccccagaaguucgacacccuggugggcgagagaggcgcccagcugagcggcggccagaagcagagaaucgccaucgccagagcccuggugagaaaccccaagauccugcugcuggacgaggccaccagcgcccuggacaccgagagcgaggccgaggugcaggccgcccuggacaaggccagagagggcagaaccaccaucgugaucgcccacagacugagcaccgugagaaacgccgacgugaucgccggcuucgaggacggcgugaucguggagcagggcagccacagcgagcugaugaagaaggagggcguguacuucaagcuggugaacaugcagaccagcggcagccagauccagagcgaggaguucgagcugaacgacgagaaggccgccaccagaauggcccccaacggcuggaagagcagacuguucagacacagcacccagaagaaccugaagaacagccagaugugccagaagagccuggacguggagaccgacggccuggaggccaacgugccccccgugagcuuccugaaggugcugaagcugaacaagaccgaguggcccuacuucguggugggcaccgugugcgccaucgccaacggcggccugcagcccgccuucagcgugaucuucagcgagaucaucgccaucuucggccccggcgacgacgccgugaagcagcagaagugcaacaucuucagccugaucuuccuguuccugggcaucaucagcuucuucaccuucuuccugcagggcuucaccuucggcaaggccggcgagauccugaccagaagacugagaagcauggccuucaaggccaugcugagacaggacaugagcugguucgacgaccacaagaacagcaccggcgcccugagcaccagacuggccaccgacgccgcccaggugcagggcgccaccggcaccagacuggcccugaucgcccagaacaucgccaaccugggcaccggcaucaucaucagcuucaucuacggcuggcagcugacccugcugcugcuggccguggugcccaucaucgccgugagcggcaucguggagaugaagcugcuggccggcaacgccaagagagacaagaaggagcuggaggccgccggcaagaucgccaccgaggccaucgagaacaucagaaccguggugagccugacccaggagagaaaguucgagagcauguacguggagaagcuguacggccccuacagaaacagcgugcagaaggcccacaucuacggcaucaccuucagcaucagccaggccuucauguacuucagcuacgccggcugcuucagauucggcgccuaccugaucgugaacggccacaugagauucagagacgugauccugguguucagcgccaucguguucggcgccguggcccugggccacgccagcagcuucgcccccgacuacgccaaggccaagcugagcgccgcccaccuguucaugcuguucgagagacagccccugaucgacagcuacagcgaggagggccugaagcccgacaaguucgagggcaacaucaccuucaacgaggugguguucaacuaccccaccagagccaacgugcccgugcugcagggccugagccuggaggugaagaagggccagacccuggcccuggugggcagcagcggcugcggcaagagcaccguggugcagcugcuggagagauucuacgacccccuggccggcaccgugcugcuggacggccaggaggccaagaagcugaacgugcaguggcugagagcccagcugggcaucgugagccaggagcccauccuguucgacugcagcaucgccgagaacaucgccuacggcgacaacagcagaguggugagccaggacgagaucgugagcgccgccaaggccgccaacauccaccccuucaucgagacccugccccacaaguacgagaccagagugggcgacaagggcacccagcugagcggcggccagaagcagagaaucgccaucgccagagcccugaucagacagccccagauccugcugcuggacgaggccaccagcgcccuggacaccgagagcgagaagguggugcaggaggcccuggacaaggccagagagggcagaaccugcaucgugaucgcccacagacugagcaccauccagaacgccgaccugaucgugguguuccagaacggcagagugaaggagcacggcacccaccagcagcugcuggcccagaagggcaucuacuucagcauggugagcgugcaggccggcacccagaaccuguaa

SEQ ID NO: 13102 - RNA, 3774 nt, Artificial Sequence
  ABCB5__Homo_sapiens__NP_001157413
auggagaacagcgagagagccgaggagaugcaggagaacuaccagagaaacggcaccgccgaggagcagcccaagcugagaaaggaggccgugggcagcaucgagaucuucagauucgccgacggccuggacaucacccugaugauccugggcauccuggccagccuggugaacggcgccugccugccccugaugccccuggugcugggcgagaugagcgacaaccugaucagcggcugccuggugcagaccaacaccaccaacuaccagaacugcacccagagccaggagaagcugaacgaggacaugacccugcugacccuguacuacgugggcaucggcguggccgcccugaucuucggcuacauccagaucagccuguggaucaucaccgccgccagacagaccaagagaaucagaaagcaguucuuccacagcgugcuggcccaggacaucggcugguucgacagcugcgacaucggcgagcugaacaccagaaugaccgacgacaucgacaagaucagcgacggcaucggcgacaagaucgcccugcuguuccagaacaugagcaccuucagcaucggccuggccgugggccuggugaagggcuggaagcugacccuggugacccugagcaccagcccccugaucauggccagcgccgccgccugcagcagaauggugaucagccugaccagcaaggagcugagcgccuacagcaaggccggcgccguggccgaggaggugcugagcagcaucagaaccgugaucgccuucagagcccaggagaaggagcugcagagauacacccagaaccugaaggacgccaaggacuucggcaucaagagaaccaucgccagcaaggugagccugggcgccguguacuucuucaugaacggcaccuacggccuggccuucugguacggcaccagccugauccugaacggcgagcccggcuacaccaucggcaccgugcuggccguguucuucagcgugauccacagcagcuacugcaucggcgccgccgugccccacuucgagaccuucgccaucgccagaggcgccgccuuccacaucuuccaggugaucgacaagaagcccagcaucgacaacuucagcaccgccggcuacaagcccgagagcaucgagggcaccguggaguucaagaacgugagcuucaacuaccccagcagacccagcaucaagauccugaagggccugaaccugagaaucaagagcggcgagaccguggcccuggugggccugaacggcagcggcaagagcaccguggugcagcugcugcagagacuguacgaccccgacgacggcuucaucaugguggacgagaacgacaucagagcccugaacgugagacacuacagagaccacaucggcguggugagccaggagcccgugcuguucggcaccaccaucagcaacaacaucaaguacggcagagacgacgugaccgacgaggagauggagagagccgccagagaggccaacgccuacgacuucaucauggaguuccccaacaaguucaacacccuggugggcgagaagggcgcccagaugagcggcggccagaagcagagaaucgccaucgccagagcccuggugagaaaccccaagauccugauccuggacgaggccaccagcgcccuggacagcgagagcaagagcgccgugcaggccgcccuggagaaggccagcaagggcagaaccaccaucgugguggcccacagacugagcaccaucagaagcgccgaccugaucgugacccugaaggacggcaugcuggccgagaagggcgcccacgccgagcugauggccaagagaggccuguacuacagccuggugaugagccaggacaucaagaaggccgacgagcagauggagagcaugaccuacagcaccgagagaaagaccaacagccugccccugcacagcgugaagagcaucaagagcgacuucaucgacaaggccgaggagagcacccagagcaaggagaucagccugcccgaggugagccugcugaagauccugaagcugaacaagcccgaguggcccuucguggugcugggcacccuggccagcgugcugaacggcaccgugcaccccguguucagcaucaucuucgccaagaucaucaccauguucggcaacaacgacaagaccacccugaagcacgacgccgagaucuacagcaugaucuucgugauccugggcgugaucugcuucgugagcuacuucaugcagggccuguucuacggcagagccggcgagauccugaccaugagacugagacaccuggccuucaaggccaugcuguaccaggacaucgccugguucgacgagaaggagaacagcaccggcggccugaccaccauccuggccaucgacaucgcccagauccagggcgccaccggcagcagaaucggcgugcugacccagaacgccaccaacaugggccugagcgugaucaucagcuucaucuacggcugggagaugaccuuccugauccugagcaucgcccccgugcuggccgugaccggcaugaucgagaccgccgccaugaccggcuucgccaacaaggacaagcaggagcugaagcacgccggcaagaucgccaccgaggcccuggagaacaucagaaccaucgugagccugaccagagagaaggccuucgagcagauguacgaggagaugcugcagacccagcacagaaacaccagcaagaaggcccagaucaucggcagcugcuacgccuucagccacgccuucaucuacuucgccuacgccgccggcuucagauucggcgccuaccugauccaggccggcagaaugacccccgagggcauguucaucguguucaccgccaucgccuacggcgccauggccaucggcgagacccuggugcuggcccccgaguacagcaaggccaagagcggcgccgcccaccuguucgcccugcuggagaagaagcccaacaucgacagcagaagccaggagggcaagaagcccgacaccugcgagggcaaccuggaguucagagaggugagcuucuucuaccccugcagacccgacguguucauccugagaggccugagccugagcaucgagagaggcaagaccguggccuucgugggcagcagcggcugcggcaagagcaccagcgugcagcugcugcagagacuguacgaccccgugcagggccaggugcuguucgacggcguggacgccaaggagcugaacgugcaguggcugagaagccagaucgccaucgugccccaggagcccgugcuguucaacugcagcaucgccgagaacaucgccuacggcgacaacagcagaguggugccccuggacgagaucaaggaggccgccaacgccgccaacauccacagcuucaucgagggccugcccgagaaguacaacacccaggugggccugaagggcgcccagcugagcggcggccagaagcagagacuggccaucgccagagcccugcugcagaagcccaagauccugcugcuggacgaggccaccagcgcccuggacaacgacagcgagaagguggugcagcacgcccuggacaaggccagaaccggcagaaccugccugguggugacccacagacugagcgccauccagaacgccgaccugaucguggugcugcacaacggcaagaucaaggagcagggcacccaccaggagcugcugagaaacagagacaucuacuucaagcuggugaacgcccagagcgugcaguaa

SEQ ID NO: 13103 - RNA, 2529 nt, Artificial Sequence
  ABCB6__Homo_sapiens__NP_005680
auggugaccgugggcaacuacugcgaggccgagggccccgugggccccgccuggaugcaggacggccugagccccugcuucuucuucacccuggugcccagcaccagaauggcccugggcacccuggcccuggugcuggcccugcccugcagaagaagagagagacccgccggcgccgacagccugagcuggggcgccggccccagaaucagccccuacgugcugcagcugcugcuggccacccugcaggccgcccugccccuggccggccuggccggcagagugggcaccgccagaggcgccccccugcccagcuaccugcugcuggccagcgugcuggagagccuggccggcgccugcggccuguggcugcuggugguggagagaagccaggccagacagagacuggccaugggcaucuggaucaaguucagacacagccccggccugcugcugcuguggaccguggccuucgccgccgagaaccuggcccuggugagcuggaacagcccccagugguggugggccagagccgaccugggccagcaggugcaguucagccugugggugcugagauacguggugagcggcggccuguucgugcugggccugugggcccccggccugagaccccagagcuacacccugcaggugcacgaggaggaccaggacguggagagaagccaggugagaagcgccgcccagcagagcaccuggagagacuucggcagaaagcugagacugcugagcggcuaccuguggcccagaggcagccccgcccugcagcugguggugcugaucugccugggccugaugggccuggagagagcccugaacgugcuggugcccaucuucuacagaaacaucgugaaccugcugaccgagaaggcccccuggaacagccuggccuggaccgugaccagcuacguguuccugaaguuccugcagggcggcggcaccggcagcaccggcuucgugagcaaccugagaaccuuccuguggaucagagugcagcaguucaccagcagaagaguggagcugcugaucuucagccaccugcacgagcugagccugagauggcaccugggcagaagaaccggcgaggugcugagaaucgccgacagaggcaccagcagcgugaccggccugcugagcuaccugguguucaacgugauccccacccuggccgacaucaucaucggcaucaucuacuucagcauguucuucaacgccugguucggccugaucguguuccugugcaugagccuguaccugacccugaccaucguggugaccgaguggagaaccaaguucagaagagccaugaacacccaggagaacgccaccagagccagagccguggacagccugcugaacuucgagaccgugaaguacuacaacgccgagagcuacgagguggagagauacagagaggccaucaucaaguaccagggccuggaguggaagagcagcgccagccuggugcugcugaaccagacccagaaccuggugaucggccugggccugcuggccggcagccugcugugcgccuacuucgugaccgagcagaagcugcaggugggcgacuacgugcuguucggcaccuacaucauccagcuguacaugccccugaacugguucggcaccuacuacagaaugauccagaccaacuucaucgacauggagaacauguucgaccugcugaaggaggagaccgaggugaaggaccugcccggcgccggcccccugagauuccagaagggcagaaucgaguucgagaacgugcacuucagcuacgccgacggcagagagacccugcaggacgugagcuucaccgugaugcccggccagacccuggcccuggugggccccagcggcgccggcaagagcaccauccugagacugcuguucagauucuacgacaucagcagcggcugcaucagaaucgacggccaggacaucagccaggugacccaggccagccugagaagccacaucggcguggugccccaggacaccgugcuguucaacgacaccaucgccgacaacaucagauacggcagagugaccgccggcaacgacgagguggaggccgccgcccaggccgccggcauccacgacgccaucauggccuuccccgagggcuacagaacccaggugggcgagagaggccugaagcugagcggcggcgagaagcagagaguggccaucgccagaaccauccugaaggcccccggcaucauccugcuggacgaggccaccagcgcccuggacaccagcaacgagagagccauccaggccagccuggccaaggugugcgccaacagaaccaccaucgugguggcccacagacugagcaccguggugaacgccgaccagauccuggugaucaaggacggcugcaucguggagagaggcagacacgaggcccugcugagcagaggcggcguguacgccgacauguggcagcugcagcagggccaggaggagaccagcgaggacaccaagccccagaccauggagagauaa

SEQ ID NO: 13104 - RNA, 2259 nt, Artificial Sequence
  ABCB7__Homo_sapiens__NP_001258625
auggcccugcuggccaugcacagcuggagaugggccgccgccgccgccgccuucgagaagagaagacacagcgccauccugaucagaccccuggugagcgugagcggcagcggcccccaguggagaccccaccagcugggcgcccugggcaccgccagagccuaccagauccccgagagccugaagagcaucaccuggcagagacugggcaagggcaacagcggccaguuccuggacgccgccaaggcccugcagguguggccccugaucgagaagagaaccugcuggcacggccacgccggcggcggccugcacaccgaccccaaggagggccugaaggacguggacaccagaaagaucaucaaggccaugcugagcuacguguggcccaaggacagacccgaccugagagccagaguggccaucagccugggcuuccugggcggcgccaaggccaugaacaucguggugcccuucauguucaaguacgccguggacagccugaaccagaugagcggcaacaugcugaaccugagcgacgcccccaacaccguggccaccauggccaccgccgugcugaucggcuacggcgugagcagagccggcgccgccuucuucaacgaggugagaaacgccguguucggcaagguggcccagaacagcaucagaagaaucgccaagaacguguuccugcaccugcacaaccuggaccugggcuuccaccugagcagacagaccggcgcccugagcaaggccaucgacagaggcaccagaggcaucagcuucgugcugagcgcccugguguucaaccugcugcccaucauguucgaggugaugcuggugagcggcgugcuguacuacaagugcggcgcccaguucgcccuggugacccugggcacccugggcaccuacaccgccuucaccguggccgugaccagauggagaaccagauucagaaucgagaugaacaaggccgacaacgacgccggcaacgccgccaucgacagccugcugaacuacgagaccgugaaguacuucaacaacgagagauacgaggcccagagauacgacggcuuccugaagaccuacgagaccgccagccugaagagcaccagcacccuggccaugcugaacuucggccagagcgccaucuucagcgugggccugaccgccaucauggugcuggccagccagggcaucguggccggcacccugaccgugggcgaccuggugauggugaacggccugcuguuccagcugagccugccccugaacuuccugggcaccguguacagagagaccagacaggcccugaucgacaugaacacccuguucacccugcugaagguggacacccagaucaaggacaaggugauggccagcccccugcagaucaccccccagaccgccaccguggccuucgacaacgugcacuucgaguacaucgagggccagaaggugcugagcggcaucagcuucgaggugcccgccggcaagaagguggccaucgugggcggcagcggcagcggcaagagcaccaucgugagacugcuguucagauucuacgagccccagaagggcagcaucuaccuggccggccagaacauccaggacgugagccuggagagccugagaagagccgugggcguggugccccaggacgccgugcuguuccacaacaccaucuacuacaaccugcuguacggcaacaucagcgccagccccgaggagguguacgccguggccaagcuggccggccugcacgacgccauccugagaaugccccacggcuacgacacccaggugggcgagagaggccugaagcugagcggcggcgagaagcagagaguggccaucgccagagccauccugaaggacccccccgugauccuguacgacgaggccaccagcagccuggacagcaucaccgaggagaccauccugggcgccaugaaggacguggugaagcacagaaccagcaucuucaucgcccacagacugagcaccgugguggacgccgacgagaucaucgugcuggaccagggcaagguggccgagagaggcacccaccacggccugcuggccaacccccacagcaucuacagcgagauguggcacacccagagcagcagagugcagaaccacgacaaccccaagugggaggccaagaaggagaacaucagcaaggaggaggagagaaagaagcugcaggaggagaucgugaacagcgugaagggcugcggcaacugcagcugcuaa

SEQ ID NO: 13105 - RNA, 2208 nt, Artificial Sequence
  ABCB8__Homo_sapiens__NP_001269220
augcuggugcaccuguucagagugggcaucagaggcggccccuuccccggcagacugcugcccccccugagauuccagaccuucagcgccgugagaaacaccuggagaaacggcaagaccggccagcugcacaaggccgagggcgaguacagcgacggcuacagaagcagcagccugcugagagccguggcccaccugagaagccagcugugggcccaccugcccagagccccccuggcccccagauggagccccagcgccuggugcugggugggcggcgcccugcugggccccauggugcugagcaagcacccccaccugugccugguggcccugugcgaggccgaggaggccccccccgccagcagcaccccccacguggugggcagcagauucaacuggaagcuguucuggcaguuccugcacccccaccugcuggugcugggcguggccguggugcuggcccugggcgccgcccuggugaacgugcagaucccccugcugcugggccagcugguggaggugguggccaaguacaccagagaccacgugggcagcuucaugaccgagagccagaaccugagcacccaccugcugauccuguacggcgugcagggccugcugaccuucggcuaccuggugcugcugagccacgugggcgagagaauggccguggacaugagaagagcccuguucagcagccugcugagacaggacaucaccuucuucgacgccaacaagaccggccagcuggugagcagacugaccaccgacgugcaggaguucaagagcagcuucaagcuggugaucagccagggccugagaagcugcacccagguggccggcugccuggugagccugagcaugcugagcaccagacugacccugcugcugaugguggccacccccgcccugaugggcgugggcacccugaugggcagcggccugagaaagcugagcagacagugccaggagcagaucgccagagccaugggcguggccgacgaggcccugggcaacgugagaaccgugagagccuucgccauggagcagagagaggaggagagauacggcgccgagcuggaggccugcagaugcagagccgaggagcugggcagaggcaucgcccuguuccagggccugagcaacaucgccuucaacugcauggugcugggcacccuguucaucggcggcagccugguggccggccagcagcugaccggcggcgaccugaugagcuuccugguggccagccagaccgugcagagaagcauggccaaccugagcgugcuguucggccagguggugagaggccugagcgccggcgccagaguguucgaguacauggcccugaaccccugcaucccccugagcggcggcugcugcgugcccaaggagcagcugagaggcagcgugaccuuccagaacgugugcuucagcuaccccugcagacccggcuucgaggugcugaaggacuucacccugacccugccccccggcaagaucguggcccuggugggccagagcggcggcggcaagaccaccguggccagccugcuggagagauucuacgaccccaccgccggcguggugaugcuggacggcagagaccugagaacccuggaccccagcuggcugagaggccagguggugggcuucaucagccaggagcccgugcuguucggcaccaccaucauggagaacaucagauucggcaagcuggaggccagcgacgaggagguguacaccgccgccagagaggccaacgcccacgaguucaucaccagcuuccccgagggcuacaacaccguggugggcgagagaggcaccacccugagcggcggccagaagcagagacuggccaucgccagagcccugaucaagcagcccaccgugcugauccuggacgaggccaccagcgcccuggacgccgagagcgagagaguggugcaggaggcccuggacagagccagcgccggcagaaccgugcuggugaucgcccacagacugagcaccgugagaggcgcccacugcaucguggugauggccgacggcagagugugggaggccggcacccacgaggagcugcugaagaagggcggccuguacgccgagcugaucagaagacaggcccuggacgcccccagaaccgccgcccccccccccaagaagcccgagggccccagaagccaccagcacaagagcuaa

SEQ ID NO: 13106 - RNA, 2112 nt, Artificial Sequence
  ABCB9__Homo_sapiens__NP_001229942
augagacuguggaaggccgugguggugacccuggccuucaugagcguggacaucugcgugaccaccgccaucuacguguucagccaccuggacagaagccugcuggaggacaucagacacuucaacaucuucgacagcgugcuggaccugugggccgccugccuguacagaagcugccugcugcugggcgccaccaucggcguggccaagaacagcgcccugggccccagaagacugagagccagcuggcuggugaucacccuggugugccuguucgugggcaucuacgccauggugaagcugcugcuguucagcgaggugagaagacccaucagagaccccugguucugggcccuguucguguggaccuacaucagccugggcgccagcuuccugcugugguggcugcugagcaccgugagacccggcacccaggcccuggagcccggcgccgccaccgaggccgagggcuuccccggcagcggcagacccccccccgagcaggccagcggcgccacccugcagaagcugcugagcuacaccaagcccgacguggccuuccugguggccgccagcuucuuccugaucguggccgcccugggcgagaccuuccugcccuacuacaccggcagagccaucgacggcaucgugauccagaagagcauggaccaguucagcaccgccguggugaucgugugccugcuggccaucggcagcagcuucgccgccggcaucagaggcggcaucuucacccugaucuucgccagacugaacaucagacugagaaacugccuguucagaagccuggugagccaggagaccagcuucuucgacgagaacagaaccggcgaccugaucagcagacugaccagcgacaccaccauggugagcgaccuggugagccagaacaucaacguguuccugagaaacaccgugaaggugaccggcguggugguguucauguucagccugagcuggcagcugagccuggugaccuucaugggcuuccccaucaucaugauggugagcaacaucuacggcaaguacuacaagagacugagcaaggaggugcagaacgcccuggccagagccagcaacaccgccgaggagaccaucagcgccaugaagaccgugagaagcuucgccaacgaggaggaggaggccgagguguaccugagaaagcugcagcagguguacaagcugaacagaaaggaggccgccgccuacauguacuacguguggggcagcggccugacccugcugguggugcaggugagcauccuguacuacggcggccaccuggugaucagcggccagaugaccagcggcaaccugaucgccuucaucaucuacgaguucgugcugggcgacugcauggagaacgugagcuucagccugagccccggcaaggugaccgcccuggugggccccagcggcagcggcaagagcagcugcgugaacauccuggagaacuucuacccccuggagggcggcagagugcugcuggacggcaagcccaucagcgccuacgaccacaaguaccugcacagagugaucagccuggugagccaggagcccgugcuguucgccagaagcaucaccgacaacaucagcuacggccugcccaccgugcccuucgagauggugguggaggccgcccagaaggccaacgcccacggcuucaucauggagcugcaggacggcuacagcaccgagaccggcgagaagggcgcccagcugagcggcggccagaagcagagaguggccauggccagagcccuggugagaaacccccccgugcugauccuggacgaggccaccagcgcccuggacgccgagagcgaguaccugauccagcaggccauccacggcaaccugcagaagcacaccgugcugaucaucgcccacagacugagcaccguggagcacgcccaccugaucguggugcuggacaagggcagaguggugcagcagggcacccaccagcagcugcuggcccagggcggccuguacgccaagcuggugcagagacagaugcugggccugcagcccgccgccgacuucaccgccggccacaacgagcccguggccaacggcagccacaaggccuaa

SEQ ID NO: 13107 - RNA, 4479 nt, Artificial Sequence
  ABCC10__Homo_sapiens__NP_001185863
auggagagacugcuggcccagcugugcggcagcagcgccgccuggccccugccccugugggagggcgacaccaccggccacugcuucacccagcuggugcugagcgcccugccccacgcccugcuggccgugcugagcgccugcuaccugggcacccccagaagccccgacuacauccugcccugcagccccggcuggagacugagacuggccgccagcuuccugcugagcguguucccccugcuggaccugcugcccguggcccugccccccggcgccggccccggccccaucggccuggaggugcuggccggcugcguggccgccguggccuggaucagccacagccuggcccugugggugcuggcccacagcccccacggccacagcagaggcccccuggcccuggcccugguggcccugcugcccgcccccgcccuggugcugaccgugcuguggcacugccagagaggcacccugcugcccccccugcugcccggccccauggccagacugugccugcugauccugcagcuggccgcccugcuggccuacgcccugggcugggccgcccccggcggccccagagagcccugggcccaggagccccugcugcccgaggaccaggagcccgagguggccgaggacggcgagagcuggcugagcagauucagcuacgccuggcuggccccccugcuggccagaggcgccugcggcgagcugagacagccccaggacaucugcagacugccccacagacugcagcccaccuaccuggccagaguguuccaggcccacuggcaggagggcgccagacuguggagagcccuguacggcgccuucggcagaugcuaccuggcccugggccugcugaagcuggugggcaccaugcugggcuucagcggcccccugcugcugagccugcuggugggcuuccuggaggagggccaggagccccugagccacggccugcuguacgcccugggccuggccggcggcgccgugcugggcgccgugcugcagaaccaguacggcuacgagguguacaaggugacccugcaggccagaggcgccgugcugaacauccuguacugcaaggcccugcagcugggccccagcagaccccccaccggcgaggcccugaaccugcugggcaccgacagcgagagacugcugaacuucgccggcagcuuccacgaggccuggggccugccccugcagcuggccaucacccuguaccugcuguaccagcaggugggcguggccuucgugggcggccugauccuggcccugcugcuggugcccgugaacaaggugaucgccaccagaaucauggccagcaaccaggagaugcugcagcacaaggacgccagagugaagcuggugaccgagcugcugagcggcaucagagugaucaaguucugcggcugggagcaggcccugggcgccagaguggaggccugcagagccagagagcugggcagacugagagugaucaaguaccuggacgccgccugcguguaccugugggccgcccugcccguggugaucagcaucgugaucuucaucaccuacgugcugaugggccaccagcugaccgccaccaagguguucaccgcccuggcccuggugagaaugcugauccugccccugaacaacuuccccugggugaucaacggccugcuggaggccaaggugagccuggacagaauccagcuguuccuggaccugcccaaccacaacccccaggccuacuacagccccgacccccccgccgagcccagcaccgugcuggagcugcacggcgcccuguucagcugggaccccgugggcaccagccuggagaccuucaucagccaccuggaggugaagaagggcaugcuggugggcaucgugggcaaggugggcugcggcaagagcagccugcuggccgccaucgccggcgagcugcacagacugagaggccacguggccgugagaggccugagcaagggcuucggccuggccacccaggagcccuggauccaguucgccaccaucagagacaacauccuguucggcaagaccuucgacgcccagcuguacaaggaggugcuggaggccugcgcccugaacgacgaccugagcauccugcccgccggcgaccagaccgaggugggcgagaagggcgugacccugagcggcggccagagagccagaaucgcccuggccagagccguguaccaggagaaggagcuguaccugcuggacgacccccuggccgccguggacgccgacguggccaaccaccugcugcacagaugcauccugggcaugcugagcuacaccaccagacugcugugcacccacagaaccgaguaccuggagagagccgacgccgugcugcugauggaggccggcagacugaucagagccggcccccccagcgagauccugccccuggugcaggccgugcccaaggccugggccgagaacggccaggagagcgacagcgccaccgcccagagcgugcagaaccccgagaagaccaaggagggccuggaggaggagcagagcaccagcggcagacugcugcaggaggagagcaagaaggagggcgccguggcccugcacguguaccaggccuacuggaaggccgugggccagggccuggcccuggccauccuguucagccugcugcugaugcaggccaccagaaacgccgccgacugguggcugagccacuggaucagccagcugaaggccgagaacagcagccaggaggcccagcccagcaccagccccgccagcaugggccuguucagcccccagcugcugcuguucagccccggcaaccuguacauccccguguucccccugcccaaggccgcccccaacggcagcagcgacaucagauucuaccugaccguguacgccaccaucgccggcgugaacagccugugcacccugcugagagccgugcuguucgccgccggcacccugcaggccgccgccacccugcacagaagacugcugcacagagugcugauggcccccgugaccuucuucaacgccacccccaccggcagaauccugaacagauucagcagcgacguggccugcgccgacgacagccugcccuucauccugaacauccugcuggccaacgccgccggccugcugggccugcuggccgugcugggcagcggccugcccuggcugcugcugcugcugcccccccugagcaucauguacuaccacgugcagagacacuacagagccagcagcagagagcugagaagacugggcagccugacccugagcccccuguacagccaccuggccgacacccuggccggccugagcgugcugagagccaccggcgccaccuacagauucgaggaggagaaccugagacugcuggagcugaaccagagaugccaguucgccaccagcgccaccaugcaguggcuggacaucagacugcagcugaugggcgccgccguggugagcgccaucgccggcaucgcccuggugcagcaccagcagggccuggccaaccccggccuggugggccugagccugagcuacgcccugagccugaccggccugcugagcggccuggugagcagcuucacccagaccgaggccaugcuggugagcguggagagacuggaggaguacaccugcgaccugccccaggagccccagggccagccccugcagcugggcaccggcuggcugacccagggcggcguggaguuccaggacguggugcuggccuacagacccggccugcccaacgcccuggacggcgugaccuucugcgugcagcccggcgagaagcugggcaucgugggcagaaccggcagcggcaagagcagccugcugcuggugcuguucagacugcuggagcccagcagcggcagagugcugcuggacggcguggacaccagccagcuggagcuggcccagcugagaagccagcuggccaucaucccccaggagcccuuccuguucagcggcaccgugagagagaaccuggacccccagggccugcacaaggacagagcccuguggcaggcccugaagcagugccaccugagcgaggugaucaccagcaugggcggccuggacggcgagcugggcgagggcggcagaagccugagccugggccagagacagcugcugugccuggccagagcccugcugaccgacgccaagauccugugcaucgacgaggccaccgccagcguggaccagaagaccgaccagcugcugcagcagaccaucugcaagagauucgccaacaagaccgugcugaccaucgcccacagacugaacaccauccugaacagcgacagagugcuggugcugcaggccggcagagugguggagcuggacagccccgccacccugagaaaccagccccacagccuguuccagcagcugcugcagagcagccagcagggcgugcccgccagccugggcggccccuaa

SEQ ID NO: 13108 - RNA, 4149 nt, Artificial Sequence
  ABCC11__Homo_sapiens__NP_115972
augaccagaaagagaaccuacugggugcccaacagcagcggcggccuggugaacagaggcaucgacaucggcgacgacauggugagcggccugaucuacaagaccuacacccugcaggacggccccuggagccagcaggagagaaaccccgaggcccccggcagagccgccgugccccccuggggcaaguacgacgccgcccugagaaccaugauccccuucagacccaagcccagauuccccgccccccagccccuggacaacgccggccuguucagcuaccugaccgugagcuggcugaccccccugaugauccagagccugagaagcagacuggacgagaacaccauccccccccugagcgugcacgacgccagcgacaagaacgugcagagacugcacagacugugggaggaggaggugagcagaagaggcaucgagaaggccagcgugcugcuggugaugcugagauuccagagaaccagacugaucuucgacgcccugcugggcaucugcuucugcaucgccagcgugcugggccccauccugaucauccccaagauccuggaguacagcgaggagcagcugggcaacguggugcacggcgugggccugugcuucgcccuguuccugagcgagugcgugaagagccugagcuucagcagcagcuggaucaucaaccagagaaccgccaucagauucagagccgccgugagcagcuucgccuucgagaagcugauccaguucaagagcgugauccacaucaccagcggcgaggccaucagcuucuucaccggcgacgugaacuaccuguucgagggcgugugcuacggcccccuggugcugaucaccugcgccagccuggugaucugcagcaucagcagcuacuucaucaucggcuacaccgccuucaucgccauccugugcuaccugcugguguucccccuggccguguucaugaccagaauggccgugaaggcccagcaccacaccagcgaggugagcgaccagagaaucagagugaccagcgaggugcugaccugcaucaagcugaucaagauguacaccugggagaagcccuucgccaagaucaucgaggaccugagaagaaaggagagaaagcugcuggagaagugcggccuggugcagagccugaccagcaucacccuguucaucauccccaccguggccaccgccgugugggugcugauccacaccagccugaagcugaagcugaccgccagcauggccuucagcaugcuggccagccugaaccugcugagacugagcguguucuucgugcccaucgccgugaagggccugaccaacagcaagagcgccgugaugagauucaagaaguucuuccugcaggagagccccguguucuacgugcagacccugcaggaccccagcaaggcccugguguucgaggaggccacccugagcuggcagcagaccugccccggcaucgugaacggcgcccuggagcuggagagaaacggccacgccagcgagggcaugaccagacccagagacgcccugggccccgaggaggagggcaacagccugggccccgagcugcacaagaucaaccugguggugagcaagggcaugaugcugggcgugugcggcaacaccggcagcggcaagagcagccugcugagcgccauccuggaggagaugcaccugcuggagggcagcgugggcgugcagggcagccuggccuacgugccccagcaggccuggaucgugagcggcaacaucagagagaacauccugaugggcggcgccuacgacaaggccagauaccugcaggugcugcacugcugcagccugaacagagaccuggagcugcugcccuucggcgacaugaccgagaucggcgagagaggccugaaccugagcggcggccagaagcagagaaucagccuggccagagccguguacagcgacagacagaucuaccugcuggacgacccccugagcgccguggacgcccacgugggcaagcacaucuucgaggagugcaucaagaagacccugagaggcaagaccguggugcuggugacccaccagcugcaguaccuggaguucugcggccagaucauccugcuggagaacggcaagaucugcgagaacggcacccacagcgagcugaugcagaagaagggcaaguacgcccagcugauccagaagaugcacaaggaggccaccagcgacaugcugcaggacaccgccaagaucgccgagaagcccaagguggagagccaggcccuggccaccagccuggaggagagccugaacggcaacgccgugcccgagcaccagcugacccaggaggaggagauggaggagggcagccugagcuggagaguguaccaccacuacauccaggccgccggcggcuacauggugagcugcaucaucuucuucuucguggugcugaucguguuccugaccaucuucagcuucugguggcugagcuacuggcuggagcagggcagcggcaccaacagcagcagagagagcaacggcaccauggccgaccugggcaacaucgccgacaacccccagcugagcuucuaccagcugguguacggccugaacgcccugcugcugaucugcgugggcgugugcagcagcggcaucuucaccaaggugaccagaaaggccagcaccgcccugcacaacaagcuguucaacaagguguucagaugccccaugagcuucuucgacaccauccccaucggcagacugcugaacugcuucgccggcgaccuggagcagcuggaccagcugcugcccaucuucagcgagcaguuccuggugcugagccugauggugaucgccgugcugcugaucgugagcgugcugagccccuacauccugcugaugggcgccaucaucauggugaucugcuucaucuacuacaugauguucaagaaggccaucggcguguucaagagacuggagaacuacagcagaagcccccuguucagccacauccugaacagccugcagggccugagcagcauccacguguacggcaagaccgaggacuucaucagccaguucaagagacugaccgacgcccagaacaacuaccugcugcuguuccugagcagcaccagauggauggcccugagacuggagaucaugaccaaccuggugacccuggccguggcccuguucguggccuucggcaucagcagcacccccuacagcuucaaggugauggccgugaacaucgugcugcagcuggccagcagcuuccaggccaccgccagaaucggccuggagaccgaggcccaguucaccgccguggagagaauccugcaguacaugaagaugugcgugagcgaggccccccugcacauggagggcaccagcugcccccagggcuggccccagcacggcgagaucaucuuccaggacuaccacaugaaguacagagacaacacccccaccgugcugcacggcaucaaccugaccaucagaggccacgagguggugggcaucgugggcagaaccggcagcggcaagagcagccugggcauggcccuguucagacugguggagcccauggccggcagaauccugaucgacggcguggacaucugcagcaucggccuggaggaccugagaagcaagcugagcgugaucccccaggaccccgugcugcugagcggcaccaucagauucaaccuggaccccuucgacagacacaccgaccagcagaucugggacgcccuggagagaaccuuccugaccaaggccaucagcaaguuccccaagaagcugcacaccgacgugguggagaacggcggcaacuucagcgugggcgagagacagcugcugugcaucgccagagccgugcugagaaacagcaagaucauccugaucgacgaggccaccgccagcaucgacauggagaccgacacccugauccagagaaccaucagagaggccuuccagggcugcaccgugcuggugaucgcccacagagugaccaccgugcugaacugcgaccacauccuggugaugggcaacggcaaggugguggaguucgacagacccgaggugcugagaaagaagcccggcagccuguucgccgcccugauggccaccgccaccagcagccugagauaa

SEQ ID NO: 13109 - RNA, 4080 nt, Artificial Sequence
  ABCC12__Homo_sapiens__NP_150229
auggugggcgagggccccuaccugaucagcgaccuggaccagagaggcagaagaagaagcuucgccgagagauacgaccccagccugaagaccaugauccccgugagacccugcgccagacuggcccccaaccccguggacgacgccggccugcugagcuucgccaccuucagcuggcugacccccgugauggugaagggcuacagacagagacugaccguggacacccugcccccccugagcaccuacgacagcagcgacaccaacgccaagagauucagagugcugugggacgaggagguggccagagugggccccgagaaggccagccugagccacgugguguggaaguuccagagaaccagagugcugauggacaucguggccaacauccugugcaucaucauggccgccaucggccccgugauccugauccaccagauccugcagcagaccgagagaaccagcggcaaggugugggugggcaucggccugugcaucgcccuguucgccaccgaguucaccaagguguucuucugggcccuggccugggccaucaacuacagaaccgccaucagacugaagguggcccugagcacccugguguucgagaaccuggugagcuucaagacccugacccacaucagcgugggcgaggugcugaacauccugagcagcgacagcuacagccuguucgaggccgcccuguucugcccccugcccgccaccauccccauccugaugguguucugcgccgccuacgccuucuucauccugggccccaccgcccugaucggcaucagcguguacgugaucuucauccccgugcagauguucauggccaagcugaacagcgccuucagaagaagcgccauccuggugaccgacaagagagugcagaccaugaacgaguuccugaccugcaucagacugaucaagauguacgccugggagaagagcuucaccaacaccauccaggacaucagaagaagagagagaaagcugcuggagaaggccggcuucgugcagagcggcaacagcgcccuggcccccaucgugagcaccaucgccaucgugcugacccugagcugccacauccugcugagaagaaagcugaccgcccccguggccuucagcgugaucgccauguucaacgugaugaaguucagcaucgccauccugcccuucagcaucaaggccauggccgaggccaacgugagccugagaagaaugaagaagauccugaucgacaagagcccccccagcuacaucacccagcccgaggaccccgacaccgugcugcugcuggccaacgccacccugaccugggagcacgaggccagcagaaagagcacccccaagaagcugcagaaccagaagagacaccugugcaagaagcagagaagcgaggccuacagcgagagaagcccccccgccaagggcgccaccggccccgaggagcagagcgacagccugaagagcgugcugcacagcaucagcuucguggugagaaagggcaagauccugggcaucugcggcaacgugggcagcggcaagagcagccugcuggccgcccugcugggccagaugcagcugcagaagggcgugguggccgugaacggcacccuggccuacgugagccagcaggccuggaucuuccacggcaacgugagagagaacauccuguucggcgagaaguacgaccaccagagauaccagcacaccgugagagugugcggccugcagaaggaccugagcaaccugcccuacggcgaccugaccgagaucggcgagagaggccugaaccugagcggcggccagagacagagaaucagccuggccagagccguguacagcgacagacagcuguaccugcuggacgacccccugagcgccguggacgcccacgugggcaagcacguguucgaggagugcaucaagaagacccugagaggcaagaccguggugcuggugacccaccagcugcaguuccuggagagcugcgacgaggugauccugcuggaggacggcgagaucugcgagaagggcacccacaaggagcugauggaggagagaggcagauacgccaagcugauccacaaccugagaggccugcaguucaaggaccccgagcaccuguacaacgccgccaugguggaggccuucaaggagagccccgccgagagagaggaggacgccggcaucaucgugcuggcccccggcaacgagaaggacgagggcaaggagagcgagaccggcagcgaguucguggacaccaaggugcccgagcaccagcugauccagaccgagagcccccaggagggcaccgugaccuggaagaccuaccacaccuacaucaaggccagcggcggcuaccugcugagccuguucaccguguuccuguuccugcugaugaucggcagcgccgccuucagcaacugguggcugggccuguggcuggacaagggcagcagaaugaccugcggcccccagggcaacagaaccaugugcgaggugggcgccgugcuggccgacaucggccagcacguguaccaguggguguacaccgccagcaugguguucaugcugguguucggcgugaccaagggcuucguguucaccaagaccacccugauggccagcagcagccugcacgacaccguguucgacaagauccugaagagccccaugagcuucuucgacaccacccccaccggcagacugaugaacagauucagcaaggacauggacgagcuggacgugagacugcccuuccacgccgagaacuuccugcagcaguucuucauggugguguucauccuggugauccuggccgccguguuccccgccgugcugcuggugguggccagccuggccgugggcuucuucauccugcugagaaucuuccacagaggcgugcaggagcugaagaagguggagaacgugagcagaagccccugguucacccacaucaccagcagcaugcagggccugggcaucauccacgccuacggcaagaaggagagcugcaucaccuaccaccugcuguacuucaacugcgcccugagaugguucgcccugagaauggacgugcugaugaacauccugaccuucaccguggcccugcuggugacccugagcuucagcagcaucagcaccagcagcaagggccugagccugagcuacaucauccagcugagcggccugcugcaggugugcgugagaaccggcaccgagacccaggccaaguucaccagcguggagcugcugagagaguacaucagcaccugcgugcccgagugcacccacccccugaaggugggcaccugccccaaggacuggcccagcagaggcgagaucaccuucagagacuaccagaugagauacagagacaacaccccccuggugcuggacagccugaaccugaacauccagagcggccagaccgugggcaucgugggcagaaccggcagcggcaagagcagccugggcauggcccuguucagacugguggagcccgccagcggcaccaucuucaucgacgagguggacaucugcauccugagccuggaggaccugagaaccaagcugaccgugaucccccaggaccccgugcuguucgugggcaccgugagauacaaccuggaccccuucgagagccacaccgacgagaugcuguggcaggugcuggagagaaccuucaugagagacaccaucaugaagcugcccgagaagcugcaggccgaggugaccgagaacggcgagaacuucagcgugggcgagagacagcugcugugcguggccagagcccugcugagaaacagcaagaucauccugcuggacgaggccaccgccagcauggacagcaagaccgacacccuggugcagaacaccaucaaggacgccuucaagggcugcaccgugcugaccaucgcccacagacugaacaccgugcugaacugcgaccacgugcuggugauggagaacggcaaggugaucgaguucgacaagcccgaggugcuggccgagaagcccgacagcgccuucgccaugcugcuggccgccgaggugagacuguaa

SEQ ID NO: 13110 - RNA, 4596 nt, Artificial Sequence
  ABCC1__Homo_sapiens__NP_004987
auggcccugagaggcuucugcagcgccgacggcagcgacccccugugggacuggaacgugaccuggaacaccagcaaccccgacuucaccaagugcuuccagaacaccgugcuggugugggugcccugcuucuaccugugggccugcuuccccuucuacuuccuguaccugagcagacacgacagaggcuacauccagaugaccccccugaacaagaccaagaccgcccugggcuuccugcuguggaucgugugcugggccgaccuguucuacagcuucugggagagaagcagaggcaucuuccuggcccccguguuccuggugagccccacccugcugggcaucaccaugcugcuggccaccuuccugauccagcuggagagaagaaagggcgugcagagcagcggcaucaugcugaccuucuggcugguggcccuggugugcgcccuggccauccugagaagcaagaucaugaccgcccugaaggaggacgcccagguggaccuguucagagacaucaccuucuacguguacuucagccugcugcugauccagcuggugcugagcugcuucagcgacagaagcccccuguucagcgagaccauccacgaccccaaccccugccccgagagcagcgccagcuuccugagcagaaucaccuucugguggaucaccggccugaucgugagaggcuacagacagccccuggagggcagcgaccuguggagccugaacaaggaggacaccagcgagcagguggugcccgugcuggugaagaacuggaagaaggagugcgccaagaccagaaagcagcccgugaaggugguguacagcagcaaggaccccgcccagcccaaggagagcagcaagguggacgccaacgaggagguggaggcccugaucgugaagagcccccagaaggaguggaaccccagccuguucaaggugcuguacaagaccuucggccccuacuuccugaugagcuucuucuucaaggccauccacgaccugaugauguucagcggcccccagauccugaagcugcugaucaaguucgugaacgacaccaaggcccccgacuggcagggcuacuucuacaccgugcugcuguucgugaccgccugccugcagacccuggugcugcaccaguacuuccacaucugcuucgugagcggcaugagaaucaagaccgccgugaucggcgccguguacagaaaggcccuggugaucaccaacagcgccagaaagagcagcaccgugggcgagaucgugaaccugaugagcguggacgcccagagauucauggaccuggccaccuacaucaacaugaucuggagcgccccccugcaggugauccuggcccuguaccugcuguggcugaaccugggccccagcgugcuggccggcguggccgugauggugcugauggugcccgugaacgccgugauggccaugaagaccaagaccuaccagguggcccacaugaagagcaaggacaacagaaucaagcugaugaacgagauccugaacggcaucaaggugcugaagcuguacgccugggagcuggccuucaaggacaaggugcuggccaucagacaggaggagcugaaggugcugaagaagagcgccuaccugagcgccgugggcaccuucaccugggugugcacccccuuccugguggcccugugcaccuucgccguguacgugaccaucgacgagaacaacauccuggacgcccagaccgccuucgugagccuggcccuguucaacauccugagauucccccugaacauccugcccauggugaucagcagcaucgugcaggccagcgugagccugaagagacugagaaucuuccugagccacgaggagcuggagcccgacagcaucgagagaagacccgugaaggacggcggcggcaccaacagcaucaccgugagaaacgccaccuucaccugggccagaagcgacccccccacccugaacggcaucaccuucagcauccccgagggcgcccugguggccguggugggccaggugggcugcggcaagagcagccugcugagcgcccugcuggccgagauggacaagguggagggccacguggccaucaagggcagcguggccuacgugccccagcaggccuggauccagaacgacagccugagagagaacauccuguucggcugccagcuggaggagcccuacuacagaagcgugauccaggccugcgcccugcugcccgaccuggagauccugcccagcggcgacagaaccgagaucggcgagaagggcgugaaccugagcggcggccagaagcagagagugagccuggccagagccguguacagcaacgccgacaucuaccuguucgacgacccccugagcgccguggacgcccacgugggcaagcacaucuucgagaacgugaucggccccaagggcaugcugaagaacaagaccagaauccuggugacccacagcaugagcuaccugccccagguggacgugaucaucgugaugagcggcggcaagaucagcgagaugggcagcuaccaggagcugcuggccagagacggcgccuucgccgaguuccugagaaccuacgccagcaccgagcaggagcaggacgccgaggagaacggcgugaccggcgugagcggccccggcaaggaggccaagcagauggagaacggcaugcuggugaccgacagcgccggcaagcagcugcagagacagcugagcagcagcagcagcuacagcggcgacaucagcagacaccacaacagcaccgccgagcugcagaaggccgaggccaagaaggaggagaccuggaagcugauggaggccgacaaggcccagaccggccaggugaagcugagcguguacugggacuacaugaaggccaucggccuguucaucagcuuccugagcaucuuccuguucaugugcaaccacgugagcgcccuggccagcaacuacuggcugagccuguggaccgacgaccccaucgugaacggcacccaggagcacaccaaggugagacugagcguguacggcgcccugggcaucagccagggcaucgccguguucggcuacagcauggccgugagcaucggcggcauccuggccagcagaugccugcacguggaccugcugcacagcauccugagaagccccaugagcuucuucgagagaacccccagcggcaaccuggugaacagauucagcaaggagcuggacaccguggacagcaugauccccgaggugaucaagauguucaugggcagccuguucaacgugaucggcgccugcaucgugauccugcuggccacccccaucgccgccaucaucauccccccccugggccugaucuacuucuucgugcagagauucuacguggccagcagcagacagcugaagagacuggagagcgugagcagaagccccguguacagccacuucaacgagacccugcugggcgugagcgugaucagagccuucgaggagcaggagagauucauccaccagagcgaccugaagguggacgagaaccagaaggccuacuaccccagcaucguggccaacagauggcuggccgugagacuggagugcgugggcaacugcaucgugcuguucgccgcccuguucgccgugaucagcagacacagccugagcgccggccuggugggccugagcgugagcuacagccugcaggugaccaccuaccugaacuggcuggugagaaugagcagcgagauggagaccaacaucguggccguggagagacugaaggaguacagcgagaccgagaaggaggcccccuggcagauccaggagaccgccccccccagcagcuggccccaggugggcagaguggaguucagaaacuacugccugagauacagagaggaccuggacuucgugcugagacacaucaacgugaccaucaacggcggcgagaaggugggcaucgugggcagaaccggcgccggcaagagcagccugacccugggccuguucagaaucaacgagagcgccgagggcgagaucaucaucgacggcaucaacaucgccaagaucggccugcacgaccugagauucaagaucaccaucaucccccaggaccccgugcuguucagcggcagccugagaaugaaccuggaccccuucagccaguacagcgacgaggagguguggaccagccuggagcuggcccaccugaaggacuucgugagcgcccugcccgacaagcuggaccacgagugcgccgagggcggcgagaaccugagcgugggccagagacagcuggugugccuggccagagcccugcugagaaagaccaagauccuggugcuggacgaggccaccgccgccguggaccuggagaccgacgaccugauccagagcaccaucagaacccaguucgaggacugcaccgugcugaccaucgcccacagacugaacaccaucauggacuacaccagagugaucgugcuggacaagggcgagauccaggaguacggcgcccccagcgaccugcugcagcagagaggccuguucuacagcauggccaaggacgccggccugguguaa

SEQ ID NO: 13111 - RNA, 4638 nt, Artificial Sequence
  ABCC2__Homo_sapiens__NP_000383
augcuggagaaguucugcaacagcaccuucuggaacagcagcuuccuggacagccccgaggccgaccugccccugugcuucgagcagaccgugcugguguggaucccccugggcuuccuguggcugcuggcccccuggcagcugcugcacguguacaagagcagaaccaagagaagcagcaccaccaagcuguaccuggccaagcagguguucgugggcuuccugcugauccuggccgccaucgagcuggcccuggugcugaccgaggacagcggccaggccaccgugcccgccgugagauacaccaaccccagccuguaccugggcaccuggcugcuggugcugcugauccaguacagcagacaguggugcgugcagaagaacagcugguuccugagccuguucuggauccugagcauccugugcggcaccuuccaguuccagacccugaucagaacccugcugcagggcgacaacagcaaccuggccuacagcugccuguucuucaucagcuacggcuuccagauccugauccugaucuucagcgccuucagcgagaacaacgagagcagcaacaaccccagcagcaucgccagcuuccugagcagcaucaccuacagcugguacgacagcaucauccugaagggcuacaagagaccccugacccuggaggacgugugggagguggacgaggagaugaagaccaagacccuggugagcaaguucgagacccacaugaagagagagcugcagaaggccagaagagcccugcagagaagacaggagaagagcagccagcagaacagcggcgccagacugcccggccugaacaagaaccagagccagagccaggacgcccuggugcuggaggacguggagaagaagaagaagaagagcggcaccaagaaggacgugcccaagagcuggcugaugaaggcccuguucaagaccuucuacauggugcugcugaagagcuuccugcugaagcuggugaacgacaucuucaccuucgugagcccccagcugcugaagcugcugaucagcuucgccagcgacagagacaccuaccuguggaucggcuaccugugcgccauccugcuguucaccgccgcccugauccagagcuucugccugcagugcuacuuccagcugugcuucaagcugggcgugaaggugagaaccgccaucauggccagcguguacaagaaggcccugacccugagcaaccuggccagaaaggaguacaccgugggcgagaccgugaaccugaugagcguggacgcccagaagcugauggacgugaccaacuucaugcacaugcuguggagcagcgugcugcagaucgugcugagcaucuucuuccuguggagagagcugggccccagcgugcuggccggcgugggcgugauggugcuggugauccccaucaacgccauccugagcaccaagagcaagaccauccaggugaagaacaugaagaacaaggacaagagacugaagaucaugaacgagauccugagcggcaucaagauccugaaguacuucgccugggagcccagcuucagagaccaggugcagaaccugagaaagaaggagcugaagaaccugcuggccuucagccagcugcagugcguggugaucuucguguuccagcugacccccgugcuggugagcguggugaccuucagcguguacgugcugguggacagcaacaacauccuggacgcccagaaggccuucaccagcaucacccuguucaacauccugagauucccccugagcaugcugcccaugaugaucagcagcaugcugcaggccagcgugagcaccgagagacuggagaaguaccugggcggcgacgaccuggacaccagcgccaucagacacgacugcaacuucgacaaggccaugcaguucagcgaggccagcuucaccugggagcacgacagcgaggccaccgugagagacgugaaccuggacaucauggccggccagcugguggccgugaucggccccgugggcagcggcaagagcagccugaucagcgccaugcugggcgagauggagaacgugcacggccacaucaccaucaagggcaccaccgccuacgugccccagcagagcuggauccagaacggcaccaucaaggacaacauccuguucggcaccgaguucaacgagaagagauaccagcaggugcuggaggccugcgcccugcugcccgaccuggagaugcugcccggcggcgaccuggccgagaucggcgagaagggcaucaaccugagcggcggccagaagcagagaaucagccuggccagagccaccuaccagaaccuggacaucuaccugcuggacgacccccugagcgccguggacgcccacgugggcaagcacaucuucaacaaggugcugggccccaacggccugcugaagggcaagaccagacugcuggugacccacagcaugcacuuccugccccagguggacgagaucguggugcugggcaacggcaccaucguggagaagggcagcuacagcgcccugcuggccaagaagggcgaguucgccaagaaccugaagaccuuccugagacacaccggccccgaggaggaggccaccgugcacgacggcagcgaggaggaggacgacgacuacggccugaucagcagcguggaggagauccccgaggacgccgccagcaucaccaugagaagagagaacagcuucagaagaacccugagcagaagcagcagaagcaacggcagacaccugaagagccugagaaacagccugaagaccagaaacgugaacagccugaaggaggacgaggagcuggugaagggccagaagcugaucaagaaggaguucaucgagaccggcaaggugaaguucagcaucuaccuggaguaccugcaggccaucggccuguucagcaucuucuucaucauccuggccuucgugaugaacagcguggccuucaucggcagcaaccuguggcugagcgccuggaccagcgacagcaagaucuucaacagcaccgacuaccccgccagccagagagacaugagagugggcguguacggcgcccugggccuggcccagggcaucuucguguucaucgcccacuucuggagcgccuucggcuucgugcacgccagcaacauccugcacaagcagcugcugaacaacauccugagagcccccaugagauucuucgacaccacccccaccggcagaaucgugaacagauucgccggcgacaucagcaccguggacgacacccugccccagagccugagaagcuggaucaccugcuuccugggcaucaucagcacccuggugaugaucugcauggccacccccguguucaccaucaucgugaucccccugggcaucaucuacgugagcgugcagauguucuacgugagcaccagcagacagcugagaagacuggacagcgugaccagaagccccaucuacagccacuucagcgagaccgugagcggccugcccgugaucagagccuucgagcaccagcagagauuccugaagcacaacgaggugagaaucgacaccaaccagaagugcguguucagcuggaucaccagcaacagauggcuggccaucagacuggagcuggugggcaaccugaccguguucuucagcgcccugaugauggugaucuacagagacacccugagcggcgacaccgugggcuucgugcugagcaacgcccugaacaucacccagacccugaacuggcuggugagaaugaccagcgagaucgagaccaacaucguggccguggagagaaucaccgaguacaccaagguggagaacgaggcccccugggugaccgacaagagacccccccccgacuggcccagcaagggcaagauccaguucaacaacuaccaggugagauacagacccgagcuggaccuggugcugagaggcaucaccugcgacaucggcagcauggagaagaucggcguggugggcagaaccggcgccggcaagagcagccugaccaacugccuguucagaauccuggaggccgccggcggccagaucaucaucgacggcguggacaucgccagcaucggccugcacgaccugagagagaagcugaccaucaucccccaggaccccauccuguucagcggcagccugagaaugaaccuggaccccuucaacaacuacagcgacgaggagaucuggaaggcccuggagcuggcccaccugaagagcuucguggccagccugcagcugggccugagccacgaggugaccgaggccggcggcaaccugagcaucggccagagacagcugcugugccugggcagagcccugcugagaaagagcaagauccuggugcuggacgaggccaccgccgccguggaccuggagaccgacaaccugauccagaccaccauccagaacgaguucgcccacugcaccgugaucaccaucgcccacagacugcacaccaucauggacagcgacaaggugauggugcuggacaacggcaagaucaucgagugcggcagccccgaggagcugcugcagauccccggccccuucuacuucauggccaaggaggccggcaucgagaacgugaacagcaccaaguucuaa

SEQ ID NO: 13112 - RNA, 1719 nt, Artificial Sequence
  ABCC3__Homo_sapiens__NP_001137542
auggacgcccugugcggcagcggcgagcugggcagcaaguucugggacagcaaccugagcgugcacaccgagaaccccgaccugacccccugcuuccagaacagccugcuggccugggugcccugcaucuaccuguggguggcccugcccugcuaccugcuguaccugagacaccacugcagaggcuacaucauccugagccaccugagcaagcugaagauggugcugggcgugcugcuguggugcgugagcugggccgaccuguucuacagcuuccacggccuggugcacggcagagcccccgcccccguguucuucgugaccccccugguggugggcgugaccaugcugcuggccacccugcugauccaguacgagagacugcagggcgugcagagcagcggcgugcugaucaucuucugguuccugugcguggugugcgccaucgugcccuucagaagcaagauccugcuggccaaggccgagggcgagaucagcgaccccuucagauucaccaccuucuacauccacuucgcccuggugcugagcgcccugauccuggccugcuucagagagaagccccccuucuucagcgccaagaacguggaccccaaccccuaccccgagaccagcgccggcuuccugagcagacuguucuucuggugguucaccaagauggccaucuacggcuacagacacccccuggaggagaaggaccuguggagccugaaggaggaggacagaagccagaugguggugcagcagcugcuggaggccuggagaaagcaggagaagcagaccgccagacacaaggccagcgccgcccccggcaagaacgccagcggcgaggacgaggugcugcugggcgccagacccagacccagaaagcccagcuuccugaaggcccugcuggccaccuucggcagcagcuuccugaucagcgccugcuucaagcugauccaggaccugcugagcuucaucaacccccagcugcugagcauccugaucagauucaucagcaaccccauggcccccagcugguggggcuuccugguggccggccugauguuccugugcagcaugaugcagagccugauccugcagcacuacuaccacuacaucuucgugaccggcgugaaguucagaaccggcaucaugggcgugaucuacagaaaggcccuggugaucaccaacagcgugaagagagccagcaccgugggcgagaucgugaaccugaugagcguggacgcccagagauucauggaccuggcccccuuccugaaccugcuguggagcgccccccugcagaucauccuggccaucuacuuccuguggcagaaccugggccccagcgugcuggccggcguggccuucauggugcugcugaucccccugaacggcgccguggccgugaagaugagagccuuccaggugaagcagaugaagcugaaggacagcagaaucaagcugaugagcgagauccugaacggcaucaaggugcugaagcuguacgccugggagcccagcuuccugaagcagguggagggcaucagacagggcgagcugcagcugcugagaaccgccgccuaccugcacaccaccaccaccuucaccuggaugugcagccccuuccuggugagacugggcaccggccugggccccugccugcagggcagcggcugccccggcauggccagagcccacuggacccugcccuaa

SEQ ID NO: 13113 - RNA, 2580 nt, Artificial Sequence
  ABCC4__Homo_sapiens__NP_001098985
augcugcccguguaccaggaggugaagcccaacccccugcaggacgccaaccugugcagcagaguguucuucugguggcugaacccccuguucaagaucggccacaagagaagacuggaggaggacgacauguacagcgugcugcccgaggacagaagccagcaccugggcgaggagcugcagggcuucugggacaaggaggugcugagagccgagaacgacgcccagaagcccagccugaccagagccaucaucaagugcuacuggaagagcuaccuggugcugggcaucuucacccugaucgaggagagcgccaaggugauccagcccaucuuccugggcaagaucaucaacuacuucgagaacuacgaccccauggacagcguggcccugaacaccgccuacgccuacgccaccgugcugaccuucugcacccugauccuggccauccugcaccaccuguacuucuaccacgugcagugcgccggcaugagacugagaguggccaugugccacaugaucuacagaaaggcccugagacugagcaacauggccaugggcaagaccaccaccggccagaucgugaaccugcugagcaacgacgugaacaaguucgaccaggugaccguguuccugcacuuccugugggccggcccccugcaggccaucgccgugaccgcccugcuguggauggagaucggcaucagcugccuggccggcauggccgugcugaucauccugcugccccugcagagcugcuucggcaagcuguucagcagccugagaagcaagaccgccaccuucaccgacgccagaaucagaaccaugaacgaggugaucaccggcaucagaaucaucaagauguacgccugggagaagagcuucagcaaccugaucaccaaccugagaaagaaggagaucagcaagauccugagaagcagcugccugagaggcaugaaccuggccagcuucuucagcgccagcaagaucaucguguucgugaccuucaccaccuacgugcugcugggcagcgugaucaccgccagcagaguguucguggccgugacccuguacggcgccgugagacugaccgugacccuguucuuccccagcgccaucgagagagugagcgaggccaucgugagcaucagaagaauccagaccuuccugcugcuggacgagaucagccagagaaacagacagcugcccagcgacggcaagaagauggugcacgugcaggacuucaccgccuucugggacaaggccagcgagacccccacccugcagggccugagcuucaccgugagacccggcgagcugcuggccguggugggccccgugggcgccggcaagagcagccugcugagcgccgugcugggcgagcuggcccccagccacggccuggugagcgugcacggcagaaucgccuacgugagccagcagcccuggguguucagcggcacccugagaagcaacauccuguucggcaagaaguacgagaaggagagauacgagaaggugaucaaggccugcgcccugaagaaggaccugcagcugcuggaggacggcgaccugaccgugaucggcgacagaggcaccacccugagcggcggccagaaggccagagugaaccuggccagagccguguaccaggacgccgacaucuaccugcuggacgacccccugagcgccguggacgccgaggugagcagacaccuguucgagcugugcaucugccagauccugcacgagaagaucaccauccuggugacccaccagcugcaguaccugaaggccgccagccagauccugauccugaaggacggcaagauggugcagaagggcaccuacaccgaguuccugaagagcggcaucgacuucggcagccugcugaagaaggacaacgaggagagcgagcagccccccgugcccggcacccccacccugagaaacagaaccuucagcgagagcagcguguggagccagcagagcagcagacccagccugaaggacggcgcccuggagagccaggacaccgagaacgugcccgugacccugagcgaggagaacagaagcgagggcaaggugggcuuccaggccuacaagaacuacuucagagccggcgcccacuggaucguguucaucuuccugauccugcugaacaccgccgcccagguggccuacgugcugcaggacugguggcugagcuacugggccaacaagcagagcaugcugaacgugaccgugaacggcggcggcaacgugaccgagaagcuggaccugaacugguaccugggcaucuacagcggccugaccguggccaccgugcuguucggcaucgccagaagccugcugguguucuacgugcuggugaacagcagccagacccugcacaacaagauguucgagagcauccugaaggcccccgugcuguucuucgacagaaaccccaucggcagaauccugaacagauucagcaaggacaucggccaccuggacgaccugcugccccugaccuuccuggacuucauccagagaugggaccuggccgugcugagcuggcuggugagcaacagcuaa

SEQ ID NO: 13114 - RNA, 627 nt, Artificial Sequence
  ABCC5__Homo_sapiens__NP_001018881
augaaggacaucgacaucggcaaggaguacaucauccccagccccggcuacagaagcgugagagagagaaccagcaccagcggcacccacagagacagagaggacagcaaguucagaagaaccagaccccuggagugccaggacgcccuggagaccgccgccagagccgagggccugagccuggacgccagcaugcacagccagcugagaauccuggacgaggagcaccccaagggcaaguaccaccacggccugagcgcccugaagcccaucagaaccaccagcaagcaccagcaccccguggacaacgccggccuguucagcugcaugaccuucagcuggcugagcagccuggccagaguggcccacaagaagggcgagcugagcauggaggacguguggagccugagcaagcacgagagcagcgacgugaacugcagaagacuggagagacuguggcaggaggagcugaacgaggugggccccgacgccgccagccugagaagagugguguggaucuucugcagaaccagacugauccugagcaucgugugccugaugaucacccagcuggccggcuucagcggccccaacuuccaggacggcugcauccugagaagcgaguaa

SEQ ID NO: 13115 - RNA, 300 nt, Artificial Sequence
  ABCC6__Homo_sapiens__NP_001072996
auggccgcccccgccgagcccugcgccggccagggcguguggaaccagaccgagcccgagcccgccgccaccagccugcugagccugugcuuccugagaaccgccggcgugugggugccccccauguaccugugggugcugggccccaucuaccugcuguucauccaccaccacggcagaggcuaccugagaaugagcccccuguucaaggccaagaugguggccgccauccccggcagccuggagcccggcaacgugagaggcagacagggcaccggcuggaaccuggugaagagcuaa

SEQ ID NO: 13116 - RNA, 4746 nt, Artificial Sequence
  ABCC8__Homo_sapiens__NP_000343
augccccuggccuucugcggcagcgagaaccacagcgccgccuacagaguggaccagggcgugcugaacaacggcugcuucguggacgcccugaacguggugccccacguguuccugcuguucaucaccuuccccauccuguucaucggcuggggcagccagagcagcaaggugcacauccaccacagcaccuggcugcacuuccccggccacaaccugagauggauccugaccuucaugcugcuguucgugcuggugugcgagaucgccgagggcauccugagcgacggcgugaccgagagccaccaccugcaccuguacaugcccgccggcauggccuucauggccgccgugaccagcgugguguacuaccacaacaucgagaccagcaacuuccccaagcugcugaucgcccugcugguguacuggacccuggccuucaucaccaagaccaucaaguucgugaaguuccuggaccacgccaucggcuucagccagcugagauucugccugaccggccugcuggugauccuguacggcaugcugcugcugguggaggugaacgugaucagagugagaagauacaucuucuucaagacccccagagaggugaagccccccgaggaccugcaggaccugggcgugagauuccugcagcccuucgugaaccugcugagcaagggcaccuacugguggaugaacgccuucaucaagaccgcccacaagaagcccaucgaccugagagccaucggcaagcugcccaucgccaugagagcccugaccaacuaccagagacugugcgaggccuucgacgcccaggugagaaaggacauccagggcacccagggcgccagagccaucuggcaggcccugagccacgccuucggcagaagacuggugcugagcagcaccuucagaauccuggccgaccugcugggcuucgccggcccccugugcaucuucggcaucguggaccaccugggcaaggagaacgacguguuccagcccaagacccaguuccugggcguguacuucgugagcagccaggaguuccuggccaacgccuacgugcuggccgugcugcuguuccuggcccugcugcugcagagaaccuuccugcaggccagcuacuacguggccaucgagaccggcaucaaccugagaggcgccauccagaccaagaucuacaacaagaucaugcaccugagcaccagcaaccugagcaugggcgagaugaccgccggccagaucugcaaccugguggccaucgacaccaaccagcugaugugguucuucuuccugugccccaaccugugggccaugcccgugcagaucaucgugggcgugauccugcuguacuacauccugggcgugagcgcccugaucggcgccgccgugaucauccugcuggcccccgugcaguacuucguggccaccaagcugagccaggcccagagaagcacccuggaguacagcaacgagagacugaagcagaccaacgagaugcugagaggcaucaagcugcugaagcuguacgccugggagaacaucuucagaaccagaguggagaccaccagaagaaaggagaugaccagccugagagccuucgccaucuacaccagcaucagcaucuucaugaacaccgccauccccaucgccgccgugcugaucaccuucgugggccacgugagcuucuucaaggaggccgacuucagccccagcguggccuucgccagccugagccuguuccacauccuggugaccccccuguuccugcugagcagcguggugagaagcaccgugaaggcccuggugagcgugcagaagcugagcgaguuccugagcagcgccgagaucagagaggagcagugcgccccccacgagcccaccccccagggccccgccagcaaguaccaggccgugccccugagaguggugaacagaaagagacccgccagagaggacugcagaggccugaccggcccccugcagagccuggugcccagcgccgacggcgacgccgacaacugcugcgugcagaucaugggcggcuacuucaccuggacccccgacggcauccccacccugagcaacaucaccaucagaauccccagaggccagcugaccaugaucgugggccaggugggcugcggcaagagcagccugcugcuggccgcccugggcgagaugcagaaggugagcggcgccguguucuggagcagccugcccgacagcgagaucggcgaggaccccagccccgagagagagaccgccaccgaccuggacaucagaaagagaggccccguggccuacgccagccagaagcccuggcugcugaacgccaccguggaggagaacaucaucuucgagagccccuucaacaagcagagauacaagauggugaucgaggccugcagccugcagcccgacaucgacauccugccccacggcgaccagacccagaucggcgagagaggcaucaaccugagcggcggccagagacagagaaucagcguggccagagcccuguaccagcacgccaacgugguguuccuggacgaccccuucagcgcccuggacauccaccugagcgaccaccugaugcaggccggcauccuggagcugcugagagacgacaagagaaccguggugcuggugacccacaagcugcaguaccugccccacgccgacuggaucaucgccaugaaggacggcaccauccagagagagggcacccugaaggacuuccagagaagcgagugccagcuguucgagcacuggaagacccugaugaacagacaggaccaggagcuggagaaggagaccgugaccgagagaaaggccaccgagcccccccagggccugagcagagccaugagcagcagagacggccugcugcaggacgaggaggaggaggaggaggaggccgccgagagcgaggaggacgacaaccugagcagcaugcugcaccagagagccgagauccccuggagagccugcgccaaguaccugagcagcgccggcauccugcugcugagccugcugguguucagccagcugcugaagcacauggugcugguggccaucgacuacuggcuggccaaguggaccgacagcgcccugacccugacccccgccgccagaaacugcagccugagccaggagugcacccuggaccagaccguguacgccaugguguucaccgugcugugcagccugggcaucgugcugugccuggugaccagcgugaccguggaguggaccggccugaagguggccaagagacugcacagaagccugcugaacagaaucauccuggcccccaugagauucuucgagaccaccccccugggcagcauccugaacagauucagcagcgacugcaacaccaucgaccagcacauccccagcacccuggagugccugagcagaagcacccugcugugcgugagcgcccuggccgugaucagcuacgugacccccguguuccugguggcccugcugccccuggccaucgugugcuacuucauccagaaguacuucagaguggccagcagagaccugcagcagcuggacgacaccacccagcugccccugcugagccacuucgccgagaccguggagggccugaccaccaucagagccuucagauacgaggccagauuccagcagaagcugcuggaguacaccgacagcaacaacaucgccagccuguuccugaccgccgccaacagauggcuggaggugagaauggaguacaucggcgccugcguggugcugaucgccgccgugaccagcaucagcaacagccugcacagagagcugagcgccggccuggugggccugggccugaccuacgcccugauggugagcaacuaccugaacuggauggugagaaaccuggccgacauggagcugcagcugggcgccgugaagagaauccacggccugcugaagaccgaggccgagagcuacgagggccugcuggcccccagccugauccccaagaacuggcccgaccagggcaagauccagauccagaaccugagcgugagauacgacagcagccugaagcccgugcugaagcacgugaacgcccugaucgcccccggccagaagaucggcaucugcggcagaaccggcagcggcaagagcagcuucagccuggccuucuucagaaugguggacaccuucgagggccacaucaucaucgacggcaucgacaucgccaagcugccccugcacacccugagaagcagacugagcaucauccugcaggaccccgugcuguucagcggcaccaucagauucaaccuggaccccgagagaaagugcagcgacagcacccugugggaggcccuggagaucgcccagcugaagcugguggugaaggcccugcccggcggccuggacgccaucaucaccgagggcggcgagaacuucagccagggccagagacagcuguucugccuggccagagccuucgugagaaagaccagcaucuucaucauggacgaggccaccgccagcaucgacauggccaccgagaacauccugcagaagguggugaugaccgccuucgccgacagaaccguggugaccaucgcccacagagugcacaccauccugagcgccgaccuggugaucgugcugaagagaggcgccauccuggaguucgacaagcccgagaagcugcugagcagaaaggacagcguguucgccagcuucgugagagccgacaaguaa

SEQ ID NO: 13117 - RNA, 4650 nt, Artificial Sequence
  ABCC9__Homo_sapiens__NP_005682
augagccugagcuucugcggcaacaacaucagcagcuacaacaucaacgacggcgugcugcagaacagcugcuucguggacgcccugaaccuggugccccacguguuccugcuguucaucaccuuccccauccuguucaucggcuggggcagccagagcagcaaggugcagauccaccacaacaccuggcugcacuuccccggccacaaccugagauggauccugaccuucgcccugcuguucgugcacgugugcgagaucgccgagggcaucgugagcgacagcagaagagagagcagacaccugcaccuguucaugcccgccgugaugggcuucguggccaccaccaccagcaucguguacuaccacaacaucgagaccagcaacuuccccaagcugcugcuggcccuguuccuguacugggugauggccuucaucaccaagaccaucaagcuggugaaguacugccagagcggccuggacaucagcaaccugagauucugcaucaccggcaugauggugauccugaacggccugcugauggccguggagaucaacgugaucagagugagaagauacguguucuucaugaacccccagaaggugaagccccccgaggaccugcaggaccugggcgugagauuccugcagcccuucgugaaccugcugagcaaggccaccuacugguggaugaacacccugaucaucagcgcccacaagaagcccaucgaccugaaggccaucggcaagcugcccaucgccaugagagccgugaccaacuacgugugccugaaggacgccuacgaggagcagaagaagaagguggccgaccaccccaacagaacccccagcaucuggcuggccauguacagagccuucggcagacccauccugcugagcagcaccuucagauaccuggccgaccugcugggcuucgccggcccccugugcaucagcggcaucgugcagagagugaacgagacccagaacggcaccaacaacaccaccggcaucagcgagacccugagcagcaaggaguuccuggagaacgccuacgugcuggccgugcugcuguuccuggcccugauccugcagagaaccuuccugcaggccagcuacuacgugaccaucgagaccggcaucaaccugagaggcgcccugcuggccaugaucuacaacaagauccugagacugagcaccagcaaccugagcaugggcgagaugacccugggccagaucaacaaccugguggccaucgagaccaaccagcugaugugguuccuguuccugugccccaaccugugggccaugcccgugcagaucaucaugggcgugauccugcuguacaaccugcugggcagcagcgcccuggugggcgccgccgugaucgugcugcuggcccccauccaguacuucaucgccaccaagcuggccgaggcccagaagagcacccuggacuacagcaccgagagacugaagaagaccaacgagauccugaagggcaucaagcugcugaagcuguacgccugggagcacaucuucugcaagagcguggaggagaccagaaugaaggagcugagcagccugaagaccuucgcccuguacaccagccugagcaucuucaugaacgccgccauccccaucgccgccgugcuggccaccuucgugacccacgccuacgccagcggcaacaaccugaagcccgccgaggccuucgccagccugagccuguuccacauccuggugaccccccuguuccugcugagcaccguggugagauucgccgugaaggccaucaucagcgugcagaagcugaacgaguuccugcugagcgacgagaucggcgacgacagcuggagaaccggcgagagcagccugcccuucgagagcugcaagaagcacaccggcgugcagcccaagaccaucaacagaaagcagcccggcagauaccaccuggacagcuacgagcagagcaccagaagacugagacccgccgagaccgaggacaucgccaucaaggugaccaacggcuacuucagcuggggcagcggccuggccacccugagcaacaucgacaucagaauccccaccggccagcugaccaugaucgugggccaggugggcugcggcaagagcagccugcugcuggccauccugggcgagaugcagacccuggagggcaaggugcacuggagcaacgugaacgagagcgagcccagcuucgaggccaccagaagcagaaacagauacagcguggccuacgccgcccagaagcccuggcugcugaacgccaccguggaggagaacaucaccuucggcagccccuucaacaagcagagauacaaggccgugaccgacgccugcagccugcagcccgacaucgaccugcugcccuucggcgaccagaccgagaucggcgagagaggcaucaaccugagcggcggccagagacagagaaucugcguggccagagcccuguaccagaacaccaacaucguguuccuggacgaccccuucagcgcccuggacauccaccugagcgaccaccugaugcaggagggcauccugaaguuccugcaggacgacaagagaacccuggugcuggugacccacaagcugcaguaccugacccacgccgacuggaucaucgccaugaaggacggcagcgugcugagagagggcacccugaaggacauccagaccaaggacguggagcuguacgagcacuggaagacccugaugaacagacaggaccaggagcuggagaaggacauggaggccgaccagaccacccuggagagaaagacccugagaagagccauguacagcagagaggccaaggcccagauggaggacgaggacgaggaggaggaggaggaggaggacgaggacgacaacaugagcaccgugaugagacugagaaccaagaugcccuggaagaccugcuggagauaccugaccagcggcggcuucuuccugcugauccugaugaucuucagcaagcugcugaagcacagcgugaucguggccaucgacuacuggcuggccaccuggaccagcgaguacagcaucaacaacaccggcaaggccgaccagaccuacuacguggccggcuucagcauccugugcggcgccggcaucuuccugugccuggugaccagccugaccguggaguggaugggccugaccgccgccaagaaccugcaccacaaccugcugaacaagaucauccugggccccaucagauucuucgacaccaccccccugggccugauccugaacagauucagcgccgacaccaacaucaucgaccagcacaucccccccacccuggagagccugaccagaagcacccugcugugccugagcgccaucggcaugaucagcuacgccacccccguguuccugguggcccugcugccccugggcguggccuucuacuucauccagaaguacuucagaguggccagcaaggaccugcaggagcuggacgacagcacccagcugccccugcugugccacuucagcgagaccgccgagggccugaccaccaucagagccuucagacacgagaccagauucaagcagagaaugcuggagcugaccgacaccaacaacaucgccuaccuguuccugagcgccgccaacagauggcuggaggugagaaccgacuaccugggcgccugcaucgugcugaccgccagcaucgccagcaucagcggcagcagcaacagcggccuggugggccugggccugcuguacgcccugaccaucaccaacuaccugaacuggguggugagaaaccuggccgaccuggaggugcagaugggcgccgugaagaaggugaacagcuuccugaccauggagagcgagaacuacgagggcaccauggaccccagccaggugcccgagcacuggccccaggagggcgagaucaagauccacgaccugugcgugagauacgagaacaaccugaagcccgugcugaagcacgugaaggccuacaucaagcccggccagaaggugggcaucugcggcagaaccggcagcggcaagagcagccugagccuggccuucuucagaaugguggacaucuucgacggcaagaucgugaucgacggcaucgacaucagcaagcugccccugcacacccugagaagcagacugagcaucauccugcaggaccccauccuguucagcggcagcaucagauucaaccuggaccccgagugcaagugcaccgacgacagacugugggaggcccuggagaucgcccagcugaagaacauggugaagagccugcccggcggccuggacgccguggugaccgagggcggcgagaacuucagcgugggccagagacagcuguucugccuggccagagccuucgugagaaagagcagcauccugaucauggacgaggccaccgccagcaucgacauggccaccgagaacauccugcagaagguggugaugaccgccuucgccgacagaaccguggugaccaucgcccacagagugagcagcaucauggacgccggccuggugcugguguucagcgagggcauccugguggagugcgacaccgugcccaaccugcuggcccacaagaacggccuguucagcacccuggugaugaccaacaaguaa

SEQ ID NO: 13118 - RNA, 2238 nt, Artificial Sequence
  ABCD1__Homo_sapiens__NP_000024
augcccgugcugagcagacccagacccuggagaggcaacacccugaagagaaccgccgugcugcuggcccuggccgccuacggcgcccacaagguguacccccuggugagacagugccuggcccccgccagaggccugcaggcccccgccggcgagcccacccaggaggccagcggcguggccgccgccaaggccggcaugaacagaguguuccugcagagacugcuguggcugcugagacugcuguuccccagagugcugugcagagagaccggccugcuggcccugcacagcgccgcccuggugagcagaaccuuccugagcguguacguggccagacuggacggcagacuggccagaugcaucgugagaaaggaccccagagccuucggcuggcagcugcugcaguggcugcugaucgcccugcccgccaccuucgugaacagcgccaucagauaccuggagggccagcuggcccugagcuucagaagcagacugguggcccacgccuacagacuguacuucagccagcagaccuacuacagagugagcaacauggacggcagacugagaaaccccgaccagagccugaccgaggacgugguggccuucgccgccagcguggcccaccuguacagcaaccugaccaagccccugcuggacguggccgugaccagcuacacccugcugagagccgccagaagcagaggcgccggcaccgccuggcccagcgccaucgccggccuggugguguuccugaccgccaacgugcugagagccuucagccccaaguucggcgagcugguggccgaggaggccagaagaaagggcgagcugagauacaugcacagcagagugguggccaacagcgaggagaucgccuucuacggcggccacgagguggagcuggcccugcugcagagaagcuaccaggaccuggccagccagaucaaccugauccugcuggagagacugugguacgugaugcuggagcaguuccugaugaaguacguguggagcgccagcggccugcugaugguggccgugcccaucaucaccgccaccggcuacagcgagagcgacgccgaggccgugaagaaggccgcccuggagaagaaggaggaggagcuggugagcgagagaaccgaggccuucaccaucgccagaaaccugcugaccgccgccgccgacgccaucgagagaaucaugagcagcuacaaggaggugaccgagcuggccggcuacaccgccagagugcacgagauguuccagguguucgaggacgugcagagaugccacuucaagagacccagagagcuggaggacgcccaggccggcagcggcaccaucggcagaagcggcgugagaguggagggcccccugaagaucagaggccaggugguggacguggagcagggcaucaucugcgagaacauccccaucgugacccccagcggcgagguggugguggccagccugaacaucagaguggaggagggcaugcaccugcugaucaccggccccaacggcugcggcaagagcagccuguucagaauccugggcggccuguggcccaccuacggcggcgugcuguacaagccccccccccagagaauguucuacaucccccagagacccuacaugagcgugggcagccugagagaccaggugaucuaccccgacagcguggaggacaugcagagaaagggcuacagcgagcaggaccuggaggccauccuggacguggugcaccugcaccacauccugcagagagagggcggcugggaggccaugugcgacuggaaggacgugcugagcggcggcgagaagcagagaaucggcauggccagaauguucuaccacagacccaaguacgcccugcuggacgagugcaccagcgccgugagcaucgacguggagggcaagaucuuccaggccgccaaggacgccggcaucgcccugcugagcaucacccacagacccagccuguggaaguaccacacccaccugcugcaguucgacggcgagggcggcuggaaguucgagaagcuggacagcgccgccagacugagccugaccgaggagaagcagagacuggagcagcagcuggccggcauccccaagaugcagagaagacugcaggagcugugccagauccugggcgaggccguggcccccgcccacgugcccgcccccagcccccagggccccggcggccugcagggcgccagcaccuaa

SEQ ID NO: 13119 - RNA, 2223 nt, Artificial Sequence
  ABCD2__Homo_sapiens__XP_011536329
augacccacaugcugaacgccgccgccgacagagugaaguggaccagaagcagcgccgccaagagagccgccugccugguggccgccgccuacgcccugaagacccuguaccccaucaucggcaagagacugaagcagagcggccacggcaagaagaaggccgccgccuaccccgccgccgagaacaccgagauccugcacugcaccgagaccaucugcgagaagcccagccccggcgugaacgccgacuucuucaagcagcugcuggagcugagaaagauccuguuccccaagcuggugaccaccgagaccggcuggcugugccugcacagcguggcccugaucagcagaaccuuccugagcaucuacguggccggccuggacggcaagaucgugaagagcaucguggagaagaagcccagaaccuucaucaucaagcugaucaaguggcugaugaucgccauccccgccaccuucgugaacagcgccaucagauaccuggagugcaagcuggcccuggccuucagaaccagacugguggaccacgccuacgagaccuacuucaccaaccagaccuacuacaaggugaucaacauggacggcagacuggccaaccccgaccagagccugaccgaggacaucaugauguucagccagagcguggcccaccuguacagcaaccugaccaagcccauccuggacgugaugcugaccagcuacacccugauccagaccgccaccagcagaggcgccagccccaucggccccacccugcuggccggccuggugguguacgccaccgccaaggugcugaaggccugcagccccaaguucggcaagcugguggccgaggaggcccacagaaagggcuaccugagauacgugcacagcagaaucaucgccaacguggaggagaucgccuucuacagaggccacaagguggagaugaagcagcugcagaagagcuacaaggcccuggccgaccagaugaaccugauccugagcaagagacugugguacaucaugaucgagcaguuccugaugaaguacguguggagcagcagcggccugaucaugguggccauccccaucaucaccgccaccggcuucgccgacggcgaggacggccagaagcaggugauggugagcgagagaaccgaggccuucaccaccgccagaaaccugcuggccagcggcgccgacgccaucgagagaaucaugagcagcuacaaggaggugaccgagcuggccggcuacaccgccagaguguacaacauguucuggguguucgacgaggugaagagaggcaucuacaagagaaccgccgugauccaggagagcgagagccacagcaagaacggcgccaagguggagcugccccugagcgacacccuggccaucaagggcaaggugaucgacguggaccacggcaucaucugcgagaacgugcccaucaucacccccgccggcgaggugguggccagcagacugaacuucaagguggaggagggcaugcaccugcugaucaccggccccaacggcugcggcaagagcagccuguucagaauccugagcggccuguggcccguguacgagggcgugcuguacaagccccccccccagcacauguucuacaucccccagagacccuacaugagccugggcagccugagagaccaggugaucuaccccgacagcguggacgacaugcacgacaagggcuacaccgaccaggaccuggagagaauccugcacaacgugcaccuguaccacaucgugcagagagagggcggcugggacgccgugauggacuggaaggacgugcugagcggcggcgagaagcagagaaugggcauggccagaauguucuaccacaagcccaaguacgcccugcuggacgagugcaccagcgccgugagcaucgacguggagggcaagaucuuccaggccgccaagggcgccggcaucagccugcugagcaucacccacagacccagccuguggaaguaccacacccaccugcugcaguucgacggcgagggcggcuggagauucgagcagcuggacaccgccaucagacugacccugagcgaggagaagcagaagcuggagagccagcuggccggcauccccaagaugcagcagagacugaacgagcugugcaagauccugggcgaggacagcgugcugaagaccaucaagaacgaggacgagaccagcuaa

SEQ ID NO: 13120 - RNA, 1044 nt, Artificial Sequence
  ABCD3__Homo_sapiens__XP_011540179
augggcuucaucgacagcaucaucgccaaguaccuggccaccguggugggcuaccugguggugagcagacccuuccuggaccugagccaccccagacaccugaagagcacccacagcgagcugcuggaggacuacuaccagagcggcagaaugcugcugagaaugagccaggcccugggcagaaucgugcuggccggcagagagaugaccagacuggccggcuucaccgccagaaucaccgagcugaugcaggugcugaaggaccugaaccacggcaaguacgagagaaccauggugagccagcaggagaagggcaucgagggcgugcaggugaucccccugauccccggcgccggcgagaucaucaucgccgacaacaucaucaaguucgaccacgugccccuggccacccccaacggcgacgugcugaucagagaccugaacuucgaggugagaagcggcgccaacgugcugaucugcggccccaacggcugcggcaagagcagccuguucagagugcugggcgagcuguggccccuguucggcggcagacugaccaagcccgagagaggcaagcuguucuacgugccccagagacccuacaugacccugggcacccugagagaccaggugaucuaccccgacggcagagaggaccagaagagaaagggcaucagcgaccuggugcugaaggaguaccuggacaacgugcagcugggccacauccuggagagagagggcggcugggacagcgugcaggacuggauggacgugcugagcggcggcgagaagcagagaauggccauggccagacuguucuaccacaagccccaguucgccauccuggacgagugcaccagcgccgugagcguggacguggagggcuacaucuacagccacugcagaaaggugggcaucacccuguucaccgugagccacagaaagagccuguggaagcaccacgaguacuaccugcacauggacggcagaggcaacuacgaguucaagcagaucaccgaggacaccguggaguucggcagcuaa

SEQ ID NO: 13121 - RNA, 1821 nt, Artificial Sequence
  ABCD4__Homo_sapiens__NP_005041
auggccguggccggccccgcccccggcgccggcgccagacccagacuggaccugcaguuccugcagagauuccugcagauccugaaggugcuguuccccagcuggagcagccagaacgcccugauguuccugacccugcugugccugacccugcuggagcaguucgugaucuaccaggugggccugauccccagccaguacuacggcgugcugggcaacaaggaccuggagggcuucaagacccugaccuuccuggccgugaugcugaucgugcugaacagcacccugaagagcuucgaccaguucaccugcaaccugcuguacgugagcuggagaaaggaccugaccgagcaccugcacagacuguacuucagaggcagagccuacuacacccugaacgugcugagagacgacaucgacaaccccgaccagagaaucagccaggacguggagagauucugcagacagcugagcagcauggccagcaagcugaucaucagccccuucacccugguguacuacaccuaccagugcuuccagagcaccggcuggcugggccccgugagcaucuucggcuacuucauccugggcaccguggugaacaagacccugaugggccccaucgugaugaagcuggugcaccaggagaagcuggagggcgacuucagauucaagcacaugcagaucagagugaacgccgagcccgccgccuucuacagagccggccacguggagcacaugagaaccgacagaagacugcagagacugcugcagacccagagagagcugaugagcaaggagcuguggcuguacaucggcaucaacaccuucgacuaccugggcagcauccugagcuacguggugaucgccauccccaucuucagcggcguguacggcgaccugagccccgccgagcugagcacccuggugagcaagaacgccuucgugugcaucuaccugaucagcugcuucacccagcugaucgaccugagcaccacccugagcgacguggccggcuacacccacagaaucggccagcugagagagacccugcuggacaugagccugaagagccaggacugcgagauccugggcgagagcgaguggggccuggacaccccccccggcuggcccgccgccgagcccgccgacaccgccuuccugcuggagagagugagcaucagcgcccccagcagcgacaagccccugaucaaggaccugagccugaagaucagcgagggccagagccugcugaucaccggcaacaccggcaccggcaagaccagccugcugagagugcugggcggccuguggaccagcaccagaggcagcgugcagaugcugaccgacuucggcccccacggcgugcuguuccugccccagaagcccuucuucaccgacggcacccugagagagcaggugaucuacccccugaaggagguguaccccgacagcggcagcgccgacgacgagagaauccugagauuccuggagcuggccggccugagcaaccugguggccagaaccgagggccuggaccagcagguggacuggaacugguacgacgugcugagccccggcgagaugcagagacugagcuucgccagacuguucuaccugcagcccaaguacgccgugcuggacgaggccaccagcgcccugaccgaggagguggagagcgagcuguacagaaucggccagcagcugggcaugaccuucaucagcgugggccacagacagagccuggagaaguuccacagccuggugcugaagcugugcggcggcggcagaugggagcugaugagaaucaagguggaguaa

SEQ ID NO: 13122 - RNA, 1800 nt, Artificial Sequence
  ABCE1__Homo_sapiens__NP_002931
auggccgacaagcugaccagaaucgccaucgugaaccacgacaagugcaagcccaagaagugcagacaggagugcaagaagagcugccccguggugagaaugggcaagcugugcaucgaggugaccccccagagcaagaucgccuggaucagcgagacccugugcaucggcugcggcaucugcaucaagaagugccccuucggcgcccugagcaucgugaaccugcccagcaaccuggagaaggagaccacccacagauacugcgccaacgccuucaagcugcacagacugcccauccccagacccggcgaggugcugggccuggugggcaccaacggcaucggcaagagcaccgcccugaagauccuggccggcaagcagaagcccaaccugggcaaguacgacgacccccccgacuggcaggagauccugaccuacuucagaggcagcgagcugcagaacuacuucaccaagauccuggaggacgaccugaaggccaucaucaagccccaguacguggaccagauccccaaggccgccaagggcaccgugggcagcauccuggacagaaaggacgagaccaagacccaggccaucgugugccagcagcuggaccugacccaccugaaggagagaaacguggaggaccugagcggcggcgagcugcagagauucgccugcgccguggugugcauccagaaggccgacaucuucauguucgacgagcccagcagcuaccuggacgugaagcagagacugaaggccgccaucaccaucagaagccugaucaaccccgacagauacaucaucgugguggagcacgaccugagcgugcuggacuaccugagcgacuucaucugcugccuguacggcgugcccagcgccuacggcguggugaccaugcccuucagcgugagagagggcaucaacaucuuccuggacggcuacgugcccaccgagaaccugagauucagagacgccagccugguguucaagguggccgagaccgccaacgaggaggaggugaagaagaugugcauguacaaguaccccggcaugaagaagaagaugggcgaguucgagcuggccaucguggccggcgaguucaccgacagcgagaucauggugaugcugggcgagaacggcaccggcaagaccaccuucaucagaaugcuggccggcagacugaagcccgacgagggcggcgaggugcccgugcugaacgugagcuacaagccccagaagaucagccccaagagcaccggcagcgugagacagcugcugcacgagaagaucagagacgccuacacccacccccaguucgugaccgacgugaugaagccccugcagaucgagaacaucaucgaccaggaggugcagacccugagcggcggcgagcugcagagaguggcccuggcccugugccugggcaagcccgccgacguguaccugaucgacgagcccagcgccuaccuggacagcgagcagagacugauggccgccagaguggugaagagauucauccugcacgccaagaagaccgccuucgugguggagcacgacuucaucauggccaccuaccuggccgacagagugaucguguucgacggcgugcccagcaagaacaccguggccaacagcccccagacccugcuggccggcaugaacaaguuccugagccagcuggagaucaccuucagaagagaccccaacaacuacagacccagaaucaacaagcugaacagcaucaaggacguggagcagaagaagagcggcaacuacuucuuccuggacgacuaa

SEQ ID NO: 13123 - RNA, 2538 nt, Artificial Sequence
  ABCF1__Homo_sapiens__NP_001020262
augcccaaggcccccaagcagcagccccccgagcccgaguggaucggcgacggcgagagcaccagccccagcgacaagguggugaagaagggcaagaaggacaagaagaucaagaagaccuucuucgaggagcuggccguggaggacaagcaggccggcgaggaggagaaggugcugaaggagaaggagcagcagcagcagcagcagcagcagcagcagaagaagaagagagacaccagaaagggcagaagaaagaaggacguggacgacgacggcgaggagaaggagcugauggagagacugaagaagcugagcgugcccaccagcgacgaggaggacgaggugcccgcccccaagcccagaggcggcaagaagaccaagggcggcaacguguucgccgcccugauccaggaccagagcgaggaggaggaggaggaggagaagcacccccccaagcccgccaagcccgagaagaacagaaucaacaaggccgugagcgaggagcagcagcccgcccugaagggcaagaagggcaaggaggagaagagcaagggcaaggccaagccccagaacaaguucgccgcccuggacaacgaggaggaggacaaggaggaggagaucaucaaggagaaggagccccccaagcagggcaaggagaaggccaagaaggccgagcagggcagcgaggaggagggcgagggcgaggaggaggaggaggagggcggcgagagcaaggccgacgaccccuacgcccaccugagcaagaaggagaagaagaagcugaagaagcagauggaguacgagagacagguggccagccugaaggccgccaacgccgccgagaacgacuucagcgugagccaggccgagaugagcagcagacaggccaugcuggagaacgccagcgacaucaagcuggagaaguucagcaucagcgcccacggcaaggagcuguucgugaacgccgaccuguacaucguggccggcagaagauacggccuggugggccccaacggcaagggcaagaccacccugcugaagcacaucgccaacagagcccugagcaucccccccaacaucgacgugcugcugugcgagcaggaggugguggccgacgagacccccgccgugcaggccgugcugagagccgacaccaagagacugaagcugcuggaggaggagagaagacugcagggccagcuggagcagggcgacgacaccgccgccgagagacuggagaagguguacgaggagcugagagccaccggcgccgccgccgccgaggccaaggccagaagaauccuggccggccugggcuucgaccccgagaugcagaacagacccacccagaaguucagcggcggcuggagaaugagagugagccuggccagagcccuguucauggagcccacccugcugaugcuggacgagcccaccaaccaccuggaccugaacgccgugaucuggcugaacaacuaccugcagggcuggagaaagacccugcugaucgugagccacgaccagggcuuccuggacgacgugugcaccgacaucauccaccuggacgcccagagacugcacuacuacagaggcaacuacaugaccuucaagaagauguaccagcagaagcagaaggagcugcugaagcaguacgagaagcaggagaagaagcugaaggagcugaaggccggcggcaagagcaccaagcaggccgagaagcagaccaaggaggcccugaccagaaagcagcagaagugcagaagaaagaaccaggacgaggagagccaggaggcccccgagcugcugaagagacccaaggaguacaccgugagauucaccuuccccgacccccccccccugagcccccccgugcugggccugcacggcgugaccuucggcuaccagggccagaagccccuguucaagaaccuggacuucggcaucgacauggacagcagaaucugcaucgugggccccaacggcgugggcaagagcacccugcugcugcugcugaccggcaagcugacccccacccacggcgagaugagaaagaaccacagacugaagaucggcuucuucaaccagcaguacgccgagcagcugagaauggaggagacccccaccgaguaccugcagagaggcuucaaccugcccuaccaggacgccagaaagugccugggcagauucggccuggagagccacgcccacaccauccagaucugcaagcugagcggcggccagaaggccagagugguguucgccgagcuggccugcagagagcccgacgugcugauccuggacgagcccaccaacaaccuggacaucgagagcaucgacgcccugggcgaggccaucaacgaguacaagggcgccgugaucguggugagccacgacgccagacugaucaccgagaccaacugccagcugugggugguggaggagcagagcgugagccagaucgacggcgacuucgaggacuacaagagagaggugcuggaggcccugggcgaggugauggugagcagacccagagaguaa

SEQ ID NO: 13124 - RNA, 1905 nt, Artificial Sequence
  ABCF2__Homo_sapiens__NP_005683
augcccagcgaccuggccaagaagaaggccgccaagaagaaggaggccgccaaggccagacagagacccagaaagggccacgaggagaacggcgacguggugaccgagccccagguggccgagaagaacgaggccaacggcagagagaccaccgagguggaccugcugaccaaggagcuggaggacuucgagaugaagaaggccgccgccagagccgugaccggcgugcuggccagccaccccaacagcaccgacgugcacaucaucaaccugagccugaccuuccacggccaggagcugcugagcgacaccaagcuggagcugaacagcggcagaagauacggccugaucggccugaacggcaucggcaagagcaugcugcugagcgccaucggcaagagagaggugcccauccccgagcacaucgacaucuaccaccugaccagagagaugccccccagcgacaagaccccccugcacugcgugauggagguggacaccgagagagccaugcuggagaaggaggccgagagacuggcccacgaggacgccgagugcgagaagcugauggagcuguacgagagacuggaggagcuggacgccgacaaggccgagaugagagccagcagaauccugcacggccugggcuucacccccgccaugcagagaaagaagcugaaggacuucagcggcggcuggagaaugagaguggcccuggccagagcccuguucaucagacccuucaugcugcugcuggacgagcccaccaaccaccuggaccuggacgccugcguguggcuggaggaggagcugaagaccuucaagagaauccuggugcuggugagccacagccaggacuuccugaacggcgugugcaccaacaucauccacaugcacaacaagaagcugaaguacuacaccggcaacuacgaccaguacgugaagaccagacuggagcuggaggagaaccagaugaagagauuccacugggagcaggaccagaucgcccacaugaagaacuacaucgccagauucggccacggcagcgccaagcuggccagacaggcccagagcaaggagaagacccugcagaagaugauggccagcggccugaccgagagaguggugagcgacaagacccugagcuucuacuucccccccugcggcaagauccccccccccgugaucauggugcagaacgugagcuucaaguacaccaaggacggccccugcaucuacaacaaccuggaguucggcaucgaccuggacaccagaguggcccuggugggccccaacggcgccggcaagagcacccugcugaagcugcugaccggcgagcugcugcccaccgacggcaugaucagaaagcacagccacgugaagaucggcagauaccaccagcaccugcaggagcagcuggaccuggaccugagcccccuggaguacaugaugaagugcuaccccgagaucaaggagaaggaggagaugagaaagaucaucggcagauacggccugaccggcaagcagcaggugagccccaucagaaaccugagcgacggccagaagugcagagugugccuggccuggcuggccuggcagaacccccacaugcuguuccuggacgagcccaccaaccaccuggacaucgagaccaucgacgcccuggccgacgccaucaacgaguucgagggcggcaugaugcuggugagccacgacuucagacugauccagcagguggcccaggagaucugggugugcgagaagcagaccaucaccaaguggcccggcgacauccuggccuacaaggagcaccugaagagcaagcugguggacgaggagccccagcugaccaagagaacccacaacgugugcacccugacccuggccagccugcccagacccuaa

SEQ ID NO: 13125 - RNA, 2037 nt, Artificial Sequence
  ABCG1__Homo_sapiens__NP_004906
auggccugccugauggccgccuucagcgugggcaccgccaugaacgccagcagcuacagcgccgagaugaccgagcccaagagcgugugcgugagcguggacgagguggugagcagcaacauggaggccaccgagaccgaccugcugaacggccaccugaagaagguggacaacaaccugaccgaggcccagagauucagcagccugcccagaagagccgccgugaacaucgaguucagagaccugagcuacagcgugcccgagggccccugguggagaaagaagggcuacaagacccugcugaagggcaucagcggcaaguucaacagcggcgagcugguggccaucaugggccccagcggcgccggcaagagcacccugaugaacauccuggccggcuacagagagaccggcaugaagggcgccgugcugaucaacggccugcccagagaccugagaugcuucagaaaggugagcugcuacaucaugcaggacgacaugcugcugccccaccugaccgugcaggaggccaugauggugagcgcccaccugaagcugcaggagaaggacgagggcagaagagagauggugaaggagauccugaccgcccugggccugcugagcugcgccaacaccagaaccggcagccugagcggcggccagagaaagagacuggccaucgcccuggagcuggugaacaacccccccgugauguucuucgacgagcccaccagcggccuggacagcgccagcugcuuccagguggugagccugaugaagggccuggcccagggcggcagaagcaucaucugcaccauccaccagcccagcgccaagcuguucgagcuguucgaccagcuguacgugcugagccagggccagugcguguacagaggcaaggugugcaaccuggugcccuaccugagagaccugggccugaacugccccaccuaccacaaccccgccgacuucgugauggagguggccagcggcgaguacggcgaccagaacagcagacuggugagagccgugagagagggcaugugcgacagcgaccacaagagagaccugggcggcgacgccgaggugaaccccuuccuguggcacagacccagcgaggaggugaagcagaccaagagacugaagggccugagaaaggacagcagcagcauggagggcugccacagcuucagcgccagcugccugacccaguucugcauccuguucaagagaaccuuccugagcaucaugagagacagcgugcugacccaccugagaaucaccagccacaucggcaucggccugcugaucggccugcuguaccugggcaucggcaacgaggccaagaaggugcugagcaacagcggcuuccuguucuucagcaugcuguuccugauguucgccgcccugaugcccaccgugcugaccuucccccuggagaugggcguguuccugagagagcaccugaacuacugguacagccugaaggccuacuaccuggccaagaccauggccgacgugcccuuccagaucauguuccccguggccuacugcagcaucguguacuggaugaccagccagcccagcgacgccgugagauucgugcuguucgccgcccugggcaccaugaccagccugguggcccagagccugggccugcugaucggcgccgccagcaccagccugcagguggccaccuucgugggccccgugaccgccauccccgugcugcuguucagcggcuucuucgugagcuucgacaccauccccaccuaccugcaguggaugagcuacaucagcuacgugagauacggcuucgagggcgugauccugagcaucuacggccuggacagagaggaccugcacugcgacaucgacgagaccugccacuuccagaagagcgaggccauccugagagagcuggacguggagaacgccaagcuguaccuggacuucaucgugcugggcaucuucuucaucagccugagacugaucgccuacuucgugcugagauacaagaucagagccgagagauaa

SEQ ID NO: 13126 - RNA, 1836 nt, Artificial Sequence
  ABCG2__Homo_sapiens__NP_001244315
augagcagcagcaacguggagguguucauccccgugagccagggcaacaccaacggcuuccccgccaccgccagcaacgaccugaaggccuucaccgagggcgccgugcugagcuuccacaacaucugcuacagagugaagcugaagagcggcuuccugcccugcagaaagcccguggagaaggagauccugagcaacaucaacggcaucaugaagcccggccugaacgccauccugggccccaccggcggcggcaagagcagccugcuggacgugcuggccgccagaaaggaccccagcggccugagcggcgacgugcugaucaacggcgcccccagacccgccaacuucaagugcaacagcggcuacguggugcaggacgacguggugaugggcacccugaccgugagagagaaccugcaguucagcgccgcccugagacuggccaccaccaugaccaaccacgagaagaacgagagaaucaacagagugauccaggagcugggccuggacaagguggccgacagcaaggugggcacccaguucaucagaggcgugagcggcggcgagagaaagagaaccagcaucggcauggagcugaucaccgaccccagcauccuguuccuggacgagcccaccaccggccuggacagcagcaccgccaacgccgugcugcugcugcugaagagaaugagcaagcagggcagaaccaucaucuucagcauccaccagcccagauacagcaucuucaagcuguucgacagccugacccugcuggccagcggcagacugauguuccacggccccgcccaggaggcccugggcuacuucgagagcgccggcuaccacugcgaggccuacaacaaccccgccgacuucuuccuggacaucaucaacggcgacagcaccgccguggcccugaacagagaggaggacuucaaggccaccgagaucaucgagcccagcaagcaggacaagccccugaucgagaagcuggccgagaucuacgugaacagcagcuucuacaaggagaccaaggccgagcugcaccagcugagcggcggcgagaagaagaagaagaucaccguguucaaggagaucagcuacaccaccagcuucugccaccagcugagaugggugagcaagagaagcuucaagaaccugcugggcaacccccaggccagcaucgcccagaucaucgugaccguggugcugggccuggugaucggcgccaucuacuucggccugaagaacgacagcaccggcauccagaacagagccggcgugcuguucuuccugaccaccaaccagugcuucagcagcgugagcgccguggagcuguucgugguggagaagaagcuguucauccacgaguacaucagcggcuacuacagagugagcagcuacuuccugggcaagcugcugagcgaccugcugcccaugagaaugcugcccagcaucaucuucaccugcaucguguacuucaugcugggccugaagcccaaggccgacgccuucuucgugaugauguucacccugaugaugguggccuacagcgccagcagcauggcccuggccaucgccgccggccagagcguggugagcguggccacccugcugaugaccaucugcuucguguucaugauggugugcuggagcaucagccagccccugcaccugggcugccacggcuucagcaccagcgccuuccacgacauggaccugagacugugcagcaucaugaacuucugggacaagaccagcgcccaggacagcaugcagcaggagaccauccuggugaccaugcagcacgugcuggccaagaacaucugguaa

SEQ ID NO: 13127 - RNA, 1941 nt, Artificial Sequence
  ABCG4__Homo_sapiens__NP_001135977
auggccgagaaggcccuggaggccgugggcugcggccugggccccggcgccguggccauggccgugacccuggaggacggcgccgagccccccgugcugaccacccaccugaagaagguggagaaccacaucaccgaggcccagagauucagccaccugcccaagagaagcgccguggacaucgaguucguggagcugagcuacagcgugagagagggccccugcuggagaaagagaggcuacaagacccugcugaagugccugagcggcaaguucugcagaagagagcugaucggcaucaugggccccagcggcgccggcaagagcaccuucaugaacauccuggccggcuacagagagagcggcaugaagggccagauccuggugaacggcagacccagagagcugagaaccuucagaaagaugagcugcuacaucaugcaggacgacaugcugcugccccaccugaccgugcuggaggccaugauggugagcgccaaccugaagcugagcgagaagcaggaggugaagaaggagcuggugaccgagauccugaccgcccugggccugaugagcugcagccacaccagaaccgcccugcugagcggcggccagagaaagagacuggccaucgcccuggagcuggugaacaacccccccgugauguucuucgacgagcccaccagcggccuggacagcgccagcugcuuccagguggugagccugaugaagagccuggcccagggcggcagaaccaucaucugcaccauccaccagcccagcgccaagcuguucgagauguucgacaagcuguacauccugagccagggccagugcaucuucaagggcguggugaccaaccugauccccuaccugaagggccugggccugcacugccccaccuaccacaaccccgccgacuucaucaucgagguggccagcggcgaguacggcgaccugaaccccaugcuguucagagccgugcagaacggccugugcgccauggccgagaagaagagcagccccgagaagaacgaggugcccgcccccugcccccccugcccccccgagguggaccccaucgagagccacaccuucgccaccagcacccugacccaguucugcauccuguucaagagaaccuuccugagcauccugagagacaccgugcugacccaccugagauucaugagccacguggugaucggcgugcugaucggccugcuguaccugcacaucggcgacgacgccagcaagguguucaacaacaccggcugccuguucuucagcaugcuguuccugauguucgccgcccugaugcccaccgugcugaccuucccccuggagauggccguguucaugagagagcaccugaacuacugguacagccugaaggccuacuaccuggccaagaccauggccgacgugcccuuccagguggugugccccgugguguacugcagcaucguguacuggaugaccggccagcccgccgagaccagcagauuccugcuguucagcgcccuggccaccgccaccgcccugguggcccagagccugggccugcugaucggcgccgccagcaacagccugcagguggccaccuucgugggccccgugaccgccauccccgugcugcuguucagcggcuucuucgugagcuucaagaccauccccaccuaccugcaguggagcagcuaccugagcuacgugagauacggcuucgagggcgugauccugaccaucuacggcauggagagaggcgaccugaccugccuggaggagagaugccccuucagagagccccagagcauccugagagcccuggacguggaggacgccaagcuguacauggacuuccuggugcugggcaucuucuuccuggcccugagacugcuggccuaccuggugcugagauacagagugaagagcgagagauaa

SEQ ID NO: 13128 - RNA, 1956 nt, Artificial Sequence
  ABCG5__Homo_sapiens__NP_071881
augggcgaccugagcagccugacccccggcggcagcaugggccugcaggugaacagaggcagccagagcagccuggagggcgcccccgccaccgcccccgagccccacagccugggcauccugcacgccagcuacagcgugagccacagagugagacccuggugggacaucaccagcugcagacagcaguggaccagacagauccugaaggacgugagccuguacguggagagcggccagaucaugugcauccugggcagcagcggcagcggcaagaccacccugcuggacgccaugagcggcagacugggcagagccggcaccuuccugggcgagguguacgugaacggcagagcccugagaagagagcaguuccaggacugcuucagcuacgugcugcagagcgacacccugcugagcagccugaccgugagagagacccugcacuacaccgcccugcuggccaucagaagaggcaaccccggcagcuuccagaagaagguggaggccgugauggccgagcugagccugagccacguggccgacagacugaucggcaacuacagccugggcggcaucagcaccggcgagagaagaagagugagcaucgccgcccagcugcugcaggaccccaaggugaugcuguucgacgagcccaccaccggccuggacugcaugaccgccaaccagaucguggugcugcugguggagcuggccagaagaaacagaaucguggugcugaccauccaccagcccagaagcgagcuguuccagcuguucgacaagaucgccauccugagcuucggcgagcugaucuucugcggcacccccgccgagaugcuggacuucuucaacgacugcggcuaccccugccccgagcacagcaaccccuucgacuucuacauggaccugaccagcguggacacccagagcaaggagagagagaucgagaccagcaagagagugcagaugaucgagagcgccuacaagaagagcgccaucugccacaagacccugaagaacaucgagagaaugaagcaccugaagacccugcccauggugcccuucaagaccaaggacagccccggcguguucagcaagcugggcgugcugcugagaagagugaccagaaaccuggugagaaacaagcuggccgugaucaccagacugcugcagaaccugaucaugggccuguuccugcuguucuucgugcugagagugagaagcaacgugcugaagggcgccauccaggacagagugggccugcuguaccaguucgugggcgccacccccuacaccggcaugcugaacgccgugaaccuguuccccgugcugagagccgugagcgaccaggagagccaggacggccuguaccagaaguggcagaugaugcuggccuacgcccugcacgugcugcccuucagcgugguggccaccaugaucuucagcagcgugugcuacuggacccugggccugcaccccgagguggccagauucggcuacuucagcgccgcccugcuggccccccaccugaucggcgaguuccugacccuggugcugcugggcaucgugcagaaccccaacaucgugaacagcgugguggcccugcugagcaucgccggcgugcuggugggcagcggcuuccugagaaacauccaggagaugcccauccccuucaagaucaucagcuacuucaccuuccagaaguacugcagcgagauccugguggugaacgaguucuacggccugaacuucaccugcggcagcagcaacgugagcgugaccaccaaccccaugugcgccuucacccagggcauccaguucaucgagaagaccugccccggcgccaccagcagauucaccaugaacuuccugauccuguacagcuucauccccgcccuggugauccugggcaucgugguguucaagaucagagaccaccugaucagcagauaa

SEQ ID NO: 13129 - RNA, 2022 nt, Artificial Sequence
  ABCG8__Homo_sapiens__NP_071882
auggccggcaaggccgccgaggagagaggccugcccaagggcgccaccccccaggacaccagcggccugcaggacagacuguucagcagcgagagcgacaacagccuguacuucaccuacagcggccagcccaacacccuggaggugagagaccugaacuaccagguggaccuggccagccaggugcccugguucgagcagcuggcccaguucaagaugcccuggaccagccccagcugccagaacagcugcgagcugggcauccagaaccugagcuucaaggugagaagcggccagaugcuggccaucaucggcagcagcggcugcggcagagccagccugcuggacgugaucaccggcagaggccacggcggcaagaucaagagcggccagaucuggaucaacggccagcccagcagcccccagcuggugagaaagugcguggcccacgugagacagcacaaccagcugcugcccaaccugaccgugagagagacccuggccuucaucgcccagaugagacugcccagaaccuucagccaggcccagagagacaagagaguggaggacgugaucgccgagcugagacugagacagugcgccgacaccagagugggcaacauguacgugagaggccugagcggcggcgagagaagaagagugagcaucggcgugcagcugcuguggaaccccggcauccugauccuggacgagcccaccagcggccuggacagcuucaccgcccacaaccuggugaagacccugagcagacuggccaagggcaacagacuggugcugaucagccugcaccagcccagaagcgacaucuucagacuguucgaccuggugcugcugaugaccagcggcacccccaucuaccugggcgccgcccagcacauggugcaguacuucaccgccaucggcuaccccugccccagauacagcaaccccgccgacuucuacguggaccugaccagcaucgacagaagaagcagagagcaggagcuggccaccagagagaaggcccagagccuggccgcccuguuccuggagaaggugagagaccuggacgacuuccuguggaaggccgagaccaaggaccuggacgaggacaccugcguggagagcagcgugaccccccuggacaccaacugccugcccagccccaccaagaugcccggcgccgugcagcaguucaccacccugaucagaagacagaucagcaacgacuucagagaccugcccacccugcugauccacggcgccgaggccugccugaugagcaugaccaucggcuuccuguacuucggccacggcagcauccagcugagcuucauggacaccgccgcccugcuguucaugaucggcgcccugauccccuucaacgugauccuggacgugaucagcaagugcuacagcgagagagccaugcuguacuacgagcuggaggacggccuguacaccaccggccccuacuucuucgccaagauccugggcgagcugcccgagcacugcgccuacaucaucaucuacggcaugcccaccuacuggcuggccaaccugagacccggccugcagcccuuccugcugcacuuccugcugguguggcuggugguguucugcugcagaaucauggcccuggccgccgccgcccugcugcccaccuuccacauggccagcuucuucagcaacgcccuguacaacagcuucuaccuggccggcggcuucaugaucaaccugagcagccuguggaccgugcccgccuggaucagcaaggugagcuuccugagauggugcuucgagggccugaugaagauccaguucagcagaagaaccuacaagaugccccugggcaaccugaccaucgccgugagcggcgacaagauccugagcgugauggagcuggacagcuacccccuguacgccaucuaccugaucgugaucggccugagcggcggcuucauggugcuguacuacgugagccugagauucaucaagcagaagcccagccaggacugguaa

SEQ ID NO: 13130 - RNA, 1089 nt, Artificial Sequence
  ABHD12B__Homo_sapiens__NP_001193602
auggacgcccaggacugccaggccgccgccagccccgagccccccggcccccccgccagaagcugcguggccgccuggugggacaugguggacagaaaccugagauacuucccccacagcugcagcaugcugggcagaaagaucgccgcccuguacgacagcuucaccagcaagagccugaaggagcacguguuccugccccugaucgacaugcugaucuacuucaacuucuucaaggcccccuuccugguggaccugaagaagcccgagcugaagaucccccacaccgugaacuucuaccugagaguggagcccggcgugaugcugggcaucuggcacaccgugcccagcugcagaggcgaggacgccaagggcaaggacugcugcugguacgaggccgcccugagagacggcaaccccaucaucguguaccugcacggcagcgccgagcacagagccgccagccacagacugaagcuggugaaggugcugagcgacggcggcuuccacgugcugagcguggacuacagaggcuucggcgacagcaccggcaagcccaccgaggagggccugaccaccgacgccaucugcguguacgaguggaccaaggccagaagcggcaucacccccgugugccuguggggccacagccugggcaccggcguggccaccaacgccgccaaggugcuggaggagaagggcugccccguggacgccaucgugcuggaggcccccuucaccaacauguggguggccagcaucaacuacccccugcugaagaucuacagaaacauccccggcuuccugagaacccugauggacgcccugagaaaggacaagaucaucuuccccaacgacgagaacgugaaguuccugagcagcccccugcugauccugcacggcgaggacgacagaaccgugccccuggaguacggcaagaagcuguacgagaucgccagaaacgccuacagaaacaaggagagagugaagauggugaucuucccccccggcuuccagcacaaccugcugugcaagagccccacccugcugaucaccgugagagacuuccugagcaagcaguggagcuaa

SEQ ID NO: 13131 - RNA, 1197 nt, Artificial Sequence
  ABHD12__Homo_sapiens__NP_001035937
augagaaagagaaccgagcccguggcccuggagcacgagagaugcgccgccgccggcagcagcagcagcggcagcgccgccgccgcccuggacgccgacugcagacugaagcagaaccugagacugaccggccccgccgccgccgagcccagaugcgccgccgacgccggcaugaagagagcccugggcagaagaaagggcguguggcugagacugagaaagauccuguucugcgugcugggccuguacaucgccauccccuuccugaucaagcugugccccggcauccaggccaagcugaucuuccugaacuucgugagagugcccuacuucaucgaccugaagaagccccaggaccagggccugaaccacaccugcaacuacuaccugcagcccgaggaggacgugaccaucggcguguggcacaccgugcccgccgugugguggaagaacgcccagggcaaggaccagaugugguacgaggacgcccuggccagcagccaccccaucauccuguaccugcacggcaacgccggcaccagaggcggcgaccacagaguggagcuguacaaggugcugagcagccugggcuaccacguggugaccuucgacuacagaggcuggggcgacagcgugggcacccccagcgagagaggcaugaccuacgacgcccugcacguguucgacuggaucaaggccagaagcggcgacaaccccguguacaucuggggccacagccugggcaccggcguggccaccaaccuggugagaagacugugcgagagagagaccccccccgacgcccugauccuggagagccccuucaccaacaucagagaggaggccaagagccaccccuucagcgugaucuacagauacuuccccggcuucgacugguucuuccuggaccccaucaccagcagcggcaucaaguucgccaacgacgagaacgugaagcacaucagcugcccccugcugauccugcacgccgaggacgaccccguggugcccuuccagcugggcagaaagcuguacagcaucgccgcccccgccagaagcuucagagacuucaaggugcaguucgugcccuuccacagcgaccugggcuacagacacaaguacaucuacaagagccccgagcugcccagaauccugagagaguuccugggcaagagcgagcccgagcaccagcacuaa

SEQ ID NO: 13132 - RNA, 1578 nt, Artificial Sequence
  ABHD16A__Homo_sapiens__NP_001170986
augcccccccccgcccuguuccugagcagccuguaccccagacuggaguuccagaacgacuucuacagaagcugcaucagaagaagcagcccccagcccccccccaaccuggccuggagacccgagagccuguacagcggcgagcuggccggcggcggcuaccugagccugagcaagguggugcccuucagccacuacgccggcacccugcugcugcugcuggccggcguggccugccugagaggcaucggcagauggaccaacccccaguacagacaguucaucaccauccuggaggccacccacagaaaccagagcagcgagaacaagagacagcuggccaacuacaacuucgacuucagaagcuggcccguggacuuccacugggaggagcccagcagcagaaaggagagcagaggcggccccagcagaagaggcguggcccugcugagacccgagccccugcacagaggcaccgccgacacccugcugaacagagugaagaagcugcccugccagaucaccagcuaccugguggcccacacccugggcagaagaaugcuguaccccggcagcguguaccugcugcagaaggcccugaugcccgugcugcugcagggccaggccagacugguggaggagugcaacggcagaagagccaagcugcuggccugcgacggcaacgagaucgacaccauguucguggacagaagaggcaccgccgagccccagggccagaagcuggugaucugcugcgagggcaacgccggcuucuacgaggugggcugcgugagcaccccccuggaggccggcuacagcgugcugggcuggaaccaccccggcuucgccggcagcaccggcgugcccuucccccagaacgaggccaacgccauggacgugguggugcaguucgccauccacagacugggcuuccagccccaggacaucaucaucuacgccuggagcaucggcggcuucaccgccaccugggccgccaugagcuaccccgacgugagcgccaugauccuggacgccagcuucgacgaccuggugccccuggcccugaaggugaugcccgacagcuggagaggccuggugaccagaaccgugagacagcaccugaaccugaacaacgccgagcagcugugcagauaccagggccccgugcugcugaucagaagaaccaaggacgagaucaucaccaccaccgugcccgaggacaucaugagcaacagaggcaacgaccugcugcugaagcugcugcagcacagauaccccagagugauggccgaggagggccugagaguggugagacaguggcuggaggccagcagccagcuggaggaggccagcaucuacagcagaugggagguggaggaggacuggugccugagcgugcugagaagcuaccaggccgagcacggccccgacuuccccuggagcgugggcgaggacaugagcgccgacggcagaagacagcuggcccuguuccuggccagaaagcaccugcacaacuucgaggccacccacugcaccccccugcccgcccagaacuuccagaugcccuggcaccuguaa

SEQ ID NO: 13133 - RNA, 867 nt, Artificial Sequence
  ABHD17B__Homo_sapiens__NP_001020951
augaacaaccugagcuucagcgagcugugcugccuguucugcugcccccccugccccggcaagaucgccagcaagcuggccuuccugccccccgaccccaccuacacccugaugugcgacgagagcggcagcagauggacccugcaccugagcgagagagccgacuggcaguacagcagcagagagaaggacgccaucgagugcuucaugaccagaaccagcaagggcaacagaaucgccugcauguucgugagaugcagccccaacgccaaguacacccugcuguucagccacggcaacgccguggaccugggccagaugagcagcuucuacaucggccugggcagcagaaucaacugcaacaucuucagcuacgacuacagcggcuacggcgccagcagcggcaagcccaccgagaagaaccuguacgccgacaucgaggccgccuggcuggcccugagaaccagauacggcaucagacccgagaacgugaucaucuacggccagagcaucggcaccgugcccagcguggaccuggccgccagauacgagagcgccgccgugauccugcacagcccccugaccagcggcaugagaguggccuuccccgacaccaagaagaccuacugcuucgacgccuuccccaacaucgacaagaucagcaagaucaccagccccgugcugaucauccacggcaccgaggacgaggugaucgacuucagccacggccuggcccuguucgagagaugccagagacccguggagccccuguggguggagggcgccggccacaacgacguggagcuguacggccaguaccuggagagacugaagcaguucgugagccaggagcuggugaaccuguaa

SEQ ID NO: 13134 - RNA, 1278 nt, Artificial Sequence
  ABHD2__Homo_sapiens__XP_005254890
augaacgccaugcuggagacccccgagcugcccgccguguucgacggcgugaagcuggccgccguggccgccgugcuguacgugaucgugagaugccugaaccugaagagccccaccgccccccccgaccuguacuuccaggacagcggccugagcagauuccugcugaagagcugcccccugcugaccaaggaguacauccccccccugaucuggggcaagagcggccacauccagaccgcccuguacggcaagaugggcagagugagaagcccccaccccuacggccacagaaaguucaucaccaugagcgacggcgccaccagcaccuucgaccuguucgagccccuggccgagcacugcgugggcgacgacaucaccauggugaucugccccggcaucgccaaccacagcgagaagcaguacaucagaaccuucguggacuacgcccagaagaacggcuacagaugcgccgugcugaaccaccugggcgcccugcccaacaucgagcugaccagccccagaauguucaccuacggcugcaccugggaguucggcgccauggugaacuacaucaagaagaccuacccccugacccagcuggugguggugggcuucagccugggcggcaacaucgugugcaaguaccugggcgagacccaggccaaccaggagaaggugcugugcugcgugagcgugugccagggcuacagcgcccugagagcccaggagaccuucaugcagugggaccagugcagaagauucuacaacuuccugauggccgacaacaugaagaagaucauccugagccacagacaggcccuguucggcgaccacgugaagaagccccagagccuggaggacaccgaccugagcagacuguacaccgccaccagccugaugcagaucgacgacaacgugaugagaaaguuccacggcuacaacagccugaaggaguacuacgaggaggagagcugcaugagauaccugcacagaaucuacgugccccugaugcuggugaacgccgccgacgacccccuggugcacgagagccugcugaccauccccaagagccugagcgagaagagagagaacgugauguucgugcugccccugcacggcggccaccugggcuucuucgagggcagcgugcuguuccccgagccccugaccuggauggacaagcuggugguggaguacgccaacgccaucugccagugggagagaaacaagcugcagugcagcgacaccgagcagguggaggccgaccuggaguaa

SEQ ID NO: 13135 - RNA, 1050 nt, Artificial Sequence
  ABHD5__Homo_sapiens__NP_057090
auggccgccgaggaggaggagguggacagcgccgacaccggcgagagaagcggcuggcugaccggcuggcugcccaccuggugccccaccagcaucagccaccugaaggaggccgaggagaagaugcugaagugcgugcccugcaccuacaagaaggagcccgugagaaucagcaacggcaacaagaucuggacccugaaguucagccacaacaucagcaacaagaccccccuggugcugcugcacggcuucggcggcggccugggccugugggcccugaacuucggcgaccugugcaccaacagacccguguacgccuucgaccugcugggcuucggcagaagcagcagacccagauucgacagcgacgccgaggagguggagaaccaguucguggagagcaucgaggaguggagaugcgcccugggccuggacaagaugauccugcugggccacaaccugggcggcuuccuggccgccgccuacagccugaaguaccccagcagagugaaccaccugauccugguggagcccuggggcuuccccgagagacccgaccuggccgaccaggacagacccauccccguguggaucagagcccugggcgccgcccugacccccuucaacccccuggccggccugagaaucgccggccccuucggccugagccuggugcagagacugagacccgacuucaagagaaaguacagcagcauguucgaggacgacaccgugaccgaguacaucuaccacugcaacgugcagacccccagcggcgagaccgccuucaagaacaugaccauccccuacggcugggccaagagacccaugcugcagagaaucggcaagaugcaccccgacauccccgugagcgugaucuucggcgccagaagcugcaucgacggcaacagcggcaccagcauccagagccugagaccccacagcuacgugaagaccaucgccauccugggcgccggccacuacguguacgccgaccagcccgaggaguucaaccagaaggugaaggagaucugcgacaccguggacuaa

SEQ ID NO: 13136 - RNA, 1014 nt, Artificial Sequence
  ABHD6__Homo_sapiens__NP_065727
auggaccuggacguggugaacauguucgugaucgccggcggcacccuggccauccccauccuggccuucguggccagcuuccugcuguggcccagcgcccugaucagaaucuacuacugguacuggagaagaacccugggcaugcaggugagauacgugcaccacgaggacuaccaguucugcuacagcuucagaggcagacccggccacaagcccagcauccugaugcugcacggcuucagcgcccacaaggacauguggcugagcguggugaaguuccugcccaagaaccugcaccuggugugcguggacaugcccggccacgagggcaccaccagaagcagccuggacgaccugagcaucgacggccaggugaagagaauccaccaguucguggagugccugaagcugaacaagaagcccuuccaccuggugggcaccagcaugggcggccagguggccggcguguacgccgccuacuaccccagcgacgugagcagccugugccuggugugccccgccggccugcaguacagcaccgacaaccaguucgugcagagacugaaggagcugcagggcagcgccgccguggagaagaucccccugauccccagcacccccgaggagaugagcgagaugcugcagcugugcagcuacgugagauucaaggugccccagcagauccugcagggccugguggacgugagaaucccccacaacaacuucuacagaaagcuguuccuggagaucgugagcgagaagagcagauacagccugcaccagaacauggacaagaucaaggugcccacccagaucaucuggggcaagcaggaccaggugcuggacgugagcggcgccgacaugcuggccaagagcaucgccaacugccagguggagcugcuggagaacugcggccacagcguggugauggagagacccagaaagaccgccaagcugaucaucgacuuccuggccagcgugcacaacaccgacaacaacaagaagcuggacuaa

SEQ ID NO: 13137 - RNA, 1446 nt, Artificial Sequence
  ABI1__Homo_sapiens__NP_001012768
auggccgagcugcagaugcugcuggaggaggagauccccagcggcaagagagcccugaucgagagcuaccagaaccugaccagaguggccgacuacugcgagaacaacuacauccaggccaccgacaagagaaaggcccuggaggagaccaaggccuacaccacccagagccuggccagcguggccuaccagaucaacgcccuggccaacaacgugcugcagcugcuggacauccaggccagccagcugagaagaauggagagcagcaucaaccacaucagccagaccguggacauccacaaggagaagguggccagaagagagaucggcauccugaccaccaacaagaacaccagcagaacccacaagaucaucgcccccgccaacauggagagacccgugagauacaucagaaagcccaucgacuacaccgugcuggacgacgugggccacggcgugaaguggcugaaggccaagcacggcaacaaccagcccgccagaaccggcacccugagcagaaccaacccccccacccagaagccccccagcccccccaugagcggcagaggcacccugggcagaaacacccccuacaagacccuggagcccgugaagccccccaccgugcccaacgacuacaugaccagccccgccagacugggcagccagcacagccccggcagaaccgccagccugaaccagagacccagaacccacagcggcagcagcggcggcagcggcagcagagagaacagcggcagcagcagcaucggcauccccaucgccgugcccacccccagcccccccaccaucggccccgccgcccccggcagcgcccccggcagccaguacggcaccaugaccagacagaucagcagacacaacagcaccaccagcagcaccagcagcggcggcuacagaagaacccccagcgugaccgcccaguucagcgcccagccccacgugaacggcggcccccuguacagccagaacagcaucagcaucgcccccccccccccccccaugccccagcugaccccccagaucccccugaccggcuucguggccagagugcaggagaacaucgccgacagccccacccccccccccccccccccccccgacgacauccccauguucgacgacagcccccccccccccccccccccccccguggacuacgaggacgaggaggccgccguggugcaguacaacgaccccuacgccgacggcgaccccgccugggcccccaagaacuacaucgagaaggugguggccaucuacgacuacaccaaggacaaggacgacgagcugagcuucauggagggcgccaucaucuacgugaucaagaagaacgacgacggcugguacgagggcgugugcaacagagugaccggccuguuccccggcaacuacguggagagcaucaugcacuacaccgacuaa

SEQ ID NO: 13138 - RNA, 1542 nt, Artificial Sequence
  ABI2__Homo_sapiens__NP_001269854
auggccgagcugcagaugcugcuggaggaggagauccccggcggcagaagagcccuguucgacagcuacaccaaccuggagagaguggccgacuacugcgagaacaacuacauccagagcgccgacaagcagagagcccuggaggagaccaaggccuacaccacccagagccuggccagcguggccuaccugaucaacacccuggccaacaacgugcugcagaugcuggacauccaggccagccagcugagaagaauggagagcagcaucaaccacaucagccagaccguggacauccacaaggagaagguggccagaagagagaucggcauccugaccaccaacaagaacaccagcagaacccacaagaucaucgcccccgccaaccuggagagacccgugagauacaucagaaagcccaucgacuacaccauccuggacgacaucggccacggcgugaaguggcugcugagauucaaggugagcacccagaacaugaagaugggcggccugcccagaaccaccccccccacccagaagccccccagcccccccaugagcggcaagggcacccugggcagacacagccccuacagaacccuggagcccgugagaccccccguggugcccaacgacuacgugcccagccccaccagaaacauggcccccagccagcagagccccgugagaaccgccagcgugaaccagagaaacagaaccuacagcagcagcggcagcagcggcggcagccaccccagcagcagaagcagcagcagagagaacagcggcagcggcagcgugggcgugcccaucgccgugcccacccccagcccccccagcguguuccccgcccccgccggcagcgccggcacccccccccugcccgccaccagcgccagcgcccccgccccccuggugcccgccaccgugcccagcagcaccgcccccgacgccgccgccggcggcgcccagacccuggccgacggcuucaccagccccaccccccccguggugagcagcaccccccccaccggccaccccgugcaguucuacagcaugaacagacccgccagcagacacaccccccccaccaucggcggcagccugcccuacagaagaccccccagcaucaccagccagaccagccugcagaaccagaugaacggcggccccuucuacagccagaaccccgugagcgacaccccccccccccccccccccguggaggagcccguguucgacgagagccccccccccccccccccccccgaggacuacgaggaggaggaggccgccgugguggaguacagcgaccccuacgccgaggaggacccccccugggcccccagaagcuaccuggagaaggugguggccaucuacgacuacaccaaggacaaggaggacgagcugagcuuccaggagggcgccaucaucuacgugaucaagaagaacgacgacggcugguacgagggcgugaugaacggcgugaccggccuguuccccggcaacuacguggagagcaucaugcacuacagcgaguaa

SEQ ID NO: 13139 - RNA, 3228 nt, Artificial Sequence
  ABI3BP__Homo_sapiens__NP_056244
augagaggcggcaagugcaacaugcugagcagccugggcugccugcugcugugcggcagcaucacccuggcccugggcaacgcccagaagcugcccaagggcaagagacccaaccugaaggugcacaucaacaccaccagcgacagcauccugcugaaguuccugagacccagccccaacgugaagcuggagggccugcugcugggcuacggcagcaacgugagccccaaccaguacuucccccugcccgccgagggcaaguucaccgaggccaucguggacgccgagcccaaguaccugaucguggugagacccgcccccccccccagccagaagaagagcugcagcggcaagaccagaagcagaaagccccugcagcugguggugggcacccugacccccagcagcguguuccugagcuggggcuuccugaucaacccccaccacgacuggacccugcccagccacugccccaacgacagauucuacaccaucagauacagagagaaggacaaggagaagaaguggaucuuccagaucugccccgccaccgagaccaucguggagaaccugaagcccaacaccguguacgaguucggcgugaaggacaacguggagggcggcaucuggagcaagaucuucaaccacaagaccguggugggcagcaagaaggugaacggcaagauccagagcaccuacgaccaggaccacaccgugcccgccuacgugcccagaaagcugauccccaucaccaucaucaagcaggugauccagaacgugacccacaaggacagcgccaagagccccgagaaggccccccugggcggcgugauccuggugcaccugaucauccccggccugaacgagaccaccgugaagcugcccgccagccugauguucgagaucagcgacgcccugaagacccagcuggccaagaacgagacccuggcccugcccgccgagagcaagacccccgagguggagaagaucagcgccagacccaccaccgugacccccgagaccgugcccagaagcaccaagcccaccaccagcagcgcccuggacgugagcgagaccacccuggccagcagcgagaagcccuggaucgugcccaccgccaagaucagcgaggacagcaaggugcugcagccccagaccgccaccuacgacguguucagcagccccaccaccagcgacgagcccgagaucagcgacagcuacaccgccaccagcgacagaauccuggacagcaucccccccaagaccagcagaacccuggagcagcccagagccacccuggcccccagcgagacccccuucgugccccagaagcuggagaucuucaccagccccgagaugcagcccaccacccccgccccccagcagaccaccagcauccccagcacccccaagagaagacccagacccaagccccccagaaccaagcccgagagaaccaccagcgccggcaccaucacccccaagaucagcaagagccccgagcccaccuggaccacccccgcccccggcaagacccaguucaucagccugaagcccaagaucccccugagccccgaggugacccacaccaagcccgcccccaagcagacccccagagccccccccaagcccaagaccagccccagacccagaaucccccagacccagcccgugcccaaggugccccagagagugaccgccaagcccaagaccagccccagccccgaggugagcuacaccacccccgcccccaaggacgugcugcugccccacaagcccuaccccgaggugagccagagcgagcccgccccccuggagaccagaggcauccccuucauccccaugaucagccccagccccagccaggaggagcugcagaccacccuggaggagaccgaccagagcacccaggagcccuucaccaccaagauccccagaaccaccgagcuggccaagaccacccaggccccccacagauucuacaccaccgugagacccagaaccagcgacaagccccacaucagacccggcgugaagcaggcccccagacccagcggcgccgacagaaacgugagcguggacagcacccaccccaccaagaagcccggcaccagaagacccccccugccccccagacccacccaccccagaagaaagccccugccccccaacaacgugaccggcaagcccggcagcgccggcaucaucagcagcggccccaucaccacccccccccugagaagcacccccagacccaccggcaccccccuggagagaaucgagaccgacaucaagcagcccaccgugcccgccagcggcgaggagcuggagaacaucaccgacuucagcagcagccccaccagagagaccgacccccugggcaagcccagauucaagggcccccacgugagauacauccagaagcccgacaacagccccugcagcaucaccgacagcgugaagagauuccccaaggaggaggccaccgagggcaacgccaccagccccccccagaacccccccaccaaccugaccguggugaccguggagggcugccccagcuucgugauccuggacugggagaagccccugaacgacaccgugaccgaguacgaggugaucagcagagagaacggcagcuucagcggcaagaacaagagcauccagaugaccaaccagaccuucagcaccguggagaaccugaagcccaacaccagcuacgaguuccaggugaagcccaagaacccccugggcgagggccccgugagcaacaccguggccuucagcaccgagagcgccgaccccagagugagcgagcccgugagcgccggcagagacgccaucuggaccgagagacccuucaacagcgacagcuacagcgagugcaagggcaagcaguacgugaagagaaccugguacaagaaguucgugggcgugcagcugugcaacagccugagauacaagaucuaccugagcgacagccugaccggcaaguucuacaacaucggcgaccagagaggccacggcgaggaccacugccaguucguggacagcuuccuggacggcagaaccggccagcagcugaccagcgaccagcugcccaucaaggagggcuacuucagagccgugagacaggagcccgugcaguucggcgagaucggcggccacacccagaucaacuacgugcagugguacgagugcggcaccaccauccccggcaagugguaa

SEQ ID NO: 13140 - RNA, 1083 nt, Artificial Sequence
  ABI3__Homo_sapiens__NP_001128658
auggccgagcugcagcagcugcaggaguucgagauccccaccggcagagaggcccugagaggcaaccacagcgcccugcugagaguggccgacuacugcgaggacaacuacgugcaggccaccgacaagagaaaggcccuggaggagaccauggccuucaccacccaggcccuggccagcguggccuaccaggugggcaaccuggccggccacacccugagaaugcuggaccugcagggcgccgcccugagacagguggaggccagaauggugaacaugcacauggagaagguggccagaagagagaucggcacccuggccaccgugcagagacugccccccggccagaaggugaucgcccccgagaaccugcccccccugacccccuacugcagaagaccccugaacuucggcugccuggacgacaucggccacggcaucaaggaccugagcacccagcugagcagaaccggcacccugagcagaaagagcaucaaggcccccgccacccccgccagcgccacccugggcagaccccccagaauccccgagcccgugcaccugcccguggugcccgacggcagacugagcgccgccagcagcgccagcagccuggccagcgccggcagcgccgagggcgugggcggcgcccccacccccaagggccaggccgccccccccgcccccccccugcccagcagccuggaccccccccccccccccgccgccguggagguguuccagagaccccccacccuggaggagcugagcccccccccccccgacgaggagcugccccugccccuggaccugccccccccccccccccuggacggcgacgagcugggccugcccccccccccccccggcuucggccccgacgagcccagcugggugcccgccagcuaccuggagaagguggugacccuguaccccuacaccagccagaaggacaacgagcugagcuucagcgagggcaccgugaucugcgugaccagaagauacagcgacggcuggugcgagggcgugagcagcgagggcaccggcuucuuccccggcaacuacguggagcccagcugcuaa

SEQ ID NO: 13141 - RNA, 3393 nt, Artificial Sequence
  ABL1__Homo_sapiens__NP_005148
augcuggagaucugccugaagcuggugggcugcaagagcaagaagggccugagcagcagcagcagcugcuaccuggaggaggcccugcagagacccguggccagcgacuucgagccccagggccugagcgaggccgccagauggaacagcaaggagaaccugcuggccggccccagcgagaacgaccccaaccuguucguggcccuguacgacuucguggccagcggcgacaacacccugagcaucaccaagggcgagaagcugagagugcugggcuacaaccacaacggcgaguggugcgaggcccagaccaagaacggccagggcugggugcccagcaacuacaucacccccgugaacagccuggagaagcacagcugguaccacggccccgugagcagaaacgccgccgaguaccugcugagcagcggcaucaacggcagcuuccuggugagagagagcgagagcagccccggccagagaagcaucagccugagauacgagggcagaguguaccacuacagaaucaacaccgccagcgacggcaagcuguacgugagcagcgagagcagauucaacacccuggccgagcuggugcaccaccacagcaccguggccgacggccugaucaccacccugcacuaccccgcccccaagagaaacaagcccaccguguacggcgugagccccaacuacgacaagugggagauggagagaaccgacaucaccaugaagcacaagcugggcggcggccaguacggcgagguguacgagggcguguggaagaaguacagccugaccguggccgugaagacccugaaggaggacaccauggagguggaggaguuccugaaggaggccgccgugaugaaggagaucaagcaccccaaccuggugcagcugcugggcgugugcaccagagagccccccuucuacaucaucaccgaguucaugaccuacggcaaccugcuggacuaccugagagagugcaacagacaggaggugaacgccguggugcugcuguacauggccacccagaucagcagcgccauggaguaccuggagaagaagaacuucauccacagagaccuggccgccagaaacugccuggugggcgagaaccaccuggugaagguggccgacuucggccugagcagacugaugaccggcgacaccuacaccgcccacgccggcgccaaguuccccaucaaguggaccgcccccgagagccuggccuacaacaaguucagcaucaagagcgacgugugggccuucggcgugcugcugugggagaucgccaccuacggcaugagccccuaccccggcaucgaccugagccagguguacgagcugcuggagaaggacuacagaauggagagacccgagggcugccccgagaagguguacgagcugaugagagccugcuggcaguggaaccccagcgacagacccagcuucgccgagauccaccaggccuucgagaccauguuccaggagagcagcaucagcgacgagguggagaaggagcugggcaagcagggcgugagaggcgccgugagcacccugcugcaggcccccgagcugcccaccaagaccagaaccagcagaagagccgccgagcacagagacaccaccgacgugcccgagaugccccacagcaagggccagggcgagagcgacccccuggaccacgagcccgccgugagcccccugcugcccagaaaggagagaggcccccccgagggcggccugaacgaggacgagagacugcugcccaaggacaagaagaccaaccuguucagcgcccugaucaagaagaagaagaagaccgcccccaccccccccaagagaagcagcagcuucagagagauggacggccagcccgagagaagaggcgccggcgaggaggagggcagagacaucagcaacggcgcccuggccuucaccccccuggacaccgccgaccccgccaagagccccaagcccagcaacggcgccggcgugcccaacggcgcccugagagagagcggcggcagcggcuucagaagcccccaccuguggaagaagagcagcacccugaccagcagcagacuggccaccggcgaggaggagggcggcggcagcagcagcaagagauuccugagaagcugcagcgccagcugcgugccccacggcgccaaggacaccgaguggagaagcgugacccugcccagagaccugcagagcaccggcagacaguucgacagcagcaccuucggcggccacaagagcgagaagcccgcccugcccagaaagagagccggcgagaacagaagcgaccaggugaccagaggcaccgugacccccccccccagacuggugaagaagaacgaggaggccgccgacgagguguucaaggacaucauggagagcagccccggcagcagcccccccaaccugacccccaagccccugagaagacaggugaccguggcccccgccagcggccugccccacaaggaggaggccggcaagggcagcgcccugggcacccccgccgccgccgagcccgugacccccaccagcaaggccggcagcggcgcccccggcggcaccagcaagggccccgccgaggagagcagagugagaagacacaagcacagcagcgagagccccggcagagacaagggcaagcugagcagacugaagcccgcccccccccccccccccgccgccagcgccggcaaggccggcggcaagcccagccagagccccagccaggaggccgccggcgaggccgugcugggcgccaagaccaaggccaccagccugguggacgccgugaacagcgacgccgccaagcccagccagcccggcgagggccugaagaagcccgugcugcccgccacccccaagccccagagcgccaagcccagcggcacccccaucagccccgcccccgugcccagcacccugcccagcgccagcagcgcccuggccggcgaccagcccagcagcaccgccuucaucccccugaucagcaccagagugagccugagaaagaccagacagccccccgagagaaucgccagcggcgccaucaccaagggcguggugcuggacagcaccgaggcccugugccuggccaucagcagaaacagcgagcagauggccagccacagcgccgugcuggaggccggcaagaaccuguacaccuucugcgugagcuacguggacagcauccagcagaugagaaacaaguucgccuucagagaggccaucaacaagcuggagaacaaccugagagagcugcagaucugccccgccaccgccggcagcggccccgccgccacccaggacuucagcaagcugcugagcagcgugaaggagaucagcgacaucgugcagagauaa

SEQ ID NO: 13142 - RNA, 3195 nt, Artificial Sequence
  ABL2__Homo_sapiens__NP_001129472
auggugcugggcaccgugcugcugccccccaacagcuacggcagagaccaggacaccagccugugcugccugugcaccgaggccagcgagagcgcccugcccgaccugaccgaccacuucgccagcugcguggaggacggcuucgagggcgacaagaccggcggcagcagccccgaggcccugcacagacccuacggcugcgacguggagccccaggcccugaacgaggccaucagauggagcagcaaggagaaccugcugggcgccaccgagagcgaccccaaccuguucguggcccuguacgacuucguggccagcggcgacaacacccugagcaucaccaagggcgagaagcugagagugcugggcuacaaccagaacggcgaguggagcgaggugagaagcaagaacggccagggcugggugcccagcaacuacaucacccccgugaacagccuggagaagcacagcugguaccacggccccgugagcagaagcgccgccgaguaccugcugagcagccugaucaacggcagcuuccuggugagagagagcgagagcagccccggccagcugagcaucagccugagauacgagggcagaguguaccacuacagaaucaacaccaccgccgacggcaagguguacgugaccgccgagagcagauucagcacccuggccgagcuggugcaccaccacagcaccguggccgacggccuggugaccacccugcacuaccccgcccccaagugcaacaagcccaccguguacggcgugagccccauccacgacaagugggagauggagagaaccgacaucaccaugaagcacaagcugggcggcggccaguacggcgagguguacgugggcguguggaagaaguacagccugaccguggccgugaagacccugaaggaggacaccauggagguggaggaguuccugaaggaggccgccgugaugaaggagaucaagcaccccaaccuggugcagcugcugggcgugugcacccuggagccccccuucuacaucgugaccgaguacaugcccuacggcaaccugcuggacuaccugagagagugcaacagagaggaggugaccgccguggugcugcuguacauggccacccagaucagcagcgccauggaguaccuggagaagaagaacuucauccacagagaccuggccgccagaaacugccuggugggcgagaaccacguggugaagguggccgacuucggccugagcagacugaugaccggcgacaccuacaccgcccacgccggcgccaaguuccccaucaaguggaccgcccccgagagccuggccuacaacaccuucagcaucaagagcgacgugugggccuucggcgugcugcugugggagaucgccaccuacggcaugagccccuaccccggcaucgaccugagccagguguacgaccugcuggagaagggcuacagaauggagcagcccgagggcugcccccccaagguguacgagcugaugagagccugcuggaaguggagccccgccgacagacccagcuucgccgagacccaccaggccuucgagaccauguuccacgacagcagcaucagcgaggagguggccgaggagcugggcagagccgccagcagcagcagcguggugcccuaccugcccagacugcccauccugcccagcaagaccagaacccugaagaagcagguggagaacaaggagaacaucgagggcgcccaggacgccaccgagaacagcgccagcagccuggcccccggcuucaucagaggcgcccaggccagcagcggcagccccgcccugcccagaaagcagagagacaagagccccagcagccugcuggaggacgccaaggagaccugcuucaccagagacagaaagggcggcuucuucagcagcuucaugaagaagagaaacgcccccaccccccccaagagaagcagcagcuucagagagauggagaaccagccccacaagaaguacgagcugaccggccugcccgagcaggacagaauggccaugacccugcccagaaacugccagagaagcaagcugcagcuggagagaaccgugagcaccagcagccagcccgaggagaacguggacagagccaacgacaugcugcccaagaagagcgaggagagcgccgcccccagcagagagagacccaaggccaagcugcugcccagaggcgccaccgcccugccccugagaacccccagcggcgaccuggccaucaccgagaaggacccccccggcgugggcguggccggcguggccgccgcccccaagggcaaggagaagaacggcggcgccagacugggcauggccggcgugcccgaggacggcgagcagcccggcuggcccagccccgccaaggccgcccccgugcugcccaccacccacaaccacaaggugcccgugcugaucagccccacccugaagcacacccccgccgacgugcagcugaucggcaccgacagccagggcaacaaguucaagcugcugagcgagcaccaggugaccagcagcggcgacaaggacagacccagaagagugaagcccaagugcgcccccccccccccccccgugaugagacugcugcagcaccccagcaucugcagcgaccccaccgaggagcccaccgcccugaccgccggccagagcaccagcgagacccaggagggcggcaagaaggccgcccugggcgccgugcccaucagcggcaaggccggcagacccgugaugccccccccccaggugccccugcccaccagcagcaucagccccgccaagauggccaacggcaccgccggcaccaagguggcccugagaaagaccaagcaggccgccgagaagaucagcgccgacaagaucagcaaggaggcccugcuggagugcgccgaccugcugagcagcgcccugaccgagcccgugcccaacagccagcugguggacaccggccaccagcugcuggacuacugcagcggcuacguggacugcaucccccagaccagaaacaaguucgccuucagagaggccgugagcaagcuggagcugagccugcaggagcugcaggugagcagcgccgccgccggcgugcccggcaccaaccccgugcugaacaaccugcugagcugcgugcaggagaucagcgacguggugcagagauaa

SEQ ID NO: 13143 - RNA, 2157 nt, Artificial Sequence
  ABLIM1__Homo_sapiens__NP_001003407
augcugaugacccuggagaugaccgagcugaccgacccccaccacaccaugggcgacuacaagguggcccacccccaggacccccaccaccccagcgagaagcccgugauccacugccacaagugcggcgagcccugcaagggcgaggugcugagagugcagaccaagcacuuccacaucaagugcuucaccugcaaggugugcggcugcgaccuggcccagggcggcuucuucaucaagaacggcgaguaccugugcacccuggacuaccagagaauguacggcaccagaugccacggcugcggcgaguucguggagggcgagguggugaccgcccugggcaagaccuaccaccccaacugcuucgccugcaccaucugcaagagacccuucccccccggcgacagagugaccuucaacggcagagacugccugugccagcugugcgcccagcccaugagcagcagccccaaggagaccaccuucagcagcaacugcgccggcugcggcagagacaucaagaacggccaggcccugcuggcccuggacaagcaguggcaccugggcugcuucaagugcaagagcugcggcaaggugcugaccggcgaguacaucagcaaggacggcgcccccuacugcgagaaggacuaccagggccuguucggcgugaagugcgaggccugccaccaguucaucaccggcaaggugcuggaggccggcgacaagcacuaccaccccagcugcgccagaugcagcagaugcaaccagauguucaccgagggcgaggagauguaccugcagggcagcaccguguggcaccccgacugcaagcagagcaccaagaccgaggagaagcugagacccaccagaaccagcagcgagagcaucuacagcagacccggcagcagcauccccggcagccccggccacaccaucuacgccaagguggacaacgagauccuggacuacaaggaccuggccgccauccccaaggugaaggccaucuacgacaucgagagacccgaccugaucaccuacgagcccuucuacaccagcggcuacgacgacaagcaggagagacagagccugggcgagagccccagaacccugagccccacccccagcgccgagggcuaccaggacgugagagacagaaugauccacagaagcaccagccagggcagcaucaacagccccguguacagcagacacagcuacacccccaccaccagcagaagcccccagcacuuccacagacccggcaacgagcccagcagcggcagaaacagcccccugcccuacagacccgacagcagaccccugacccccaccuacgcccaggcccccaagcacuuccacgugcccgaccagggcaucaacaucuacagaaagccccccaucuacaagcagcacgccgcccuggccgcccagagcaagagcagcgaggacaucaucaaguucagcaaguuccccgccgcccaggcccccgaccccagcgagacccccaagaucgagaccgaccacuggcccggcccccccagcuucgccguggugggccccgacaugaagagaagaagcagcggcagagaggaggacgacgaggagcugcugagaagaagacagcugcaggaggagcagcugaugaagcugaacagcggccugggccagcugauccugaaggaggagauggagaaggagagcagagagagaagcagccugcuggccagcagauacgacagccccaucaacagcgccagccacauccccagcagcaagaccgccagccugcccggcuacggcagaaacggccugcacagacccgugagcaccgacuucgcccaguacaacagcuacggcgacgugagcggcggcgugagagacuaccagacccugcccgacggccacaugcccgccaugagaauggacagaggcgugagcaugcccaacaugcuggagcccaagaucuuccccuacgagaugcugauggugaccaacagaggcagaaacaagauccugagagagguggacagaaccagacuggagagacaccuggcccccgagguguucagagagaucuucggcaugagcauccaggaguucgacagacugccccuguggagaagaaacgacaugaagaagaaggccaagcuguucuaa

SEQ ID NO: 13144 - RNA, 1938 nt, Artificial Sequence
  ABLIM2__Homo_sapiens__NP_001123555
augagcgccgugagccagccccaggccgcccccagcccccuggagaagagccccagcaccgccauccugugcaacaccugcggcaacgugugcaagggcgaggugcugagagugcaggacaaguacuuccacaucaagugcuucgugugcaaggccugcggcugcgaccuggccgagggcggcuucuucgugagacagggcgaguacaucugcacccuggacuaccagagacuguacggcaccagaugcuucagcugcgaccaguucaucgagggcgagguggugagcgcccugggcaagaccuaccaccccgacugcuucgugugcgccgugugcagacugcccuucccccccggcgacagagugaccuucaacggcaaggagugcaugugccagaagugcagccugcccgugagcgugggcagcagcgcccaccugagccagggccugagaagcugcggcggcugcggcaccgagaucaagaacggccaggcccugguggcccuggacaagcacuggcaccugggcugcuucaagugcaagagcugcggcaagcugcugaacgccgaguacaucagcaaggacggccugcccuacugcgaggccgacuaccacgccaaguucggcaucagaugcgacagcugcgagaaguacaucaccggcagagugcuggaggccggcgagaagcacuaccaccccagcugcgcccugugcgugagaugcggccagauguucgccgagggcgaggagauguaccugcagggcagcagcaucuggcaccccgccugcagacaggccgccagaaccgaggacagaaacaaggagaccagaaccagcagcgagagcaucaucagcgugcccgccagcagcaccagcggcagccccagcagagugaucuacgccaagcugggcggcgagauccuggacuacagagaccuggccgcccugcccaagagcaaggccaucuacgacaucgacagacccgacaugaucagcuacagccccuacaucagccacagcgccggcgacagacagagcuacggcgagggcgaccaggacgacagaagcuacaagcagugcagaaccagcagccccagcagcaccggcagcgugagccugggcagauacacccccaccagcagaagcccccagcacuacagcagacccgccggcaccgugagcgugggcaccagcagcugccugagccugagccagcaccccagccccaccagcguguucagacaccacuacauccccuacuucagaggcagcgagagcggcagaagcacccccagccugagcgugcugagcgacagcaagcccccccccagcaccuaccagcaggcccccagacacuuccacgugcccgacaccggcgugaaggacaacaucuacagaaagccccccaucuacagacagcacgccgccagaagaagcgacggcgaggacggcagccuggaccaggacaacagaaagcagaagagcagcuggcugaugcugaagggcgacgccgacaccagaaccaacagccccgaccuggacacccagagccugagccacagcagcggcaccgacagagacccccugcagagaauggccggcgacagcuuccacagcagauuccccuacagcaagagcgacccccugcccggccacggcaagaacggccuggaccagagaaacgccaaccuggcccccugcggcgccgaccccgacgccagcuggggcaugagagaguacaagaucuaccccuacgacagccugaucgugaccaacagaaucagagugaagcugcccaaggacguggacagaaccagacuggagagacaccugagccccgaggaguuccaggagguguucggcaugagcaucgaggaguucgacagacuggcccuguggaagagaaacgaccugaagaagaaggcccugcuguucuaa

SEQ ID NO: 13145 - RNA, 1065 nt, Artificial Sequence
  ABO__Homo_sapiens__NP_065202
auggccgaggugcugagaacccuggccggcaagcccaagugccacgcccugagacccaugauccuguuccugaucaugcuggugcuggugcuguucggcuacggcgugcugagccccagaagccugaugcccggcagccuggagagaggcuucugcauggccgugagagagcccgaccaccugcagagagugagccugcccagaaugguguacccccagcccaaggugcugacccccugcagaaaggacgugcugguggugacccccuggcuggcccccaucgugugggagggcaccuucaacaucgacauccugaacgagcaguucagacugcagaacaccaccaucggccugaccguguucgccaucaagaaguacguggccuuccugaagcuguuccuggagaccgccgagaagcacuucauggugggccacagagugcacuacuacguguucaccgaccagcccgccgccgugcccagagugacccugggcaccggcagacagcugagcgugcuggaggugagagccuacaagagauggcaggacgugagcaugagaagaauggagaugaucagcgacuucugcgagagaagauuccugagcgagguggacuaccuggugugcguggacguggacauggaguucagagaccacgugggcguggagauccugaccccccuguucggcacccugcaccccggcuucuacggcagcagcagagaggccuucaccuacgagagaagaccccagagccaggccuacauccccaaggacgagggcgacuucuacuaccugggcggcuucuucggcggcagcgugcaggaggugcagagacugaccagagccugccaccaggccaugaugguggaccaggccaacggcaucgaggccguguggcacgacgagagccaccugaacaaguaccugcugagacacaagcccaccaaggugcugagccccgaguaccugugggaccagcagcugcugggcuggcccgccgugcugagaaagcugagauucaccgccgugcccaagaaccaccaggccgugagaaaccccuaa

SEQ ID NO: 13146 - RNA, 1146 nt, Artificial Sequence
  ABRA__Homo_sapiens__NP_631905
auggcccccggcgagaaggagagcggcgagggccccgccaagagcgcccugagaaagaucagaaccgccacccuggugaucagccuggccagaggcuggcagcagugggccaacgagaacagcaucagacaggcccaggagcccaccggcuggcugcccggcggcacccaggacagcccccaggcccccaagcccaucaccccccccaccagccaccagaaggcccagagcgcccccaagagcccccccagacugcccgagggccacggcgacggccagagcagcgagaaggcccccgaggugagccacaucaagaagaaggaggugagcaagaccguggugagcaagaccuacgagagaggcggcgacgugagccaccugagccacagauacgagagagacgccggcgugcuggagcccggccagcccgagaacgacaucgacagaauccugcacagccacggcagccccaccagaagaagaaagugcgccaaccuggugagcgagcugaccaagggcuggagagugauggagcaggaggagcccaccuggagaagcgacagcguggacaccgaggacagcggcuacggcggcgaggccgaggagagacccgagcaggacggcgugcagguggccguggugagaaucaagagaccccugcccagccaggugaacagauucaccgagaagcugaacugcaaggcccagcagaaguacagccccgugggcaaccugaagggcagauggcagcagugggccgacgagcacauccagagccagaagcugaaccccuucagcgaggaguucgacuacgagcuggccaugagcaccagacugcacaagggcgacgagggcuacggcagacccaaggagggcaccaagaccgccgagagagccaagagagccgaggagcacaucuacagagagaugauggacaugugcuucaucaucugcaccauggccagacacagaagagacggcaagauccaggugaccuucggcgaccuguucgacagauacgugagaaucagcgacaagguggugggcauccugaugagagccagaaagcacggccugguggacuucgagggcgagaugcuguggcagggcagagacgaccacguggugaucacccugcugaaguaa

SEQ ID NO: 13147 - RNA, 2442 nt, Artificial Sequence
  ABR__Homo_sapiens__NP_001153218
augcccuacaucgacgagagccccaccaugagcccccagcugagcgccagaagccagggcggcggcgacggcgugagccccaccccccccgagggccuggcccccggcguggaggccggcaagggccuggagaugagaaagcuggugcugagcggcuuccuggccagcgaggagaucuacaucaaccagcuggaggcccugcugcugcccaugaagccccugaaggccaccgccaccaccagccagcccgugcugaccauccagcagaucgagaccaucuucuacaagauccaggacaucuacgagauccacaaggaguucuacgacaaccugugccccaaggugcagcagugggacagccaggugaccaugggccaccuguuccagaagcuggccagccagcugggcguguacaaggccuucguggacaacuacaagguggcccuggagaccgccgagaagugcagccagagcaacaaccaguuccagaagaucagcgaggagcugaaggugaagggccccaaggacagcaaggacagccacaccagcgugaccauggaggcccugcuguacaagcccaucgacagagugaccagaagcacccuggugcugcacgaccugcugaagcacacccccguggaccaccccgacuacccccugcugcaggacgcccugagaaucagccagaacuuccugagcagcaucaacgaggacaucgaccccagaagaaccgccgugaccacccccaagggcgagaccagacagcuggugaaggacggcuuccugguggaggugagcgagagcagcagaaagcugagacacguguuccuguucaccgacgugcugcugugcgccaagcugaagaagaccagcgccggcaagcaccagcaguacgacugcaagugguacaucccccuggccgaccugguguuccccagccccgaggagagcgaggccagcccccaggugcaccccuuccccgaccacgagcuggaggacaugaagaugaagaucagcgcccugaagagcgagauccagaaggagaaggccaacaagggccagagcagagccaucgagagacugaagaagaagauguucgagaacgaguuccugcugcugcugaacagccccaccauccccuucagaauccacaacagaaacggcaagagcuaccuguuccugcugagcagcgacuacgagagaagcgaguggagagaggccauccagaagcugcagaagaaggaccugcaggccuucgugcugagcagcguggagcugcaggugcugaccggcagcugcuucaagcugagaaccgugcacaacauccccgugaccagcaacaaggacgacgacgagagccccggccuguacggcuuccugcacgugaucgugcacagcgccaagggcuucaagcagagcgccaaccuguacugcacccuggagguggacagcuucggcuacuucgugagcaaggccaagaccagaguguucagagacaccgccgagcccaagugggacgaggaguucgagaucgagcuggagggcagccagagccugagaauccugugcuacgagaagugcuacgacaagaccaaggugaacaaggacaacaacgagaucguggacaagaucaugggcaagggccagauccagcuggacccccagaccguggagaccaagaacuggcacaccgacgugaucgagaugaacggcaucaagguggaguucagcaugaaguucaccagcagagacaugagccugaagagaacccccagcaagaagcagaccggcguguucggcgugaagaucagcguggugaccaagagagagagaagcaaggugcccuacaucgugagacagugcguggaggagguggagaagagaggcaucgaggaggugggcaucuacagaaucagcggcguggccaccgacauccaggcccugaaggccguguucgacgccaacaacaaggacauccugcugaugcugagcgacauggacaucaacgccaucgccggcacccugaagcuguacuucagagagcugcccgagccccugcugaccgacagacuguaccccgccuucauggagggcaucgcccugagcgaccccgccgccaaggagaacugcaugaugcaccugcugagaagccugcccgaccccaaccugaucaccuuccuguuccugcuggagcaccugaagagaguggccgagaaggagcccaucaacaagaugagccugcacaaccuggccaccguguucggccccacccugcugagacccagcgagguggagagcaaggcccaccugaccagcgccgccgacaucuggagccacgacgugauggcccaggugcaggugcugcuguacuaccugcagcacccccccaucagcuucgccgagcugaagagaaacacccuguacuucagcaccgacguguaa

SEQ ID NO: 13148 - RNA, 819 nt, Artificial Sequence
  ABT1__Homo_sapiens__NP_037507
auggaggccgaggagagcgagaaggccgccaccgagcaggagccccuggagggcaccgagcagacccuggacgccgaggaggagcaggaggagagcgaggaggccgccugcggcagcaagaagagaguggugcccggcaucguguaccugggccacaucccccccagauucagaccccugcacgugagaaaccugcugagcgccuacggcgaggugggcagaguguucuuccaggccgaggacagauucgugagaagaaagaagaaggccgccgccgccgccggcggcaagaagagaagcuacaccaaggacuacaccgagggcuggguggaguucagagacaagagaaucgccaagagaguggccgccagccugcacaacacccccaugggcgccagaagaagaagccccuucagauacgaccuguggaaccugaaguaccugcacagauucaccuggagccaccugagcgagcaccuggccuucgagagacaggugagaagacagagacugagagccgagguggcccaggccaagagagagaccgacuucuaccugcagagcguggagagaggccagagauuccuggccgccgacggcgaccccgccagacccgacggcagcuggaccuucgcccagagacccaccgagcaggagcugagagccagaaaggccgccagacccggcggcagagagagagccagacuggccaccgcccaggacaaggccagaagcaacaagggccugcuggccagaaucuucggcgcccccccccccagcgagagcauggagggccccagccuggugagagacagcuaa

SEQ ID NO: 13149 - RNA, 996 nt, Artificial Sequence
  ACAA1__Homo_sapiens__NP_001123882
augcagagacugcagguggugcugggccaccugagaggccccgccgacagcggcuggaugccccaggccgcccccugccugagcggcgccccccaggccagcgccgccgacguggugguggugcacggcagaagaaccgccaucugcagagccggcagaggcggcuucaaggacaccacccccgacgagcugcugagcgccgugaugaccgccgugcugaaggacgugaaccugagacccgagcagcugggcgacaucugcgugggcaacgugcugcagcccggcgccggcgccaucauggccagaaucgcccaguuccugagcgacauccccgagaccgugccccugagcaccgugaacagacagugcagcagcggccugcaggccguggccagcaucgccggcggcaucagaaacggcagcuacgacaucggcauggccugcggcaucaccagcgagaacguggccgagagauucggcaucagcagagagaagcaggacaccuucgcccuggccagccagcagaaggccgccagagcccagagcaagggcugcuuccaggccgagaucgugcccgugaccaccaccgugcacgacgacaagggcaccaagagaagcaucaccgugacccaggacgagggcaucagacccagcaccaccauggagggccuggccaagcugaagcccgccuucaagaaggacggcagcaccaccgccggccugaccgugagcgacguggacaucuucgagaucaacgaggccuucgccagccaggccgccuacugcguggagaagcugagacugccccccgagaaggugaacccccugggcggcgccguggcccugggccacccccugggcugcaccggcgccagacaggugaucacccugcugaacgagcugaagagaagaggcaagagagccuacggcguggugagcaugugcaucggcaccggcaugggcgccgccgccguguucgaguaccccggcaacuaa

SEQ ID NO: 13150 - RNA, 1194 nt, Artificial Sequence
  ACAA2__Homo_sapiens__NP_006102
auggcccugcugagaggcguguucgugguggccgccaagagaacccccuucggcgccuacggcggccugcugaaggacuucaccgccaccgaccugagcgaguucgccgccaaggccgcccugagcgccggcaaggugagccccgagaccguggacagcgugaucaugggcaacgugcugcagagcagcagcgacgccaucuaccuggccagacacgugggccugagagugggcauccccaaggagacccccgcccugaccaucaacagacugugcggcagcggcuuccagagcaucgugaacggcugccaggagaucugcgugaaggaggccgagguggugcugugcggcggcaccgagagcaugagccaggcccccuacugcgugagaaacgugagauucggcaccaagcugggcagcgacaucaagcuggaggacagccugugggugagccugaccgaccagcacgugcagcugcccauggccaugaccgccgagaaccuggccgugaagcacaagaucagcagagaggagugcgacaaguacgcccugcagagccagcagagauggaaggccgccaacgacgccggcuacuucaacgacgagauggcccccaucgaggugaagaccaagaagggcaagcagaccaugcagguggacgagcacgccagaccccagaccacccuggagcagcugcagaagcugccccccguguucaagaaggacggcaccgugaccgccggcaacgccagcggcguggccgacggcgccggcgccgugaucaucgccagcgaggacgccgugaagaagcacaacuucaccccccuggccagaaucgugggcuacuucgugagcggcugcgaccccagcaucaugggcaucggccccgugcccgccaucagcggcgcccugaagaaggccggccugagccugaaggacauggaccugguggaggugaacgaggccuucgccccccaguaccuggccguggagagaagccuggaccuggacaucagcaagaccaacgugaacggcggcgccaucgcccugggccacccccugggcggcagcggcagcagaaucaccgcccaccuggugcacgagcugagaagaagaggcggcaaguacgccgugggcagcgccugcaucggcggcggccagggcaucgccgugaucauccagagcaccgccuaa

SEQ ID NO: 13151 - RNA, 7152 nt, Artificial Sequence
  ACACA__Homo_sapiens__NP_942131
augugguggagcacccugaugagcauccugagagccagaagcuucuggaaguggaucagcacccagaccgugagaaucaucagagccgugagagcccacuucggcggcaucauggacgagcccagcccccuggcccagccccuggagcugaaccagcacagcagauucaucaucggcagcgugagcgaggacaacagcgaggacgagaucagcaaccuggugaagcuggaccugcuggaggagaaggagggcagccugagccccgccagcgugggcagcgacacccugagcgaccugggcaucagcagccugcaggacggccuggcccugcacaucagaagcagcaugagcggccugcaccuggugaagcagggcagagacagaaagaagaucgacagccagagagacuucaccguggccagccccgccgaguucgugaccagauucggcggcaacaaggugaucgagaaggugcugaucgccaacaacggcaucgccgccgugaagugcaugagaagcaucagaagauggagcuacgagauguucagaaacgagagagccaucagauucguggugauggugacccccgaggaccugaaggccaacgccgaguacaucaagauggccgaccacuacgugcccgugcccggcggccccaacaacaacaacuacgccaacguggagcugauccuggacaucgccaagagaauccccgugcaggccgugugggccggcuggggccacgccagcgagaaccccaagcugcccgagcugcugcugaagaacggcaucgccuucaugggcccccccagccaggccaugugggcccugggcgacaagaucgccagcagcaucguggcccagaccgccggcauccccacccugcccuggagcggcagcggccugagaguggacuggcaggagaacgacuucagcaagagaauccugaacgugccccaggagcuguacgagaagggcuacgugaaggacguggacgacggccugcaggccgccgaggaggugggcuaccccgugaugaucaaggccagcgagggcggcggcggcaagggcaucagaaaggugaacaacgccgacgacuuccccaaccuguucagacaggugcaggccgaggugcccggcagccccaucuucgugaugagacuggccaagcagagcagacaccuggaggugcagauccuggccgaccaguacggcaacgccaucagccuguucggcagagacugcagcgugcagagaagacaccagaagaucaucgaggaggcccccgccaccaucgccacccccgccguguucgagcacauggagcagugcgccgugaagcuggccaagauggugggcuacgugagcgccggcaccguggaguaccuguacagccaggacggcagcuucuacuuccuggagcugaaccccagacugcagguggagcaccccugcaccgagaugguggccgacgugaaccugcccgccgcccagcugcagaucgccaugggcaucccccuguacagaaucaaggacaucagaaugauguacggcgugagccccuggggcgacagccccaucgacuucgaggacagcgcccacgugcccugccccagaggccacgugaucgccgccagaaucaccagcgagaaccccgacgagggcuucaagcccagcagcggcaccgugcaggagcugaacuucagaagcaacaagaacguguggggcuacuucagcguggccgccgccggcggccugcacgaguucgccgacagccaguucggccacugcuucagcuggggcgagaacagagaggaggccaucagcaacauggugguggcccugaaggagcugagcaucagaggcgacuucagaaccaccguggaguaccugaucaagcugcuggagaccgagagcuuccagaugaacagaaucgacaccggcuggcuggacagacugaucgccgagaaggugcaggccgagagacccgacaccaugcugggcguggugugcggcgcccugcacguggccgacgugagccugagaaacagcgugagcaacuuccugcacagccuggagagaggccaggugcugcccgcccacacccugcugaacaccguggacguggagcugaucuacgagggcgugaaguacgugcugaaggugaccagacagagccccaacagcuacguggugaucaugaacggcagcugcguggagguggacgugcacagacugagcgacggcggccugcugcugagcuacgacggcagcagcuacaccaccuacaugaaggaggagguggacagauacagaaucaccaucggcaacaagaccugcguguucgagaaggagaacgaccccagcgugaugagaagccccagcgccggcaagcugauccaguacaucguggaggacggcggccacguguucgccggccagugcuacgccgagaucgaggugaugaagauggugaugacccugaccgccguggagagcggcugcauccacuacgugaagagacccggcgccgcccuggaccccggcugcgugcuggccaagaugcagcuggacaaccccagcaaggugcagcaggccgagcugcacaccggcagccugcccagaauccagagcaccgcccugagaggcgagaagcugcacagaguguuccacuacgugcuggacaaccuggugaacgugaugaacggcuacugccugcccgaccccuucuucagcagcaaggugaaggacuggguggagagacugaugaagacccugagagaccccagccugccccugcuggagcugcaggacaucaugaccagcgugagcggcagaaucccccccaacguggagaagagcaucaagaaggagauggcccaguacgccagcaacaucaccagcgugcugugccaguuccccagccagcagaucgccaacauccuggacagccacgccgccacccugaacagaaagagcgagagagagguguucuucaugaacacccagagcaucgugcagcuggugcagagauacagaagcggcaucagaggccacaugaaggccguggugauggaccugcugagacaguaccugagaguggagacccaguuccagaacggccacuacgacaagugcguguucgcccugagagaggagaacaagagcgacaugaacaccgugcugaacuacaucuucagccacgcccaggugaccaagaagaaccugcuggugaccaugcugaucgaccagcugugcggcagagaccccacccugaccgacgagcugcugaacauccugaccgagcugacccagcugagcaagaccaccaacgccaagguggcccugagagccagacaggugcugaucgccagccaccugcccagcuacgagcugagacacaaccagguggagagcaucuuccugagcgccaucgacauguacggccaccaguucugcaucgagaaccugcagaagcugauccugagcgagaccagcaucuucgacgugcugcccaacuucuucuaccacagcaaccagguggugagaauggccgcccuggagguguacgugagaagagccuacaucgccuacgagcugaacagcgugcagcacagacagcugaaggacaacaccugcgugguggaguuccaguucaugcugcccaccagccaccccaacagaggcaacauccccacccugaacagaaugagcuucagcagcaaccugaaccacuacggcaugacccacguggccagcgugagcgacgugcugcuggacaacagcuucaccccccccugccagagaaugggcggcauggugagcuucagaaccuucgaggacuucgugagaaucuucgacgaggugaugggcugcuucagcgacagccccccccagagccccaccuuccccgaggccggccacaccagccuguacgacgaggacaaggugcccagagacgagcccauccacauccugaacguggccaucaagaccgacugcgacaucgaggacgacagacuggccgccauguucagagaguucacccagcagaacaaggccacccugguggaccacggcaucagaagacugaccuuccugguggcccagaaggacuucagaaagcaggugaacuacgagguggacagaagauuccacagagaguuccccaaguucuucaccuucagagccagagacaaguucgaggaggacagaaucuacagacaccuggagcccgcccuggccuuccagcuggagcugaacagaaugagaaacuucgaccugaccgccauccccugcgccaaccacaagaugcaccuguaccugggcgccgccaagguggaggugggcaccgaggugaccgacuacagauucuucgugagagccaucaucagacacagcgaccuggugaccaaggaggccagcuucgaguaccugcagaacgagggcgagagacugcugcuggaggccauggacgagcuggagguggccuucaacaacaccaacgugagaaccgacugcaaccacaucuuccugaacuucgugcccaccgugaucauggaccccagcaagaucgaggagagcgugagaagcauggugaugagauacggcagcagacuguggaagcugagagugcugcaggccgagcugaagaucaacaucagacugacccccaccggcaaggccauccccaucagacuguuccugaccaacgagagcggcuacuaccuggacaucagccuguacaaggaggugaccgacagcagaaccgcccagaucauguuccaggccuacggcgacaagcagggcccccugcacggcaugcugaucaacacccccuacgugaccaaggaccugcugcagagcaagagauuccaggcccagagccugggcaccaccuacaucuacgacauccccgagauguucagacagagccugaucaagcugugggagagcaugagcacccaggccuuccugcccagccccccccugcccagcgacaugcugaccuacaccgagcuggugcuggacgaccagggccagcuggugcacaugaacagacugcccggcggcaacgagaucggcaugguggccuggaagaugaccuucaagagccccgaguaccccgagggcagagacaucaucgugaucggcaacgacaucaccuacagaaucggcagcuucggcccccaggaggaccugcuguuccugagagccagcgagcuggccagagccgagggcauccccagaaucuacgugagcgccaacagcggcgccagaaucggccuggccgaggagaucagacacauguuccacguggccuggguggaccccgaggaccccuacaagggcuacagauaccuguaccugaccccccaggacuacaagagagugagcgcccugaacagcgugcacugcgagcacguggaggacgagggcgagagcagauacaagaucaccgacaucaucggcaaggaggagggcaucggccccgagaaccugagaggcagcggcaugaucgccggcgagagcagccuggccuacaacgagaucaucaccaucagccuggugaccugcagagccaucggcaucggcgccuaccuggugagacugggccagagaaccauccagguggagaacagccaccugauccugaccggcgccggcgcccugaacaaggugcugggcagagagguguacaccagcaacaaccagcugggcggcauccagaucaugcacaacaacggcgugacccacugcaccgugugcgacgacuucgagggcguguucaccgugcugcacuggcugagcuacaugcccaagagcgugcacagcagcgugccccugcugaacagcaaggaccccaucgacagaaucaucgaguucgugcccaccaagacccccuacgaccccagauggaugcuggccggcagaccccaccccacccagaagggccaguggcugagcggcuucuucgacuacggcagcuucagcgagaucaugcagcccugggcccagaccgugguggugggcagagccagacugggcggcauccccgugggcgugguggccguggagaccagaaccguggagcugagcauccccgccgaccccgccaaccuggacagcgaggccaagaucauccagcaggccggccaggugugguuccccgacagcgccuucaagaccuaccaggccaucaaggacuucaacagagagggccugccccugaugguguucgccaacuggagaggcuucagcggcggcaugaaggacauguacgaccaggugcugaaguucggcgccuacaucguggacggccugagagagugcugccagcccgugcugguguacauccccccccaggccgagcugagaggcggcagcuggguggugaucgacagcagcaucaaccccagacacauggagauguacgccgacagagagagcagaggcagcgugcuggagcccgagggcaccguggagaucaaguucagaagaaaggaccuggugaagaccaugagaagaguggaccccguguacauccaccuggccgagagacugggcacccccgagcugagcaccgccgagagaaaggagcuggagaacaagcugaaggagagagaggaguuccugauccccaucuaccaccagguggccgugcaguucgccgaccugcacgacacccccggcagaaugcaggagaagggcgugaucagcgacauccuggacuggaagaccagcagaaccuucuucuacuggagacugagaagacugcugcuggaggaccuggugaagaagaagauccacaacgccaaccccgagcugaccgacggccagauccaggccaugcugagaagaugguucguggagguggagggcaccgugaaggccuacgugugggacaacaacaaggaccuggccgaguggcuggagaagcagcugaccgaggaggacggcgugcacagcgugaucgaggagaacaucaagugcaucagcagagacuacgugcugaagcagaucagaagccuggugcaggccaaccccgagguggccauggacagcaucauccacaugacccagcacaucagccccacccagagagccgaggugaucagaauccugagcaccauggacagccccagcaccuaa

SEQ ID NO: 13152 - RNA, 7377 nt, Artificial Sequence
  ACACB__Homo_sapiens__XP_011536564
auggugcugcugcugugccugagcugccugaucuucagcugccugaccuucagcuggcugaagaucuggggcaagaugaccgacagcaagcccaucaccaagagcaagagcgaggccaaccugauccccagccaggagcccuuccccgccagcgacaacagcggcgagaccccccagagaaacggcgagggccacacccugcccaagacccccagccaggccgagcccgccagccacaagggccccaaggacgccggcagaagaagaaacagccugccccccagccaccagaagccccccagaaacccccugagcagcagcgacgccgcccccagccccgagcugcaggccaacggcaccggcacccagggccuggaggccaccgacaccaacggccugagcagcagcgccagaccccagggccagcaggccggcagccccagcaaggaggacaagaagcaggccaacaucaagagacagcugaugaccaacuucauccugggcagcuucgacgacuacagcagcgacgaggacagcguggccggcagcagcagagagagcaccagaaagggcagcagagccagccugggcgcccugagccuggaggccuaccugaccaccggcgaggccgagaccagagugcccaccaugagacccagcaugagcggccugcaccuggugaagagaggcagagagcacaagaagcuggaccugcacagagacuucaccguggccagccccgccgaguucgugaccagauucggcggcgacagagugaucgagaaggugcugaucgccaacaacggcaucgccgccgugaagugcaugagaagcaucagaagaugggccuacgagauguucagaaacgagagagccaucagauucguggugauggugacccccgaggaccugaaggccaacgccgaguacaucaagauggccgaccacuacgugcccgugcccggcggccccaacaacaacaacuacgccaacguggagcugaucguggacaucgccaagagaauccccgugcaggccgugugggccggcuggggccacgccagcgagaaccccaagcugcccgagcugcugugcaagaacggcguggccuuccugggcccccccagcgaggccaugugggcccugggcgacaagaucgccagcaccgugguggcccagacccugcaggugcccacccugcccuggagcggcagcggccugaccguggaguggaccgaggacgaccugcagcagggcaagagaaucagcgugcccgaggacguguacgacaagggcugcgugaaggacguggacgagggccuggaggccgccgagagaaucggcuucccccugaugaucaaggccagcgagggcggcggcggcaagggcaucagaaaggccgagagcgccgaggacuuccccauccuguucagacaggugcagagcgagauccccggcagccccaucuuccugaugaagcuggcccagcacgccagacaccuggaggugcagauccuggccgaccaguacggcaacgccgugagccuguucggcagagacugcagcauccagagaagacaccagaagaucguggaggaggcccccgccaccaucgccccccuggccaucuucgaguucauggagcagugcgccaucagacuggccaagaccgugggcuacgugagcgccggcaccguggaguaccuguacagccaggacggcagcuuccacuuccuggagcugaaccccagacugcagguggagcaccccugcaccgagaugaucgccgacgugaaccugcccgccgcccagcugcagaucgccaugggcgugccccugcacagacugaaggacaucagacugcuguacggcgagagccccuggggcgugacccccaucagcuucgagacccccagcaaccccccccuggccagaggccacgugaucgccgccagaaucaccagcgagaaccccgacgagggcuucaagcccagcagcggcaccgugcaggagcugaacuucagaagcagcaagaacguguggggcuacuucagcguggccgccaccggcggccugcacgaguucgccgacagccaguucggccacugcuucagcuggggcgagaacagagaggaggccaucagcaacauggugguggcccugaaggagcugagcaucagaggcgacuucagaaccaccguggaguaccugaucaaccugcuggagaccgagagcuuccagaacaacgacaucgacaccggcuggcuggacuaccugaucgccgagaaggugcaggccgagaagcccgacaucaugcugggcguggugugcggcgcccugaacguggccgacgccauguucagaaccugcaugaccgacuuccugcacagccuggagagaggccaggugcugcccgccgacagccugcugaaccugguggacguggagcugaucuacggcggcgugaaguacauccugaagguggccagacagagccugaccauguucgugcugaucaugaacggcugccacaucgagaucgacgcccacagacugaacgacggcggccugcugcugagcuacaacggcaacagcuacaccaccuacaugaaggaggagguggacagcuacagaaucaccaucggcaacaagaccugcguguucgagaaggagaacgaccccaccgugcugagaagccccagcgccggcaagcugacccaguacaccguggaggacggcggccacguggaggccggcagcagcuacgccgagauggaggugaugaagaugaucaugacccugaacgugcaggagagaggcagagugaaguacaucaagagacccggcgccgugcuggaggccggcugcgugguggccagacuggagcuggacgaccccagcaaggugcaccccgccgagcccuucaccggcgagcugcccgcccagcagacccugcccauccugggcgagaagcugcaccagguguuccacagcgugcuggagaaccugaccaacgugaugagcggcuucugccugcccgagcccguguucagcaucaagcugaaggagugggugcagaagcugaugaugacccugagacaccccagccugccccugcuggagcugcaggagaucaugaccagcguggccggcagaauccccgcccccguggagaagagcgugagaagagugauggcccaguacgccagcaacaucaccagcgugcugugccaguuccccagccagcagaucgccaccauccuggacugccacgccgccacccugcagagaaaggccgacagagagguguucuucaucaacacccagagcaucgugcagcuggugcagagauacagaagcggcaucagaggcuacaugaagaccguggugcuggaccugcugagaagauaccugagaguggagcaccacuuccagcaggcccacuacgacaagugcgugaucaaccugagagagcaguucaagcccgacaugagccaggugcuggacugcaucuucagccacgcccagguggccaagaagaaccagcuggugaucaugcugaucgacgagcugugcggccccgaccccagccugagcgacgagcugaucagcauccugaacgagcugacccagcugagcaagagcgagcacugcaagguggcccugagagccagacagauccugaucgccagccaccugcccagcuacgagcugagacacaaccagguggagagcaucuuccugagcgccaucgacauguacggccaccaguucugccccgagaaccugaagaagcugauccugagcgagaccaccaucuucgacgugcugcccaccuucuucuaccacgccaacaagguggugugcauggccagccuggagguguacgugagaagaggcuacaucgccuacgagcugaacagccugcagcacagacagcugcccgacggcaccugcgugguggaguuccaguucaugcugcccagcagccaccccaacagaaugaccgugcccaucagcaucaccaaccccgaccugcugagacacagcaccgagcuguucauggacagcggcuucagcccccugugccagagaaugggcgccaugguggccuucagaagauucgaggacuucaccagaaacuucgacgaggugaucagcugcuucgccaacgugcccaaggacaccccccuguucagcgaggccagaaccagccuguacagcgaggacgacugcaagagccugagagaggagcccauccacauccugaacgugagcauccagugcgccgaccaccuggaggacgaggcccuggugcccauccugagaaccuucgugcagagcaagaagaacauccugguggacuacggccugagaagaaucaccuuccugaucgcccaggagaaggaguuccccaaguucuucaccuucagagccagagacgaguucgccgaggacagaaucuacagacaccuggagcccgcccuggccuuccagcuggagcugaacagaaugagaaacuucgaccugaccgccgugcccugcgccaaccacaagaugcaccuguaccugggcgccgccaaggugaaggagggcguggaggugaccgaccacagauucuucaucagagccaucaucagacacagcgaccugaucaccaaggaggccagcuucgaguaccugcagaacgagggcgagagacugcugcuggaggccauggacgagcuggagguggccuucaacaacaccagcgugagaaccgacugcaaccacaucuuccugaacuucgugcccaccgugaucauggaccccuucaagaucgaggagagcgugagauacauggugaugagauacggcagcagacuguggaagcugagagugcugcaggccgaggugaagaucaacaucagacagaccaccaccggcagcgccgugcccaucagacuguucaucaccaacgagagcggcuacuaccuggacaucagccuguacaaggaggugaccgacagcagaagcggcaacaucauguuccacagcuucggcaacaagcagggcccccagcacggcaugcugaucaacacccccuacgugaccaaggaccugcugcaggccaagagauuccaggcccagacccugggcaccaccuacaucuacgacuuccccgagauguucagacaggcccuguucaagcuguggggcagccccgacaaguaccccaaggacauccugaccuacaccgagcuggugcuggacagccagggccagcugguggagaugaacagacugcccggcggcaacgaggugggcaugguggccuucaagaugagauucaagacccaggaguaccccgagggcagagacgugaucgugaucggcaacgacaucaccuucagaaucggcagcuucggccccggcgaggaccugcuguaccugagagccagcgagauggccagagccgagggcauccccaagaucuacguggccgccaacagcggcgccagaaucggcauggccgaggagaucaagcacauguuccacguggccuggguggaccccgaggacccccacaagggcuucaaguaccuguaccugaccccccaggacuacaccagaaucagcagccugaacagcgugcacugcaagcacaucgaggagggcggcgagagcagauacaugaucaccgacaucaucggcaaggacgacggccugggcguggagaaccugagaggcagcggcaugaucgccggcgagagcagccuggccuacgaggagaucgugaccaucagccuggugaccugcagagccaucggcaucggcgccuaccuggugagacugggccagagagugauccagguggagaacagccacaucauccugaccggcgccagcgcccugaacaaggugcugggcagagagguguacaccagcaacaaccagcugggcggcgugcagaucaugcacuacaacggcgugagccacaucaccgugcccgacgacuucgagggcguguacaccauccuggaguggcugagcuacaugcccaaggacaaccacagccccgugcccaucaucacccccaccgaccccaucgacagagagaucgaguuccugcccagcagagcccccuacgaccccagauggaugcuggccggcagaccccaccccacccugaagggcaccuggcagagcggcuucuucgaccacggcagcuucaaggagaucauggcccccugggcccagaccguggugaccggcagagccagacugggcggcauccccgugggcgugaucgccguggagaccagaaccguggagguggccgugcccgccgaccccgccaaccuggacagcgaggccaagaucauccagcaggccggccaggugugguuccccgacagcgccuacaagaccgcccaggccgugaaggacuucaacagagagaagcugccccugaugaucuucgccaacuggagaggcuucagcggcggcaugaaggacauguacgaccaggugcugaaguucggcgccuacaucguggacggccugagacaguacaagcagcccauccugaucuacaucccccccuacgccgagcugagaggcggcagcuggguggugaucgacgccaccaucaacccccugugcaucgagauguacgccgacaaggagagcagaggcggcgugcuggagcccgagggcaccguggagaucaaguucagaaagaaggaccugaucaagagcaugagaagaaucgaccccgccuacaagaagcugauggagcagcugggcgagcccgaccugagcgacaaggacagaaaggaccuggagggcagacugaaggccagagaggaccugcugcugcccaucuaccaccagguggccgugcaguucgccgacuuccacgacacccccggcagaaugcuggagaagggcgugaucagcgacauccuggaguggaagaccgccagaaccuuccuguacuggagacugagaagacugcugcuggaggaccaggugaagcaggagauccugcaggccagcggcgagcugagccacgugcacauccagagcaugcugagaagaugguucguggagaccgagggcgccgugaaggccuaccugugggacaacaaccaggugguggugcaguggcuggagcagcacuggcaggccggcgacggccccagaagcaccaucagagagaacaucaccuaccugaagcacgacagcgugcugaagaccaucagaggccugguggaggagaaccccgagguggccguggacugcgugaucuaccugagccagcacaucagccccgccgagagagcccagguggugcaccugcugagcaccauggacagccccgccagcaccuaa

SEQ ID NO: 13153 - RNA, 3273 nt, Artificial Sequence
  ACAD10__Homo_sapiens__NP_001130010
augugcgugagaagcugcuuccagagccccagacugcaguggguguggagaaccgccuuccugaagcacacccagagaagacaccagggcagccacagauggacccaccugggcggcagcaccuacagagccgugaucuucgacaugggcggcgugcugauccccagccccggcagaguggccgccgagugggaggugcagaacagaauccccagcggcaccauccugaaggcccugauggagggcggcgagaacggccccuggaugagauucaugagagccgagaucaccgccgagggcuuccugagagaguucggcagacugugcagcgagaugcugaagaccagcgugcccguggacagcuucuucagccugcugaccagcgagagaguggccaagcaguuccccgugaugaccgaggccaucacccagaucagagccaagggccugcagaccgccgugcugagcaacaacuucuaccugcccaaccagaagagcuuccugccccuggacagaaagcaguucgacgugaucguggagagcugcauggagggcaucugcaagcccgaccccagaaucuacaagcugugccuggagcagcugggccugcagcccagcgagagcaucuuccuggacgaccugggcaccaaccugaaggaggccgccagacugggcauccacaccaucaagagacagggcuucgccgugcugcccaagcuggugagcaacagcugggcccaggccaucuacccccccuacccccccaagguggugagacugcaggugaacgaccccgagaccgccgugaaggagcuggaggcccugcugggcuucacccugagagugggcgugcccaacaccagacccgugaagaagaccauggagauccccaaggacagccugcagaaguaccugaaggaccugcugggcauccagaccaccggcccccuggagcugcugcaguucgaccacggccagagcaaccccaccuacuacaucagacuggccaacagagaccuggugcugagaaagaagccccccggcacccugcugcccagcgcccacgccaucgagagagaguucagaaucaugaaggcccuggccaacgccggcgugcccgugcccaacgugcuggaccugugcgaggacagcagcgugaucggcacccccuucuacgugauggaguacugccccggccugaucuacaaggaccccagccugcccggccuggagcccagccacagaagagccaucuacaccgccaugaacaccgugcugugcaagauccacagcguggaccugcaggccgugggccuggaggacuacggcaagcagggcgacuacauccccagacaggugagaaccugggugaagcaguacagagccagcgagaccagcaccauccccgccauggagagacugaucgaguggcugccccugcaccugcccagacagcagagaaccaccguggugcacggcgacuucagacuggacaaccugguguuccaccccgaggagcccgaggugcuggccgugcuggacugggagcugagcacccugggcgacccccuggccgacguggccuacagcugccuggcccacuaccugcccagcagcuuccccgugcugagaggcaucaacgacugcgaccugacccagcugggcauccccgccgccgaggaguacuucagaauguacugccugcagaugggccugccccccaccgagaacuggaacuucuacauggccuucagcuucuucagaguggccgccauccugcagggcguguacaagagaagccugaccggccaggccagcagcaccuacgccgagcagaccggcaagcugaccgaguucgugagcaaccuggccugggacuucgccgugaaggagggcuucagaguguucaaggagaugcccuucaccaacccccugaccagaagcuaccacaccugggccagaccccagagccaguggugccccaccggcagcagaagcuacagcagcgugcccgaggccagccccgcccacaccagcagaggcggccuggugaucagccccgagagccugagcccccccgugagagagcuguaccacagacugaagcacuucauggagcagagaguguaccccgccgagcccgagcugcagagccaccaggccagcgccgccagauggagccccagcccccugaucgaggaccugaaggagaaggccaaggccgagggccuguggaaccuguuccugccccuggaggccgaccccgagaagaaguacggcgccggccugaccaacguggaguacgcccaccugugcgagcugaugggcaccagccuguacgcccccgaggugugcaacugcagcgcccccgacaccggcaacauggagcugcuggugagauacggcaccgaggcccagaaggccagauggcugaucccccugcuggagggcaaggccagaagcugcuucgccaugaccgagccccagguggccagcagcgacgccaccaacaucgaggccagcaucagagaggaggacagcuucuacgugaucaacggccacaagugguggaucaccggcauccuggaccccagaugccagcugugcguguucaugggcaagaccgacccccacgcccccagacacagacagcagagcgugcugcuggugcccauggacacccccggcaucaagaucaucagaccccugaccguguacggccuggaggacgcccccggcggccacggcgaggugagauucgagcacgugagagugcccaaggagaacauggugcugggccccggcagaggcuucgagaucgcccagggcagacugggccccggcagaauccaccacugcaugagacugaucggcuucagcgagagagcccuggcccugaugaaggccagagugaagagcagacuggccuucggcaagccccugguggagcagggcaccgugcuggccgacaucgcccagagcagaguggagaucgagcaggccagacugcuggugcugagagccgcccaccugauggaccuggccggcaacaaggccgccgcccuggacaucgccaugaucaagaugguggcccccagcauggccagcagagugaucgacagagccauccaggccuucggcgccgccggccugagcagcgacuacccccuggcccaguucuucaccugggccagagcccugagauucgccgacggccccgacgaggugcacagagccaccguggccaagcuggagcugaagcacagaaucuaa

SEQ ID NO: 13154 - RNA, 1248 nt, Artificial Sequence
  ACAD8__Homo_sapiens__NP_055199
augcuguggagcggcugcagaagauucggcgccagacugggcugccugcccggcggccugagagugcuggugcagaccggccacagaagccugaccagcugcaucgaccccagcaugggccugaacgaggagcagaaggaguuccagaagguggccuucgacuucgccgccagagagauggcccccaacauggccgagugggaccagaaggagcuguuccccguggacgugaugagaaaggccgcccagcugggcuucggcggcguguacauccagaccgacgugggcggcagcggccugagcagacuggacaccagcgugaucuucgaggcccuggccaccggcugcaccagcaccaccgccuacaucagcauccacaacaugugcgccuggaugaucgacagcuucggcaacgaggagcagagacacaaguucugccccccccugugcaccauggagaaguucgccagcuacugccugaccgagcccggcagcggcagcgacgccgccagccugcugaccagcgccaagaagcagggcgaccacuacauccugaacggcagcaaggccuucaucagcggcgccggcgagagcgacaucuacguggugaugugcagaaccggcggccccggccccaagggcaucagcugcaucgugguggagaagggcacccccggccugagcuucggcaagaaggagaagaaggugggcuggaacagccagcccaccagagccgugaucuucgaggacugcgccgugcccguggccaacagaaucggcagcgagggccagggcuuccugaucgccgugagaggccugaacggcggcagaaucaacaucgccagcugcagccugggcgccgcccacgccagcgugauccugaccagagaccaccugaacgugagaaagcaguucggcgagccccuggccagcaaccaguaccugcaguucacccuggccgacauggccaccagacugguggccgccagacugauggugagaaacgccgccguggcccugcaggaggagagaaaggacgccguggcccugugcagcauggccaagcuguucgccaccgacgagugcuucgccaucugcaaccaggcccugcagaugcacggcggcuacggcuaccugaaggacuacgccgugcagcaguacgugagagacagcagagugcaccagauccuggagggcagcaacgaggugaugagaauccugaucagcagaagccugcugcaggaguaa

SEQ ID NO: 13155 - RNA, 1866 nt, Artificial Sequence
  ACAD9__Homo_sapiens__NP_054768
augagcggcugcggccuguuccugagaaccaccgccgccgccagagccugcagaggccugguggugagcaccgccaacagaagacugcugagaaccagcccccccgugagagccuucgccaaggagcuguuccugggcaagaucaagaagaaggagguguuccccuuccccgaggugagccaggacgagcugaacgagaucaaccaguuccugggccccguggagaaguucuucaccgaggagguggacagcagaaagaucgaccaggagggcaagauccccgacgagacccuggagaagcugaagagccugggccuguucggccugcaggugcccgaggaguacggcggccugggcuucagcaacaccauguacagcagacugggcgagaucaucagcauggacggcagcaucaccgugacccuggccgcccaccaggccaucggccugaagggcaucauccuggccggcaccgaggagcagaaggccaaguaccugcccaagcuggccagcggcgagcacaucgccgccuucugccugaccgagcccgccagcggcagcgacgccgccagcaucagaagcagagccacccugagcgaggacaagaagcacuacauccugaacggcagcaagguguggaucaccaacggcggccuggccaacaucuucaccguguucgccaagaccgaggugguggacagcgacggcagcgugaaggacaagaucaccgccuucaucguggagagagacuucggcggcgugaccaacggcaagcccgaggacaagcugggcaucagaggcagcaacaccugcgaggugcacuucgagaacaccaagauccccguggagaacauccugggcgaggugggcgacggcuucaagguggccaugaacauccugaacagcggcagauucagcaugggcagcgugguggccggccugcugaagagacugaucgagaugaccgccgaguacgccugcaccagaaagcaguucaacaagagacugagcgaguucggccugauccaggagaaguucgcccugauggcccagaaggccuacgugauggagagcaugaccuaccugaccgccggcaugcuggaccagcccggcuuccccgacugcagcaucgaggccgccauggugaagguguucagcagcgaggccgccuggcagugcgugagcgaggcccugcagauccugggcggccugggcuacaccagagacuaccccuacgagagaauccugagagacaccagaauccugcugaucuucgagggcaccaacgagauccugagaauguacaucgcccugaccggccugcagcacgccggcagaauccugaccaccagaauccacgagcugaagcaggccaaggugagcaccgugauggacaccgugggcagaagacugagagacagccugggcagaaccguggaccugggccugaccggcaaccacggcguggugcaccccagccuggccgacagcgccaacaaguucgaggagaacaccuacugcuucggcagaaccguggagacccugcugcugagauucggcaagaccaucauggaggagcagcuggugcugaagagaguggccaacauccugaucaaccuguacggcaugaccgccgugcugagcagagccagcagaagcaucagaaucggccugagaaaccacgaccacgaggugcugcuggccaacaccuucugcguggaggccuaccugcagaaccuguucagccugagccagcuggacaaguacgcccccgagaaccuggacgagcagaucaagaaggugagccagcagauccuggagaagagagccuacaucugcgcccacccccuggacagaaccugcuaa

SEQ ID NO: 13156 - RNA, 1293 nt, Artificial Sequence
  ACADL__Homo_sapiens__NP_001599
auggccgccagacugcugagaggcagccugagagugcugggcggccacagagcccccagacagcugcccgccgccagaugcagccacagcggcggcgaggagagacuggagacccccagcgccaagaagcugaccgacaucggcaucagaagaaucuucagccccgagcacgacaucuucagaaagagcgugagaaaguucuuccaggaggaggugaucccccaccacagcgagugggagaaggccggcgaggugagcagagaggugugggagaaggccggcaagcagggccugcugggcgugaacaucgccgagcaccugggcggcaucggcggcgaccuguacagcgccgccaucgugugggaggagcaggccuacagcaacugcagcggccccggcuucagcauccacagcggcaucgugaugagcuacaucaccaaccacggcagcgaggagcagaucaagcacuucaucccccagaugaccgccggcaagugcaucggcgccaucgccaugaccgagcccggcgccggcagcgaccugcagggcaucaagaccaacgccaagaaggacggcagcgacuggauccugaacggcagcaagguguucaucagcaacggcagccugagcgacguggugaucgugguggccgugaccaaccacgaggcccccagccccgcccacggcaucagccuguuccugguggagaacggcaugaagggcuucaucaagggcagaaagcugcacaagaugggccugaaggcccaggacaccgccgagcuguucuucgaggacaucagacugcccgccagcgcccugcugggcgaggagaacaagggcuucuacuacaucaugaaggagcugccccaggagagacugcugaucgccgacguggccaucagcgccagcgaguucauguucgaggagaccagaaacuacgugaagcagagaaaggccuucggcaagaccguggcccaccugcagaccgugcagcacaagcuggccgagcugaagacccacaucugcgugaccagagccuucguggacaacugccugcagcugcacgaggccaagagacuggacagcgccaccgccugcauggccaaguacugggccagcgagcugcagaacagcguggccuacgacugcgugcagcugcacggcggcuggggcuacaugugggaguaccccaucgccaaggccuacguggacgccagagugcagcccaucuacggcggcaccaacgagaucaugaaggagcugaucgccagagagaucguguucgacaaguaa

SEQ ID NO: 13157 - RNA, 1299 nt, Artificial Sequence
  ACADSB__Homo_sapiens__NP_001600
auggagggccuggccgugagacugcugagaggcagcagacugcugagaagaaacuuccugaccugccugagcagcuggaagauccccccccacgugagcaagagcagccagagcgaggcccugcugaacaucaccaacaacggcauccacuucgccccccugcagaccuucaccgacgaggagaugaugaucaagagcagcgugaagaaguucgcccaggagcagaucgccccccuggugagcaccauggacgagaacagcaagauggagaagagcgugauccagggccuguuccagcagggccugaugggcaucgagguggaccccgaguacggcggcaccggcgccagcuuccugagcaccgugcuggugaucgaggagcuggccaagguggacgccagcguggccguguucugcgagauccagaacacccugaucaacacccugaucagaaagcacggcaccgaggagcagaaggccaccuaccugccccagcugaccaccgagaaggugggcagcuucugccugagcgaggccggcgccggcagcgacagcuucgcccugaagaccagagccgacaaggagggcgacuacuacgugcugaacggcagcaagauguggaucagcagcgccgagcacgccggccuguuccuggugauggccaacguggaccccaccaucggcuacaagggcaucaccagcuuccugguggacagagacacccccggccugcacaucggcaagcccgagaacaagcugggccugagagccagcagcaccugcccccugaccuucgagaacgugaaggugcccgaggccaacauccugggccagaucggccacggcuacaaguacgccaucggcagccugaacgagggcagaaucggcaucgccgcccagaugcugggccuggcccagggcugcuucgacuacaccauccccuacaucaaggagagaauccaguucggcaagagacuguucgacuuccagggccugcagcaccagguggcccacguggccacccagcuggaggccgccagacugcugaccuacaacgccgccagacugcuggaggccggcaagcccuucaucaaggaggccagcauggccaaguacuacgccagcgagaucgccggccagaccaccagcaagugcaucgaguggaugggcggcgugggcuacaccaaggacuaccccguggagaaguacuucagagacgccaagaucggcaccaucuacgagggcgccagcaacauccagcugaacaccaucgccaagcacaucgacgccgaguacuaa

SEQ ID NO: 13158 - RNA, 1239 nt, Artificial Sequence
  ACADS__Homo_sapiens__NP_000008
auggccgccgcccugcuggccagagccagcggccccgccagaagagcccugugccccagagccuggagacagcugcacaccaucuaccagagcguggagcugcccgagacccaccagaugcugcugcagaccugcagagacuucgccgagaaggagcuguuccccaucgccgcccagguggacaaggagcaccuguuccccgccgcccaggugaagaagaugggcggccugggccugcuggccauggacgugcccgaggagcugggcggcgccggccuggacuaccuggccuacgccaucgccauggaggagaucagcagaggcugcgccagcaccggcgugaucaugagcgugaacaacagccuguaccugggccccauccugaaguucggcagcaaggagcagaagcaggccugggugacccccuucaccagcggcgacaagaucggcugcuucgcccugagcgagcccggcaacggcagcgacgccggcgccgccagcaccaccgccagagccgagggcgacagcugggugcugaacggcaccaaggccuggaucaccaacgccugggaggccagcgccgccgugguguucgccagcaccgacagagcccugcagaacaagggcaucagcgccuuccuggugcccaugcccacccccggccugacccugggcaagaaggaggacaagcugggcaucagaggcagcagcaccgccaaccugaucuucgaggacugcagaauccccaaggacagcauccugggcgagcccggcaugggcuucaagaucgccaugcagacccuggacaugggcagaaucggcaucgccagccaggcccugggcaucgcccagaccgcccuggacugcgccgugaacuacgccgagaacagaauggccuucggcgccccccugaccaagcugcaggugauccaguucaagcuggccgacauggcccuggcccuggagagcgccagacugcugaccuggagagccgccaugcugaaggacaacaagaagcccuucaucaaggaggccgccauggccaagcuggccgccagcgaggccgccaccgccaucagccaccaggccauccagauccugggcggcaugggcuacgugaccgagaugcccgccgagagacacuacagagacgccagaaucaccgagaucuacgagggcaccagcgagauccagagacuggugaucgccggccaccugcugagaagcuacagaagcuaa

SEQ ID NO: 13159 - RNA, 1968 nt, Artificial Sequence
  ACADVL__Homo_sapiens__NP_000009
augcaggccgccagaauggccgccagccugggcagacagcugcugagacugggcggcggcagcagcagacugaccgcccugcugggccagcccagacccggccccgccagaagacccuacgccggcggcgccgcccagcuggcccuggacaagagcgacagccaccccagcgacgcccugaccagaaagaagcccgccaaggccgagagcaagagcuucgccgugggcauguucaagggccagcugaccaccgaccagguguuccccuaccccagcgugcugaacgaggagcagacccaguuccugaaggagcugguggagcccgugagcagauucuucgaggaggugaacgaccccgccaagaacgacgcccuggagaugguggaggagaccaccuggcagggccugaaggagcugggcgccuucggccugcaggugcccagcgagcugggcggcgugggccugugcaacacccaguacgccagacugguggagaucgugggcaugcacgaccugggcgugggcaucacccugggcgcccaccagagcaucggcuucaagggcauccugcuguucggcaccaaggcccagaaggagaaguaccugcccaagcuggccagcggcgagaccguggccgccuucugccugaccgagcccagcagcggcagcgacgccgccagcaucagaaccagcgccgugcccagccccugcggcaaguacuacacccugaacggcagcaagcuguggaucagcaacggcggccuggccgacaucuucaccguguucgccaagacccccgugaccgaccccgccaccggcgccgugaaggagaagaucaccgccuucgugguggagagaggcuucggcggcaucacccacggcccccccgagaagaagaugggcaucaaggccagcaacaccgccgagguguucuucgacggcgugagagugcccagcgagaacgugcugggcgaggugggcagcggcuucaagguggccaugcacauccugaacaacggcagauucggcauggccgccgcccuggccggcaccaugagaggcaucaucgccaaggccguggaccacgccaccaacagaacccaguucggcgagaagauccacaacuucggccugauccaggagaagcuggccagaauggugaugcugcaguacgugaccgagagcauggccuacauggugagcgccaacauggaccagggcgccaccgacuuccagaucgaggccgccaucagcaagaucuucggcagcgaggccgccuggaaggugaccgacgagugcauccagaucaugggcggcaugggcuucaugaaggagcccggcguggagagagugcugagagaccugagaaucuucagaaucuucgagggcaccaacgacauccugagacuguucguggcccugcagggcugcauggacaagggcaaggagcugagcggccugggcagcgcccugaagaaccccuucggcaacgccggccugcugcugggcgaggccggcaagcagcugagaagaagagccggccugggcagcggccugagccugagcggccuggugcaccccgagcugagcagaagcggcgagcuggccgugagagcccuggagcaguucgccaccgugguggaggccaagcugaucaagcacaagaagggcaucgugaacgagcaguuccugcugcagagacuggccgacggcgccaucgaccuguacgccauggugguggugcugagcagagccagcagaagccugagcgagggccaccccaccgcccagcacgagaagaugcugugcgacaccuggugcaucgaggccgccgccagaaucagagagggcauggccgcccugcagagcgaccccuggcagcaggagcuguacagaaacuucaagagcaucagcaaggcccugguggagagaggcggcguggugaccagcaacccccugggcuucuaa

SEQ ID NO: 13160 - RNA, 7296 nt, Artificial Sequence
  ACAN__Homo_sapiens__NP_001126
augaccacccugcuguggguguucgugacccugagagugaucaccgccgccgugaccguggagaccagcgaccacgacaacagccugagcgugagcaucccccagcccagcccccugagagugcugcugggcaccagccugaccauccccugcuacuucaucgaccccaugcaccccgugaccaccgcccccagcaccgccccccuggcccccagaaucaaguggagcagagugagcaaggagaaggagguggugcugcugguggccaccgagggcagagugagagugaacagcgccuaccaggacaaggugagccugcccaacuaccccgccauccccagcgacgccacccuggaggugcagagccugagaagcaacgacagcggcguguacagaugcgaggugaugcacggcaucgaggacagcgaggccacccuggaggugguggugaagggcaucguguuccacuacagagccaucagcaccagauacacccuggacuucgacagagcccagagagccugccugcagaacagcgccaucaucgccacccccgagcagcugcaggccgccuacgaggacggcuuccaccagugcgacgccggcuggcuggccgaccagaccgugagauaccccauccacacccccagagagggcugcuacggcgacaaggacgaguuccccggcgugagaaccuacggcaucagagacaccaacgagaccuacgacguguacugcuucgccgaggagauggagggcgagguguucuacgccaccagccccgagaaguucaccuuccaggaggccgccaacgagugcagaagacugggcgccagacuggccaccaccggccagcuguaccuggccuggcaggccggcauggacaugugcagcgccggcuggcuggccgacagaagcgugagauaccccaucagcaaggccagacccaacugcggcggcaaccugcugggcgugagaaccguguacgugcacgccaaccagaccggcuaccccgaccccagcagcagauacgacgccaucugcuacaccggcgaggacuucguggacauccccgagaacuucuucggcgugggcggcgaggaggacaucaccgugcagaccgugaccuggcccgacauggagcugccccugcccagaaacaucaccgagggcgaggccagaggcagcgugauccugaccgugaagcccaucuucgaggugagccccagcccccuggagcccgaggagcccuucaccuucgcccccgagaucggcgccaccgccuucgccgagguggagaacgagaccggcgaggccaccagacccuggggcuuccccacccccggccugggccccgccaccgccuucaccagcgaggaccugguggugcaggugaccgccgugcccggccagccccaccugcccggcggcgugguguuccacuacagacccggccccaccagauacagccugaccuucgaggaggcccagcaggccugccugagaaccggcgccgugaucgccagccccgagcagcugcaggccgccuacgaggccggcuacgagcagugcgacgccggcuggcugagagaccagaccgugagauaccccaucgugagccccagaacccccugcgugggcgacaaggacagcagccccggcgugagaaccuacggcgugagacccagcaccgagaccuacgacguguacugcuucguggacagacuggagggcgagguguucuucgccaccagacuggagcaguucaccuuccaggaggcccuggaguucugcgagagccacaacgccacccuggccaccaccggccagcuguacgccgccuggagcagaggccuggacaagugcuacgccggcuggcuggccgacggcagccugagauaccccaucgugacccccagacccgccugcggcggcgacaagcccggcgugagaaccguguaccuguaccccaaccagaccggccugcccgacccccugagcagacaccacgccuucugcuucagaggcaucagcgccgugcccagccccggcgaggaggagggcggcacccccaccagccccagcggcguggaggaguggaucgugacccagguggugcccggcguggccgccgugcccguggaggaggagaccaccgccgugcccagcggcgagaccaccgccauccuggaguucaccaccgagcccgagaaccagaccgagugggagcccgccuacacccccgugggcaccagcccccugcccggcauccugcccaccuggccccccaccggcgccgccaccgaggagagcaccgagggccccagcgccaccgaggugcccagcgccagcgaggagcccagccccagcgaggugcccuuccccagcgaggagcccagccccagcgaggagcccuuccccagcgugagacccuuccccagcguggagcuguuccccagcgaggagcccuuccccagcaaggagcccagccccagcgaggagcccagcgccagcgaggagcccuacacccccagcccccccgugcccagcuggaccgagcugcccagcagcggcgaggagagcggcgcccccgacgugagcggcgacuucaccggcagcggcgacgugagcggccaccuggacuucagcggccagcugagcggcgacagagccagcggccugcccagcggcgaccuggacagcagcggccugaccagcaccgugggcagcggccugcccguggagagcggccugcccagcggcgacgaggagagaaucgaguggcccagcacccccaccgugggcgagcugcccagcggcgccgagauccuggagggcagcgccagcggcgugggcgaccugagcggccugcccagcggcgaggugcuggagaccagcgccagcggcgugggcgaccugagcggccugcccagcggcgaggugcuggagaccaccgcccccggcguggaggacaucagcggccugcccagcggcgaggugcuggagaccaccgcccccggcguggaggacaucagcggccugcccagcggcgaggugcuggagaccaccgcccccggcguggaggacaucagcggccugcccagcggcgaggugcuggagaccaccgcccccggcguggaggacaucagcggccugcccagcggcgaggugcuggagaccaccgcccccggcguggaggacaucagcggccugcccagcggcgaggugcuggagaccaccgcccccggcguggaggacaucagcggccugcccagcggcgaggugcuggagaccgccgcccccggcguggaggacaucagcggccugcccagcggcgaggugcuggagaccgccgcccccggcguggaggacaucagcggccugcccagcggcgaggugcuggagaccgccgcccccggcguggaggacaucagcggccugcccagcggcgaggugcuggagaccgccgcccccggcguggaggacaucagcggccugcccagcggcgaggugcuggagaccgccgcccccggcguggaggacaucagcggccugcccagcggcgaggugcuggagaccgccgcccccggcguggaggacaucagcggccugcccagcggcgaggugcuggagaccgccgcccccggcguggaggacaucagcggccugcccagcggcgaggugcuggagaccgccgcccccggcguggaggacaucagcggccugcccagcggcgaggugcuggagaccgccgcccccggcguggaggacaucagcggccugcccagcggcgaggugcuggagaccgccgcccccggcguggaggacaucagcggccugcccagcggcgaggugcuggagaccgccgcccccggcguggaggacaucagcggccugcccagcggcgaggugcuggagaccgccgcccccggcguggaggacaucagcggccugcccagcggcgaggugcuggagaccgccgcccccggcguggaggacaucagcggccugcccagcggcgaggugcuggagaccgccgcccccggcguggaggacaucagcggccugcccagcggcgaggugcuggagaccgccgcccccggcguggaggacaucagcggccugcccagcggcgaggugcuggagaccgccgcccccggcguggaggacaucagcggccugcccagcggcgaggugcuggagaccaccgcccccggcguggaggagaucagcggccugcccagcggcgaggugcuggagaccaccgcccccggcguggacgagaucagcggccugcccagcggcgaggugcuggagaccaccgcccccggcguggaggagaucagcggccugcccagcggcgaggugcuggagaccagcaccagcgccgugggcgaccugagcggccugcccagcggcggcgaggugcuggagaucagcgugagcggcguggaggacaucagcggccugcccagcggcgaggugguggagaccagcgccagcggcaucgaggacgugagcgagcugcccagcggcgagggccuggagaccagcgccagcggcguggaggaccugagcagacugcccagcggcgaggaggugcuggagaucagcgccagcggcuucggcgaccugagcggccugcccagcggcggcgagggccuggagaccagcgccagcgaggugggcaccgaccugagcggccugcccagcggcagagagggccuggagaccagcgccagcggcgccgaggaccugagcggccugcccagcggcaaggaggaccuggugggcagcgccagcggcgaccuggaccugggcaagcugcccagcggcacccugggcagcggccaggcccccgagaccagcggccugcccagcggcuucagcggcgaguacagcggcguggaccugggcagcggcccccccagcggccugcccgacuucagcggccugcccagcggcuuccccaccgugagccugguggacagcacccugguggagguggugaccgccagcaccgccagcgagcuggagggcagaggcaccaucggcaucagcggcgccggcgagaucagcggccugcccagcagcgagcuggacaucagcggcagagccagcggccugcccagcggcaccgagcugagcggccaggccagcggcagccccgacgugagcggcgagauccccggccuguucggcgugagcggccagcccagcggcuuccccgacaccagcggcgagaccagcggcgugaccgagcugagcggccugagcagcggccagcccggcaucagcggcgaggccagcggcgugcuguacggcaccagccagcccuucggcaucaccgaccugagcggcgagaccagcggcgugcccgaccugagcggccagcccagcggccugcccggcuucagcggcgccaccagcggcgugcccgaccuggugagcggcaccaccagcggcagcggcgagagcagcggcaucaccuucguggacaccagccugguggagguggcccccaccaccuucaaggaggaggagggccugggcagcguggagcugagcggccugcccagcggcgaggccgaccugagcggcaagagcggcaugguggacgugagcggccaguucagcggcaccguggacagcagcggcuucaccagccagacccccgaguucagcggccugcccagcggcaucgccgaggugagcggcgagagcagcagagccgagaucggcagcagccugcccagcggcgccuacuacggcagcggcacccccagcagcuuccccaccgugagccugguggacagaacccugguggagagcgugacccaggcccccaccgcccaggaggccggcgagggccccagcggcauccuggagcugagcggcgcccacagcggcgcccccgacaugagcggcgagcacagcggcuuccuggaccugagcggccugcagagcggccugaucgagcccagcggcgagccccccggcacccccuacuucagcggcgacuucgccagcaccaccaacgugagcggcgagagcagcguggccaugggcaccagcggcgaggccagcggccugcccgaggugacccugaucaccagcgaguucguggagggcgugaccgagcccaccaucagccaggagcugggccagagaccccccgugacccacaccccccagcuguucgagagcagcggcaaggugagcaccgccggcgacaucagcggcgccacccccgugcugcccggcagcggcguggaggugagcagcgugcccgagagcagcagcgagaccagcgccuaccccgaggccggcuucggcgccagcgccgcccccgaggccagcagagaggacagcggcagccccgaccugagcgagaccaccagcgccuuccacgaggccaaccuggagagaagcagcggccugggcgugagcggcagcacccugaccuuccaggagggcgaggccagcgccgcccccgaggugagcggcgagagcaccaccaccagcgacgugggcaccgaggcccccggccugcccagcgccacccccaccgccagcggcgacagaaccgagaucagcggcgaccugagcggccacaccagccagcugggcguggugaucagcaccagcauccccgagagcgaguggacccagcagacccagagacccgccgagacccaccuggagaucgagagcagcagccugcuguacagcggcgaggagacccacaccguggagaccgccaccagccccaccgacgccagcauccccgccagccccgaguggaagagagagagcgagagcaccgccgccgaccaggaggugugcgaggagggcuggaacaaguaccagggccacugcuacagacacuuccccgacagagagaccuggguggacgccgagagaagaugcagagagcagcagagccaccugagcagcaucgugacccccgaggagcaggaguucgugaacaacaacgcccaggacuaccaguggaucggccugaacgacagaaccaucgagggcgacuucagauggagcgacggccaccccaugcaguucgagaacuggagacccaaccagcccgacaacuucuucgccgccggcgaggacugcguggugaugaucuggcacgagaagggcgaguggaacgacgugcccugcaacuaccaccugcccuucaccugcaagaagggcaccgccaccaccuacaagagaagacugcagaagagaagcagcagacaccccagaagaagcagacccagcaccgcccacuaa

SEQ ID NO: 13161 - RNA, 1284 nt, Artificial Sequence
  ACAT1__Homo_sapiens__NP_000010
auggccgugcuggccgcccugcugagaagcggcgccagaagcagaagcccccugcugagaagacuggugcaggagaucagauacguggagagaagcuacgugagcaagcccacccugaaggagguggugaucgugagcgccaccagaacccccaucggcagcuuccugggcagccugagccugcugcccgccaccaagcugggcagcaucgccauccagggcgccaucgagaaggccggcauccccaaggaggaggugaaggaggccuacaugggcaacgugcugcagggcggcgagggccaggcccccaccagacaggccgugcugggcgccggccugcccaucagcacccccugcaccaccaucaacaaggugugcgccagcggcaugaaggccaucaugauggccagccagagccugaugugcggccaccaggacgugaugguggccggcggcauggagagcaugagcaacgugcccuacgugaugaacagaggcagcacccccuacggcggcgugaagcuggaggaccugaucgugaaggacggccugaccgacguguacaacaagauccacaugggcagcugcgccgagaacaccgccaagaagcugaacaucgccagaaacgagcaggacgccuacgccaucaacagcuacaccagaagcaaggccgccugggaggccggcaaguucggcaacgaggugauccccgugaccgugaccgugaagggccagcccgacgugguggugaaggaggacgaggaguacaagagaguggacuucagcaaggugcccaagcugaagaccguguuccagaaggagaacggcaccgugaccgccgccaacgccagcacccugaacgacggcgccgccgcccuggugcugaugaccgccgacgccgccaagagacugaacgugaccccccuggccagaaucguggccuucgccgacgccgccguggagcccaucgacuuccccaucgcccccguguacgccgccagcauggugcugaaggacgugggccugaagaaggaggacaucgccaugugggaggugaacgaggccuucagccugguggugcuggccaacaucaagaugcuggagaucgacccccagaaggugaacaucaacggcggcgccgugagccugggccaccccaucggcaugagcggcgccagaaucgugggccaccugacccacgcccugaagcagggcgaguacggccuggccagcaucugcaacggcggcggcggcgccagcgccaugcugauccagaagcuguaa

SEQ ID NO: 13162 - RNA, 1281 nt, Artificial Sequence
  ACAT2__Homo_sapiens__NP_001290182
augggcagccaccccgugcugagaaucuggggcaacagaagagccaccgccgccagccugggcagaagcggcggcagacugagcagccccagacugcugagagugguggcccccacccugaccuucgcccagaccagcagaugcagcuucaacggcgcccuggccgccgugcccgugcaggaccugggcagcaccgugaucaaggaggugcugaagagagccaccguggcccccgaggacgugagcgaggugaucuucggccacgugcuggccgccggcugcggccagaaccccgugagacaggccagcgugggcgccggcauccccuacagcgugcccgccuggagcugccagaugaucugcggcagcggccugaaggccgugugccuggccgugcagagcaucggcaucggcgacagcagcaucgugguggccggcggcauggagaacaugagcaaggccccccaccuggccuaccugagaaccggcgugaagaucggcgagaugccccugaccgacagcauccugugcgacggccugaccgacgccuuccacaacugccacaugggcaucaccgccgagaacguggccaagaaguggcaggugagcagagaggaccaggacaagguggccgugcugagccagaacagaaccgagaacgcccagaaggccggccacuucgacaaggagaucgugcccgugcuggugagcaccagaaagggccugaucgaggugaagaccgacgaguuccccagacacggcagcaacaucgaggccaugagcaagcugaagcccuacuuccugaccgacggcaccggcaccgugacccccgccaacgccagcggcaucaacgacggcgccgccgccguggugcugaugaagaagagcgaggccgacaagagaggccugaccccccuggccagaaucgugagcuggagccaggugggcguggagcccagcaucaugggcaucggccccauccccgccaucaagcaggccgugaccaaggccggcuggagccuggaggacguggacaucuucgagaucaacgaggccuucgccgccgugagcgccgccaucgugaaggagcugggccugaaccccgagaaggugaacaucgagggcggcgccaucgcccugggccacccccugggcgccagcggcugcagaauccuggugacccugcugcacacccuggagagaaugggcagaagcagaggcguggccgcccugugcaucggcggcggcaugggcaucgccaugugcgugcagagagaguaa

SEQ ID NO: 13163 - RNA, 1587 nt, Artificial Sequence
  ACBD3__Homo_sapiens__NP_073572
auggccgccgugcugaacgccgagagacuggaggugagcguggacggccugacccugagccccgaccccgaggagagacccggcgccgagggcgccccccugcugccccccccccugcccccccccagcccccccggcagcggcagaggccccggcgccagcggcgagcagcccgagcccggcgaggccgccgccggcggcgccgccgaggaggccagaagacuggagcagagauggggcuucggccuggaggagcuguacggccuggcccugagauucuucaaggagaaggacggcaaggccuuccaccccaccuacgaggagaagcugaagcugguggcccugcacaagcaggugcugaugggccccuacaaccccgacaccugccccgaggugggcuucuucgacgugcugggcaacgacagaagaagagagugggccgcccugggcaacaugagcaaggaggacgccaugguggaguucgugaagcugcugaacagaugcugccaccuguucagcaccuacguggccagccacaagaucgagaaggaggagcaggagaagaagagaaaggaggaggaggagagaagaagaagagaggaggaggagagagagagacugcagaaggaggaggagaagagaagaagagaggaggaggagagacugagaagagaggaggaggagagaagaagaaucgaggaggagagacugagacuggagcagcagaagcagcagaucauggccgcccugaacagccagaccgccgugcaguuccagcaguacgccgcccagcaguaccccggcaacuacgagcagcagcagauccugaucagacagcugcaggagcagcacuaccagcaguacaugcagcagcuguaccaggugcagcuggcccagcagcaggccgcccugcagaagcagcaggagguggugguggccggcagcagccugcccaccagcagcaaggugaacgccaccgugcccagcaacaugaugagcgugaacggccaggccaagacccacaccgacagcagcgagaaggagcuggagcccgaggccgccgaggaggcccuggagaacggccccaaggagagccugcccgugaucgccgcccccagcauguggaccagaccccagaucaaggacuucaaggagaagauccagcaggacgccgacagcgugaucaccgugggcagaggcgagguggugaccgugagagugcccacccacgaggagggcagcuaccuguucugggaguucgccaccgacaacuacgacaucggcuucggcguguacuucgaguggaccgacagccccaacaccgccgugagcgugcacgugagcgagagcagcgacgacgacgaggaggaggaggagaacaucggcugcgaggagaaggccaagaagaacgccaacaagccccugcuggacgagaucgugcccguguacagaagagacugccacgaggagguguacgccggcagccaccaguaccccggcagaggcguguaccugcugaaguucgacaacagcuacagccuguggagaagcaagagcguguacuacagaguguacuacaccagauaa

SEQ ID NO: 13164 - RNA, 1026 nt, Artificial Sequence
  ACBD4__Homo_sapiens__NP_001129176
augggcaccgagaaggagagccccgagcccgacugccagaagcaguuccaggccgccgugagcgugauccagaaccugcccaagaacggcagcuacagacccagcuacgaggagaugcugagauucuacagcuacuacaagcaggccaccaugggccccugccuggugcccagacccggcuucugggaccccaucggcagauacaagugggacgccuggaacagccugggcaagaugagcagagaggaggccaugagcgccuacaucaccgagaugaagcugguggcccagaaggugaucgacaccgugccccugggcgagguggccgaggacauguucggcuacuucgagccccuguaccaggugauccccgacaugcccagaccccccgagaccuuccugagaagagugaccggcuggaaggagcagguggugaacggcgacgugggcgccgugagcgagccccccugccugcccaaggagcccgccccccccagccccgccagccugugggccgugacccugcccacccccccccagagccccauccaccccggcaccuggacccccagauucagcgugauccccuggagcagcuggagccugagcugguucggccagagcagcggccagcaccuggaggagagcgugauccccggcaccgcccccugccccccccagagaaagagaggcugcggcgccgccagaagaggccccagaagcuggaccugcggcugcuggggccaguucgagcacuacagaagagccugcagaagaugcagaagaggcugcagagccuggagagccugccccggcccccugagcagaggcagaagccccggccccgugcugggccacggcccccugggcagcagaggccccagaugcagcagcagcagcugcggccccagcagcagcagcggcagcagcgagugcuucggccccaagagaggcgacugccaguggagaggccugugcagccagcugagacugagcugcugcgcccugagccugcccagaguguaa

SEQ ID NO: 13165 - RNA, 1473 nt, Artificial Sequence
  ACBD5__Homo_sapiens__NP_001035938
auggccgacaccagaagcgugcacgagaccagauucgaggccgccgugaaggugauccagagccugcccaagaacggcagcuuccagcccaccaacgagaugaugcugaaguucuacagcuucuacaagcaggccaccgagggccccugcaagcugagcagacccggcuucugggaccccaucggcagauacaagugggacgccuggagcagccugggcgacaugaccaaggaggaggccaugaucgccuacguggaggagaugaagaagaucaucgagaccaugcccaugaccgagaagguggaggagcugcugagagugaucggccccuucuacgagaucguggaggacaagaagagcggcagaagcagcgacaucaccagcgaccugggcaacgugcugaccagcacccccaacgccaagaccgugaacggcaaggccgagagcagcgacagcggcgccgagagcgaggaggaggaggcccaggaggaggugaagggcgccgagcagagcgacaacgacaagaagaugaugaagaagagcgccgaccacaagaaccuggaggugaucgugaccaacggcuacgacaaggacggcuucgugcaggacauccagaacgacauccacgccagcagcagccugaacggcagaagcaccgaggaggugaagcccaucgacgagaaccugggccagaccggcaagagcgccgugugcauccaccaggacaucaacgacgaccacguggaggacgugaccggcauccagcaccugaccagcgacagcgacagcgagguguacugcgacagcauggagcaguucggccaggaggagagccuggacagcuucaccagcaacaacggccccuuccaguacuaccugggcggccacagcagccagcccauggagaacagcggcuucagagaggacauccaggugccccccggcaacggcaacaucggcaacaugcaggugguggccguggagggcaagggcgaggugaagcacggcggcgaggacggcagaaacaacagcggcgccccccacagagagaagagaggcggcgagaccgacgaguucagcaacgugagaagaggcagaggccacagaaugcagcaccugagcgagggcaccaagggcagacaggugggcagcggcggcgacggcgagagauggggcagcgacagaggcagcagaggcagccugaacgagcagaucgcccuggugcugaugagacugcaggaggacaugcagaacgugcugcagagacugcagaagcuggagacccugaccgcccugcaggccaagagcagcaccagcacccugcagaccgccccccagcccaccagccagagacccagcugguggcccuucgagaugagccccggcgugcugaccuucgccaucaucuggcccuucaucgcccaguggcugguguaccuguacuaccagagaagaagaagaaagcugaacuaa

SEQ ID NO: 13166 - RNA, 849 nt, Artificial Sequence
  ACBD6__Homo_sapiens__NP_115736
auggccagcagcuuccugcccgccggcgccaucaccggcgacagcggcggcgagcugagcagcggcgacgacagcggcgagguggaguucccccacagccccgagaucgaggagaccagcugccuggccgagcuguucgagaaggccgccgcccaccugcagggccugauccagguggccagcagagagcagcugcuguaccuguacgccagauacaagcaggugaaggugggcaacugcaacacccccaagcccagcuucuucgacuucgagggcaagcagaagugggaggccuggaaggcccugggcgacagcagccccagccaggccaugcaggaguacaucgccguggugaagaagcuggaccccggcuggaacccccagauccccgagaagaagggcaaggaggccaacaccggcuucggcggccccgugaucagcagccuguaccacgaggagaccaucagagaggaggacaagaacaucuucgacuacugcagagagaacaacaucgaccacaucaccaaggccaucaagagcaagaacguggacgugaacgugaaggacgaggagggcagagcccugcugcacugggccugcgacagaggccacaaggagcuggugaccgugcugcugcagcacagagccgacaucaacugccaggacaacgagggccagaccgcccugcacuacgccagcgccugcgaguuccuggacaucguggagcugcugcugcagagcggcgccgaccccacccugagagaccaggacggcugccugcccgaggaggugaccggcugcaagaccgugagccuggugcugcagagacacaccaccggcaaggccuaa

SEQ ID NO: 13167 - RNA, 1506 nt, Artificial Sequence
  ACCS__Homo_sapiens__NP_115981
auguucacccugccccagaaggacuucagagcccccaccaccugccugggccccaccugcaugcaggaccugggcagcagccacggcgaggaccuggagggcgagugcagcagaaagcuggaccagaagcugcccgagcugagaggcgugggcgaccccgccaugaucagcagcgacaccagcuaccugagcagcagaggcagaaugaucaagugguucugggacagcgccgaggagggcuacagaaccuaccacauggacgaguacgacgaggacaagaaccccagcggcaucaucaaccugggcaccagcgagaacaagcugugcuucgaccugcugagcuggagacugagccagagagacaugcagagaguggagcccagccugcugcaguacgccgacuggagaggccaccuguuccugagagaggagguggccaaguuccugagcuucuacugcaagagccccgugccccugagacccgagaacgugguggugcugaacggcggcgccagccuguucagcgcccuggccaccgugcugugcgaggccggcgaggccuuccugauccccacccccuacuacggcgccaucacccagcacgugugccuguacggcaacaucagacuggccuacguguaccuggacagcgaggugaccggccuggacaccagacccuuccagcugaccguggagaagcuggagauggcccugagagaggcccacagcgagggcgugaaggugaagggccugauccugaucagcccccagaacccccugggcgacguguacagccccgaggagcugcaggaguaccugguguucgccaagagacacagacugcacgugaucguggacgagguguacaugcugagcguguucgagaagagcgugggcuacagaagcgugcugagccuggagagacugcccgacccccagagaacccacgugaugugggccaccagcaaggacuucggcaugagcggccugagauucggcacccuguacaccgagaaccaggacguggccaccgccguggccagccugugcagauaccacggccugagcggccuggugcaguaccagauggcccagcugcugagagacagagacuggaucaaccagguguaccugcccgagaaccacgccagacugaaggccgcccacaccuacgugagcgaggagcugagagcccugggcauccccuuccugagcagaggcgccggcuucuucaucuggguggaccugagaaaguaccugcccaagggcaccuucgaggaggagaugcugcuguggagaagauuccuggacaacaaggugcugcugagcuucggcaaggccuucgagugcaaggagcccggcugguucagauucguguucagcgaccaggugcacagacugugccugggcaugcagagagugcagcaggugcuggccggcaagagccagguggccgaggaccccagacccagccagagccaggagcccagcgaccagagaagauaa

SEQ ID NO: 13168 - RNA, 1635 nt, Artificial Sequence
  ACD__Homo_sapiens__NP_001075955
augcccggcagaugccagagcgacgccgccaugagagugaacggccccgccagcagagcccccgccggcuggaccagcggcagccugcacaccggccccagagccggcagacccagagcccaggccagaggcgugagaggcagaggccugcugcugagacccagacccgccaaggagcugccccugcccagaaagggcggcgccugggcccccgccggcaaccccggcccccugcacccccugggcguggccgugggcauggccggcagcggcagacuggugcugagacccuggaucagagagcugauccugggcagcgagacccccagcagccccagagccggccagcugcuggaggugcugcaggacgccgaggccgccguggccggccccagccacgcccccgacaccagcgacgugggcgccacccugcuggugagcgacggcacccacagcgugagaugccuggugaccagagaggcccuggacaccagcgacugggaggagaaggaguucggcuucagaggcaccgagggcagacugcugcugcugcaggacugcggcgugcacgugcagguggccgagggcggcgcccccgccgaguucuaccugcagguggacagauucagccugcugcccaccgagcagcccagacugagagugcccggcugcaaccaggaccuggacgugcagaagaagcuguacgacugccuggaggagcaccugagcgagagcaccagcagcaacgccggccugagccugagccagcugcuggacgagaugagagaggaccaggagcaccagggcgcccuggugugccuggccgagagcugccugacccuggagggccccugcaccgccccccccgugacccacugggccgccagcagaugcaaggccaccggcgaggccguguacaccgugcccagcagcaugcugugcaucagcgagaacgaccagcugauccugagcagccugggccccugccagagaacccagggccccgagcugcccccccccgaccccgcccugcaggaccugagccugacccugaucgccagcccccccagcagccccagcagcagcggcacccccgcccugcccggccacaugagcagcgaggagagcggcaccagcaucagccugcugcccgcccugagccuggccgcccccgaccccggccagagaagcagcagccagcccagccccgccaucugcagcgcccccgccacccugacccccagaagcccccacgccagcagaacccccagcagcccccugcagagcugcacccccagccugagccccagaagccacgugcccagcccccaccaggcccuggugaccagaccccagaagcccagccuggaguucaaggaguucgugggccugcccugcaagaacagaccccccuuccccagaaccggcgccaccagaggcgcccaggagcccugcagcgugugggagccccccaagagacacagagacggcagcgccuuccaguacgaguacgagccccccugcaccagccugugcgccagagugcaggccgugagacugcccccccagcugauggccugggcccugcacuuccugauggacgcccagcccggcagcgagcccacccccauguaa

SEQ ID NO: 13169 - RNA, 2418 nt, Artificial Sequence
  ACE2__Homo_sapiens__NP_068576
augagcagcagcagcuggcugcugcugagccugguggccgugaccgccgcccagagcaccaucgaggagcaggccaagaccuuccuggacaaguucaaccacgaggccgaggaccuguucuaccagagcagccuggccagcuggaacuacaacaccaacaucaccgaggagaacgugcagaacaugaacaacgccggcgacaaguggagcgccuuccugaaggagcagagcacccuggcccagauguacccccugcaggagauccagaaccugaccgugaagcugcagcugcaggcccugcagcagaacggcagcagcgugcugagcgaggacaagagcaagagacugaacaccauccugaacaccaugagcaccaucuacagcaccggcaaggugugcaaccccgacaacccccaggagugccugcugcuggagcccggccugaacgagaucauggccaacagccuggacuacaacgagagacugugggccugggagagcuggagaagcgaggugggcaagcagcugagaccccuguacgaggaguacguggugcugaagaacgagauggccagagccaaccacuacgaggacuacggcgacuacuggagaggcgacuacgaggugaacggcguggacggcuacgacuacagcagaggccagcugaucgaggacguggagcacaccuucgaggagaucaagccccuguacgagcaccugcacgccuacgugagagccaagcugaugaacgccuaccccagcuacaucagccccaucggcugccugcccgcccaccugcugggcgacauguggggcagauucuggaccaaccuguacagccugaccgugcccuucggccagaagcccaacaucgacgugaccgacgccaugguggaccaggccugggacgcccagagaaucuucaaggaggccgagaaguucuucgugagcgugggccugcccaacaugacccagggcuucugggagaacagcaugcugaccgaccccggcaacgugcagaaggccgugugccaccccaccgccugggaccugggcaagggcgacuucagaauccugaugugcaccaaggugaccauggacgacuuccugaccgcccaccacgagaugggccacauccaguacgacauggccuacgccgcccagcccuuccugcugagaaacggcgccaacgagggcuuccacgaggccgugggcgagaucaugagccugagcgccgccacccccaagcaccugaagagcaucggccugcugagccccgacuuccaggaggacaacgagaccgagaucaacuuccugcugaagcaggcccugaccaucgugggcacccugcccuucaccuacaugcuggagaaguggagauggaugguguucaagggcgagauccccaaggaccaguggaugaagaaguggugggagaugaagagagagaucgugggcgugguggagcccgugccccacgacgagaccuacugcgaccccgccagccuguuccacgugagcaacgacuacagcuucaucagauacuacaccagaacccuguaccaguuccaguuccaggaggcccugugccaggccgccaagcacgagggcccccugcacaagugcgacaucagcaacagcaccgaggccggccagaagcuguucaacaugcugagacugggcaagagcgagcccuggacccuggcccuggagaacguggugggcgccaagaacaugaacgugagaccccugcugaacuacuucgagccccuguucaccuggcugaaggaccagaacaagaacagcuucgugggcuggagcaccgacuggagccccuacgccgaccagagcaucaaggugagaaucagccugaagagcgcccugggcgacaaggccuacgaguggaacgacaacgagauguaccuguucagaagcagcguggccuacgccaugagacaguacuuccugaaggugaagaaccagaugauccuguucggcgaggaggacgugagaguggccaaccugaagcccagaaucagcuucaacuucuucgugaccgcccccaagaacgugagcgacaucauccccagaaccgagguggagaaggccaucagaaugagcagaagcagaaucaacgacgccuucagacugaacgacaacagccuggaguuccugggcauccagcccacccugggcccccccaaccagccccccgugagcaucuggcugaucguguucggcguggugaugggcgugaucguggugggcaucgugauccugaucuucaccggcaucagagacagaaagaagaagaacaaggccagaagcggcgagaaccccuacgccagcaucgacaucagcaagggcgagaacaaccccggcuuccagaacaccgacgacgugcagaccagcuucuaa

SEQ ID NO: 13170 - RNA, 3921 nt, Artificial Sequence
  ACE__Homo_sapiens__NP_000780
augggcgccgccagcggcagaagaggccccggccugcugcugccccugccccugcugcugcugcugcccccccagcccgcccuggcccuggaccccggccugcagcccggcaacuucagcgccgacgaggccggcgcccagcuguucgcccagagcuacaacagcagcgccgagcaggugcuguuccagagcguggccgccagcugggcccacgacaccaacaucaccgccgagaacgccagaagacaggaggaggccgcccugcugagccaggaguucgccgaggccuggggccagaaggccaaggagcuguacgagcccaucuggcagaacuucaccgacccccagcugagaagaaucaucggcgccgugagaacccugggcagcgccaaccugccccuggccaagagacagcaguacaacgcccugcugagcaacaugagcagaaucuacagcaccgccaaggugugccugcccaacaagaccgccaccugcuggagccuggaccccgaccugaccaacauccuggccagcagcagaagcuacgccaugcugcuguucgccugggagggcuggcacaacgccgccggcaucccccugaagccccuguacgaggacuucaccgcccugagcaacgaggccuacaagcaggacggcuucaccgacaccggcgccuacuggagaagcugguacaacagccccaccuucgaggacgaccuggagcaccuguaccagcagcuggagccccuguaccugaaccugcacgccuucgugagaagagcccugcacagaagauacggcgacagauacaucaaccugagaggccccauccccgcccaccugcugggcgacaugugggcccagagcugggagaacaucuacgacaugguggugcccuuccccgacaagcccaaccuggacgugaccagcaccaugcugcagcagggcuggaacgccacccacauguucagaguggccgaggaguucuucaccagccuggagcugagccccaugccccccgaguucugggagggcagcaugcuggagaagcccgccgacggcagagagguggugugccacgccagcgccugggacuucuacaacagaaaggacuucagaaucaagcagugcaccagagugaccauggaccagcugagcaccgugcaccacgagaugggccacauccaguacuaccugcaguacaaggaccugcccgugagccugagaagaggcgccaaccccggcuuccacgaggccaucggcgacgugcuggcccugagcgugagcacccccgagcaccugcacaagaucggccugcuggacagagugaccaacgacaccgagagcgacaucaacuaccugcugaagauggcccuggagaagaucgccuuccugcccuucggcuaccugguggaccaguggagauggggcguguucagcggcagaaccccccccagcagauacaacuucgacuggugguaccugagaaccaaguaccagggcaucugcccccccgugaccagaaacgagacccacuucgacgccggcgccaaguuccacgugcccaacgugacccccuacaucagauacuucgugagcuucgugcugcaguuccaguuccacgaggcccugugcaaggaggccggcuacgagggcccccugcaccagugcgacaucuacagaagcaccaaggccggcgccaagcugagaaaggugcugcaggccggcagcagcagacccuggcaggaggugcugaaggacauggugggccuggacgcccuggacgcccagccccugcugaaguacuuccagcccgugacccaguggcugcaggagcagaaccagcagaacggcgaggugcugggcuggcccgaguaccaguggcaccccccccugcccgacaacuaccccgagggcaucgaccuggugaccgacgaggccgaggccagcaaguucguggaggaguacgacagaaccagccaggugguguggaacgaguacgccgaggccaacuggaacuacaacaccaacaucaccaccgagaccagcaagauccugcugcagaagaacaugcagaucgccaaccacacccugaaguacggcacccaggccagaaaguucgacgugaaccagcugcagaacaccaccaucaagagaaucaucaagaaggugcaggaccuggagagagccgcccugcccgcccaggagcuggaggaguacaacaagauccugcuggacauggagaccaccuacagcguggccaccgugugccaccccaacggcagcugccugcagcuggagcccgaccugaccaacgugauggccaccagcagaaaguacgaggaccugcugugggccugggagggcuggagagacaaggccggcagagccauccugcaguucuaccccaaguacguggagcugaucaaccaggccgccagacugaacggcuacguggacgccggcgacagcuggagaagcauguacgagacccccagccuggagcaggaccuggagagacuguuccaggagcugcagccccuguaccugaaccugcacgccuacgugagaagagcccugcacagacacuacggcgcccagcacaucaaccuggagggccccauccccgcccaccugcugggcaacaugugggcccagaccuggagcaacaucuacgaccugguggugcccuuccccagcgcccccagcauggacaccaccgaggccaugcugaagcagggcuggacccccagaagaauguucaaggaggccgacgacuucuucaccagccugggccugcugcccgugccccccgaguucuggaacaagagcaugcuggagaagcccaccgacggcagagagguggugugccacgccagcgccugggacuucuacaacggcaaggacuucagaaucaagcagugcaccaccgugaaccuggaggaccuggugguggcccaccacgagaugggccacauccaguacuucaugcaguacaaggaccugcccguggcccugagagagggcgccaaccccggcuuccacgaggccaucggcgacgugcuggcccugagcgugagcacccccaagcaccugcacagccugaaccugcugagcagcgagggcggcagcgacgagcacgacaucaacuuccugaugaagauggcccuggacaagaucgccuucauccccuucagcuaccugguggaccaguggagauggagaguguucgacggcagcaucaccaaggagaacuacaaccaggagugguggagccugagacugaaguaccagggccugugcccccccgugcccagaacccagggcgacuucgaccccggcgccaaguuccacauccccagcagcgugcccuacaucagauacuucgugagcuucaucauccaguuccaguuccacgaggcccugugccaggccgccggccacaccggcccccugcacaagugcgacaucuaccagagcaaggaggccggccagagacuggccaccgccaugaagcugggcuucagcagacccuggcccgaggccaugcagcugaucaccggccagcccaacaugagcgccagcgccaugcugagcuacuucaagccccugcuggacuggcugagaaccgagaacgagcugcacggcgagaagcugggcuggccccaguacaacuggacccccaacagcgccagaagcgagggcccccugcccgacagcggcagagugagcuuccugggccuggaccuggacgcccagcaggccagagugggccaguggcugcugcuguuccugggcaucgcccugcugguggccacccugggccugagccagagacuguucagcaucagacacagaagccugcacagacacagccacggcccccaguucggcagcgagguggagcugagacacagcuaa

SEQ ID NO: 13171 - RNA, 828 nt, Artificial Sequence
  ACER2__Homo_sapiens__NP_001010887
augggcgccccccacuggugggaccagcugcaggccggcagcagcgagguggacuggugcgaggacaacuacaccaucgugcccgccaucgccgaguucuacaacaccaucagcaacgugcuguucuucauccugccccccaucugcaugugccuguucagacaguacgccaccugcuucaacagcggcaucuaccugaucuggacccugcuggugguggugggcaucggcagcguguacuuccacgccacccugagcuuccugggccagaugcuggacgagcuggccgugcugugggugcugaugugcgcccuggccaugugguuccccagaagauaccugcccaagaucuucagaaacgacagaggcagauucaaggugguggugagcgugcugagcgccgugaccaccugccuggccuucgugaagcccgccaucaacaacaucagccugaugacccugggcgugcccugcaccgcccugcugaucgccgagcugaagagaugcgacaacaugagaguguucaagcugggccuguucagcggccugugguggacccuggcccuguucugcuggaucagcgacagagccuucugcgagcugcugagcagcuucaacuuccccuaccugcacugcauguggcacauccugaucugccuggccgccuaccugggcugcgugugcuucgccuacuucgacgccgccagcgagauccccgagcagggccccgugaucaaguucuggcccaacgagaagugggccuucaucggcgugcccuacgugagccugcugugcgccaacaagaagagcagcgugaagaucaccuaa

SEQ ID NO: 13172 - RNA, 693 nt, Artificial Sequence
  ACER3__Homo_sapiens__NP_001287882
auggcccccgccgccgacagagagggcuacuggggccccaccaccagcacccuggacuggugcgaggagaacuacagcgugaccugguacaucgccgaguuccuggugggcaugggcagcuggugcuuccacaugacccugaaguacgagaugcagcugcuggacgagcugcccaugaucuacagcugcugcaucuucguguacugcauguucgagugcuucaagaucaagaacagcgugaacuaccaccugcuguucacccuggugcuguucagccugaucgugaccaccguguaccugaaggugaaggagcccaucuuccaccaggugauguacggcaugcugguguucacccuggugcugagaagcaucuacaucgugaccuggguguaccccuggcugagaggccugggcuacaccagccugggcaucuuccugcugggcuuccuguucuggaacaucgacaacaucuucugcgagagccugagaaacuucagaaagaaggugccccccaucaucggcaucaccacccaguuccacgccugguggcacauccugaccggccugggcagcuaccugcacauccuguucagccuguacaccagaacccuguaccugagauacagacccaaggugaaguuccuguucggcaucuggcccgugauccuguucgagccccugagaaagcacuaa

SEQ ID NO: 13173 - RNA, 1581 nt, Artificial Sequence
  ACHE__Homo_sapiens__NP_001269378
augagacccccccagugccugcugcacacccccagccuggccagcccccugcugcugcugcugcuguggcugcugggcggcggcgugggcgccgagggcagagaggacgccgagcugcuggugaccgugagaggcggcagacugagaggcaucagacugaagacccccggcggccccgugagcgccuuccugggcauccccuucgccgagccccccaugggccccagaagauuccugccccccgagcccaagcagcccuggagcggcgugguggacgccaccaccuuccagagcgugugcuaccaguacguggacacccuguaccccggcuucgagggcaccgagauguggaaccccaacagagagcugagcgaggacugccuguaccugaacguguggacccccuaccccagacccaccagccccacccccgugcugguguggaucuacggcggcggcuucuacagcggcgccagcagccuggacguguacgacggcagauuccuggugcaggccgagagaaccgugcuggugagcaugaacuacagagugggcgccuucggcuuccuggcccugcccggcagcagagaggcccccggcaacgugggccugcuggaccagagacuggcccugcagugggugcaggagaacguggccgccuucggcggcgaccccaccagcgugacccuguucggcgagagcgccggcgccgccagcgugggcaugcaccugcugagcccccccagcagaggccuguuccacagagccgugcugcagagcggcgcccccaacggccccugggccaccgugggcaugggcgaggccagaagaagagccacccagcuggcccaccuggugggcugcccccccggcggcaccggcggcaacgacaccgagcugguggccugccugagaaccagacccgcccaggugcuggugaaccacgaguggcacgugcugccccaggagagcguguucagauucagcuucgugcccgugguggacggcgacuuccugagcgacacccccgaggcccugaucaacgccggcgacuuccacggccugcagcuggccggcagacuggccgcccagggcgccagaguguacgccuacguguucgagcacagagccagcacccugagcuggccccuguggaugggcgugccccacggcuacgagaucgaguucaucuucggcaucccccuggaccccagcagaaacuacaccgccgaggagaagaucuucgcccagagacugaugagauacugggccaacuucgccagaaccggcgaccccaacgagcccagagaccccaaggccccccaguggccccccuacaccgccggcgcccagcaguacgugagccuggaccugagaccccuggaggugagaagaggccugagagcccaggccugcgccuucuggaacagauuccugcccaagcugcugagcgccaccgacacccuggacgaggccgagagacaguggaaggccgaguuccacagauggagcagcuacauggugcacuggaagaaccaguucgaccacuacagcaagcaggacagaugcagcgaccuguaa

SEQ ID NO: 13174 - RNA, 3987 nt, Artificial Sequence
  ACIN1__Homo_sapiens__NP_001158286
auguggagaagaaagcaccccagaaccagcggcggcaccagaggcgugcugagcggcaacagaggcguggaguacggcagcggcagaggccaccugggcaccuucgagggcagauggagaaagcugcccaagaugcccgaggccgugggcaccgaccccagcaccagcagaaagauggccgagcuggaggaggugacccuggacggcaagccccugcaggcccugagagugaccgaccugaaggccgcccuggagcagagaggccuggccaagagcggccagaagagcgcccuggugaagagacugaagggcgcccugaugcuggagaaccugcagaagcacagcaccccccacgccgccuuccagcccaacagccagaucggcgaggagaugagccagaacagcuucaucaagcaguaccuggagaagcagcaggagcugcugagacagagacuggagagagaggccagagaggccgccgagcuggaggaggccagcgccgagagcgaggacgagaugauccaccccgagggcguggccagccugcugccccccgacuuccagagcagccuggagagacccgagcuggagcugagcagacacagccccagaaagagcagcagcaucagcgaggagaagggcgacagcgacgacgagaagcccagaaagggcgagagaagaagcagcagagugagacaggccagagccgccaagcugagcgagggcagccagcccgccgaggaggaggaggaccaggagacccccagcagaaaccugagagugagagccgacagaaaccugaagaccgaggaggaggaggaggaggaggaggaggaggaggaggacgacgaggaggaggagggcgacgacgagggccagaagagcagagaggcccccauccugaaggaguucaaggaggagggcgaggagauccccagagugaagcccgaggagaugauggacgagagacccaagaccagaagccaggagcaggaggugcuggagagaggcggcagauucaccagaagccaggaggaggccagaaagagccaccuggccagacagcagcaggagaaggagaugaagaccaccagcccccuggaggaggaggagagagagaucaagagcagccagggccugaaggagaagagcaagagccccagcccccccagacugaccgaggacagaaagaaggccagccugguggcccugcccgagcagaccgccagcgaggaggagaccccccccccccugcugaccaaggaggccagcagcccccccccccacccccagcugcacagcgaggaggagaucgagcccauggagggccccgccccccccgugcugauccagcugagcccccccaacaccgacgccgacaccagagagcugcuggugagccagcacaccgugcagcuggugggcggccugagcccccugagcagccccagcgacaccaaggccgagagccccgccgagaaggugcccgaggagagcgugcugccccuggugcagaagagcacccuggccgacuacagcgcccagaaggaccuggagcccgagagcgacagaagcgcccagccccugccccugaagaucgaggagcuggcccuggccaagggcaucaccgaggagugccugaagcagcccagccuggagcagaaggagggcagaagagccagccacacccugcugcccagccacagacugaagcagagcgccgacagcagcagcagcagaagcagcagcagcagcagcagcagcagcagaagcagaagcagaagccccgacagcagcggcagcagaagccacagcccccugagaagcaagcagagagacguggcccaggccagaacccacgccaaccccagaggcagacccaagaugggcagcagaagcaccagcgagagcagaagcagaagcagaagcagaagcagaagcgccagcagcaacagcagaaagagccugagccccggcgugagcagagacagcagcaccagcuacaccgagaccaaggaccccagcagcggccaggagguggccaccccccccgugccccagcugcaggugugcgagcccaaggagagaaccagcaccagcagcagcagcgugcaggccagaagacugagccagcccgagagcgccgagaagcacgugacccagagacugcagcccgagagaggcagccccaagaagugcgaggccgaggaggccgagccccccgccgccacccagccccagaccagcgagacccagaccagccaccugcccgagagcgagagaauccaccacaccguggaggagaaggaggaggugaccauggacaccagcgagaacagacccgagaacgacgugcccgagccccccaugcccaucgccgaccaggugagcaacgacgacagacccgagggcagcguggaggacgaggagaagaaggagagcagccugcccaagagcuucaagagaaagaucagcguggugagcaccaagggcgugcccgccggcaacagcgacaccgagggcggccagcccggcagaaagagaagauggggcgccagcaccgccaccacccagaagaagcccagcaucagcaucaccaccgagagccugaaggaggccgugguggaccugcacgccgacgacagcagaaucagcgaggacgagaccgagagaaacggcgacgacggcacccacgacaagggccugaagaucugcagaaccgugacccagguggugcccgccgagggccaggagaacggccagagagaggaggaggaggaggagaaggagcccgaggccgagccccccgugcccccccaggugagcguggagguggcccugcccccccccgccgagcacgaggugaagaaggugacccugggcgacacccugaccagaagaagcaucagccagcagaagagcggcgugagcaucaccaucgacgaccccgugagaaccgcccaggugcccagcccccccagaggcaagaucagcaacaucgugcacaucagcaaccuggugagacccuucacccugggccagcugaaggagcugcugggcagaaccggcacccugguggaggaggccuucuggaucgacaagaucaagagccacugcuucgugaccuacagcaccguggaggaggccguggccaccagaaccgcccugcacggcgugaaguggccccagagcaaccccaaguuccugugcgccgacuacgccgagcaggacgagcuggacuaccacagaggccugcugguggacagacccagcgagaccaagaccgaggagcagggcauccccagaccccugcacccccccccccccccccccgugcagcccccccagcaccccagagccgagcagagagagcaggagagagccgugagagagcagugggccgagagagagagagagauggagagaagagagagaaccagaagcgagagagagugggacagagacaaggugagagagggccccagaagcagaagcagaagcagagacagaagaagaaaggagagagccaagagcaaggagaagaagagcgagaagaaggagaaggcccaggaggagccccccgccaagcugcuggacgaccuguucagaaagaccaaggccgcccccugcaucuacuggcugccccugaccgacagccagaucgugcagaaggaggccgagagagccgagagagccaaggagagagagaagagaagaaaggagcaggaggaggaggagcagaaggagagagagaaggaggccgagagagagagaaacagacagcuggagagagagaagagaagagagcacagcagagagagagacagagagagagagagagagagagagagagacagaggcgacagagacagagacagagagagagacagagagagaggcagagagagagacagaagagacaccaagagacacagcagaagcagaagcagaagcacccccgugagagacagaggcggcagaagauaa

SEQ ID NO: 13175 - RNA, 1017 nt, Artificial Sequence
  ACKR1__Homo_sapiens__NP_001116423
auggccagcagcggcuacgugcugcaggccgagcugagccccagcaccgagaacagcagccagcuggacuucgaggacguguggaacagcagcuacggcgugaacgacagcuuccccgacggcgacuacggcgccaaccuggaggccgccgcccccugccacagcugcaaccugcuggacgacagcgcccugcccuucuucauccugaccagcgugcugggcauccuggccagcagcaccgugcuguucaugcuguucagaccccuguucagauggcagcugugccccggcuggcccgugcuggcccagcuggccgugggcagcgcccuguucagcaucguggugcccgugcuggcccccggccugggcagcaccagaagcagcgcccugugcagccugggcuacugcgugugguacggcagcgccuucgcccaggcccugcugcugggcugccacgccagccugggccacagacugggcgccggccaggugcccggccugacccugggccugaccgugggcaucuggggcguggccgcccugcugacccugcccgugacccuggccagcggcgccagcggcggccugugcacccugaucuacagcaccgagcugaaggcccugcaggccacccacaccguggccugccuggccaucuucgugcugcugccccugggccuguucggcgccaagggccugaagaaggcccugggcaugggccccggccccuggaugaacauccugugggccugguucaucuucugguggccccacggcguggugcugggccuggacuuccuggugagaagcaagcugcugcugcugagcaccugccuggcccagcaggcccuggaccugcugcugaaccuggccgaggcccuggccauccugcacugcguggccaccccccugcugcuggcccuguucugccaccaggccaccagaacccugcugcccagccugccccugcccgagggcuggagcagccaccuggacacccugggcagcaagagcuaa

SEQ ID NO: 13176 - RNA, 1155 nt, Artificial Sequence
  ACKR2__Homo_sapiens__NP_001287
auggccgccaccgccagcccccagccccuggccaccgaggacgccgacagcgagaacagcagcuucuacuacuacgacuaccuggacgagguggccuucaugcugugcagaaaggacgccguggugagcuucggcaagguguuccugcccguguucuacagccugaucuucgugcugggccugagcggcaaccugcugcugcugauggugcugcugagauacgugcccagaagaagaaugguggagaucuaccugcugaaccuggccaucagcaaccugcuguuccuggugacccugcccuucuggggcaucagcguggccuggcacuggguguucggcagcuuccugugcaagauggugagcacccuguacaccaucaacuucuacagcggcaucuucuucaucagcugcaugagccuggacaaguaccuggagaucgugcacgcccagcccuaccacagacugagaaccagagccaagagccugcugcuggccaccaucgugugggccgugagccuggccgugagcauccccgacaugguguucgugcagacccacgagaaccccaagggcguguggaacugccacgccgacuucggcggccacggcaccaucuggaagcuguuccugagauuccagcagaaccugcugggcuuccugcugccccugcuggccaugaucuucuucuacagcagaaucggcugcgugcuggugagacugagacccgccggccagggcagagcccugaagaucgccgccgcccuggugguggccuucuucgugcugugguuccccuacaaccugacccuguuccugcacacccugcuggaccugcagguguucggcaacugcgaggugagccagcaccuggacuacgcccugcaggugaccgagagcaucgccuuccugcacugcugcuucagccccauccuguacgccuucagcagccacagauucagacaguaccugaaggccuuccuggccgccgugcugggcuggcaccuggcccccggcaccgcccaggccagccugagcagcugcagcgagagcagcauccugaccgcccaggaggagaugaccggcaugaacgaccugggcgagagacagagcgagaacuaccccaacaaggaggacgugggcaacaagagcgccuaa

SEQ ID NO: 13177 - RNA, 1089 nt, Artificial Sequence
  ACKR3__Homo_sapiens__XP_005246155
auggaccugcaccuguucgacuacagcgagcccggcaacuucagcgacaucagcuggcccugcaacagcagcgacugcaucgugguggacaccgugaugugccccaacaugcccaacaagagcgugcugcuguacacccugagcuucaucuacaucuucaucuucgugaucggcaugaucgccaacagcgugguggugugggugaacauccaggccaagaccaccggcuacgacacccacugcuacauccugaaccuggccaucgccgaccuguggguggugcugaccauccccguguggguggugagccuggugcagcacaaccaguggcccaugggcgagcugaccugcaaggugacccaccugaucuucagcaucaaccuguucggcagcaucuucuuccugaccugcaugagcguggacagauaccugagcaucaccuacuucaccaacacccccagcagcagaaagaagauggugagaagaguggugugcauccugguguggcugcuggccuucugcgugagccugcccgacaccuacuaccugaagaccgugaccagcgccagcaacaacgagaccuacugcagaagcuucuaccccgagcacagcaucaaggaguggcugaucggcauggagcuggugagcguggugcugggcuucgccgugcccuucagcaucaucgccguguucuacuuccugcuggccagagccaucagcgccagcagcgaccaggagaagcacagcagcagaaagaucaucuucagcuacguggugguguuccuggugugcuggcugcccuaccacguggccgugcugcuggacaucuucagcauccugcacuacauccccuucaccugcagacuggagcacgcccuguucaccgcccugcacgugacccagugccugagccuggugcacugcugcgugaaccccgugcuguacagcuucaucaacagaaacuacagauacgagcugaugaaggccuucaucuucaaguacagcgccaagaccggccugaccaagcugaucgacgccagcagagugagcgagaccgaguacagcgcccuggagcagagcaccaaguaa

SEQ ID NO: 13178 - RNA, 1053 nt, Artificial Sequence
  ACKR4__Homo_sapiens__NP_848540
auggcccuggagcagaaccagagcaccgacuacuacuacgaggagaacgagaugaacggcaccuacgacuacagccaguacgagcugaucugcaucaaggaggacgugagagaguucgccaagguguuccugcccguguuccugaccaucguguucgugaucggccuggccggcaacagcauggugguggccaucuacgccuacuacaagaagcagagaaccaagaccgacguguacauccugaaccuggccguggccgaccugcugcugcuguucacccugcccuucugggccgugaacgccgugcacggcugggugcugggcaagaucaugugcaagaucaccagcgcccuguacacccugaacuucgugagcggcaugcaguuccuggccugcaucagcaucgacagauacguggccgugaccaaggugcccagccagagcggcgugggcaagcccugcuggaucaucugcuucugcguguggauggccgccauccugcugagcaucccccagcugguguucuacaccgugaacgacaacgccagaugcauccccaucuuccccagauaccugggcaccagcaugaaggcccugauccagaugcuggagaucugcaucggcuucguggugcccuuccugaucaugggcgugugcuacuucaucaccgccagaacccugaugaagaugcccaacaucaagaucagcagaccccugaaggugcugcugaccguggugaucguguucaucgugacccagcugcccuacaacaucgugaaguucugcagagccaucgacaucaucuacagccugaucaccagcugcaacaugagcaagagaauggacaucgccauccaggugaccgagagcaucgcccuguuccacagcugccugaaccccauccuguacguguucaugggcgccagcuucaagaacuacgugaugaagguggccaagaaguacggcagcuggagaagacagagacagagcguggaggaguuccccuucgacagcgagggccccaccgagcccaccagcaccuucagcaucuaa

SEQ ID NO: 13179 - RNA, 3468 nt, Artificial Sequence
  ACLY__Homo_sapiens__NP_001290203
augggcgccggcaagagccccgccggccccggccagaagcccgaccccggcaagcugcccgccgccggcgugcugagaauccugagaggcagcagcggccuguggaagaagagaagagccagaaccagcgccgagaccggcagagccggccugagcgccgccaugagcgccaaggccaucagcgagcagaccggcaaggagcugcuguacaaguucaucugcaccaccagcgccauccagaacagauucaaguacgccagagugacccccgacaccgacugggccagacugcugcaggaccaccccuggcugcugagccagaaccugguggugaagcccgaccagcugaucaagagaagaggcaagcugggccuggugggcgugaaccugacccuggacggcgugaagagcuggcugaagcccagacugggccaggaggccaccgugggcaaggccaccggcuuccugaagaacuuccugaucgagcccuucgugccccacagccaggccgaggaguucuacgugugcaucuacgccaccagagagggcgacuacgugcuguuccaccacgagggcggcguggacgugggcgacguggacgccaaggcccagaagcugcuggugggcguggacgagaagcugaaccccgaggacaucaagaagcaccugcuggugcacgcccccgaggacaagaaggagauccuggccagcuucaucagcggccuguucaacuucuacgaggaccuguacuucaccuaccuggagaucaacccccugguggugaccaaggacggcguguacgugcuggaccuggccgccaagguggacgccaccgccgacuacaucugcaaggugaaguggggcgacaucgaguuccccccccccuucggcagagaggccuaccccgaggaggccuacaucgccgaccuggacgccaagagcggcgccagccugaagcugacccugcugaaccccaagggcagaaucuggaccaugguggccggcggcggcgccagcgugguguacagcgacaccaucugcgaccugggcggcgugaacgagcuggccaacuacggcgaguacagcggcgcccccagcgagcagcagaccuacgacuacgccaagaccauccugagccugaugaccagagagaagcaccccgacggcaagauccugaucaucggcggcagcaucgccaacuucaccaacguggccgccaccuucaagggcaucgugagagccaucagagacuaccagggcccccugaaggagcacgaggugaccaucuucgugagaagaggcggccccaacuaccaggagggccugagagugaugggcgaggugggcaagaccaccggcauccccauccacguguucggcaccgagacccacaugaccgccaucgugggcauggcccugggccacagacccauccccaaccagccccccaccgccgcccacaccgccaacuuccugcugaacgccagcggcagcaccagcacccccgcccccagcagaaccgccagcuucagcgagagcagagccgacgagguggcccccgccaagaaggccaagcccgccaugccccaggacagcgugcccagccccagaagccugcagggcaagagcaccacccuguucagcagacacaccaaggccaucguguggggcaugcagaccagagccgugcagggcaugcuggacuucgacuacgugugcagcagagacgagcccagcguggccgccaugguguaccccuucaccggcgaccacaagcagaaguucuacuggggccacaaggagauccugauccccguguucaagaacauggccgacgccaugagaaagcaccccgagguggacgugcugaucaacuucgccagccugagaagcgccuacgacagcaccauggagaccaugaacuacgcccagaucagaaccaucgccaucaucgccgagggcauccccgaggcccugaccagaaagcugaucaagaaggccgaccagaagggcgugaccaucaucggccccgccaccgugggcggcaucaagcccggcugcuucaagaucggcaacaccggcggcaugcuggacaacauccuggccagcaagcuguacagacccggcagcguggccuacgugagcagaagcggcggcaugagcaacgagcugaacaacaucaucagcagaaccaccgacggcguguacgagggcguggccaucggcggcgacagauaccccggcagcaccuucauggaccacgugcugagauaccaggacacccccggcgugaagaugaucguggugcugggcgagaucggcggcaccgaggaguacaagaucugcagaggcaucaaggagggcagacugaccaagcccaucgugugcuggugcaucggcaccugcgccaccauguucagcagcgaggugcaguucggccacgccggcgccugcgccaaccaggccagcgagaccgccguggccaagaaccaggcccugaaggaggccggcguguucgugcccagaagcuucgacgagcugggcgagaucauccagagcguguacgaggaccugguggccaacggcgugaucgugcccgcccaggaggugcccccccccaccgugcccauggacuacagcugggccagagagcugggccugaucagaaagcccgccagcuucaugaccagcaucugcgacgagagaggccaggagcugaucuacgccggcaugcccaucaccgagguguucaaggaggagaugggcaucggcggcgugcugggccugcugugguuccagaagagacugcccaaguacagcugccaguucaucgagaugugccugauggugaccgccgaccacggccccgccgugagcggcgcccacaacaccaucaucugcgccagagccggcaaggaccuggugagcagccugaccagcggccugcugaccaucggcgacagauucggcggcgcccuggacgccgccgccaagauguucagcaaggccuucgacagcggcaucauccccauggaguucgugaacaagaugaagaaggagggcaagcugaucaugggcaucggccacagagugaagagcaucaacaaccccgacaugagagugcagauccugaaggacuacgugagacagcacuuccccgccaccccccugcuggacuacgcccuggagguggagaagaucaccaccagcaagaagcccaaccugauccugaacguggacggccugaucggcguggccuucguggacaugcugagaaacugcggcagcuucaccagagaggaggccgacgaguacaucgacaucggcgcccugaacggcaucuucgugcugggcagaagcaugggcuucaucggccacuaccuggaccagaagagacugaagcagggccuguacagacaccccugggacgacaucagcuacgugcugcccgagcacaugagcauguaa

SEQ ID NO: 13180 - RNA, 1011 nt, Artificial Sequence
  ACMSD__Homo_sapiens__NP_612199
augaagaucgacauccacagccacauccugcccaaggaguggcccgaccugaagaagagauucggcuacggcggcugggugcagcugcagcaccacagcaagggcgaggccaagcugcugaaggacggcaagguguucagaguggugagagagaacugcugggaccccgaggugagaaucagagagauggaccagaagggcgugaccgugcaggcccugagcaccgugcccgugauguucagcuacugggccaagcccgaggacacccugaaccugugccagcugcugaacaacgaccuggccagcaccguggugagcuaccccagaagauucgugggccugggcacccugcccaugcaggcccccgagcuggccgugaaggagauggagagaugcgugaaggagcugggcuuccccggcgugcagaucggcacccacgugaacgagugggaccugaacgcccaggagcuguuccccguguacgccgccgccgagagacugaagugcagccuguucgugcaccccugggacaugcagauggacggcagaauggccaaguacuggcugcccuggcuggugggcaugcccgccgagaccaccaucgccaucugcagcaugaucaugggcggcguguucgagaaguuccccaagcugaaggugugcuucgcccacggcggcggcgccuuccccuucaccgugggcagaaucagccacggcuucagcaugagacccgaccugugcgcccaggacaaccccaugaaccccaagaaguaccugggcagcuucuacaccgacgcccuggugcacgacccccugagccugaagcugcugaccgacgugaucggcaaggacaaggugauccugggcaccgacuaccccuucccccugggcgagcuggagcccggcaagcugaucgagagcauggaggaguucgacgaggagaccaagaacaagcugaaggccggcaacgcccuggccuuccugggccuggagagaaagcaguucgaguaa

SEQ ID NO: 13181 - RNA, 2670 nt, Artificial Sequence
  ACO1__Homo_sapiens__NP_002188
augagcaaccccuucgcccaccuggccgagccccuggaccccgugcagcccggcaagaaguucuucaaccugaacaagcuggaggacagcagauacggcagacugcccuucagcaucagagugcugcuggaggccgccaucagaaacugcgacgaguuccuggugaagaagcaggacaucgagaacauccugcacuggaacgugacccagcacaagaacaucgaggugcccuucaagcccgccagagugauccugcaggacuucaccggcgugcccgccgugguggacuucgccgccaugagagacgccgugaagaagcugggcggcgaccccgagaagaucaaccccgugugccccgccgaccuggugaucgaccacagcauccagguggacuucaacagaagagccgacagccugcagaagaaccaggaccuggaguucgagagaaacagagagagauucgaguuccugaaguggggcagccaggccuuccacaacaugagaaucaucccccccggcagcggcaucauccaccaggugaaccuggaguaccuggccagagugguguucgaccaggacggcuacuacuaccccgacagccuggugggcaccgacagccacaccaccaugaucgacggccugggcauccugggcuggggcgugggcggcaucgaggccgaggccgugaugcugggccagcccaucagcauggugcugccccaggugaucggcuacagacugaugggcaagccccacccccuggugaccagcaccgacaucgugcugaccaucaccaagcaccugagacaggugggcguggugggcaaguucguggaguucuucggccccggcguggcccagcugagcaucgccgacagagccaccaucgccaacaugugccccgaguacggcgccaccgccgccuucuuccccguggacgaggugagcaucaccuaccuggugcagaccggcagagacgaggagaagcugaaguacaucaagaaguaccugcaggccgugggcauguucagagacuucaacgaccccagccaggaccccgacuucacccaggugguggagcuggaccugaagaccguggugcccugcugcagcggccccaagagaccccaggacaagguggccgugagcgacaugaagaaggacuucgagagcugccugggcgccaagcagggcuucaagggcuuccagguggcccccgagcaccacaacgaccacaagaccuucaucuacgacaacaccgaguucacccuggcccacggcagcguggugaucgccgccaucaccagcugcaccaacaccagcaaccccagcgugaugcugggcgccggccugcuggccaagaaggccguggacgccggccugaacgugaugcccuacaucaagaccagccugagccccggcagcggcguggugaccuacuaccugcaggagagcggcgugaugcccuaccugagccagcugggcuucgacguggugggcuacggcugcaugaccugcaucggcaacagcggcccccugcccgagcccgugguggaggccaucacccagggcgaccugguggccgugggcgugcugagcggcaacagaaacuucgagggcagagugcaccccaacaccagagccaacuaccuggccagccccccccuggugaucgccuacgccaucgccggcaccaucagaaucgacuucgagaaggagccccugggcgugaacgccaagggccagcagguguuccugaaggacaucuggcccaccagagacgagauccaggccguggagagacaguacgugauccccggcauguucaaggagguguaccagaagaucgagaccgugaacgagagcuggaacgcccuggccacccccagcgacaagcuguucuucuggaacagcaagagcaccuacaucaagagcccccccuucuucgagaaccugacccuggaccugcagccccccaagagcaucguggacgccuacgugcugcugaaccugggcgacagcgugaccaccgaccacaucagccccgccggcaacaucgccagaaacagccccgccgccagauaccugaccaacagaggccugacccccagagaguucaacagcuacggcagcagaagaggcaacgacgccgugauggccagaggcaccuucgccaacaucagacugcugaacagauuccugaacaagcaggccccccagaccauccaccugcccagcggcgagauccuggacguguucgacgccgccgagagauaccagcaggccggccugccccugaucgugcuggccggcaaggaguacggcgccggcagcagcagagacugggccgccaagggccccuuccugcugggcaucaaggccgugcuggccgagagcuacgagagaauccacagaagcaaccuggugggcaugggcgugaucccccuggaguaccugcccggcgagaacgccgacgcccugggccugaccggccaggagagauacaccaucaucauccccgagaaccugaagccccagaugaaggugcaggugaagcuggacaccggcaagaccuuccaggccgugaugagauucgacaccgacguggagcugaccuacuuccugaacggcggcauccugaacuacaugaucagaaagauggccaaguaa

SEQ ID NO: 13182 - RNA, 2343 nt, Artificial Sequence
  ACO2__Homo_sapiens__NP_001089
auggcccccuacagccugcuggugaccagacugcagaaggcccugggcgugagacaguaccacguggccagcgugcugugccagagagccaagguggccaugagccacuucgagcccaacgaguacauccacuacgaccugcuggagaagaacaucaacaucgugagaaagagacugaacagaccccugacccugagcgagaagaucguguacggccaccuggacgaccccgccagccaggagaucgagagaggcaagagcuaccugagacugagacccgacagaguggccaugcaggacgccaccgcccagauggccaugcugcaguucaucagcagcggccugagcaagguggccgugcccagcaccauccacugcgaccaccugaucgaggcccaggugggcggcgagaaggaccugagaagagccaaggacaucaaccaggagguguacaacuuccuggccaccgccggcgccaaguacggcgugggcuucuggaagcccggcagcggcaucauccaccagaucauccuggagaacuacgccuaccccggcgugcugcugaucggcaccgacagccacacccccaacggcggcggccugggcggcaucugcaucggcgugggcggcgccgacgccguggacgugauggccggcauccccugggagcugaagugccccaaggugaucggcgugaagcugaccggcagccugagcggcuggagcagccccaaggacgugauccugaagguggccggcauccugaccgugaagggcggcaccggcgccaucguggaguaccacggccccggcguggacagcaucagcugcaccggcauggccaccaucugcaacaugggcgccgagaucggcgccaccaccagcguguuccccuacaaccacagaaugaagaaguaccugagcaagaccggcagagaggacaucgccaaccuggccgacgaguucaaggaccaccuggugcccgaccccggcugccacuacgaccagcugaucgagaucaaccugagcgagcugaagccccacaucaacggccccuucacccccgaccuggcccaccccguggccgaggugggcaagguggccgagaaggagggcuggccccuggacaucagagugggccugaucggcagcugcaccaacagcagcuacgaggacaugggcagaagcgccgccguggccaagcaggcccuggcccacggccugaagugcaagagccaguucaccaucacccccggcagcgagcagaucagagccaccaucgagagagacggcuacgcccagauccugagagaccugggcggcaucgugcuggccaacgccugcggccccugcaucggccagugggacagaaaggacaucaagaagggcgagaagaacaccaucgugaccagcuacaacagaaacuucaccggcagaaacgacgccaaccccgagacccacgccuucgugaccagccccgagaucgugaccgcccuggccaucgccggcacccugaaguucaaccccgagaccgacuaccugaccggcaccgacggcaagaaguucagacuggaggcccccgacgccgacgagcugcccaagggcgaguucgaccccggccaggacaccuaccagcacccccccaaggacagcagcggccagcacguggacgugagccccaccagccagagacugcagcugcuggagcccuucgacaagugggacggcaaggaccuggaggaccugcagauccugaucaaggugaagggcaagugcaccaccgaccacaucagcgccgccggccccuggcugaaguucagaggccaccuggacaacaucagcaacaaccugcugaucggcgccaucaacaucgagaacggcaaggccaacagcgugagaaacgccgugacccaggaguucggccccgugcccgacaccgccagauacuacaagaagcacggcaucagauggguggugaucggcgacgagaacuacggcgagggcagcagcagagagcacgccgcccuggagcccagacaccugggcggcagagccaucaucaccaagagcuucgccagaauccacgagaccaaccugaagaagcagggccugcugccccugaccuucgccgaccccgccgacuacaacaagauccaccccguggacaagcugaccauccagggccugaaggacuucacccccggcaagccccugaagugcaucaucaagcaccccaacggcacccaggagaccauccugcugaaccacaccuucaacgagacccagaucgagugguucagagccggcagcgcccugaacagaaugaaggagcugcagcaguaa

SEQ ID NO: 13183 - RNA, 354 nt, Artificial Sequence
  ACOT13__Homo_sapiens__NP_001153566
auggugagaaagaucacccuggugagcgccgcccccggcaaggugaucugcgagaugaagguggaggaggagcacaccaacgccaucggcacccugcacggcggccugaccgccacccugguggacaacaucagcaccauggcccugcugugcaccgagagaggcgcccccggcgugagcguggacaugaacaucaccuacaugagccccgccaagcugggcgaggacaucgugaucaccgcccacgugcugaagcagggcaagacccuggccuucaccagcguggaccugaccaacaaggccaccggcaagcugaucgcccagggcagacacaccaagcaccugggcaacuaa

SEQ ID NO: 13184 - RNA, 1266 nt, Artificial Sequence
  ACOT1__Homo_sapiens__NP_001032238
auggccgccacccugauccuggagcccgccggcagaugcugcugggacgagcccgugagaaucgccgugagaggccuggcccccgagcagcccgugacccugagagccagccugagagacgagaagggcgcccuguuccaggcccacgccagauacagagccgacacccugggcgagcuggaccuggagagagcccccgcccugggcggcagcuucgccggccuggagcccaugggccugcugugggcccuggagcccgagaagccccuggugagacuggugaagagagacgugagaaccccccuggccguggagcuggaggugcuggacggccacgaccccgaccccggcagacugcugugcagagugagacacgagagauacuuccugccccccggcgugagaagagagcccgugagagccggcagagugagaggcacccuguuccugccccccgagcccggccccuuccccggcaucguggacauguucggcaccggcggcggccugcuggaguacagagccagccugcuggccggcaagggcuucgccgugauggcccuggccuacuacaacuacgaggaccugcccaagaccauggagacccugcaccuggaguacuucgaggaggccgugaacuaccugcugagccaccccgaggugaagggccccggcgugggccugcugggcaucagcaagggcggcgagcugugccugagcauggccagcuuccugaagggcaucaccgccgccguggugaucaacggcagcguggccaacgugggcggcacccugagauacaagggcgagacccugccccccgugggcgugaacagaaacagaaucaaggugaccaaggacggcuacgccgacaucguggacgugcugaacagcccccuggagggccccgaccagaagagcuucauccccguggagagagccgagagcaccuuccuguuccuggugggccaggacgaccacaacuggaagagcgaguucuacgccaacgaggccugcaagagacugcaggcccacggcagaagaaagccccagaucaucugcuaccccgagaccggccacuacaucgagccccccuacuucccccugugcagagccagccugcacgcccuggugggcagccccaucaucuggggcggcgagcccagagcccacgccauggcccagguggacgccuggaagcagcugcagaccuucuuccacaagcaccugggcggccacgagggcaccauccccagcaagguguaa

SEQ ID NO: 13185 - RNA, 1452 nt, Artificial Sequence
  ACOT2__Homo_sapiens__NP_006812
augagcaacaagcugcugagcccccacccccacagcguggugcugagaagcgaguucaagauggccagcagccccgccgugcugagagccagcagacuguaccaguggagccugaagagcagcgcccaguuccugggcagcccccagcugagacaggugggccagaucaucagagugcccgccagaauggccgccacccugauccuggagcccgccggcagaugcugcugggacgagcccgugagaaucgccgugagaggccuggcccccgagcagcccgugacccugagagccagccugagagacgagaagggcgcccuguuccaggcccacgccagauacagagccgacacccugggcgagcuggaccuggagagagcccccgcccugggcggcagcuucgccggccuggagcccaugggccugcugugggcccuggagcccgagaagccccuggugagacuggugaagagagacgugagaaccccccuggccguggagcuggaggugcuggacggccacgaccccgaccccggcagacugcugugccagaccagacacgagagauacuuccugccccccggcgugagaagagagcccgugagagugggcagagugagaggcacccuguuccugccccccgagcccggccccuuccccggcaucguggacauguucggcaccggcggcggccugcuggaguacagagccagccugcuggccggcaagggcuucgccgugauggcccuggccuacuacaacuacgaggaccugcccaagaccauggagacccugcaccuggaguacuucgaggaggccaugaacuaccugcugagccaccccgaggugaagggccccggcgugggccugcugggcaucagcaagggcggcgagcugugccugagcauggccagcuuccugaagggcaucaccgccgccguggugaucaacggcagcguggccaacgugggcggcacccugcacuacaagggcgagacccugccccccgugggcgugaacagaaacagaaucaaggugaccaaggacggcuacgccgacaucguggacgugcugaacagcccccuggagggccccgaccagaagagcuucauccccguggagagagccgagagcaccuuccuguuccuggugggccaggacgaccacaacuggaagagcgaguucuacgccaacgaggccugcaagagacugcaggcccacggcagaagaaagccccagaucaucugcuaccccgagaccggccacuacaucgagccccccuacuucccccugugcagagccagccugcacgcccuggugggcagccccaucaucuggggcggcgagcccagagcccacgccauggcccagguggacgccuggaagcagcugcagaccuucuuccacaagcaccugggcggccacgagggcaccauccccagcaagguguaa

SEQ ID NO: 13186 - RNA, 1320 nt, Artificial Sequence
  ACOT9__Homo_sapiens__NP_001028755
augagaagagccgcccugagacugugcgcccugggcaagggccagcugacccccggcagaggccugacccagggcccccagaaccccaagaagcagggcaucuuccacauccacgaggugagagacaagcugagagagaucgugggcgccagcaccaacuggagagaccacgugaaggccauggaggagagaaagcugcugcacagcuuccuggccaagagccaggacggccugccccccagaagaaugaaggacagcuacaucgaggugcugcugccccugggcagcgagcccgagcugagagagaaguaccugaccgugcagaacaccgugagauucggcagaauccuggaggaccuggacagccugggcgugcugaucugcuacaugcacaacaagauccacagcgccaagaugagcccccugagcaucgugaccgcccugguggacaagaucgacaugugcaagaagagccugagccccgagcaggacaucaaguucagcggccacgugagcugggugggcaagaccagcauggaggugaagaugcagauguuccagcugcacggcgacgaguucugccccgugcuggacgccaccuucgugaugguggccagagacagcgagaacaagggccccgccuucgugaacccccugauccccgagagccccgaggaggaggagcuguucagacagggcgagcugaacaagggcagaagaaucgccuucagcagcaccagccugcugaagauggcccccagcgccgaggagagaaccaccauccacgagauguuccugagcacccuggaccccaagaccaucagcuucagaagcagagugcugcccagcaacgccguguggauggagaacagcaagcugaagagccuggagaucugccacccccaggagagaaacaucuucaacagaaucuucggcggcuuccugaugagaaaggccuacgagcuggccugggccaccgccugcagcuucggcggcagcagacccuucgugguggccguggacgacaucauguuccagaagcccguggaggugggcagccugcuguuccugagcagccaggugugcuucacccagaacaacuacauccaggugagagugcacagcgagguggccagccugcaggagaagcagcacaccaccaccaacguguuccacuucaccuucaugagcgagaaggaggugccccugguguuccccaagaccuacggcgagagcaugcuguaccuggacggccagagacacuucaacagcaugagcggccccgccacccugagaaaggacuaccugguggagcccuaa

SEQ ID NO: 13187 - RNA, 1869 nt, Artificial Sequence
  ACOX1__Homo_sapiens__NP_001171968
augauccugaacgaccccgacuuccagcacgaggaccugaacuuccugaccagaagccagagauacgagguggccgugagaaagagcgccaucauggugaagaagaugagagaguucggcaucgccgaccccgacgagaucaugugguucaagaacuucgugcacagaggcagacccgagccccuggaccugcaccugggcauguuccugcccacccugcugcaccaggccaccgccgagcagcaggagagauucuucaugcccgccuggaaccuggagaucaucggcaccuacgcccagaccgagaugggccacggcacccaccugagaggccuggagaccaccgccaccuacgaccccgagacccaggaguucauccugaacagccccaccgugaccagcaucaagugguggcccggcggccugggcaagaccagcaaccacgccaucgugcuggcccagcugaucaccaagggcaagugcuacggccugcacgccuucaucgugcccaucagagagaucggcacccacaagccccugcccggcaucaccgugggcgacaucggccccaaguucggcuacgacgagaucgacaacggcuaccugaagauggacaaccacagaauccccagagagaacaugcugaugaaguacgcccaggugaagcccgacggcaccuacgugaagccccugagcaacaagcugaccuacggcaccaugguguucgugagaagcuuccuggugggcgaggccgccagagcccugagcaaggccugcaccaucgccaucagauacagcgccgugagacaccagagcgagaucaagcccggcgagcccgagccccagauccuggacuuccagacccagcaguacaagcuguucccccugcuggccaccgccuacgccuuccaguucgugggcgccuacaugaaggagaccuaccacagaaucaacgagggcaucggccagggcgaccugagcgagcugcccgagcugcacgcccugaccgccggccugaaggccuucaccagcuggaccgccaacaccggcaucgaggccugcagaauggccugcggcggccacggcuacagccacugcagcggccugcccaacaucuacgugaacuucacccccagcugcaccuucgagggcgagaacaccgugaugaugcugcagaccgccagauuccugaugaagagcuacgaccaggugcacagcggcaagcuggugugcggcauggugagcuaccugaacgaccugcccagccagagaauccagccccagcagguggccguguggcccaccaugguggacaucaacagccccgagagccugaccgaggccuacaagcugagagccgccagacugguggagaucgccgccaagaaccugcagaaggaggugauccacagaaagagcaaggagguggccuggaaccugaccagcguggaccuggugagagccagcgaggcccacugccacuacgugguggugaagcuguucagcgagaagcugcugaagauccaggacaaggccauccaggccgugcugagaagccugugccugcuguacagccuguacggcaucagccagaacgccggcgacuuccugcagggcagcaucaugaccgagccccagaucacccaggugaaccagagagugaaggagcugcugacccugaucagaagcgacgccguggcccugguggacgccuucgacuuccaggacgugacccugggcagcgugcugggcagauacgacggcaacguguacgagaaccuguucgagugggccaagaacagcccccugaacaaggccgaggugcacgagagcuacaagcaccugaagagccugcagagcaagcuguaa

SEQ ID NO: 13188 - RNA, 2046 nt, Artificial Sequence
  ACOX2__Homo_sapiens__NP_003491
augggcagccccgugcacagagugagccugggcgacaccuggagcagacagaugcaccccgacaucgagagcgagagauacaugcagagcuucgacguggagagacugaccaacauccuggacggcggcgcccagaacaccgcccugagaagaaagguggagagcaucauccacagcuaccccgaguucagcugcaaggacaacuacuucaugacccagaacgagagauacaaggccgccaugagaagagccuuccacaucagacugaucgccagaagacugggcuggcuggaggacggcagagagcugggcuacgccuacagagcccugagcggcgacguggcccugaacauccacagaguguucgugagagcccugagaagccugggcagcgaggagcagaucgccaagugggacccccugugcaagaacauccagaucaucgccaccuacgcccagaccgagcugggccacggcaccuaccugcagggccuggagaccgaggccaccuacgacgccgccacccaggaguucgugauccacagccccacccugaccgccaccaagugguggcccggcgaccugggcagaagcgccacccacgcccuggugcaggcccagcugaucugcagcggcgccagaagaggcaugcacgccuucaucgugcccaucagaagccugcaggaccacaccccccugcccggcaucaucaucggcgacaucggccccaagauggacuucgaccagaccgacaacggcuuccugcagcugaaccacgugagagugcccagagagaacaugcugagcagauucgcccaggugcugcccgacggcaccuacgugaagcugggcaccgcccagagcaacuaccugcccauggugguggugagaguggagcugcugagcggcgagauccugcccauccugcagaaggccugcgugaucgccaugagauacagcgugaucagaagacagagcagacugagacccagcgaccccgaggccaaggugcuggacuaccagacccagcagcagaagcuguucccccagcuggccaucagcuacgccuuccacuuccuggccgugagccugcuggaguucuuccagcacagcuacaccgccauccugaaccaggacuucagcuuccugcccgagcugcacgcccugagcaccggcaugaaggccaugaugagcgaguucugcacccagggcgccgagaugugcagaagagccugcggcggccacggcuacagcaagcugagcggccugcccagccuggugaccaagcugagcgccagcugcaccuacgagggcgagaacaccgugcuguaccugcagguggccagauuccuggugaagagcuaccugcagacccagaugagccccggcagcaccccccagagaagccugagccccagcguggccuaccugaccgcccccgaccuggccagaugccccgcccagagagccgccgacuuccugugccccgagcuguacaccaccgccugggcccacguggccgugagacugaucaaggacagcgugcagcaccugcagacccugacccagagcggcgccgaccagcacgaggccuggaaccagaccaccgugauccaccugcaggccgccaaggugcacugcuacuacgugaccgugaagggcuucaccgaggcccuggagaagcuggagaacgagcccgccauccagcaggugcugaagagacugugcgaccugcacgccauccacggcauccugaccaacagcggcgacuuccugcacgacgccuuccugagcggcgcccagguggacauggccagaaccgccuaccuggaccugcugagacugaucagaaaggacgccauccugcugaccgacgccuucgacuucaccgaccagugccugaacagcgcccugggcugcuacgacggcaacguguacgagagacuguuccagugggcccagaagagccccaccaacacccaggagaaccccgccuacgaggaguacaucagaccccugcugcagagcuggagaagcaagcuguaa

SEQ ID NO: 13189 - RNA, 1875 nt, Artificial Sequence
  ACOX3__Homo_sapiens__NP_001095137
auggccagcaccguggagggcggcgacaccgcccugcugcccgaguuccccagaggcccccuggacgccuacagagccagagccagcuucagcuggaaggagcuggcccuguucaccgagggcgagggcaugcugagauucaagaagaccaucuucagcgcccuggagaacgacccccuguucgccagaagccccggcgccgaccugagccuggagaaguacagagagcugaacuuccugagaugcaagagaaucuucgaguacgacuuccugagcguggaggacauguucaagagcccccugaaggugcccgcccugauccagugccugggcauguacgacagcagccuggccgccaaguaccugcugcacagccugguguucggcagcgccguguacagcagcggcagcgagagacaccugaccuacauccagaagaucuucagaauggagaucuucggcugcuucgcccugaccgagcugagccacggcagcaacaccaaggccaucagaaccaccgcccacuacgaccccgccaccgaggaguucaucauccacagccccgacuucgaggccgccaaguucugggugggcaacaugggcaagaccgccacccacgccgugguguucgccaagcugugcgugcccggcgaccagugccacggccugcaccccuucaucgugcagaucagagaccccaagacccugcugcccaugcccggcgugauggugggcgacaucggcaagaagcugggccagaacggccuggacaacggcuucgccauguuccacaaggugagagugcccagacagagccugcugaacagaaugggcgacgugacccccgagggcaccuacgugagccccuucaaggacgugagacagagauucggcgccagccugggcagccugagcagcggcagagugagcaucgugagccuggccauccugaaccugaagcuggccguggccaucgcccugagauucagcgccaccagaagacaguucggccccaccgaggaggaggagauccccgugcuggaguaccccaugcagcaguggagacugcugcccuaccuggccgccguguacgcccuggaccacuucagcaagagccuguuccuggaccugguggagcugcagagaggccuggccagcggcgacagaagcgccagacaggccgagcugggcagagagauccacgcccuggccagcgccagcaagccccuggccagcuggaccacccagcagggcauccaggagugcagagaggccugcggcggccacggcuaccuggccaugaacagacugggcgugcugagagacgacaacgaccccaacugcaccuacgagggcgacaacaacauccugcugcagcagaccagcaacuaccugcugggccugcuggcccaccaggugcacgacggcgccugcuucagaagcccccugaagagcguggacuuccuggacgccuaccccggcauccuggaccagaaguucgaggugagcagcguggccgacugccuggacagcgccguggcccuggccgccuacaaguggcuggugugcuaccugcugagagagaccuaccagaagcugaaccaggagaagagaagcggcagcagcgacuucgaggccagaaacaagugccaggugagccacggcagaccccuggcccuggccuucguggagcugaccguggugcagagauuccacgagcacgugcaccagcccagcgugccccccagccugagagccgugcugggcagacugagcgcccuguacgcccuguggagccugagcagacacgccgcccugcuguacagagccgagagaagaugcagcugccccggcagaagagacagaagcagcuaa

SEQ ID NO: 13190 - RNA, 1743 nt, Artificial Sequence
  ACOXL__Homo_sapiens__NP_001136279
augagagcccugaccgugcagagagugaaguucgccauggaccugccccugcugaagagagccggccaggaccuggccgagaagaccaagaacuucgugagcagaagccuggugaucggcgaggugcugagcauggccgacauggccaccggcgugaagugcggcaucaucuacuggcuguucggcggcgccaucagaaaccugggcagccccgagcacgugaccaagugguuccagccccugcaggagcagaaguacaccggcauguucgccaugaccgagagaggccacggcagcaacgccagaggcauccagaccgaggccaccuucgaccugagcgcccaggaguucgugaucgacacccccugcgagaacgccgagaagauguacaucggcaacgccauguacggcaacuacgccgccguguucgcccagcugaucaucgacggcagaagccagggcccccacugcuucaucgugcccgugagagacgagaacggcagccuguaccccggcgugaccgccaucgacaugauguacaaggagggccugcacggcguggacaacggcauccugaucuucgacaaggugagaauccccagagagaaccugcuggacaaguucggcagcguggcccccgacggccaguaccacagccccaucagaaacaagagcgccagauucaacgccaugcuggccgcccugacccccagcagacuggccguggccuuccaggccaugggcgccaugaagcugggccugaccaucgccaucagauacagccacagcagaagacaguucggccccaagaccaaggaggaggugaagaucaucgagcaccagacccagacccugagacugaugccccaccuggccaccgcccuggcccugaccuucgugagcagauacgccggcgcccugcuggacgaggacguguuccagggcaaggagcuggugaacagcagaagccugcaggcccugguggccggccugaaggccuacagcaccugggagaacaucagaugccugcaggacugcagagagugcaccggcggcaugguggugggcagagagcugcuggcccaguacaccaagcaguacgaggagaagccccuguucggccugcugcagaacugggccgagagcgugggcgacaagcugagaaccagcuuccuggccuucaacauggacaccguggacgaccuggccuuccugcugaaggccgugaaguucagagagagagugcugcagagaggccugguggccagaaucuacuacaaggugaagaccaagaaggaggacuucuuccacgccuggaacagcugccugcaccacguggccagccugagccuggcccacacccacagagugacccuggagcaguucagccuggccgugaagagcugccccgaccaggaggaccagacccugcugaugaaguucugccugcuguacggcaccaagcugguguuccaggagagagccugguaccuggagcacaaguaccugacccccauggccagcaccagaaucagaaaccagcugcuggaccugugcgacagcgugaaggacgacgccagaagagugaucagcaccuucaacaucccccacaccuaccugcacgcccccaucgccggcaucagcaaccccagagccgccugggccuucuaccccgccccccugcagcccagacccagagaggaggccagaagcagaagacccaagcugggcgccaagcuguaa

SEQ ID NO: 13191 - RNA, 339 nt, Artificial Sequence
  ACP1__Homo_sapiens__NP_001035739
auggccgagcaggccaccaagagcgugcuguucgugugccugggcaacaucugcagaagccccaucgccgaggccguguucagaaagcuggugaccgaccagaacaucagcgagaacuggagaguggacagcgccgccaccagcggcuacgagaucggcaacccccccgacuacagaggccagagcugcaugaagagacacggcauccccaugagccacguggccagacaggugcccagccuggaccugaagcugugcgugcugugcuucagcggcagccugaccgccgugcuguuccugaccggcaccugggccggcccccagacccaggagcuguaa

SEQ ID NO: 13192 - RNA, 1176 nt, Artificial Sequence
  ACP2__Homo_sapiens__NP_001289419
auggccggcaagagaagcggcuggagcagagccgcccugcugcagcugcugcugggcgugaaccugguggugaugccccccaccagagccagaagccugagauucgugacccuggagggcaugcugcagcacugggagcugggccaggcccugagacagagauaccacggcuuccugaacaccagcuaccacagacaggagguguacgugagaagcaccgacuucgacagaacccugaugagcgccgaggccaaccuggccggccuguucccccccaacggcaugcagagauucaaccccaacaucagcuggcagcccauccccgugcacaccgugcccaucaccgaggacagacugcugaaguucccccugggccccugccccagauacgagcagcugcagaacgagaccagacagacccccgaguaccagaacgagagcagcagaaacgcccaguuccuggacaugguggccaacgagaccggccugaccgaccugacccuggagaccguguggaacguguacgacacccuguucugcgagcagacccacggccugagacugccccccugggccagcccccagaccaugcagagacugagcagacugaaggacuucagcuucagauuccuguucggcaucuaccagcaggccgagaaggccagacugcagggcggcgugcugcuggcccagaucagaaagaaccugacccugauggccaccaccagccagcugcccaagcugcugguguacagcgcccacgacaccacccugguggcccugcagauggcccuggacguguacaacggcgagcaggcccccuacgccagcugccacaucuucgagcuguaccaggaggacagcggcaacuucagcguggagauguacuucagaaacgagagcgacaaggcccccuggccccugagccugcccggcugcccccacagaugcccccugcaggacuuccugagacugaccgagcccguggugcccaaggacuggcagcaggagugccagcuggccagcggccccgccgacaccgaggugaucguggcccuggccgugugcggcagcauccuguuccugcugaucgugcugcugcugaccgugcuguucagaaugcaggcccagccccccggcuacagacacguggccgacggcgaggaccacgccuaa

SEQ ID NO: 13193 - RNA, 978 nt, Artificial Sequence
  ACP5__Homo_sapiens__NP_001104506
auggacauguggaccgcccugcugauccugcaggcccugcugcugcccagccuggccgacggcgccacccccgcccugagauucguggccgugggcgacuggggcggcgugcccaacgcccccuuccacaccgccagagagauggccaacgccaaggagaucgccagaaccgugcagauccugggcgccgacuucauccugagccugggcgacaacuucuacuucaccggcgugcaggacaucaacgacaagagauuccaggagaccuucgaggacguguucagcgacagaagccugagaaaggugcccugguacgugcuggccggcaaccacgaccaccugggcaacgugagcgcccagaucgccuacagcaagaucagcaagagauggaacuuccccagccccuucuacagacugcacuucaagaucccccagaccaacgugagcguggccaucuucaugcuggacaccgugacccugugcggcaacagcgacgacuuccugagccagcagcccgagagacccagagacgugaagcuggccagaacccagcugagcuggcugaagaagcagcuggccgccgccagagaggacuacgugcugguggccggccacuaccccguguggagcaucgccgagcacggccccacccacugccuggugaagcagcugagaccccugcuggccaccuacggcgugaccgccuaccugugcggccacgaccacaaccugcaguaccugcaggacgagaacggcgugggcuacgugcugagcggcgccggcaacuucauggaccccagcaagagacaccagagaaaggugcccaacggcuaccugagauuccacuacggcaccgaggacagccugggcggcuucgccuacguggagaucagcagcaaggagaugaccgugaccuacaucgaggccagcggcaagagccuguucaagaccagacugcccagaagagccagacccuaa

SEQ ID NO: 13194 - RNA, 1206 nt, Artificial Sequence
  ACP6__Homo_sapiens__XP_011507903
augaucaccggcguguucagcaugagacuguggacccccgugggcgugcugaccagccuggccuacugccugcaccagagaagaguggcccuggccgagcugcaggaggccgacggccagugccccguggacagaagccugcugaagcugaagauggugcaggugguguucagacacggcgccagaagcccccugaagccccugccccuggaggagcagguggaguggaacccccagcugcuggaggugcccccccagacccaguucgacuacaccgugaccaaccuggccggcggccccaagcccuacagccccuacgacagccaguaccacgagaccacccugaagggcggcauguucgccggccagcugaccaaggugggcaugcagcagauguucgcccugggcgagagacugagaaagaacuacguggaggacauccccuuccugagccccaccuucaacccccaggagguguucaucagaagcaccaacaucuucagaaaccuggagagcaccagaugccugcuggccggccuguuccagugccagaaggagggccccaucaucauccacaccgacgaggccgacagcgaggugcuguaccccaacuaccagagcugcuggagccugagacagagaaccagaggcagaagacagaccgccagccugcagcccggcaucagcgaggaccugaagaaggugaaggacagaaugggcaucgacagcagcgacaagguggacuucuucauccugcuggacaacguggccgccgagcaggcccacaaccugcccagcugccccaugcugaagagauucgccagaaugaucgagcagagagccguggacaccagccuguacauccugcccaaggaggacagagagagccugcagauggccgugggccccuuccugcacauccuggagagcaaccugcugaaggccauggacagcgccaccgcccccgacaagaucagaaagcuguaccuguacgccgcccacgacgugaccuucaucccccugcugaugacccugggcaucuucgaccacaaguggccccccuucgccguggaccugaccauggagcuguaccagcaccuggagagcaaggagugguucgugcagcuguacuaccacggcaaggaccugcagguggccagcaucaccggcaugaagaagauccugggccuguuccagccccacuaa

SEQ ID NO: 13195 - RNA, 1161 nt, Artificial Sequence
  ACPP__Homo_sapiens__NP_001090
augagagccgccccccugcugcuggccagagccgccagccugagccugggcuuccuguuccugcuguucuucuggcuggacagaagcgugcuggccaaggagcugaaguucgugacccugguguucagacacggcgacagaagccccaucgacaccuuccccaccgaccccaucaaggagagcagcuggccccagggcuucggccagcugacccagcugggcauggagcagcacuacgagcugggcgaguacaucagaaagagauacagaaaguuccugaacgagagcuacaagcacgagcagguguacaucagaagcaccgacguggacagaacccugaugagcgccaugaccaaccuggccgcccuguucccccccgagggcgugagcaucuggaaccccauccugcuguggcagcccauccccgugcacaccgugccccugagcgaggaccagcugcuguaccugcccuucagaaacugccccagauuccaggagcuggagagcgagacccugaagagcgaggaguuccagaagagacugcaccccuacaaggacuucaucgccacccugggcaagcugagcggccugcacggccaggaccuguucggcaucuggagcaagguguacgacccccuguacugcgagagcgugcacaacuucacccugcccagcugggccaccgaggacaccaugaccaagcugagagagcugagcgagcugagccugcugagccuguacggcauccacaagcagaaggagaagagcagacugcagggcggcgugcuggugaacgagauccugaaccacaugaagagagccacccagauccccagcuacaagaagcugaucauguacagcgcccacgacaccaccgugagcggccugcagauggcccuggacguguacaacggccugcugccccccuacgccagcugccaccugaccgagcuguacuucgagaagggcgaguacuucguggagauguacuacagaaacgagacccagcacgagcccuacccccugaugcugcccggcugcagccccagcugcccccuggagagauucgccgagcuggugggccccgugaucccccaggacuggagcaccgagugcaugaccaccaacagccaccagggcaccgaggacagcaccgacuaa

SEQ ID NO: 13196 - RNA, 1632 nt, Artificial Sequence
  ACRBP__Homo_sapiens__NP_115878
augagaaagcccgccgccggcuuccugcccagccugcugaaggugcugcugcugccccuggcccccgccgccgcccaggacagcacccaggccagcacccccggcagcccccugagccccaccgaguacgagagauucuucgcccugcugacccccaccuggaaggccgagaccaccugcagacugagagccacccacggcugcagaaaccccacccuggugcagcuggaccaguacgagaaccacggccuggugcccgacggcgccgugugcagcaaccugcccuacgccagcugguucgagagcuucugccaguucacccacuacagaugcagcaaccacguguacuacgccaagagagugcugugcagccagcccgugagcauccugagccccaacacccugaaggagaucgaggccagcgccgaggugagccccaccaccaugaccagccccaucagcccccacuucaccgugaccgagagacagaccuuccagcccuggcccgagagacugagcaacaacguggaggagcugcugcagagcagccugagccugggcggccaggagcaggcccccgagcacaagcaggagcagggcguggagcacagacaggagcccacccaggagcacaagcaggaggagggccagaagcaggaggagcaggaggaggagcaggaggaggagggcaagcaggaggagggccagggcaccaaggagggcagagaggccgugagccagcugcagaccgacagcgagcccaaguuccacagcgagagccugagcagcaaccccagcagcuucgcccccagagugagagagguggagagcacccccaugaucauggagaacauccaggagcugaucagaagcgcccaggagaucgacgagaugaacgagaucuacgacgagaacagcuacuggagaaaccagaaccccggcagccugcugcagcugccccacaccgaggcccugcuggugcugugcuacagcaucguggagaacaccugcaucaucacccccaccgccaaggccuggaaguacauggaggaggagauccugggcuucggcaagagcgugugcgacagccugggcagaagacacaugagcaccugcgcccugugcgacuucugcagccugaagcuggagcagugccacagcgaggccagccugcagagacagcagugcgacaccagccacaagacccccuucgugagcccccugcuggccagccagagccugagcaucggcaaccaggugggcagccccgagagcggcagauucuacggccuggaccuguacggcggccugcacauggacuucuggugcgccagacuggccaccaagggcugcgaggacgugagagugagcggcuggcugcagaccgaguuccugagcuuccaggacggcgacuuccccaccaagaucugcgacaccgacuacauccaguaccccaacuacugcagcuucaagagccagcagugccugaugagaaacagaaacagaaaggugagcagaaugagaugccugcagaacgagaccuacagcgcccugagccccggcaagagcgaggacguggugcugagauggagccaggaguucagcacccugacccugggccaguucggcuaa

SEQ ID NO: 13197 - RNA, 2076 nt, Artificial Sequence
  ACRC__Homo_sapiens__XP_011529367
auggacggcugcaagaaggagcugcccagacugcaggagcccgaggaggacgaggacugcuacauccugaacgugcagagcagcagcgacgacaccagcggcagcagcguggccagaagagcccccaagagacaggccagcugcauccugaacgugcagagcagaagcggcgacaccagcggcagcagcguggccagaagagcccccaagagacaggccagcagcgugguggugaucgacagcgacagcgacgaggagugccacacccacgaggagaagaaggccaagcugcuggagaucaacagcgacgacgagagccccgagugcugccacgugaagcccgccauccaggagccccccaucgugaucagcgacgacgacaacgacgacgacaacggcaacgaccuggaggugcccgacgacaacagcgacgacagcgaggcccccgacgacaacagcgacgacagcgaggcccccgacgacaacagcgacgacagcgaggcccccgacgacaacagcgacgacagcgaggcccccgacgacaacagcgacgacagcgacgugcccgacgacaacagcgacgacagcagcgacgacaacagcgacgacagcagcgacgacaacagcgacgacagcgacgugcccgacgacaagagcgacgacagcgacgugcccgacgacagcagcgacgacagcgacgugcccgacgacagcagcgacgacagcgaggcccccgacgacagcagcgacgacagcgaggcccccgacgacagcagcgacgacagcgaggcccccgacgacagcagcgacgacagcgaggcccccgacgacagcagcgacgacagcgaggccagcgacgacagcagcgacgacagcgaggccagcgacgacagcagcgacgacagcgaggcccccgacgacaagagcgacgacagcgacgugcccgaggacaagagcgacgacagcgacgugcccgacgacaacagcgacgaccuggaggugcccgugcccgccgaggaccugugcaacgagggccagaucgccagcgacgaggaggagcugguggaggccgccgccgccgugagccagcacgacagcagcgacgacgccggcgagcaggaccugggcgagaaccugagcaagccccccagcgaccccgaggccaaccccgaggugagcgagagaaagcugcccaccgaggaggagcccgcccccgugguggagcagagcggcaagagaaagagcaagaccaagaccaucguggagccccccagaaagagacagaccaagaccaagaacaucguggagccccccagaaagagacagaccaagaccaagaacaucguggagccccugagaaagagaaaggccaagaccaagaacgugagcgugacccccggccacaagaagagaggccccagcaagaagaagcccggcgccgccaagguggagaagagaaagaccagaacccccaagugcaaggugcccggcugcuuccugcaggaccuggagaagagcaagaaguacagcggcaagaaccugaagagaaacaaggacgagcuggugcagagaaucuacgaccuguucaacagaagcgugugcgacaagaagcugcccgagaagcugagaaucggcuggaacaacaagauggugaagaccgccggccugugcagcaccggcgagaugugguaccccaaguggagaagauucgccaagauccagaucggccugaaggugugcgacagcgccgacagaaucagagacacccugauccacgagaugugccacgccgccagcuggcugaucgacggcauccacgacagccacggcgacgccuggaaguacuacgccagaaagagcaacagaauccaccccgagcugcccagagugaccagaugccacaacuacaagaucaacuacaaggugcacuacgagugcaccggcugcaagaccagaaucggcugcuacaccaagagccuggacaccagcagauucaucugcgccaagugcaagggcagccuggugauggugccccugacccagaaggacggcaccagaaucgugccccacguguaa

SEQ ID NO: 13198 - RNA, 1266 nt, Artificial Sequence
  ACR__Homo_sapiens__NP_001088
augguggagaugcugcccaccgccauccugcuggugcuggccgugagcgugguggccaaggacaacgccaccugcgacggccccugcggccugagauucagacagaacccccagggcggcgugagaaucgugggcggcaaggccgcccagcacggcgccuggcccuggauggugagccugcagaucuucaccuacaacagccacagauaccacaccugcggcggcagccugcugaacagcagaugggugcugaccgccgcccacugcuucgugggcaagaacaacgugcacgacuggagacugguguucggcgccaaggagaucaccuacggcaacaacaagcccgugaaggccccccugcaggagagauacguggagaagaucaucauccacgagaaguacaacagcgccaccgagggcaacgacaucgcccugguggagaucaccccccccaucagcugcggcagauucaucggccccggcugccugccccacuucaaggccggccugcccagaggcagccagagcugcuggguggccggcuggggcuacaucgaggagaaggcccccagacccagcagcauccugauggaggccagaguggaccugaucgaccuggaccugugcaacagcacccagugguacaacggcagagugcagcccaccaacgugugcgccggcuaccccgugggcaagaucgacaccugccagggcgacagcggcggcccccugaugugcaaggacagcaaggagagcgccuacgugguggugggcaucaccagcuggggcgugggcugcgccagagccaagagacccggcaucuacaccgccaccuggcccuaccugaacuggaucgccagcaagaucggcagcaacgcccugagaaugauccagagcgccaccccccccccccccaccaccagacccccccccaucagaccccccuucagccaccccaucagcgcccaccugcccugguacuuccagcccccccccagaccccugccccccagaccccccgccgcccagcccagacccccccccagcccccccccccccccccccccccccgccagcccccugcccccccccccccccccccccccccccacccccagcagcaccaccaagcugccccagggccugagcuucgccaagagacugcagcagcugaucgaggugcugaagggcaagaccuacagcgacggcaagaaccacuacgacauggagaccaccgagcugcccgagcugaccagcaccagcuaa

SEQ ID NO: 13199 - RNA, 798 nt, Artificial Sequence
  ACRV1__Homo_sapiens__NP_001603
augaacagauuccugcugcugaugagccuguaccugcugggcagcgccagaggcaccagcagccagcccaacgagcugagcggcagcaucgaccaccagaccagcgugcagcagcugcccggcgaguucuucagccuggagaaccccagcgacgccgaggcccuguacgagaccagcagcggccugaacacccugagcgagcacggcagcagcgagcacggcagcagcaagcacaccguggccgagcacaccagcggcgagcacgccgagagcgagcacgccagcggcgagcccgccgccaccgagcacgccgagggcgagcacaccgugggcgagcagcccagcggcgagcagcccagcggcgagcaccugagcggcgagcagccccugagcgagcuggagagcggcgagcagcccagcgacgagcagcccagcggcgagcacggcagcggcgagcagcccagcggcgagcaggccagcggcgagcagcccagcggcgagcacgccagcggcgagcaggccagcggcgcccccaucagcagcaccagcaccggcaccauccugaacugcuacaccugcgccuacaugaacgaccagggcaagugccugagaggcgagggcaccugcaucacccagaacagccagcagugcaugcugaagaagaucuucgagggcggcaagcugcaguucauggugcagggcugcgagaacaugugccccagcaugaaccuguucagccacggcaccagaaugcagaucaucugcugcagaaaccagagcuucugcaacaagaucuaa

SEQ ID NO: 13200 - RNA, 2175 nt, Artificial Sequence
  ACSBG1__Homo_sapiens__NP_055977
augcccagaaacagcggcgccggcuacggcugcccccacggcgaccccagcaugcuggacagcagagagaccccccaggagagcagacaggacaugaucgugagaaccacccaggagaagcugaagaccagcagccugaccgacagacagccccugagcaaggagagccugaaccacgcccuggagcugagcgugcccgagaaggugaacaacgcccagugggacgcccccgaggaggcccuguggaccaccagagccgacggcagagugagacugagaaucgaccccagcugcccccagcugcccuacaccgugcacagaauguucuacgaggcccuggacaaguacggcgaccugaucgcccugggcuucaagagacaggacaagugggagcacaucagcuacagccaguacuaccugcuggccagaagagccgccaagggcuuccugaagcugggccugaagcaggcccacagcguggccauccugggcuucaacagccccgagugguucuucagcgccgugggcaccguguucgccggcggcaucgugaccggcaucuacaccaccagcagccccgaggccugccaguacaucgccuacgacugcugcgccaacgugaucaugguggacacccagaagcagcuggagaagauccugaagaucuggaagcagcugccccaccugaaggccguggugaucuacaaggagcccccccccaacaagauggccaacguguacaccauggaggaguucauggagcugggcaacgaggugcccgaggaggcccuggacgccaucaucgacacccagcagcccaaccagugcugcgugcugguguacaccagcggcaccaccggcaaccccaagggcgugaugcugagccaggacaacaucaccuggaccgccagauacggcagccaggccggcgacaucagacccgccgaggugcagcaggaggugguggugagcuaccugccccugagccacaucgccgcccagaucuacgaccuguggaccggcauccaguggggcgcccaggugugcuucgccgagcccgacgcccugaagggcagccuggugaacacccugagagagguggagcccaccagccacaugggcgugcccagagugugggagaagaucauggagagaauccaggagguggccgcccagagcggcuucaucagaagaaagaugcugcugugggccaugagcgugacccuggagcagaaccugaccugccccggcagcgaccugaagcccuucaccaccagacuggccgacuaccuggugcuggccaaggugagacaggcccugggcuucgccaagugccagaagaacuucuacggcgccgcccccaugauggccgagacccagcacuucuuccugggccugaacaucagacuguacgccggcuacggccugagcgagaccagcggcccccacuucaugagcagccccuacaacuacagacuguacagcagcggcaagcuggugcccggcugcagagugaagcuggugaaccaggacgccgagggcaucggcgagaucugccuguggggcagaaccaucuucaugggcuaccugaacauggaggacaagaccugcgaggccaucgacgaggagggcuggcugcacaccggcgacgccggcagacuggacgccgacggcuuccuguacaucaccggcagacugaaggagcugaucaucaccgccggcggcgagaacgugccccccgugcccaucgaggaggccgugaagauggagcugcccaucaucagcaacgccaugcugaucggcgaccagagaaaguuccugagcaugcugcugacccugaagugcacccuggaccccgacaccagcgaccagaccgacaaccugaccgagcaggccauggaguucugccagagagugggcagcagagccaccaccgugagcgagaucaucgagaagaaggacgaggccguguaccaggccaucgaggagggcaucagaagagugaacaugaacgccgccgccagacccuaccacauccagaagugggccauccuggagagagacuucagcaucagcggcggcgagcugggccccaccaugaagcugaagagacugaccgugcuggagaaguacaagggcaucaucgacagcuucuaccaggagcagaagauguaa

SEQ ID NO: 13201 - RNA, 2001 nt, Artificial Sequence
  ACSBG2__Homo_sapiens__NP_001276107
augaccggcacccccaagacccaggagggcgccaaggaccuggagguggacaugaacaagaccgaggugacccccagacuguggaccaccugcagagacggcgaggugcugcugagacugagcaagcacggccccggccacgagacccccaugaccauccccgaguucuucagagagagcgugaacagauucggcaccuaccccgcccuggccagcaagaacggcaagaagugggagauccugaacuucaaccaguacuacgaggccugcagaaaggccgccaagagccugaucaagcugggccuggagagauuccacggcgugggcauccugggcuucaacagcgccgagugguucaucaccgccgugggcgccauccuggccggcggccugugcgugggcaucuacgccaccaacagcgccgaggugugccaguacgugaucacccacgccaaggugaacauccugcugguggagaacgaccagcagcugcagaagauccugagcaucccccagagcagccuggagccccugaaggccaucauccaguacagacugcccaugaagaagaacaacaaccuguacagcugggacgacuucauggagcugggcagaagcauccccgacacccagcuggagcaggugaucgagagccagaaggccaaccagugcgccgugcugaucuacaccagcggcaccaccggcauccccaagggcgugaugcugagccacgacaacaucaccuggaucgccggcgccgugaccaaggacuucaagcugaccgacaagcacgagaccguggugagcuaccugccccugagccacaucgccgcccagaugauggacaucugggugcccaucaagaucggcgcccugaccuacuucgcccaggccgacgcccugaagggcacccuggugagcacccugaaggaggugaagcccaccguguucaucggcgugccccagaucugggagaagauccacgagauggugaagaagaacagcgccaagagcaugggccugaagaagaaggccuucgugugggccagaaacaucggcuucaaggugaacagcaagaagaugcugggcaaguacaacacccccgugagcuacagaauggccaagacccugguguucagcaaggugaagaccagccugggccuggaccacugccacagcuucaucagcggcaccgccccccugaaccaggagaccgccgaguucuuccugagccuggacauccccaucggcgagcuguacggccugagcgagagcagcggcccccacaccaucagcaaccagaacaacuacagacugcugagcugcggcaagauccugaccggcugcaagaacaugcuguuccagcagaacaaggacggcaucggcgagaucugccuguggggcagacacaucuucaugggcuaccuggagagcgagaccgagaccaccgaggccaucgacgacgagggcuggcugcacagcggcgaccugggccagcuggacggccugggcuuccuguacgugaccggccacaucaaggagauccugaucaccgccggcggcgagaacgugccccccauccccguggagacccuggugaagaagaagauccccaucaucagcaacgccaugcuggugggcgacaagcugaaguuccugagcaugcugcugacccugaagugcgagaugaaccagaugagcggcgagccccuggacaagcugaacuucgaggccaucaacuucugcagaggccugggcagccaggccagcaccgugaccgagaucgugaagcagcaggacccccugguguacaaggccauccagcagggcaucaacgccgugaaccaggaggccaugaacaacgcccagagaaucgagaagugggugauccuggagaaggacuucagcaucuacggcggcgagcugggccccaugaugaagcugaagagacacuucguggcccagaaguacaagaagcagaucgaccacauguaccacuaa

SEQ ID NO: 13202 - RNA, 1731 nt, Artificial Sequence
  ACSF3__Homo_sapiens__NP_777577
augcugccccacguggugcugaccuucagaagacugggcugcgcccuggccagcugcagacuggcccccgccagacacagaggcagcggccugcugcacaccgcccccguggccagaagcgacagaagcgcccccguguucaccagagcccuggccuucggcgacagaaucgcccugguggaccagcacggcagacacaccuacagagagcuguacagcagaagccugagacugagccaggagaucugcagacugugcggcugcgugggcggcgaccugagagaggagagagugagcuuccugugcgccaacgacgccagcuacgugguggcccagugggccagcuggaugagcggcggcguggccgugccccuguacagaaagcaccccgccgcccagcuggaguacgugaucugcgacagccagagcagcguggugcuggccagccaggaguaccuggagcugcugagccccguggugagaaagcugggcgugccccugcugccccugacccccgccaucuacaccggcgccguggaggagcccgccgaggugcccgugcccgagcagggcuggagaaacaagggcgccaugaucaucuacaccagcggcaccaccggcagacccaagggcgugcugagcacccaccagaacaucagagccguggugaccggccuggugcacaagugggccuggaccaaggacgacgugauccugcacgugcugccccugcaccacgugcacggcguggugaacgcccugcugugcccccugugggugggcgccaccugcgugaugaugcccgaguucagcccccagcaggugugggagaaguuccugagcagcgagacccccagaaucaacguguucauggccgugcccaccaucuacaccaagcugauggaguacuacgacagacacuucacccagccccacgcccaggacuuccugagagccgugugcgaggagaagaucagacugauggugagcggcagcgccgcccugccccugcccgugcuggagaaguggaagaacaucaccggccacacccugcuggagagauacggcaugaccgagaucggcauggcccugagcggcccccugaccaccgccgugagacugcccggcagcgugggcaccccccugcccggcgugcaggugagaaucgugagcgagaacccccagagagaggccugcagcuacaccauccacgccgagggcgacgagagaggcaccaaggugacccccggcuucgaggagaaggagggcgagcugcuggugagaggccccagcguguucagagaguacuggaacaagcccgaggagaccaagagcgccuucacccuggacggcugguucaagaccggcgacaccgugguguucaaggacggccaguacuggaucagaggcagaaccagcguggacaucaucaagaccggcggcuacaaggugagcgcccuggagguggaguggcaccugcuggcccaccccagcaucaccgacguggccgugaucggcgugcccgacaugaccuggggccagagagugaccgccguggugacccugagagagggccacagccugagccacagagagcugaaggagugggccagaaacgugcuggcccccuacgccgugcccagcgagcuggugcugguggaggagauccccagaaaccagaugggcaagaucgacaagaaggcccugaucagacacuuccaccccagcuaa

SEQ ID NO: 13203 - RNA, 1995 nt, Artificial Sequence
  ACSL1__Homo_sapiens__NP_001273640
augcaggcccacgagcuguucagauacuucagaaugcccgagcugguggacuucagacaguacgugagaacccugcccaccaacacccugaugggcuucggcgccuucgccgcccugaccaccuucugguacgccaccagacccaagccccugaagccccccugcgaccugagcaugcagagcguggagguggccggcagcggcggcgccagaagaagcgcccugcuggacagcgacgagccccugguguacuucuacgacgacgugaccacccuguacgagggcuuccagagaggcauccaggugagcaacaacggccccugccugggcagcagaaagcccgaccagcccuacgaguggcugagcuacaagcagugggugaucaucgagcagggcugcuucgccuacagcauggugaucgugccccuguacgacacccugggcaacgaggccaucaccuacaucgugaacaaggccgagcugagccugguguucguggacaagcccgagaaggccaagcugcugcuggagggcguggagaacaagcugauccccggccugaagaucaucguggugauggacgccuacggcagcgagcugguggagagaggccagagaugcggcguggaggugaccagcaugaaggccauggaggaccugggcagagccaacagaagaaagcccaagccccccgcccccgaggaccuggccgugaucugcuucaccagcggcaccaccggcaaccccaagggcgccauggugacccacagaaacaucgugagcgacugcagcgccuucgugaaggccaccgagaacaccgugaaccccugccccgacgacacccugaucagcuuccugccccuggcccacauguucgagagagugguggagugcgugaugcugugccacggcgccaagaucggcuucuuccagggcgacaucagacugcugauggacgaccugaaggugcugcagcccaccguguuccccguggugcccagacugcugaacagaauguucgacagaaucuucggccaggccaacaccacccugaagagauggcugcuggacuucgccagcaagagaaaggaggccgagcugagaagcggcaucaucagaaacaacagccugugggacagacugaucuuccacaaggugcagagcagccugggcggcagagugagacugauggugaccggcgccgcccccgugagcgccaccgugcugaccuuccugagagccgcccugggcugccaguucuacgagggcuacggccagaccgagugcaccgccggcugcugccugaccaugcccggcgacuggaccgccggccacgugggcgcccccaugcccugcaaccugaucaagcugguggacguggaggagaugaacuacauggccgccgagggcgagggcgaggugugcgugaagggccccaacguguuccagggcuaccugaaggaccccgccaagaccgccgaggcccuggacaaggacggcuggcugcacaccggcgacaucggcaaguggcugcccaacggcacccugaagaucaucgacagaaagaagcacaucuucaagcuggcccagggcgaguacaucgcccccgagaagaucgagaacaucuacaugagaagcgagcccguggcccagguguucgugcacggcgagagccugcaggccuuccugaucgccaucguggugcccgacguggagacccugugcagcugggcccagaagagaggcuucgagggcagcuucgaggagcugugcagaaacaaggacgugaagaaggccauccuggaggacauggugagacugggcaaggacagcggccugaagcccuucgagcaggugaagggcaucacccugcaccccgagcuguucagcaucgacaacggccugcugacccccaccaugaaggccaagagacccgagcugagaaacuacuucagaagccagaucgacgaccuguacagcaccaucaagguguaa

SEQ ID NO: 13204 - RNA, 2163 nt, Artificial Sequence
  ACSL3__Homo_sapiens__NP_976251
augaacaaccacgugagcagcaagcccagcaccaugaagcugaagcacaccaucaaccccauccugcuguacuucauccacuuccugaucagccuguacaccauccugaccuacauccccuucuacuucuucagcgagagcagacaggagaagagcaacagaaucaaggccaagcccgugaacagcaagcccgacagcgccuacagaagcgugaacagccuggacggccuggccagcgugcuguaccccggcugcgacacccuggacaagguguucaccuacgccaagaacaaguucaagaacaagagacugcugggcaccagagaggugcugaacgaggaggacgaggugcagcccaacggcaagaucuucaagaaggugauccugggccaguacaacuggcugagcuacgaggacguguucgugagagccuucaacuucggcaacggccugcagaugcugggccagaagcccaagaccaacaucgccaucuucugcgagaccagagccgaguggaugaucgccgcccaggccugcuucauguacaacuuccagcuggugacccuguacgccacccugggcggccccgccaucgugcacgcccugaacgagaccgaggugaccaacaucaucaccagcaaggagcugcugcagaccaagcugaaggacaucgugagccuggugcccagacugagacacaucaucaccguggacggcaagccccccaccuggagcgaguuccccaagggcaucaucgugcacaccauggccgccguggaggcccugggcgccaaggccagcauggagaaccagccccacagcaagccccugcccagcgacaucgccgugaucauguacaccagcggcagcaccggccugcccaagggcgugaugaucagccacagcaacaucaucgccggcaucaccggcauggccgagagaauccccgagcugggcgaggaggacguguacaucggcuaccugccccuggcccacgugcuggagcugagcgccgagcuggugugccugagccacggcugcagaaucggcuacagcagcccccagacccuggccgaccagagcagcaagaucaagaagggcagcaagggcgacaccagcaugcugaagcccacccugauggccgccgugcccgagaucauggacagaaucuacaagaacgugaugaacaaggugagcgagaugagcagcuuccagagaaaccuguucauccuggccuacaacuacaagauggagcagaucagcaagggcagaaacaccccccugugcgacagcuucguguucagaaaggugagaagccugcugggcggcaacaucagacugcugcugugcggcggcgccccccugagcgccaccacccagagauucaugaacaucugcuucugcugccccgugggccagggcuacggccugaccgagagcgccggcgccggcaccaucagcgaggugugggacuacaacaccggcagagugggcgccccccuggugugcugcgagaucaagcugaagaacugggaggagggcggcuacuucaacaccgacaagccccaccccagaggcgagauccugaucggcggccagagcgugaccaugggcuacuacaagaacgaggccaagaccaaggccgacuucuucgaggacgagaacggccagagauggcugugcaccggcgacaucggcgaguucgagcccgacggcugccugaagaucaucgacagaaagaaggaccuggugaagcugcaggccggcgaguacgugagccugggcaagguggaggccgcccugaagaaccugccccugguggacaacaucugcgccuacgccaacagcuaccacagcuacgugaucggcuucguggugcccaaccagaaggagcugaccgagcuggccagaaagaagggccugaagggcaccugggaggagcugugcaacagcugcgagauggagaacgaggugcugaaggugcugagcgaggccgccaucagcgccagccuggagaaguucgagauccccgugaagaucagacugagccccgagcccuggacccccgagaccggccuggugaccgacgccuucaagcugaagagaaaggagcugaagacccacuaccaggccgacaucgagagaauguacggcagaaaguaa

SEQ ID NO: 13205 - RNA, 2220 nt, Artificial Sequence
  ACSL5__Homo_sapiens__NP_057318
auggacgcccugaagccccccugccuguggagaaaccacgagagaggcaagaaggacagagacagcugcggcagaaagaacagcgagcccggcagcccccacagccuggaggcccugagagacgccgcccccagccagggccugaacuuccugcugcuguucaccaagaugcuguucaucuucaacuuccuguucagcccccugcccacccccgcccugaucugcauccugaccuucggcgccgccaucuuccuguggcugaucaccagaccccagcccgugcugccccugcuggaccugaacaaccagagcgugggcaucgagggcggcgccagaaagggcgugagccagaagaacaacgaccugaccagcugcugcuucagcgacgccaagaccauguacgagguguuccagagaggccuggccgugagcgacaacggccccugccugggcuacagaaagcccaaccagcccuacagauggcugagcuacaagcaggugagcgacagagccgaguaccugggcagcugccugcugcacaagggcuacaagagcagccccgaccaguucgugggcaucuucgcccagaacagacccgaguggaucaucagcgagcuggccugcuacaccuacagcaugguggccgugccccuguacgacacccugggccccgaggccaucgugcacaucgugaacaaggccgacaucgccauggugaucugcgacaccccccagaaggcccuggugcugaucggcaacguggagaagggcuucacccccagccugaaggugaucauccugauggaccccuucgacgacgaccugaagcagagaggcgagaagagcggcaucgagauccugagccuguacgacgccgagaaccugggcaaggagcacuucagaaagcccgugccccccagccccgaggaccugagcgugaucugcuucaccagcggcaccaccggcgaccccaagggcgccaugaucacccaccagaacaucgugagcaacgccgccgccuuccugaagugcguggagcacgccuacgagcccacccccgacgacguggccaucagcuaccugccccuggcccacauguucgagagaaucgugcaggccgugguguacagcugcggcgccagagugggcuucuuccagggcgacaucagacugcuggccgacgacaugaagacccugaagcccacccuguuccccgccgugcccagacugcugaacagaaucuacgacaaggugcagaacgaggccaagaccccccugaagaaguuccugcugaagcuggccgugagcagcaaguucaaggagcugcagaagggcaucaucagacacgacagcuucugggacaagcugaucuucgccaagauccaggacagccugggcggcagagugagagugaucgugaccggcgccgcccccaugagcaccagcgugaugaccuucuucagagccgccaugggcugccagguguacgaggccuacggccagaccgagugcaccggcggcugcaccuucacccugcccggcgacuggaccagcggccacgugggcgugccccuggccugcaacuacgugaagcuggaggacguggccgacaugaacuacuucaccgugaacaacgagggcgaggugugcaucaagggcaccaacguguucaagggcuaccugaaggaccccgagaagacccaggaggcccuggacagcgacggcuggcugcacaccggcgacaucggcagauggcugcccaacggcacccugaagaucaucgacagaaagaagaacaucuucaagcuggcccagggcgaguacaucgcccccgagaagaucgagaacaucuacaacagaagccagcccgugcugcagaucuucgugcacggcgagagccugagaagcagccuggugggcgugguggugcccgacaccgacgugcugcccagcuucgccgccaagcugggcgugaagggcagcuucgaggagcugugccagaaccagguggugagagaggccauccuggaggaccugcagaagaucggcaaggagagcggccugaagaccuucgagcaggugaaggccaucuuccugcaccccgagcccuucagcaucgagaacggccugcugacccccacccugaaggccaagagaggcgagcugagcaaguacuucagaacccagaucgacagccuguacgagcacauccaggacuaa

SEQ ID NO: 13206 - RNA, 2169 nt, Artificial Sequence
  ACSL6__Homo_sapiens__NP_001009185
augcugaccuucuuccuggugagcggcggcagccuguggcuguucguggaguucgugcugagccugcuggagaagaugcagacccaggagauccugagaauccugagacugcccgagcugggcgaccugggccaguucuucagaagccugagcgccaccacccuggugagcaugggcgcccuggccgccauccuggccuacugguucacccacagacccaaggcccugcagccccccugcaaccugcugaugcagagcgaggagguggaggacagcggcggcgccagaagaagcgugaucggcagcggcccccagcugcugacccacuacuacgacgacgccagaaccauguaccagguguucagaagaggccugagcaucagcggcaacggccccugccugggcuucagaaagcccaagcagcccuaccaguggcugagcuaccaggagguggccgacagagccgaguuccugggcagcggccugcugcagcacaacugcaaggccugcaccgaccaguucaucggcguguucgcccagaacagacccgaguggaucaucguggagcuggccugcuacaccuacagcauggugguggugccccuguacgacacccugggccccggcgccaucagauacaucaucaacaccgccgacaucagcaccgugaucguggacaagccccagaaggccgugcugcugcuggagcacguggagagaaaggagacccccggccugaagcugaucauccugauggaccccuucgaggaggcccugaaggagagaggccagaagugcggcguggugaucaagagcaugcaggccguggaggacugcggccaggagaaccaccaggcccccgugcccccccagcccgacgaccugagcaucgugugcuucaccagcggcaccaccggcaaccccaagggcgccaugcugacccacggcaacgugguggccgacuucagcggcuuccugaaggugaccgagaaggugaucuuccccagacaggacgacgugcugaucagcuuccugccccuggcccacauguucgagagagugauccagagcgugguguacugccacggcggcagagugggcuucuuccagggcgacaucagacugcugagcgacgacaugaaggcccugugccccaccaucuuccccguggugcccagacugcugaacagaauguacgacaagaucuucagccaggccaacaccccccugaagagauggcugcuggaguucgccgccaagagaaagcaggccgaggugagaagcggcaucaucagaaacgacagcaucugggacgagcuguucuucaacaagauccaggccagccugggcggcugcgugagaaugaucgugaccggcgccgcccccgccagccccaccgugcugggcuuccugagagccgcccugggcugccagguguacgagggcuacggccagaccgagugcaccgccggcugcaccuucaccacccccggcgacuggaccagcggccacgugggcgccccccugcccugcaaccacaucaagcugguggacguggaggagcugaacuacugggccugcaagggcgagggcgagaucugcgugagaggccccaacguguucaagggcuaccugaaggaccccgacagaaccaaggaggcccuggacagcgacggcuggcugcacaccggcgacaucggcaaguggcugcccgccggcacccugaagaucaucgacagaaagaagcacaucuucaagcuggcccagggcgaguacguggcccccgagaagaucgagaacaucuacaucagaagccagcccguggcccagaucuacgugcacggcgacagccugaaggccuuccuggugggcaucguggugcccgaccccgaggugaugcccagcugggcccagaagagaggcaucgagggcaccuacgccgaccugugcaccaacaaggaccugaagaaggccauccuggaggacauggugagacugggcaaggagagcggccugcacagcuucgagcaggugaaggccauccacauccacagcgacauguucagcgugcagaacggccugcugacccccacccugaaggccaagagacccgagcugagagaguacuucaagaagcagaucgaggagcuguacagcaucagcauguaa

SEQ ID NO: 13207 - RNA, 1734 nt, Artificial Sequence
  ACSM1__Homo_sapiens__NP_001305819
augcaguggcugaugagauucagaacccuguggggcauccacaagagcuuccacaacauccaccccgcccccagccagcugagaugcagaagccugagcgaguucggcgcccccagauggaacgacuacgaggugcccgaggaguucaacuucgccagcuacgugcuggacuacugggcccagaaggagaaggagggcaagagaggccccaaccccgccuucuggugggugaacggccagggcgacgaggugaaguggagcuucagagagaugggcgaccugaccagaagaguggccaacguguucacccagaccugcggccugcagcagggcgaccaccuggcccugaugcugcccagagugcccgagugguggcugguggccgugggcugcaugagaaccggcaucaucuucauccccgccaccauccugcugaaggccaaggacauccuguacagacugcagcugagcaaggccaagggcaucgugaccaucgacgcccuggccagcgagguggacagcaucgccagccagugccccagccugaagaccaagcugcuggugagcgaccacagcagagagggcuggcuggacuucagaagccuggugaagagcgccagccccgagcacaccugcgugaagagcaagacccuggaccccauggugaucuucuucaccagcggcaccaccggcuuccccaagauggccaagcacagccacggccuggcccugcagcccagcuuccccggcagcagaaagcugagaagccugaagaccagcgacgugagcuggugccugagcgacagcggcuggaucguggccaccaucuggacccugguggagcccuggaccgccggcugcaccguguucauccaccaccugccccaguucgacaccaaggugaucauccagacccugcugaaguaccccaucaaccacuucuggggcgugagcagcaucuacagaaugauccugcagcaggacuucaccagcaucagauuccccgcccuggagcacugcuacaccggcggcgagguggugcugcccaaggaccaggaggaguggaagagaagaaccggccugcugcuguacgagaacuacggccagagcgagaccggccugaucugcgccaccuacuggggcaugaagaucaagcccggcuucaugggcaaggccaccccccccuacgacgugcaggugaucgacgacaagggcagcauccugccccccaacaccgagggcaacaucggcaucagaaucaagcccgugagacccgugagccuguucaugugcuacgagggcgaccccgagaagaccgccaagguggagugcggcgacuucuacaacaccggcgacagaggcaagauggacgaggagggcuacaucugcuuccugggcagaagcgacgacaucaucaacgccagcggcuacagaaucggccccgccgagguggagagcgcccugguggagcaccccgccguggccgagagcgccguggugggcagccccgaccccaucagaggcgagguggugaaggccuucaucgugcugaccccccaguuccugagccacgacaaggaccagcugaccaaggagcugcagcagcacgugaagagcgugaccgcccccuacaaguaccccagaaagguggaguucgugagcgagcugcccaagaccaucaccggcaagaucgagagaaaggagcugagaaagaaggagaccggccagauguaa

SEQ ID NO: 13208 - RNA, 1734 nt, Artificial Sequence
  ACSM2B__Homo_sapiens__NP_001098539
augcacuggcugagaaaggugcagggccugugcacccuguggggcacccagaugagcagcagaacccuguacaucaacagcagacagcuggugagccugcaguggggccaccaggaggugcccgccaaguucaacuucgccagcgacgugcuggaccacugggccgacauggagaaggccggcaagagacugcccagccccgcccuguggugggugaacggcaagggcaaggagcugauguggaacuucagagagcugagcgagaacagccagcaggccgccaacauccugagcggcgccugcggccugcagagaggcgacagaguggccgugaugcugcccagagugcccgagugguggcuggugauccugggcugcaucagagccggccugaucuucaugcccggcaccauccagaugaagagcaccgacauccuguacagacugcagaugagcaaggccaaggccaucguggccggcgacgaggugauccaggagguggacaccguggccagcgagugccccagccugagaaucaagcugcuggugagcgagaagagcugcgacggcuggcugaacuucaagaagcugcugaacgaggccagcaccacccaccacugcguggagaccggcagccaggaggccagcgccaucuacuucaccagcggcaccagcggccugcccaagauggccgagcacagcuacagcagccugggccugaaggccaagauggacgccggcuggaccggccugcaggccagcgacaucauguggaccaucagcgacaccggcuggauccugaacauccugggcagccugcuggagagcuggacccugggcgccugcaccuucgugcaccugcugcccaaguucgacccccuggugauccugaagacccugagcagcuaccccaucaagagcaugaugggcgcccccaucguguacagaaugcugcugcagcaggaccugagcagcuacaaguucccccaccugcagaacugccuggccggcggcgagagccugcugcccgagacccuggagaacuggagagcccagaccggccuggacaucagagaguucuacggccagaccgagaccggccugaccugcauggugagcaagaccaugaagaucaagcccggcuacaugggcaccgccgccagcugcuacgacgugcaggugaucgacgacaagggcaacgugcugccccccggcaccgagggcgacaucggcaucagagugaagcccaucagacccaucggcaucuucagcggcuacguggagaaccccgacaagaccgccgccaacaucagaggcgacuucuggcugcugggcgacagaggcaucaaggacgaggacggcuacuuccaguucaugggcagagccgacgacaucaucaacagcagcggcuacagaaucggccccagcgagguggagaacgcccugaugaagcaccccgccgugguggagaccgccgugaucagcagccccgaccccgugagaggcgagguggugaaggccuucgugauccuggccagccaguuccugagccacgaccccgagcagcugaccaaggagcugcagcagcacgugaagagcgugaccgcccccuacaaguaccccagaaagaucgaguucgugcugaaccugcccaagaccgugaccggcaagauccagagaaccaagcugagagacaaggaguggaagaugagcggcaaggccagagcccaguaa

SEQ ID NO: 13209 - RNA, 1761 nt, Artificial Sequence
  ACSM3__Homo_sapiens__NP_005613
augcuggccagagugaccagaaagaugcugagacacgccaagugcuuccagagacuggccaucuucggcagcgugagagcccugcacaaggacaacagaaccgccaccccccagaacuucagcaacuacgagagcaugaagcaggacuucaagcugggcauccccgaguacuucaacuucgccaaggacgugcuggaccaguggaccgacaaggagaaggccggcaagaagcccagcaaccccgccuucugguggaucaacagaaacggcgaggagaugagauggagcuucgaggagcugggcagccugagcagaaaguucgccaacauccugagcgaggccugcagccugcagagaggcgacagagugauccugauccugcccagagugcccgagugguggcuggccaacguggccugccugagaaccggcaccgugcugauccccggcaccacccagcugacccagaaggacauccuguacagacugcagagcagcaaggccaacugcaucaucaccaacgacgugcuggcccccgccguggacgccguggccagcaagugcgagaaccugcacagcaagcugaucgugagcgagaacagcagagagggcuggggcaaccugaaggagcugaugaagcacgccagcgacagccacaccugcgugaagaccaagcacaacgagaucauggccaucuucuucaccagcggcaccagcggcuaccccaagaugaccgcccacacccacagcagcuucggccugggccugagcgugaacggcagauucuggcuggaccugacccccagcgacgugauguggaacaccagcgacaccggcugggccaagagcgccuggagcagcguguucagccccuggauccagggcgccugcguguucacccaccaccugcccagauucgagcccaccagcauccugcagacccugagcaaguaccccaucaccguguucugcagcgcccccaccguguacagaaugcuggugcagaacgacaucaccagcuacaaguucaagagccugaagcacugcgugagcgccggcgagcccaucacccccgacgugaccgagaaguggagaaacaagaccggccuggacaucuacgagggcuacggccagaccgagaccgugcugaucugcggcaacuucaagggcaugaagaucaagcccggcagcaugggcaagcccagccccgccuucgacgugaagaucguggacgugaacggcaacgugcugccccccggccaggagggcgacaucggcauccaggugcugcccaacagacccuucggccuguucacccacuacguggacaaccccagcaagaccgccagcacccugagaggcaacuucuacaucaccggcgacagaggcuacauggacaaggacggcuacuucugguucguggccagagccgacgacgugauccugagcagcggcuacagaaucggccccuucgagguggagaacgcccugaacgagcaccccagcguggccgagagcgccguggugagcagccccgaccccaucagaggcgagguggugaaggccuucguggugcugaaccccgacuacaagagccacgaccaggagcagcugaucaaggagauccaggagcacgugaagaagaccaccgcccccuacaaguaccccagaaagguggaguucauccaggagcugcccaagaccaucagcggcaagaccaagagaaacgagcugagaaagaaggaguggaagaccaucuaa

SEQ ID NO: 13210 - RNA, 1707 nt, Artificial Sequence
  ACSS1__Homo_sapiens__NP_001239605
augagaagaagaaaggagagacagcccugggacagauuccacuuccugcacuucgccccccacggcagagagcugcuggagaccaccugcagacuggccaacacccugaagagacacggcgugcacagaggcgacagaguggccaucuacaugcccgugagcccccuggccguggccgccaugcuggccugcgccagaaucggcgccgugcacaccgugaucuucgccggcuucagcgccgagagccuggccggcagaaucaacgacgccaagugcaagguggugaucaccuucaaccagggccugagaggcggcagagugguggagcugaagaagaucguggacgaggccgugaagcacugccccaccgugcagcacgugcugguggcccacagaaccgacaacaaggugcacaugggcgaccuggacgugccccuggagcaggagauggccaaggaggaccccgugugcgcccccgagagcaugggcagcgaggacaugcuguucaugcuguacaccagcggcagcaccggcaugcccaagggcaucgugcacacccaggccggcuaccugcuguacgccgcccugacccacaagcugguguucgaccaccagcccggcgacaucuucggcugcguggccgacaucggcuggaucaccggccacagcuacgugguguacggcccccugugcaacggcgccaccagcgugcuguucgagagcacccccguguaccccaacgccggcagauacugggagaccguggagagacugaagaucaaccaguucuacggcgcccccaccgccgugagacugcugcugaaguacggcgacgccugggugaagaaguacgacagaagcagccugagaacccugggcagcgugggcgagcccaucaacugcgaggccugggaguggcugcacagaguggugggcgacagcagaugcacccugguggacaccugguggcagaccgagaccggcggcaucugcaucgcccccagacccagcgaggagggcgccgagauccugcccgccauggccaugagacccuucuucggcaucgugcccgugcugauggacgagaagggcagcgugguggagggcagcaacgugagcggcgcccugugcaucagccaggccuggcccggcauggccagaaccaucuacggcgaccaccagagauucguggacgccuacuucaaggccuaccccggcuacuacuucaccggcgacggcgccuacagaaccgagggcggcuacuaccagaucaccggcagaauggacgacgugaucaacaucagcggccacagacugggcaccgccgagaucgaggacgccaucgccgaccaccccgccgugcccgagagcgccgugaucggcuacccccacgacaucaagggcgaggccgccuucgccuucaucguggugaaggacagcgccggcgacagcgacgugguggugcaggagcugaagagcaugguggccaccaagaucgccaaguacgccgugcccgacgagauccugguggugaagagacugcccaagaccagaagcggcaaggugaugagaagacugcugagaaagaucaucaccagcgaggcccaggagcugggcgacaccaccacccuggaggaccccagcaucaucgccgagauccugagcguguaccagaagugcaaggacaagcaggccgccgccaaguaa

SEQ ID NO: 13211 - RNA, 2145 nt, Artificial Sequence
  ACSS2__Homo_sapiens__NP_001070020
augggccugcccgaggagagagugagaagcggcagcggcagcagaggccaggaggaggccggcgccggcggcagagccagaagcuggagccccccccccgaggugagcagaagcgcccacgugcccagccugcagagauacagagagcugcacagaagaagcguggaggagcccagagaguucuggggcgacaucgccaaggaguucuacuggaagacccccugccccggccccuuccugagauacaacuucgacgugaccaagggcaagaucuucaucgaguggaugaagggcgccaccaccaacaucugcuacaacgugcuggacagaaacgugcacgagaagaagcugggcgacaagguggccuucuacugggagggcaacgagcccggcgagaccacccagaucaccuaccaccagcugcuggugcaggugugccaguucagcaacgugcugagaaagcagggcauccagaagggcgacagaguggccaucuacaugcccaugauccccgagcuggugguggccaugcuggccugcgccagaaucggcgcccugcacagcaucguguucgccggcuucagcagcgagagccugugcgagagaauccuggacagcagcugcagccugcugaucaccaccgacgccuucuacagaggcgagaagcuggugaaccugaaggagcuggccgacgaggcccugcagaagugccaggagaagggcuuccccgugagaugcugcaucguggugaagcaccugggcagagccgagcugggcaugggcgacagcaccagccagagcccccccaucaagagaagcugccccgacgugcagggcaagcugaaggagaagagcaagagagugcagccccagaucagcuggaaccagggcaucgaccugugguggcacgagcugaugcaggaggccggcgacgagugcgagcccgaguggugcgacgccgaggacccccuguucauccuguacaccagcggcagcaccggcaagcccaagggcguggugcacaccgugggcggcuacaugcuguacguggccaccaccuucaaguacguguucgacuuccacgccgaggacguguucuggugcaccgccgacaucggcuggaucaccggccacagcuacgugaccuacggcccccuggccaacggcgccaccagcgugcuguucgagggcauccccaccuaccccgacgugaacagacuguggagcaucguggacaaguacaaggugaccaaguucuacaccgcccccaccgccaucagacugcugaugaaguucggcgacgagcccgugaccaagcacagcagagccagccugcaggugcugggcaccgugggcgagcccaucaaccccgaggccuggcugugguaccacagaguggugggcgcccagagaugccccaucguggacaccuucuggcagaccgagaccggcggccacaugcugaccccccugcccggcgccacccccaugaagcccggcagcgccaccuuccccuucuucggcguggcccccgccauccugaacgagagcggcgaggagcuggagggcgaggccgagggcuaccugguguucaagcagcccuggcccggcaucaugagaaccguguacggcaaccacgagagauucgagaccaccuacuucaagaaguuccccggcuacuacgugaccggcgacggcugccagagagaccaggacggcuacuacuggaucaccggcagaaucgacgacaugcugaacgugagcggccaccugcugagcaccgccgagguggagagcgcccugguggagcacgaggccguggccgaggccgccguggugggccacccccaccccgugaagggcgagugccuguacugcuucgugacccugugcgacggccacaccuucagccccaagcugaccgaggagcugaagaagcagaucagagagaagaucggccccaucgccacccccgacuacauccagaacgcccccggccugcccaagaccagaagcggcaagaucaugagaagagugcugagaaagaucgcccagaacgaccacgaccugggcgacaugagcaccguggccgaccccagcgugaucagccaccuguucagccacagaugccugaccauccaguaa

SEQ ID NO: 13212 - RNA, 2061 nt, Artificial Sequence
  ACSS3__Homo_sapiens__NP_078836
augaagcccagcuggcugcagugcagaaaggugaccagcgccggcggccugggcggcccccugcccggcagcagccccgccagaggcgccggcgccgcccugagagcccugguggugcccggccccagaggcggccugggcggcagaggcugcagagcccugagcagcggcagcggcagcgaguacaagacccacuucgccgccagcgugaccgaccccgagagauucuggggcaaggccgccgagcagaucagcugguacaagcccuggaccaagacccuggagaacaagcacagccccagcaccagaugguucguggagggcaugcugaacaucugcuacaacgccguggacagacacaucgagaacggcaagggcgacaagaucgccaucaucuacgacagccccgugaccaacaccaaggccaccuucaccuacaaggaggugcuggagcaggugagcaagcuggccggcgugcuggugaagcacggcaucaagaagggcgacaccguggugaucuacaugcccaugaucccccaggccauguacaccaugcuggccugcgccagaaucggcgccauccacagccugaucuucggcggcuucgccagcaaggagcugagcagcagaaucgaccacgugaagcccaaggugguggugaccgccagcuucggcaucgagcccggcagaagaguggaguacgugccccugguggaggaggcccugaagaucggccagcacaagcccgacaagauccugaucuacaacagacccaacauggaggccgugccccuggcccccggcagagaccuggacugggacgaggagauggccaaggcccagagccacgacugcgugcccgugcugagcgagcacccccuguacauccuguacaccagcggcaccaccggccugcccaagggcgugaucagacccaccggcggcuacgccgugaugcugcacuggagcaugagcagcaucuacggccugcagcccggcgagguguggugggccgccagcgaccugggcuggguggugggccacagcuacaucugcuacggcccccugcugcacggcaacaccaccgugcuguacgagggcaagcccgugggcacccccgacgccggcgccuacuucagagugcuggccgagcacggcguggccgcccuguucaccgcccccaccgccaucagagccaucagacagcaggaccccggcgccgcccugggcaagcaguacagccugaccagauucaagacccuguucguggccggcgagagaugcgacguggagacccuggaguggagcaagaacguguucagagugcccgugcuggaccacugguggcagaccgagaccggcagccccaucaccgccagcugcgugggccugggcaacagcaagacccccccccccggccaggccggcaagagcgugcccggcuacaacgugaugauccuggacgacaacaugcagaagcugaaggccagaugccugggcaacaucguggugaagcugccccugccccccggcgccuucagcggccuguggaagaaccaggaggccuucaagcaccuguacuucgagaaguuccccggcuacuacgacaccauggacgccggcuacauggacgaggagggcuaccuguacgugaugagcagaguggacgacgugaucaacguggccggccacagaaucagcgccggcgccaucgaggagagcauccugagccacggcaccguggccgacugcgccguggugggcaaggaggacccccugaagggccacgugccccuggcccugugcgugcugagaaaggacaucaacgccaccgaggagcaggugcuggaggagaucgugaagcacgugagacagaacaucggccccguggccgccuucagaaacgccguguucgugaagcagcugcccaagaccagaagcggcaagauccccagaagcgcccugagcgccaucgugaacggcaagcccuacaagaucaccagcaccaucgaggaccccagcaucuucggccacguggaggagaugcugaagcaggccuaa

SEQ ID NO: 13213 - RNA, 1134 nt, Artificial Sequence
  ACTA1__Homo_sapiens__NP_001091
augugcgacgaggacgagaccaccgcccuggugugcgacaacggcagcggccuggugaaggccggcuucgccggcgacgacgcccccagagccguguuccccagcaucgugggcagacccagacaccagggcgugauggugggcaugggccagaaggacagcuacgugggcgacgaggcccagagcaagagaggcauccugacccugaaguaccccaucgagcacggcaucaucaccaacugggacgacauggagaagaucuggcaccacaccuucuacaacgagcugagaguggcccccgaggagcaccccacccugcugaccgaggccccccugaaccccaaggccaacagagagaagaugacccagaucauguucgagaccuucaacgugcccgccauguacguggccauccaggccgugcugagccuguacgccagcggcagaaccaccggcaucgugcuggacagcggcgacggcgugacccacaacgugcccaucuacgagggcuacgcccugccccacgccaucaugagacuggaccuggccggcagagaccugaccgacuaccugaugaagauccugaccgagagaggcuacagcuucgugaccaccgccgagagagagaucgugagagacaucaaggagaagcugugcuacguggcccuggacuucgagaacgagauggccaccgccgccagcagcagcagccuggagaagagcuacgagcugcccgacggccaggugaucaccaucggcaacgagagauucagaugccccgagacccuguuccagcccagcuucaucggcauggagagcgccggcauccacgagaccaccuacaacagcaucaugaagugcgacaucgacaucagaaaggaccuguacgccaacaacgugaugagcggcggcaccaccauguaccccggcaucgccgacagaaugcagaaggagaucaccgcccuggcccccagcaccaugaagaucaagaucaucgccccccccgagagaaaguacagcguguggaucggcggcagcauccuggccagccugagcaccuuccagcagauguggaucaccaagcaggaguacgacgaggccggccccagcaucgugcacagaaagugcuucuaa

SEQ ID NO: 13214 - RNA, 1134 nt, Artificial Sequence
  ACTA2__Homo_sapiens__XP_011538318
augugcgaggaggaggacagcaccgcccuggugugcgacaacggcagcggccugugcaaggccggcuucgccggcgacgacgcccccagagccguguuccccagcaucgugggcagacccagacaccagggcgugauggugggcaugggccagaaggacagcuacgugggcgacgaggcccagagcaagagaggcauccugacccugaaguaccccaucgagcacggcaucaucaccaacugggacgacauggagaagaucuggcaccacagcuucuacaacgagcugagaguggcccccgaggagcaccccacccugcugaccgaggccccccugaaccccaaggccaacagagagaagaugacccagaucauguucgagaccuucaacgugcccgccauguacguggccauccaggccgugcugagccuguacgccagcggcagaaccaccggcaucgugcuggacagcggcgacggcgugacccacaacgugcccaucuacgagggcuacgcccugccccacgccaucaugagacuggaccuggccggcagagaccugaccgacuaccugaugaagauccugaccgagagaggcuacagcuucgugaccaccgccgagagagagaucgugagagacaucaaggagaagcugugcuacguggcccuggacuucgagaacgagauggccaccgccgccagcagcagcagccuggagaagagcuacgagcugcccgacggccaggugaucaccaucggcaacgagagauucagaugccccgagacccuguuccagcccagcuucaucggcauggagagcgccggcauccacgagaccaccuacaacagcaucaugaagugcgacaucgacaucagaaaggaccuguacgccaacaacgugcugagcggcggcaccaccauguaccccggcaucgccgacagaaugcagaaggagaucaccgcccuggcccccagcaccaugaagaucaagaucaucgccccccccgagagaaaguacagcguguggaucggcggcagcauccuggccagccugagcaccuuccagcagauguggaucagcaagcaggaguacgacgaggccggccccagcaucgugcacagaaagugcuucuaa

SEQ ID NO: 13215 - RNA, 1128 nt, Artificial Sequence
  ACTB__Homo_sapiens__NP_001092
auggacgacgacaucgccgcccuggugguggacaacggcagcggcaugugcaaggccggcuucgccggcgacgacgcccccagagccguguuccccagcaucgugggcagacccagacaccagggcgugauggugggcaugggccagaaggacagcuacgugggcgacgaggcccagagcaagagaggcauccugacccugaaguaccccaucgagcacggcaucgugaccaacugggacgacauggagaagaucuggcaccacaccuucuacaacgagcugagaguggcccccgaggagcaccccgugcugcugaccgaggccccccugaaccccaaggccaacagagagaagaugacccagaucauguucgagaccuucaacacccccgccauguacguggccauccaggccgugcugagccuguacgccagcggcagaaccaccggcaucgugauggacagcggcgacggcgugacccacaccgugcccaucuacgagggcuacgcccugccccacgccauccugagacuggaccuggccggcagagaccugaccgacuaccugaugaagauccugaccgagagaggcuacagcuucaccaccaccgccgagagagagaucgugagagacaucaaggagaagcugugcuacguggcccuggacuucgagcaggagauggccaccgccgccagcagcagcagccuggagaagagcuacgagcugcccgacggccaggugaucaccaucggcaacgagagauucagaugccccgaggcccuguuccagcccagcuuccugggcauggagagcugcggcauccacgagaccaccuucaacagcaucaugaagugcgacguggacaucagaaaggaccuguacgccaacaccgugcugagcggcggcaccaccauguaccccggcaucgccgacagaaugcagaaggagaucaccgcccuggcccccagcaccaugaagaucaagaucaucgccccccccgagagaaaguacagcguguggaucggcggcagcauccuggccagccugagcaccuuccagcagauguggaucagcaagcaggaguacgacgagagcggccccagcaucgugcacagaaagugcuucuaa

SEQ ID NO: 13216 - RNA, 1131 nt, Artificial Sequence
  ACTBL2__Homo_sapiens__NP_001017992
augaccgacaacgagcugagcgcccuggugguggacaacggcagcggcaugugcaaggccggcuucggcggcgacgacgcccccagagccguguuccccagcaugaucggcagacccagacaccagggcgugauggugggcaugggccagaaggacugcuacgugggcgacgaggcccagagcaagagaggcgugcugacccugaaguaccccaucgagcacggcguggugaccaacugggacgacauggagaagaucugguaccacaccuucuacaacgagcugagaguggcccccgacgagcaccccauccugcugaccgaggccccccugaaccccaagaucaacagagagaagaugacccagaucauguucgaggccuucaacacccccgccauguacguggccauccaggccgugcugagccuguacgccagcggcagaaccaccggcaucgugauggacagcggcgacggcgugacccacaucgugcccaucuacgagggcuacgcccugccccacgccauccugagacuggaccuggccggcagagaccugaccgacuaccugaugaagauccugaccgagagaggcuacaacuucaccaccaccgccgagagagagaucgugagagacgugaaggagaagcugugcuacguggcccuggacuucgagcaggagauggugagagccgccgccagcagcagccccgagagaagcuacgagcugcccgacggccaggugaucaccaucggcaacgagagauucagaugccccgaggccaucuuccagcccagcuuccugggcaucgagagcagcggcauccacgagaccaccuucaacagcaucaugaagugcgacguggacaucagaaaggaccuguacgccaacaccgugcugagcggcggcagcaccauguaccccggcaucgccgacagaaugcagaaggagaucaucacccuggcccccagcaccaugaagaucaagaucaucgccccccccgagagaaaguacagcguguggaucggcggcagcauccuggccagccugagcaccuuccagcagauguggaucagcaagcaggaguacgacgaggccggcccccccaucgugcacagaaagugcuucuaa

SEQ ID NO: 13217 - RNA, 1134 nt, Artificial Sequence
  ACTC1__Homo_sapiens__NP_005150
augugcgacgacgaggagaccaccgcccuggugugcgacaacggcagcggccuggugaaggccggcuucgccggcgacgacgcccccagagccguguuccccagcaucgugggcagacccagacaccagggcgugauggugggcaugggccagaaggacagcuacgugggcgacgaggcccagagcaagagaggcauccugacccugaaguaccccaucgagcacggcaucaucaccaacugggacgacauggagaagaucuggcaccacaccuucuacaacgagcugagaguggcccccgaggagcaccccacccugcugaccgaggccccccugaaccccaaggccaacagagagaagaugacccagaucauguucgagaccuucaacgugcccgccauguacguggccauccaggccgugcugagccuguacgccagcggcagaaccaccggcaucgugcuggacagcggcgacggcgugacccacaacgugcccaucuacgagggcuacgcccugccccacgccaucaugagacuggaccuggccggcagagaccugaccgacuaccugaugaagauccugaccgagagaggcuacagcuucgugaccaccgccgagagagagaucgugagagacaucaaggagaagcugugcuacguggcccuggacuucgagaacgagauggccaccgccgccagcagcagcagccuggagaagagcuacgagcugcccgacggccaggugaucaccaucggcaacgagagauucagaugccccgagacccuguuccagcccagcuucaucggcauggagagcgccggcauccacgagaccaccuacaacagcaucaugaagugcgacaucgacaucagaaaggaccuguacgccaacaacgugcugagcggcggcaccaccauguaccccggcaucgccgacagaaugcagaaggagaucaccgcccuggcccccagcaccaugaagaucaagaucaucgccccccccgagagaaaguacagcguguggaucggcggcagcauccuggccagccugagcaccuuccagcagauguggaucagcaagcaggaguacgacgaggccggccccagcaucgugcacagaaagugcuucuaa

SEQ ID NO: 13218 - RNA, 1128 nt, Artificial Sequence
  ACTG1__Homo_sapiens__NP_001605
auggaggaggagaucgccgcccuggugaucgacaacggcagcggcaugugcaaggccggcuucgccggcgacgacgcccccagagccguguuccccagcaucgugggcagacccagacaccagggcgugauggugggcaugggccagaaggacagcuacgugggcgacgaggcccagagcaagagaggcauccugacccugaaguaccccaucgagcacggcaucgugaccaacugggacgacauggagaagaucuggcaccacaccuucuacaacgagcugagaguggcccccgaggagcaccccgugcugcugaccgaggccccccugaaccccaaggccaacagagagaagaugacccagaucauguucgagaccuucaacacccccgccauguacguggccauccaggccgugcugagccuguacgccagcggcagaaccaccggcaucgugauggacagcggcgacggcgugacccacaccgugcccaucuacgagggcuacgcccugccccacgccauccugagacuggaccuggccggcagagaccugaccgacuaccugaugaagauccugaccgagagaggcuacagcuucaccaccaccgccgagagagagaucgugagagacaucaaggagaagcugugcuacguggcccuggacuucgagcaggagauggccaccgccgccagcagcagcagccuggagaagagcuacgagcugcccgacggccaggugaucaccaucggcaacgagagauucagaugccccgaggcccuguuccagcccagcuuccugggcauggagagcugcggcauccacgagaccaccuucaacagcaucaugaagugcgacguggacaucagaaaggaccuguacgccaacaccgugcugagcggcggcaccaccauguaccccggcaucgccgacagaaugcagaaggagaucaccgcccuggcccccagcaccaugaagaucaagaucaucgccccccccgagagaaaguacagcguguggaucggcggcagcauccuggccagccugagcaccuuccagcagauguggaucagcaagcaggaguacgacgagagcggccccagcaucgugcacagaaagugcuucuaa

SEQ ID NO: 13219 - RNA, 1002 nt, Artificial Sequence
  ACTG2__Homo_sapiens__NP_001186822
augugcgaggaggagaccaccgcccuggugugcgacaacggcagcggccugugcaaggccggcuucgccggcgacgacgcccccagagccguguuccccagcaucgugggcagacccagacaccagaucuggcaccacagcuucuacaacgagcugagaguggcccccgaggagcaccccacccugcugaccgaggccccccugaaccccaaggccaacagagagaagaugacccagaucauguucgagaccuucaacgugcccgccauguacguggccauccaggccgugcugagccuguacgccagcggcagaaccaccggcaucgugcuggacagcggcgacggcgugacccacaacgugcccaucuacgagggcuacgcccugccccacgccaucaugagacuggaccuggccggcagagaccugaccgacuaccugaugaagauccugaccgagagaggcuacagcuucgugaccaccgccgagagagagaucgugagagacaucaaggagaagcugugcuacguggcccuggacuucgagaacgagauggccaccgccgccagcagcagcagccuggagaagagcuacgagcugcccgacggccaggugaucaccaucggcaacgagagauucagaugccccgagacccuguuccagcccagcuucaucggcauggagagcgccggcauccacgagaccaccuacaacagcaucaugaagugcgacaucgacaucagaaaggaccuguacgccaacaacgugcugagcggcggcaccaccauguaccccggcaucgccgacagaaugcagaaggagaucaccgcccuggcccccagcaccaugaagaucaagaucaucgccccccccgagagaaaguacagcguguggaucggcggcagcauccuggccagccugagcaccuuccagcagauguggaucagcaagcccgaguacgacgaggccggccccagcaucgugcacagaaagugcuucuaa

SEQ ID NO: 13220 - RNA, 1290 nt, Artificial Sequence
  ACTL6A__Homo_sapiens__NP_004292
augagcggcggcguguacggcggcgacgaggugggcgcccugguguucgacaucggcagcuacaccgugagagccggcuacgccggcgaggacugccccaagguggacuuccccaccgccaucggcauggugguggagagagacgacggcagcacccugauggagaucgacggcgacaagggcaagcagggcggccccaccuacuacaucgacaccaacgcccugagagugcccagagagaacauggaggccaucagcccccugaagaacggcaugguggaggacugggacagcuuccaggccauccuggaccacaccuacaagaugcacgugaagagcgaggccagccugcaccccgugcugaugagcgaggcccccuggaacaccagagccaagagagagaagcugaccgagcugauguucgagcacuacaacauccccgccuucuuccugugcaagaccgccgugcugaccgccuucgccaacggcagaagcaccggccugauccuggacagcggcgccacccacaccaccgccauccccgugcacgacggcuacgugcugcagcagggcaucgugaagagcccccuggccggcgacuucaucaccaugcagugcagagagcuguuccaggagaugaacaucgagcuggugccccccuacaugaucgccagcaaggaggccgugagagagggcagccccgccaacuggaagagaaaggagaagcugccccaggugaccagaagcuggcacaacuacaugugcaacugcgugauccaggacuuccaggccagcgugcugcaggugagcgacagcaccuacgacgagcagguggccgcccagaugcccaccgugcacuacgaguuccccaacggcuacaacugcgacuucggcgccgagagacugaagauccccgagggccuguucgaccccagcaacgugaagggccugagcggcaacaccaugcugggcgugagccacguggugaccaccagcgugggcaugugcgacaucgacaucagacccggccuguacggcagcgugaucguggccggcggcaacacccugauccagagcuucaccgacagacugaacagagagcugagccagaagaccccccccagcaugagacugaagcugaucgccaacaacaccaccguggagagaagauucagcagcuggaucggcggcagcauccuggccagccugggcaccuuccagcagauguggaucagcaagcaggaguacgaggagggcggcaagcagugcguggagagaaagugccccuaa

SEQ ID NO: 13221 - RNA, 1281 nt, Artificial Sequence
  ACTL6B__Homo_sapiens__NP_057272
augagcggcggcguguacggcggcgacgaggugggcgcccugguguucgacaucggcagcuucagcgugagagccggcuacgccggcgaggacugccccaaggccgacuuccccaccaccgugggccugcuggccgccgaggagggcggcggccuggagcuggagggcgacaaggagaagaagggcaagaucuuccacaucgacaccaacgcccugcacgugcccagagacggcgccgaggugaugagcccccugaagaacggcaugaucgaggacugggagugcuucagagccauccuggaccacaccuacagcaagcacgugaagagcgagcccaaccugcaccccgugcugaugagcgaggcccccuggaacaccagagccaagagagagaagcugaccgagcugauguucgagcaguacaacauccccgccuucuuccugugcaagaccgccgugcugaccgccuucgccaacggcagaagcaccggccuggugcuggacagcggcgccacccacaccaccgccauccccgugcacgacggcuacgugcugcagcagggcaucgugaagagcccccuggccggcgacuucaucagcaugcagugcagagagcuguuccaggagauggccaucgacaucaucccccccuacaugaucgccgccaaggagcccgugagagagggcgccccccccaacuggaagaagaaggagaagcugccccaggugagcaagagcuggcacaacuacaugugcaacgaggugauccaggacuuccaggccagcgugcugcaggugagcgacagccccuacgacgagcagguggccgcccagaugcccaccgugcacuacgagaugcccaacggcuacaacaccgacuacggcgccgagagacugagaauccccgagggccuguucgaccccagcaacgugaagggccugagcggcaacaccaugcugggcgugggccacguggugaccaccagcaucggcaugugcgacaucgacaucagacccggccuguacggcagcgugaucgugaccggcggcaacacccugcugcagggcuucaccgacagacugaacagagagcugagccagaagaccccccccagcaugagacugaagcugaucgccagcaacagcaccauggagagaaaguucagccccuggaucggcggcagcauccuggccagccugggcaccuuccagcagauguggaucagcaagcaggaguacgaggagggcggcaagcagugcguggagagaaagugccccuaa

SEQ ID NO: 13222 - RNA, 1176 nt, Artificial Sequence
  ACTL8__Homo_sapiens__XP_011540513
augagccugcugccccccagagagagccccgccgccagcagcagcaccagcgugccccccaccagcgccagcgccauggccgccagaaccgugaucaucgaccacggcagcggcuuccugaaggccggcaccgccggcuggaacgagccccagaugguguuccccaacaucgugaacuaccugcccugcaaggagaaccccggccccagcuacgccagaagaagagugagccugggcaucgacaucugccaccccgacaccuucagcuaccccaucgagagaggcagaauccugaacugggagggcgugcaguaccuguggagcuucgugcuggagaaccacagaagagagcaggaggugccccccgugaucaucaccgagaccccccugagagagcccgccgacagaaagaagaugcuggagauccuguucgagcugcugcacgugcccagcgugcugcuggccgaccagcugcagaugagccuguacgccagcggccugcugaccggcguggugguggacagcggcuacggccugaccagagugcagcccuuccaccagggcagaccccugcccgccagcggcaagacccuggaguucgccggccaggaccugagcgccuaccugcugaagagccuguucaaggaggacugcgacagaagaugccuguuccagcuggagaccguggccgugacccagaugaacaagugcuacgugccccagaaccugggcgaggcccuggacuucagagagagacagcagagcgcccuggacgagagcaacaccuaccagcugcccgacggcagcagaguggagcugacccccaugcagagaguggcccccgagauguucuucagcccccagguguucgagcagcccggccccagcauccccagagccaucguggagagcguggagagcugcgagaucagccugagaccccugcuggugagccacgugauggccugcggcggcaacacccuguaccccggcuucaccaagagacuguucagagagcugaugggcgaccacgugagcagcaccaaggccaccgugugggagggcagcaacagaaacuucagcguguggcugggcgccagcgugguggcccaccugagcaccuaccagagcgaguggaugagcagagaggaguacggcgagcacaugagaauguaa

SEQ ID NO: 13223 - RNA, 1251 nt, Artificial Sequence
  ACTL9__Homo_sapiens__NP_848620
auggacgccagcagacccaagagcagcgagagccagagcagccuggaggcccccagacccggccccaaccccagccccaacguggugaacaagccccugcagagagacagccccggcaugguggccgacagacugccccccaagaccggcgccguggugaucgacaugggcaccggcaccugcaaggugggcuucgccggccaggccagccccaccuacaccguggccaccauccugggcugccagcccaagaagcccgccaccagcggccagagcggccugcagaccuucaucggcgaggccgccagagugcugcccgagcugacccuggugcagccccugagaagcggcaucgugguggacugggacgccgccgagcugaucuggagacaccugcuggagcacgaccugagaguggccacccacgaccacccccugcuguucagcgacccccccuucagccccgccaccaacagagagaagcugguggagguggccuucgagagccugagaagccccgccauguacguggccagccagagcgugcugagcguguacgcccacggcagagugagcggccuggugguggacaccggccacggcgugaccuacaccgugcccguguuccagggcuacaaccugcugcacgccaccgagagacuggaccuggccggcaacaaccugaccgccuuccuggccgagaugcugcugcaggccggccugccccugggccagcaggaccuggaccugguggagaacaucaagcaccacuacugcuacguggccagcgacuuccagaaggagcaggccagacccgagcaggaguacaagagaacccugaagcugcccgacggcagaaccgugacccugggcaaggagcuguuccagugccccgagcugcuguucaacccccccgaggugcccggccugagccccgugggccugagcaccauggccaagcagagccugagaaagcugagccuggagaugagagccgaccuggcccagaacgugcugcugugcggcggcagcagccuguucaccggcuucgagggcagauucagagccgagcugcugagagcccugcccgccgagacccacguggugguggccgcccagcccaccagaaacuucagcguguggaucggcggcagcauccuggccagccugagagccuuccagagcugcugggugcugagagagcaguacgaggagcagggccccuacaucguguacagaaagugcuacuaa

SEQ ID NO: 13224 - RNA, 2679 nt, Artificial Sequence
  ACTN1__Homo_sapiens__NP_001093
auggaccacuacgacagccagcagaccaacgacuacaugcagcccgaggaggacugggacagagaccugcugcuggaccccgccugggagaagcagcagagaaagaccuucaccgccuggugcaacagccaccugagaaaggccggcacccagaucgagaacaucgaggaggacuucagagacggccugaagcugaugcugcugcuggaggugaucagcggcgagagacuggccaagcccgagagaggcaagaugagagugcacaagaucagcaacgugaacaaggcccuggacuucaucgccagcaagggcgugaagcuggugagcaucggcgccgaggagaucguggacggcaacgugaagaugacccugggcaugaucuggaccaucauccugagauucgccauccaggacaucagcguggaggagaccagcgccaaggagggccugcugcuguggugccagagaaagaccgcccccuacaagaacgugaacauccagaacuuccacaucagcuggaaggacggccugggcuucugcgcccugauccacagacacagacccgagcugaucgacuacggcaagcugagaaaggacgacccccugaccaaccugaacaccgccuucgacguggccgagaaguaccuggacauccccaagaugcuggacgccgaggacaucgugggcaccgccagacccgacgagaaggccaucaugaccuacgugagcagcuucuaccacgccuucagcggcgcccagaaggccgagaccgccgccaacagaaucugcaaggugcuggccgugaaccaggagaacgagcagcugauggaggacuacgagaagcuggccagcgaccugcuggaguggaucagaagaaccauccccuggcuggagaacagagugcccgagaacaccaugcacgccaugcagcagaagcuggaggacuucagagacuacagaagacugcacaagccccccaaggugcaggagaagugccagcuggagaucaacuucaacacccugcagaccaagcugagacugagcaacagacccgccuucaugcccagcgagggcagaauggugagcgacaucaacaacgccuggggcugccuggagcagguggagaagggcuacgaggaguggcugcugaacgagaucagaagacuggagagacuggaccaccuggccgagaaguucagacagaaggccagcauccacgaggccuggaccgacggcaaggaggccaugcugagacagaaggacuacgagaccgccacccugagcgagaucaaggcccugcugaagaagcacgaggccuucgagagcgaccuggccgcccaccaggacagaguggagcagaucgccgccaucgcccaggagcugaacgagcuggacuacuacgacagccccagcgugaacgccagaugccagaagaucugcgaccagugggacaaccugggcgcccugacccagaagagaagagaggcccuggagagaaccgagaagcugcuggagaccaucgaccagcuguaccuggaguacgccaagagagccgcccccuucaacaacuggauggagggcgccauggaggaccugcaggacaccuucaucgugcacaccaucgaggagauccagggccugaccaccgcccacgagcaguucaaggccacccugcccgacgccgacaaggagagacuggccauccugggcauccacaacgaggugagcaagaucgugcagaccuaccacgugaacauggccggcaccaaccccuacaccaccaucaccccccaggagaucaacggcaagugggaccacgugagacagcuggugcccagaagagaccaggcccugaccgaggagcacgccagacagcagcacaacgagagacugagaaagcaguucggcgcccaggccaacgugaucggccccuggauccagaccaagauggaggagaucggcagaaucagcaucgagaugcacggcacccuggaggaccagcugagccaccugagacaguacgagaagagcaucgugaacuacaagcccaagaucgaccagcuggagggcgaccaccagcugauccaggaggcccugaucuucgacaacaagcacaccaacuacaccauggagcacaucagagugggcugggagcagcugcugaccaccaucgccagaaccaucaacgagguggagaaccagauccugaccagagacgccaagggcaucagccaggagcagaugaacgaguucagagccagcuucaaccacuucgacagagaccacagcggcacccugggccccgaggaguucaaggccugccugaucagccugggcuacgacaucggcaacgacccccagggcgaggccgaguucgccagaaucaugagcaucguggaccccaacagacugggcguggugaccuuccaggccuucaucgacuucaugagcagagagaccgccgacaccgacaccgccgaccaggugauggccagcuucaagauccuggccggcgacaagaacuacaucaccauggacgagcugagaagagagcugccccccgaccaggccgaguacugcaucgccagaauggcccccuacaccggccccgacagcgugcccggcgcccuggacuacaugagcuucagcaccgcccuguacggcgagagcgaccuguaa

SEQ ID NO: 13225 - RNA, 2685 nt, Artificial Sequence
  ACTN2__Homo_sapiens__NP_001094
augaaccagaucgagcccggcgugcaguacaacuacguguacgacgaggacgaguacaugauccaggaggaggagugggacagagaccugcugcuggaccccgccugggagaagcagcagagaaagaccuucaccgccuggugcaacagccaccugagaaaggccggcacccagaucgagaacaucgaggaggacuucagaaacggccugaagcugaugcugcugcuggaggugaucagcggcgagagacugcccaagcccgacagaggcaagaugagauuccacaagaucgccaacgugaacaaggcccuggacuacaucgccagcaagggcgugaagcuggugagcaucggcgccgaggagaucguggacggcaacgugaagaugacccugggcaugaucuggaccaucauccugagauucgccauccaggacaucagcguggaggagaccagcgccaaggagggccugcugcuguggugccagagaaagaccgcccccuacagaaacgugaacauccagaacuuccacaccagcuggaaggacggccugggccugugcgcccugauccacagacacagacccgaccugaucgacuacagcaagcugaacaaggacgaccccaucggcaacaucaaccuggccauggagaucgccgagaagcaccuggacauccccaagaugcuggacgccgaggacaucgugaacacccccaagcccgacgagagagccaucaugaccuacgugagcugcuucuaccacgccuucgccggcgccgagcaggccgagaccgccgccaacagaaucugcaaggugcuggccgugaaccaggagaacgagagacugauggaggaguacgagagacuggccagcgagcugcuggaguggaucagaagaaccauccccuggcuggagaacagaacccccgagaagaccaugcaggccaugcagaagaagcuggaggacuucagagacuacagaagaaagcacaagccccccaaggugcaggagaagugccagcuggagaucaacuucaacacccugcagaccaagcugagaaucagcaacagacccgccuucaugcccagcgagggcaagauggugagcgacaucgccggcgccuggcagagacuggagcaggccgagaagggcuacgaggaguggcugcugaacgagaucagaagacuggagagacuggagcaccuggccgagaaguucagacagaaggccagcacccacgagaccugggccuacggcaaggagcagauccugcugcagaaggacuacgagagcgccagccugaccgaggugagagcccugcugagaaagcacgaggccuucgagagcgaccuggccgcccaccaggacagaguggagcagaucgccgccaucgcccaggagcugaacgagcuggacuaccacgacgccgugaacgugaacgacagaugccagaagaucugcgaccagugggacagacugggcacccugacccagaagagaagagaggcccuggagagaauggagaagcugcuggagaccaucgaccagcugcaccuggaguucgccaagagagccgcccccuucaacaacuggauggagggcgccauggaggaccugcaggacauguucaucgugcacagcaucgaggagauccagagccugaucaccgcccacgagcaguucaaggccacccugcccgaggccgacggcgagagacagagcaucauggccauccagaacgagguggagaaggugauccagagcuacaacaucagaaucagcagcagcaaccccuacagcaccgugaccauggacgagcugagaaccaagugggacaaggugaagcagcuggugcccaucagagaccagagccugcaggaggagcuggccagacagcacgccaacgagagacugagaagacaguucgccgcccaggccaacgccaucggccccuggauccagaacaagauggaggagaucgccagaagcagcauccagaucaccggcgcccuggaggaccagaugaaccagcugaagcaguacgagcacaacaucaucaacuacaagaacaacaucgacaagcuggagggcgaccaccagcugauccaggaggcccugguguucgacaacaagcacaccaacuacaccauggagcacaucagagugggcugggagcugcugcugaccaccaucgccagaaccaucaacgagguggagacccagauccugaccagagacgccaagggcaucacccaggagcagaugaacgaguucagagccagcuucaaccacuucgacagaagaaagaacggccugauggaccacgaggacuucagagccugccugaucagcaugggcuacgaccugggcgaggccgaguucgccagaaucaugacccugguggaccccaacggccagggcaccgugaccuuccagagcuucaucgacuucaugaccagagagaccgccgacaccgacaccgccgagcaggugaucgccagcuucagaauccuggccagcgacaagcccuacauccuggccgaggagcugagaagagagcugccccccgaccaggcccaguacugcaucaagagaaugcccgccuacagcggccccggcagcgugcccggcgcccuggacuacgccgccuucagcagcgcccuguacggcgagagcgaccuguaa

SEQ ID NO: 13226 - RNA, 2706 nt, Artificial Sequence
  ACTN3__Homo_sapiens__NP_001095
augaugauggugaugcagcccgagggccugggcgccggcgagggcagauucgccggcggcggcggcggcggcgaguacauggagcaggaggaggacugggacagagaccugcugcuggaccccgccugggagaagcagcagagaaagaccuucaccgccuggugcaacagccaccugagaaaggccggcacccagaucgagaacaucgaggaggacuucagaaacggccugaagcugaugcugcugcuggaggugaucagcggcgagagacugcccagacccgacaagggcaagaugagauuccacaagaucgccaacgugaacaaggcccuggacuucaucgccagcaagggcgugaagcuggugagcaucggcgccgaggagaucguggacggcaaccugaagaugacccugggcaugaucuggaccaucauccugagauucgccauccaggacaucagcguggaggagaccagcgccaaggagggccugcugcuguggugccagagaaagaccgcccccuacagaaacgugaacgugcagaacuuccacaccagcuggaaggacggccuggcccugugcgcccugauccacagacacagacccgaccugaucgacuacgccaagcugagaaaggacgaccccaucggcaaccugaacaccgccuucgagguggccgagaaguaccuggacauccccaagaugcuggacgccgaggacaucgugaacacccccaagcccgacgagaaggccaucaugaccuacgugagcugcuucuaccacgccuucgccggcgccgagcaggccgagaccgccgccaacagaaucugcaaggugcuggccgugaaccaggagaacgagaagcugauggaggaguacgagaagcuggccagcgagcugcuggaguggaucagaagaaccgugcccuggcuggagaacagagugggcgagcccagcaugagcgccaugcagagaaagcuggaggacuucagagacuacagaagacugcacaagccccccagaauccaggagaagugccagcuggagaucaacuucaacacccugcagaccaagcugagacugagccacagacccgccuucaugcccagcgagggcaagcuggugagcgacaucgccaacgccuggagaggccuggagcagguggagaagggcuacgaggacuggcugcugagcgagaucagaagacugcagagacugcagcaccuggccgagaaguucagacagaaggccagccugcacgaggccuggaccagaggcaaggaggagaugcugagccagagagacuacgacagcgcccugcugcaggaggugagagcccugcugagaagacacgaggccuucgagagcgaccuggccgcccaccaggacagaguggagcacaucgccgcccuggcccaggagcugaacgagcuggacuaccacgaggccgccagcgugaacagcagaugccaggccaucugcgaccagugggacaaccugggcacccugacccagaagagaagagacgcccuggagagaauggagaagcugcuggagaccaucgacagacugcagcuggaguucgccagaagagccgcccccuucaacaacuggcuggacggcgccguggaggaccugcaggacguguggcuggugcacagcguggaggagacccagagccugcugaccgcccacgaccaguucaaggccacccugcccgaggccgacagagagagaggcgccaucaugggcauccagggcgagauccagaagaucugccagaccuacggccugagacccugcagcaccaaccccuacaucacccugagcccccaggacaucaacaccaagugggacauggugagaaagcuggugcccagcugcgaccagacccugcaggaggagcuggccagacagcaggugaacgagagacugagaagacaguucgccgcccaggccaacgccaucggccccuggauccaggccaagguggaggaggugggcagacuggccgccggccuggccggcagccuggaggagcagauggccggccugagacagcaggagcagaacaucaucaacuacaagaccaacaucgacagacuggagggcgaccaccagcugcugcaggagagccugguguucgacaacaagcacaccguguacagcauggagcacaucagagugggcugggagcagcugcugaccagcaucgccagaaccaucaacgagguggagaaccaggugcugaccagagacgccaagggccugagccaggagcagcugaacgaguucagagccagcuucaaccacuucgacagaaagcagaacggcaugauggagcccgacgacuucagagccugccugaucagcaugggcuacgaccugggcgagguggaguucgccagaaucaugaccaugguggaccccaacgccgccggcguggugaccuuccaggccuucaucgacuucaugaccagagagaccgccgagaccgacaccaccgagcaggugguggccagcuucaagauccuggccggcgacaagaacuacaucacccccgaggagcugagaagagagcugcccgccaagcaggccgaguacugcaucagaagaauggugcccuacaagggcagcggcgcccccgccggcgcccuggacuacguggccuucagcagcgcccuguacggcgagagcgaccuguaa

SEQ ID NO: 13227 - RNA, 2736 nt, Artificial Sequence
  ACTN4__Homo_sapiens__NP_004915
augguggacuaccacgccgccaaccagagcuaccaguacggccccagcagcgccggcaacggcgccggcggcggcggcagcaugggcgacuacauggcccaggaggacgacugggacagagaccugcugcuggaccccgccugggagaagcagcagagaaagaccuucaccgccuggugcaacagccaccugagaaaggccggcacccagaucgagaacaucgacgaggacuucagagacggccugaagcugaugcugcugcuggaggugaucagcggcgagagacugcccaagcccgagagaggcaagaugagagugcacaagaucaacaacgugaacaaggcccuggacuucaucgccagcaagggcgugaagcuggugagcaucggcgccgaggagaucguggacggcaacgccaagaugacccugggcaugaucuggaccaucauccugagauucgccauccaggacaucagcguggaggagaccagcgccaaggagggccugcugcuguggugccagagaaagaccgcccccuacaagaacgugaacgugcagaacuuccacaucagcuggaaggacggccuggccuucaacgcccugauccacagacacagacccgagcugaucgaguacgacaagcugagaaaggacgaccccgugaccaaccugaacaacgccuucgagguggccgagaaguaccuggacauccccaagaugcuggacgccgaggacaucgugaacaccgccagacccgacgagaaggccaucaugaccuacgugagcagcuucuaccacgccuucagcggcgcccagaaggccgagaccgccgccaacagaaucugcaaggugcuggccgugaaccaggagaacgagcaccugauggaggacuacgagaagcuggccagcgaccugcuggaguggaucagaagaaccauccccuggcuggaggacagagugccccagaagaccauccaggagaugcagcagaagcuggaggacuucagagacuacagaagagugcacaagccccccaaggugcaggagaagugccagcuggagaucaacuucaacacccugcagaccaagcugagacugagcaacagacccgccuucaugcccagcgagggcaagauggugagcgacaucaacaacggcuggcagcaccuggagcaggccgagaagggcuacgaggaguggcugcugaacgagaucagaagacuggagagacuggaccaccuggccgagaaguucagacagaaggccagcauccacgaggccuggaccgacggcaaggaggccaugcugaagcacagagacuacgagaccgccacccugagcgacaucaaggcccugaucagaaagcacgaggccuucgagagcgaccuggccgcccaccaggacagaguggagcagaucgccgccaucgcccaggagcugaacgagcuggacuacuacgacagccacaacgugaacaccagaugccagaagaucugcgaccagugggacgcccugggcagccugacccacagcagaagagaggcccuggagaagaccgagaagcagcuggaggccaucgaccagcugcaccuggaguacgccaagagagccgcccccuucaacaacuggauggagagcgccauggaggaccugcaggacauguucaucgugcacaccaucgaggagaucgagggccugaucagcgcccacgaccaguucaagagcacccugcccgacgccgacagagagagagaggccauccuggccauccacaaggaggcccagagaaucgccgagagcaaccacaucaagcugagcggcagcaaccccuacaccaccgugaccccccagaucaucaacagcaagugggagaaggugcagcagcuggugcccaagagagaccacgcccugcuggaggagcagagcaagcagcagagcaacgagcaccugagaagacaguucgccagccaggccaacguggugggccccuggauccagaccaagauggaggagaucggcagaaucagcaucgagaugaacggcacccuggaggaccagcugagccaccugaagcaguacgagagaagcaucguggacuacaagcccaaccuggaccugcuggagcagcagcaccagcugauccaggaggcccugaucuucgacaacaagcacaccaacuacaccauggagcacaucagagugggcugggagcagcugcugaccaccaucgccagaaccaucaacgagguggagaaccagauccugaccagagacgccaagggcaucagccaggagcagaugcaggaguucagagccagcuucaaccacuucgacaaggaccacggcggcgcccugggccccgaggaguucaaggccugccugaucagccugggcuacgacguggagaacgacagacagggcgaggccgaguucaacagaaucaugagccugguggaccccaaccacagcggccuggugaccuuccaggccuucaucgacuucaugagcagagagaccaccgacaccgacaccgccgaccaggugaucgccagcuucaaggugcuggccggcgacaagaacuucaucaccgccgaggagcugagaagagagcugccccccgaccaggccgaguacugcaucgccagaauggcccccuaccagggccccgacgccgugcccggcgcccuggacuacaagagcuucagcaccgcccuguacggcgagagcgaccuguaa

SEQ ID NO: 13228 - RNA, 1131 nt, Artificial Sequence
  ACTR1A__Homo_sapiens__NP_005727
auggagagcuacgacgugaucgccaaccagcccguggugaucgacaacggcagcggcgugaucaaggccggcuucgccggcgaccagauccccaaguacugcuuccccaacuacgugggcagacccaagcacgugagagugauggccggcgcccuggagggcgacaucuucaucggccccaaggccgaggagcacagaggccugcugagcaucagauaccccauggagcacggcaucgugaaggacuggaacgacauggagagaaucuggcaguacguguacagcaaggaccagcugcagaccuucagcgaggagcaccccgugcugcugaccgaggccccccugaaccccagaaagaacagagagagagccgccgagguguucuucgagaccuucaacgugcccgcccuguucaucagcaugcaggccgugcugagccuguacgccaccggcagaaccaccggcguggugcuggacagcggcgacggcgugacccacgccgugcccaucuacgagggcuucgccaugccccacagcaucaugagaaucgacaucgccggcagagacgugagcagauuccugagacuguaccugagaaaggagggcuacgacuuccacagcagcagcgaguucgagaucgugaaggccaucaaggagagagccugcuaccugagcaucaacccccagaaggacgagacccuggagaccgagaaggcccaguacuaccugcccgacggcagcaccaucgagaucggccccagcagauucagagcccccgagcugcuguucagacccgaccugaucggcgaggagagcgagggcauccacgaggugcugguguucgccauccagaagagcgacauggaccugagaagaacccuguucagcaacaucgugcugagcggcggcagcacccuguucaagggcuucggcgacagacugcugagcgaggugaagaagcuggcccccaaggacgugaagaucagaaucagcgccccccaggagagacuguacagcaccuggaucggcggcagcauccuggccagccuggacaccuucaagaagaugugggugagcaagaaggaguacgaggaggacggcgccagaagcauccacagaaagaccuucuaa

SEQ ID NO: 13229 - RNA, 1131 nt, Artificial Sequence
  ACTR1B__Homo_sapiens__NP_005726
auggagagcuacgacaucaucgccaaccagcccguggugaucgacaacggcagcggcgugaucaaggccggcuucgccggcgaccagauccccaaguacugcuuccccaacuacgugggcagacccaagcacaugagagugauggccggcgcccuggagggcgaccuguucaucggccccaaggccgaggagcacagaggccugcugaccaucagauaccccauggagcacggcguggugagagacuggaacgacauggagagaaucuggcaguacguguacagcaaggaccagcugcagaccuucagcgaggagcaccccgugcugcugaccgaggccccccugaaccccagcaagaacagagagaaggccgccgagguguucuucgagaccuucaacgugcccgcccuguucaucagcaugcaggccgugcugagccuguacgccaccggcagaaccaccggcguggugcuggacagcggcgacggcgugacccacgccgugcccaucuacgagggcuucgccaugccccacagcaucaugagaguggacaucgccggcagagacgugagcagauaccugagacugcugcugagaaaggagggcguggacuuccacaccagcgccgaguucgagguggugagaaccaucaaggagagagccugcuaccugagcaucaacccccagaaggacgaggcccuggagaccgagaaggugcaguacacccugcccgacggcagcacccuggacgugggccccgccagauucagagcccccgagcugcuguuccagcccgaccuggugggcgacgagagcgagggccugcacgaggugguggccuucgccauccacaagagcgacauggaccugagaagaacccuguucgccaacaucgugcugagcggcggcagcacccuguucaagggcuucggcgacagacugcugagcgaggugaagaagcuggcccccaaggacaucaagaucaagaucagcgccccccaggagagacuguacagcaccuggaucggcggcagcauccuggccagccuggacaccuucaagaagaugugggugagcaagaaggaguacgaggaggacggcagcagagccauccacagaaagaccuucuaa

SEQ ID NO: 13230 - RNA, 1200 nt, Artificial Sequence
  ACTR2__Homo_sapiens__NP_001005386
auggacagccagggcagaaaggugguggugugcgacaacggcaccggcuucgugaagugcggcuacgccggcagcaacuuccccgagcacaucuuccccgcccuggugggcagacccaucaucagaagcaccaccaaggugggcaacaucgagaucaagaacaacaagaagauggaccugauggugggcgacgaggccagcgagcugagaagcaugcuggaggugaacuaccccauggagaacggcaucgugagaaacugggacgacaugaagcaccugugggacuacaccuucggccccgagaagcugaacaucgacaccagaaacugcaagauccugcugaccgagccccccaugaaccccaccaagaacagagagaagaucguggaggugauguucgagaccuaccaguucagcggcguguacguggccauccaggccgugcugacccuguacgcccagggccugcugaccggcguggugguggacagcggcgacggcgugacccacaucugccccguguacgagggcuucagccugccccaccugaccagaagacuggacaucgccggcagagacaucaccagauaccugaucaagcugcugcugcugagaggcuacgccuucaaccacagcgccgacuucgagaccgugagaaugaucaaggagaagcugugcuacgugggcuacaacaucgagcaggagcagaagcuggcccuggagaccaccgugcugguggagagcuacacccugcccgacggcagaaucaucaaggugggcggcgagagauucgaggcccccgaggcccuguuccagccccaccugaucaacguggagggcgugggcguggccgagcugcuguucaacaccauccaggccgccgacaucgacaccagaagcgaguucuacaagcacaucgugcugagcggcggcagcaccauguaccccggccugcccagcagacuggagagagagcugaagcagcuguaccuggagagagugcugaagggcgacguggagaagcugagcaaguucaagaucagaaucgaggacccccccagaagaaagcacaugguguuccugggcggcgccgugcuggccgacaucaugaaggacaaggacaacuucuggaugaccagacaggaguaccaggagaagggcgugagagugcuggagaagcugggcgugaccgugagauaa

SEQ ID NO: 13231 - RNA, 1047 nt, Artificial Sequence
  ACTR3B__Homo_sapiens__NP_001035225
auggccggcagccugccccccugcgugguggacugcggcaccggcuacaccaagcugggcuacgccggcaacaccgagccccaguucaucauccccagcugcaucgccaucagagagagcgccaaggugguggaccaggcccagagaagagugcugagaggcguggacgaccuggacuucuucaucggcgacgaggccaucgacaagcccaccuacgccaccaaguggcccaucagacacggcaucaucgaggacugggaccugauggagagauucauggagcaggugguguucaaguaccugagagccgagcccgaggaccacuacuuccugaugaccgagcccccccugaacacccccgagaacagagaguaccuggccgagaucauguucgagagcuucaacgugcccggccuguacaucgccgugcaggccgugcuggcccuggccgccagcuggaccagcagacaggugggcgagagaacccugaccggcaucgugaucgacagcggcgacggcgugacccacgugauccccguggccgagggcuacgugaucggcagcugcaucaagcacauccccaucgccggcagagacaucaccuacuucauccagcagcugcugagagagagagaggugggcaucccccccgagcagagccuggagaccgccaaggccaucaaggagaaguacugcuacaucugccccgacaucgugaaggaguucgccaaguacgacguggaccccagaaaguggaucaagcaguacaccggcaucaacgccaucaaccagaagaaguucgugaucgacgugggcuacgagagauuccugggccccgagaucuucuuccaccccgaguucgccaaccccgacuucauggagagcaucagcgacgugguggacgaggugauccagaacugccccaucgacgugagaagaccccuguacaagcccgaguucuuccaggugugccacaccaagaaggacuacgaggaguacggccccagcaucugcagacacaaccccguguucggcgugaugagcuaa

SEQ ID NO: 13232 - RNA, 1104 nt, Artificial Sequence
  ACTR3__Homo_sapiens__NP_001264069
augaagggcguggacgaccuggacuucuucaucggcgacgaggccaucgagaagcccaccuacgccaccaaguggcccaucagacacggcaucguggaggacugggaccugauggagagauucauggagcaggugaucuucaaguaccugagagccgagcccgaggaccacuacuuccugcugaccgagcccccccugaacacccccgagaacagagaguacaccgccgagaucauguucgagagcuucaacgugcccggccuguacaucgccgugcaggccgugcuggcccuggccgccagcuggaccagcagacaggugggcgagagaacccugaccggcaccgugaucgacagcggcgacggcgugacccacgugauccccguggccgagggcuacgugaucggcagcugcaucaagcacauccccaucgccggcagagacaucaccuacuucauccagcagcugcugagagacagagaggugggcaucccccccgagcagagccuggagaccgccaaggccgugaaggagagauacagcuacgugugccccgaccuggugaaggaguucaacaaguacgacaccgacggcagcaaguggaucaagcaguacaccggcaucaacgccaucagcaagaaggaguucagcaucgacgugggcuacgagagauuccugggccccgagaucuucuuccaccccgaguucgccaaccccgacuucacccagcccaucagcgaggugguggacgaggugauccagaacugccccaucgacgugagaagaccccuguacaagaacaucgugcugagcggcggcagcaccauguucagagacuucggcagaagacugcagagagaccugaagagaaccguggacgccagacugaagcugagcgaggagcugagcggcggcagacugaagcccaagcccaucgacgugcaggugaucacccaccacaugcagagauacgccgugugguucggcggcagcaugcuggccagcacccccgaguucuaccaggugugccacaccaagaaggacuacgaggagaucggccccagcaucugcagacacaaccccguguucggcgugaugagcuaa

SEQ ID NO: 13233 - RNA, 1824 nt, Artificial Sequence
  ACTR5__Homo_sapiens__NP_079131
auggccgccaacguguuccccuucagagacgccagagccgcccccgaccccgugcuggaggccggccccguggcccacggcccccugcccgugccccuggugcuggacaacggcagcuuccaggugagagccggcugggccugccccggccaggaccccggccccgagcccagacugcaguucagagccgugugcgccagaggcagaggcggcgccagaggcgccagcggcccccaggugggcaacgcccugggcagccuggagccccugagauggaugcugagaagccccuucgacagaaacgugcccgugaaccuggagcugcaggagcugcugcuggacuacagcuuccagcaccugggcgugagcagccagggcugcguggaccaccccaucgugcugaccgaggccgugugcaacccccuguacagcagacagaugaugagcgagcugcuguucgagugcuacggcauccccaagguggccuacggcaucgacagccuguucagcuucuaccacaacaagcccaagaacagcaugugcagcggccugaucaucagcagcggcuaccagugcacccacgugcugcccauccuggagggcagacuggacgccaagaacugcaagagaaucaaccugggcggcagccaggccgccggcuaccugcagagacugcugcagcugaaguaccccggccaccuggccgccaucacccugagcagaauggaggagauccugcacgagcacagcuacaucgccgaggacuacguggaggagcugcacaaguggagaugccccgacuacuacgagaacaacgugcacaagaugcagcugcccuucagcagcaagcugcugggcagcacccugaccagcgaggagaagcaggagagaagacagcagcagcugagaagacugcaggagcugaacgccagaagaagagaggagaagcugcagcuggaccaggagagacuggacagacugcuguacgugcaggagcugcuggaggacggccagauggaccaguuccacaaggcccugaucgagcugaacauggacagccccgaggagcugcagagcuacauccagaagcugagcaucgccguggagcaggccaagcagaagauccugcaggccgaggugaaccuggagguggacgugguggacagcaagcccgagacccccgaccuggagcagcuggagcccagccuggaggacguggagagcaugaacgacuucgacccccuguucagcgaggagacccccggcguggagaagcccgugaccaccgugcagcccguguucaaccuggccgccuaccaccagcuguucgugggcaccgagagaaucagagcccccgagaucaucuuccagcccagccugaucggcgaggagcaggccggcaucgccgagacccugcaguacauccuggacagauaccccaaggacauccaggagaugcuggugcagaacguguuccugaccggcggcaacaccauguaccccggcaugaaggccagaauggagaaggagcugcuggagaugagacccuucagaagcagcuuccaggugcagcuggccagcaaccccgugcuggacgccugguacggcgccagagacugggcccugaaccaccuggacgacaacgagguguggaucaccagaaaggaguacgaggagaagggcggcgaguaccugaaggagcacugcgccagcaacaucuacgugcccaucagacugcccaagcaggccagcagaagcagcgacgcccaggccagcagcaagggcagcgccgccggcggcggcggcgccggcgagcaggccuaa

SEQ ID NO: 13234 - RNA, 1131 nt, Artificial Sequence
  ACTRT1__Homo_sapiens__NP_612146
auguucaacccccacgcccuggacgugcccgccgugaucuucgacaacggcagcggccugugcaaggccggccugagcggcgagaucggccccagacacgugaucagcagcgugcugggccacugcaaguucaacgugccccuggccagacugaaccagaaguacuucgugggccaggaggcccuguacaaguacgaggcccugcaccugcacuaccccaucgagagaggccuggugaccggcugggacgacauggagaagcuguggaagcaccuguucgagagagagcugggcgugaagcccagccagcagcccgugcugaugaccgagcccagccugaaccccagagagaucagagagaagcuggccgagaugauguucgagaccuucagcgugcccggcuucuaccugagcaaccacgccguggccgcccuguacgccagcgccugcgugaccggccuggugguggacagcggcgacggcgugaccugcaccgugcccaucuucgagggcuacagccugccccacgccgugaccaagcugugcauggccggcagagacaucaccgagcaccugaccagacugcuguucgccagcggcuucaacuuccccugcauccugaacaaggccguggugaacaacaucaaggagaagcugugcuacaucgcccuggagcccgagaaggagcugagaaagagcagaggcgaggugcugggcgccuacagacugcccgacggccacgugauccacuucggcgacgagcuguaccaggugcccgaggugcuguucgcccccgaccagcugggcauccacagccccggccugagcaagauggugagcagcagcaucaugaagugcgacaccgacauccagaacaagcuguacgccgacaucgugcugagcggcggcaccacccugcugcccggccuggaggagagacugaugaaggagguggagcagcuggccagcaagggcacccccaucaagaucaccgccagccccgacagaugcuucagcgccuggaucggcgccagcaucaugaccagcaugagcagcuucaagcagaugugggugaccagcgccgacuucaaggaguacggcaccagcguggugcagagaagaugcuucuaa

SEQ ID NO: 13235 - RNA, 1518 nt, Artificial Sequence
  ACVR1B__Homo_sapiens__NP_004293
auggccgagagcgccggcgccagcagcuucuucccccugguggugcugcugcuggccggcagcggcggcagcggccccagaggcgugcaggcccugcugugcgccugcaccagcugccugcaggccaacuacaccugcgagaccgacggcgccugcauggugagcaucuucaaccuggacggcauggagcaccacgugagaaccugcauccccaagguggagcuggugcccgccggcaagcccuucuacugccugagcagcgaggaccugagaaacacccacugcugcuacaccgacuacugcaacagaaucgaccugagagugcccagcggccaccugaaggagcccgagcaccccagcauguggggccccguggagcuggugggcaucaucgccggccccguguuccugcuguuccugaucaucaucaucguguuccuggugaucaacuaccaccagagaguguaccacaacagacagagacuggacauggaggaccccagcugcgagaugugccugagcaaggacaagacccugcaggaccugguguacgaccugagcaccagcggcagcggcagcggccugccccuguucgugcagagaaccguggccagaaccaucgugcugcaggagaucaucggcaagggcagauucggcgagguguggagaggcagauggagaggcggcgacguggccgugaagaucuucagcagcagagaggagagaagcugguucagagaggccgagaucuaccagaccgugaugcugagacacgagaacauccugggcuucaucgccgccgacaacaaggacaacggcaccuggacccagcuguggcuggugagcgacuaccacgagcacggcagccuguucgacuaccugaacagauacaccgugaccaucgagggcaugaucaagcuggcccugagcgccgccagcggccuggcccaccugcacauggagaucgugggcacccagggcaagcccggcaucgcccacagagaccugaagagcaagaacauccuggugaagaagaacggcaugugcgccaucgccgaccugggccuggccgugagacacgacgccgugaccgacaccaucgacaucgcccccaaccagagagugggcaccaagagauacauggcccccgaggugcuggacgagaccaucaacaugaagcacuucgacagcuucaagugcgccgacaucuacgcccugggccugguguacugggagaucgccagaagaugcaacagcggcggcgugcacgaggaguaccagcugcccuacuacgaccuggugcccagcgaccccagcaucgaggagaugagaaagguggugugcgaccagaagcugagacccaacauccccaacugguggcagagcuacgaggcccugagagugaugggcaagaugaugagagagugcugguacgccaacggcgccgccagacugaccgcccugagaaucaagaagacccugagccagcugagcgugcaggaggacgugaagaucuaa

SEQ ID NO: 13236 - RNA, 1332 nt, Artificial Sequence
  ACVR1C__Homo_sapiens__NP_001104501
augcugaccaacggcaaggagcaggugaucaagagcugcgugagccugcccgagcugaacgcccagguguucugccacagcagcaacaacgugaccaagaccgagugcugcuucaccgacuucugcaacaacaucacccugcaccugcccaccgccagccccaacgcccccaagcugggccccauggagcuggccaucaucaucaccgugcccgugugccugcugagcaucgccgccaugcugaccgugugggccugccagggcagacagugcagcuacagaaagaagaagagacccaacguggaggagccccugagcgagugcaaccuggugaacgccggcaagacccugaaggaccugaucuacgacgugaccgccagcggcagcggcagcggccugccccugcuggugcagagaaccaucgccagaaccaucgugcugcaggagaucgugggcaagggcagauucggcgagguguggcacggcagauggugcggcgaggacguggccgugaagaucuucagcagcagagacgagagaagcugguucagagaggccgagaucuaccagaccgugaugcugagacacgagaacauccugggcuucaucgccgccgacaacaaggacaacggcaccuggacccagcuguggcuggugagcgaguaccacgagcagggcagccuguacgacuaccugaacagaaacaucgugaccguggccggcaugaucaagcuggcccugagcaucgccagcggccuggcccaccugcacauggagaucgugggcacccagggcaagcccgccaucgcccacagagacaucaagagcaagaacauccuggugaagaagugcgagaccugcgccaucgccgaccugggccuggccgugaagcacgacagcauccugaacaccaucgacaucccccagaaccccaaggugggcaccaagagauacauggcccccgagaugcuggacgacaccaugaacgugaacaucuucgagagcuucaagagagccgacaucuacagcgugggccugguguacugggagaucgccagaagaugcagcgugggcggcaucguggaggaguaccagcugcccuacuacgacauggugcccagcgaccccagcaucgaggagaugagaaagguggugugcgaccagaaguucagacccagcauccccaaccaguggcagagcugcgaggcccugagagugaugggcagaaucaugagagagugcugguacgccaacggcgccgccagacugaccgcccugagaaucaagaagaccaucagccagcugugcgugaaggaggacugcaaggccuaa

SEQ ID NO: 13237 - RNA, 1530 nt, Artificial Sequence
  ACVR1__Homo_sapiens__NP_001096
augguggacggcgugaugauccugcccgugcugaucaugaucgcccugcccagccccagcauggaggacgagaagcccaaggugaaccccaagcuguacaugugcgugugcgagggccugagcugcggcaacgaggaccacugcgagggccagcagugcuucagcagccugagcaucaacgacggcuuccacguguaccagaagggcugcuuccagguguacgagcagggcaagaugaccugcaagaccccccccagccccggccaggccguggagugcugccagggcgacuggugcaacagaaacaucaccgcccagcugcccaccaagggcaagagcuuccccggcacccagaacuuccaccuggaggugggccugaucauccugagcgugguguucgccgugugccugcuggccugccugcugggcguggcccugagaaaguucaagagaagaaaccaggagagacugaaccccagagacguggaguacggcaccaucgagggccugaucaccaccaacgugggcgacagcacccuggccgaccugcuggaccacagcugcaccagcggcagcggcagcggccugcccuuccuggugcagagaaccguggccagacagaucacccugcuggagugcgugggcaagggcagauacggcgagguguggagaggcagcuggcagggcgagaacguggccgugaagaucuucagcagcagagacgagaagagcugguucagagagaccgagcuguacaacaccgugaugcugagacacgagaacauccugggcuucaucgccagcgacaugaccagcagacacagcagcacccagcuguggcugaucacccacuaccacgagaugggcagccuguacgacuaccugcagcugaccacccuggacaccgugagcugccugagaaucgugcugagcaucgccagcggccuggcccaccugcacaucgagaucuucggcacccagggcaagcccgccaucgcccacagagaccugaagagcaagaacauccuggugaagaagaacggccagugcugcaucgccgaccugggccuggccgugaugcacagccagagcaccaaccagcuggacgugggcaacaaccccagagugggcaccaagagauacauggcccccgaggugcuggacgagaccauccagguggacugcuucgacagcuacaagagaguggacaucugggccuucggccuggugcugugggagguggccagaagaauggugagcaacggcaucguggaggacuacaagccccccuucuacgacguggugcccaacgaccccagcuucgaggacaugagaaagguggugugcguggaccagcagagacccaacauccccaacagaugguucagcgaccccacccugaccagccuggccaagcugaugaaggagugcugguaccagaaccccagcgccagacugaccgcccugagaaucaagaagacccugaccaagaucgacaacagccuggacaagcugaagaccgacugcuaa

SEQ ID NO: 13238 - RNA, 1542 nt, Artificial Sequence
  ACVR2A__Homo_sapiens__NP_001265508
augggcgccgccgccaagcuggccuucgccguguuccugaucagcugcagcagcggcgccauccugggcagaagcgagacccaggagugccuguucuucaacgccaacugggagaaggacagaaccaaccagaccggcguggagcccugcuacggcgacaaggacaagagaagacacugcuucgccaccuggaagaacaucagcggcagcaucgagaucgugaagcagggcugcuggcuggacgacaucaacugcuacgacagaaccgacugcguggagaagaaggacagccccgagguguacuucugcugcugcgagggcaacaugugcaacgagaaguucagcuacuuccccgagauggaggugacccagcccaccagcaaccccgugacccccaagccccccuacuacaacauccugcuguacagccuggugccccugaugcugaucgccggcaucgugaucugcgccuucuggguguacagacaccacaagauggccuacccccccgugcuggugcccacccaggaccccggcccccccccccccagcccccugcugggccugaagccccugcagcugcuggaggugaaggccagaggcagauucggcugcguguggaaggcccagcugcugaacgaguacguggccgugaagaucuuccccauccaggacaagcagagcuggcagaacgaguacgagguguacagccugcccggcaugaagcacgagaacauccugcaguucaucggcgccgagaagagaggcaccagcguggacguggaccuguggcugaucaccgccuuccacgagaagggcagccugagcgacuuccugaaggccaacguggugagcuggaacgagcugugccacaucgccgagaccauggccagaggccuggccuaccugcacgaggacauccccggccugaaggacggccacaagcccgccaucagccacagagacaucaagagcaagaacgugcugcugaagaacaaccugaccgccugcaucgccgacuucggccuggcccugaaguucgaggccggcaagagcgccggcgacacccacggccaggugggcaccagaagauacauggcccccgaggugcuggagggcgccaucaacuuccagagagacgccuuccugagaaucgacauguacgccaugggccuggugcugugggagcuggccagcagaugcaccgccgccgacggccccguggacgaguacaugcugcccuucgaggaggagaucggccagcaccccagccuggaggacaugcaggaggugguggugcacaagaagaagagacccgugcugagagacuacuggcagaagcacgccggcauggccaugcugugcgagaccaucgaggagugcugggaccacgacgccgaggccagacugagcgccggcugcgugggcgagagaaucacccagaugcagagacugaccaacaucaucaccaccgaggacaucgugaccguggugaccauggugaccaacguggacuucccccccaaggagagcagccuguaa

SEQ ID NO: 13239 - RNA, 1539 nt, Artificial Sequence
  ACVR2B__Homo_sapiens__NP_001097
augaccgcccccuggguggcccuggcccugcuguggggcagccugugcgccggcagcggcagaggcgaggccgagaccagagagugcaucuacuacaacgccaacugggagcuggagagaaccaaccagagcggccuggagagaugcgagggcgagcaggacaagagacugcacugcuacgccagcuggagaaacagcagcggcaccaucgagcuggugaagaagggcugcuggcuggacgacuucaacugcuacgacagacaggagugcguggccaccgaggagaacccccagguguacuucugcugcugcgagggcaacuucugcaacgagagauucacccaccugcccgaggccggcggccccgaggugaccuacgagcccccccccaccgcccccacccugcugaccgugcuggccuacagccugcugcccaucggcggccugagccugaucgugcugcuggccuucuggauguacagacacagaaagccccccuacggccacguggacauccacgaggaccccggcccccccccccccagcccccuggugggccugaagccccugcagcugcuggagaucaaggccagaggcagauucggcugcguguggaaggcccagcugaugaacgacuucguggccgugaagaucuucccccugcaggacaagcagagcuggcagagcgagagagagaucuucagcacccccggcaugaagcacgagaaccugcugcaguucaucgccgccgagaagagaggcagcaaccuggagguggagcuguggcugaucaccgccuuccacgacaagggcagccugaccgacuaccugaagggcaacaucaucaccuggaacgagcugugccacguggccgagaccaugagcagaggccugagcuaccugcacgaggacgugcccuggugcagaggcgagggccacaagcccagcaucgcccacagagacuucaagagcaagaacgugcugcugaagagcgaccugaccgccgugcuggccgacuucggccuggccgugagauucgagcccggcaagccccccggcgacacccacggccaggugggcaccagaagauacauggcccccgaggugcuggagggcgccaucaacuuccagagagacgccuuccugagaaucgacauguacgccaugggccuggugcugugggagcuggugagcagaugcaaggccgccgacggccccguggacgaguacaugcugcccuucgaggaggagaucggccagcaccccagccuggaggagcugcaggaggugguggugcacaagaagaugagacccaccaucaaggaccacuggcugaagcaccccggccuggcccagcugugcgugaccaucgaggagugcugggaccacgacgccgaggccagacugagcgccggcugcguggaggagagagugagccugaucagaagaagcgugaacggcaccaccagcgacugccuggugagccuggugaccagcgugaccaacguggaccugccccccaaggagagcagcaucuaa

SEQ ID NO: 13240 - RNA, 1512 nt, Artificial Sequence
  ACVRL1__Homo_sapiens__NP_001070869
augacccugggcagccccagaaagggccugcugaugcugcugauggcccuggugacccagggcgaccccgugaagcccagcagaggcccccuggugaccugcaccugcgagagcccccacugcaagggccccaccugcagaggcgccuggugcaccguggugcuggugagagaggagggcagacacccccaggagcacagaggcugcggcaaccugcacagagagcugugcagaggcagacccaccgaguucgugaaccacuacugcugcgacagccaccugugcaaccacaacgugagccuggugcuggaggccacccagccccccagcgagcagcccggcaccgacggccagcuggcccugauccugggccccgugcuggcccugcuggcccugguggcccugggcgugcugggccuguggcacgugagaagaagacaggagaagcagagaggccugcacagcgagcugggcgagagcagccugauccugaaggccagcgagcagggcgacagcaugcugggcgaccugcuggacagcgacugcaccaccggcagcggcagcggccugcccuuccuggugcagagaaccguggccagacagguggcccugguggagugcgugggcaagggcagauacggcgagguguggagaggccuguggcacggcgagagcguggccgugaagaucuucagcagcagagacgagcagagcugguucagagagaccgagaucuacaacaccgugcugcugagacacgacaacauccugggcuucaucgccagcgacaugaccagcagaaacagcagcacccagcuguggcugaucacccacuaccacgagcacggcagccuguacgacuuccugcagagacagacccuggagccccaccuggcccugagacuggccgugagcgccgccugcggccuggcccaccugcacguggagaucuucggcacccagggcaagcccgccaucgcccacagagacuucaagagcagaaacgugcuggugaagagcaaccugcagugcugcaucgccgaccugggccuggccgugaugcacagccagggcagcgacuaccuggacaucggcaacaaccccagagugggcaccaagagauacauggcccccgaggugcuggacgagcagaucagaaccgacugcuucgagagcuacaaguggaccgacaucugggccuucggccuggugcugugggagaucgccagaagaaccaucgugaacggcaucguggaggacuacagaccccccuucuacgacguggugcccaacgaccccagcuucgaggacaugaagaagguggugugcguggaccagcagacccccaccauccccaacagacuggccgccgaccccgugcugagcggccuggcccagaugaugagagagugcugguaccccaaccccagcgccagacugaccgcccugagaaucaagaagacccugcagaagaucagcaacagccccgagaagcccaaggugauccaguaa

SEQ ID NO: 13241 - RNA, 1227 nt, Artificial Sequence
  ACY1__Homo_sapiens__NP_001185824
augaccagcaagggccccgaggaggagcaccccagcgugacccuguucagacaguaccugagaaucagaaccgugcagcccaagcccgacuacggcgccgccguggccuucuucgaggagaccgccagacagcugggccugggcugccagaagguggagguggcccccggcuacguggugaccgugcugaccuggcccggcaccaaccccacccugagcagcauccugcugaacagccacaccgacguggugcccguguucaaggagcacuggagccacgaccccuucgaggccuucaaggacagcgagggcuacaucuacgccagaggcgcccaggacaugaagugcgugagcauccaguaccuggaggccgugagaagacugaagguggagggccacagauuccccagaaccauccacaugaccuucgugcccgacgaggaggugggcggccaccagggcauggagcuguucgugcagagacccgaguuccacgcccugagagccggcuucgcccuggacgagggcaucgccaaccccaccgacgccuucaccguguucuacagcgagagaagccccuggugggugagagugaccagcaccggcagacccggccacgccagcagauucauggaggacaccgccgccgagaagcugcacaagguggugaacagcauccuggccuucagagagaaggaguggcagagacugcagagcaacccccaccugaaggagggcagcgugaccagcgugaaccugaccaagcuggagggcggcguggccuacaacgugauccccgccaccaugagcgccagcuucgacuucagaguggcccccgacguggacuucaaggccuucgaggagcagcugcagagcuggugccaggccgccggcgagggcgugacccuggaguucgcccagaaguggaugcacccccaggugacccccaccgacgacagcaaccccuggugggccgccuucagcagagugugcaaggacaugaaccugacccuggagcccgagaucaugcccgccgccaccgacaacagauacaucagagccgugggcgugcccgcccugggcuucagccccaugaacagaacccccgugcugcugcacgaccacgacgagagacugcacgaggccguguuccugagaggcguggacaucuacaccagacugcugcccgcccuggccagcgugcccgcccugcccagcgacagcuaa

SEQ ID NO: 13242 - RNA, 960 nt, Artificial Sequence
  ACY3__Homo_sapiens__NP_542389
augugcagccugcccgugcccagagagccccugagaagaguggccgugaccggcggcacccacggcaacgagaugagcggcguguaccuggccagacacuggcugcacgcccccgccgagcugcagagagccagcuucagcgccgugcccgugcuggccaaccccgccgccaccagcggcugcagaagauacguggaccacgaccugaacagaaccuucaccagcagcuuccugaacagcagacccacccccgacgaccccuacgaggugaccagagccagagagcugaaccagcugcugggccccaaggccagcggccaggccuucgacuucgugcuggaccugcacaacaccaccgccaacaugggcaccugccugaucgccaagagcagccacgagguguucgccaugcaccugugcagacaccugcagcugcaguaccccgagcugagcugccagguguuccuguaccagagaagcggcgaggagagcuacaaccuggacagcguggccaagaacggccugggccuggagcugggcccccagccccagggcgugcugagagccgacaucuucagcagaaugagaacccugguggccaccgugcuggacuucaucgagcuguucaaccagggcaccgccuuccccgccuucgagauggaggccuacagacccgugggcgugguggacuuccccagaaccgaggccggccaccuggccggcaccgugcacccccagcugcaggacagagacuuccagccccugcagcccggcgcccccaucuuccagauguucagcggcgaggaccugcuguacgagggcgagagcaccguguaccccguguucaucaacgaggccgccuacuacgagaagggcguggccuucgugcagaccgagaaguucaccuucaccgugcccgccaugcccgcccugacccccgcccccagccccgccagcuaa

SEQ ID NO: 13243 - RNA, 300 nt, Artificial Sequence
  ACYP2__Homo_sapiens__NP_612457
augagcaccgcccagagccugaagagcguggacuacgagguguucggcagagugcagggcgugugcuucagaauguacaccgaggacgaggccagaaagaucggcguggugggcugggugaagaacaccagcaagggcaccgugaccggccaggugcagggccccgaggacaaggugaacagcaugaagagcuggcugagcaaggugggcagccccagcagcagaaucgacagaaccaacuucagcaacgagaagaccaucagcaagcuggaguacagcaacuucagcaucagauacuaa

SEQ ID NO: 13244 - RNA, 1698 nt, Artificial Sequence
  ADAD1__Homo_sapiens__NP_001152757
auggccagcaacaaccacugguuccagagcagccaggugcccagcuucgcccagaugcugaagaagaaccugcccgugcagcccgccaccaagaccaucaccacccccaccggcuggagcagcgagagcuacggccugagcaagauggccagcaaggugacccaggugaccggcaacuuccccgagccccugcugagcaagaaccugagcagcaucagcaaccccgugcugccccccaagaagauccccaaggaguucaucaugaaguacaagagaggcgagaucaaccccgugagcgcccugcaccaguucgcccagaugcagagagugcagcuggaccugaaggagaccgugaccaccggcaacgugaugggccccuacuucgccuucugcgccgugguggacggcauccaguacaagaccggccugggccagaacaagaaggagagcagaagcaacgccgccaagcuggcccuggacgagcugcugcagcuggacgagcccgagcccagaauccuggagaccagcggccccccccccuuccccgccgagcccguggugcugagcgagcuggccuacgugagcaaggugcacuacgagggcagacacauccaguacgccaagaucagccagaucgugaaggagagauucaaccagcugaucagcaacagaagcgaguaccugaaguacagcagcagccuggccgccuucaucaucgagagagccggccagcacgaggugguggccaucggcaccggcgaguacaacuacagccaggacaucaagcccgacggcagagugcugcacgacacccacgccguggugaccgccagaagaagccugcugagcaagaaccccgccaugauggagaagagcaucuucugcaccgagcccaccagcaaccugcugacccugaagcagaacaucaacaucugccuguacaugaaccagcugcccaagggcagcgcccagaucaagagccagcugagacugaacccccacagcaucagcgccuucgaggccaacgaggagcugugccugcacguggccguggagggcaagaucuaccugaccguguacugccccaaggacggcgugaacagaaucagcagcaugagcagcagcgacaagcugaccagaugggaggugcugggcgugcagggcgcccugcugagccacuucauccagcccguguacaucagcagcauccugaucggcgacggcaacugcagcgacaccagaggccuggagaucgccaucaagcagagaguggacgacgcccugaccagcaagcugcccauguucuaccuggugaacagaccccacaucagccuggugcccagcgccuacccccugcagaugaaccuggaguacaaguuccugagccugaacugggcccagggcgacgugagccuggagaucguggacggccugagcggcaagaucaccgagagcagccccuucaagagcggcaugagcauggccagcagacugugcaaggccgccaugcugagcagauucaaccugcuggccaaggaggccaagaaggagcugcuggaggccggcaccuaccacgccgccaagugcaugagcgccagcuaccaggaggccaagugcaagcugaagagcuaccugcagcagcacggcuacggcagcuggaucgugaagagccccugcaucgagcaguucaacauguaa

SEQ ID NO: 13245 - RNA, 1092 nt, Artificial Sequence
  ADA__Homo_sapiens__NP_000013
auggcccagacccccgccuucgacaagcccaagguggagcugcacgugcaccuggacggcagcaucaagcccgagaccauccuguacuacggcagaagaagaggcaucgcccugcccgccaacaccgccgagggccugcugaacgugaucggcauggacaagccccugacccugcccgacuuccuggccaaguucgacuacuacaugcccgccaucgccggcugcagagaggccaucaagagaaucgccuacgaguucguggagaugaaggccaaggagggcgugguguacguggaggugagauacagcccccaccugcuggccaacagcaagguggagcccauccccuggaaccaggccgagggcgaccugacccccgacgaggugguggcccuggugggccagggccugcaggagggcgagagagacuucggcgugaaggccagaagcauccugugcugcaugagacaccagcccaacuggagccccaaggugguggagcugugcaagaaguaccagcagcagaccgugguggccaucgaccuggccggcgacgagaccauccccggcagcagccugcugcccggccacgugcaggccuaccaggaggccgugaagagcggcauccacagaaccgugcacgccggcgaggugggcagcgccgagguggugaaggaggccguggacauccugaagaccgagagacugggccacggcuaccacacccuggaggaccaggcccuguacaacagacugagacaggagaacaugcacuucgagaucugccccuggagcagcuaccugaccggcgccuggaagcccgacaccgagcacgccgugaucagacugaagaacgaccaggccaacuacagccugaacaccgacgacccccugaucuucaagagcacccuggacaccgacuaccagaugaccaagagagacaugggcuucaccgaggaggaguucaagagacugaacaucaacgccgccaagagcagcuuccugcccgaggacgagaagagagagcugcuggaccugcuguacaaggccuacggcaugccccccagcgccagcgccggccagaaccuguaa

SEQ ID NO: 13246 - RNA, 2247 nt, Artificial Sequence
  ADAM10__Homo_sapiens__NP_001101
auggugcugcugagagugcugauccugcugcugagcugggccgccggcaugggcggccaguacggcaacccccugaacaaguacaucagacacuacgagggccugagcuacaacguggacagccugcaccagaagcaccagagagccaagagagccgugagccacgaggaccaguuccugagacuggacuuccacgcccacggcagacacuucaaccugagaaugaagagagacaccagccuguucagcgacgaguucaagguggagaccagcaacaaggugcuggacuacgacaccagccacaucuacaccggccacaucuacggcgaggagggcagcuucagccacggcagcgugaucgacggcagauucgagggcuucauccagaccagaggcggcaccuucuacguggagcccgccgagagauacaucaaggacagaacccugcccuuccacagcgugaucuaccacgaggacgacaucaacuacccccacaaguacggcccccagggcggcugcgccgaccacagcguguucgagagaaugagaaaguaccagaugaccggcguggaggaggugacccagaucccccaggaggagcacgccgccaacggccccgagcugcugagaaagaagagaaccaccagcgccgagaagaacaccugccagcuguacauccagaccgaccaccuguucuucaaguacuacggcaccagagaggccgugaucgcccagaucagcagccacgugaaggccaucgacaccaucuaccagaccaccgacuucagcggcaucagaaacaucagcuucauggugaagagaaucagaaucaacaccaccgccgacgagaaggaccccaccaaccccuucagauuccccaacaucggcguggagaaguuccuggagcugaacagcgagcagaaccacgacgacuacugccuggccuacguguucaccgacagagacuucgacgacggcgugcugggccuggccugggugggcgcccccagcggcagcagcggcggcaucugcgagaagagcaagcuguacagcgacggcaagaagaagagccugaacaccggcaucaucaccgugcagaacuacggcagccacgugccccccaaggugagccacaucaccuucgcccacgaggugggccacaacuucggcagcccccacgacagcggcaccgagugcacccccggcgagagcaagaaccugggccagaaggagaacggcaacuacaucauguacgccagagccaccagcggcgacaagcugaacaacaacaaguucagccugugcagcaucagaaacaucagccaggugcuggagaagaagagaaacaacugcuucguggagagcggccagcccaucugcggcaacggcaugguggagcagggcgaggagugcgacugcggcuacagcgaccagugcaaggacgagugcugcuucgacgccaaccagcccgagggcagaaagugcaagcugaagcccggcaagcagugcagccccagccagggccccugcugcaccgcccagugcgccuucaagagcaagagcgagaagugcagagacgacagcgacugcgccagagagggcaucugcaacggcuucaccgcccugugccccgccagcgaccccaagcccaacuucaccgacugcaacagacacacccaggugugcaucaacggccagugcgccggcagcaucugcgagaaguacggccuggaggagugcaccugcgccagcagcgacggcaaggacgacaaggagcugugccacgugugcugcaugaagaagauggaccccagcaccugcgccagcaccggcagcgugcaguggagcagacacuucagcggcagaaccaucacccugcagcccggcagccccugcaacgacuucagaggcuacugcgacguguucaugagaugcagacugguggacgccgacggcccccuggccagacugaagaaggccaucuucagccccgagcuguacgagaacaucgccgaguggaucguggcccacuggugggccgugcugcugaugggcaucgcccugaucaugcugauggccggcuucaucaagaucugcagcgugcacacccccagcagcaaccccaagcugcccccccccaagccccugcccggcacccugaagagaagaagacccccccagcccauccagcagccccagagacagagacccagagagagcuaccagaugggccacaugagaagauaa

SEQ ID NO: 13247 - RNA, 2310 nt, Artificial Sequence
  ADAM11__Homo_sapiens__NP_002381
augagacugcugagaagaugggccuucgccgcccugcugcugagccugcugcccacccccggccugggcacccagggccccgccggcgcccugagauggggcggccugccccagcugggcggccccggcgcccccgaggugaccgagcccagcagacuggugagagagagcagcggcggcgaggugagaaagcagcagcuggacaccagagugagacaggagccccccggcggcccccccgugcaccuggcccaggugagcuucgugauccccgccuucaacagcaacuucacccuggaccuggagcugaaccaccaccugcugagcagccaguacguggagagacacuucagcagagagggcaccacccagcacagcaccggcgccggcgaccacugcuacuaccagggcaagcugagaggcaacccccacagcuucgccgcccugagcaccugccagggccugcacggcguguucagcgacggcaaccugaccuacaucguggagccccaggagguggccggccccuggggcgccccccagggcccccugccccaccugaucuacagaaccccccugcugcccgacccccugggcugcagagagcccggcugccuguucgccgugcccgcccagagcgccccccccaacagacccagacugagaagaaagagacaggugagaagaggccaccccaccgugcacagcgagaccaaguacguggagcugaucgugaucaacgaccaccagcuguucgagcagaugagacagagcguggugcugaccagcaacuucgccaagagcguggugaaccuggccgacgugaucuacaaggagcagcugaacaccagaaucgugcugguggccauggagaccugggccgacggcgacaagauccaggugcaggacgaccugcuggagacccuggccagacugaugguguacagaagagagggccugcccgagcccagcgacgccacccaccuguucagcggcagaaccuuccagagcaccagcagcggcgccgccuacgugggcggcaucugcagccugagccacggcggcggcgugaacgaguacggcaacaugggcgccauggccgugacccuggcccagacccugggccagaaccugggcaugauguggaacaagcacagaagcagcgccggcgacugcaagugccccgacaucuggcugggcugcaucauggaggacaccggcuucuaccugcccagaaaguucagcagaugcagcaucgacgaguacaaccaguuccugcaggagggcggcggcagcugccuguucaacaagccccugaagcugcuggacccccccgagugcggcaacggcuucguggaggccggcgaggagugcgacugcggcagcgugcaggagugcagcagagccggcggcaacugcugcaagaagugcacccugacccacgacgccaugugcagcgacggccugugcugcagaagaugcaaguacgagcccagaggcgugagcugcagagaggccgugaacgagugcgacaucgccgagaccugcaccggcgacagcagccagugcccccccaaccugcacaagcuggacggcuacuacugcgaccacgagcagggcagaugcuacggcggcagaugcaagaccagagacagacagugccaggugcuguggggccacgccgccgccgacagauucugcuacgagaagcugaacguggagggcaccgagagaggcagcugcggcagaaagggcagcggcugggugcagugcagcaagcaggacgugcugugcggcuuccugcugugcgugaacaucagcggcgcccccagacugggcgaccuggugggcgacaucagcagcgugaccuucuaccaccagggcaaggagcuggacugcagaggcggccacgugcagcuggccgacggcagcgaccugagcuacguggaggacggcaccgccugcggccccaacaugcugugccuggaccacagaugccugcccgccagcgccuucaacuucagcaccugccccggcagcggcgagagaagaaucugcagccaccacggcgugugcagcaacgagggcaagugcaucugccagcccgacuggaccggcaaggacugcagcauccacaacccccugcccaccagcccccccaccggcgagaccgagagauacaagggccccagcggcaccaacaucaucaucggcagcaucgccggcgccgugcugguggccgccaucgugcugggcggcaccggcuggggcuucaagaacaucagaagaggcagaagcggcggcgccuaa

SEQ ID NO: 13248 - RNA, 2208 nt, Artificial Sequence
  ADAM12__Homo_sapiens__NP_001275904
auggccgccagaccccugcccgugagccccgccagagcccugcugcuggcccuggccggcgcccugcuggcccccugcgaggccagaggcgugagccuguggaaccagggcagagccgacgagguggugagcgccagcgugggcagcggcgaccuguggauccccgugaagagcuucgacagcaagaaccaccccgaggugcugaacaucagacugcagagagagagcaaggagcugaucaucaaccuggagagaaacgagggccugaucgccagcagcuucaccgagacccacuaccugcaggacggcaccgacgugagccuggccagaaacuacaccggccacugcuacuaccacggccacgugagaggcuacagcgacagcgccgugagccugagcaccugcagcggccugagaggccugaucguguucgagaacgagagcuacgugcuggagcccaugaagagcgccaccaacagauacaagcuguuccccgccaagaagcugaagagcgugagaggcagcugcggcagccaccacaacacccccaaccuggccgccaagaacguguuccccccccccagccagaccugggccagaagacacaagagagagacccugaaggccaccaaguacguggagcuggugaucguggccgacaacagagaguuccagagacagggcaaggaccuggagaaggugaagcagagacugaucgagaucgccaaccacguggacaaguucuacagaccccugaacaucagaaucgugcuggugggcguggagguguggaacgacauggacaagugcagcgugagccaggaccccuucaccagccugcacgaguuccuggacuggagaaagaugaagcugcugcccagaaagagccacgacaacgcccagcuggugagcggcguguacuuccagggcaccaccaucggcauggcccccaucaugagcaugugcaccgccgaccagagcggcggcaucgugauggaccacagcgacaacccccugggcgccgccgugacccuggcccacgagcugggccacaacuucggcaugaaccacgacacccuggacagaggcugcagcugccagauggccguggagaagggcggcugcaucaugaacgccagcaccggcuaccccuuccccaugguguucagcagcugcagcagaaaggaccuggagaccagccuggagaagggcaugggcgugugccuguucaaccugcccgaggugagagagagcuucggcggccagaagugcggcaacagauucguggaggagggcgaggagugcgacugcggcgagcccgaggagugcaugaacagaugcugcaacgccaccaccugcacccugaagcccgacgccgugugcgcccacggccugugcugcgaggacugccagcugaagcccgccggcaccgccugcagagacagcagcaacagcugcgaccugcccgaguucugcaccggcgccagcccccacugccccgccaacguguaccugcacgacggccacagcugccaggacguggacggcuacugcuacaacggcaucugccagacccacgagcagcagugcgugacccuguggggccccggcgccaagcccgcccccggcaucugcuucgagagagugaacagcgccggcgaccccuacggcaacugcggcaaggugagcaagagcagcuucgccaagugcgagaugagagacgccaagugcggcaagauccagugccagggcggcgccagcagacccgugaucggcaccaacgccgugagcaucgagaccaacaucccccugcagcagggcggcagaauccugugcagaggcacccacguguaccugggcgacgacaugcccgaccccggccuggugcuggccggcaccaagugcgccgacggcaagaucugccugaacagacagugccagaacaucagcguguucggcgugcacgagugcgccaugcagugccacggcagaggcgugugcaacaacagaaagaacugccacugcgaggcccacugggccccccccuucugcgacaaguucggcuucggcggcagcaccgacagcggccccaucagacaggccgaggccagacaggaggccgccgagagcaacagagagagaggccagggccaggagcccgugggcagccaggagcacgccagcaccgccagccugacccugaucuaa

SEQ ID NO: 13249 - RNA, 2475 nt, Artificial Sequence
  ADAM15__Homo_sapiens__NP_001248393
augagacuggcccugcugugggcccugggccugcugggcgccggcagcccccugcccagcuggccccugcccaacaucgugcugagcuggggcgugcugggccccgccggcggcaccgaggagcagcaggccgagagcgagaaggcccccagagagccccuggagccccaggugcugcaggacgaccugcccaucagccugaagaaggugcugcagaccagccugcccgagccccugagaaucaagcuggagcuggacggcgacagccacauccuggagcugcugcagaacagagagcuggugcccggcagacccacccuggugugguaccagcccgacggcaccagaguggugagcgagggccacacccuggagaacugcugcuaccagggcagagugagaggcuacgccggcagcugggugagcaucugcaccugcagcggccugagaggccugguggugcugacccccgagagaagcuacacccuggagcagggccccggcgaccugcagggcccccccaucaucagcagaauccaggaccugcaccugcccggccacaccugcgcccugagcuggagagagagcgugcacacccagaagccccccgagcacccccugggccagagacacaucagaagaagaagagacguggugaccgagaccaagaccguggagcuggugaucguggccgaccacagcgaggcccagaaguacagagacuuccagcaccugcugaacagaacccuggagguggcccugcugcuggacaccuucuucagaccccugaacgugagaguggcccuggugggccuggaggccuggacccagagagaccugguggagaucagccccaaccccgccgugacccuggagaacuuccugcacuggagaagagcccaccugcugcccagacugccccacgacagcgcccagcuggugaccggcaccagcuucagcggccccaccgugggcauggccauccagaacagcaucugcagccccgacuucagcggcggcgugaacauggaccacagcaccagcauccugggcguggccagcagcaucgcccacgagcugggccacagccugggccuggaccacgaccugcccggcaacagcugccccugccccggccccgcccccgccaagaccugcaucauggaggccagcaccgacuuccugcccggccugaacuucagcaacugcagcagaagagcccuggagaaggcccugcuggacggcaugggcagcugccuguucgagagacugcccagccugccccccauggccgccuucugcggcaacauguucguggagcccggcgagcagugcgacugcggcuuccuggacgacugcguggaccccugcugcgacagccugaccugccagcugagacccggcgcccagugcgccagcgacggccccugcugccagaacugccagcugagacccagcggcuggcagugcagacccaccagaggcgacugcgaccugcccgaguucugccccggcgacagcagccagugcccccccgacgugagccugggcgacggcgagcccugcgccggcggccaggccgugugcaugcacggcagaugcgccagcuacgcccagcagugccagagccuguggggccccggcgcccagcccgccgccccccugugccugcagaccgccaacaccagaggcaacgccuucggcagcugcggcagaaaccccagcggcagcuacgugagcugcacccccagagacgccaucugcggccagcugcagugccagaccggcagaacccagccccugcugggcagcaucagagaccugcugugggagaccaucgacgugaacggcaccgagcugaacugcagcugggugcaccuggaccugggcagcgacguggcccagccccugcugacccugcccggcaccgccugcggccccggccuggugugcaucgaccacagaugccagagaguggaccugcugggcgcccaggagugcagaagcaagugccacggccacggcgugugcgacagcaacagacacugcuacugcgaggagggcugggccccccccgacugcaccacccagcugaaggccaccagcagccugaccaccggccugcugcugagccugcuggugcugcuggugcuggugaugcugggcgccagcuacugguacagagccagacugcaccagagacugugccagcugaagggccccaccugccaguacagagccgcccagagcggccccagcgagagacccggccccccccagagagcccugcuggccagaggcaccaagagccagggccccgccaagccccccccccccagaaagccccugcccgccgacccccagggcagaugccccagcggcgaccugcccggccccggcgccggcauccccccccugguggugcccagcagacccgccccccccccccccaccgugagcagccuguaccuguaa

SEQ ID NO: 13250 - RNA, 2475 nt, Artificial Sequence
  ADAM17__Homo_sapiens__NP_003174
augagacagagccugcuguuccugaccagcguggugcccuucgugcuggcccccagaccccccgacgaccccggcuucggcccccaccagagacuggagaagcuggacagccugcugagcgacuacgacauccugagccugagcaacauccagcagcacagcgugagaaagagagaccugcagaccagcacccacguggagacccugcugaccuucagcgcccugaagagacacuucaagcuguaccugaccagcagcaccgagagauucagccagaacuucaaggugguggugguggacggcaagaacgagagcgaguacaccgugaaguggcaggacuucuucaccggccacguggugggcgagcccgacagcagagugcuggcccacaucagagacgacgacgugaucaucagaaucaacaccgacggcgccgaguacaacaucgagccccuguggagauucgugaacgacaccaaggacaagagaaugcugguguacaagagcgaggacaucaagaacgugagcagacugcagagccccaaggugugcggcuaccugaagguggacaacgaggagcugcugcccaagggccugguggacagagagccccccgaggagcuggugcacagagugaagagaagagccgaccccgaccccaugaagaacaccugcaagcugcuggugguggccgaccacagauucuacagauacaugggcagaggcgaggagagcaccaccaccaacuaccugaucgagcugaucgacagaguggacgacaucuacagaaacaccagcugggacaacgccggcuucaagggcuacggcauccagaucgagcagaucagaauccugaagagcccccaggaggugaagcccggcgagaagcacuacaacauggccaagagcuaccccaacgaggagaaggacgccugggacgugaagaugcugcuggagcaguucagcuucgacaucgccgaggaggccagcaaggugugccuggcccaccuguucaccuaccaggacuucgacaugggcacccugggccuggccuacgugggcagccccagagccaacagccacggcggcgugugccccaaggccuacuacagccccgugggcaagaagaacaucuaccugaacagcggccugaccagcaccaagaacuacggcaagaccauccugaccaaggaggccgaccuggugaccacccacgagcugggccacaacuucggcgccgagcacgaccccgacggccuggccgagugcgcccccaacgaggaccagggcggcaaguacgugauguaccccaucgccgugagcggcgaccacgagaacaacaagauguucagcaacugcagcaagcagagcaucuacaagaccaucgagagcaaggcccaggagugcuuccaggagagaagcaacaaggugugcggcaacagcagaguggacgagggcgaggagugcgaccccggcaucauguaccugaacaacgacaccugcugcaacagcgacugcacccugaaggagggcgugcagugcagcgacagaaacagccccugcugcaagaacugccaguucgagaccgcccagaagaagugccaggaggccaucaacgccaccugcaagggcgugagcuacugcaccggcaacagcagcgagugccccccccccggcaacgccgaggacgacaccgugugccuggaccugggcaagugcaaggacggcaagugcauccccuucugcgagagagagcagcagcuggagagcugcgccugcaacgagaccgacaacagcugcaaggugugcugcagagaccugagcggcagaugcgugcccuacguggacgccgagcagaagaaccuguuccugagaaagggcaagcccugcaccgugggcuucugcgacaugaacggcaagugcgagaagagagugcaggacgugaucgagagauucugggacuucaucgaccagcugagcaucaacaccuucggcaaguuccuggccgacaacaucgugggcagcgugcugguguucagccugaucuucuggauccccuucagcauccuggugcacugcguggacaagaagcuggacaagcaguacgagagccugagccuguuccaccccagcaacguggagaugcugagcagcauggacagcgccagcgugagaaucaucaagcccuuccccgccccccagacccccggcagacugcagcccgcccccgugauccccagcgcccccgccgcccccaagcuggaccaccagagaauggacaccauccaggaggaccccagcaccgacagccacauggacgaggacggcuucgagaaggaccccuuccccaacagcagcaccgccgccaagagcuucgaggaccugaccgaccaccccgugaccagaagcgagaaggccgccagcuucaagcugcagagacagaacagaguggacagcaaggagaccgagugcuaa

SEQ ID NO: 13251 - RNA, 2757 nt, Artificial Sequence
  ADAM19__Homo_sapiens__NP_150377
augcccggcggcgccggcgccgccagacugugccugcuggccuucgcccugcagccccugagacccagagccgccagagagcccggcuggaccagaggcagcgaggagggcagccccaagcugcagcacgagcugaucaucccccaguggaagaccagcgagagccccgugagagagaagcacccccugaaggccgagcugagagugauggccgagggcagagagcugauccuggaccuggagaagaacgagcagcuguucgcccccagcuacaccgagacccacuacaccagcagcggcaacccccagaccaccaccagaaagcuggaggaccacugcuucuaccacggcaccgugagagagaccgagcugagcagcgugacccugagcaccugcagaggcaucagaggccugaucaccgugagcagcaaccugagcuacgugaucgagccccugcccgacagcaagggccagcaccugaucuacagaagcgagcaccugaagcccccccccggcaacugcggcuucgagcacagcaagcccaccaccagagacugggcccugcaguucacccagcagaccaagaagagacccagaagaaugaagagagaggaccugaacagcaugaaguacguggagcuguaccugguggccgacuaccuggaguuccagaagaacagaagagaccaggacgccaccaagcacaagcugaucgagaucgccaacuacguggacaaguucuacagaagccugaacaucagaaucgcccuggugggccuggagguguggacccacggcaacaugugcgaggugagcgagaaccccuacagcacccuguggagcuuccugagcuggagaagaaagcugcuggcccagaaguaccacgacaacgcccagcugaucaccggcaugagcuuccacggcaccaccaucggccuggccccccugauggccaugugcagcguguaccagagcggcggcgugaacauggaccacagcgagaacgccaucggcguggccgccaccauggcccacgagaugggccacaacuucggcaugacccacgacagcgccgacugcugcagcgccagcgccgccgacggcggcugcaucauggccgccgccaccggccaccccuuccccaagguguucaacggcugcaacagaagagagcuggacagauaccugcagagcggcggcggcaugugccugagcaacaugcccgacaccagaaugcuguacggcggcagaagaugcggcaacggcuaccuggaggacggcgaggagugcgacugcggcgaggaggaggagugcaacaaccccugcugcaacgccagcaacugcacccugagacccggcgccgagugcgcccacggcagcugcugccaccagugcaagcugcuggcccccggcacccugugcagagagcaggccagacagugcgaccugcccgaguucugcaccggcaagagcccccacugccccaccaacuucuaccagauggacggcacccccugcgagggcggccaggccuacugcuacaacggcaugugccugaccuaccaggagcagugccagcagcuguggggccccggcgccagacccgcccccgaccugugcuucgagaaggugaacguggccggcgacaccuucggcaacugcggcaaggacaugaacggcgagcacagaaagugcaacaugagagacgccaagugcggcaagauccagugccagagcagcgaggccagaccccuggagagcaacgccgugcccaucgacaccaccaucaucaugaacggcagacagauccagugcagaggcacccacguguacagaggccccgaggaggagggcgacaugcuggaccccggccuggugaugaccggcaccaagugcggcuacaaccacaucugcuucgagggccagugcagaaacaccagcuucuucgagaccgagggcugcggcaagaagugcaacggccacggcgugugcaacaacaaccagaacugccacugccugcccggcugggccccccccuucugcaacacccccggccacggcggcagcaucgacagcggccccaugccccccgagagcgugggccccgugguggccggcgugcugguggccauccuggugcuggccgugcugaugcugauguacuacugcugcagacagaacaacaagcugggccagcugaagcccagcgcccugcccagcaagcugagacagcaguucagcugccccuucagagugagccagaacagcggcaccggccacgccaaccccaccuucaagcugcagaccccccagggcaagagaaaggugaucaacacccccgagauccugagaaagcccagccagcccccccccagacccccccccgacuaccugagaggcggcagcccccccgccccccugcccgcccaccugagcagagccgccagaaacagccccggccccggcagccagaucgagagaaccgagagcagcagaagacccccccccagcagacccaucccccccgcccccaacugcaucgugagccaggacuucagcagacccagacccccccagaaggcccugcccgccaaccccgugcccggcagaagaagccugcccagacccggcggcgccagcccccugagaccccccggcgccggcccccagcagagcagaccccuggccgcccuggcccccaaguuccccgaguacagaagccagagagccggcggcaugaucagcagcaagaucuaa

SEQ ID NO: 13252 - RNA, 2331 nt, Artificial Sequence
  ADAM20__Homo_sapiens__XP_005268209
auggugcagcugcaccaggacaccgacccccagauccccaagggccagcccugcacccugaacagcagcgagggcggcgccagacccgccgugccccacacccuguucagcagcgcccuggacagauggcugcacaacgacagcuucaucauggccgugggcgagccccuggugcacaucagagugacccugcugcugcugugguucggcauguuccugagcaucagcggccacagccaggccagacccagccaguacuucaccagccccgagguggugaucccccugaaggugaucagcagaggcagaggcgccaaggcccccggcuggcugagcuacagccugagauucggcggccagagauacaucgugcacaugagagugaacaagcugcuguucgccgcccaccugcccguguucaccuacaccgagcagcacgcccugcugcaggaccagcccuucauccaggacgacugcuacuaccacggcuacguggagggcgugcccgagagccugguggcccugagcaccugcagcggcggcuuccugggcaugcugcagaucaacgaccugguguacgagaucaagcccaucagcgugagcgccaccuucgagcaccugguguacaagaucgacagcgacgacacccaguucccccccaugagaugcggccugaccgaggagaagaucgcccaccagauggagcugcagcugagcuacaacuucacccugaagcagagcagcuucgugggcugguggacccaccagagauucguggagcuggugguggugguggacaacaucagauaccuguucagccagagcaacgccaccaccgugcagcacgagguguucaacguggugaacaucguggacagcuucuaccacccccuggagguggacgugauccugaccggcaucgacaucuggaccgccagcaacccccugcccaccagcggcgaccuggacaacgugcuggaggacuucagcaucuggaagaacuacaaccugaacaacagacugcagcacgacguggcccaccuguucaucaaggacacccagggcaugaagcugggcguggccuacgugaagggcaucugccagaaccccuucaacaccggcguggacguguucgaggacaacagacuggugguguucgccaucacccugggccacgagcugggccacaaccugggcaugcagcacgacacccaguggugcgugugcgagcugcaguggugcaucaugcacgccuacagaaaggugaccaccaaguucagcaacugcagcuacgcccaguacugggacagcaccaucagcagcggccugugcauccagcccccccccuaccccggcaacaucuucagacugaaguacugcggcaaccuggugguggaggagggcgaggagugcgacugcggcaccaucagacagugcgccaaggaccccugcugccugcugaacugcacccugcaccccggcgccgccugcgccuucggcaucugcugcaaggacugcaaguuccugcccagcggcacccugugcagacagcaggugggcgagugcgaccugcccgaguggugcaacggcaccagccaccagugccccgacgacguguacgugcaggacggcaucagcugcaacgugaacgccuucugcuacgagaagaccugcaacaaccacgacauccagugcaaggagaucuucggccaggacgccagaagcgccagccagagcugcuaccaggagaucaacacccagggcaacagauucggccacugcggcaucgugggcaccaccuacgugaagugcuggacccccgacaucaugugcggcagagugcagugcgagaacgugggcgugauccccaaccugaucgagcacagcaccgugcagcaguuccaccugaacgacaccaccugcuggggcaccgacuaccaccugggcauggccauccccgacaucggcgaggugaaggacggcaccgugugcggccccgagaagaucugcaucagaaagaagugcgccagcauggugcaccugagccaggccugccagcccaagaccugcaacaugagaggcaucugcaacaacaagcagcacugccacugcaaccacgagugggccccccccuacugcaaggacaagggcuacggcggcagcgccgacagcggccccccccccaagaacaacauggagggccugaacgugaugggcaagcugagauaccugagccugcugugccugcugccccugguggccuuccugcuguucugccugcacgugcuguucaagaagagaaccaagagcaaggaggacgaggagggcuaa

SEQ ID NO: 13253 - RNA, 2169 nt, Artificial Sequence
  ADAM21__Homo_sapiens__NP_003804
auggccguggacggcacccugguguacaucagagugacccugcugcugcuguggcugggcguguuccugagcaucagcggcuacugccaggccggccccagccagcacuucaccagccccgagguggugaucccccugaaggugaucagcagaggcagaagcgccaaggcccccggcuggcugagcuacagccugagauucggcggccagaagcacguggugcacaugagagugaagaagcugcuggugagcagacaccugcccguguucaccuacaccgacgacagagcccugcuggaggaccagcuguucauccccgacgacugcuacuaccacggcuacguggaggccgcccccgagagccuggugguguucagcgccugcuucggcggcuucagaggcgugcugaagaucagcggccugaccuacgagaucgagcccaucagacacagcgccaccuucgagcaccugguguacaagaucaacagcaacgagacccaguuccccgccaugagaugcggccugaccgagaaggagguggccagacagcagcuggaguucgaggaggccgagaacagcgcccuggagcccaagagcgccggcgacugguggacccacgccugguuccuggagcugguggugguggugaaccacgacuucuucaucuacagccagagcaacaucagcaaggugcaggaggacguguuccugguggugaacaucguggacagcauguacaagcagcugggcaccuacaucauccugaucggcaucgagaucuggaaccagggcaacguguuccccaugaccagcaucgagcaggugcugaacgacuucagccaguggaagcagaucagccugagccagcugcagcacgacgccgcccacauguucaucaagaacagccugaucagcauccugggccuggccuacguggccggcaucugcagaccccccaucgacugcggcguggacaacuuccagggcgacaccuggagccuguucgccaacaccguggcccacgagcugggccacacccugggcaugcagcacgacgaggaguucugcuucugcggcgagagaggcugcaucaugaacaccuucagagugcccgccgagaaguucaccaacugcagcuacgccgacuucaugaagaccacccugaaccagggcagcugccugcacaacccccccagacugggcgagaucuucaugcugaagagaugcggcaacggcgugguggagagagaggagcagugcgacugcggcagcgugcagcagugcgagcaggacgccugcugccugcugaacugcacccugagacccggcgccgccugcgccuucggccugugcugcaaggacugcaaguucaugcccagcggcgagcugugcagacaggaggugaacgagugcgaccugcccgaguggugcaacggcaccagccaccagugccccgaggacagauacgugcaggacggcauccccugcagcgacagcgccuacugcuaccagaagagaugcaacaaccacgaccagcacugcagagagaucuucggcaaggacgccaagagcgccagccagaacugcuacaaggagaucaacagccagggcaacagauucggccacugcggcaucaacggcaccaccuaccugaagugccacaucagcgacguguucugcggcagagugcagugcgagaacgugagagacaucccccugcugcaggaccacuucacccugcagcacacccacaucaacggcgugaccugcuggggcaucgacuaccaccugagaaugaacaucagcgacaucggcgaggugaaggacggcaccgugugcggccccggcaagaucugcauccacaagaagugcgugagccugagcgugcugagccacgugugccugcccgagaccugcaacaugaagggcaucugcaacaacaagcaccacugccacugcggcuacggcuggagcccccccuacugccagcacagaggcuacggcggcagcaucgacagcggccccgccagcgccaagagaggcguguuccugccccugaucgugauccccagccugagcgugcugaccuuccuguucaccgugggccugcugauguaccugagacagugcagcggccccaaggagaccaaggcccacagcagcggcuaa

SEQ ID NO: 13254 - RNA, 2613 nt, Artificial Sequence
  ADAM22__Homo_sapiens__NP_057435
augcaggccgccguggccgugagcgugcccuuccugcugcugugcgugcugggcaccugcccccccgccagaugcggccaggccggcgacgccagccugauggagcuggagaagagaaaggagaacagauucguggagagacagagcaucgugccccugagacugaucuacagaagcggcggcgaggacgagagcagacacgacgcccuggacaccagagugagaggcgaccugggcggcccccagcugacccacguggaccaggccagcuuccagguggacgccuucggcaccagcuucauccuggacguggugcugaaccacgaccugcugagcagcgaguacaucgagagacacaucgagcacggcggcaagaccguggaggugaagggcggcgagcacugcuacuaccagggccacaucagaggcaaccccgacagcuucguggcccugagcaccugccacggccugcacggcauguucuacgacggcaaccacaccuaccugaucgagcccgaggagaacgacaccacccaggaggacuuccacuuccacagcguguacaagagcagacuguucgaguucagccuggacgaccugcccagcgaguuccagcaggugaacaucacccccagcaaguucauccugaagcccagacccaagagaagcaagagacagcugagaagauaccccagaaacguggaggaggagaccaaguacaucgagcugaugaucgugaacgaccaccugauguucaagaagcacagacugagcguggugcacaccaacaccuacgccaagagcguggugaacauggccgaccugaucuacaaggaccagcugaagaccagaaucgugcugguggccauggagaccugggccaccgacaacaaguucgccaucagcgagaacccccugaucacccugagagaguucaugaaguacagaagagacuucaucaaggagaagagcgacgccgugcaccuguucagcggcagccaguucgagagcagcagaagcggcgccgccuacaucggcggcaucugcagccugcugaagggcggcggcgugaacgaguucggcaagaccgaccugauggccgugacccuggcccagagccuggcccacaacaucggcaucaucagcgacaagagaaagcuggccagcggcgagugcaagugcgaggacaccuggagcggcugcaucaugggcgacaccggcuacuaccugcccaagaaguucacccagugcaacaucgaggaguaccacgacuuccugaacagcggcggcggcgccugccuguucaacaagcccagcaagcugcuggacccccccgagugcggcaacggcuucaucgagaccggcgaggagugcgacugcggcacccccgccgagugcgugcuggagggcgccgagugcugcaagaagugcacccugacccaggacagccagugcagcgacggccugugcugcaagaagugcaaguuccagcccaugggcaccgugugcagagaggccgugaacgacugcgacaucagagagaccugcagcggcaacagcagccagugcgcccccaacauccacaagauggacggcuacagcugcgacggcgugcagggcaucugcuucggcggcagaugcaagaccagagacagacagugcaaguacaucuggggccagaaggugaccgccagcgacaaguacugcuacgagaagcugaacaucgagggcaccgagaagggcaacugcggcaaggacaaggacaccuggauccagugcaacaagagagacgugcugugcggcuaccugcugugcaccaacaucggcaacauccccagacugggcgagcuggacggcgagaucaccagcacccugguggugcagcagggcagaacccugaacugcagcggcggccacgugaagcuggaggaggacguggaccugggcuacguggaggacggcacccccugcggcccccagaugaugugccuggagcacagaugccugcccguggccagcuucaacuucagcaccugccugagcagcaaggagggcaccaucugcagcggcaacggcgugugcagcaacgagcugaagugcgugugcaacagacacuggaucggcagcgacugcaacaccuacuucccccacaacgacgacgccaagaccggcaucacccugagcggcaacggcguggccggcaccaacaucaucaucggcaucaucgccggcaccauccuggugcuggcccugauccugggcaucaccgccuggggcuacaagaacuacagagagcagagaagcaacggccugagccacagcuggagcgagagaauccccgacaccaagcacaucagcgacaucugcgagaacggcagacccagaagcaacagcuggcagggcaaccugggcggcaacaagaagaagaucagaggcaagagauucagacccagaagcaacagcaccgagacccugagccccgccaagagccccagcagcagcaccggcagcaucgccagcagcagaaaguaccccuaccccaugcccccccugcccgacgaggacaagaaggugaacagacagagcgccagacugugggagaccagcaucuaa

SEQ ID NO: 13255 - RNA, 2499 nt, Artificial Sequence
  ADAM23__Homo_sapiens__NP_003803
augaagccccccggcagcagcagcagacagcccccccuggccggcugcagccuggccggcgccagcugcggcccccagagaggccccgccggcagcgugcccgccagcgcccccgccagaaccccccccugcagacugcugcuggugcugcugcugcugcccccccuggccgccagcagcagacccagagccuggggcgccgccgcccccagcgccccccacuggaacgagaccgccgagaagaaccugggcgugcuggccgacgaggacaacacccugcagcagaacagcagcagcaacaucagcuacagcaacgccaugcagaaggagaucacccugcccagcagacugaucuacuacaucaaccaggacagcgagagccccuaccacgugcuggacaccaaggccagacaccagcagaagcacaacaaggccgugcaccuggcccaggccagcuuccagaucgaggccuucggcagcaaguucauccuggaccugauccugaacaacggccugcugagcagcgacuacguggagauccacuacgagaacggcaagccccaguacagcaagggcggcgagcacugcuacuaccacggcagcaucagaggcgugaaggacagcaagguggcccugagcaccugcaacggccugcacggcauguucgaggacgacaccuucguguacaugaucgagccccuggagcuggugcacgacgagaagagcaccggcagaccccacaucauccagaagacccuggccggccaguacagcaagcagaugaagaaccugaccauggagagaggcgaccaguggcccuuccugagcgagcugcaguggcugaagagaagaaagagagccgugaaccccagcagaggcaucuucgaggagaugaaguaccuggagcugaugaucgugaacgaccacaagaccuacaagaagcacagaagcagccacgcccacaccaacaacuucgccaagagcguggugaaccugguggacagcaucuacaaggagcagcugaacaccagaguggugcugguggccguggagaccuggaccgagaaggaccagaucgacaucaccaccaaccccgugcagaugcugcacgaguucagcaaguacagacagagaaucaagcagcacgccgacgccgugcaccugaucagcagagugaccuuccacuacaagagaagcagccugagcuacuucggcggcgugugcagcagaaccagaggcgugggcgugaacgaguacggccugcccauggccguggcccaggugcugagccagagccuggcccagaaccugggcauccagugggagcccagcagcagaaagcccaagugcgacugcaccgagagcuggggcggcugcaucauggaggagaccggcgugagccacagcagaaaguucagcaagugcagcauccuggaguacagagacuuccugcagagaggcggcggcgccugccuguucaacagacccaccaagcuguucgagcccaccgagugcggcaacggcuacguggaggccggcgaggagugcgacugcggcuuccacguggagugcuacggccugugcugcaagaagugcagccugagcaacggcgcccacugcagcgacggccccugcugcaacaacaccagcugccuguuccagcccagaggcuacgagugcagagacgccgugaacgagugcgacaucaccgaguacugcaccggcgacagcggccagugcccccccaaccugcacaagcaggacggcuacgccugcaaccagaaccagggcagaugcuacaacggcgagugcaagaccagagacaaccagugccaguacaucuggggcaccaaggccgccggcagcgacaaguucugcuacgagaagcugaacaccgagggcaccgagaagggcaacugcggcaaggacggcgacagauggauccagugcagcaagcacgacguguucugcggcuuccugcugugcaccaaccugaccagagcccccagaaucggccagcugcagggcgagaucauccccaccagcuucuaccaccagggcagagugaucgacugcagcggcgcccacguggugcuggacgacgacaccgacgugggcuacguggaggacggcacccccugcggccccagcaugaugugccuggacagaaagugccugcagauccaggcccugaacaugagcagcugcccccuggacagcaagggcaaggugugcagcggccacggcgugugcagcaacgaggccaccugcaucugcgacuucaccugggccggcaccgacugcagcaucagagaccccgugagaaaccugcacccccccaaggacgagggccccaagggccccagcgccaccaaccugaucaucggcagcaucgccggcgccauccugguggccgccaucgugcugggcggcaccggcuggggcuucaagaacgugaagaagagaagauucgaccccacccagcagggccccaucuaa

SEQ ID NO: 13256 - RNA, 2328 nt, Artificial Sequence
  ADAM28__Homo_sapiens__NP_055080
augcugcagggccugcugcccgugagccugcugcugagcguggccgugagcgccaucaaggagcugcccggcgugaagaaguacgaggugguguaccccaucagacugcacccccugcacaagagagaggccaaggagcccgagcagcaggagcaguucgagaccgagcugaaguacaagaugaccaucaacggcaagaucgccgugcuguaccugaagaagaacaagaaccugcuggcccccggcuacaccgagaccuacuacaacagcaccggcaaggagaucaccaccagcccccagaucauggacgacugcuacuaccagggccacauccugaacgagaaggugagcgacgccagcaucagcaccugcagaggccugagaggcuacuucagccagggcgaccagagauacuucaucgagccccugagccccauccacagagacggccaggagcacgcccuguucaaguacaaccccgacgagaagaacuacgacagcaccugcggcauggacggcgugcugugggcccacgaccugcagcagaacaucgcccugcccgccaccaagcuggugaagcugaaggacagaaaggugcaggagcacgagaaguacaucgaguacuaccuggugcuggacaacggcgaguucaagagauacaacgagaaccaggacgagaucagaaagagaguguucgagauggccaacuacgugaacaugcuguacaagaagcugaacacccacguggcccuggugggcauggagaucuggaccgacaaggacaagaucaagaucacccccaacgccagcuucacccuggagaacuucagcaaguggagaggcagcgugcugagcagaagaaagagacacgacaucgcccagcugaucaccgccaccgagcuggccggcaccaccgugggccuggccuucaugagcaccaugugcagccccuacagcgugggcguggugcaggaccacagcgacaaccugcugagaguggccggcaccauggcccacgagaugggccacaacuucggcauguuccacgacgacuacagcugcaagugccccagcaccaucugcgugauggacaaggcccugagcuucuacauccccaccgacuucagcagcugcagcagacugagcuacgacaaguucuucgaggacaagcugagcaacugccuguucaacgccccccugcccaccgacaucaucagcacccccaucugcggcaaccagcugguggagaugggcgaggacugcgacugcggcaccagcgaggagugcaccaacaucugcugcgacgccaagaccugcaagaucaaggccaccuuccagugcgcccugggcgagugcugcgagaagugccaguucaagaaggccggcauggugugcagacccgccaaggacgagugcgaccugcccgagaugugcaacggcaagagcggcaacugccccgacgacagauuccaggugaacggcuuccccugccaccacggcaagggccacugccugaugggcaccugccccacccugcaggagcagugcaccgagcuguggggccccggcaccgagguggccgacaagagcugcuacaacagaaacgagggcggcagcaaguacggcuacugcagaagaguggacgacacccugauccccugcaaggccaacgacaccaugugcggcaagcuguucugccagggcggcagcgacaaccugcccuggaagggcagaaucgugaccuuccugaccugcaagaccuucgaccccgaggacaccagccaggagaucggcaugguggccaacggcaccaagugcggcgacaacaaggugugcaucaacgccgagugcguggacaucgagaaggccuacaagagcaccaacugcagcagcaagugcaagggccacgccgugugcgaccacgagcugcagugccagugcgaggagggcuggaucccccccgacugcgacgacagcagcgugguguuccacuucagcaucguggugggcgugcuguuccccauggccgugaucuucguggugguggccauggugaucagacaccagagcagcagagagaagcagaagaaggaccagagaccccugagcaccaccggcaccagaccccacaagcagaagagaaagccccagauggugaaggccgugcagccccaggagaugagccagaugaagccccacguguacgaccugcccguggagggcaacgagccccccgccagcuuccacaaggacaccaacgcccugccccccaccguguucaaggacaaccccgugagcacccccaaggacagcaaccccaaggccuaa

SEQ ID NO: 13257 - RNA, 2463 nt, Artificial Sequence
  ADAM29__Homo_sapiens__NP_001265056
augaagaugcugcugcugcugcacugccugggcguguuccugagcugcagcggccacauccaggacgagcacccccaguaccacagcccccccgacguggugauccccgugagaaucaccggcaccaccagaggcaugaccccccccggcuggcugagcuacauccugcccuucggcggccagaagcacaucauccacaucaaggugaagaagcugcuguucagcaagcaccugcccguguucaccuacaccgaccagggcgccauccuggaggaccagcccuucgugcagaacaacugcuacuaccacggcuacguggagggcgaccccgagagccuggugagccugagcaccugcuucggcggcuuccagggcauccugcagaucaacgacuucgccuacgagaucaagccccuggccuucagcaccaccuucgagcaccugguguacaagauggacagcgaggagaagcaguucagcaccaugagaagcggcuucaugcagaacgagaucaccugcagaauggaguucgaggagaucgacaacagcacccagaagcagagcagcuacgugggcugguggauccacuucagaaucguggagaucgugguggugaucgacaacuaccuguacaucagauacgagagaaacgacagcaagcugcuggaggaccuguacgugaucgugaacaucguggacagcauccuggacgugaucggcgugaaggugcugcuguucggccuggagaucuggaccaacaagaaccugaucgugguggacgacgugagaaagagcgugcaccuguacugcaaguggaagagcgagaacaucacccccagaaugcagcacgacaccagccaccuguucaccacccugggccugagaggccugagcggcaucggcgccuucagaggcaugugcaccccccacagaagcugcgccaucgugaccuucaugaacaagacccugggcaccuucagcaucgccguggcccaccaccugggccacaaccugggcaugaaccacgacgaggacaccugcagaugcagccagcccagaugcaucaugcacgagggcaacccccccaucaccaaguucagcaacugcagcuacggcgacuucugggaguacaccguggagagaaccaagugccugcuggagaccgugcacaccaaggacaucuucaacgugaagagaugcggcaacggcgugguggaggagggcgaggagugcgacugcggcccccugaagcacugcgccaaggaccccugcugccugagcaacugcacccugaccgacggcagcaccugcgccuucggccugugcugcaaggacugcaaguuccugcccagcggcaaggugugcagaaaggaggugaacgagugcgaccugcccgaguggugcaacggcaccagccacaagugccccgacgacuucuacguggaggacggcauccccugcaaggagagaggcuacugcuacgagaagagcugccacgacagaaacgagcagugcagaagaaucuucggcgccggcgccaacaccgccagcgagaccugcuacaaggagcugaacacccugggcgacagagugggccacugcggcaucaagaacgccaccuacaucaagugcaacaucagcgacgugcagugcggcagaauccagugcgagaacgugaccgagauccccaacaugagcgaccacaccaccgugcacugggccagauucaacgacaucaugugcuggagcaccgacuaccaccugggcaugaagggccccgacaucggcgaggugaaggacggcaccgagugcggcaucgaccacaucugcauccacagacacugcgugcacaucaccauccugaacagcaacugcagccccgccuucugcaacaagagaggcaucugcaacaacaagcaccacugccacugcaacuaccugugggacccccccaacugccugaucaagggcuacggcggcagcguggacagcggccccccccccaagagaaagaagaagaagaaguucugcuaccugugcauccugcugcugaucgugcuguucauccugcugugcugccuguacagacugugcaagaagagcaagcccaucaagaagcagcaggacgugcagacccccagcgccaaggaggaggagaagauccagagaagaccccacgagcugcccccccagagccagcccugggugaugcccagccagagccagccccccgugacccccagccagagccacccccaggugaugcccagccagagccagccccccgugacccccagccagagccagcccagagugaugcccagccagagccagccccccgugaugcccagccagagccacccccagcugacccccagccagagccagccccccgugacccccagccagagacagccccagcugaugcccagccagagccagccccccgugacccccagcuaa

SEQ ID NO: 13258 - RNA, 2151 nt, Artificial Sequence
  ADAM2__Homo_sapiens__NP_001265042
auguggagagugcuguuccugcugagcggccugggcggccugagaauggacagcaacuucgacagccugcccgugcagaucaccgugcccgagaagaucagaagcaucaucaaggagggcaucgagagccaggccagcuacaagaucgugaucgagggcaagcccuacaccgugaaccugaugcagaagaacuuccugccccacaacuucagaguguacagcuacagcggcaccggcaucaugaagccccuggaccaggacuuccagaacuucugccacuaccagggcuacaucgagggcuaccccaagagcguggugauggugagcaccugcaccggccugagaggcgugcugcaguucgagaacgugagcuacggcaucgagccccuggagagcagcgugggcuucgagcacgugaucuaccaggugaagcacaagaaggccgacgugagccuguacaacgagaaggacaucgagagcagagaccugagcuucaagcugcagagcguggaguacaaccacaugggcagcgacaccaccgugguggcccagaagguguuccagcugaucggccugaccaacgccaucuucgugagcuucaacaucaccaucauccugagcagccuggagcuguggaucgacgagaacaagaucgccaccaccggcgaggccaacgagcugcugcacaccuuccugagauggaagaccagcuaccuggugcugagaccccacgacguggccuuccugcugguguacagagagaagagcaacuacgugggcgccaccuuccagggcaagaugugcgacgccaacuacgccggcggcguggugcugcaccccagaaccaucagccuggagagccuggccgugauccuggcccagcugcugagccugagcaugggcaucaccuacgacgacaucaacaagugccagugcagcggcgccgugugcaucaugaaccccgaggccauccacuucagcggcgugaagaucuucagcaacugcagcuucgaggacuucgcccacuucaucagcaagcagaagagccagugccugcacaaccagcccagacuggaccccuucuucaagcagcaggccgugugcggcaacgccaagcuggaggccggcgaggagugcgacugcggcaccgagcaggacugcgcccugaucggcgagaccugcugcgacaucgccaccugcagauucaaggccggcagcaacugcgccgagggccccugcugcgagaacugccuguucaugagcaaggagagaaugugcagacccagcuucgaggagugcgaccugcccgaguacugcaacggcagcagcgccagcugccccgagaaccacuacgugcagaccggccaccccugcggccugaaccaguggaucugcaucgacggcgugugcaugagcggcgacaagcagugcaccgacaccuucggcaaggagguggaguucggccccagcgagugcuacagccaccugaacagcaagaccgacgugagcggcaacugcggcaucagcgacagcggcuacacccagugcgaggccgacaaccugcagugcggcaagcugaucugcaaguacgugggcaaguuccugcugcagauccccagagccaccaucaucuacgccaacaucagcggccaccugugcaucgccguggaguucgccagcgaccacgccgacagccagaagauguggaucaaggacggcaccagcugcggcagcaacaaggugugcagaaaccagagaugcgugagcagcagcuaccugggcuacgacugcaccaccgacaagugcaacgacagaggcgugugcaacaacaagaagcacugccacugcagcgccagcuaccugccccccgacugcagcgugcagagcgaccuguggcccggcggcagcaucgacagcggcaacuucccccccguggccauccccgccagacugcccgagagaagauacaucgagaacaucuaccacagcaagcccaugagauggcccuucuuccuguucauccccuucuucaucaucuucugcgugcugaucgccaucauggugaaggugaacuuccagagaaagaaguggagaaccgaggacuacagcagcgacgagcagcccgagagcgagagcgagcccaagggcuaa

SEQ ID NO: 13259 - RNA, 2439 nt, Artificial Sequence
  ADAM33__Homo_sapiens__NP_001269376
augggcuggagacccagaagagccagaggcaccccccugcugcugcugcugcugcugcugcugcuguggcccgugcccggcgccggcgugcugcagggccacauccccggccagcccgugaccccccacugggugcuggacggccagcccuggagaaccgugagccuggaggagcccgugagcaagcccgacaugggccugguggcccuggaggccgagggccaggagcugcugcuggagcuggagaagaaccacagacugcuggcccccggcuacaucgagacccacuacggccccgacggccagcccguggugcuggcccccaaccacaccgaccacugccacuaccagggcagagugagaggcuuccccgacagcuggguggugcugugcaccugcagcggcaugagcggccugaucacccugagcagaaacgccagcuacuaccugagacccuggccccccagaggcagcaaggacuucagcacccacgagaucuucagaauggagcagcugcugaccuggaagggcaccugcggccacagagaccccggcaacaaggccggcaugaccagccugcccggcggcccccagagcagaggcagaagagaggccagaagaaccagaaaguaccuggagcuguacaucguggccgaccacacccuguuccugaccagacacagaaaccugaaccacaccaagcagagacugcuggagguggccaacuacguggaccagcugcugagaacccuggacauccagguggcccugaccggccuggagguguggaccgagagagacagaagcagagugacccaggacgccaacgccacccugugggccuuccugcaguggagaagaggccugugggcccagagaccccacgacagcgcccagcugcugaccggcagagccuuccagggcgccaccgugggccuggcccccguggagggcaugugcagagccgagagcagcggcggcgugagcaccgaccacagcgagcugcccaucggcgccgccgccaccauggcccacgagaucggccacagccugggccugagccacgaccccgacggcugcugcguggaggccgccgccgagagcggcggcugcgugauggccgccgccaccggccaccccuuccccagaguguucagcgccugcagcagaagacagcugagagccuucuucagaaagggcggcggcgccugccugagcaacgcccccgaccccggccugcccgugccccccgcccugugcggcaacggcuucguggaggccggcgaggagugcgacugcggccccggccaggagugcagagaccugugcugcuucgcccacaacugcagccugagacccggcgcccagugcgcccacggcgacugcugcgugagaugccugcugaagcccgccggcgcccugugcagacaggccaugggcgacugcgaccugcccgaguucugcaccggcaccagcagccacugcccccccgacguguaccugcuggacggcagccccugcgccagaggcagcggcuacugcugggacggcgccugccccacccuggagcagcagugccagcagcuguggggccccggcagccaccccgcccccgaggccugcuuccagguggugaacagcgccggcgacgcccacggcaacugcggccaggacagcgagggccacuuccugcccugcgccggcagagacgcccugugcggcaagcugcagugccagggcggcaagcccagccugcuggccccccacauggugcccguggacagcaccgugcaccuggacggccaggaggugaccugcagaggcgcccuggcccugcccagcgcccagcuggaccugcugggccugggccugguggagcccggcacccagugcggccccagaauggugugccagagcagaagaugcagaaagaacgccuuccaggagcugcagagaugccugaccgccugccacagccacggcgugugcaacagcaaccacaacugccacugcgcccccggcugggccccccccuucugcgacaagcccggcuucggcggcagcauggacagcggccccgugcaggccgagaaccacgacaccuuccugcuggccaugcugcugagcgugcugcugccccugcugcccggcgccggccuggccuggugcugcuacagacugcccggcgcccaccugcagagaugcagcuggggcugcagaagagaccccgccugcagcggccccaaggacggcccccacagagaccacccccugggcggcgugcaccccauggagcugggccccaccgccaccggccagcccuggccccuggaccccgagaacagccacgagcccagcagccaccccgagaagccccugcccgccgugagccccgacccccaggaccaggugcagaugcccagaagcugccugugguaa

SEQ ID NO: 13260 - RNA, 2265 nt, Artificial Sequence
  ADAM7__Homo_sapiens__NP_003808
augcugcccggcugcaucuuccugaugauccugcugaucccccaggugaaggagaaguucauccugggcguggagggccagcagcuggugagacccaagaagcugccccugauccagaagagagacaccggccacacccacgacgacgacauccugaagaccuacgaggaggagcugcuguacgagaucaagcugaacagaaagacccuggugcugcaccugcugagaagcagagaguuccugggcagcaacuacagcgagaccuucuacagcaugaagggcgaggccuucaccagacacccccagaucauggaccacugcuucuaccagggcagcaucgugcacgaguacgacagcgccgccagcaucagcaccugcaacggccugagaggcuucuucagaaucaacgaccagagauaccugaucgagcccgugaaguacagcgacgagggcgagcaccugguguucaaguacaaccugagagugcccuacggcgccaacuacagcugcaccgagcugaacuucaccagaaagaccgugcccggcgacaacgagagcgaggaggacagcaagaucaagggcauccacgacgagaaguacguggagcuguucaucguggccgacgacaccguguacagaagaaacggccacccccacaacaagcugagaaacagaaucuggggcauggugaacuucgugaacaugaucuacaagacccugaacauccacgugacccuggugggcaucgagaucuggacccacgaggacaagaucgagcuguacagcaacaucgagaccacccugcugagauucagcuucuggcaggagaagauccugaagaccagaaaggacuucgaccacguggugcugcugagcggcaaguggcuguacagccacgugcagggcaucagcuaccccggcggcaugugccugcccuacuacagcaccagcaucaucaaggaccugcugcccgacaccaacaucaucgccaacagaauggcccaccagcugggccacaaccugggcaugcagcacgacgaguuccccugcaccugccccagcggcaagugcgugauggacagcgacggcagcauccccgcccugaaguucagcaagugcagccagaaccaguaccaccaguaccugaaggacuacaagcccaccugcaugcugaacauccccuuccccuacaacuuccacgacuuccaguucugcggcaacaagaagcuggacgagggcgaggagugcgacugcggccccgcccaggagugcaccaaccccugcugcgacgcccacaccugcgugcugaagcccggcuucaccugcgccgagggcgagugcugcgagagcugccagaucaagaaggccggcagcaucugcagacccgccaaggacgagugcgacuuccccgagaugugcaccggccacagccccgccugccccaaggaccaguucagagugaacggcuuccccugcaagaacagcgagggcuacugcuucaugggcaagugccccaccagagaggaccagugcagcgagcuguucgacgacgaggccaucgagagccacgacaucugcuacaagaugaacaccaagggcaacaaguucggcuacugcaagaacaaggagaacagauuccugcccugcgaggagaaggacgugagaugcggcaagaucuacugcaccggcggcgagcugagcagccugcugggcgaggacaagaccuaccaccugaaggacccccagaagaacgccaccgugaagugcaagaccaucuuccuguaccacgacagcaccgacaucggccugguggccagcggcaccaagugcggcgagggcauggugugcaacaacggcgagugccugaacauggagaagguguacaucagcaccaacugccccagccagugcaacgagaaccccguggacggccacggccugcagugccacugcgaggagggccaggcccccguggccugcgaggagacccugcacgugaccaacaucaccauccuggugguggugcuggugcuggugaucgugggcaucggcgugcugauccugcuggugagauacagaaagugcaucaagcugaagcaggugcagagcccccccaccgagacccugggcguggagaacaagggcuacuucggcgacgagcagcagaucagaaccgagcccauccugcccgagauccacuuccugaacaagcccgccagcaaggacagcagaggcaucgccgaccccaaccagagcgccaaguaa

SEQ ID NO: 13261 - RNA, 2475 nt, Artificial Sequence
  ADAM8__Homo_sapiens__NP_001100
augagaggccugggccuguggcugcugggcgccaugaugcugcccgccaucgcccccagcagacccugggcccugauggagcaguacgagguggugcugcccuggagacugcccggccccagagugagaagagcccugcccagccaccugggccugcaccccgagagagugagcuacgugcugggcgccaccggccacaacuucacccugcaccugagaaagaacagagaccugcugggcagcggcuacaccgagaccuacaccgccgccaacggcagcgaggugaccgagcagcccagaggccaggaccacugcuucuaccagggccacguggagggcuaccccgacagcgccgccagccugagcaccugcgccggccugagaggcuucuuccaggugggcagcgaccugcaccugaucgagccccuggacgagggcggcgagggcggcagacacgccguguaccaggccgagcaccugcugcagaccgccggcaccugcggcgugagcgacgacagccugggcagccugcugggccccagaaccgccgccguguucagacccagacccggcgacagccugcccagcagagagaccagauacguggagcuguacguggugguggacaacgccgaguuccagaugcugggcagcgaggccgccgugagacacagagugcuggagguggugaaccacguggacaagcuguaccagaagcugaacuucagaguggugcuggugggccuggagaucuggaacagccaggacagauuccacgugagccccgaccccagcgugacccuggagaaccugcugaccuggcaggccagacagagaaccagaagacaccugcacgacaacgugcagcugaucaccggcguggacuucaccggcaccaccgugggcuucgccagagugagcgccaugugcagccacagcagcggcgccgugaaccaggaccacagcaagaaccccgugggcguggccugcaccauggcccacgagaugggccacaaccugggcauggaccacgacgagaacgugcagggcugcagaugccaggagagauucgaggccggcagaugcaucauggccggcagcaucggcagcagcuuccccagaauguucagcgacugcagccaggccuaccuggagagcuuccuggagagaccccagagcgugugccuggccaacgcccccgaccugagccaccuggugggcggccccgugugcggcaaccuguucguggagagaggcgagcagugcgacugcggcccccccgaggacugcagaaacagaugcugcaacagcaccaccugccagcuggccgagggcgcccagugcgcccacggcaccugcugccaggagugcaaggugaagcccgccggcgagcugugcagacccaagaaggacaugugcgaccuggaggaguucugcgacggcagacaccccgagugccccgaggacgccuuccaggagaacggcacccccugcagcggcggcuacugcuacaacggcgccugccccacccuggcccagcagugccaggccuucuggggccccggcggccaggccgccgaggagagcugcuucagcuacgacauccugcccggcugcaaggccagcagauacagagccgacaugugcggcgugcugcagugcaagggcggccagcagccccugggcagagccaucugcaucguggacgugugccacgcccugaccaccgaggacggcaccgccuacgagcccgugcccgagggcaccagaugcggccccgagaaggugugcuggaagggcagaugccaggaccugcacguguacagaagcagcaacugcagcgcccagugccacaaccacggcgugugcaaccacaagcaggagugccacugccacgccggcugggcccccccccacugcgccaagcugcugaccgaggugcacgccgccagcggcagccugcccguguucguggugguggugcuggugcugcuggccguggugcuggugacccuggccggcaucaucguguacagaaaggccagaagcagaauccugagcagaaacguggcccccaagaccaccaugggcagaagcaacccccuguuccaccaggccgccagcagagugcccgccaagggcggcgcccccgcccccagcagaggcccccaggagcuggugcccaccacccaccccggccagcccgccagacaccccgccagcagcguggcccugaagagacccccccccgccccccccgugaccgugagcagcccccccuuccccgugcccguguacaccagacaggcccccaagcaggugaucaagcccaccuucgccccccccgugccccccgugaagcccggcgccggcgccgccaaccccggccccgccgagggcgccgugggccccaagguggcccugaagccccccauccagagaaagcagggcgccggcgcccccaccgcccccuaa

SEQ ID NO: 13262 - RNA, 2460 nt, Artificial Sequence
  ADAM9__Homo_sapiens__NP_003807
augggcagcggcgccagauuccccagcggcacccugagagugagauggcugcugcugcugggccuggugggccccgugcugggcgccgccagacccggcuuccagcagaccagccaccugagcagcuacgagaucaucacccccuggagacugaccagagagagaagagaggcccccagacccuacagcaagcaggugagcuacgugauccaggccgagggcaaggagcacaucauccaccuggagagaaacaaggaccugcugcccgaggacuucgugguguacaccuacaacaaggagggcacccugaucaccgaccaccccaacauccagaaccacugccacuacagaggcuacguggagggcgugcacaacagcagcaucgcccugagcgacugcuucggccugagaggccugcugcaccuggagaacgccagcuacggcaucgagccccugcagaacagcagccacuucgagcacaucaucuacagaauggacgacguguacaaggagccccugaagugcggcgugagcaacaaggacaucgagaaggagaccgccaaggacgaggaggaggagccccccagcaugacccagcugcugagaagaagaagagccgugcugccccagaccagauacguggagcuguucaucgugguggacaaggagagauacgacaugaugggcagaaaccagaccgccgugagagaggagaugauccugcuggccaacuaccuggacagcauguacaucaugcugaacaucagaaucgugcuggugggccuggagaucuggaccaacggcaaccugaucaacaucgugggcggcgccggcgacgugcugggcaacuucgugcaguggagagagaaguuccugaucaccagaagaagacacgacagcgcccagcuggugcugaagaagggcuucggcggcaccgccggcauggccuucgugggcaccgugugcagcagaagccacgccggcggcaucaacguguucggccagaucaccguggagaccuucgccagcaucguggcccacgagcugggccacaaccugggcaugaaccacgacgacggcagagacugcagcugcggcgccaagagcugcaucaugaacagcggcgccagcggcagcagaaacuucagcagcugcagcgccgaggacuucgagaagcugacccugaacaagggcggcaacugccugcugaacauccccaagcccgacgaggccuacagcgcccccagcugcggcaacaagcugguggacgccggcgaggagugcgacugcggcacccccaaggagugcgagcuggaccccugcugcgagggcagcaccugcaagcugaagagcuucgccgagugcgccuacggcgacugcugcaaggacugcagauuccugcccggcggcacccugugcagaggcaagaccagcgagugcgacgugcccgaguacugcaacggcagcagccaguucugccagcccgacguguucauccagaacggcuaccccugccagaacaacaaggccuacugcuacaacggcaugugccaguacuacgacgcccagugccaggugaucuucggcagcaaggccaaggccgcccccaaggacugcuucaucgaggugaacagcaagggcgacagauucggcaacugcggcuucagcggcaacgaguacaagaagugcgccaccggcaacgcccugugcggcaagcugcagugcgagaacgugcaggagauccccguguucggcaucgugcccgccaucauccagacccccagcagaggcaccaagugcuggggcguggacuuccagcugggcagcgacgugcccgaccccggcauggugaacgagggcaccaagugcggcgccggcaagaucugcagaaacuuccagugcguggacgccagcgugcugaacuacgacugcgacgugcagaagaagugccacggccacggcgugugcaacagcaacaagaacugccacugcgagaacggcugggccccccccaacugcgagaccaagggcuacggcggcagcguggacagcggccccaccuacaacgagaugaacaccgcccugagagacggccugcugguguucuucuuccugaucgugccccugaucgugugcgccaucuucaucuucaucaagagagaccagcuguggagaagcuacuucagaaagaagagaagccagaccuacgagagcgacggcaagaaccaggccaaccccagcagacagcccggcagcgugcccagacacgugagccccgugaccccccccagagaggugcccaucuacgccaacagauucgccgugcccaccuacgccgccaagcagccccagcaguuccccagcagacccccccccccccagcccaaggugagcagccagggcaaccugauccccgccagacccgcccccgcccccccccuguacagcagccugaccuaa

SEQ ID NO: 13263 - RNA, 1176 nt, Artificial Sequence
  ADAMDEC1__Homo_sapiens__NP_001138743
augauccugaacggcgaggagaucauccugagccugcagaagaccaagcaccugcugggccccgacuacaccgagacccuguacagccccagaggcgaggagaucaccaccaagcccgagaacauggagcacugcuacuacaagggcaacauccugaacgagaagaacagcguggccagcaucagcaccugcgacggccugagaggcuacuucacccaccaccaccagagauaccagaucaagccccugaagagcaccgacgagaaggagcacgccguguucaccagcaaccaggaggagcaggaccccgccaaccacaccugcggcgugaagagcaccgacggcaagcagggccccaucagaaucagcagaagccugaagagccccgagaaggaggacuuccugagagcccagaaguacaucgaccuguaccuggugcuggacaacgccuucuacaagaacuacaacgagaaccugacccugaucagaagcuucguguucgacgugaugaaccugcugaacgugaucuacaacaccaucgacgugcagguggcccuggugggcauggagaucuggagcgacggcgacaagaucaagguggugcccagcgccagcaccaccuucgacaacuuccugagauggcacagcagcaaccugggcaagaagauccacgaccacgcccagcugcugagcggcaucagcuucaacaacagaagagugggccuggccgccagcaacagccugugcagccccagcagcguggccgugaucgaggccaagaagaagaacaacguggcccuggugggcgugaugagccacgagcugggccacgugcugggcaugcccgacgugcccuucaacaccaagugccccagcggcagcugcgugaugaaccaguaccugagcagcaaguuccccaaggacuucagcaccagcugcagagcccacuucgagagauaccugcugagccagaagcccaagugccugcugcaggcccccauccccaccaacaucaugaccacccccgugugcggcaaccaccugcuggaggugggcgaggacugcgacugcggcagccccaaggagugcaccaaccugugcugcgaggcccugaccugcaagcugaagcccggcaccgacugcggcggcgacgcccccaaccacaccaccgaguaa

SEQ ID NO: 13264 - RNA, 3312 nt, Artificial Sequence
  ADAMTS10__Homo_sapiens__NP_112219
auggcccccgccugccagauccugagaugggcccuggcccugggccugggccugauguucgaggugacccacgccuucagaagccaggacgaguuccugagcagccuggagagcuacgagaucgccuuccccaccagaguggaccacaacggcgcccugcuggccuucagcccccccccccccagaagacagagaagaggcaccggcgccaccgccgagagcagacuguucuacaagguggccagccccagcacccacuuccugcugaaccugaccagaagcagcagacugcuggccggccacgugagcguggaguacuggaccagagagggccuggccuggcagagagccgccagaccccacugccuguacgccggccaccugcagggccaggccagcagcagccacguggccaucagcaccugcggcggccugcacggccugaucguggccgacgaggaggaguaccugaucgagccccugcacggcggccccaagggcagcagaagccccgaggagagcggcccccacgugguguacaagagaagcagccugagacacccccaccuggacaccgccugcggcgugagagacgagaagcccuggaagggcagacccugguggcugagaacccugaagcccccccccgccagaccccugggcaacgagaccgagagaggccagcccggccugaagagaagcgugagcagagagagauacguggagacccuggugguggccgacaagaugaugguggccuaccacggcagaagagacguggagcaguacgugcuggccaucaugaacaucguggccaagcuguuccaggacagcagccugggcagcaccgugaacauccuggugaccagacugauccugcugaccgaggaccagcccacccuggagaucacccaccacgccggcaagagccuggacagcuucugcaaguggcagaagagcaucgugaaccacagcggccacggcaacgccauccccgagaacggcguggccaaccacgacaccgccgugcugaucaccagauacgacaucugcaucuacaagaacaagcccugcggcacccugggccuggcccccgugggcggcaugugcgagagagagagaagcugcagcgugaacgaggacaucggccuggccaccgccuucaccaucgcccacgagaucggccacaccuucggcaugaaccacgacggcgugggcaacagcugcggcgccagaggccaggaccccgccaagcugauggccgcccacaucaccaugaagaccaaccccuucguguggagcagcugcagcagagacuacaucaccagcuuccuggacagcggccugggccugugccugaacaacagaccccccagacaggacuucguguaccccaccguggcccccggccaggccuacgacgccgacgagcagugcagauuccagcacggcgugaagagcagacagugcaaguacggcgaggugugcagcgagcuguggugccugagcaagagcaacagaugcaucaccaacagcauccccgccgccgagggcacccugugccagacccacaccaucgacaagggcuggugcuacaagagagugugcgugcccuucggcagcagacccgagggcguggacggcgccuggggccccuggacccccuggggcgacugcagcagaaccugcggcggcggcgugagcagcagcagcagacacugcgacagccccagacccaccaucggcggcaaguacugccugggcgagagaagaagacacagaagcugcaacaccgacgacugcccccccggcagccaggacuucagagaggugcagugcagcgaguucgacagcauccccuucagaggcaaguucuacaaguggaagaccuacagaggcggcggcgugaaggccugcagccugaccugccuggccgagggcuucaacuucuacaccgagagagccgccgccgugguggacggcacccccugcagacccgacaccguggacaucugcgugagcggcgagugcaagcacgugggcugcgacagagugcugggcagcgaccugagagaggacaagugcagagugugcggcggcgacggcagcgccugcgagaccaucgagggcguguucagccccgccagccccggcgccggcuacgaggacgugguguggauccccaagggcagcgugcacaucuucauccaggaccugaaccugagccugagccaccuggcccugaagggcgaccaggagagccugcugcuggagggccugcccggcaccccccagccccacagacugccccuggccggcaccaccuuccagcugagacagggccccgaccaggugcagagccuggaggcccugggccccaucaacgccagccugaucgugauggugcuggccagaaccgagcugcccgcccugagauacagauucaacgcccccaucgccagagacagccugccccccuacagcuggcacuacgcccccuggaccaagugcagcgcccagugcgccggcggcagccaggugcaggccguggagugcagaaaccagcuggacagcagcgccguggccccccacuacugcagcgcccacagcaagcugcccaagagacagagagccugcaacaccgagcccugcccccccgacuggguggugggcaacuggagccugugcagcagaagcugcgacgccggcgugagaagcagaagcguggugugccagagaagagugagcgccgccgaggagaaggcccuggacgacagcgccugcccccagcccagaccccccgugcuggaggccugccacggccccaccugcccccccgagugggccgcccuggacuggagcgagugcacccccagcugcggccccggccugagacacagaguggugcugugcaagagcgccgaccacagagccacccugccccccgcccacugcagccccgccgccaagccccccgccaccaugagaugcaaccugagaagaugcccccccgccagauggguggccggcgaguggggcgagugcagcgcccagugcggcgugggccagagacagagaagcgugagaugcaccagccacaccggccaggccagccacgagugcaccgaggcccugagaccccccaccacccagcagugcgaggccaagugcgacagccccacccccggcgacggccccgaggagugcaaggacgugaacaagguggccuacugcccccuggugcugaaguuccaguucugcagcagagccuacuucagacagaugugcugcaagaccugccacggccacuaa

SEQ ID NO: 13265 - RNA, 4785 nt, Artificial Sequence
  ADAMTS12__Homo_sapiens__NP_112217
augcccugcgcccagagaagcuggcuggccaaccugagcgugguggcccagcugcugaacuucggcgcccugugcuacggcagacagccccagcccggccccgugagauuccccgacagaagacaggagcacuucaucaagggccugcccgaguaccacguggugggccccgugagaguggacgccagcggccacuuccugagcuacggccugcacuaccccaucaccagcagcagaagaaagagagaccuggacggcagcgaggacuggguguacuacagaaucagccacgaggagaaggaccuguucuucaaccugaccgugaaccagggcuuccugagcaacagcuacaucauggagaagagauacggcaaccugagccacgugaagaugauggccagcagcgccccccugugccaccugagcggcaccgugcugcagcagggcaccagagugggcaccgccgcccugagcgccugccacggccugaccggcuucuuccagcugccccacggcgacuucuucaucgagcccgugaagaagcacccccugguggagggcggcuaccacccccacaucguguacagaagacagaaggugcccgagaccaaggagcccaccugcggccugaaggacagcgugaacaucagccagaagcaggagcuguggagagagaagugggagagacacaaccugcccagcagaagccugagcagaagaagcaucagcaaggagagauggguggagacccuggugguggccgacaccaagaugaucgaguaccacggcagcgagaacguggagagcuacauccugaccaucaugaacauggugaccggccuguuccacaaccccagcaucggcaacgccauccacaucgugguggugagacugauccugcuggaggaggaggagcagggccugaagaucgugcaccacgccgagaagacccugagcagcuucugcaaguggcagaagagcaucaaccccaagagcgaccugaaccccgugcaccacgacguggccgugcugcugaccagaaaggacaucugcgccggcuucaacagacccugcgagacccugggccugagccaccugagcggcaugugccagccccacagaagcugcaacaucaacgaggacagcggccugccccuggccuucaccaucgcccacgagcugggccacagcuucggcauccagcacgacggcaaggagaacgacugcgagcccgugggcagacaccccuacaucaugagcagacagcugcaguacgaccccaccccccugaccuggagcaagugcagcgaggaguacaucaccagauuccuggacagaggcuggggcuucugccuggacgacauccccaagaagaagggccugaagagcaaggugaucgcccccggcgugaucuacgacgugcaccaccagugccagcugcaguacggccccaacgccaccuucugccaggagguggagaacgugugccagacccuguggugcagcgugaagggcuucugcagaagcaagcuggacgccgccgccgacggcacccagugcggcgagaagaaguggugcauggccggcaagugcaucaccgugggcaagaagcccgagagcauccccggcggcuggggcagauggagccccuggagccacugcagcagaaccugcggcgccggcgugcagagcgccgagagacugugcaacaaccccgagcccaaguucggcggcaaguacugcaccggcgagagaaagagauacagacugugcaacgugcaccccugcagaagcgaggcccccaccuucagacagaugcagugcagcgaguucgacaccgugcccuacaagaacgagcuguaccacugguuccccaucuucaaccccgcccaccccugcgagcuguacugcagacccaucgacggccaguucagcgagaagaugcuggacgccgugaucgacggcacccccugcuucgagggcggcaacagcagaaacgugugcaucaacggcaucugcaagauggugggcugcgacuacgagaucgacagcaacgccaccgaggacagaugcggcgugugccugggcgacggcagcagcugccagaccgugagaaagauguucaagcagaaggagggcagcggcuacguggacaucggccugauccccaagggcgccagagacaucagagugauggagaucgagggcgccggcaacuuccuggccaucagaagcgaggaccccgagaaguacuaccugaacggcggcuucaucauccaguggaacggcaacuacaagcuggccggcaccguguuccaguacgacagaaagggcgaccuggagaagcugauggccaccggccccaccaacgagagcguguggauccagcugcuguuccaggugaccaaccccggcaucaaguacgaguacaccauccagaaggacggccuggacaacgacguggagcagcagauguacuucuggcaguacggccacuggaccgagugcagcgugaccugcggcaccggcaucagaagacagaccgcccacugcaucaagaagggcagaggcauggugaaggccaccuucugcgaccccgagacccagcccaacggcagacagaagaagugccacgagaaggccugcccccccagauggugggccggcgagugggaggccugcagcgccaccugcggcccccacggcgagaagaagagaaccgugcugugcauccagaccauggugagcgacgagcaggcccugccccccaccgacugccagcaccugcugaagcccaagacccugcugagcugcaacagagacauccugugccccagcgacuggaccgugggcaacuggagcgagugcagcgugagcugcggcggcggcgugagaaucagaagcgugaccugcgccaagaaccacgacgagcccugcgacgugaccagaaagcccaacagcagagcccugugcggccugcagcagugccccagcagcagaagagugcugaagcccaacaagggcaccaucagcaacggcaagaacccccccacccugaagcccgugcccccccccaccagcagacccagaaugcugaccacccccaccggccccgagagcaugagcaccagcacccccgccaucagcagccccagccccaccaccgccagcaaggagggcgaccugggcggcaagcaguggcaggacagcagcacccagcccgagcugagcagcagauaccugaucagcaccggcagcaccagccagcccauccugaccagccagagccugagcauccagcccagcgaggagaacgugagcagcagcgacaccggccccaccagcgagggcggccugguggccaccaccaccagcggcagcggccugagcagcagcagaaaccccaucaccuggcccgugacccccuucuacaacacccugaccaagggccccgagauggagauccacagcggcagcggcgaggagagagagcagcccgaggacaaggacgagagcaaccccgugaucuggaccaagaucagagugcccggcaacgacgcccccguggagagcaccgagaugccccuggcccccccccugacccccgaccugagcagagagagcugguggccccccuucagcaccgugauggagggccugcugcccagccagagacccaccaccagcgagaccggcacccccagaguggagggcauggugaccgagaagcccgccaacacccugcugccccugggcggcgaccaccagcccgagcccagcggcaagaccgccaacagaaaccaccugaagcugcccaacaacaugaaccagaccaagagcagcgagcccgugcugaccgaggaggacgccaccagccugaucaccgagggcuuccugcugaacgccagcaacuacaagcagcugaccaacggccacggcagcgcccacuggaucgugggcaacuggagcgagugcagcaccaccugcggccugggcgccuacuggagaagaguggagugcagcacccagauggacagcgacugcgccgccauccagagacccgaccccgccaagagaugccaccugagacccugcgccggcuggaaggugggcaacuggagcaagugcagcagaaacugcagcggcggcuucaagaucagagagauccagugcguggacagcagagaccacagaaaccugagacccuuccacugccaguuccuggccggcaucccccccccccugagcaugagcugcaaccccgagcccugcgaggccuggcagguggagcccuggagccagugcagcagaagcugcggcggcggcgugcaggagagaggcguguucugccccggcggccugugcgacuggaccaagagacccaccagcaccaugagcugcaacgagcaccugugcugccacugggccaccggcaacugggaccugugcagcaccagcugcggcggcggcuuccagaagagaaccgugcagugcgugcccagcgagggcaacaagaccgaggaccaggaccagugccugugcgaccacaagcccagaccccccgaguucaagaagugcaaccagcaggccugcaagaagagcgccgaccugcugugcaccaaggacaagcugagcgccagcuucugccagacccugaaggccaugaagaagugcagcgugcccaccgugagagccgagugcugcuucagcugcccccagacccacaucacccacacccagagacagagaagacagagacugcugcagaagagcaaggagcuguaa

SEQ ID NO: 13266 - RNA, 4284 nt, Artificial Sequence
  ADAMTS13__Homo_sapiens__NP_620594
augcaccagagacaccccagagccagaugccccccccugugcguggccggcauccuggccugcggcuuccugcugggcugcuggggccccagccacuuccagcagagcugccugcaggcccuggagccccaggccgugagcagcuaccugagccccggcgccccccugaagggcagaccccccagccccggcuuccagagacagagacagagacagagaagagccgccggcggcauccugcaccuggagcugcugguggccgugggccccgacguguuccaggcccaccaggaggacaccgagagauacgugcugaccaaccugaacaucggcgccgagcugcugagagaccccagccugggcgcccaguucagagugcaccuggugaagauggugauccugaccgagcccgagggcgcccccaacaucaccgccaaccugaccagcagccugcugagcgugugcggcuggagccagaccaucaaccccgaggacgacaccgaccccggccacgccgaccuggugcuguacaucaccagauucgaccuggagcugcccgacggcaacagacaggugagaggcgugacccagcugggcggcgccugcagccccaccuggagcugccugaucaccgaggacaccggcuucgaccugggcgugaccaucgcccacgagaucggccacagcuucggccuggagcacgacggcgcccccggcagcggcugcggccccagcggccacgugauggccagcgacggcgccgcccccagagccggccuggccuggagccccugcagcagaagacagcugcugagccugcugagcgccggcagagccagaugcgugugggacccccccagaccccagcccggcagcgccggccacccccccgacgcccagcccggccuguacuacagcgccaacgagcagugcagaguggccuucggccccaaggccguggccugcaccuucgccagagagcaccuggacaugugccaggcccugagcugccacaccgacccccuggaccagagcagcugcagcagacugcuggugccccugcuggacggcaccgagugcggcguggagaaguggugcagcaagggcagaugcagaagccugguggagcugacccccaucgccgccgugcacggcagauggagcagcuggggccccagaagccccugcagcagaagcugcggcggcggcguggugaccagaagaagacagugcaacaaccccagacccgccuucggcggcagagccugcgugggcgccgaccugcaggccgagaugugcaacacccaggccugcgagaagacccagcuggaguucaugagccagcagugcgccagaaccgacggccagccccugagaagcagccccggcggcgccagcuucuaccacuggggcgccgccgugccccacagccagggcgacgcccugugcagacacaugugcagagccaucggcgagagcuucaucaugaagagaggcgacagcuuccuggacggcaccagaugcaugcccagcggccccagagaggacggcacccugagccugugcgugagcggcagcugcagaaccuucggcugcgacggcagaauggacagccagcaggugugggacagaugccaggugugcggcggcgacaacagcaccugcagccccagaaagggcagcuucaccgccggcagagccagagaguacgugaccuuccugaccgugacccccaaccugaccagcguguacaucgccaaccacagaccccuguucacccaccuggccgugagaaucggcggcagauacgugguggccggcaagaugagcaucagccccaacaccaccuaccccagccugcuggaggacggcagaguggaguacagaguggcccugaccgaggacagacugcccagacuggaggagaucagaaucuggggcccccugcaggaggacgccgacauccagguguacagaagauacggcgaggaguacggcaaccugaccagacccgacaucaccuucaccuacuuccagcccaagcccagacaggccugggugugggccgccgugagaggccccugcagcgugagcugcggcgccggccugagaugggugaacuacagcugccuggaccaggccagaaaggagcugguggagaccgugcagugccagggcagccagcagccccccgccuggcccgaggccugcgugcuggagcccugcccccccuacugggccgugggcgacuucggccccugcagcgccagcugcggcggcggccugagagagagacccgugagaugcguggaggcccagggcagccugcugaagacccugccccccgccagaugcagagccggcgcccagcagcccgccguggcccuggagaccugcaacccccagcccugccccgccagaugggaggugagcgagcccagcagcugcaccagcgccggcggcgccggccuggcccuggagaacgagaccugcgugcccggcgccgacggccuggaggcccccgugaccgagggccccggcagcguggacgagaagcugcccgcccccgagcccugcgugggcaugagcugcccccccggcuggggccaccuggacgccaccagcgccggcgagaaggcccccagccccuggggcagcaucagaaccggcgcccaggccgcccacguguggacccccgccgccggcagcugcagcgugagcugcggcagaggccugauggagcugagauuccugugcauggacagcgcccugagagugcccgugcaggaggagcugugcggccuggccagcaagcccggcagcagaagagaggugugccaggccgugcccugccccgccagauggcaguacaagcuggccgccugcagcgugagcugcggcagaggcguggugagaagaauccuguacugcgccagagcccacggcgaggacgacggcgaggagauccugcuggacacccagugccagggccugcccagacccgagccccaggaggccugcagccuggagcccugcccccccagauggaaggugaugagccugggccccugcagcgccagcugcggccugggcaccgccagaagaagcguggccugcgugcagcuggaccagggccaggacguggagguggacgaggccgccugcgccgcccuggugagacccgaggccagcgugcccugccugaucgccgacugcaccuacagauggcacgugggcaccuggauggagugcagcgugagcugcggcgacggcauccagagaagaagagacaccugccugggcccccaggcccaggcccccgugcccgccgacuucugccagcaccugcccaagcccgugaccgugagaggcugcugggccggccccugcgugggccagggcacccccagccuggugccccacgaggaggccgccgcccccggcagaaccaccgccacccccgccggcgccagccuggaguggagccaggccagaggccugcuguucagccccgccccccagcccagaagacugcugcccggcccccaggagaacagcgugcagagcagcgccugcggcagacagcaccuggagcccaccggcaccaucgacaugagaggccccggccaggccgacugcgccguggccaucggcagaccccugggcgagguggugacccugagagugcuggagagcagccugaacugcagcgccggcgacaugcugcugcuguggggcagacugaccuggagaaagaugugcagaaagcugcuggacaugaccuucagcagcaagaccaacacccugguggugagacagagaugcggcagacccggcggcggcgugcugcugagauacggcagccagcuggcccccgagaccuucuacagagagugcgacaugcagcuguucggccccuggggcgagaucgugagccccagccugagccccgccaccagcaacgccggcggcugcagacuguucaucaacguggccccccacgccagaaucgccauccacgcccuggccaccaacaugggcgccggcaccgagggcgccaacgccagcuacauccugaucagagacacccacagccugagaaccaccgccuuccacggccagcaggugcuguacugggagagcgagagcagccaggccgagauggaguucagcgagggcuuccugaaggcccaggccagccugagaggccaguacuggacccugcagagcugggugcccgagaugcaggacccccagagcuggaagggcaaggagggcaccuaa

SEQ ID NO: 13267 - RNA, 3672 nt, Artificial Sequence
  ADAMTS14__Homo_sapiens__NP_542453
auggccccccugagagcccugcugagcuaccugcugccccugcacugcgcccugugcgccgccgccggcagcagaacccccgagcugcaccugagcggcaagcugagcgacuacggcgugaccgugcccugcagcaccgacuucagaggcagauuccugagccacguggugagcggccccgccgccgccagcgccggcagcauggugguggacaccccccccacccugcccagacacagcagccaccugagaguggccagaagcccccugcaccccggcggcacccuguggcccggcagagugggcagacacagccuguacuucaacgugaccguguucggcaaggagcugcaccugagacugagacccaacagaagacugguggugcccggcagcagcguggaguggcaggaggacuucagagagcuguucagacagccccugagacaggagugcguguacaccggcggcgugaccggcaugcccggcgccgccguggccaucagcaacugcgacggccuggccggccugaucagaaccgacagcaccgacuucuucaucgagccccuggagagaggccagcaggagaaggaggccagcggcagaacccacgugguguacagaagagaggccgugcagcaggagugggccgagcccgacggcgaccugcacaacgaggccuucggccugggcgaccugcccaaccugcugggccuggugggcgaccagcugggcgacaccgagagaaagagaagacacgccaagcccggcagcuacagcaucgaggugcugcuggugguggacgacagcguggugagauuccacggcaaggagcacgugcagaacuacgugcugacccugaugaacaucguggacgagaucuaccacgacgagagccugggcgugcacaucaacaucgcccuggugagacugaucauggugggcuacagacagagccugagccugaucgagagaggcaaccccagcagaagccuggagcaggugugcagaugggcccacagccagcagagacaggaccccagccacgccgagcaccacgaccacgugguguuccugaccagacaggacuucggccccagcggcuacgcccccgugaccggcaugugccacccccugagaagcugcgcccugaaccacgaggacggcuucagcagcgccuucgugaucgcccacgagaccggccacgugcugggcauggagcacgacggccagggcaacggcugcgccgacgagaccagccugggcagcgugauggccccccuggugcaggccgccuuccacagauuccacuggagcagaugcagcaagcuggagcugagcagauaccugcccagcuacgacugccugcuggacgaccccuucgaccccgccuggccccagccccccgagcugcccggcaucaacuacagcauggacgagcagugcagauucgacuucggcagcggcuaccagaccugccuggccuucagaaccuucgagcccugcaagcagcuguggugcagccaccccgacaaccccuacuucugcaagaccaagaagggccccccccuggacggcaccgagugcgcccccggcaaguggugcuucaagggccacugcaucuggaagagccccgagcagaccuacggccaggacggcggcuggagcagcuggaccaaguucggcagcugcagcagaagcugcggcggcggcgugagaagcagaagcagaagcugcaacaaccccagccccgccuacggcggcagacugugccugggccccauguucgaguaccaggugugcaacagcgaggagugccccggcaccuacgaggacuucagagcccagcagugcgccaagagaaacagcuacuacgugcaccagaacgccaagcacagcugggugcccuacgagcccgacgacgacgcccagaagugcgagcugaucugccagagcgccgacaccggcgacgugguguucaugaaccagguggugcacgacggcaccagaugcagcuacagagaccccuacagcgugugcgccagaggcgagugcgugcccgugggcugcgacaaggaggugggcagcaugaaggccgacgacaagugcggcgugugcggcggcgacaacagccacugcagaaccgugaagggcacccugggcaaggccagcaagcaggccggcgcccugaagcuggugcagauccccgccggcgccagacacauccagaucgaggcccuggagaagagcccccacagaaucguggugaagaaccaggugaccggcagcuucauccugaaccccaagggcaaggaggccaccagcagaaccuucaccgccaugggccuggagugggaggacgccguggaggacgccaaggagagccugaagaccagcggcccccugcccgaggccaucgccauccuggcccugccccccaccgagggcggccccagaagcagccuggccuacaaguacgugauccacgaggaccugcugccccugaucggcagcaacaacgugcugcuggaggagauggacaccuacgagugggcccugaagagcugggcccccugcagcaaggccugcggcggcggcauccaguucaccaaguacggcugcagaagaagaagagaccaccacauggugcagagacaccugugcgaccacaagaagagacccaagcccaucagaagaagaugcaaccagcaccccugcagccagcccgugugggugaccgaggaguggggcgccugcagcagaagcugcggcaagcugggcgugcagaccagaggcauccagugccugcugccccugagcaacggcacccacaaggugaugcccgccaaggccugcgccggcgacagacccgaggccagaagacccugccugagagugcccugccccgcccaguggagacugggcgccuggagccagugcagcgccaccugcggcgagggcauccagcagagacagguggugugcagaaccaacgccaacagccugggccacugcgagggcgacagacccgacaccgugcaggugugcagccugcccgccugcggcggcaaccaccagaacagcaccgugagagccgacgugugggagcugggcacccccgagggccagugggugccccagagcgagccccugcaccccaucaacaagaucagcagcaccgagcccugcaccggcgacagaagcguguucugccagauggaggugcuggacagauacugcagcauccccggcuaccacagacugugcugcgugagcugcaucaagaaggccagcggccccaaccccggccccgaccccggccccaccagccugccccccuucagcacccccggcagcccccugcccggcccccaggaccccgccgacgccgccgagccccccggcaagcccaccggcagcgaggaccaccagcacggcagagccacccagcugcccggcgcccuggacaccagcagccccggcacccagcaccccuucgcccccgagacccccauccccggcgccagcuggagcaucagccccaccacccccggcggccugcccuggggcuggacccagacccccacccccgugcccgaggacaagggccagcccggcgaggaccugagacaccccggcaccagccugcccgccgccagccccgugaccuaa

SEQ ID NO: 13268 - RNA, 2853 nt, Artificial Sequence
  ADAMTS15__Homo_sapiens__NP_620686
augcugcugcugggcauccugacccuggccuucgccggcagaaccgccggcggcagcgagcccgagagagaggugguggugcccaucagacuggaccccgacaucaacggcagaagauacuacuggagaggccccgaggacagcggcgaccagggccugaucuuccagaucaccgccuuccaggaggacuucuaccugcaccugacccccgacgcccaguuccuggcccccgccuucagcaccgagcaccugggcgugccccugcagggccugaccggcggcagcagcgaccugagaagaugcuucuacagcggcgacgugaacgccgagcccgacagcuucgccgccgugagccugugcggcggccugagaggcgccuucggcuacagaggcgccgaguacgugaucagcccccugcccaacgccagcgcccccgccgcccagagaaacagccagggcgcccaccugcugcagagaagaggcgugcccggcggccccagcggcgaccccaccagcagaugcggcguggccagcggcuggaaccccgccauccugagagcccuggaccccuacaagcccagaagagccggcuucggcgagagcagaagcagaagaagaagcggcagagccaagagauucgugagcauccccagauacguggagacccuggugguggccgacgagagcauggugaaguuccacggcgccgaccuggagcacuaccugcugacccugcuggccaccgccgccagacuguacagacaccccagcauccugaaccccaucaacaucgugguggugaaggugcugcugcugagagacagagacagcggccccaaggugaccggcaacgccgcccugacccugagaaacuucugcgccuggcagaagaagcugaacaaggugagcgacaagcaccccgaguacugggacaccgccauccuguucaccagacaggaccugugcggcgccaccaccugcgacacccugggcauggccgacgugggcaccaugugcgaccccaagagaagcugcagcgugaucgaggacgacggccugcccagcgccuucaccaccgcccacgagcugggccacguguucaacaugccccacgacaacgugaaggugugcgaggagguguucggcaagcugagagccaaccacaugaugagccccacccugauccagaucgacagagccaaccccuggagcgccugcagcgccgccaucaucaccgacuuccuggacagcggccacggcgacugccugcuggaccagcccagcaagcccaucagccugcccgaggaccugcccggcgccagcuacacccugagccagcagugcgagcuggccuucggcgugggcagcaagcccugccccuacaugcaguacugcaccaagcuguggugcaccggcaaggccaagggccagauggugugccagaccagacacuuccccugggccgacggcaccagcugcggcgagggcaagcugugccugaagggcgccugcguggagagacacaaccugaacaagcacagaguggacggcagcugggccaagugggaccccuacggccccugcagcagaaccugcggcggcggcgugcagcuggccagaagacagugcaccaaccccacccccgccaacggcggcaaguacugcgagggcgugagagugaaguacagaagcugcaaccuggagcccugccccagcagcgccagcggcaagagcuucagagaggagcagugcgaggccuucaacggcuacaaccacagcaccaacagacugacccuggccguggccugggugcccaaguacagcggcgugagccccagagacaagugcaagcugaucugcagagccaacggcaccggcuacuucuacgugcuggcccccaaggugguggacggcacccugugcagccccgacagcaccagcgugugcgugcagggcaagugcaucaaggccggcugcgacggcaaccugggcagcaagaagagauucgacaagugcggcgugugcggcggcgacaacaagagcugcaagaaggugaccggccuguucaccaagcccaugcacggcuacaacuucgugguggccauccccgccggcgccagcagcaucgacaucagacagagaggcuacaagggccugaucggcgacgacaacuaccuggcccugaagaacagccagggcaaguaccugcugaacggccacuucguggugagcgccguggagagagaccugguggugaagggcagccugcugagauacagcggcaccggcaccgccguggagagccugcaggccagcagacccauccuggagccccugaccguggaggugcugagcgugggcaagaugaccccccccagagugagauacagcuucuaccugcccaaggagcccagagaggacaagagcagccaccccaaggaccccagaggccccagcgugcugcacaacagcgugcugagccugagcaaccagguggagcagcccgacgacagaccccccgccagauggguggccggcagcuggggccccugcagcgccagcugcggcagcggccugcagaagagagccguggacugcagaggcagcgccggccagagaaccgugcccgccugcgacgccgcccacagacccguggagacccaggccugcggcgagcccugccccaccugggagcugagcgccuggagccccugcagcaagagcugcggcagaggcuuccagagaagaagccugaagugcgugggccacggcggcagacugcuggccagagaccagugcaaccugcacagaaagccccaggagcuggacuucugcgugcugagacccugcuaa

SEQ ID NO: 13269 - RNA, 3675 nt, Artificial Sequence
  ADAMTS16__Homo_sapiens__NP_620687
augaagcccagagccagaggcuggagaggccuggccgcccuguggaugcugcuggcccagguggccgagcaggcccccgccugcgccaugggccccgccgccgccgcccccggcagccccagcgugcccagaccccccccccccgccgagagacccggcuggauggagaagggcgaguacgaccuggugagcgccuacgagguggaccacagaggcgacuacgugagccacgagaucaugcaccaccagagaagaagaagagccgugcccgugagcgagguggagagccugcaccugagacugaagggcagcagacacgacuuccacauggaccugagaaccagcagcagccugguggcccccggcuucaucgugcagacccugggcaagaccggcaccaagagcgugcagacccugccccccgaggacuucugcuucuaccagggcagccugagaagccacagaaacagcagcguggcccugagcaccugccagggccugagcggcaugaucagaaccgaggaggccgacuacuuccugagaccccugcccagccaccugagcuggaagcugggcagagccgcccagggcagcagccccagccacgugcuguacaagagaagcaccgagccccacgcccccggcgccagcgaggugcuggugaccagcagaaccugggagcuggcccaccagccccugcacagcagcgaccugagacugggccugccccagaagcagcacuucugcggcagaagaaagaaguacaugccccagccccccaaggaggaccuguucauccugcccgacgaguacaagagcugccugagacacaagagaagccugcugagaagccacagaaacgaggagcugaacguggagacccugguggugguggacaagaagaugaugcagaaccacggccacgagaacaucaccaccuacgugcugaccauccugaacauggugagcgcccuguucaaggacggcaccaucggcggcaacaucaacaucgccaucgugggccugauccugcuggaggacgagcagcccggccuggugaucagccaccacgccgaccacacccugagcagcuucugccaguggcagagcggccugaugggcaaggacggcaccagacacgaccacgccauccugcugaccggccuggacaucugcagcuggaagaacgagcccugcgacacccugggcuucgcccccaucagcggcaugugcagcaaguacagaagcugcaccaucaacgaggacaccggccugggccuggccuucaccaucgcccacgagagcggccacaacuucggcaugauccacgacggcgagggcaacaugugcaagaagagcgagggcaacaucaugagccccacccuggccggcagaaacggcguguucagcuggagccccugcagcagacaguaccugcacaaguuccugagcaccgcccaggccaucugccuggccgaccagcccaagcccgugaaggaguacaaguaccccgagaagcugcccggcgagcuguacgacgccaacacccagugcaaguggcaguucggcgagaaggccaagcugugcaugcuggacuucaagaaggacaucugcaaggcccuguggugccacagaaucggcagaaagugcgagaccaaguucaugcccgccgccgagggcaccaucugcggccacgacauguggugcagaggcggccagugcgugaaguacggcgacgagggccccaagcccacccacggccacuggagcgacuggagcagcuggagccccugcagcagaaccugcggcggcggcgugagccacagaagcagacugugcaccaaccccaagcccagccacggcggcaaguucugcgagggcagcaccagaacccugaagcugugcaacagccagaagugccccagagacagcguggacuucagagccgcccagugcgccgagcacaacagcagaagauucagaggcagacacuacaaguggaagcccuacacccagguggaggaccaggaccugugcaagcuguacugcaucgccgagggcuucgacuucuucuucagccugagcaacaaggugaaggacggcacccccugcagcgaggacagcagaaacgugugcaucgacggcaucugcgagagagugggcugcgacaacgugcugggcagcgacgccguggaggacgugugcggcgugugcaacggcaacaacagcgccugcaccauccacagaggccuguacaccaagcaccaccacaccaaccaguacuaccacauggugaccauccccagcggcgccagaagcaucagaaucuacgagaugaacgugagcaccagcuacaucagcgugagaaacgcccugagaagauacuaccugaacggccacuggaccguggacuggcccggcagauacaaguucagcggcaccaccuucgacuacagaagaagcuacaacgagcccgagaaccugaucgccaccggccccaccaacgagacccugaucguggagcugcuguuccagggcagaaaccccggcguggccugggaguacagcaugcccagacugggcaccgagaagcagccccccgcccagcccagcuacaccugggccaucgugagaagcgagugcagcgugagcugcggcggcggccagaugaccgugagagagggcugcuacagagaccugaaguuccaggugaacaugagcuucugcaaccccaagaccagacccgugaccggccuggugcccugcaaggugagcgccugcccccccagcuggagcgugggcaacuggagcgccugcagcagaaccugcggcggcggcgcccagagcagacccgugcagugcaccagaagagugcacuacgacagcgagcccgugcccgccagccugugcccccagcccgcccccagcagcagacaggccugcaacagccagagcugcccccccgccuggagcgccggccccugggccgagugcagccacaccugcggcaagggcuggagaaagagagccguggccugcaagagcaccaaccccagcgccagagcccagcugcugcccgacgccgugugcaccagcgagcccaagcccagaaugcacgaggccugccugcugcagagaugccacaagcccaagaagcugcaguggcuggugagcgccuggagccagugcagcgugaccugcgagagaggcacccagaagagauuccugaagugcgccgagaaguacgugagcggcaaguacagagagcuggccagcaagaagugcagccaccugcccaagcccagccuggagcuggagagagccugcgccccccugcccugccccagacacccccccuucgccgccgccggccccagcagaggcagcugguucgccagccccuggagccagugcaccgccagcugcggcggcggcgugcagaccagaagcgugcagugccuggccggcggcagacccgccagcggcugccugcugcaccagaagcccagcgccagccuggccugcaacacccacuucugccccaucgccgagaagaaggacgccuucugcaaggacuacuuccacuggugcuaccuggugccccagcacggcaugugcagccacaaguucuacggcaagcagugcugcaagaccugcagcaagagcaaccuguaa

SEQ ID NO: 13270 - RNA, 3288 nt, Artificial Sequence
  ADAMTS17__Homo_sapiens__NP_620688
augugcgacggcgcccugcugcccccccuggugcugcccgugcugcugcugcugguguggggccuggaccccggcaccgccgugggcgacgccgccgccgacguggagguggugcugcccuggagagugagacccgacgacgugcaccugcccccccugcccgccgcccccggccccagaagaagaagaagacccagaaccccccccgccgcccccagagccagacccggcgagagagcccugcugcugcaccugcccgccuucggcagagaccuguaccugcagcugagaagagaccugagauuccugagcagaggcuucgagguggaggaggccggcgccgccagaagaagaggcagacccgccgagcugugcuucuacagcggcagagugcugggccaccccggcagccuggugagccugagcgccugcggcgccgccggcggccuggugggccugauccagcugggccaggagcaggugcugauccagccccugaacaacagccagggccccuucagcggcagagagcaccugaucagaagaaaguggagccugacccccagccccagcgccgaggcccagagacccgagcagcugugcaaggugcugaccgagaagaagaagcccaccuggggcagacccagcagagacuggagagagagaagaaacgccaucagacugaccagcgagcacaccguggagacccuggugguggccgacgccgacauggugcaguaccacggcgccgaggccgcccagagauucauccugaccgugaugaacaugguguacaacauguuccagcaccagagccugggcaucaagaucaacauccaggugaccaagcuggugcugcugagacagagacccgccaagcugagcaucggccaccacggcgagagaagccuggagagcuucugccacuggcagaacgaggaguacggcggcgccagauaccugggcaacaaccaggugcccggcggcaaggacgaccccccccugguggacgccgccguguucgugaccagaaccgacuucugcgugcacaaggacgagcccugcgacaccgugggcaucgccuaccugggcggcgugugcagcgccaagagaaagugcgugcuggccgaggacaacggccugaaccuggccuucaccaucgcccacgagcugggccacaaccugggcaugaaccacgacgacgaccacagcagcugcgccggcagaagccacaucaugagcggcgagugggugaagggcagaaaccccagcgaccugagcuggagcagcugcagcagagacgaccuggagaacuuccugaagagcaaggugagcaccugccugcuggugaccgaccccagaagccagcacaccgugagacugccccacaagcugcccggcaugcacuacagcgccaacgagcagugccagauccuguucggcaugaacgccaccuucugcagaaacauggagcaccugaugugcgccggccuguggugccugguggagggcgacaccagcugcaagaccaagcuggaccccccccuggacggcaccgagugcggcgccgacaaguggugcagagccggcgagugcgugagcaagacccccauccccgagcacguggacggcgacuggagccccuggggcgccuggagcaugugcagcagaaccugcggcaccggcgccagauucagacagagaaagugcgacaaccccccccccggccccggcggcacccacugccccggcgccagcguggagcacgccgugugcgagaaccugcccugccccaagggccugcccagcuucagagaccagcagugccaggcccacgacagacugagccccaagaagaagggccugcugaccgccguggugguggacgacaagcccugcgagcuguacugcagcccccugggcaaggagagcccccugcugguggccgacagagugcuggacggcacccccugcggccccuacgagaccgaccugugcgugcacggcaagugccagaagaucggcugcgacggcaucaucggcagcgccgccaaggaggacagaugcggcgugugcagcggcgacggcaagaccugccaccuggugaagggcgacuucagccacgccagaggcaccgcccugaaggacagcggcaagggcagcaucaacagcgacuggaagaucgagcugcccggcgaguuccagaucgccggcaccaccgugagauacgugagaagaggccugugggagaagaucagcgccaagggccccaccaagcugccccugcaccugauggugcugcuguuccacgaccaggacuacggcauccacuacgaguacaccgugcccgugaacagaaccgccgagaaccagagcgagcccgagaagccccaggacagccuguucaucuggacccacagcggcugggagggcugcagcgugcagugcggcggcggcgagagaagaaccaucgugagcugcaccagaaucgugaacaagaccaccacccuggugaacgacagcgacugcccccaggccagcagacccgagccccaggugagaagaugcaaccugcaccccugccagagcagauggguggccggccccuggagccccugcagcgccaccugcgagaagggcuuccagcacagagaggugaccugcguguaccagcugcagaacggcacccacguggccaccagaccccuguacugccccggccccagacccgccgccgugcagagcugcgagggccaggacugccugagcaucugggaggccagcgaguggagccagugcagcgccagcugcggcaagggcguguggaagagaaccguggccugcaccaacagccagggcaagugcgacgccagcaccagacccagagccgaggaggccugcgaggacuacagcggcugcuacgaguggaagaccggcgacuggagcaccugcagcagcaccugcggcaagggccugcagagcagaguggugcagugcaugcacaaggugaccggcagacacggcagcgagugccccgcccugagcaagcccgcccccuacagacagugcuaccaggaggugugcaacgacagaaucaacgccaacaccaucaccagccccagacuggccgcccugaccuacaagugcaccagagaccaguggaccguguacugcagagugaucagagagaagaaccugugccaggacaugagaugguaccagagaugcugccagaccugcagagacuucuacgccaacaagaugagacagcccccccccaacagcuaa

SEQ ID NO: 13271 - RNA, 3666 nt, Artificial Sequence
  ADAMTS18__Homo_sapiens__NP_955387
auggagugcgcccugcugcuggccugcgccuuccccgccgccggcagcggcccccccagaggccuggccggccugggcagaguggccaaggcccugcagcugugcugccugugcugcgccagcguggccgccgcccuggccagcgacagcagcagcggcgccagcggccugaacgacgacuacguguucgugacccccguggagguggacagcgccggcagcuacaucagccacgacauccugcacaacggcagaaagaagagaagcgcccagaacgccagaagcagccugcacuacagauucagcgccuucggccaggagcugcaccuggagcugaagcccagcgccauccugagcagccacuucaucgugcaggugcugggcaaggacggcgccagcgagacccagaagcccgaggugcagcagugcuucuaccagggcuucaucagaaacgacagcagcagcagcguggccgugagcaccugcgccggccugagcggccugaucagaaccagaaagaacgaguuccugaucagcccccugccccagcugcuggcccaggagcacaacuacagcagccccgccggccaccacccccacgugcuguacaagagaaccgccgaggagaagauccagagauacagaggcuaccccggcagcggcagaaacuaccccggcuacagccccagccacaucccccacgccagccagagcagagagaccgaguaccaccacagaagacugcagaagcagcacuucugcggcagaagaaagaaguacgcccccaagccccccaccgaggacaccuaccugagauucgacgaguacggcagcagcggcagacccagaagaagcgccggcaagagccagaagggccugaacguggagacccuggugguggccgacaagaagaugguggagaagcacggcaagggcaacgugaccaccuacauccugaccgugaugaacauggugagcggccuguucaaggacggcaccaucggcagcgacaucaacguggugguggugagccugauccugcuggagcaggagcccggcggccugcugaucaaccaccacgccgaccagagccugaacagcuucugccaguggcagagcgcccugaucggcaagaacggcaagagacacgaccacgccauccugcugaccggcuucgacaucugcagcuggaagaacgagcccugcgacacccugggcuucgcccccaucagcggcaugugcagcaaguacagaagcugcaccaucaacgaggacaccggccugggccuggccuucaccaucgcccacgagagcggccacaacuucggcaugauccacgacggcgagggcaaccccugcagaaaggccgagggcaacaucaugagccccacccugaccggcaacaacggcguguucagcuggagcagcugcagcagacaguaccugaagaaguuccugagcaccccccaggccggcugccugguggacgagcccaagcaggccggccaguacaaguaccccgacaagcugcccggccagaucuacgacgccgacacccagugcaaguggcaguucggcgccaaggccaagcugugcagccugggcuucgugaaggacaucugcaagagccuguggugccacagagugggccacagaugcgagaccaaguucaugcccgccgccgagggcaccgugugcggccugagcauguggugcagacagggccagugcgugaaguucggcgagcugggccccagacccauccacggccaguggagcgccuggagcaaguggagcgagugcagcagaaccugcggcggcggcgugaaguuccaggagagacacugcaacaaccccaagccccaguacggcggccuguucugccccggcagcagcagaaucuaccagcugugcaacaucaaccccugcaacgagaacagccuggacuucagagcccagcagugcgccgaguacaacagcaagcccuucagaggcugguucuaccaguggaagcccuacaccaagguggaggaggaggacagaugcaagcuguacugcaaggccgagaacuucgaguucuucuucgccaugagcggcaaggugaaggacggcacccccugcagccccaacaagaacgacgugugcaucgacggcgugugcgagcuggugggcugcgaccacgagcugggcagcaaggccgugagcgacgccugcggcgugugcaagggcgacaacagcaccugcaaguucuacaagggccuguaccugaaccagcacaaggccaacgaguacuaccccguggugcugauccccgccggcgccagaagcaucgagauccaggagcugcaggugagcagcagcuaccuggccgugagaagccugagccagaaguacuaccugaccggcggcuggagcaucgacuggcccggcgaguuccccuucgccggcaccaccuucgaguaccagagaagcuucaacagacccgagagacuguacgcccccggccccaccaacgagacccugguguucgagauccugaugcagggcaagaaccccggcaucgccuggaaguacgcccugcccaaggugaugaacggcaccccccccgccaccaagagacccgccuacaccuggagcaucgugcagagcgagugcagcgugagcugcggcggcggcuacaucaacgugaaggccaucugccugagagaccagaacacccaggugaacagcagcuucugcagcgccaagaccaagcccgugaccgagcccaagaucugcaacgccuucagcugccccgccuacuggaugcccggcgaguggagcaccugcagcaaggccugcgccggcggccagcagagcagaaagauccagugcgugcagaagaagcccuuccagaaggaggaggccgugcugcacagccugugccccgugagcacccccacccaggugcaggccugcaacagccacgccugccccccccaguggagccugggccccuggagccagugcagcaagaccugcggcagaggcgugagaaagagagagcugcugugcaagggcagcgccgccgagacccugcccgagagccagugcaccagccugcccagacccgagcugcaggagggcugcgugcugggcagaugccccaagaacagcagacugcaguggguggccagcagcuggagcgagugcagcgccaccugcggccugggcgugagaaagagagagaugaagugcagcgagaagggcuuccagggcaagcugaucaccuuccccgagagaagaugcagaaacaucaagaagcccaaccuggaccuggaggagaccugcaacagaagagccugccccgcccaccccguguacaacaugguggccggcugguacagccugcccuggcagcagugcaccgugaccugcggcggcggcgugcagaccagaagcgugcacugcgugcagcagggcagacccagcagcagcugccugcugcaccagaagccccccgugcugagagccugcaacaccaacuucugccccgcccccgagaagagagaggaccccagcugcguggacuucuucaacuggugccaccuggugccccagcacggcgugugcaaccacaaguucuacggcaagcagugcugcaagagcugcaccagaaagaucuaa

SEQ ID NO: 13272 - RNA, 3624 nt, Artificial Sequence
  ADAMTS19__Homo_sapiens__NP_598377
augagacugacccacaucugcugcugcugccugcuguaccagcugggcuuccugagcaacggcaucgugagcgagcugcaguucgcccccgacagagaggagugggaggugguguuccccgcccuguggagaagagagcccguggaccccgccggcggcagcggcggcagcgccgaccccggcugggugagaggcgugggcggcggcggcagcgccagagcccaggccgccggcagcagcagagaggugagaagcguggcccccgugccccuggaggagcccguggagggcagaagcgagagcagacugagaccccccccccccagcgagggcgaggaggacgaggagcuggagagccaggagcugcccagaggcagcagcggcgccgccgcccugagccccggcgcccccgccagcuggcagccccccccccccccccagcccccccccagccccccccccgcccagcacgccgagcccgacggcgacgaggugcugcugagaauccccgccuucagcagagaccuguaccugcugcugagaagagacggcagauuccuggcccccagauucgccguggagcagagacccaaccccggccccggccccaccggcgccgccagcgccccccagccccccgccccccccgacgccggcugcuucuacaccggcgccgugcugagacaccccggcagccuggccagcuucagcaccugcggcggcggccugaugggcuucauccagcugaacgaggacuucaucuucaucgagccccugaacgacaccauggccaucaccggccacccccacagaguguacagacagaagagaagcauggaggagaaggugaccgagaagagcgcccugcacagccacuacugcggcaucaucagcgacaagggcagacccagaagcagaaagaucgccgagagcggcagaggcaagagauacagcuacaagcugccccaggaguacaacaucgagaccguggugguggccgaccccgccauggugagcuaccacggcgccgacgccgccagaagauucauccugaccauccugaacaugguguucaaccuguuccagcacaagagccugagcgugcaggugaaccugagagugaucaagcugauccugcugcacgagaccccccccgagcuguacaucggccaccacggcgagaagaugcuggagagcuucugcaaguggcagcacgaggaguucggcaagaagaacgacauccaccuggagaugagcaccaacuggggcgaggacaugaccagcguggacgccgccauccugaucaccagaaaggacuucugcgugcacaaggacgagcccugcgacaccgugggcaucgccuaccugagcggcaugugcagcgagaagagaaagugcaucaucgccgaggacaacggccugaaccuggccuucaccaucgcccacgagaugggccacaacaugggcaucaaccacgacaacgaccaccccagcugcgccgacggccugcacaucaugagcggcgaguggaucaagggccagaaccugggcgacgugagcuggagcagaugcagcaaggaggaccuggagagauuccugagaagcaaggccagcaacugccugcugcagaccaacccccagagcgugaacagcgugauggugcccagcaagcugcccggcaugaccuacaccgccgacgagcagugccagauccuguucggcccccuggccagcuucugccaggagaugcagcacgugaucugcaccggccuguggugcaagguggagggcgagaaggagugcagaaccaagcuggacccccccauggacggcaccgacugcgaccugggcaaguggugcaaggccggcgagugcaccagcagaaccagcgcccccgagcaccuggccggcgaguggagccuguggagccccugcagcagaaccugcagcgccggcaucagcagcagagagagaaagugccccggccuggacagcgaggccagagacugcaacggccccagaaagcaguacagaaucugcgagaacccccccugccccgccggccugcccggcuucagagacuggcagugccaggccuacagcgugagaaccagcagccccaagcacauccugcaguggcaggccgugcuggacgaggagaagcccugcgcccuguucugcagccccgugggcaaggagcagcccauccugcugagcgagaaggugauggacggcaccagcugcggcuaccagggccuggacaucugcgccaacggcagaugccagaaggugggcugcgacggccugcugggcagccuggccagagaggaccacugcggcgugugcaacggcaacggcaagagcugcaagaucaucaagggcgacuucaaccacaccagaggcgccggcuacguggaggugcuggugauccccgccggcgccagaagaaucaaggugguggaggagaagcccgcccacagcuaccuggcccugagagacgccggcaagcagagcaucaacagcgacuggaagaucgagcacagcggcgccuucaaccuggccggcaccaccgugcacuacgugagaagaggccugugggagaagaucagcgccaagggccccaccaccgccccccugcaccugcuggugcugcuguuccaggaccagaacuacggccugcacuacgaguacaccauccccagcgacccccugcccgagaaccagagcagcaaggcccccgagccccuguucauguggacccacaccagcugggaggacugcgacgccaccugcggcggcggcgagagaaagaccaccgugagcugcaccaagaucaugagcaagaacaucagcaucguggacaacgagaagugcaaguaccugaccaagcccgagccccagaucagaaagugcaacgagcagcccugccagaccagauggaugaugaccgaguggacccccugcagcagaaccugcggcaagggcaugcagagcagacagguggccugcacccagcagcugagcaacggcacccugaucagagccagagagagagacugcaucggccccaagcccgccagcgcccagagaugcgagggccaggacugcaugaccgugugggaggccggcguguggagcgagugcagcgugaagugcggcaagggcaucagacacagaaccgugagaugcaccaaccccagaaagaagugcgugcugagcaccagacccagagaggccgaggacugcgaggacuacagcaagugcuacguguggagaaugggcgacuggagcaagugcagcaucaccugcggcaagggcaugcagagcagagugauccagugcaugcacaagaucaccggcagacacggcaacgagugcuucagcagcgagaagcccgccgccuacagacccugccaccugcagcccugcaacgagaagaucaacgugaacaccaucaccagccccagacuggccgcccugaccuucaagugccugggcgaccaguggcccguguacugcagagugaucagagagaagaaccugugccaggacaugagaugguaccagagaugcugcgagaccugcagagacuucuacgcccagaagcugcagcagaagagcuaa

SEQ ID NO: 13273 - RNA, 2904 nt, Artificial Sequence
  ADAMTS1__Homo_sapiens__NP_008919
augcagagagccgugcccgagggcuucggcagaagaaagcugggcagcgacaugggcaacgccgagagagcccccggcagcagaagcuucggccccgugcccacccugcugcugcuggccgccgcccugcuggccgugagcgacgcccugggcagacccagcgaggaggacgaggagcugguggugcccgagcuggagagagcccccggccacggcaccaccagacugagacugcacgccuucgaccagcagcuggaccuggagcugagacccgacagcagcuuccuggcccccggcuucacccugcagaacgugggcagaaagagcggcagcgagaccccccugcccgagaccgaccuggcccacugcuucuacagcggcaccgugaacggcgaccccagcagcgccgccgcccugagccugugcgagggcgugagaggcgccuucuaccugcugggcgaggccuacuucauccagccccugcccgccgccagcgagagacuggccaccgccgcccccggcgagaagccccccgccccccugcaguuccaccugcugagaagaaacagacagggcgacgugggcggcaccugcggcgugguggacgacgagcccagacccaccggcaaggccgagaccgaggacgaggacgagggcaccgagggcgaggacgagggcgcccaguggagcccccaggaccccgcccugcagggcgugggccagcccaccggcaccggcagcaucagaaagaagagauucgugagcagccacagauacguggagaccaugcugguggccgaccagagcauggccgaguuccacggcagcggccugaagcacuaccugcugacccuguucagcguggccgccagacuguacaagcaccccagcaucagaaacagcgugagccuggugguggugaagauccuggugauccacgacgagcagaagggccccgaggugaccagcaacgccgcccugacccugagaaacuucugcaacuggcagaagcagcacaacccccccagcgacagagacgccgagcacuacgacaccgccauccuguucaccagacaggaccugugcggcagccagaccugcgacacccugggcauggccgacgugggcaccgugugcgaccccagcagaagcugcagcgugaucgaggacgacggccugcaggccgccuucaccaccgcccacgagcugggccacguguucaacaugccccacgacgacgccaagcagugcgccagccugaacggcgugaaccaggacagccacaugauggccagcaugcugagcaaccuggaccacagccagcccuggagccccugcagcgccuacaugaucaccagcuuccuggacaacggccacggcgagugccugauggacaagccccagaaccccauccagcugcccggcgaccugcccggcaccagcuacgacgccaacagacagugccaguucaccuucggcgaggacagcaagcacugccccgacgccgccagcaccugcagcacccuguggugcaccggcaccagcggcggcgugcuggugugccagaccaagcacuuccccugggccgacggcaccagcugcggcgagggcaaguggugcaucaacggcaagugcgugaacaagaccgacagaaagcacuucgacacccccuuccacggcagcuggggcauguggggccccuggggcgacugcagcagaaccugcggcggcggcgugcaguacaccaugagagagugcgacaaccccgugcccaagaacggcggcaaguacugcgagggcaagagagugagauacagaagcugcaaccuggaggacugccccgacaacaacggcaagaccuucagagaggagcagugcgaggcccacaacgaguucagcaaggccagcuucggcagcggccccgccguggaguggauccccaaguacgccggcgugagccccaaggacagaugcaagcugaucugccaggccaagggcaucggcuacuucuucgugcugcagcccaaggugguggacggcacccccugcagccccgacagcaccagcgugugcgugcagggccagugcgugaaggccggcugcgacagaaucaucgacagcaagaagaaguucgacaagugcggcgugugcggcggcaacggcagcaccugcaagaagaucagcggcagcgugaccagcgccaagcccggcuaccacgacaucaucaccauccccaccggcgccaccaacaucgaggugaagcagagaaaccagagaggcagcagaaacaacggcagcuuccuggccaucaaggccgccgacggcaccuacauccugaacggcgacuacacccugagcacccuggagcaggacaucauguacaagggcguggugcugagauacagcggcagcagcgccgcccuggagagaaucagaagcuucagcccccugaaggagccccugaccauccaggugcugaccgugggcaacgcccugagacccaagaucaaguacaccuacuucgugaagaagaagaaggagagcuucaacgccauccccaccuucagcgccugggugaucgaggaguggggcgagugcagcaagagcugcgagcugggcuggcagagaagacugguggagugcagagacaucaacggccagcccgccagcgagugcgccaaggaggugaagcccgccagcaccagacccugcgccgaccaccccugcccccaguggcagcugggcgaguggagcagcugcagcaagaccugcggcaagggcuacaagaagagaagccugaagugccugagccacgacggcggcgugcugagccacgagagcugcgacccccugaagaagcccaagcacuucaucgacuucugcaccauggccgagugcagcuaa

SEQ ID NO: 13274 - RNA, 5733 nt, Artificial Sequence
  ADAMTS20__Homo_sapiens__NP_079279
auguggguggccaaguggcugaccggccugcuguaccaccugagccuguucaucaccagaagcugggagguggacuuccaccccagacaggaggcccuggugagaacccugaccagcuacgagguggugauccccgagagagugaacgaguucggcgagguguucccccagagccaccacuucagcagacagaagagaagcagcgaggcccuggagcccaugcccuucagaacccacuacagauucaccgccuacggccagcuguuccagcugaaccugaccgccgacgccagcuuccuggccgccggcuacaccgaggugcaccugggcacccccgagagaggcgccugggagagcgacgccggccccagcgaccugagacacugcuucuacagaggccaggugaacagccaggaggacuacaaggccguggugagccugugcggcggccugaccggcaccuucaagggccagaacggcgaguacuuccuggagcccaucaugaaggccgacggcaacgaguacgaggacggccacaacaagccccaccugaucuacagacaggaccugaacaacagcuuccugcagacccugaaguacugcagcgugagcgagagccagaucaaggagaccagccugcccuuccacaccuacagcaacaugaacgaggaccugaacgugaugaaggagagagugcugggccacaccagcaagaacgugccccugaaggacgagagaagacacagcagaaagaagagacugaucagcuaccccagauacaucgagaucauggugaccgccgacgccaagguggugagcgcccacggcagcaaccugcagaacuacauccugacccugaugagcaucguggccaccaucuacaaggaccccagcaucggcaaccugauccacaucgugguggugaagcuggugaugauccacagagaggaggagggccccgugaucaacuucgacggcgccaccacccugaagaacuucugcagcuggcagcagacccagaacgaccuggacgacgugcaccccagccaccacgacaccgccgugcugaucaccagagaggacaucugcagcagcaaggagaagugcaacaugcugggccugagcuaccugggcaccaucugcgacccccugcagagcugcuucaucaacgaggagaagggccugaucagcgccuucaccaucgcccacgagcugggccacacccugggcgugcagcacgacgacaaccccagaugcaaggagaugaaggugaccaaguaccacgugauggcccccgcccugagcuuccacaugagccccuggagcuggagcaacugcagcagaaaguacgugaccgaguuccuggacaccggcuacggcgagugccugcuggacaagcccgacgaggagaucuacaaccugcccagcgagcugcccggcagcagauacgacggcaacaagcagugcgagcuggccuucggccccggcagccagaugugcccccacaucaacaucugcaugcaccuguggugcaccagcaccgagaagcugcacaagggcugcuucacccagcacgugccccccgccgacggcaccgacugcggccccggcaugcacugcagacacggccugugcgugaacaaggagaccgagaccagacccgugaacggcgaguggggccccugggagcccuacagcagcugcagcagaaccugcggcggcggcaucgagagcgccaccagaagaugcaacagacccgagcccagaaacggcggcaacuacugcgugggcagaagaaugaaguucagaagcugcaacaccgacagcugccccaagggcacccaggacuucagagagaagcagugcagcgacuucaacggcaagcaccuggacaucagcggcauccccagcaacgugagauggcugcccagauacagcggcaucggcaccaaggacagaugcaagcuguacugccagguggccggcaccaacuacuucuaccugcugaaggacaugguggaggacggcacccccugcggcaccgagacccacgacaucugcgugcagggccagugcauggccgccggcugcgaccacgugcugaacagcagcgccaagaucgacaagugcggcgugugcggcggcgacaacagcagcugcaagaccaucaccggcguguucaacagcagccacuacggcuacaacgugguggugaagauccccgccggcgccaccaacguggacaucagacaguacagcuacagcggccagcccgacgacagcuaccuggcccugagcgacgccgagggcaacuuccuguucaacggcaacuuccugcugagcaccagcaagaaggagaucaacgugcagggcaccagaaccgugaucgaguacagcggcagcaacaacgccguggagagaaucaacagcaccaacagacaggagaaggagcugauccugcaggugcugugcgugggcaaccuguacaaccccgacgugcacuacagcuucaacaucccccuggaggagagaagcgacauguucaccugggaccccuacggccccugggagggcugcaccaagaugugccagggccugcagagaagaaacaucaccugcauccacaagagcgaccacagcguggugagcgacaaggagugcgaccaccugccccugcccagcuucgugacccagagcugcaacaccgacugcgagcugagauggcacgugaucggcaagagcgagugcagcagccagugcggccagggcuacagaacccuggacauccacugcaugaaguacagcauccacgagggccagaccgugcagguggacgaccacuacugcggcgaccagcugaagccccccacccaggagcugugccacggcaacugcguguucaccagauggcacuacagcgaguggagccagugcagcagaagcugcggcggcggcgagagaagcagagagagcuacugcaugaacaacuucggccacagacuggccgacaacgagugccaggagcugagcagagugaccagagagaacugcaacgaguucagcugccccagcugggccgccagcgaguggagcgagugccuggugaccugcggcaagggcaccaagcagagacagguguggugccagcugaacguggaccaccugagcgacggcuucugcaacagcagcaccaagcccgagagccugagccccugcgagcugcacaccugcgccagcuggcaggugggccccuggggccccugcaccaccaccugcggccacggcuaccagaugagagacgugaagugcgugaacgagcuggccagcgccgugcuggaggacaccgagugccacgaggccagcagacccagcgacagacagagcugcgugcugacccccugcagcuucaucagcaagcuggagaccgcccugcugcccaccgugcugaucaagaagauggcccaguggagacacggcagcuggacccccugcagcgugagcugcggcagaggcacccaggccagauacgugagcugcagagacgcccuggacagaaucgccgacgagagcuacugcgcccaccugcccagacccgccgagaucugggacugcuucacccccugcggcgaguggcaggccggcgacuggagccccugcagcgccagcugcggccacggcaagaccaccagacaggugcugugcaugaacuaccaccagcccaucgacgagaacuacugcgaccccgaggugagaccccugauggagcaggagugcagccuggccgccugcccccccgcccacagccacuuccccagcagccccgugcagcccagcuacuaccugagcaccaaccugccccugacccagaagcuggaggacaacgagaaccagguggugcaccccagcgugagaggcaaccaguggagaaccggccccuggggcagcugcagcagcagcugcagcggcggccugcagcacagagccguggugugccaggacgagaacggccagagcgccagcuacugcgacgccgccagcaagccccccgagcugcagcagugcggccccggccccugcccccaguggaacuacggcaacuggggcgagugcagccagaccugcggcggcggcaucaagagcagacuggugaucugccaguuccccaacggccagauccuggaggaccacaacugcgagaucgugaacaagccccccagcgugauccagugccacaugcacgccugccccgccgacgugagcuggcaccaggagcccuggaccagcugcagcgccagcugcggcaagggcagaaaguacagagagguguucugcaucgaccaguuccagagaaagcuggaggacaccaacugcagccaggugcagaagccccccacccacaaggccugcagaagcgugagaugccccagcuggaaggccaacagcuggaacgagugcagcgugaccugcggcagcggcgugcagcagagagacguguacugcagacugaagggcgugggccaggugguggaggagaugugcgaccagagcaccagacccugcagccagagaagaugcuggagccaggacugcgugcagcacaagggcauggagagaggcagacugaacugcagcaccagcugcgagagaaaggacagccaccagagaauggagugcaccgacaaccagaucagacaggugaacgagaucguguacaacagcagcaccaucagccugaccagcaagaacugcagaaacccccccugcaacuacaucguggugaccgccgacagcagccagugcgccaacaacugcggcuucagcuacagacagagaaucaccuacugcaccgagauccccagcaccaagaagcacaagcugcacagacugagacccaucguguaccaggagugccccguggugcccagcagccagguguaccagugcaucaacagcugccugcaccuggccaccuggaaggugggcaaguggagcaagugcagcgugaccugcggcaucggcaucaugaagagacaggugaagugcaucaccaagcacggccugagcagcgaccugugccugaaccaccugaagcccggcgcccagaagaagugcuacgccaacgacugcaagagcuucaccaccugcaaggagauccaggugaagaaccacaucagaaaggacggcgacuacuaccugaacaucaagggcagaaucaucaagaucuacugcgccgacauguaccuggagaaccccaaggaguaccugacccuggugcagggcgaggagaacuucagcgagguguacggcuucagacugaagaaccccuaccagugccccuucaacggcagcagaagagaggacugcgagugcgacaacggccaccuggccgccggcuacaccguguucagcaagaucagaaucgaccugaccagcaugcagaucaagaccaccgaccugcuguucagcaagaccaucuucggcaacgccgugcccuucgccaccgccggcgacugcuacagcgccuucagaugcccccagggccaguucagcaucaaccugagcggcaccggcaugaagaucagcagcaccgccaaguggcugacccagggcagcuacaccagcgugagcaucagaagaagcgaggacggcaccagauucuucggcaagugcggcggcuacugcggcaagugccugccccacaugaccaccggccugcccauccaggugaucuaa

SEQ ID NO: 13275 - RNA, 3636 nt, Artificial Sequence
  ADAMTS2__Homo_sapiens__NP_055059
auggacccccccgccggcgccgccagaagacugcugugccccgcccugcugcugcugcugcugcugcugccccccccccugcugccccccccccccccccccgccaacgccagacuggccgccgccgccgacccccccggcggcccccugggccacggcgccgagagaauccuggccgugcccgugagaaccgacgcccagggcagacuggugagccacguggugagcgccgccaccagcagagccggcgugagagccagaagagccgcccccgugagaacccccagcuuccccggcggcaacgaggaggagcccggcagccaccuguucuacaacgugaccguguucggcagagaccugcaccugagacugagacccaacgccagacugguggcccccggcgccaccauggaguggcagggcgagaagggcaccaccagaguggagccccugcugggcagcugccuguacgugggcgacguggccggccuggccgaggccagcagcguggcccugagcaacugcgacggccuggccggccugaucagaauggaggaggaggaguucuucaucgagccccuggagaagggccuggccgcccaggaggccgagcagggcagagugcacgugguguacagaagaccccccaccagccccccccugggcggcccccaggcccuggacaccggcgccagccuggacagccuggacagccugagcagagcccugggcgugcuggaggagcacgccaacagcagcagaagaagagccagaagacacgccgccgacgacgacuacaacaucgaggugcugcugggcguggacgacagcguggugcaguuccacggcaaggagcacgugcagaaguaccugcugacccugaugaacaucgugaacgagaucuaccacgacgagagccugggcgcccacaucaacguggugcuggugagaaucauccugcugagcuacggcaagagcaugagccugaucgagaucggcaaccccagccagagccuggagaacgugugcagaugggccuaccugcagcagaagcccgacaccggccacgacgaguaccacgaccacgccaucuuccugaccagacaggacuucggccccagcggcaugcagggcuacgcccccgugaccggcaugugccaccccgugagaagcugcacccugaaccacgaggacggcuucagcagcgccuucgugguggcccacgagaccggccacgugcugggcauggagcacgacggccagggcaacagaugcggcgacgaggugagacugggcagcaucauggccccccuggugcaggccgccuuccacagauuccacuggagcagaugcagccagcaggagcugagcagauaccugcacagcuacgacugccugcuggacgaccccuucgcccacgacuggcccgcccugccccagcugcccggccugcacuacagcaugaacgagcagugcagauucgacuucggccugggcuacaugaugugcaccgccuucagaaccuucgaccccugcaagcagcuguggugcagccaccccgacaaccccuacuucugcaagaccaagaagggccccccccuggacggcaccaugugcgcccccggcaagcacugcuucaagggccacugcaucuggcugacccccgacauccugaagagagacggcagcuggggcgccuggagccccuucggcagcugcagcagaaccugcggcaccggcgugaaguucagaaccagacagugcgacaacccccaccccgccaacggcggcagaaccugcagcggccuggccuacgacuuccagcugugcagcagacaggacugccccgacagccuggccgacuucagagaggagcagugcagacagugggaccuguacuucgagcacggcgacgcccagcaccacuggcugccccacgagcacagagacgccaaggagagaugccaccuguacugcgagagcagagagaccggcgagguggugagcaugaagagaauggugcacgacggcaccagaugcagcuacaaggacgccuucagccugugcgugagaggcgacugcagaaaggugggcugcgacggcgugaucggcagcagcaagcaggaggacaagugcggcgugugcggcggcgacaacagccacugcaagguggugaagggcaccuucaccagaagccccaagaagcacggcuacaucaagauguucgagauccccgccggcgccagacaccugcugauccaggagguggacgccaccagccaccaccuggccgugaagaaccuggagaccggcaaguucauccugaacgaggagaacgacguggacgccagcagcaagaccuucaucgccaugggcguggagugggaguacagagacgaggacggcagagagacccugcagaccaugggcccccugcacggcaccaucaccgugcuggugauccccgugggcgacaccagagugagccugaccuacaaguacaugauccacgaggacagccugaacguggacgacaacaacgugcuggaggaggacagcgugguguacgagugggcccugaagaaguggagccccugcagcaagcccugcggcggcggcagccaguucaccaaguacggcugcagaagaagacuggaccacaagauggugcacagaggcuucugcgccgcccugagcaagcccaaggccaucagaagagccugcaacccccaggagugcagccagcccgugugggugaccggcgagugggagcccugcagccagaccugcggcagaaccggcaugcaggugagaagcgugagaugcauccagccccugcacgacaacaccaccagaagcgugcacgccaagcacugcaacgacgccagacccgagagcagaagagccugcagcagagagcugugccccggcagauggagagccggccccuggagccagugcagcgugaccugcggcaacggcacccaggagagacccgugcugugcagaaccgccgacgacagcuucggcaucugccaggaggagagacccgagaccgccagaaccugcagacugggccccugccccagaaacaucagcgaccccagcaagaagagcuacguggugcaguggcugagcagacccgaccccgacagccccaucagaaagaucagcagcaagggccacugccagggcgacaagagcaucuucugcagaauggaggugcugagcagauacugcagcauccccggcuacaacaagcugugcugcaagagcugcaaccuguacaacaaccugaccaacguggagggcagaaucgagcccccccccggcaagcacaacgacaucgacguguucaugcccacccugcccgugcccaccguggccauggaggugagacccagccccagcaccccccuggaggugccccugaacgccagcagcaccaacgccaccgaggaccaccccgagaccaacgccguggacgagcccuacaagauccacggccuggaggacgaggugcagccccccaaccugauccccagaagacccagccccuacgagaagaccagaaaccagagaauccaggagcugaucgacgagaugagaaagaaggagaugcugggcaaguucuaa

SEQ ID NO: 13276 - RNA, 3618 nt, Artificial Sequence
  ADAMTS3__Homo_sapiens__NP_055058
auggugcugcugagccuguggcugaucgccgccgcccugguggaggugagaaccagcgccgacggccaggccggcaacgaggagauggugcagaucgaccugcccaucaagagauacagagaguacgagcuggugacccccgugagcaccaaccuggagggcagauaccugagccacacccugagcgccagccacaagaagagaagcgccagagacgugagcagcaaccccgagcagcuguucuucaacaucaccgccuucggcaaggacuuccaccugagacugaagcccaacacccagcugguggcccccggcgccgugguggaguggcacgagaccagccuggugcccggcaacaucaccgaccccaucaacaaccaccagcccggcagcgccaccuacagaaucagaagaaccgagccccugcagaccaacugcgccuacgugggcgacaucguggacauccccggcaccagcguggccaucagcaacugcgacggccuggccggcaugaucaagagcgacaacgaggaguacuucaucgagccccuggagagaggcaagcagauggaggaggagaagggcagaauccacgugguguacaagagaagcgccguggagcaggcccccaucgacaugagcaaggacuuccacuacagagagagcgaccuggagggccuggacgaccugggcaccguguacggcaacauccaccagcagcugaacgagaccaugagaagaagaagacacgccggcgagaacgacuacaacaucgaggugcugcugggcguggacgacagcguggugagauuccacggcaaggagcacgugcagaacuaccugcugacccugaugaacaucgugaacgagaucuaccacgacgagagccugggcgugcacaucaacguggugcuggugagaaugaucaugcugggcuacgccaagagcaucagccugaucgagagaggcaaccccagcagaagccuggagaacgugugcagaugggccagccagcagcagagaagcgaccugaaccacagcgagcaccacgaccacgccaucuuccugaccagacaggacuucggccccgccggcaugcagggcuacgcccccgugaccggcaugugccaccccgugagaagcugcacccugaaccacgaggacggcuucagcagcgccuucgugguggcccacgagaccggccacgugcugggcauggagcacgacggccagggcaacagaugcggcgacgagaccgccaugggcagcgugauggccccccuggugcaggccgccuuccacagauaccacuggagcagaugcagcggccaggagcugaagagauacauccacagcuacgacugccugcuggacgaccccuucgaccacgacuggcccaagcugcccgagcugcccggcaucaacuacagcauggacgagcagugcagauucgacuucggcgugggcuacaagaugugcaccgccuucagaaccuucgaccccugcaagcagcuguggugcagccaccccgacaaccccuacuucugcaagaccaagaagggccccccccuggacggcaccgagugcgccgccggcaaguggugcuacaagggccacugcauguggaagaacgccaaccagcagaagcaggacggcaacuggggcagcuggaccaaguucggcagcugcagcagaaccugcggcaccggcgugagauucagaaccagacagugcaacaaccccaugcccaucaacggcggccaggacugccccggcgugaacuucgaguaccagcugugcaacaccgaggagugccagaagcacuucgaggacuucagagcccagcagugccagcagagaaacagccacuucgaguaccagaacaccaagcaccacuggcugcccuacgagcaccccgaccccaagaagagaugccaccuguacugccagagcaaggagaccggcgacguggccuacaugaagcagcuggugcacgacggcacccacugcagcuacaaggaccccuacagcaucugcgugagaggcgagugcgugaaggugggcugcgacaaggagaucggcagcaacaagguggaggacaagugcggcgugugcggcggcgacaacagccacugcagaaccgugaagggcaccuucaccagaacccccagaaagcugggcuaccugaagauguucgacaucccccccggcgccagacacgugcugauccaggaggacgaggccagcccccacauccuggccaucaagaaccaggccaccggccacuacauccugaacggcaagggcgaggaggccaagagcagaaccuucaucgaccugggcguggagugggacuacaacaucgaggacgacaucgagagccugcacaccgacggcccccugcacgaccccgugaucgugcugaucaucccccaggagaacgacaccagaagcagccugaccuacaaguacaucauccacgaggacagcgugcccaccaucaacagcaacaacgugauccaggaggagcuggacaccuucgagugggcccugaagagcuggagccagugcagcaagcccugcggcggcggcuuccaguacaccaaguacggcugcagaagaaagagcgacaacaagauggugcacagaagcuucugcgaggccaacaagaagcccaagcccaucagaagaaugugcaacauccaggagugcacccacccccuguggguggccgaggagugggagcacugcaccaagaccugcggcagcagcggcuaccagcugagaaccgugagaugccugcagccccugcuggacggcaccaacagaagcgugcacagcaaguacugcaugggcgacagacccgagagcagaagacccugcaacagagugcccugccccgcccaguggaagaccggccccuggagcgagugcagcgugaccugcggcgagggcaccgaggugagacaggugcugugcagagccggcgaccacugcgacggcgagaagcccgagagcgugagagccugccagcugccccccugcaacgacgagcccugccugggcgacaagagcaucuucugccagauggaggugcuggccagauacugcagcauccccggcuacaacaagcugugcugcgagagcugcagcaagagaagcagcacccugcccccccccuaccugcuggaggccgccgagacccacgacgacgugaucagcaaccccagcgaccugcccagaagccuggugaugcccaccagccuggugcccuaccacagcgagacccccgccaagaagaugagccugagcagcaucagcagcgugggcggccccaacgccuacgccgccuucagacccaacagcaagcccgacggcgccaaccugagacagagaagcgcccagcaggccggcagcaagaccgugagacuggugaccgugcccagcagcccccccaccaagagagugcaccugagcagcgccagccagauggccgccgccagcuucuucgccgccagcgacagcaucggcgccagcagccaggccagaaccagcaagaaggacggcaagaucaucgacaacagaagacccaccagaagcagcacccuggagagauaa

SEQ ID NO: 13277 - RNA, 2514 nt, Artificial Sequence
  ADAMTS4__Homo_sapiens__NP_005090
augagccagaccggcagccaccccggcagaggccuggccggcagauggcuguggggcgcccagcccugccugcugcugcccaucgugccccugagcuggcugguguggcugcugcugcugcugcuggccagccugcugcccagcgccagacuggccagcccccugcccagagaggaggagaucguguuccccgagaagcugaacggcagcgugcugcccggcagcggcgcccccgccagacugcugugcagacugcaggccuucggcgagacccugcugcuggagcuggagcaggacagcggcgugcagguggagggccugaccgugcaguaccugggccaggcccccgagcugcugggcggcgccgagcccggcaccuaccugaccggcaccaucaacggcgaccccgagagcguggccagccugcacugggacggcggcgcccugcugggcgugcugcaguacagaggcgccgagcugcaccugcagccccuggagggcggcacccccaacagcgccggcggccccggcgcccacauccugagaagaaagagccccgccagcggccagggccccaugugcaacgugaaggccccccugggcagccccagccccagacccagaagagccaagagauucgccagccugagcagauucguggagacccuggugguggccgacgacaagauggccgccuuccacggcgccggccugaagagauaccugcugaccgugauggccgccgccgccaaggccuucaagcaccccagcaucagaaaccccgugagccugguggugaccagacuggugauccugggcagcggcgaggagggcccccaggugggccccagcgccgcccagacccugagaagcuucugcgccuggcagagaggccugaacacccccgaggacagcgaccccgaccacuucgacaccgccauccuguucaccagacaggaccugugcggcgugagcaccugcgacacccugggcauggccgacgugggcaccgugugcgaccccgccagaagcugcgccaucguggaggacgacggccugcagagcgccuucaccgccgcccacgagcugggccacguguucaacaugcugcacgacaacagcaagcccugcaucagccugaacggcccccugagcaccagcagacacgugauggcccccgugauggcccacguggaccccgaggagcccuggagccccugcagcgccagauucaucaccgacuuccuggacaacggcuacggccacugccugcuggacaagcccgaggccccccugcaccugcccgugaccuuccccggcaaggacuacgacgccgacagacagugccagcugaccuucggccccgacagcagacacugcccccagcugcccccccccugcgccgcccuguggugcagcggccaccugaacggccacgccaugugccagaccaagcacagccccugggccgacggcacccccugcggccccgcccaggccugcaugggcggcagaugccugcacauggaccagcugcaggacuucaacaucccccaggccggcggcuggggccccuggggccccuggggcgacugcagcagaaccugcggcggcggcgugcaguucagcagcagagacugcaccagacccgugcccagaaacggcggcaaguacugcgagggcagaagaaccagauucagaagcugcaacaccgaggacugccccaccggcagcgcccugaccuucagagaggagcagugcgccgccuacaaccacagaaccgaccuguucaagagcuuccccggccccauggacugggugcccagauacaccggcguggccccccaggaccagugcaagcugaccugccaggcccaggcccugggcuacuacuacgugcuggagcccagagugguggacggcacccccugcagccccgacagcagcagcgugugcgugcagggcagaugcauccacgccggcugcgacagaaucaucggcagcaagaagaaguucgacaagugcauggugugcggcggcgacggcagcggcugcagcaagcagagcggcagcuucagaaaguucagauacggcuacaacaacguggugaccauccccgccggcgccacccacauccuggugagacagcagggcaaccccggccacagaagcaucuaccuggcccugaagcugcccgacggcagcuacgcccugaacggcgaguacacccugaugcccagccccaccgacguggugcugcccggcgccgugagccugagauacagcggcgccaccgccgccagcgagacccugagcggccacggcccccuggcccagccccugacccugcaggugcugguggccggcaacccccaggacaccagacugagauacagcuucuucgugcccagacccacccccagcacccccagacccaccccccaggacuggcugcacagaagagcccagauccuggagauccugagaagaagacccugggccggcagaaaguaa

SEQ ID NO: 13278 - RNA, 2793 nt, Artificial Sequence
  ADAMTS5__Homo_sapiens__NP_008969
augcugcugggcugggccagccugcugcugugcgccuucagacugccccuggccgccgugggccccgccgccacccccgcccaggacaaggccggccagccccccaccgccgccgccgccgcccagcccagaagaagacagggcgaggaggugcaggagagagccgagccccccggccacccccacccccuggcccagagaagaagaagcaagggccuggugcagaacaucgaccagcuguacagcggcggcggcaaggugggcuaccugguguacgccggcggcagaagauuccugcuggaccuggagagagacggcagcgugggcaucgccggcuucgugcccgccggcggcggcaccagcgcccccuggagacacagaagccacugcuucuacagaggcaccguggacggcagccccagaagccuggccguguucgaccugugcggcggccuggacggcuucuucgccgugaagcacgccagauacacccugaagccccugcugagaggccccugggccgaggaggagaagggcagaguguacggcgacggcagcgccagaauccugcacguguacaccagagagggcuucagcuucgaggcccugccccccagagccagcugcgagacccccgccagcacccccgaggcccacgagcacgcccccgcccacagcaaccccagcggcagagccgcccuggccagccagcugcuggaccagagcgcccugagccccgccggcggcagcggcccccagaccugguggagaagaagaagaagaagcaucagcagagccagacagguggagcugcugcugguggccgacgccagcauggccagacuguacggcagaggccugcagcacuaccugcugacccuggccagcaucgccaacagacuguacagccacgccagcaucgagaaccacaucagacuggccguggugaaggugguggugcugggcgacaaggacaagagccuggaggugagcaagaacgccgccaccacccugaagaacuucugcaaguggcagcaccagcacaaccagcugggcgacgaccacgaggagcacuacgacgccgccauccuguucaccagagaggaccugugcggccaccacagcugcgacacccugggcauggccgacgugggcaccaucugcagccccgagagaagcugcgccgugaucgaggacgacggccugcacgccgccuucaccguggcccacgagaucggccaccugcugggccugagccacgacgacagcaaguucugcgaggagaccuucggcagcaccgaggacaagagacugaugagcagcauccugaccagcaucgacgccagcaagcccuggagcaagugcaccagcgccaccaucaccgaguuccuggacgacggccacggcaacugccugcuggaccugcccagaaagcagauccugggccccgaggagcugcccggccagaccuacgacgccacccagcagugcaaccugaccuucggccccgaguacagcgugugccccggcauggacgugugcgccagacuguggugcgccguggugagacagggccagauggugugccugaccaagaagcugcccgccguggagggcacccccugcggcaagggcagaaucugccugcagggcaagugcguggacaagaccaagaagaaguacuacagcaccagcagccacggcaacuggggcagcuggggcagcuggggccagugcagcagaagcugcggcggcggcgugcaguucgccuacagacacugcaacaaccccgcccccagaaacaacggcagauacugcaccggcaagagagccaucuacagaagcugcagccugaugcccugcccccccaacggcaagagcuucagacacgagcagugcgaggccaagaacggcuaccagagcgacgccaagggcgugaagaccuucguggagugggugcccaaguacgccggcgugcugcccgccgacgugugcaagcugaccugcagagccaagggcaccggcuacuacgugguguucagccccaaggugaccgacggcaccgagugcagacuguacagcaacagcgugugcgugagaggcaagugcgugagaaccggcugcgacggcaucaucggcagcaagcugcaguacgacaagugcggcgugugcggcggcgacaacagcagcugcaccaagaucgugggcaccuucaacaagaagagcaagggcuacaccgacguggugagaauccccgagggcgccacccacaucaaggugagacaguucaaggccaaggaccagaccagauucaccgccuaccuggcccugaagaagaagaacggcgaguaccugaucaacggcaaguacaugaucagcaccagcgagaccaucaucgacaucaacggcaccgugaugaacuacagcggcuggagccacagagacgacuuccugcacggcaugggcuacagcgccaccaaggagauccugaucgugcagauccuggccaccgaccccaccaagccccuggacgugagauacagcuucuucgugcccaagaagagcacccccaaggugaacagcgugaccagccacggcagcaacaaggugggcagccacaccagccagccccagugggugaccggccccuggcuggccugcagcagaaccugcgacaccggcuggcacaccagaaccgugcagugccaggacggcaacagaaagcuggccaagggcugcccccugagccagagacccagcgccuucaagcagugccugcugaagaagugcuaa

SEQ ID NO: 13279 - RNA, 3354 nt, Artificial Sequence
  ADAMTS6__Homo_sapiens__NP_922932
auggagauccuguggaagacccugaccuggauccugagccugaucauggccagcagcgaguuccacagcgaccacagacugagcuacagcagccaggaggaguuccugaccuaccuggagcacuaccagcugaccauccccaucagaguggaccagaacggcgccuuccugagcuucaccgugaagaacgacaagcacagcagaagaagaagaagcauggaccccaucgacccccagcaggccgugagcaagcuguucuucaagcugagcgccuacggcaagcacuuccaccugaaccugacccugaacaccgacuucgugagcaagcacuucaccguggaguacuggggcaaggacggcccccaguggaagcacgacuuccuggacaacugccacuacaccggcuaccugcaggaccagagaagcaccaccaagguggcccugagcaacugcgugggccugcacggcgugaucgccaccgaggacgaggaguacuucaucgagccccugaagaacaccaccgaggacagcaagcacuucagcuacgagaacggccacccccacgugaucuacaagaagagcgcccugcagcagagacaccuguacgaccacagccacugcggcgugagcgacuucaccagaagcggcaagcccugguggcugaacgacaccagcaccgugagcuacagccugcccaucaacaacacccacauccaccacagacagaagagaagcgugagcaucgagagauucguggagacccuggugguggccgacaagaugauggugggcuaccacggcagaaaggacaucgagcacuacauccugagcgugaugaacaucguggccaagcuguacagagacagcagccugggcaacguggugaacaucaucguggccagacugaucgugcugaccgaggaccagcccaaccuggagaucaaccaccacgccgacaagagccuggacagcuucugcaaguggcagaagagcauccugagccaccagagcgacggcaacaccauccccgagaacggcaucgcccaccacgacaacgccgugcugaucaccagauacgacaucugcaccuacaagaacaagcccugcggcacccugggccuggccagcguggccggcaugugcgagcccgagagaagcugcagcaucaacgaggacaucggccugggcagcgccuucaccaucgcccacgagaucggccacaacuucggcaugaaccacgacggcaucggcaacagcugcggcaccaagggccacgaggccgccaagcugauggccgcccacaucaccgccaacaccaaccccuucagcuggagcgccugcagcagagacuacaucaccagcuuccuggacagcggcagaggcaccugccuggacaacgagccccccaagagagacuuccuguaccccgccguggcccccggccagguguacgacgccgacgagcagugcagauuccaguacggcgccaccagcagacagugcaaguacggcgaggugugcagagagcuguggugccugagcaagagcaacagaugcgugaccaacagcauccccgccgccgagggcacccugugccagaccggcaacaucgagaagggcuggugcuaccagggcgacugcgugcccuucggcaccuggccccagagcaucgacggcggcuggggccccuggagccuguggggcgagugcagcagaaccugcggcggcggcgugagcagcagccugagacacugcgacagccccgcccccagcggcggcggcaaguacugccugggcgagagaaagagauacagaagcugcaacaccgaccccugcccccugggcagcagagacuucagagagaagcagugcgccgacuucgacaacaugcccuucagaggcaaguacuacaacuggaagcccuacaccggcggcggcgugaagcccugcgcccugaacugccuggccgagggcuacaacuucuacaccgagagagcccccgccgugaucgacggcacccagugcaacgccgacagccuggacaucugcaucaacggcgagugcaagcacgugggcugcgacaacauccugggcagcgacgccagagaggacagaugcagagugugcggcggcgacggcagcaccugcgacgccaucgagggcuucuucaacgacagccugcccagaggcggcuacauggagguggugcagauccccagaggcagcgugcacaucgaggugagagagguggccaugagcaagaacuacaucgcccugaagagcgagggcgacgacuacuacaucaacggcgccuggaccaucgacuggcccagaaaguucgacguggccggcaccgccuuccacuacaagagacccaccgacgagcccgagagccuggaggcccugggccccaccagcgagaaccugaucgugauggugcugcugcaggagcagaaccugggcaucagauacaaguucaacgugcccaucaccagaaccggcagcggcgacaacgaggugggcuucaccuggaaccaccagcccuggagcgagugcagcgccaccugcgccggcggcgugcagagacaggagguggugugcaagagacuggacgacaacagcaucgugcagaacaacuacugcgaccccgacagcaagccccccgagaaccagagagccugcaacaccgagcccugcccccccgagugguucaucggcgacuggcuggagugcagcaagaccugcgacggcggcaugagaaccagagccgugcugugcaucagaaagaucggccccagcgaggaggagacccuggacuacagcggcugccugacccacagacccguggagaaggagcccugcaacaaccagagcugccccccccaguggguggcccuggacuggagcgagugcacccccaagugcggccccggcuucaagcacagaaucgugcugugcaagagcagcgaccugagcaagaccuuccccgccgcccagugccccgaggagagcaagccccccgugagaaucagaugcagccugggcagaugccccccccccagaugggugaccggcgacuggggccagugcagcgcccagugcggccugggccagcagaugagaaccgugcagugccugagcuacaccggccaggccagcagcgacugccuggagaccgugagaccccccagcaugcagcagugcgagagcaagugcgacagcacccccaucagcaacaccgaggagugcaaggacgugaacaagguggccuacugcccccuggugcugaaguucaaguucugcagcagagccuacuucagacagaugugcugcaagaccugccagggccacuaa

SEQ ID NO: 13280 - RNA, 5061 nt, Artificial Sequence
  ADAMTS7__Homo_sapiens__NP_055087
augcccggcggccccagccccagaagccccgccccccugcugagaccccugcugcugcugcugugcgcccuggcccccggcgcccccggccccgcccccggcagagccaccgagggcagagccgcccuggacaucgugcaccccgugagaguggacgccggcggcagcuuccugagcuacgagcuguggcccagagcccugagaaagagagacgugagcgugagaagagacgcccccgccuucuacgagcugcaguacagaggcagagagcugagauucaaccugaccgccaaccagcaccugcuggcccccggcuucgugagcgagaccagaagaagaggcggccugggcagagcccacaucagagcccacacccccgccugccaccugcugggcgaggugcaggaccccgagcuggagggcggccuggccgccaucagcgccugcgacggccugaagggcguguuccagcugagcaacgaggacuacuucaucgagccccuggacagcgcccccgccagacccggccacgcccagccccacgugguguacaagagacaggcccccgagagacuggcccagagaggcgacagcagcgcccccagcaccugcggcgugcagguguaccccgagcuggagagcagaagagagagaugggagcagagacagcaguggagaagacccagacugagaagacugcaccagagaagcgugagcaaggagaaguggguggagacccuggugguggccgacgccaagaugguggaguaccacggccagccccagguggagagcuacgugcugaccaucaugaacaugguggccggccuguuccacgaccccagcaucggcaaccccauccacaucaccaucgugagacuggugcugcuggaggacgaggaggaggaccugaagaucacccaccacgccgacaacacccugaagagcuucugcaaguggcagaagagcaucaacaugaagggcgacgcccacccccugcaccacgacaccgccauccugcugaccagaaaggaccugugcgccgccaugaacagacccugcgagacccugggccugagccacguggccggcaugugccagccccacagaagcugcagcaucaacgaggacaccggccugccccuggccuucaccguggcccacgagcugggccacagcuucggcauccagcacgacggcagcggcaacgacugcgagcccgugggcaagagacccuucaucaugagcccccagcugcuguacgacgccgccccccugaccuggagcagaugcagcagacaguacaucaccagauuccuggacagaggcuggggccugugccuggacgacccccccgccaaggacaucaucgacuuccccagcgugccccccggcgugcuguacgacgugagccaccagugcagacugcaguacggcgccuacagcgccuucugcgaggacauggacaacgugugccacacccuguggugcagcgugggcaccaccugccacagcaagcuggacgccgccguggacggcaccagaugcggcgagaacaaguggugccugagcggcgagugcgugcccgugggcuucagacccgaggccguggacggcggcuggagcggcuggagcgccuggagcaucugcagcagaagcugcggcaugggcgugcagagcgccgagagacagugcacccagcccacccccaaguacaagggcagauacugcgugggcgagagaaagagauucagacugugcaaccugcaggccugccccgccggcagacccagcuucagacacgugcagugcagccacuucgacgccaugcuguacaagggccagcugcacaccugggugcccguggugaacgacgugaaccccugcgagcugcacugcagacccgccaacgaguacuucgccgagaagcugagagacgccgugguggacggcacccccugcuaccaggugagagccagcagagaccugugcaucaacggcaucugcaagaacgugggcugcgacuucgagaucgacagcggcgccauggaggacagaugcggcgugugccacggcaacggcagcaccugccacaccgugagcggcaccuucgaggaggccgagggccugggcuacguggacgugggccugauccccgccggcgccagagagaucagaauccaggagguggccgaggccgccaacuuccuggcccugagaagcgaggaccccgagaaguacuuccugaacggcggcuggaccauccaguggaacggcgacuaccagguggccggcaccaccuucaccuacgccagaagaggcaacugggagaaccugaccagccccggccccaccaaggagcccguguggauccagcugcuguuccaggagagcaaccccggcgugcacuacgaguacaccauccacagagaggccggcggccacgacgaggugcccccccccguguucagcuggcacuacggccccuggaccaagugcaccgugaccugcggcagaggcgugcagagacagaacguguacugccuggagagacaggccggccccguggacgaggagcacugcgacccccugggcagacccgacgaccagcagagaaagugcagcgagcagcccugccccgccagauggugggccggcgaguggcagcugugcagcagcagcugcggccccggcggccugagcagaagagccgugcugugcaucagaagcgugggccuggacgagcagagcgcccuggagccccccgccugcgagcaccugcccagaccccccaccgagacccccugcaacagacacgugcccugccccgccaccugggccgugggcaacuggagccagugcagcgugaccugcggcgagggcacccagagaagaaacgugcugugcaccaacgacaccggcgugcccugcgacgaggcccagcagcccgccagcgaggugaccugcagccugccccugugcagauggccccugggcacccugggccccgagggcagcggcagcggcagcagcagccacgagcuguucaacgaggccgacuucaucccccaccaccuggcccccagacccagccccgccagcagccccaagcccggcaccaugggcaacgccaucgaggaggaggcccccgagcuggaccugcccggccccguguucguggacgacuucuacuacgacuacaacuucaucaacuuccacgaggaccugagcuacggccccagcgaggagcccgaccuggaccuggccggcaccggcgacagaaccccccccccccacagccaccccgccgcccccagcaccggcagccccgugcccgccaccgagccccccgccgccaaggaggagggcgugcugggccccuggagccccagccccuggcccagccaggccggcagaagcccccccccccccagcgagcagacccccggcaacccccugaucaacuuccugcccgaggaggacacccccaucggcgcccccgaccugggccugcccagccugagcuggcccagagugagcaccgacggccugcagacccccgccacccccgagagccagaacgacuuccccgugggcaaggacagccagagccagcugcccccccccuggagagacagaaccaacgagguguucaaggacgacgaggagcccaagggcagaggcgccccccaccugccccccagacccagcagcacccugcccccccugagccccgugggcagcacccacagcagccccagccccgacguggccgagcuguggaccggcggcaccguggccugggagcccgcccuggagggcggccugggccccguggacagcgagcuguggcccaccgugggcguggccagccugcugcccccccccaucgccccccugcccgagaugaaggugagagacagcagccuggagcccggcacccccagcuuccccacccccggccccggcagcugggaccugcagaccguggccguguggggcaccuuccugcccaccacccugaccggccugggccacaugcccgagcccgcccugaaccccggccccaagggccagcccgagagccugagccccgaggugccccugagcagcagacugcugagcacccccgccugggacagccccgccaacagccacagagugcccgagacccagccccuggcccccagccuggccgaggccggcccccccgccgacccccugguggugagaaacgccggcuggcaggccggcaacuggagcgagugcagcaccaccugcggccugggcgccguguggagacccgugagaugcagcagcggcagagacgaggacugcgcccccgccggcagaccccagcccgccagaagaugccaccugagacccugcgccaccuggcacagcggcaacuggagcaagugcagcagaagcugcggcggcggcagcagcgugagagacgugcagugcguggacaccagagaccugagaccccugagacccuuccacugccagcccggccccgccaagccccccgcccacagacccugcggcgcccagcccugccugagcugguacaccagcagcuggagagagugcagcgaggccugcggcggcggcgagcagcagagacuggugaccugccccgagcccggccugugcgaggaggcccugagacccaacaccaccagacccugcaacacccaccccugcacccaguggguggugggccccuggggccagugcagcggccccugcggcggcggcgugcagagaagacuggugaagugcgugaacacccagaccggccugcccgaggaggacagcgaccagugcggccacgaggccuggcccgagagcagcagacccugcggcaccgaggacugcgagcccguggagccccccagaugcgagagagacagacugagcuucggcuucugcgagacccugagacugcugggcagaugccagcugcccaccaucagaacccagugcugcagaagcugcagcccccccagccacggcgcccccagcagaggccaccagagaguggccagaagauaa

SEQ ID NO: 13281 - RNA, 2670 nt, Artificial Sequence
  ADAMTS8__Homo_sapiens__NP_008968
augcugcccgcccccgccgcccccagauggcccccccugcugcugcugcugcugcugcugcugccccuggccagaggcgcccccgccagacccgccgccggcggccaggccagcgagcugguggugcccaccagacugcccggcagcgccggcgagcuggcccugcaccugagcgccuucggcaagggcuucgugcugagacuggcccccgacgacagcuuccuggcccccgaguucaagaucgagagacugggcggcagcggcagagccaccggcggcgagagaggccugagaggcugcuucuucagcggcaccgugaacggcgagcccgagagccuggccgccgugagccugugcagaggccugagcggcagcuuccugcuggacggcgaggaguucaccauccagccccagggcgccggcggcagccuggcccagccccacagacugcagagauggggccccgccggcgccagaccccugcccagaggccccgagugggagguggagaccggcgagggccagagacaggagagaggcgaccaccaggaggacagcgaggaggagagccaggaggaggaggccgagggcgccagcgagcccccccccccccugggcgccaccagcagaaccaagagauucgugagcgaggccagauucguggagacccugcugguggccgacgccagcauggccgccuucuacggcgccgaccugcagaaccacauccugacccugaugagcguggccgccagaaucuacaagcaccccagcaucaagaacagcaucaaccugaugguggugaaggugcugaucguggaggacgagaaguggggccccgaggugagcgacaacggcggccugacccugagaaacuucugcaacuggcagagaagauucaaccagcccagcgacagacaccccgagcacuacgacaccgccauccugcugaccagacagaacuucugcggccaggagggccugugcgacacccugggcguggccgacaucggcaccaucugcgaccccaacaagagcugcagcgugaucgaggacgagggccugcaggccgcccacacccuggcccacgagcugggccacgugcugagcaugccccacgacgacagcaagcccugcaccagacuguucggccccaugggcaagcaccacgugauggccccccuguucgugcaccugaaccagacccugcccuggagccccugcagcgccauguaccugaccgagcugcuggacggcggccacggcgacugccugcuggacgcccccgccgccgcccugccccugcccaccggccugcccggcagaauggcccuguaccagcuggaccagcagugcagacagaucuucggccccgacuucagacacugccccaacaccagcgcccaggacgugugcgcccagcuguggugccacaccgacggcgccgagccccugugccacaccaagaacggcagccugcccugggccgacggcacccccugcggccccggccaccugugcagcgagggcagcugccugcccgaggaggagguggagagacccaagcccguggccgacggcggcugggcccccuggggccccuggggcgagugcagcagaaccugcggcggcggcgugcaguucagccacagagagugcaaggaccccgagccccagaacggcggcagauacugccugggcagaagagccaaguaccagagcugccacaccgaggagugcccccccgacggcaagagcuucagagagcagcagugcgagaaguacaacgccuacaacuacaccgacauggacggcaaccugcugcagugggugcccaaguacgccggcgugagccccagagacagaugcaagcuguucugcagagccagaggcagaagcgaguucaagguguucgaggccaaggugaucgacggcacccugugcggccccgagacccuggccaucugcgugagaggccagugcgugaaggccggcugcgaccacgugguggacagccccagaaagcuggacaagugcggcgugugcggcggcaagggcaacagcugcagaaaggugagcggcagccugacccccaccaacuacggcuacaacgacaucgugaccauccccgccggcgccaccaacaucgacgugaagcagagaagccaccccggcgugcagaacgacggcaacuaccuggcccugaagaccgccgacggccaguaccugcugaacggcaaccuggccaucagcgccaucgagcaggacauccuggugaagggcaccauccugaaguacagcggcagcaucgccacccuggagagacugcagagcuucagaccccugcccgagccccugaccgugcagcugcugaccgugcccggcgagguguucccccccaaggugaaguacaccuucuucgugcccaacgacguggacuucagcaugcagagcagcaaggagagagccaccaccaacaucauccagccccugcugcacgcccagugggugcugggcgacuggagcgagugcagcagcaccugcggcgccggcuggcagagaagaaccguggagugcagagaccccagcggccaggccagcgccaccugcaacaaggcccugaagcccgaggacgccaagcccugcgagagccagcugugcccccuguaa

SEQ ID NO: 13282 - RNA, 5808 nt, Artificial Sequence
  ADAMTS9__Homo_sapiens__NP_891550
augcaguucgugagcugggccacccugcugacccugcuggugagagaccuggccgagaugggcagccccgacgccgccgccgccgugagaaaggacagacugcaccccagacaggugaagcugcuggagacccugagcgaguacgagaucgugagccccaucagagugaacgcccugggcgagcccuuccccaccaacgugcacuucaagagaaccagaagaagcaucaacagcgccaccgaccccuggcccgccuucgccagcagcagcagcagcagcaccagcagccaggcccacuacagacugagcgccuucggccagcaguuccuguucaaccugaccgccaacgccggcuucaucgccccccuguucaccgugacccugcugggcacccccggcgugaaccagaccaaguucuacagcgaggaggaggccgagcugaagcacugcuucuacaagggcuacgugaacaccaacagcgagcacaccgccgugaucagccugugcagcggcaugcugggcaccuucagaagccacgacggcgacuacuucaucgagccccugcagagcauggacgagcaggaggacgaggaggagcagaacaagccccacaucaucuacagaagaagcgccccccagagagagcccagcaccggcagacacgccugcgacaccagcgagcacaagaacagacacagcaaggacaagaagaagaccagagccagaaaguggggcgagagaaucaaccuggccggcgacguggccgcccugaacagcggccuggccaccgaggccuucagcgccuacggcaacaagaccgacaacaccagagagaagagaacccacagaagaaccaagagauuccugagcuaccccagauucguggaggugcuggugguggccgacaacagaauggugagcuaccacggcgagaaccugcagcacuacauccugacccugaugagcaucguggccagcaucuacaaggaccccagcaucggcaaccugaucaacaucgugaucgugaaccugaucgugauccacaacgagcaggacggccccagcaucagcuucaacgcccagaccacccugaagaacuucugccaguggcagcacagcaagaacagccccggcggcauccaccacgacaccgccgugcugcugaccagacaggacaucugcagagcccacgacaagugcgacacccugggccuggccgagcugggcaccaucugcgaccccuacagaagcugcagcaucagcgaggacagcggccugagcaccgccuucaccaucgcccacgagcugggccacguguucaacaugccccacgacgacaacaacaagugcaaggaggagggcgugaagagcccccagcacgugauggcccccacccugaacuucuacaccaaccccuggauguggagcaagugcagcagaaaguacaucaccgaguuccuggacaccggcuacggcgagugccugcugaacgagcccgagagcagacccuacccccugcccgugcagcugcccggcauccuguacaacgugaacaagcagugcgagcugaucuucggccccggcagccaggugugccccuacaugaugcagugcagaagacuguggugcaacaacgugaacggcgugcacaagggcugcagaacccagcacacccccugggccgacggcaccgagugcgagcccggcaagcacugcaaguacggcuucugcgugcccaaggagauggacgugcccgugaccgacggcagcuggggcagcuggagccccuucggcaccugcagcagaaccugcggcggcggcaucaagaccgccaucagagagugcaacagacccgagcccaagaacggcggcaaguacugcgugggcagaagaaugaaguucaagagcugcaacaccgagcccugccugaagcagaagagagacuucagagacgagcagugcgcccacuucgacggcaagcacuucaacaucaacggccugcugcccaacgugagaugggugcccaaguacagcggcauccugaugaaggacagaugcaagcuguucugcagaguggccggcaacaccgccuacuaccagcugagagacagagugaucgacggcacccccugcggccaggacaccaacgacaucugcgugcagggccugugcagacaggccggcugcgaccacgugcugaacagcaaggccagaagagacaagugcggcgugugcggcggcgacaacagcagcugcaagaccguggccggcaccuucaacaccgugcacuacggcuacaacaccguggugagaauccccgccggcgccaccaacaucgacgugagacagcacagcuucagcggcgagaccgacgacgacaacuaccuggcccugagcagcagcaagggcgaguuccugcugaacggcaacuucguggugaccauggccaagagagagaucagaaucggcaacgccgugguggaguacagcggcagcgagaccgccguggagagaaucaacagcaccgacagaaucgagcaggagcugcugcugcaggugcugagcgugggcaagcuguacaaccccgacgugagauacagcuucaacauccccaucgaggacaagccccagcaguucuacuggaacagccacggccccuggcaggccugcagcaagcccugccagggcgagagaaagagaaagcuggugugcaccagagagagcgaccagcugaccgugagcgaccagagaugcgacagacugccccagcccggccacaucaccgagcccugcggcaccgacugcgaccugagauggcacguggccagcagaagcgagugcagcgcccagugcggccugggcuacagaacccuggacaucuacugcgccaaguacagcagacuggacggcaagaccgagaagguggacgacggcuucugcagcagccaccccaagcccagcaacagagagaagugcagcggcgagugcaacaccggcggcuggagauacagcgccuggaccgagugcagcaagagcugcgacggcggcacccagagaagaagagccaucugcgugaacaccagaaacgacgugcuggacgacagcaagugcacccaccaggagaaggugaccauccagagaugcagcgaguuccccugcccccaguggaagagcggcgacuggagcgagugccuggugaccugcggcaagggccacaagcacagacagguguggugccaguucggcgaggacagacugaacgacagaaugugcgaccccgagaccaagcccaccagcaugcagaccugccagcagcccgagugcgccagcuggcaggccggccccuggggccagugcagcgugaccugcggccagggcuaccagcugagagccgugaagugcaucaucggcaccuacaugagcgugguggacgacaacgacugcaacgccgccaccagacccaccgacacccaggacugcgagcugcccagcugccaccccccccccgccgcccccgagaccagaagaagcaccuacagcgcccccagaacccaguggagauucggcagcuggacccccugcagcgccaccugcggcaagggcaccagaaugagauacgugagcugcagagacgagaacggcagcguggccgacgagagcgccugcgccacccugcccagacccguggccaaggaggagugcagcgugacccccugcggccaguggaaggcccuggacuggagcagcugcagcgugaccugcggccagggcagagccaccagacaggugaugugcgugaacuacagcgaccacgugaucgacagaagcgagugcgaccaggacuacauccccgagaccgaccaggacugcagcaugagccccugcccccagagaacccccgacagcggccuggcccagcaccccuuccagaacgaggacuacagacccagaagcgccagccccagcagaacccacgugcugggcggcaaccaguggagaaccggccccuggggcgccugcagcagcaccugcgccggcggcagccagagaagagugguggugugccaggacgagaacggcuacaccgccaacgacugcguggagagaaucaagcccgacgagcagagagccugcgagagcggccccugcccccagugggccuacggcaacuggggcgagugcaccaagcugugcggcggcggcaucagaaccagacugguggugugccagagaagcaacggcgagagauuccccgaccugagcugcgagauccuggacaagccccccgacagagagcagugcaacacccacgccugcccccacgacgccgccuggagcaccggccccuggagcagcugcagcgugagcugcggcagaggccacaagcagagaaacguguacugcauggccaaggacggcagccaccuggagagcgacuacugcaagcaccuggccaagccccacggccacagaaagugcagaggcggcagaugccccaaguggaaggccggcgccuggagccagugcagcgugagcugcggcagaggcgugcagcagagacacgugggcugccagaucggcacccacaagaucgccagagagaccgagugcaaccccuacaccagacccgagagcgagagagacugccagggccccagaugcccccuguacaccuggagagccgaggaguggcaggagugcaccaagaccugcggcgagggcagcagauacagaaagguggugugcguggacgacaacaagaacgaggugcacggcgccagaugcgacgugagcaagagacccguggacagagagagcugcagccugcagcccugcgaguacguguggaucaccggcgaguggagcgagugcagcgugaccugcggcaagggcuacaagcagagacuggugagcugcagcgagaucuacaccggcaaggagaacuacgaguacagcuaccagaccaccaucaacugccccggcacccagccccccagcgugcaccccugcuaccugagagacugccccgugagcgccaccuggagagugggcaacuggggcagcugcagcgugagcugcggcgugggcgugaugcagagaagcgugcagugccugaccaacgaggaccagcccagccaccugugccacaccgaccugaagcccgaggagagaaagaccugcagaaacguguacaacugcgagcugccccagaacugcaaggaggugaagagacugaagggcgccagcgaggacggcgaguacuuccugaugaucagaggcaagcugcugaagaucuucugcgccggcaugcacagcgaccaccccaaggaguacgugacccuggugcacggcgacagcgagaacuucagcgagguguacggccacagacugcacaaccccaccgagugccccuacaacggcagcagaagagacgacugccagugcagaaaggacuacaccgccgccggcuucagcagcuuccagaagaucagaaucgaccugaccagcaugcagaucaucaccaccgaccugcaguucgccagaaccagcgagggccaccccgugcccuucgccaccgccggcgacugcuacagcgccgccaagugcccccagggcagauucagcaucaaccuguacggcaccggccugagccugaccgagagcgccagauggaucagccagggcaacuacgccgugagcgacaucaagaagagccccgacggcaccagaguggugggcaagugcggcggcuacugcggcaagugcacccccagcagcggcaccggccuggaggugagagugcuguaa

SEQ ID NO: 13283 - RNA, 5289 nt, Artificial Sequence
  ADAMTSL1__Homo_sapiens__NP_001035362
auggagugcugcagaagagccacccccggcacccugcugcuguuccuggccuuccugcugcugagcagcagaaccgccagaagcgaggaggacagagacggccugugggacgccuggggccccuggagcgagugcagcagaaccugcggcggcggcgccagcuacagccugagaagaugccugagcagcaagagcugcgagggcagaaacaucagauacagaaccugcagcaacguggacugcccccccgaggccggcgacuucagagcccagcagugcagcgcccacaacgacgugaagcaccacggccaguucuacgaguggcugcccgugagcaacgaccccgacaaccccugcagccugaagugccaggccaagggcaccacccuggugguggagcuggcccccaaggugcuggacggcaccagaugcuacaccgagagccuggacaugugcaucagcggccugugccagaucgugggcugcgaccaccagcugggcagcaccgugaaggaggacaacugcggcgugugcaacggcgacggcagcaccugcagacuggugagaggccaguacaagagccagcugagcgccaccaagagcgacgacaccgugguggccauccccuacggcagcagacacaucagacuggugcugaagggccccgaccaccuguaccuggagaccaagacccugcagggcaccaagggcgagaacagccugagcagcaccggcaccuuccugguggacaacagcagcguggacuuccagaaguuccccgacaaggagauccugagaauggccggcccccugaccgccgacuucaucgugaagaucagaaacagcggcagcgccgacagcaccgugcaguucaucuucuaccagcccaucauccacagauggagagagaccgacuucuuccccugcagcgccaccugcggcggcggcuaccagcugaccagcgccgagugcuacgaccugagaagcaacagagugguggccgaccaguacugccacuacuaccccgagaacaucaagcccaagcccaagcugcaggagugcaaccuggaccccugccccgccagcgacggcuacaagcagaucaugcccuacgaccuguaccacccccugcccagaugggaggccacccccuggaccgccugcagcagcagcugcggcggcggcauccagagcagagccgugagcugcguggaggaggacauccagggccacgugaccagcguggaggaguggaagugcauguacacccccaagaugcccaucgcccagcccugcaacaucuucgacugccccaaguggcuggcccaggaguggagccccugcaccgugaccugcggccagggccugagauacagaguggugcugugcaucgaccacagaggcaugcacaccggcggcugcagccccaagaccaagccccacaucaaggaggagugcaucgugcccacccccugcuacaagcccaaggagaagcugcccguggaggccaagcugcccugguucaagcaggcccaggagcuggaggagggcgccgccgugagcgaggagcccagcuucauccccgaggccuggagcgccugcaccgugaccugcggcgugggcacccaggugagaaucgugagaugccaggugcugcugagcuucagccagagcguggccgaccugcccaucgacgagugcgagggccccaagcccgccagccagagagccugcuacgccggccccugcagcggcgagauccccgaguucaaccccgacgagaccgacggccuguucggcggccugcaggacuucgacgagcuguacgacugggaguacgagggcuucaccaagugcagcgagagcugcggcggcggcgugcaggaggccguggugagcugccugaacaagcagaccagagagcccgccgaggagaaccugugcgugaccagcagaagacccccccagcugcugaagagcugcaaccuggaccccugccccgccagaugggagaucggcaaguggagccccugcagccugaccugcggcgugggccugcagaccagagacguguucugcagccaccugcugagcagagagaugaacgagaccgugauccuggccgacgagcugugcagacagcccaagcccagcaccgugcaggccugcaacagauucaacugcccccccgccugguaccccgcccaguggcagcccugcagcagaaccugcggcggcggcgugcagaagagagaggugcugugcaagcagagaauggccgacggcagcuuccuggagcugcccgagaccuucugcagcgccagcaagcccgccugccagcaggccugcaagaaggacgacugccccagcgaguggcugcugagcgacuggaccgagugcagcaccagcugcggcgagggcacccagaccagaagcgccaucugcagaaagaugcugaagaccggccugagcaccguggugaacagcacccugugccccccccugcccuucagcagcagcaucagacccugcaugcuggccaccugcgccagacccggcagacccagcaccaagcacagcccccacaucgccgccgccagaaagguguacauccagaccagaagacagagaaagcugcacuucguggugggcggcuucgccuaccugcugcccaagaccgccguggugcugagaugccccgccagaagagugagaaagccccugaucaccugggagaaggacggccagcaccugaucagcagcacccacgugaccguggcccccuucggcuaccugaagauccacagacugaagcccagcgacgccggcguguacaccugcagcgccggccccgccagagagcacuucgugaucaagcugaucggcggcaacagaaagcugguggccagaccccugagccccagaagcgaggaggaggugcuggccggcagaaagggcggccccaaggaggcccugcagacccacaagcaccagaacggcaucuucagcaacggcagcaaggccgagaagagaggccuggccgccaaccccggcagcagauacgacgaccuggugagcagacugcuggagcagggcggcuggcccggcgagcugcuggccagcugggaggcccaggacagcgccgagagaaacaccaccagcgaggaggaccccggcgccgagcaggugcugcugcaccugcccuucaccauggugaccgagcagagaagacuggacgacauccugggcaaccugagccagcagcccgaggagcugagagaccuguacagcaagcaccugguggcccagcuggcccaggagaucuucagaagccaccuggagcaccaggacacccugcugaagcccagcgagagaagaaccagccccgugacccugagcccccacaagcacgugagcggcuucagcagcagccugagaaccagcagcaccggcgacgccggcggcggcagcagaagaccccacagaaagcccaccauccugagaaagaucagcgccgcccagcagcugagcgccagcgagguggugacccaccugggccagaccguggcccuggccagcggcacccugagcgugcugcugcacugcgaggccaucggccaccccagacccaccaucagcugggccagaaacggcgaggaggugcaguucagcgacagaauccugcugcagcccgacgacagccugcagauccuggcccccguggaggccgacgugggcuucuacaccugcaacgccaccaacgcccugggcuacgacagcgugagcaucgccgugacccuggccggcaagccccuggugaagaccagcagaaugaccgugaucaacaccgagaagcccgccgugaccguggacaucggcagcaccaucaagaccgugcagggcgugaacgugaccaucaacugccagguggccggcgugcccgaggccgaggugaccugguucagaaacaagagcaagcugggcagcccccaccaccugcacgagggcagccugcugcugaccaacgugagcagcagcgaccagggccuguacagcugcagagccgccaaccugcacggcgagcugaccgagagcacccagcugcugauccuggaccccccccaggugcccacccagcuggaggacaucagagcccugcuggccgccaccggccccaaccugcccagcgugcugaccagcccccugggcacccagcuggugcuggaccccggcaacagcgcccugcugggcugccccaucaagggccaccccgugcccaacaucaccugguuccacggcggccagcccaucgugaccgccaccggccugacccaccacauccuggccgccggccagauccugcagguggccaaccugagcggcggcagccagggcgaguucagcugccuggcccagaacgaggccggcgugcugaugcagaaggccagccuggugauccaggacuacugguggagcguggacagacuggccaccugcagcgccagcugcggcaacagaggcgugcagcagcccagacugagaugccugcugaacagcaccgaggugaaccccgcccacugcgccggcaaggugagacccgccgugcagcccaucgccugcaacagaagagacugccccagcagauggauggugaccagcuggagcgccugcaccagaagcugcggcggcggcgugcagaccagaagagugaccugccagaagcugaaggccagcggcaucagcacccccgugagcaacgacaugugcacccagguggccaagagacccguggacacccaggccugcaaccagcagcugugcguggagugggccuucagcagcuggggccagugcaacggccccugcaucggcccccaccuggccgugcagcacagacagguguucugccagaccagagacggcaucacccugcccagcgagcagugcagcgcccugcccagacccgugagcacccagaacugcuggagcgaggccugcagcgugcacuggagagugagccuguggacccugugcaccgccaccugcggcaacuacggcuuccagagcagaagaguggagugcgugcacgccagaaccaacaaggccgugcccgagcaccugugcagcuggggccccagacccgccaacuggcagagaugcaacaucacccccugcgagaacauggagugcagagacaccaccagauacugcgagaaggugaagcagcugaagcugugccagcugagccaguucaagagcagaugcugcggcaccugcggcaaggccuaa

SEQ ID NO: 13284 - RNA, 2856 nt, Artificial Sequence
  ADAMTSL2__Homo_sapiens__NP_001138792
auggacggcagauggcagugcagcugcugggccugguuccugcuggugcuggccgugguggccggcgacaccgugagcaccggcagcaccgacaacagccccaccagcaacagccuggagggcggcaccgacgccaccgccuucugguggggcgaguggaccaaguggaccgccugcagcagaagcugcggcggcggcgugaccagccaggagagacacugccugcagcagagaagaaagagcgugcccggccccggcaacagaaccugcaccggcaccagcaagagauaccagcugugcagagugcaggagugcccccccgacggcagaagcuucagagaggagcagugcgugagcuucaacagccacguguacaacggcagaacccaccaguggaagccccuguaccccgacgacuacgugcacaucagcagcaagcccugcgaccugcacugcaccaccguggacggccagagacagcugauggugcccgccagagacggcaccagcugcaagcugaccgaccugagaggcgugugcgugagcggcaagugcgagcccaucggcugcgacggcgugcuguucagcacccacacccuggacaagugcggcaucugccagggcgacggcagcagcugcacccacgugaccggcaacuacagaaagggcaacgcccaccugggcuacagccuggugacccacauccccgccggcgccagagacauccagaucguggagagaaagaagagcgccgacgugcuggcccuggccgacgaggccggcuacuacuucuucaacggcaacuacaagguggacagccccaagaacuucaacaucgccggcaccguggugaaguacagaagacccauggacguguacgagaccggcaucgaguacaucguggcccagggccccaccaaccagggccugaacgugaugguguggaaccagaacggcaagagccccagcaucaccuucgaguacacccugcugcagcccccccacgagagcagaccccagcccaucuacuacggcuucagcgagagcgccgagagccagggccuggacggcgccggccugaugggcuucgugccccacaacggcagccuguacggccaggccagcagcgagagacugggccuggacaacagacuguucggccaccccggccuggacauggagcugggccccagccagggccaggagaccaacgaggugugcgagcaggccggcggcggcgccugcgagggcccccccagaggcaagggcuucagagacagaaacgugaccggcaccccccugaccggcgacaaggacgacgaggagguggacacccacuucgccagccaggaguucuucagcgccaacgccaucagcgaccagcugcugggcgccggcagcgaccugaaggacuucacccugaacgagaccgugaacagcaucuucgcccagggcgcccccagaagcagccuggccgagagcuucuucguggacuacgaggagaacgagggcgccggccccuaccugcugaacggcagcuaccuggagcugagcagcgacagaguggccaacagcagcagcgaggcccccuuccccaacgugagcaccagccugcugaccagcgccggcaacagaacccacaaggccagaaccagacccaaggccagaaagcagggcgugagccccgccgacauguacagauggaagcugagcagccacgagcccugcagcgccaccugcaccaccggcgugaugagcgccuacgccaugugcgugagauacgacggcguggagguggacgacagcuacugcgacgcccugaccagacccgagcccgugcacgaguucugcgccggcagagagugccagcccagaugggagaccagcagcuggagcgagugcagcagaaccugcggcgagggcuaccaguucagaguggugagaugcuggaagaugcugagccccggcuucgacagcagcguguacagcgaccugugcgaggccgccgaggccgugagacccgaggagagaaagaccugcagaaaccccgccugcggcccccagugggagaugagcgaguggagcgagugcaccgccaagugcggcgagagaagcguggugaccagagacaucagaugcagcgaggacgagaagcugugcgaccccaacaccagacccgugggcgagaagaacugcaccggcccccccugcgacagacaguggaccgugagcgacuggggccccugcagcggcagcugcggccagggcagaaccaucagacacguguacugcaagaccagcgacggcagaguggugcccgagagccagugccagauggagaccaagccccuggccauccaccccugcggcgacaagaacugccccgcccacuggcuggcccaggacugggagagaugcaacaccaccugcggcagaggcgugaagaagagacuggugcugugcauggagcuggccaacggcaagccccagaccagaagcggccccgagugcggccuggccaagaagccccccgaggagagcaccugcuucgagagacccugcuucaagugguacaccagccccuggagcgagugcaccaagaccugcggcgugggcgugagaaugagagacgugaagugcuaccagggcaccgacaucgugagaggcugcgacccccuggugaagcccgugggcagacaggccugcgaccugcagcccugccccaccgagccccccgacgacagcugccaggaccagcccggcaccaacugcgcccuggccaucaaggugaaccugugcggccacugguacuacagcaaggccugcugcagaagcugcagacccccccacagcuaa

SEQ ID NO: 13285 - RNA, 5076 nt, Artificial Sequence
  ADAMTSL3__Homo_sapiens__NP_997400
auggccagcuggaccagccccuggugggugcugaucggcaugguguucaugcacagcccccugccccagaccaccgccgagaagagccccggcgccuacuuccugcccgaguucgcccugagcccccagggcagcuuccuggaggacaccaccggcgagcaguuccugaccuacagauacgacgaccagaccagcagaaacaccagaagcgacgaggacaaggacggcaacugggacgccuggggcgacuggagcgacugcagcagaaccugcggcggcggcgccagcuacagccugagaagaugccugaccggcagaaacugcgagggccagaacaucagauacaagaccugcagcaaccacgacugcccccccgacgccgaggacuucagagcccagcagugcagcgccuacaacgacgugcaguaccagggccacuacuacgaguggcugcccagauacaacgaccccgccgcccccugcgcccugaagugccacgcccagggccagaaccuggugguggagcuggcccccaaggugcuggacggcaccagaugcaacaccgacagccuggacaugugcaucagcggcaucugccaggccgugggcugcgacagacagcugggcagcaacgccaaggaggacaacugcggcgugugcgccggcgacggcagcaccugcagacuggugagaggccagagcaagagccacgugagccccgagaagagagaggagaacgugaucgccgugccccugggcagcagaagcgugagaaucaccgugaagggccccgcccaccuguucaucgagagcaagacccugcagggcagcaagggcgagcacagcuucaacagccccggcguguuccugguggagaacaccaccguggaguuccagagaggcagcgagagacagaccuucaagauccccggcccccugauggccgacuucaucuucaagaccagauacaccgccgccaaggacagcguggugcaguucuucuucuaccagcccaucagccaccaguggagacagaccgacuucuuccccugcaccgugaccugcggcggcggcuaccagcugaacagcgccgagugcguggacaucagacugaagagaguggugcccgaccacuacugccacuacuaccccgagaacgugaagcccaagcccaagcugaaggagugcagcauggaccccugccccagcagcgacggcuucaaggagaucaugcccuacgaccacuuccagccccugcccagaugggagcacaaccccuggaccgccugcagcgugagcugcggcggcggcauccagagaagaagcuucgugugcguggaggagagcaugcacggcgagauccugcagguggaggaguggaagugcauguacgcccccaagcccaaggugaugcagaccugcaaccuguucgacugccccaaguggaucgccauggaguggagccagugcaccgugaccugcggcagaggccugagauacagaguggugcugugcaucaaccacagaggcgagcacgugggcggcugcaacccccagcugaagcugcacaucaaggaggagugcgugauccccauccccugcuacaagcccaaggagaagagccccguggaggccaagcugcccuggcugaagcaggcccaggagcuggaggagaccagaaucgccaccgaggagcccaccuucauccccgagcccuggagcgccugcagcaccaccugcggccccggcgugcaggugagagaggugaagugcagagugcugcugaccuucacccagaccgagaccgagcugcccgaggaggagugcgagggccccaagcugcccaccgagagacccugccugcuggaggccugcgacgagagccccgccagcagagagcuggacaucccccugcccgaggacagcgagaccaccuacgacugggaguacgccggcuucacccccugcaccgccaccugcgugggcggccaccaggaggccaucgccgugugccugcacauccagacccagcagaccgugaacgacagccugugcgacauggugcacagaccccccgccaugagccaggccugcaacaccgagcccugcccccccagauggcacgugggcagcuggggccccugcagcgccaccugcggcgugggcauccagaccagagacguguacugccugcaccccggcgagacccccgccccccccgaggagugcagagacgagaagccccacgcccugcaggccugcaaccaguucgacugcccccccggcuggcacaucgaggaguggcagcagugcagcagaaccugcggcggcggcacccagaacagaagagugaccugcagacagcugcugaccgacggcagcuuccugaaccugagcgacgagcugugccagggccccaaggccagcagccacaagagcugcgccagaaccgacugccccccccaccuggccgugggcgacuggagcaagugcagcgugagcugcggcgugggcauccagagaagaaagcaggugugccagagacuggccgccaagggcagaagaaucccccugagcgagaugaugugcagagaccugcccggccugccccuggugagaagcugccagaugcccgagugcagcaagaucaagagcgagaugaagaccaagcugggcgagcagggcccccagauccugagcgugcagagaguguacauccagaccagagaggagaagagaaucaaccugaccaucggcagcagagccuaccugcugcccaacaccagcgugaucaucaagugccccgugagaagauuccagaagagccugauccagugggagaaggacggcagaugccugcagaacagcaagagacugggcaucaccaagagcggcagccugaagauccacggccuggccgcccccgacaucggcguguacagaugcaucgccggcagcgcccaggagaccguggugcugaagcugaucggcaccgacaacagacugaucgccagacccgcccugagagagcccaugagagaguaccccggcauggaccacagcgaggccaacagccugggcgugaccuggcacaagaugagacagauguggaacaacaagaacgaccuguaccuggacgacgaccacaucagcaaccagcccuuccugagagcccugcugggccacugcagcaacagcgccggcagcaccaacagcugggagcugaagaacaagcaguucgaggccgccgugaagcagggcgccuacagcauggacaccgcccaguucgacgagcugaucagaaacaugagccagcugauggagaccggcgaggugagcgacgaccuggccagccagcugaucuaccagcugguggccgagcuggccaaggcccagcccacccacaugcaguggagaggcauccaggaggagaccccccccgccgcccagcugagaggcgagaccggcagcgugagccagagcagccacgccaagaacagcggcaagcugaccuucaagcccaagggccccgugcugaugagacagagccagccccccagcaucagcuucaacaagaccaucaacagcagaaucggcaacaccguguacaucaccaagagaaccgaggugaucaacauccugugcgaccugaucacccccagcgaggccaccuacaccuggaccaaggacggcacccugcugcagcccagcgugaagaucauccuggacggcaccggcaagauccagauccagaaccccaccagaaaggagcagggcaucuacgagugcagcguggccaaccaccugggcagcgacguggagagcagcagcgugcuguacgccgaggcccccgugauccugagcguggagagaaacaucaccaagcccgagcacaaccaccugagcgugguggugggcggcaucguggaggccgcccugggcgccaacgugaccaucagaugccccgugaagggcgugccccagcccaacaucaccuggcugaagagaggcggcagccugagcggcaacgugagccugcuguucaacggcagccugcugcugcagaacgugagccuggagaacgagggcaccuacgugugcaucgccaccaacgcccugggcaaggccguggccaccagcgugcugcaccugcuggagagaagauggcccgagagcagaaucguguuccugcagggccacaagaaguacauccugcaggccaccaacaccagaaccaacagcaacgaccccaccggcgagccccccccccaggagcccuucugggagcccggcaacuggagccacugcagcgccaccugcggccaccugggcgccagaauccagagaccccagugcgugauggccaacggccaggaggugagcgaggcccugugcgaccaccugcagaagccccuggccggcuucgagcccugcaacaucagagacugccccgccagaugguucaccagcguguggagccagugcagcgugagcugcggcgagggcuaccacagcagacaggugaccugcaagagaaccaaggccaacggcaccgugcagguggugagccccagagccugcgcccccaaggacagaccccugggcagaaagcccugcuucggccaccccugcgugcagugggagcccggcaacagaugccccggcagaugcaugggcagagccgugagaaugcagcagagacacaccgccugccagcacaacagcagcgacagcaacugcgacgacagaaagagacccacccugagaagaaacugcaccagcggcgccugcgacgugugcuggcacaccggccccuggaagcccugcaccgccgccugcggcagaggcuuccagagcagaaagguggacugcauccacaccagaagcugcaagcccguggccaagagacacugcgugcagaagaagaagcccaucagcuggagacacugccugggccccagcugcgacagagacugcaccgacaccacccacuacugcauguucgugaagcaccugaaccugugcagccuggacagauacaagcagagaugcugccagagcugccaggagggcuaa

SEQ ID NO: 13286 - RNA, 3393 nt, Artificial Sequence
  ADAMTSL4__Homo_sapiens__XP_011507946
augcuggcccccagaagagcccccagcacccccagaugccugagaagcuucugcgaccagagcgcccccgccagccccuggggcagcagaggcggcgccauggagaacuggaccggcagacccuggcuguaccugcugcugcugcugagccugccccagcugugccuggaccaggaggugcugagcggccacagccugcagacccccaccgaggagggccagggccccgagggcguguggggccccugggugcagugggccagcugcagccagcccugcggcgugggcgugcagagaagaagcagaaccugccagcugcccaccgugcagcugcaccccagccugccccugccccccagaccccccagacaccccgaggcccugcugcccagaggccagggccccagaccccagaccagccccgagacccugccccuguacagaacccagagcagaggcagaggcggcccccugagaggccccgccagccaccugggcagagaggagacccaggagaucagagccgccagaagaagcagacugagagaccccaucaagcccggcauguucggcuacggcagagugcccuucgcccugccccugcacagaaacagaagacaccccagaagcccccccagaagcgagcugagccugaucagcagcagaggcgaggaggccauccccagccccacccccagagccgagcccuucagcgccaacggcagcccccagaccgagcugccccccaccgagcugagcgugcacacccccagcccccaggccgagccccugagccccgagaccgcccagaccgagguggcccccagaaccagacccgccccccugagacaccaccccagagcccaggccagcggcaccgagccccccagccccacccacagccugggcgagggcggcuucuucagagccagcccccagcccagaagacccagcagccagggcugggccagcccccagguggccggcagaagacccgaccccuuccccagcgugcccagaggcagaggccagcagggccagggccccuggggcaccggcggcaccccccacggccccagacuggagcccgacccccagcaccccggcgccuggcugccccugcugagcaacggcccccacgccagcagccuguggagccuguucgcccccagcagccccauccccagaugcagcggcgagagcgagcagcugagagccugcagccaggcccccugcccccccgagcagcccgaccccagagcccugcagugcgccgccuucaacagccaggaguucaugggccagcuguaccagugggagcccuucaccgaggccccccugcugccccugagacacgccuucuuccugcugcccggcgccggcagcggcgacagcaccggcgugcagggcagccagagaugcgagcugaacugcagacccagaggcuucagauucuacgugagacacaccgagaaggugcaggacggcacccugugccagcccggcgcccccgacaucugcguggccggcagaugccugagccccggcugcgacggcauccugggcagcggcagaagacccgacggcugcggcgugugcggcggcgacgacagcaccugcagacuggugagcggcaaccugaccgacagaggcggcccccugggcuaccagaagauccuguggauccccgccggcgcccugagacugcagaucgcccagcugagacccagcagcaacuaccuggcccugagaggccccggcggcagaagcaucaucaacggcaacugggccguggacccccccggcagcuacagagccggcggcaccguguucagauacaacagaccccccagagaggagggcaagggcgagagccugagcgccgagggccccaccacccagcccguggacguguacaugaucuuccaggaggagaaccccggcguguucuaccaguacgugaucagcagccccccccccauccuggagaaccccacccccgagccccccgugccccagcugcagcccgagauccugagaguggagcccccccuggcccccgcccccagacccgccagaacccccggcacccugcagagacaggugagaaucccccagaugcccgcccccccccaccccagaaccccccugggcagccccgccgccuacuggaagagagugggccacagcgccugcagcgccagcugcggcaagggcguguggagacccaucuuccugugcaucagcagagagagcggcgaggagcuggacgagagaagcugcgccgccggcgccagaccccccgccagccccgagcccugccacggcacccccugcccccccuacugggaggccggcgaguggaccagcugcagcagaagcugcggccccggcacccagcacagacagcugcagugcagacaggaguucggcggcggcggcagcagcgugccccccgagagaugcggccaccugcccagacccaacaucacccagagcugccagcugagacugugcggccacugggaggugggcagccccuggagccagugcagcgugagaugcggcagaggccagagaagcagacaggugagaugcgugggcaacaacggcgacgaggugagcgagcaggagugcgccagcggccccccccagccccccagcagagaggccugcgacaugggccccugcaccaccgccugguuccacagcgacuggagcagcaagugcagcgccgagugcggcaccggcauccagagaagaagcguggugugccugggcagcggcgccgcccugggccccggccagggcgaggccggcgccggcaccggccagagcugccccaccggcagcagaccccccgacaugagagccugcagccugggccccugcgagagaaccuggagaugguacaccggccccuggggcgagugcagcagcgagugcggcagcggcacccagagaagagacaucaucugcgugagcaagcugggcaccgaguucaacgugaccagccccagcaacugcagccaccugcccagaccccccgcccugcagcccugccagggccaggccugccaggacagaugguucagcacccccuggagccccugcagcagaagcugccagggcggcacccagaccagagaggugcagugccugagcaccaaccagacccugagcaccagaugccccccccagcugagacccagcagaaagagacccugcaacagccagcccugcagccagagacccgacgaccagugcaaggacagcagcccccacugcccccugguggugcaggccagacugugcguguaccccuacuacaccgccaccugcugcagaagcugcgcccacgugcuggagagaagcccccaggaccccagcuaa

SEQ ID NO: 13287 - RNA, 1416 nt, Artificial Sequence
  ADAMTSL5__Homo_sapiens__NP_998769
auggacagcgccccccuguuccccagaccccaccuguuccagaaccugcugcuguuccugugggcccugcugaacugcggccugggcgugagcgcccagggccccggcgaguggacccccugggugagcuggaccagaugcagcagcagcugcggcagaggcgugagcgugagaagcagaagaugccugagacugcccggcgaggagcccugcuggggcgacagccacgaguacagacugugccagcugcccgacugcccccccggcgccgugcccuucagagaccugcagugcgcccuguacaacggcagacccgugcugggcacccagaagaccuaccagugggugcccuuccacggcgcccccaaccagugcgaccugaacugccuggccgagggccacgccuucuaccacagcuucggcagagugcuggacggcaccgccugcagccccggcgcccagggcgugugcguggccggcagaugccugagcgccggcugcgacggccugcugggcagcggcgcccuggaggacagaugcggcagaugcggcggcgccaacgacagcugccuguucgugcagagaguguucagagacgccggcgccuucgccggcuacuggaacgugacccugauccccgagggcgccagacacaucagaguggagcacagaagcagaaaccaccuggcccugaugggcggcgacggcagauacgugcugaacggccacuggguggugagcccccccggcaccuacgaggccgccggcacccacgugguguacaccagagacaccggcccccaggagacccugcaggccgccggccccaccagccacgaccugcugcugcaggugcugcugcaggagcccaaccccggcaucgaguucgaguucuggcugcccagagagagauacagccccuuccaggccagagugcaggcccugggcuggccccugagacagccccagcccagaggcguggagccccagccccccgccgcccccgccgugacccccgcccagacccccacccuggcccccgaccccugcccccccugccccgacaccagaggcagagcccacagacugcugcacuacugcggcagcgacuucguguuccaggccagagugcugggccaccaccaccaggcccaggagaccagauacgaggugagaauccagcugguguacaagaacagaagcccccugagagccagagaguacgugugggcccccggccacugccccugccccaugcuggccccccacagagacuaccugauggccgugcagagacuggugagccccgacggcacccaggaccagcugcugcugccccacgccggcuacgccagacccuggagccccgccgaggacagcagaaucagacugaccgccagaagaugccccggcuaa

SEQ ID NO: 13288 - RNA, 1158 nt, Artificial Sequence
  ADAP1__Homo_sapiens__NP_001271237
auguuccaguucguguucagcagaguguacugcaucaaccccgccagaagaaaguggaaggaguucgagaagaugcugggcugcgccgaggagggccacgccagccugggcagagaccccgacugggccagcuacacccugggcguguucaucugccugagcugcagcggcauccacagaaacaucccccaggugagcaaggugaagagcgugagacuggacgccugggaggaggcccagguggaguucauggccagccacggcaacgacgccgccagagccagauucgagagcaaggugcccagcuucuacuacagacccacccccagcgacugccagcugcugagagagcaguggaucagagccaaguacgagagacaggaguucaucuaccccgagaagcaggagcccuacagcgccggcuacagagagggcuuccuguggaagagaggcagagacaacggccaguuccugagcagaaaguucgugcugaccgagagagagggcgcccugaaguacuucaacagaaacgacgccaaggagcccaaggccgugaugaagaucgagcaccugaacgccaccuuccagcccgccaagaucggccacccccacggccugcaggugaccuaccugaaggacaacagcaccagaaacaucuucaucuaccacgaggacggcaaggagaucguggacugguucaacgcccugagagccgccagauuccacuaccugcagguggccuuccccggcgccagcgacgccgaccuggugcccaagcugagcagaaacuaccugaaggagggcuacauggagaagaccggccccaagcagaccgagggcuucagaaagagaugguucaccauggacgacagaagacugauguacuucaaggacccccuggacgccuucgccagaggcgagguguucaucggcagcaaggagagcggcuacaccgugcugcacggcuucccccccagcacccagggccaccacuggccccacggcaucaccaucgugacccccgacagaaaguuccuguucgccugcgagaccgagagcgaccagagagaguggguggccgccuuccagaaggccguggacagacccaugcugccccaggaguacgccguggaggcccacuucaagcacaagcccuaa

SEQ ID NO: 13289 - RNA, 1146 nt, Artificial Sequence
  ADAP2__Homo_sapiens__NP_060874
augggcgacagagagagaaacaagaagagacugcuggagcugcugagagcccccgacaccggcaacgcccacugcgccgacugcggcgccgccgaccccgacugggccagcuacaagcugggcaucuucaucugccugaacugcugcggcgugcacagaaacuuccccgacaucagcagagugaagagcgugagacuggacuucugggacgacagcaucguggaguucaugauccacaacggcaaccugagagugaaggccaaguucgaggccagagugcccgccuucuacuacaucccccaggccaacgacugccuggugcugaaggagcaguggaucagagccaaguacgagagaagagaguucauggccgacggcgagaccaucagccugcccggcaacagagagggcuuccuguggaagagaggcagagacaacagccaguuccugagaagaaaguucgugcugcuggccagagagggccugcugaaguacuucaccaaggagcagggcaagagccccaaggccgugaucagcaucaaggaccugaacgccaccuuccagaccgagaagaucggccacccccacggccugcagaucaccuacagaagagacggccacaccagaaaccuguucguguaccacgagagcggcaaggagaucguggacugguucaacgcccugagagccgccagacugcaguaccugaagauggccuuccccgagcugcccgagagcgagcuggugcccuuccugaccagaaacuaccugaagcagggcuucauggagaagaccggccccaagcagaaggagcccuucaagaagagaugguucgcccuggacugccacgagagaagacugcuguacuacaagaacccccuggacgccuucgagcagggccagguguuccugggcaacaaggagcagggcuacgaggccuacgaggaccugcccaagggcaucagaggcaacagauggaaggccggccugaccaucgugacccccgagagaagauucgugcugaccugccccagcgagaaggagcagcaggaguggcuggagagccugagaggcgugcugagcagcccccugaccccccugaacagacugaccgccagcaccgagagcggcagaagcagcagauaa

SEQ ID NO: 13290 - RNA, 2145 nt, Artificial Sequence
  ADARB1__Homo_sapiens__NP_056649
auggacaucgaggacgaggagaacaugagcagcagcagcaccgacgugaaggagaacagaaaccuggacaacgugagccccaaggacggcagcacccccggccccggcgagggcagccagcugagcaacggcggcggcggcggccccggcagaaagagaccccuggaggagggcagcaacggccacagcaaguacagacugaagaagagaagaaagacccccggccccgugcugcccaagaacgcccugaugcagcugaacgagaucaagcccggccugcaguacacccugcugagccagaccggccccgugcacgccccccuguucgugaugagcguggaggugaacggccagguguucgagggcagcggccccaccaagaagaaggccaagcugcacgccgccgagaaggcccugagaagcuucgugcaguuccccaacgccagcgaggcccaccuggccaugggcagaacccugagcgugaacaccgacuucaccagcgaccaggccgacuuccccgacacccuguucaacggcuucgagacccccgacaaggccgagccccccuucuacgugggcagcaacggcgacgacagcuucagcagcagcggcgaccugagccugagcgccagccccgugcccgccagccuggcccagcccccccugcccgugcugccccccuuccccccccccagcggcaagaaccccgugaugauccugaacgagcugagacccggccugaaguacgacuuccugagcgagagcggcgagagccacgccaagagcuucgugaugagcguggugguggacggccaguucuucgagggcagcggcagaaacaagaagcuggccaaggccagagccgcccagagcgcccuggccgccaucuucaaccugcaccuggaccagacccccagcagacagcccauccccagcgagggccugcagcugcaccugccccaggugcuggccgacgccgugagcagacuggugcugggcaaguucggcgaccugaccgacaacuucagcagcccccacgccagaagaaaggugcuggccggcguggugaugaccaccggcaccgacgugaaggacgccaaggugaucagcgugagcaccggcaccaagugcaucaacggcgaguacaugagcgacagaggccuggcccugaacgacugccacgccgagaucaucagcagaagaagccugcugagauuccuguacacccagcuggagcuguaccugaacaacaaggacgaccagaagagaagcaucuuccagaagagcgagagaggcggcuucagacugaaggagaacgugcaguuccaccuguacaucagcaccagccccugcggcgacgccagaaucuucagcccccacgagcccauccuggagggcagcagaagcuacacccaggccggcgugcaguggugcaaccacggcagccugcagcccagaccccccggccugcugagcgaccccagcaccagcaccuuccagggcgccggcaccaccgagcccgccgacagacaccccaacagaaaggccagaggccagcugagaaccaagaucgagagcggcgagggcaccauccccgugagaagcaacgccagcauccagaccugggacggcgugcugcagggcgagagacugcugaccaugagcugcagcgacaagaucgccagauggaacguggugggcauccagggcagccugcugagcaucuucguggagcccaucuacuucagcagcaucauccugggcagccuguaccacggcgaccaccugagcagagccauguaccagagaaucagcaacaucgaggaccugcccccccuguacacccugaacaagccccugcugagcggcaucagcaacgccgaggccagacagcccggcaaggcccccaacuucagcgugaacuggaccgugggcgacagcgccaucgaggugaucaacgccaccaccggcaaggacgagcugggcagagccagcagacugugcaagcacgcccuguacugcagauggaugagagugcacggcaaggugcccagccaccugcugagaagcaagaucaccaagcccaacguguaccacgagagcaagcuggccgccaaggaguaccaggccgccaaggugcacuaa

SEQ ID NO: 13291 - RNA, 2220 nt, Artificial Sequence
  ADARB2__Homo_sapiens__NP_061172
auggccagcgugcugggcagcggcagaggcagcggcggccugagcagccagcugaagugcaagagcaagagaagaagaagaagaagaagcaagagaaaggacaaggugagcauccugagcaccuuccuggcccccuucaagcaccugagccccggcaucaccaacaccgaggacgacgacacccugagcaccagcagcgccgaggugaaggagaacagaaacgugggcaaccuggccgccagacccccccccagcggcgacagagccagaggcggcgcccccggcgccaagagaaagagaccccuggaggagggcaacggcggccaccugugcaagcugcagcugguguggaagaagcugagcuggagcguggcccccaagaacgcccuggugcagcugcacgagcugagacccggccugcaguacagaaccgugagccagaccggccccgugcacgcccccguguucgccguggccguggaggugaacggccugaccuucgagggcaccggccccaccaagaagaaggccaagaugagagccgccgagcuggcccugagaagcuucgugcaguuccccaacgccugccaggcccaccuggccaugggcggcggccccggccccggcaccgacuucaccagcgaccaggccgacuuccccgacacccuguuccaggaguucgagccccccgcccccagacccggccuggccggcggcagacccggcgacgccgcccugcugagcgccgccuacggcagaagaagacugcugugcagagcccuggaccuggugggccccacccccgccacccccgccgcccccggcgagagaaaccccguggugcugcugaacagacugagagccggccugagauacgugugccuggccgagcccgccgagagaagagccagaagcuucgugauggccgugagcguggacggcagaaccuucgagggcagcggcagaagcaagaagcuggccagaggccaggccgcccaggccgcccugcaggagcuguucgacauccagaugcccggccacgcccccggcagagccagaagaacccccaugccccaggaguucgccgacagcaucagccagcuggugacccagaaguucagagaggugaccaccgaccugacccccaugcacgccagacacaaggcccuggccggcaucgugaugaccaagggccuggacgccagacaggcccaggugguggcccugagcagcggcaccaagugcaucagcggcgagcaccugagcgaccagggccugguggugaacgacugccacgccgaggugguggccagaagagccuuccugcacuuccuguacacccagcuggagcugcaccugagcaagagaagagaggacagcgagagaagcaucuucgugagacugaaggagggcggcuacagacugagagagaacauccuguuccaccuguacgugagcaccagccccugcggcgacgccagacugcacagccccuacgagaucaccaccgaccugcacagcagcaagcaccuggugagaaaguucagaggccaccugagaaccaagaucgagagcggcgagggcaccgugcccgugagaggccccagcgccgugcagaccugggacggcgugcugcugggcgagcagcugaucaccaugagcugcaccgacaagaucgccagauggaacgugcugggccugcagggcgcccugcugagccacuucguggagcccguguaccugcagagcaucguggugggcagccugcaccacaccggccaccuggccagagugaugagccacagaauggagggcgugggccagcugcccgccagcuacagacacaacagaccccugcugagcggcgugagcgacgccgaggccagacagcccggcaagagcccccccuucagcaugaacuggguggugggcagcgccgaccuggagaucaucaacgccaccaccggcagaagaagcugcggcggccccagcagacugugcaagcacgugcugagcgccagaugggccagacuguacggcagacugagcaccagaacccccagccccggcgacacccccagcauguacugcgaggccaagcugggcgcccacaccuaccagagcgugaagcagcagcuguucaaggccuuccagaaggccggccugggcaccugggugagaaagccccccgagcagcagcaguuccugcugacccuguaa

SEQ ID NO: 13292 - RNA, 2796 nt, Artificial Sequence
  ADAR__Homo_sapiens__NP_001020278
auggccgagaucaaggagaagaucugcgacuaccuguucaacgugagcgacagcagcgcccugaaccuggccaagaacaucggccugaccaaggccagagacaucaacgccgugcugaucgacauggagagacagggcgacguguacagacagggcaccaccccccccaucuggcaccugaccgacaagaagagagagagaaugcagaucaagagaaacaccaacagcgugcccgagaccgcccccgccgccauccccgagaccaagagaaacgccgaguuccugaccugcaacauccccaccagcaacgccagcaacaacauggugaccaccgagaagguggagaacggccaggagcccgugaucaagcuggagaacagacaggaggccagacccgagcccgccagacugaagccccccgugcacuacaacggccccagcaaggccggcuacguggacuucgagaacggccagugggccaccgacgacauccccgacgaccugaacagcaucagagccgcccccggcgaguucagagccaucauggagaugcccagcuucuacagccacggccugcccagaugcagccccuacaagaagcugaccgagugccagcugaagaaccccaucagcggccugcuggaguacgcccaguucgccagccagaccugcgaguucaacaugaucgagcagagcggccccccccacgagcccagauucaaguuccagguggugaucaacggcagagaguucccccccgccgaggccggcagcaagaagguggccaagcaggacgccgccaugaaggccaugaccauccugcuggaggaggccaaggccaaggacagcggcaagagcgaggagagcagccacuacagcaccgagaaggagagcgagaagaccgccgagagccagacccccacccccagcgccaccagcuucuucagcggcaagagccccgugaccacccugcuggagugcaugcacaagcugggcaacagcugcgaguucagacugcugagcaaggagggccccgcccacgagcccaaguuccaguacugcguggccgugggcgcccagaccuuccccagcgugagcgcccccagcaagaagguggccaagcagauggccgccgaggaggccaugaaggcccugcacggcgaggccaccaacagcauggccagcgacaaccagcccgagggcaugaucagcgagagccuggacaaccuggagagcaugaugcccaacaaggugagaaagaucggcgagcuggugagauaccugaacaccaaccccgugggcggccugcuggaguacgccagaagccacggcuucgccgccgaguucaagcugguggaccagagcggccccccccacgagcccaaguucguguaccaggccaaggugggcggcagaugguuccccgccgugugcgcccacagcaagaagcagggcaagcaggaggccgccgacgccgcccugagagugcugaucggcgagaacgagaaggccgagagaaugggcuucaccgaggugacccccgugaccggcgccagccugagaagaaccaugcugcugcugagcagaagccccgaggcccagcccaagacccugccccugaccggcagcaccuuccacgaccagaucgccaugcugagccacagaugcuucaacacccugaccaacagcuuccagcccagccugcugggcagaaagauccuggccgccaucaucaugaagaaggacagcgaggacaugggcgugguggugagccugggcaccggcaacagaugcgugaagggcgacagccugagccugaagggcgagaccgugaacgacugccacgccgagaucaucagcagaagaggcuucaucagauuccuguacagcgagcugaugaaguacaacagccagaccgccaaggacagcaucuucgagcccgccaagggcggcgagaagcugcagaucaagaagaccgugagcuuccaccuguacaucagcaccgcccccugcggcgacggcgcccuguucgacaagagcugcagcgacagagccauggagagcaccgagagcagacacuaccccguguucgagaaccccaagcagggcaagcugagaaccaagguggagaacggcgagggcaccauccccguggagagcagcgacaucgugcccaccugggacggcaucagacugggcgagagacugagaaccaugagcugcagcgacaagauccugagauggaacgugcugggccugcagggcgcccugcugacccacuuccugcagcccaucuaccugaagagcgugacccugggcuaccuguucagccagggccaccugaccagagccaucugcugcagagugaccagagacggcagcgccuucgaggacggccugagacaccccuucaucgugaaccaccccaaggugggcagagugagcaucuacgacagcaagagacagagcggcaagaccaaggagaccagcgugaacuggugccuggccgacggcuacgaccuggagauccuggacggcaccagaggcaccguggacggccccagaaacgagcugagcagagugagcaagaagaacaucuuccugcuguucaagaagcugugcagcuucagauacagaagagaccugcugagacugagcuacggcgaggccaagaaggccgccagagacuacgagaccgccaagaacuacuucaagaagggccugaaggacaugggcuacggcaacuggaucagcaagccccaggaggagaagaacuucuaccugugccccguguaa

SEQ ID NO: 13293 - RNA, 435 nt, Artificial Sequence
  ADAT2__Homo_sapiens__NP_001273188
augguguacaacaacgagguggugggcaagggcagaaacgaggugaaccagaccaagaacgccaccagacacgccgagaugguggccaucgaccaggugcuggacuggugcagacagagcggcaagagccccagcgagguguucgagcacaccgugcuguacgugaccguggagcccugcaucaugugcgccgccgcccugagacugaugaagaucccccuggugguguacggcugccagaacgagagauucggcggcugcggcagcgugcugaacaucgccagcgccgaccugcccaacaccggcagacccuuccagugcauccccggcuacagagccgaggaggccguggagaugcugaagaccuucuacaagcaggagaaccccaacgcccccaagagcaaggugagaaagaaggagugccagaagagcuaa

SEQ ID NO: 13294 - RNA, 1104 nt, Artificial Sequence
  ADAT3__Homo_sapiens__NP_612431
augauccugugcagcagacugugccugccccagagcgccagccugagaauggagcccgcccccggccugguggagcagcccaagugccuggaggccggcagccccgagcccgagcccgcccccuggcaggcccugcccgugcugagcgagaagcagagcggcgacguggagcuggugcuggccuacgccgcccccgugcuggacaagagacagaccagcagacugcugaaggaggugagcgcccugcacccccugcccgcccagccccaccugaagagagugagacccagcagagacgccggcagcccccacgcccuggagaugcugcugugccuggccggccccgccagcggccccagaagccuggccgagcugcugcccagacccgccguggaccccagaggccugggccagcccuuccuggugcccgugcccgccagacccccccugaccagaggccaguucgaggaggccagagcccacuggcccaccagcuuccacgaggacaagcaggugaccagcgcccuggccggcagacuguucagcacccaggagagagccgccaugcagagccacauggagagagccgugugggccgccagaagagccgccgccagaggccugagagccgugggcgccguggugguggaccccgccagcgacagagugcuggccaccggccacgacugcagcugcgccgacaacccccugcugcacgccgugauggugugcguggaccugguggccagaggccagggcagaggcaccuacgacuucagacccuuccccgccugcagcuucgcccccgccgccgccccccaggccgugagagccggcgccgugagaaagcuggacgccgacgaggacggccugcccuaccugugcaccggcuacgaccuguacgugaccagagagcccugcgccaugugcgccauggcccuggugcacgccagaauccugagaguguucuacggcgcccccagccccgacggcgcccugggcaccagauucagaauccacgccagacccgaccugaaccacagauuccagguguucagaggcgugcuggaggagcagugcagauggcuggaccccgacaccuaa

SEQ ID NO: 13295 - RNA, 1944 nt, Artificial Sequence
  ADCK3__Homo_sapiens__NP_064632
auggccgccauccugggcgacaccaucaugguggccaagggccuggugaagcugacccaggccgccguggagacccaccugcagcaccugggcaucggcggcgagcugaucauggccgccagagcccugcagagcaccgccguggagcagaucggcauguuccugggcaaggugcagggccaggacaagcacgaggaguacuucgccgagaacuucggcggccccgagggcgaguuccacuucagcgugccccacgccgccggcgccagcaccgacuucagcagcgccagcgcccccgaccagagcgccccccccagccugggccacgcccacagcgagggccccgcccccgccuacguggccagcggccccuucagagaggccggcuuccccggccaggccagcagcccccugggcagagccaacggcagacuguucgccaaccccagagacagcuucagcgccaugggcuuccagagaagauucuuccaccaggaccagagccccgugggcggccugaccgccgaggacaucgagaaggccagacaggccaaggccagacccgagaacaagcagcacaagcagacccugagcgagcacgccagagagagaaaggugcccgugaccagaaucggcagacuggccaacuucggcggccuggccgugggccugggcuucggcgcccuggccgagguggccaagaagagccugagaagcgaggaccccagcggcaagaaggccgugcugggcagcagccccuuccugagcgaggccaacgccgagagaaucgugagaacccugugcaaggugagaggcgccgcccugaagcugggccagaugcugagcauccaggacgacgccuucaucaacccccaccuggccaagaucuucgagagagugagacagagcgccgacuucaugccccugaagcagaugaugaagacccugaacaacgaccugggccccaacuggagagacaagcuggaguacuucgaggagagacccuucgccgccgccagcaucggccaggugcaccuggccagaaugaagggcggcagagagguggccaugaagauccaguaccccggcguggcccagagcaucaacagcgacgugaacaaccugauggccgugcugaacaugagcaacaugcugcccgagggccuguuccccgagcaccugaucgacgugcugagaagagagcuggcccuggagugcgacuaccagagagaggccgccugcgccagaaaguucagagaccugcugaagggccaccccuucuucuacgugcccgagaucguggacgagcugugcagcccccacgugcugaccaccgagcuggugagcggcuucccccuggaccaggccgagggccugagccaggagaucagaaacgagaucugcuacaacauccuggugcugugccugagagagcuguucgaguuccacuucaugcagaccgaccccaacuggagcaacuucuucuacgacccccagcagcacaagguggcccugcuggacuucggcgccaccagagaguacgacagaagcuucaccgaccuguacauccagaucaucagagccgccgccgacagagacagagagaccgugagagccaagagcaucgagaugaaguuccugaccggcuacgaggugaaggugauggaggacgcccaccuggacgccauccugauccugggcgaggccuucgccagcgacgagcccuucgacuucggcacccagagcaccaccgagaagauccacaaccugauccccgugaugcugagacacagacuggugcccccccccgaggagaccuacagccugcacagaaagaugggcggcagcuuccugaucugcagcaagcugaaggccagauuccccugcaaggccauguucgaggaggccuacagcaacuacugcaagagacaggcccagcaguaa

SEQ ID NO: 13296 - RNA, 1512 nt, Artificial Sequence
  ADCK4__Homo_sapiens__NP_001136027
auguggcugaaggugggcggccugcugagaggcaccggcggccagcugggccagaccgugggcuggcccugcggcgcccugggccccggcccccacagauggggccccugcggcggcagcugggcccagaaguucuaccaggacggccccggcagaggccugggcgaggaggacaucagaagagccagagaggccagacccagaaagacccccagaccccagcugagcgacagaagcagagagagaaaggugcccgccagcagaaucagcagacuggccaacuucggcggccuggccgugggccugggccugggcgugcuggccgagauggccaagaagagcaugcccggcggcagacugcagagcgacaacagcuucaucagcccccagcugcagcacaucuucgagagagugagacagagcgccgacuucaugcccagauggcagaugcugagagugcuggaggaggagcugggcagagacuggcaggccaagguggccagccuggaggaggugcccuucgccgccgccagcaucggccaggugcaccagggccugcugagagacggcaccgagguggccgugaagauccaguaccccggcaucgcccagagcauccagagcgacgugcagaaccugcuggccgugcugaagaugagcgccgcccugcccgccggccuguucgccgagcagagccugcaggcccugcagcaggagcuggccugggagugcgacuacagaagagaggccgccugcgcccagaacuucagacagcugcuggccaacgaccccuucuucagagugcccgccguggugaaggagcugugcaccaccagagugcugggcauggagcuggccggcggcgugccccuggaccagugccagggccugagccaggaccugagaaaccagaucugcuuccagcugcugacccugugccugagagagcuguucgaguucagauucaugcagaccgaccccaacugggccaacuuccuguacgacgccagcagccaccaggugacccugcuggacuucggcgccagcagagaguucggcaccgaguucaccgaccacuacaucgagguggugaaggccgccgccgacggcgacagagacugcgugcugcagaagagcagagaccugaaguuccugaccggcuucgagaccaaggccuucagcgacgcccacguggaggccgugaugauccugggcgagcccuucgccacccagggccccuacgacuucggcagcggcgagaccgccagaagaauccaggaccugauccccgugcugcugagacacagacugugccccccccccgaggagaccuacgcccugcacagaaagcuggccggcgccuuccuggccugcgcccaccugagagcccacaucgccugcagagaccuguuccaggacaccuaccacagauacugggccagcagacagcccgacgccgccaccgccggcagccugcccaccaagggcgacagcuggguggaccccagcuaa

SEQ ID NO: 13297 - RNA, 4374 nt, Artificial Sequence
  ADCY10__Homo_sapiens__NP_001161221
augcugguguucggcgacgagacccacagccacuuccuggugaucggccaggccguggacgacgugagacuggcccagaacauggcccagaugaacgacgugauccugagccccaacugcuggcagcugugcgacagaagcaugaucgagaucgagagcgugcccgaccagagagccgugaaggugaacuuccugaagcccccccccaacuucaacuucgacgaguucuucaccaagugcaccaccuucaugcacuacuaccccagcggcgagcacaagaaccugcugagacuggccugcacccugaagcccgaccccgagcuggagaugagccugcagaaguacgugauggagagcauccugaagcagaucgacaacaagcagcugcagggcuaccugagcgagcugagacccgugaccaucguguucgugaaccugauguucgaggaccaggacaaggccgaggagaucggccccgccauccaggacgccuacaugcacaucaccagcgugcugaagaucuuccagggccagaucaacaagguguucauguucgacaagggcugcagcuuccugugcguguucggcuuccccggcgagaaggugcccgacgagcugacccacgcccuggagugcgccauggacaucuucgacuucugcagccaggugcacaagauccagaccgugagcaucggcguggccagcggcaucguguucugcggcaucgugggccacaccgugagacacgaguacaccgugaucggccagaaggugaaccuggccgccagaaugaugauguacuaccccggcaucgugaccugcgacagcgugaccuacaacggcagcaaccugcccgccuacuucuucaaggagcugcccaagaaggugaugaagggcguggccgacagcggcccccuguaccaguacuggggcagaaccgagaaggugauguucggcauggccugccugaucugcaacagaaaggaggacuacccccugcugggcagaaacaaggagaucaacuacuucauguacaccaugaagaaguuccugaucagcaacagcagccaggugcugauguacgagggccugcccggcuacggcaagagccagauccugaugaagaucgaguaccuggcccagggcaagaaccacagaaucaucgccaucagccugaacaagaucagcuuccaccagaccuucuacaccauccagauguucauggccaacgugcugggccuggacaccugcaagcacuacaaggagagacagaccaaccugagaaacaaggugaugacccugcuggacgagaaguucuacugccugcugaacgacaucuuccacgugcaguuccccaucagcagagagaucagcagaaugagcacccugaagaagcagaagcagcuggagauccuguucaugaagauccugaagcugaucgugaaggaggagagaaucaucuucaucaucgacgaggcccaguucguggacagcaccagcuggagauucauggagaagcugaucagaacccugcccaucuucaucaucaugagccugugccccuucgugaacauccccugcgccgccgccagagccgugaucaagaacagaaacaccaccuacaucgugaucggcgccgugcagcccaacgacaucagcaacaagaucugccuggaccugaacgugagcugcaucagcaaggagcuggacagcuaccugggcgagggcagcugcggcauccccuucuacugcgaggagcugcugaagaaccuggagcaccacgaggugcugguguuccagcagaccgagagcgaggagaagaccaacagaaccuggaacaaccuguucaaguacagcaucaagcugaccgagaagcugaacauggugacccugcacagcgacaaggagagcgaggaggugugccaccugaccagcggcgugagacugaagaaccugagcccccccaccagccugaaggagaucagccugauccagcuggacagcaugagacugagccaccagaugcuggugagaugcgccgccaucaucggccugaccuucaccaccgagcugcuguucgagauccugcccugcuggaacaugaagaugaugaucaagacccuggccacccugguggagagcaacaucuucuacugcuucagaaacggcaaggagcugcagaaggcccugaagcagaacgaccccagcuucgaggugcacuacagaagccugagccugaagcccagcgagggcauggaccacggcgaggaggagcagcugagagagcuggagaacgaggugaucgagugccacagaaucagauucugcaaccccaugaugcagaagaccgccuacgagcuguggcugaaggaccagagaaaggccaugcaccugaagugcgccagauuccuggaggaggacgcccacagaugcgaccacugcagaggcagagacuucauccccuaccaccacuucaccgugaacaucagacugaacgcccuggacauggacgccaucaagaagauggccaugagccacggcuucaagaccgaggagaagcugauccugagcaacagcgagauccccgagaccagcgccuucuuccccgagaacagaagccccgaggagaucagagagaagauccugaacuucuucgaccacgugcugaccaagaugaagaccagcgacgaggacaucaucccccuggagagcugccagugcgaggagauccuggagaucgugauccugccccuggcccaccacuuccuggcccugggcgagaacgacaaggcccuguacuacuuccuggagaucgccagcgccuaccugaucuucugcgacaacuacauggccuacauguaccugaacgagggccagaagcugcugaagacccugaagaaggacaagagcuggagccagaccuucgagagcgccaccuucuacagccugaagggcgaggugugcuucaacaugggccagaucgugcuggccaagaagaugcugagaaaggcccugaagcugcugaacagaaucuuccccuacaaccugaucagccuguuccugcacauccacguggagaagaacagacacuuccacuacgugaacagacaggcccaggagagccccccccccggcaagaagagacuggcccagcuguacagacagaccgugugccugagccugcuguggagaaucuacagcuacagcuaccuguuccacugcaaguacuacgcccaccuggccgugaugaugcagaugaacaccgcccuggagacccagaacugcuuccagaucaucaaggccuaccuggacuacagccuguaccaccaccuggccggcuacaagggcgugugguucaaguacgaggugauggccauggagcacaucuucaaccugccccugaagggcgagggcaucgagaucguggccuacguggccgagacccugguguucaacaagcugaucaugggccaccuggaccuggccaucgagcugggcagcagagcccugcagaugugggcccugcugcagaaccccaacagacacuaccagagccugugcagacugagcagaugccugcugcugaacagcagauacccccagcugauccaggugcugggcagacugugggagcugagcgugacccaggagcacaucuucagcaaggccuucuucuacuucgugugccuggacauccugcuguacagcggcuucguguacagaaccuucgaggagugccuggaguucauccaccaguacgagaacaacagaauccugaaguuccacagcggccugcugcugggccuguacagcagcguggccaucugguacgccagacugcaggagugggacaacuucuacaaguucagcaacagagccaagaaccugcugcccagaagaaccaugacccugaccuacuacgacggcaucagcagauacauggagggccaggugcugcaccugcagaagcagaucaaggagcagagcgagaacgcccaggccagcggcgaggagcugcugaagaaccuggagaaccugguggcccagaacaccaccggccccguguucugccccagacuguaccaccugauggccuacgugugcauccugaugggcgacggccagaagugcggccuguuccugaacaccgcccugagacugagcgagacccagggcaacauccuggagaagugcuggcugaacaugaacaaggagagcugguacagcaccagcgagcugaaggaggaccaguggcugcagaccauccugagccugcccagcugggagaagaucguggccggcagagugaacauccaggaccugcagaagaacaaguuccugaugagagccaacaccguggacaaccacuucuaa

SEQ ID NO: 13298 - RNA, 3360 nt, Artificial Sequence
  ADCY1__Homo_sapiens__NP_066939
auggccggcgcccccagaggcggcggcggcggcggcggcggcgccggcgagcccggcggcgccgagagagccgccggcaccagcagaagaagaggccugagagccugcgacgaggaguucgccugccccgagcuggaggcccuguucagaggcuacacccugagacuggagcaggccgccacccugaaggcccuggccgugcugagccugcuggccggcgcccuggcccuggccgagcugcugggcgcccccggccccgcccccggccuggccaagggcagccaccccgugcacugcgugcuguuccuggcccugcugguggugaccaacgugagaagccugcaggugccccagcugcagcaggugggccagcuggcccugcuguucagccugaccuucgcccugcugugcugccccuucgcccugggcggccccgccagaggcagcgccggcgccgccggcggccccgccaccgccgagcagggcguguggcagcugcugcuggugaccuucgugagcuacgcccugcugcccgugagaagccugcuggccaucggcuucggccuggugguggccgccagccaccugcuggugaccgccacccuggugcccgccaagagacccagacuguggagaacccugggcgccaacgcccugcuguucgugggcgugaacauguacggcguguucgugagaauccugaccgagagaagccagagaaaggccuuccugcaggccagaagcugcaucgaggacagacugagacuggaggacgagaacgagaagcaggagagacugcugaugagccugcugcccagaaacguggccauggagaugaaggaggacuuccugaagccccccgagagaaucuuccacaagaucuacauccagagacacgacaacgugagcauccuguucgccgacaucgugggcuucaccggccuggccagccagugcaccgcccaggagcuggugaagcugcugaacgagcuguucggcaaguucgacgagcuggccaccgagaaccacugcagaagaaucaagauccugggcgacugcuacuacugcgugagcggccugacccagcccaagaccgaccacgcccacugcugcguggagaugggccuggacaugaucgacaccaucaccagcguggccgaggccaccgagguggaccugaacaugagagugggccugcacaccggcagagugcugugcggcgugcugggccugagaaaguggcaguacgacguguggagcaacgacgugacccuggccaacgugauggaggccgccggccugcccggcaaggugcacaucaccaagaccacccuggccugccugaacggcgacuacgagguggagcccggcuacggccacgagagaaacagcuuccugaagacccacaacaucgagaccuucuucaucgugcccagccacagaagaaagaucuuccccggccugauccugagcgacaucaagcccgccaagagaaugaaguucaagaccgugugcuaccugcuggugcagcugaugcacugcagaaagauguucaaggccgagauccccuucagcaacgugaugaccugcgaggacgacgacaagagaagagcccugagaaccgccagcgagaagcugagaaacagaagcagcuucagcaccaacgugguguacaccacccccggcaccagagugaacagauacaucagcagacugcuggaggccagacagaccgagcuggagauggccgaccugaacuucuucacccugaaguacaagcacguggagagagagcagaaguaccaccagcugcaggacgaguacuucaccagcgccguggugcugacccugauccuggccgcccuguucggccugguguaccugcugaucuucccccagagcgugguggugcugcugcugcugguguucugcaucugcuuccugguggccugcgugcuguaccugcacaucaccagagugcagugcuuccccggcugccugaccauccagaucagaaccgugcugugcaucuucaucguggugcugaucuacagcguggcccagggcugcguggugggcugccugcccugggccuggagcagcaagcccaacagcagccugguggugcugagcagcggcggccagagaaccgcccugcccacccugcccugcgagagcacccaccacgcccugcugugcugccuggugggcacccugccccuggccaucuucuucagagugagcagccugcccaagaugauccugcugagcggccugaccaccagcuacauccuggugcuggagcugagcggcuacaccagaaccggcggcggcgccgugagcggcagaagcuacgagcccaucguggccauccugcuguucagcugcgcccuggcccugcacgccagacagguggacaucagacugagacuggacuaccugugggccgcccaggccgaggaggagagagaggacauggagaaggugaagcuggacaacagaagaauccuguucaaccugcugcccgcccacguggcccagcacuuccugaugagcaaccccagaaacauggaccuguacuaccagagcuacagccaggugggcgugauguucgccagcauccccaacuucaacgacuucuacaucgagcuggacggcaacaacaugggcguggagugccugagacugcugaacgagaucaucgccgacuucgacgagcugauggagaaggacuucuacaaggacaucgagaagaucaagaccaucggcagcaccuacauggccgccgugggccuggcccccaccagcggcaccaaggccaagaagagcaucagcagccaccugagcacccuggccgacuucgccaucgagauguucgacgugcuggacgagaucaacuaccagagcuacaacgacuucgugcugagagugggcaucaacgugggccccgugguggccggcgugaucggcgccagaagaccccaguacgacaucuggggcaacaccgugaacguggccagcagaauggacagcaccggcgugcagggcagaauccaggugaccgaggaggugcacagacugcugagaagaugccccuaccacuucgugugcagaggcaaggugagcgugaagggcaagggcgagaugcugaccuacuuccuggagggcagaaccgacggcaacggcagccagaucagaagccugggccuggacagaaagaugugccccuucggcagagccggccugcagggcagaagaccccccgugugccccaugcccggcgugagcgugagagccggccugcccccccacagccccggccaguaccugcccagcgccgccgccggcaaggaggccuaa

SEQ ID NO: 13299 - RNA, 3276 nt, Artificial Sequence
  ADCY2__Homo_sapiens__NP_065433
auguggcaggaggccaugagaagaagaagauaccugagagacagaagcgaggaggccgccggcggcggcgacggccugcccagaagcagagacuggcuguacgagagcuacuacugcaugagccagcagcacccccugaucguguuccugcugcugaucgugaugggcagcugccuggcccugcuggccguguucuucgcccugggccuggagguggaggaccacguggccuuccugaucaccgugcccaccgcccuggccaucuucuucgccaucuucauccuggugugcaucgagagcguguucaagaagcugcugagacuguucagccuggugaucuggaucugccugguggccaugggcuaccuguucaugugcuucggcggcaccgugagccccugggaccaggugagcuucuuccuguucaucaucuucgugguguacaccaugcugcccuucaacaugagagacgccaucaucgccagcgugcugaccagcagcagccacaccaucgugcugagcgugugccugagcgccacccccggcggcaaggagcaccugguguggcagauccuggccaacgugaucaucuucaucugcggcaaccuggccggcgccuaccacaagcaccugauggagcuggcccugcagcagaccuaccaggacaccugcaacugcaucaagagcagaaucaagcuggaguucgagaagagacagcaggagagacugcugcugagccugcugcccgcccacaucgccauggagaugaaggccgagaucauccagagacugcagggccccaaggccggccagauggagaacaccaacaacuuccacaaccuguacgugaagagacacaccaacgugagcauccuguacgccgacaucgugggcuucaccagacuggccagcgacugcagccccggcgagcuggugcacaugcugaacgagcuguucggcaaguucgaccagaucgccaaggagaacgagugcaugagaaucaagauccugggcgacugcuacuacugcgugagcggccugcccaucagccugcccaaccacgccaagaacugcgugaagaugggccuggacaugugcgaggccaucaagaaggugagagacgccaccggcguggacaucaacaugagagugggcgugcacagcggcaacgugcugugcggcgugaucggccugcagaaguggcaguacgacguguggagccacgacgugacccuggccaaccacauggaggccggcggcgugcccggcagagugcacaucagcagcgugacccuggagcaccugaacggcgccuacaagguggaggagggcgacggcgacaucagagaccccuaccugaagcagcaccuggugaagaccuacuucgugaucaaccccaagggcgagagaagaagcccccagcaccuguucagacccagacacacccuggacggcgccaagaugagagccagcgugagaaugaccagauaccuggagagcuggggcgccgccaagcccuucgcccaccugcaccacagagacagcaugaccaccgagaacggcaagaucagcaccaccgacgugcccaugggccagcacaacuuccagaacagaacccugagaaccaagagccagaagaagagauucgaggaggagcugaacgagagaaugauccaggccaucgacggcaucaacgcccagaagcaguggcugaagagcgaggacauccagagaaucagccugcuguucuacaacaaggugcuggagaaggaguacagagccaccgcccugcccgccuucaaguacuacgugaccugcgccugccugaucuucuucugcaucuucaucgugcagauccuggugcugcccaagaccagcgugcugggcaucagcuucggcgccgccuuccugcugcuggccuucauccuguucgugugcuucgccggccagcugcugcagugcagcaagaaggccagcccccugcugauguggcugcugaagagcagcggcaucaucgccaacagacccuggcccagaaucagccugaccaucaucaccaccgccaucauccugaugauggccguguucaacauguucuuccugagcgacagcgaggagaccaucccccccaccgccaacaccaccaacaccagcuucagcgccagcaacaaccagguggccauccugagagcccagaaccuguucuuccugcccuacuucaucuacagcugcauccugggccugaucagcugcagcguguuccugagagugaacuacgagcugaagaugcugaucaugaugguggcccuggugggcuacaacaccauccugcugcacacccacgcccacgugcugggcgacuacagccaggugcuguucgagagacccggcaucuggaaggaccugaagaccaugggcagcgugagccugagcaucuucuucaucacccugcuggugcugggcagacagaacgaguacuacugcagacuggacuuccuguggaagaacaaguucaagaaggagagagaggagaucgagaccauggagaaccugaacagagugcugcuggagaacgugcugcccgcccacguggccgagcacuuccuggccagaagccugaagaacgaggagcuguaccaccagagcuacgacugcgugugcgugauguucgccagcauccccgacuucaaggaguucuacaccgagagcgacgugaacaaggagggccuggagugccugagacugcugaacgagaucaucgccgacuucgacgaccugcugagcaagcccaaguucagcggcguggagaagaucaagaccaucggcagcaccuacauggccgccaccggccugagcgccgugcccagccaggagcacagccaggagcccgagagacaguacaugcacaucggcaccaugguggaguucgccuucgcccuggugggcaagcuggacgccaucaacaagcacagcuucaacgacuucaagcugagagugggcaucaaccacggccccgugaucgccggcgugaucggcgcccagaagccccaguacgacaucuggggcaacaccgugaacguggccagcagaauggacagcaccggcgugcuggacaagauccaggugaccgaggagaccagccuggugcugcagacccugggcuacaccugcaccugcagaggcaucaucaacgugaagggcaagggcgaccugaagaccuacuucgugaacaccgagaugagcagaagccugagccagagcaacguggccagcuaa

SEQ ID NO: 13300 - RNA, 3435 nt, Artificial Sequence
  ADCY3__Homo_sapiens__NP_004027
augcccagaaaccagggcuucagcgagcccgaguacagcgccgaguacagcgccgaguacagcgugagccugcccagcgaccccgacagaggcgugggcagaacccacgagaucagcgugagaaacagcggcagcugccugugccugcccagauucaugagacugaccuucgugcccgagagccuggagaaccuguaccagaccuacuucaagagacagagacacgagacccugcuggugcuggugguguucgccgcccuguucgacugcuacgugguggugaugugcgccgugguguucagcagcgacaagcuggccagccuggccguggccggcaucggccuggugcuggacaucauccuguucgugcugugcaagaagggccugcugcccgacagagugaccagaagagugcugcccuacgugcuguggcugcugaucaccgcccagaucuucagcuaccugggccugaacuucgccagagcccacgccgccagcgacaccgugggcuggcagguguucuucguguucagcuucuucaucacccugccccugagccugagccccaucgugaucaucagcguggugagcugcguggugcacacccuggugcugggcgugaccguggcccagcagcagcaggaggagcugaagggcaugcagcugcugagagagauccuggccaacguguuccuguaccugugcgccaucgccgugggcaucaugagcuacuacauggccgacagaaagcacagaaaggccuuccuggaggccagacagagccuggaggugaagaugaaccuggaggagcagagccagcagcaggagaaccugaugcugagcauccugcccaagcacguggccgacgagaugcugaaggacaugaagaaggacgagagccagaaggaccagcagcaguucaacaccauguacauguacagacacgagaacgugagcauccuguucgccgacaucgugggcuucacccagcugagcagcgccugcagcgcccaggagcuggugaagcugcugaacgagcuguucgccagauucgacaagcuggccgccaaguaccaccagcugagaaucaagauccugggcgacugcuacuacugcaucugcggccugcccgacuacagagaggaccacgccgugugcagcauccugaugggccuggccaugguggaggccaucagcuacgugagagagaagaccaagaccggcguggacaugagagugggcgugcacaccggcaccgugcugggcggcgugcugggccagaagagauggcaguacgacguguggagcaccgacgugaccguggccaacaagauggaggccggcggcauccccggcagagugcacaucagccagagcaccauggacugccugaagggcgaguucgacguggagcccggcgacggcggcagcagaugcgacuaccuggaggagaagggcaucgagaccuaccugaucaucgccagcaagcccgaggugaagaagaccgccacccagaacggccugaacggcagcgcccugcccaacggcgcccccgccagcagcaagagcagcagccccgcccugaucgagaccaaggagcccaacggcagcgcccacagcagcggcagcaccagcgagaagcccgaggagcaggacgcccaggccgacaaccccagcuuccccaaccccagaagaagacugagacugcaggaccuggccgacagagugguggacgccagcgaggacgagcacgagcugaaccagcugcugaacgaggcccugcuggagagagagagcgcccagguggugaagaagagaaacaccuuccugcugagcaugagauucauggaccccgagauggagaccagauacagcguggagaaggagaagcagagcggcgccgccuucagcugcagcugcguggugcugcugugcaccgcccugguggagauccugaucgaccccuggcugaugaccaacuacgugaccuucauggugggcgagauccugcugcugauccugaccaucugcagccuggccgccaucuuccccagagccuuccccaagaagcugguggccuucagcaccuggaucgacagaaccagaugggccagaaacaccugggccaugcuggccaucuucauccuggugauggccaacgugguggacaugcugagcugccugcaguacuacaccggccccagcaacgccaccgccggcauggagaccgagggcagcugccuggagaaccccaaguacuacaacuacguggccgugcugagccugaucgccaccaucaugcuggugcaggugagccacauggugaagcugacccugaugcugcugguggccggcgccguggccaccaucaaccuguacgccuggagacccguguucgacgaguacgaccacaagagauucagagagcacgaccugcccaugguggcccuggagcagaugcagggcuucaaccccggccugaacggcaccgacagacugccccuggugcccagcaaguacagcaugaccgugaugguguuccugaugaugcugagcuucuacuacuucagcagacacguggagaagcuggccagaacccuguuccuguggaagaucgaggugcacgaccagaaggagagaguguacgagaugagaagauggaacgaggcccuggugaccaacaugcugcccgagcacguggccagacacuuccugggcagcaagaagagagacgaggagcuguacagccagaccuacgacgagaucggcgugauguucgccagccugcccaacuucgccgacuucuacaccgaggagagcaucaacaacggcggcaucgagugccugagauuccugaacgagaucaucagcgacuucgacagccugcuggacaaccccaaguucagagugaucaccaagaucaagaccaucggcagcaccuacauggccgccagcggcgugacccccgacgugaacaccaacggcuucgccagcagcaacaaggaggacaagagcgagagagagagauggcagcaccuggccgaccuggccgacuucgcccuggccaugaaggacacccugaccaacaucaacaaccagagcuucaacaacuucaugcugagaaucggcaugaacaagggcggcgugcuggccggcgugaucggcgccagaaagccccacuacgacaucuggggcaacaccgugaacguggccagcagaauggagagcaccggcgugaugggcaacauccaggugguggaggagacccaggugauccugagagaguacggcuucagauucgugagaagaggccccaucuucgugaagggcaagggcgagcugcugaccuucuuccugaagggcagagacaagcuggccaccuuccccaacggccccagcgugacccugccccaccaggugguggacaacagcuaa

SEQ ID NO: 13301 - RNA, 2736 nt, Artificial Sequence
  ADCY5__Homo_sapiens__NP_001186571
augaagagccagaaggagggcugcugcagcagaggcgaccugagcauccagaccggccccggcggcgagugggcccccagaagacuggugagcaacgugcugaucuucagcugcaccaacaucgugggcgugugcacccacuaccccgccgaggugagccagagacaggccuuccaggagaccagagagugcauccaggccagacugcacagccagagagagaaccagcagcaggagagacugcugcugagcgugcugcccagacacguggccauggagaugaaggccgacaucaacgccaagcaggaggacaugauguuccacaagaucuacauccagaagcacgacaacgugagcauccuguucgccgacaucgagggcuucaccagccuggccagccagugcaccgcccaggagcuggugaugacccugaacgagcuguucgccagauucgacaagcuggccgccgagaaccacugccugagaaucaagauccugggcgacugcuacuacugcgugagcggccugcccgaggccagagccgaccacgcccacugcugcguggagaugggcauggacaugaucgaggccaucagccuggugagagaggugaccggcgugaacgugaacaugagagugggcauccacagcggcagagugcacugcggcgugcugggccugagaaaguggcaguucgacguguggagcaacgacgugacccuggccaaccacauggaggccggcggcaaggccggcagaauccacaucaccaaggccacccugaacuaccugaacggcgacuacgagguggagcccggcugcggcggcgagagaaacgccuaccugaaggagcacagcaucgagaccuuccugauccugagaugcacccagaagagaaaggaggagaaggccaugaucgccaagaugaacagacagagaaccaacagcaucggccacaaccccccccacuggggcgccgagagacccuucuacaaccaccugggcggcaaccaggugagcaaggagaugaagagaaugggcuucgaggaccccaaggacaagaacgcccaggagagcgccaaccccgaggacgagguggacgaguuccugggcagagccaucgacgccagaagcaucgacagacugagaagcgagcacgugagaaaguuccugcugaccuucagagagcccgaccuggagaagaaguacagcaagcagguggacgacagauucggcgccuacguggccugcgccagccugguguuccuguucaucugcuucgugcagaucaccaucgugccccacagcaucuucaugcugagcuucuaccugaccugcagccugcugcugacccuggugguguucgugagcgugaucuacagcugcgugaagcuguuccccagcccccugcagacccugagcagaaagaucgugagaagcaagaugaacagcacccuggugggcguguucaccaucacccugguguuccuggccgccuucgugaacauguucaccugcaacagcagagaccugcugggcugccuggcccaggagcacaacaucagcgccagccaggugaacgccugccacguggccgagagcgccgugaacuacagccugggcgacgagcagggcuucugcggcagccccuggcccaacugcaacuuccccgaguacuucaccuacagcgugcugcugagccugcuggccugcagcguguuccugcagaucagcugcaucggcaagcuggugcugaugcuggccaucgagcugaucuacgugcugaucguggaggugcccggcgugacccuguucgacaacgccgaccugcuggugaccgccaacgccaucgacuucuucaacaacggcaccagccagugccccgagcacgccaccaagguggcccugaagguggugacccccaucaucaucagcguguucgugcuggcccuguaccugcacgcccagcagguggagagcaccgccagacuggacuuccuguggaagcugcaggccaccgaggagaaggaggagauggaggagcugcaggccuacaacagaagacugcugcacaacauccugcccaaggacguggccgcccacuuccuggccagagagagaagaaacgacgagcuguacuaccagagcugcgagugcguggccgugauguucgccagcaucgccaacuucagcgaguucuacguggagcuggaggccaacaacgagggcguggagugccugagacugcugaacgagaucaucgccgacuucgacgagaucaucagcgaggacagauucagacagcuggagaagaucaagaccaucggcagcaccuacauggccgccagcggccugaacgacagcaccuacgacaaggugggcaagacccacaucaaggcccuggccgacuucgccaugaagcugauggaccagaugaaguacaucaacgagcacagcuucaacaacuuccagaugaagaucggccugaacaucggccccgugguggccggcgugaucggcgccagaaagccccaguacgacaucuggggcaacaccgugaacguggccagcagaauggacagcaccggcgugcccgacagaauccaggugaccaccgacauguaccaggugcuggccgccaacaccuaccagcuggagugcagaggcguggugaaggugaagggcaagggcgagaugaugaccuacuuccugaacggcggccccccccugagcuaa

SEQ ID NO: 13302 - RNA, 3507 nt, Artificial Sequence
  ADCY6__Homo_sapiens__NP_056085
augagcugguucagcggccugcuggugcccaagguggacgagagaaagaccgccuggggcgagagaaacggccagaagagaagcagaagaagaggcaccagagccggcggcuucugcacccccagauacaugagcugccugagagacgccgagccccccagccccacccccgccggcccccccagaugccccuggcaggacgacgccuucaucagaagaggcggccccggcaagggcaaggagcugggccugagagccguggcccugggcuucgaggacaccgaggugaccaccaccgccggcggcaccgccgagguggcccccgacgccgugcccagaagcggcagaagcugcuggagaagacuggugcagguguuccagagcaagcaguucagaagcgccaagcuggagagacuguaccagagauacuucuuccagaugaaccagagcagccugacccugcugauggccgugcuggugcugcugaccgccgugcugcuggccuuccacgccgcccccgccagaccccagcccgccuacguggcccugcuggccugcgccgccgcccuguucgugggccugaugguggugugcaacagacacagcuucagacaggacagcauguggguggugagcuacguggugcugggcauccuggccgccgugcaggugggcggcgcccuggccgccgaccccagaagccccagcgccggccuguggugccccguguucuucguguacaucgccuacacccugcugcccaucagaaugagagccgccgugcugagcggccugggccugagcacccugcaccugauccuggccuggcagcugaacagaggcgacgccuuccuguggaagcagcugggcgccaacgugcugcuguuccugugcaccaacgugaucggcaucugcacccacuaccccgccgaggugagccagagacaggccuuccaggagaccagaggcuacauccaggccagacugcaccugcagcacgagaacagacagcaggagagacugcugcugagcgugcugccccagcacguggccauggagaugaaggaggacaucaacaccaagaaggaggacaugauguuccacaagaucuacauccagaagcacgacaacgugagcauccuguucgccgacaucgagggcuucaccagccuggccagccagugcaccgcccaggagcuggugaugacccugaacgagcuguucgccagauucgacaagcuggccgccgagaaccacugccugagaaucaagauccugggcgacugcuacuacugcgugagcggccugcccgaggccagagccgaccacgcccacugcugcguggagaugggcguggacaugaucgaggccaucagccuggugagagaggugaccggcgugaacgugaacaugagagugggcauccacagcggcagagugcacugcggcgugcugggccugagaaaguggcaguucgacguguggagcaacgacgugacccuggccaaccacauggaggccggcggcagagccggcagaauccacaucaccagagccacccugcaguaccugaacggcgacuacgagguggagcccggcagaggcggcgagagaaacgccuaccugaaggagcagcacaucgagaccuuccugauccugggcgccagccagaagagaaaggaggagaaggccaugcuggccaagcugcagagaaccagagccaacagcauggagggccugaugcccagaugggugcccgacagagccuucagcagaaccaaggacagcaaggccuucagacagaugggcaucgacgacagcagcaaggacaacagaggcacccaggacgcccugaaccccgaggacgagguggacgaguuccugagcagagccaucgacgccagaagcaucgaccagcugagaaaggaccacgugagaagauuccugcugaccuuccagagagaggaccuggagaagaaguacagcagaaagguggaccccagauucggcgccuacguggccugcgcccugcugguguucugcuucaucugcuucauccagcugcugaucuucccccacagcacccugaugcugggcaucuacgccagcaucuuccugcugcugcugaucaccgugcugaucugcgccguguacagcugcggcagccuguuccccaaggcccugcagagacugagcagaagcaucgugagaagcagagcccacagcaccgccgugggcaucuucagcgugcugcugguguucaccagcgccaucgccaacauguucaccugcaaccacacccccaucagaagcugcgccgccagaaugcugaaccugacccccgccgacaucaccgccugccaccugcagcagcugaacuacagccugggccuggacgccccccugugcgagggcaccaugcccaccugcagcuuccccgaguacuucaucggcaacaugcugcugagccugcuggccagcagcguguuccugcacaucagcagcaucggcaagcuggccaugaucuucgugcugggccugaucuaccuggugcugcugcugcugggcccccccgccaccaucuucgacaacuacgaccugcugcugggcgugcacggccuggccagcagcaacgagaccuucgacggccuggacugccccgccgccggcagaguggcccugaaguacaugacccccgugauccugcugguguucgcccuggcccuguaccugcacgcccagcagguggagagcaccgccagacuggacuuccuguggaagcugcaggccaccggcgagaaggaggagauggaggagcugcaggccuacaacagaagacugcugcacaacauccugcccaaggacguggccgcccacuuccuggccagagagagaagaaacgacgagcuguacuaccagagcugcgagugcguggccgugauguucgccagcaucgccaacuucagcgaguucuacguggagcuggaggccaacaacgagggcguggagugccugagacugcugaacgagaucaucgccgacuucgacgagaucaucagcgaggagagauucagacagcuggagaagaucaagaccaucggcagcaccuacauggccgccagcggccugaacgccagcaccuacgaccaggugggcagaagccacaucaccgcccuggccgacuacgccaugagacugauggagcagaugaagcacaucaacgagcacagcuucaacaacuuccagaugaagaucggccugaacaugggccccgugguggccggcgugaucggcgccagaaagccccaguacgacaucuggggcaacaccgugaacgugagcagcagaauggacagcaccggcgugcccgacagaauccaggugaccaccgaccuguaccaggugcuggccgccaagggcuaccagcuggagugcagaggcguggugaaggugaagggcaagggcgagaugaccaccuacuuccugaacggcggccccagcagcuaa

SEQ ID NO: 13303 - RNA, 3243 nt, Artificial Sequence
  ADCY7__Homo_sapiens__NP_001105
augcccgccaagggcagauacuuccugaacgagggcgaggagggccccgaccaggacgcccuguacgagaaguaccagcugaccagccagcacggcccccugcugcugacccugcugcugguggccgccaccgccugcguggcccugaucaucaucgccuucagccagggcgaccccagcagacaccaggccauccugggcauggccuuccuggugcuggccguguucgccgcccugagcgugcugauguacguggagugccugcugagaagauggcugagagcccuggcccugcugaccugggccugccugguggcccugggcuacgugcugguguucgacgccuggaccaaggccgccugcgccugggagcaggugcccuucuuccuguucaucguguucgugguguacacccugcugcccuucagcaugagaggcgccguggccgugggcgccgugagcaccgccagccaccugcuggugcugggcagccugaugggcggcuucaccacccccagcgugagagugggccugcagcugcuggccaacgccgugaucuuccugugcggcaaccugaccggcgccuuccacaagcaccagaugcaggacgccagcagagaccuguucaccuacaccgugaagugcauccagaucagaagaaagcugagaaucgagaagagacagcaggagaaccugcugcugagcgugcugcccgcccacaucagcaugggcaugaagcuggccaucaucgagagacugaaggagcacggcgacagaagaugcaugcccgacaacaacuuccacagccuguacgugaagagacaccagaacgugagcauccuguacgccgacaucgugggcuucacccagcuggccagcgacugcagccccaaggagcuggugguggugcugaacgagcuguucggcaaguucgaccagaucgccaaggccaacgagugcaugagaaucaagauccugggcgacugcuacuacugcgugagcggccugcccgugagccugcccacccacgccagaaacugcgugaagaugggccuggacaugugccaggccaucaagcaggugagagaggccaccggcguggacaucaacaugagagugggcauccacagcggcaacgugcugugcggcgugaucggccugagaaaguggcaguacgacguguggagccacgacgugagccuggccaacagaauggaggccgccggcgugcccggcagagugcacaucaccgaggccacccugaagcaccuggacaaggccuacgagguggaggacggccacggccagcagagagaccccuaccugaaggagaugaacaucagaaccuaccuggugaucgaccccagaagccagcagccccccccccccagccagcaccugcccagacccaagggcgacgccgcccugaagaugagagccagcgugagaaugaccagauaccuggagagcuggggcgccgccagacccuucgcccaccugaaccacagagagagcgugagcagcggcgagacccacgugcccaacggcagaagacccaagagcgugccccagagacacagaagaacccccgacagaagcaugagccccaagggcagaagcgaggacgacagcuacgacgacgagaugcugagcgccaucgagggccugagcagcaccagacccugcugcagcaagagcgacgacuucuacaccuucggcagcaucuuccuggagaagggcuucgagagagaguacagacuggcccccauccccagagccagacacgacuucgccugcgccagccugaucuucgugugcauccugcuggugcacgugcugcugaugcccagaaccgccgcccugggcgugagcuucggccugguggccugcgugcugggccuggugcugggccugugcuucgccaccaaguucagcagaugcugccccgccagaggcacccugugcaccaucagcgagagaguggagacccagccccugcugagacugacccuggccgugcugaccaucggcagccugcugaccguggccaucaucaaccugccccugaugcccuuccaggugcccgagcugcccgugggcaacgagaccggccugcuggccgccagcagcaagaccagagcccugugcgagccccugcccuacuacaccugcagcugcgugcugggcuucaucgccugcagcguguuccugagaaugagccuggagcccaagguggugcugcugaccguggcccugguggccuaccuggugcuguucaaccugagccccugcuggcagugggacugcugcggccagggccugggcaaccugaccaagcccaacggcaccaccagcggcacccccagcugcagcuggaaggaccugaagaccaugaccaacuucuaccuggugcuguucuacaucacccugcugacccugagcagacagaucgacuacuacugcagacuggacugccuguggaagaagaaguucaagaaggagcacgaggaguucgagaccauggagaacgugaacagacugcugcuggagaacgugcugcccgcccacguggccgcccacuucaucggcgacaagcugaacgaggacugguaccaccagagcuacgacugcgugugcgugauguucgccagcgugcccgacuucaagguguucuacaccgagugcgacgugaacaaggagggccuggagugccugagacugcugaacgagaucaucgccgacuucgacgagcugcugcugaagcccaaguucagcggcguggagaagaucaagaccaucggcagcaccuacauggccgccgccggccugagcguggccagcggccacgagaaccaggagcuggagagacagcacgcccacaucggcgugaugguggaguucagcaucgcccugaugagcaagcuggacggcaucaacagacacagcuucaacagcuucagacugagagugggcaucaaccacggccccgugaucgccggcgugaucggcgccagaaagccccaguacgacaucuggggcaacaccgugaacguggccagcagaauggagagcaccggcgagcugggcaagauccaggugaccgaggagaccugcaccauccugcagggccugggcuacagcugcgagugcagaggccugaucaacgugaagggcaagggcgagcugagaaccuacuucgugugcaccgacaccgccaaguuccagggccugggccugaacuaa

SEQ ID NO: 13304 - RNA, 3756 nt, Artificial Sequence
  ADCY8__Homo_sapiens__NP_001106
auggagcugagcgacgugagaugccugaccggcagcgaggagcuguacaccauccaccccaccccccccgccggcgacggcagaagcgccagcagaccccagagacugcuguggcagaccgccgugagacacaucaccgagcagagauucauccacggccacagaggcggcagcggcagcggcagcggcggcagcggcaaggccagcgaccccgccggcggcggccccaaccaccacgccccccagcugagcggcgacagcgcccugccccuguacagccugggccccggcgagagagcccacagcaccugcggcaccaagguguuccccgagagaagcggcagcggcagcgccagcggcagcggcggcggcggcgaccugggcuuccugcaccuggacugcgcccccagcaacagcgacuucuuccugaacggcggcuacagcuacagaggcgugaucuuccccacccugagaaacagcuucaagagcagagaccuggagagacuguaccagagauacuuccugggccagagaagaaagagcgagguggugaugaacgugcuggacgugcugaccaagcugacccugcuggugcugcaccugagccuggccagcgcccccauggacccccugaagggcauccugcugggcuucuucaccggcaucgagguggugaucugcgcccuggugguggugagaaaggacaccaccagccacaccuaccugcaguacagcggcguggugaccuggguggccaugaccacccagauccuggccgccggccugggcuacggccugcugggcgacggcaucggcuacgugcuguucacccuguucgccaccuacagcaugcugccccugccccugaccugggccauccuggccggccugggcaccagccugcugcaggugauccugcagguggugauccccagacuggccgugaucagcaucaaccaggugguggcccaggccgugcuguucaugugcaugaacaccgccggcaucuucaucagcuaccugagcgacagagcccagagacaggccuuccuggagaccagaagaugcguggaggccagacugagacuggagaccgagaaccagagacaggagagacuggugcugagcgugcugcccagauucguggugcuggagaugaucaacgacaugaccaacguggaggacgagcaccugcagcaccaguuccacagaaucuacauccacagauacgagaacgugagcauccuguucgccgacgugaagggcuucaccaaccugagcaccacccugagcgcccaggagcuggugagaaugcugaacgagcuguucgccagauucgacagacuggcccacgagcaccacugccugagaaucaagauccugggcgacugcuacuacugcgugagcggccugcccgagcccagacaggaccacgcccacugcugcguggagaugggccugagcaugaucaagaccaucagauacgugagaagcagaaccaagcacgacguggacaugagaaucggcauccacagcggcagcgugcugugcggcgugcugggccugagaaaguggcaguucgacguguggagcugggacguggacaucgccaacaagcuggagagcggcggcauccccggcagaauccacaucagcaaggccacccuggacugccugaacggcgacuacaacguggaggagggccacggcaaggagagaaacgaguuccugagaaagcacaacaucgagaccuaccugaucaagcagcccgaggacagccugcugagccugcccgaggacaucgugaaggagagcgugagcagcagcgacagaagaaacagcggcgccaccuucaccgagggcagcuggagccccgagcugcccuucgacaacaucgugggcaagcagaacacccuggccgcccugaccagaaacagcaucaaccugcugcccaaccaccuggcccaggcccugcacgugcagagcggccccgaggagaucaacaagagaaucgagcacaccaucgaccugagaagcggcgacaagcugagaagagagcacaucaagcccuucagccugauguucaaggacagcagccuggagcacaaguacagccagaugagagacgagguguucaagagcaaccuggugugcgccuucaucgugcugcuguucaucaccgccauccagagccugcugcccagcagcagagugaugcccaugaccauccaguucagcauccugaucaugcugcacagcgcccuggugcugaucaccaccgccgaggacuacaagugccugccccugauccugagaaagaccugcugcuggaucaacgagaccuaccuggccagaaacgugaucaucuucgccagcauccugaucaacuuccugggcgccauccugaacauccuguggugcgacuucgacaagagcaucccccugaagaaccugaccuucaacagcagcgccguguucaccgacaucugcagcuaccccgaguacuucguguucaccggcgugcuggccauggugaccugcgccguguuccugagacugaacagcgugcugaagcuggccgugcugcugaucaugaucgccaucuacgcccugcugaccgagaccguguacgccggccuguuccugagauacgacaaccugaaccacagcggcgaggacuuccugggcaccaaggaggugagccugcugcugauggccauguuccugcuggccguguucuaccacggccagcagcuggaguacaccgccagacuggacuuccuguggagagugcaggccaaggaggagaucaacgagaugaaggagcugagagagcacaacgagaacaugcugagaaacauccugcccagccacguggccagacacuuccuggagaaggacagagacaacgaggagcuguacagccagagcuacgacgccgugggcgugauguucgccagcauccccggcuucgccgacuucuacagccagaccgagaugaacaaccagggcguggagugccugagacugcugaacgagaucaucgccgacuucgacgagcugcugggcgaggacagauuccaggacaucgagaagaucaagaccaucggcagcaccuacauggccgugagcggccugagccccgagaagcagcagugcgaggacaaguggggccaccugugcgcccuggccgacuucagccuggcccugaccgagagcauccaggagaucaacaagcacagcuucaacaacuucgagcugagaaucggcaucagccacggcagcgugguggccggcgugaucggcgccaagaagccccaguacgacaucuggggcaagaccgugaaccuggccagcagaauggacagcaccggcgugagcggcagaauccaggugcccgaggagaccuaccugauccugaaggaccagggcuucgccuucgacuacagaggcgagaucuacgugaagggcaucagcgagcaggagggcaagaucaagaccuacuuccugcugggcagagugcagcccaaccccuucauccugccccccagaagacugcccggccaguacagccuggccgccguggugcugggccuggugcagagccugaacagacagagacagaagcagcugcugaacgagaacaacaacaccggcaucaucaagggccacuacaacagaagaacccugcugagccccagcggcaccgagcccggcgcccaggccgagggcaccgacaagagcgaccugcccuaa

SEQ ID NO: 13305 - RNA, 4062 nt, Artificial Sequence
  ADCY9__Homo_sapiens__NP_001107
auggccagccccccccaccagcagcugcugcaccaccacagcaccgaggugagcugcgacagcagcggcgacagcaacagcgugagagugaagaucaaccccaagcagcugagcagcaacagccaccccaagcacugcaaguacagcaucagcagcagcugcagcagcagcggcgacagcggcggcgugcccagaagagugggcggcggcggcagacugagaagacagaagaagcugccccagcuguucgagagagccagcagcagauggugggaccccaaguucgacagcgugaaccuggaggaggccugccuggagagaugcuucccccagacccagagaagauucagauacgcccuguucuacaucggcuucgccugccugcuguggagcaucuacuucgccgugcacaugagaagcagacugaucgugaugguggcccccgcccugugcuuccugcuggugugcgugggcuucuuccuguucaccuucaccaagcuguacgccagacacuacgccuggaccagccuggcccugacccugcugguguucgcccugacccuggccgcccaguuccaggugcugacccccgugagcggcagaggcgacagcagcaaccugaccgccaccgccagacccaccgacaccugccugagccaggugggcagcuucagcaugugcaucgaggugcuguuccugcuguacaccgugaugcaccugccccuguaccugagccugugccugggcguggccuacagcgugcuguucgagaccuucggcuaccacuucagagacgaggccugcuuccccagccccggcgccggcgcccugcacugggagcugcugagcagaggccugcugcacggcugcauccacgccaucggcgugcaccuguucgugaugagccaggugagaagcagaagcaccuuccugaaggugggccagagcaucaugcacggcaaggaccuggagguggagaaggcccugaaggagagaaugauccacagcgugaugcccagaaucaucgccgacgaccugaugaagcagggcgacgaggagagcgagaacagcgugaagagacacgccaccagcagccccaagaacagaaagaagaagagcagcauccagaaggcccccaucgccuucagacccuucaagaugcagcagaucgaggaggugagcauccuguucgccgacaucgugggcuucaccaagaugagcgccaacaagagcgcccacgcccuggugggccugcugaacgaccuguucggcagauucgacagacugugcgaggagaccaagugcgagaagaucagcacccugggcgacugcuacuacugcguggccggcugccccgagcccagagccgaccacgccuacugcugcaucgagaugggccugggcaugaucaaggccaucgagcaguucugccaggagaagaaggagauggugaacaugagagugggcgugcacaccggcaccgugcugugcggcauccugggcaugagaagauucaaguucgacguguggagcaacgacgugaaccuggccaaccugauggagcagcugggcguggccggcaaggugcacaucagcgaggccaccgccaaguaccuggacgacagauacgagauggaggacggcaaggugaucgagagacugggccagagcgugguggccgaccagcugaagggccugaagaccuaccugaucagcggccagagagccaaggagagcagaugcagcugcgccgaggcccugcugagcggcuucgaggugaucgacggcagccaggugagcagcggccccagaggccagggcaccgccagcagcggcaacgugagcgaccuggcccagaccgugaagaccuucgacaaccugaagaccugccccagcugcggcaucaccuucgcccccaagagcgaggccggcgccgagggcggcgccccccagaacggcugccaggacgagcacaagaacagcaccaaggccagcggcggccccaaccccaagacccagaacggccugcugagccccccccaggaggagaagcugaccaacagccagaccagccugugcgagauccugcaggagaagggcagaugggccggcgugagccuggaccagagcgcccugcugccccugagauucaagaacaucagagagaagaccgacgcccacuucguggacgugaucaaggaggacagccugaugaaggacuacuucuucaagccccccaucaaccaguucagccugaacuuccuggaccaggagcuggagagaagcuacagaaccagcuaccaggaggaggugaucaagaacagccccgugaagaccuucgccagccccaccuucagcagccugcuggacguguuccugagcaccaccguguuccugacccugagcaccaccugcuuccugaaguacgaggccgccaccgugccccccccccccgccgcccuggccguguucagcgccgcccugcugcuggaggugcugagccuggccgugagcaucagaaugguguucuuccuggaggacgugauggccugcaccaagagacugcuggaguggaucgccggcuggcugcccagacacugcaucggcgccauccuggugagccugcccgcccuggccguguacagccacgugaccagcgaguacgagaccaacauccacuuccccguguucaccggcagcgccgcccugaucgccguggugcacuacugcaacuucugccagcugagcagcuggaugagaagcagccuggccaccguggugggcgccggcccccugcugcugcuguacgugagccugugccccgacagcagcgugcugaccagcccccuggacgccgugcagaacuucagcagcgagagaaaccccugcaacagcagcgugcccagagaccugagaagacccgccagccugaucggccaggagguggugcugguguucuuccugcugcugcugcuggugugguuccugaacagagaguucgaggugagcuacagacugcacuaccacggcgacguggaggccgaccugcacagaaccaagauccagagcaugagagaccaggccgacuggcugcugagaaacaucauccccuaccacguggccgagcagcugaaggugagccagaccuacagcaagaaccacgacagcggcggcgugaucuucgccagcaucgugaacuucagcgaguucuacgaggagaacuacgagggcggcaaggagugcuacagagugcugaacgagcugaucggcgacuucgacgagcugcugagcaagcccgacuacagcagcaucgagaagaucaagaccaucggcgccaccuacauggccgccagcggccugaacaccgcccaggcccaggacggcagccacccccaggagcaccugcagauccuguucgaguucgccaaggagaugaugagagugguggacgacuucaacaacaacaugcugugguucaacuucaagcugagagugggcuucaaccacggcccccugaccgccggcgugaucggcaccaccaagcugcuguacgacaucuggggcgacaccgugaacaucgccagcagaauggacaccaccggcguggagugcagaauccaggugagcgaggagagcuacagagugcugagcaagaugggcuacgacuucgacuacagaggcaccgugaacgugaagggcaagggccagaugaagaccuaccuguaccccaagugcaccgaccacagagugaucccccagcaccagcugagcaucagccccgacaucagagugcagguggacggcagcaucggcagaagccccaccgacgagaucgccaaccuggugcccagcgugcaguacguggacaagaccagccugggcagcgacagcagcacccaggccaaggacgcccaccugagccccaagagacccuggaaggagcccgugaaggccgaggagagaggcagauucggcaaggccaucgagaaggacgacugcgacgagaccggcaucgaggaggccaacgagcugaccaagcugaacgugagcaagagcguguaa

SEQ ID NO: 13306 - RNA, 531 nt, Artificial Sequence
  ADCYAP1__Homo_sapiens__NP_001093203
augaccaugugcagcggcgccagacuggcccugcugguguacggcaucaucaugcacagcagcguguacagcagccccgccgccgccggccugagauuccccggcaucagacccgaggaggaggccuacggcgaggacggcaacccccugcccgacuucgacggcagcgagccccccggcgccggcagccccgccagcgcccccagagccgccgccgccugguacagacccgccggcagaagagacguggcccacggcauccugaacgaggccuacagaaaggugcuggaccagcugagcgccggcaagcaccugcagagccugguggccagaggcgugggcggcagccugggcggcggcgccggcgacgacgccgagccccugagcaagagacacagcgacggcaucuucaccgacagcuacagcagauacagaaagcagauggccgugaagaaguaccuggccgccgugcugggcaagagauacaagcagagagugaagaacaagggcagaagaaucgccuaccuguaa

SEQ ID NO: 13307 - RNA, 1407 nt, Artificial Sequence
  ADCYAP1R1__Homo_sapiens__NP_001109
auggccggcguggugcacgugagccuggccgcccugcugcugcugcccauggcccccgccaugcacagcgacugcaucuucaagaaggagcaggccaugugccuggagaagauccagagagccaacgagcugaugggcuucaacgacagcagccccggcugccccggcaugugggacaacaucaccugcuggaagcccgcccacgugggcgagauggugcuggugagcugccccgagcuguucagaaucuucaaccccgaccaggugugggagaccgagaccaucggcgagagcgacuucggcgacagcaacagccuggaccugagcgacaugggcguggugagcagaaacugcaccgaggacggcuggagcgagcccuucccccacuacuucgacgccugcggcuucgacgaguacgagagcgagaccggcgaccaggacuacuacuaccugagcgugaaggcccuguacaccgugggcuacagcaccagccuggugacccugaccaccgccauggugauccugugcagauucagaaagcugcacugcaccagaaacuucauccacaugaaccuguucgugagcuucaugcugagagccaucagcguguucaucaaggacuggauccuguacgccgagcaggacagcaaccacugcuucaucagcaccguggagugcaaggccgugaugguguucuuccacuacugcguggugagcaacuacuucuggcuguucaucgagggccuguaccuguucacccugcugguggagaccuucuuccccgagagaagauacuucuacugguacaccaucaucggcuggggcacccccaccgugugcgugaccgugugggccacccugagacuguacuucgacgacaccggcugcugggacaugaacgacagcaccgcccuguggugggugaucaagggccccguggugggcagcaucauggugaacuucgugcuguucaucggcaucaucgugauccuggugcagaagcugcagagccccgacaugggcggcaacgagagcagcaucuaccugagacuggccagaagcacccugcugcugaucccccuguucggcauccacuacaccguguucgccuucagccccgagaacgugagcaagagagagagacugguguucgagcugggccugggcagcuuccagggcuucgugguggccgugcuguacugcuuccugaacggcgaggugcaggccgagaucaagagaaaguggagaagcuggaaggugaacagauacuucgccguggacuucaagcacagacaccccagccuggccagcagcggcgugaacggcggcacccagcugagcauccugagcaagagcagcagccagaucagaaugagcggccugcccgccgacaaccuggccaccuaa

SEQ ID NO: 13308 - RNA, 2214 nt, Artificial Sequence
  ADD1__Homo_sapiens__NP_001110
augaacggcgacagcagagccgccguggugaccagccccccccccaccaccgccccccacaaggagagauacuucgacagaguggacgagaacaaccccgaguaccugagagagagaaacauggcccccgaccugagacaggacuucaacaugauggagcagaagaagagagugagcaugauccugcagagccccgccuucugcgaggagcuggagagcaugauccaggagcaguucaagaagggcaagaaccccaccggccugcuggcccugcagcagaucgccgacuucaugaccaccaacgugcccaacguguaccccgccgccccccagggcggcauggccgcccugaacaugagccugggcauggugacccccgugaacgaccugagaggcagcgacagcaucgccuacgacaagggcgagaagcugcugagaugcaagcuggccgccuucuacagacuggccgaccuguucggcuggagccagcugaucuacaaccacaucaccaccagagugaacagcgagcaggagcacuuccugaucgugcccuucggccugcuguacagcgaggugaccgccagcagccuggugaagaucaaccugcagggcgacaucguggacagaggcagcaccaaccugggcgugaaccaggccggcuucacccugcacagcgccaucuacgccgccagacccgacgugaagugcguggugcacauccacacccccgccggcgccgccgugagcgccaugaagugcggccugcugcccaucagccccgaggcccugagccugggcgagguggccuaccacgacuaccacggcauccugguggacgaggaggagaaggugcugauccagaagaaccugggccccaagagcaaggugcugauccugagaaaccacggccuggugagcgugggcgagagcguggaggaggccuucuacuacauccacaaccuggugguggccugcgagauccaggugagaacccuggccagcgccggcggccccgacaaccuggugcugcugaaccccgagaaguacaaggccaagagcagaagccccggcagccccgugggcgagggcaccggcagcccccccaaguggcagaucggcgagcaggaguucgaggcccugaugagaaugcuggacaaccugggcuacagaaccggcuaccccuacagauaccccgcccugagagagaagagcaagaaguacagcgacguggaggugcccgccagcgugaccggcuacagcuucgccagcgacggcgacagcggcaccugcagcccccugagacacagcuuccagaagcagcagagagagaagaccagauggcugaacagcggcagaggcgacgaggccagcgaggagggccagaacggcagcagccccaagagcaagaccaaguggaccaaggaggacggccacagaaccagcaccagcgccgugcccaaccuguucgugccccugaacaccaaccccaaggaggugcaggagaugagaaacaagaucagagagcagaaccugcaggacaucaagaccgccggcccccagagccaggugcugugcggcguggugauggacagaagccuggugcagggcgagcuggugaccgccagcaaggccaucaucgagaaggaguaccagccccacgugaucgugagcaccaccggccccaaccccuucaccacccugaccgacagagagcuggaggaguacagaagagagguggagagaaagcagaagggcagcgaggagaaccuggacgaggccagagagcagaaggagaagagcccccccgaccagcccgccgugccccaccccccccccagcacccccaucaagcuggaggaggaccuggugcccgagcccaccaccggcgacgacagcgacgccgccaccuucaagcccacccugcccgaccugagccccgacgagcccagcgaggcccugggcuuccccaugcuggagaaggaggaggaggcccacagaccccccagccccaccgaggcccccaccgaggccagccccgagcccgcccccgaccccgcccccguggccgaggaggccgcccccagcgccguggaggagggcgccgccgccgaccccggcagcgacggcagccccggcaagagccccagcaagaagaagaagaaguucagaacccccagcuuccugaagaagagcaagaagaagagcgacagcuaa

SEQ ID NO: 13309 - RNA, 1728 nt, Artificial Sequence
  ADD2__Homo_sapiens__NP_001171984
augcccagaagaagagugcccggcgccaacugcaagcccaccggcaagaugagcgaggagaccgugcccgaggccgccagccccccccccccccagggccagcccuacuucgacagauucagcgaggacgaccccgaguacaugagacugagaaacagagccgccgaccugagacaggacuucaaccugauggagcagaagaagagagugaccaugauccugcagagccccagcuucagagaggagcuggagggccugauccaggagcagaugaagaagggcaacaacagcagcaacaucugggcccugagacagaucgccgacuucauggccagcaccagccacgccguguuccccaccagcagcaugaacgugagcaugaugacccccaucaacgaccugcacaccgccgacagccugaaccuggccaagggcgagagacugaugagaugcaagaucagcagcguguacagacugcuggaccuguacggcugggcccagcugagcgacaccuacgugacccugagagugagcaaggagcaggaccacuuccugaucagccccaagggcgugagcugcagcgaggugaccgccagcagccugaucaaggugaacauccugggcgaggugguggagaagggcagcagcugcuuccccguggacaccaccggcuucugccugcacagcgccaucuacgccgccagacccgacgugagaugcaucauccaccugcacacccccgccaccgccgccgugagcgccaugaaguggggccugcugcccgugagccacaacgcccugcuggugggcgacauggccuacuacgacuucaacggcgagauggagcaggaggccgacagaaucaaccugcagaagugccugggccccaccugcaagauccuggugcugagaaaccacggcgugguggcccugggcgacaccguggaggaggccuucuacaagaucuuccaccugcaggccgccugcgagauccaggugagcgcccugagcagcgccggcggcguggagaaccugauccugcuggagcaggagaagcacagaccccacgaggugggcagcgugcagugggccggcagcaccuucggccccaugcagaagagcagacugggcgagcacgaguucgaggcccugaugagaaugcuggacaaccugggcuacagaaccggcuacaccuacagacaccccuucgugcaggagaagaccaagcacaagagcgagguggagauccccgccaccgugaccgccuucguguucgaggaggacggcgcccccgugcccgcccugagacagcacgcccagaagcagcagaaggagaagaccagauggcugaacacccccaacaccuaccugagagugaacguggccgacgaggugcagagaagcaugggcagccccagacccaagaccaccuggaugaaggccgacgagguggagaagagcagcagcggcaugcccaucagaaucgagaaccccaaccaguucgugccccuguacaccgacccccaggaggugcuggagaugagaaacaagaucagagagcagaacagacaggacgugaagagcgccggcccccagagccagcugcuggccagcgugaucgccgagaagagcagaagccccguggagcagagacugccccugaccggcggcgagaccugccugcccagcggcagcagcgugcccggcgccggccugcaggaccccuaa

SEQ ID NO: 13310 - RNA, 2121 nt, Artificial Sequence
  ADD3__Homo_sapiens__NP_058432
augagcagcgacgccagccagggcgugaucaccaccccccccccccccagcaugccccacaaggagagauacuucgacagaaucaacgagaacgaccccgaguacaucagagagagaaacaugagccccgaccugagacaggacuucaacaugauggagcagagaaagagagugacccagauccugcagagccccgccuucagagaggaccuggagugccugauccaggagcagaugaagaagggccacaaccccaccggccugcuggcccugcagcagaucgccgacuacaucauggccaacagcuucagcggcuucagcagccccccccugagccugggcauggugacccccaucaacgaccugcccggcgccgacaccagcagcuacgugaagggcgagaagcugaccagaugcaagcuggccagccuguacagacugguggaccuguucggcugggcccaccuggccaacaccuacaucagcgugagaaucagcaaggagcaggaccacaucaucaucauccccagaggccugagcuucagcgaggccaccgccagcaaccuggugaaggugaacaucaucggcgaggugguggaccagggcagcaccaaccugaagaucgaccacaccggcuucagcccccacgccgccaucuacagcaccagacccgacgugaagugcgugauccacauccacacccuggccaccgccgccgugagcagcaugaagugcggcauccugcccaucagccaggagagccugcugcugggcgacguggccuacuacgacuaccagggcagccuggaggagcaggaggagagaauccagcugcagaaggugcugggccccagcugcaaggugcuggugcugagaaaccacggcgugguggcccugggcgagacccuggaggaggccuuccacuacaucuucaacgugcagcuggccugcgagauccaggugcaggcccuggccggcgccggcggcguggacaaccugcacgugcuggacuuccagaaguacaaggccuucaccuacaccguggccgccagcggcggcggcggcgugaacaugggcagccaccagaaguggaaggugggcgagaucgaguucgagggccugaugagaacccuggacaaccugggcuacagaaccggcuacgccuacagacacccccugaucagagagaagcccagacacaagagcgacguggagauccccgccaccgugaccgccuucagcuucgaggacgacaccgugccccugagcccccugaaguacauggcccagagacagcagagagagaagaccagauggcugaacagccccaacaccuacaugaaggugaacgugcccgaggagagcagaaacggcgagaccagccccagaaccaagaucaccuggaugaaggccgaggacagcagcaaggugagcggcggcacccccaucaagaucgaggaccccaaccaguucgugccccugaacaccaaccccaacgaggugcuggagaagagaaacaagaucagagagcagaacagauacgaccugaagaccgccggcccccagagccagcugcuggccggcaucgugguggacaagccccccagcaccaugcaguucgaggacgacgaccacggcccccccgccccccccaaccccuucagccaccugaccgagggcgagcuggaggaguacaagagaaccaucgagagaaagcagcagggccuggaggacgccgagcaggagcugcugagcgacgacgccagcagcgugagccagauccagagccagacccagagcccccagaacgugcccgagaagcuggaggagaaccacgagcuguucagcaagagcuucaucagcauggaggugcccgugaugguggugaacggcaaggacgacaugcacgacguggaggacgagcuggccaagagagugagcagacugagcaccagcaccaccaucgagaacaucgagaucaccaucaagagccccgagaagaucgaggaggugcugagccccgagggcagccccagcaagagccccagcaagaagaagaagaaguucagaacccccagcuuccugaagaagaacaagaagaaggagaagguggaggccuaa

SEQ ID NO: 13311 - RNA, 5004 nt, Artificial Sequence
  ADGB__Homo_sapiens__NP_078970
auggccagcaagcagaccaagaagaaggaggugcacagaaucaacagcgcccacggcagcgacaagagcaaggacuucuaccccuucggcagcaacgugcagagcggcagcaccgagcagaagaagggcaaguucccccuguggcccgaguggagcgaggccgacaucaacagcgagaagugggacgccggcaagggcgccaaggagaaggacaagaccggcaagagccccguguuccacuucuucgaggaccccgagggcaagaucgagcugccccccagccugaagaucuacagcuggaagagaccccaggacauccuguucagccagacccccgugguggugaagaacgagaucaccuucgaccuguucagcgccaacgagcaccugcugugcagcgagcugaugagauggaucaucagcgagaucuacgccguguggaagaucuucaacggcggcauccugagcaacuacuucaagggcaccagcggcgagcccccccugcugcccuggaagcccugggagcacaucuacagccugugcaaggccgugaagggccacaugccccuguucaacagcuacggcaaguacguggugaagcuguacuggaugggcugcuggagaaagaucaccaucgacgacuuccugcccuucgacgaggacaacaaccugcugcugcccgccaccaccuacgaguucgagcuguggcccaugcugcugagcaaggccaucaucaagcuggccaacaucgacauccacguggccgacagaagagagcugggcgaguucaccgugauccacgcccugaccggcuggcugcccgaggugaucagccugcaccccggcuacauggacaaggugugggagcugcugaaggagauccugcccgaguucaagcugagcgacgaggccagcagcgagagcaagaucgccgugcuggacagcaagcugaaggagcccggcaaggagggcaaggagggcaaggagaucaaggacggcaaggaggugaaggacgugaaggaguucaagcccgagagcagccugaccacccugaaggcccccgagaagagcgacaaggugcccaaggagaaggccgacgccagagacaucggcaagaagagaagcaaggacggcgagaaggagaaguucaaguucagccugcacggcagcagacccagcagcgaggugcaguacagcgugcagagccugagcgacugcagcagcgccauccagaccagccacauggugguguacgccaccuucaccccccuguaccuguucgagaacaagaucuucagccuggagaagauggccgacagcgccgagaagcugagagaguacggccugagccacaucugcagccaccccgugcuggugaccagaagcagaagcugcccccugguggccccccccaagccccccccccugccccccuggaagcugaucagacagaagaaggagaccgugaucaccgacgaggcccaggagcugaucgugaagaagcccgagagauuccuggagaucagcagccccuuccugaacuacagaaugacccccuucaccauccccaccgagaugcacuucgugagaagccugaucaagaagggcaucccccccggcagcgaccugcccagcgugagcgagaccgacgagaccgccacccacagccagaccgaccugagccagaucaccaaggccaccagccagggcaacaccgccagccaggugauccugggcaagggcaccgacgagcagaccgacuucggccugggcgacgcccaccagagcgacggccugaaccuggagagagagaucgugagccagaccaccgccacccaggagaagagccaggaggagcugcccaccaccaacaacagcgugagcaaggagaucuggcuggacuucgaggacuucugcgugugcuuccagaacaucuacaucuuccacaagcccagcagcuacugccugaacuuccagaagagcgaguucaaguucagcgaggagagagugagcuacuaccuguucguggacagccugaagcccaucgagcugcuggugugcuucagcgcccuggugagauggggcgaguacggcgcccugaccaaggacagcccccccaucgagcccggccugcugaccgccgagaccuucagcuggaagagccugaagcccggcagccuggugcugaagauccacaccuacgccaccaaggccaccguggugagacugcccgugggcagacacaugcugcuguucaacgccuacagccccgugggccacagcauccacaucugcagcauggugagcuucgugaucggcgacgagcacguggugcugcccaacuucgagcccgagagcugcagauucaccgagcagagccugcugaucaugaaggccaucggcaacgugaucgccaacuucaaggacaagggcaagcugagcgccgcccugaaggaccugcagaccgcccacuaccccgugcccuuccacgacaaggagcugaccgcccagcacuucagaguguuccaccugagccuguggagacugaugaagaaggugcagaucaccaagcccccccccaacuucaaguucgccuucagagccauggugcuggaccuggagcugcugaacagcagccuggaggaggugagccugguggaguggcuggacgugaaguacugcaugcccaccagcgacaaggaguacagcgccgaggagguggccgccgccaucaagauccaggccauguggagaggcaccuacgugagacugcugaugaaggccagaauccccgacaccaaggagaacaucagcguggccgacacccugcagaaggugugggccgugcuggagaugaaccuggagcaguacgccgugagccugcugagacugauguucaagagcaagugcaagagccuggagagcuaccccugcuaccaggacgaggagaccaagaucgccuucgccgacuacaccgugaccuaccaggagcagccccccaacagcugguucaucguguucagagagaccuuccuggugcaccaggacaugauccuggugcccaagguguacaccacccugcccaucugcauccugcacaucgugaacaacgacaccauggagcaggugcccaagguguuccagaagguggugcccuaccuguacaccaagaacaagaagggcuacaccuucguggccgaggccuucaccggcgacaccuacguggccgccagcagauggaagcugagacugaucggcagcagcgccccccugcccugccugagcagagacagccccugcaacagcuucgccaucaaggagaucagagacuacuacauccccaacgacaagaagauccuguucagauacagcgugaaggugcugaccccccagcccgccaccauccaggugagaaccagcaagcccgacgccuucaucaagcugcaggugcuggagaacgaggagaccauggugagcagcaccggcaagggccaggccaucauccccgccuuccacuuccugaagagcgagaagggccugagcagccagagcagcaagcacauccugagcuuccacagcgccagcaagaaggagcaggagguguacgugaagaagaaggccgcccagggcauccagaagagccccaagggcagagccgugagcgccauccaggacaucggccugccccugguggaggaggagaccaccagcacccccaccagagaggacagcagcagcaccccccugcagaacuacaaguacaucauccagugcagcgugcuguacaacagcuggccccugaccgagagccagcugaccuucgugcaggcccugaaggaccugaagaagagcaacaccaaggccuacggcgagagacacgaggagcugaucaaccugggcagccccgacagccacaccaucagcgagggccagaagagcagcgugaccagcaagaccaccagaaagggcaaggagaagagcagcgagaaggagaagaccgccaaggagaagcaggcccccagauucgagccccagaucagcaccgugcacccccagcaggaggaccccaacaagcccuacuggauccugagacuggugaccgagcacaacgagagcgagcuguucgaggugaagaaggacaccgagagagccgacgagaucagagccaugaagcaggccugggagaccaccgagcccggcagagccaucaaggccagccaggccagacugcacuaccugagcggcuucaucaagaagaccagcgacgccgagagcccccccaucagcgagagccagaccaagcccaaggaggagguggagaccgccgccagaggcgugaaggagcccaacagcaagaacagcgccggcagcgagagcaaggagaugacccagaccggcagcggcagcgccguguggaagaaguggcagcugaccaagggccugagagacguggccaagagcaccagcagcgagagcggcggcgugagcagccccggcaaggaggagagagagcagagcaccagaaaggagaacauccagaccggccccagaaccagaagccccaccauccuggagaccagccccagacugaucagaaaggcccuggaguucauggaccugagccaguacgugagaaagaccgacaccgacccccugcugcagaccgacgagcugaaccagcagcaggccaugcagaaggccgaggagauccaccaguucagacagcacagaaccagagugcugagcaucagaaacaucgaccaggaggagagacugaagcugaaggacgaggugcuggacauguacaaggagaugcaggacagccuggacgaggccagacagaagaucuucgacaucagagaggaguacagaaacaagcugcuggaggccgagcaccugaagcuggagacccuggccgcccaggaggccgccaugaagcuggagaccgagaagaugacccccgcccccgacacccagaagaagaagaagggcaagaagaaguaa

SEQ ID NO: 13312 - RNA, 1683 nt, Artificial Sequence
  ADGRA1__Homo_sapiens__NP_001077378
auggaccugaagaccgugcugagccugcccagauaccccggcgaguuccugcaccccgugguguacgccugcaccgccgugaugcugcugugccugcuggccagcuucgugaccuacaucgugcaccagagcgccaucagaaucagcagaaagggcagacacacccugcugaacuucugcuuccacgccgcccugaccuucaccguguucgccggcggcaucaacagaaccaaguaccccauccugugccaggccgugggcaucgugcugcacuacagcacccugagcaccaugcuguggaucggcgugaccgccagaaacaucuacaagcaggugaccaagaaggccccccugugccuggacaccgaccagccccccuaccccagacagccccugcugagauucuaccuggugagcggcggcgugcccuucaucaucugcggcgugaccgccgccaccaacaucagaaacuacggcaccgaggacgaggacaccgccuacugcuggauggccugggagcccagccugggcgccuucuacggccccgccgccaucaucacccuggugaccugcguguacuuccugggcaccuacgugcagcugagaagacaccccggcagaagauacgagcugagaacccagcccgaggagcagagaagacuggccacccccgagggcggcagaggcaucagacccggcaccccccccgcccacgacgcccccggcgccagcgugcugcagaacgagcacagcuuccaggcccagcugagagccgccgccuucacccuguuccuguucaccgccaccugggccuucggcgcccuggccgugagccagggccacuuccuggacaugguguucagcugccuguacggcgccuucugcgugacccugggccuguucgugcugauccaccacugcgccaagagagaggacguguggcagugcuggugggccugcugcccccccagaaaggacgcccaccccgcccuggacgccaacggcgccgcccugggcagagccgccugccugcacagccccggccugggccagcccagaggcuucgcccacccccccggccccugcaagaugaccaaccugcaggccgcccagggccacgccagcugccugagccccgccacccccugcugcgccaagaugcacugcgagccccugaccgccgacgaggcccacgugcaccugcaggaggagggcgccuucggccacgacccccaccugcacggcugccugcagggcagaaccaagccccccuacuucagcagacaccccgccgaggagcccgaguacgccuaccacauccccagcagccuggacggcagccccagaagcagcagaaccgacagcccccccagcagccuggacggccccgccggcacccacacccuggccugcugcacccagggcgaccccuuccccauggugacccagcccgagggcagcgacggcagccccgcccuguacagcugccccacccagcccggcagagaggccgcccugggccccggccaccuggagaugcugagaagaacccagagccugcccuucggcggccccagccagaacggccugcccaagggcaagcugcuggagggccugcccuucggcaccgacggcaccggcaacaucagaaccggccccuggaagaacgagaccaccguguaa

SEQ ID NO: 13313 - RNA, 4017 nt, Artificial Sequence
  ADGRA2__Homo_sapiens__NP_116166
augggcgccggcggcagaagaaugagaggcgcccccgccagacugcugcugccccugcugcccuggcugcugcugcugcuggcccccgaggccagaggcgcccccggcugcccccugagcaucagaagcugcaagugcagcggcgagagacccaagggccugagcggcggcgugcccggccccgccagaagaagaguggugugcagcggcggcgaccugcccgagccccccgagcccggccugcugcccaacggcaccgugacccugcugcugagcaacaacaagaucaccggccugagaaacggcagcuuccugggccugagccugcuggagaagcuggaccugagaaacaacaucaucagcaccgugcagcccggcgccuuccugggccugggcgagcugaagagacuggaccugagcaacaacagaaucggcugccugaccagcgagaccuuccagggccugcccagacugcugagacugaacaucagcggcaacaucuucagcagccugcagcccggcguguucgacgagcugcccgcccugaaggugguggaccugggcaccgaguuccugaccugcgacugccaccugagauggcugcugcccugggcccagaacagaagccugcagcugagcgagcacacccugugcgccuaccccagcgcccugcacgcccaggcccugggcagccugcaggaggcccagcugugcugcgagggcgcccuggagcugcacacccaccaccugauccccagccugagacaggugguguuccagggcgacagacugcccuuccagugcagcgccagcuaccugggcaacgacaccagaaucagaugguaccacaacagagcccccguggagggcgacgagcaggccggcauccugcuggccgagagccugauccacgacugcaccuucaucaccagcgagcugacccugagccacaucggcgugugggccagcggcgagugggagugcaccgugagcauggcccagggcaacgccagcaagaagguggagaucguggugcuggagaccagcgccagcuacugccccgccgagagaguggccaacaacagaggcgacuucagauggcccagaacccuggccggcaucaccgccuaccagagcugccugcaguaccccuucaccagcgugccccugggcggcggcgcccccggcaccagagccagcagaagaugcgacagagccggcagaugggagcccggcgacuacagccacugccuguacaccaacgacaucaccagagugcuguacaccuucgugcugaugcccaucaacgccagcaacgcccugacccuggcccaccagcugagaguguacaccgccgaggccgccagcuucagcgacaugauggacgugguguacguggcccagaugauccagaaguuccugggcuacguggaccagaucaaggagcugguggaggugaugguggacauggccagcaaccugaugcugguggacgagcaccugcuguggcuggcccagagagaggacaaggccugcagcagaaucgugggcgcccuggagagaaucggcggcgccgcccugagcccccacgcccagcacaucagcgugaacgccagaaacguggcccuggaggccuaccugaucaagccccacagcuacgugggccugaccugcaccgccuuccagagaagagagggcggcgugcccggcaccagacccggcagccccggccagaaccccccccccgagcccgagccccccgccgaccagcagcugagauucagaugcaccaccggcagacccaacgugagccugagcagcuuccacaucaagaacagcguggcccuggccagcauccagcugccccccagccuguucagcagccugcccgccgcccuggccccccccgugccccccgacugcacccugcagcugcugguguucagaaacggcagacuguuccacagccacagcaacaccagcagacccggcgccgccggccccggcaagagaagaggcguggccacccccgugaucuucgccggcaccagcggcugcggcgugggcaaccugaccgagcccguggccgugagccugagacacugggccgagggcgccgagcccguggccgccugguggagccaggagggccccggcgaggccggcggcuggaccagcgagggcugccagcugagaagcagccagcccaacgugagcgcccugcacugccagcaccugggcaacguggccgugcugauggagcugagcgccuuccccagagaggugggcggcgccggcgccggccugcaccccgugguguaccccugcaccgcccugcugcugcugugccuguucgccaccaucaucaccuacauccugaaccacagcagcaucagagugagcagaaagggcuggcacaugcugcugaaccugugcuuccacaucgccaugaccagcgccguguucgccggcggcaucacccugaccaacuaccagauggugugccaggccgugggcaucacccugcacuacagcagccugagcacccugcuguggaugggcgugaaggccagagugcugcacaaggagcugaccuggagagccccccccccccaggagggcgaccccgcccugcccacccccagccccaugcugagauucuaccugaucgccggcggcaucccccugaucaucugcggcaucaccgccgccgugaacauccacaacuacagagaccacagccccuacugcuggcugguguggagacccagccugggcgccuucuacauccccguggcccugauccugcugaucaccuggaucuacuuccugugcgccggccugagacugagaggcccccuggcccagaaccccaaggccggcaacagcagagccagccuggaggccggcgaggagcugagaggcagcaccagacugagaggcagcggcccccugcugagcgacagcggcagccugcuggccaccggcagcgccagagugggcacccccggcccccccgaggacggcgacagccuguacagccccggcgugcagcugggcgcccuggugaccacccacuuccuguaccuggccaugugggccugcggcgcccuggccgugagccagagauggcugcccagaguggugugcagcugccuguacggcguggccgccagcgcccugggccuguucguguucacccaccacugcgccagaagaagagacgugagagccagcuggagagccugcugcccccccgccagccccgccgccccccacgccccccccagagcccugcccgccgccgccgaggacggcagccccguguucggcgagggcccccccagccugaagagcagccccagcggcagcagcggccacccccuggcccugggccccugcaagcugaccaaccugcagcuggcccagagccaggugugcgaggccggcgccgccgccggcggcgagggcgagcccgagcccgccggcaccagaggcaaccuggcccacagacaccccaacaacgugcaccacggcagaagagcccacaagagcagagccaagggccacagagccggcgaggccugcggcaagaacagacugaaggcccugagaggcggcgccgccggcgcccuggagcugcugagcagcgagagcggcagccugcacaacagccccaccgacagcuaccugggcagcagcagaaacagccccggcgccggccugcagcuggagggcgagcccaugcugacccccagcgagggcagcgacaccagcgccgccccccugagcgaggccggcagagccggccagagaagaagcgccagcagagacagccugaagggcggcggcgcccuggagaaggagagccacagaagaagcuacccccugaacgccgccagccugaacggcgcccccaagggcggcaaguacgacgacgugacccugaugggcgccgagguggccagcggcggcugcaugaagaccggccuguggaagagcgagaccaccguguaa

SEQ ID NO: 13314 - RNA, 3966 nt, Artificial Sequence
  ADGRA3__Homo_sapiens__NP_660333
auggagccccccggcagaagaagaggcagagcccagcccccccugcugcugccccugagccugcuggcccugcuggcccugcugggcggcggcggcggcggcggcgccgccgcccugcccgccggcugcaagcacgacggcagacccagaggcgccggcagagccgccggcgccgccgagggcaagguggugugcagcagccuggagcuggcccaggugcugccccccgacacccugcccaacagaaccgugacccugauccugagcaacaacaagaucagcgagcugaagaacggcagcuucagcggccugagccugcuggagagacuggaccugagaaacaaccugaucagcagcaucgaccccggcgccuucuggggccugagcagccugaagagacuggaccugaccaacaacagaaucggcugccugaacgccgacaucuucagaggccugaccaaccuggugagacugaaccugagcggcaaccuguucagcagccugagccagggcaccuucgacuaccuggccagccugagaagccuggaguuccagaccgaguaccugcugugcgacugcaacauccuguggaugcacagaugggugaaggagaagaacaucaccgugagagacaccagaugcguguaccccaagagccugcaggcccagcccgugaccggcgugaagcaggagcugcugaccugcgaccccccccuggagcugcccagcuucuacaugacccccagccacagacaggugguguucgagggcgacagccugcccuuccagugcauggccagcuacaucgaccaggacaugcaggugcugugguaccaggacggcagaaucguggagaccgacgagagccagggcaucuucguggagaagaacaugauccacaacugcagccugaucgccagcgcccugaccaucagcaacauccaggccggcagcaccggcaacuggggcugccacgugcagaccaagagaggcaacaacaccagaaccguggacaucguggugcuggagagcagcgcccaguacugcccccccgagagaguggugaacaacaagggcgacuucagauggcccagaacccuggccggcaucaccgccuaccugcagugcaccagaaacacccacggcagcggcaucuaccccggcaacccccaggacgagagaaaggccuggagaagaugcgacagaggcggcuucugggccgacgacgacuacagcagaugccaguacgccaacgacgugaccagagugcuguacauguucaaccagaugccccugaaccugaccaacgccguggccaccgccagacagcugcuggccuacaccguggaggccgccaacuucagcgacaagauggacgugaucuucguggccgagaugaucgagaaguucggcagauucaccaaggaggagaagagcaaggagcugggcgacgugaugguggacaucgccagcaacaucaugcuggccgacgagagagugcuguggcuggcccagagagaggccaaggccugcagcagaaucgugcagugccugcagagaaucgccaccuacagacuggccggcggcgcccacguguacagcaccuacagccccaacaucgcccuggaggccuacgugaucaagagcaccggcuucaccggcaugaccugcaccguguuccagaagguggccgccagcgacagaaccggccugagcgacuacggcagaagagaccccgagggcaaccuggacaagcagcugagcuucaagugcaacgugagcaacaccuucagcagccuggcccugaagaacaccaucguggaggccagcauccagcugccccccagccuguucagccccaagcagaagagagagcugagacccaccgacgacagccuguacaagcugcagcugaucgccuucagaaacggcaagcuguuccccgccaccggcaacagcaccaaccuggccgacgacggcaagagaagaaccguggugacccccgugauccugaccaagaucgacggcgugaacguggacacccaccacauccccgugaacgugacccugagaagaaucgcccacggcgccgacgccguggccgccagaugggacuucgaccugcugaacggccagggcggcuggaagagcgacggcugccacauccuguacagcgacgagaacaucaccaccauccagugcuacagccugagcaacuacgccgugcugauggaccugaccggcagcgagcuguacacccaggccgccagccugcugcaccccgugguguacaccaccgccaucauccugcugcugugccugcuggccgugaucgugagcuacaucuaccaccacagccugaucagaaucagccugaagagcuggcacaugcuggugaaccugugcuuccacaucuuccugaccugcgugguguucgugggcggcaucacccagaccagaaacgccagcaucugccaggccgugggcaucauccugcacuacagcacccuggccaccgugcugugggugggcgugaccgccagaaacaucuacaagcaggugaccaagaaggccaagagaugccaggaccccgacgagcccccccccccccccagacccaugcugagauucuaccugaucggcggcggcauccccaucaucgugugcggcaucaccgccgccgccaacaucaagaacuacggcagcagacccaacgcccccuacugcuggauggccugggagcccagccugggcgccuucuacggccccgccagcuucaucaccuucgugaacugcauguacuuccugagcaucuucauccagcugaagagacaccccgagagaaaguacgagcugaaggagcccaccgaggagcagcagagacuggccgccaacgagaacggcgagaucaaccaccaggacagcaugagccugagccugaucagcaccagcgcccuggagaacgagcacaccuuccacagccagcugcugggcgccagccugacccugcugcuguacguggcccuguggauguucggcgcccuggccgugagccuguacuacccccuggaccugguguucagcuucguguucggcgccaccagccugagcuucagcgccuucuucguggugcaccacugcgugaacagagaggacgugagacuggccuggaucaugaccugcugccccggcagaagcagcuacagcgugcaggugaacgugcagccccccaacagcaacggcaccaacggcgaggcccccaagugccccaacagcagcgccgagagcagcugcaccaacaagagcgccagcagcuucaagaacagcagccagggcugcaagcugaccaaccugcaggccgccgccgcccagugccacgccaacagccugccccugaacagcaccccccagcuggacaacagccugaccgagcacagcauggacaacgacaucaagaugcacguggccccccuggaggugcaguucagaaccaacgugcacagcagcagacaccacaagaacagaagcaagggccacagagccagcagacugaccgugcugagagaguacgccuacgacgugcccaccagcguggagggcagcgugcagaacggccugcccaagagcagacugggcaacaacgagggccacagcagaagcagaagagccuaccuggccuacagagagagacaguacaaccccccccagcaggacagcagcgacgccugcagcacccugcccaagagcagcagaaacuucgagaagcccgugagcaccaccagcaagaaggacgcccugagaaagcccgccgugguggagcuggagaaccagcagaagagcuacggccugaaccuggccauccagaacggccccaucaagagcaacggccaggagggcccccugcugggcaccgacagcaccggcaacgugagaaccggccuguggaagcacgagaccaccguguaa

SEQ ID NO: 13315 - RNA, 4755 nt, Artificial Sequence
  ADGRB1__Homo_sapiens__XP_011515501
augagaggccaggccgccgcccccggccccguguggauccuggccccccugcugcugcugcugcugcugcugggcagaagagccagagccgccgccggcgccgacgccggccccggccccgagcccugcgccacccuggugcagggcaaguucuucggcuacuucagcgccgccgccguguuccccgccaacgccagcagaugcagcuggacccugagaaaccccgaccccagaagauacacccuguacaugaagguggccaaggcccccgugcccugcagcggccccggcagagugagaaccuaccaguucgacagcuuccuggagagcaccagaaccuaccugggcguggagagcuucgacgaggugcugagacugugcgaccccagcgccccccuggccuuccugcaggccagcaagcaguuccugcagaugagaagacagcagcccccccagcacgacggccugagacccagagccggcccccccggccccaccgacgacuucagcguggaguaccugguggugggcaacagaaaccccagcagagccgccugccagaugcugugcagauggcuggacgccugccuggccggcagcagaagcagccaccccugcggcaucaugcagacccccugcgccugccugggcggcgaggccggcggccccgccgccggcccccuggcccccagaggcgacgugugccugagagacgccguggccggcggccccgagaacugccugaccagccugacccaggacagaggcggccacggcgccaccggcggcuggaagcuguggagccuguggggcgagugcaccagagacugcggcggcggccugcagaccagaaccagaaccugccugcccgcccccggcguggagggcggcggcugcgagggcgugcuggaggagggcagacagugcaacagagaggccugcggccccgccggcagaaccagcagcagaagccagagccugagaagcaccgacgccagaagaagagaggagcugggcgacgagcugcagcaguucggcuuccccgccccccagaccggcgaccccgccgccgaggaguggagccccuggagcgugugcagcagcaccugcggcgagggcuggcagaccagaaccagauucugcgugagcagcagcuacagcacccagugcagcggcccccugagagagcagagacugugcaacaacagcgccgugugccccgugcacggcgccugggacgaguggagccccuggagccugugcagcagcaccugcggcagaggcuucagagacagaaccagaaccugcagacccccccaguucggcggcaaccccugcgagggccccgagaagcagaccaaguucugcaacaucgcccugugccccggcagagccguggacggcaacuggaacgaguggagcagcuggagcgccugcagcgccagcugcagccagggcagacagcagagaaccagagagugcaacggccccagcuacggcggcgccgagugccagggccacuggguggagaccagagacugcuuccugcagcagugccccguggacggcaaguggcaggccugggccagcuggggcagcugcagcgugaccugcggcgccggcagccagagaagagagagagugugcagcggccccuucuucggcggcgccgccugccagggcccccaggacgaguacagacagugcggcacccagagaugccccgagccccacgagaucugcgacgaggacaacuucggcgccgugaucuggaaggagacccccgccggcgagguggccgccgugagaugccccagaaacgccaccggccugauccugagaagaugcgagcuggacgaggagggcaucgccuacugggagccccccaccuacaucagaugcgugagcaucgacuacagaaacauccagaugaugaccagagagcaccuggccaaggcccagagaggccugcccggcgagggcgugagcgaggugauccagacccugguggagaucagccaggacggcaccagcuacagcggcgaccugcugagcaccaucgacgugcugagaaacaugaccgagaucuucagaagagccuacuacagccccacccccggcgacgugcagaacuucgugcagauccugagcaaccugcuggccgaggagaacagagacaagugggaggaggcccagcuggccggccccaacgccaaggagcuguucagacugguggaggacuucguggacgugaucggcuucagaaugaaggaccugagagacgccuaccaggugaccgacaaccuggugcugagcauccacaagcugcccgccagcggcgccaccgacaucagcuuccccaugaagggcuggagagccaccggcgacugggccaaggugcccgaggacagagugaccgugagcaagagcguguucagcaccggccugaccgaggccgacgaggccagcguguucguggugggcaccgugcuguacagaaaccugggcagcuuccuggcccugcagagaaacaccaccgugcugaacagcaaggugaucagcgugaccgugaagcccccccccagaagccugagaaccccccuggagaucgaguucgcccacauguacaacggcaccaccaaccagaccugcauccugugggacgagaccgacgugcccagcagcagcgcccccccccagcugggccccuggagcuggagaggcugcagaaccgugccccuggacgcccugagaaccagaugccugugcgacagacugagcaccuucgccauccuggcccagcugagcgccgacgccaacauggagaaggccacccugcccagcgugacccugaucgugggcugcggcgugagcagccugacccugcugaugcuggugaucaucuacgugagcguguggagauacaucagaagcgagagaagcgugauccugaucaacuucugccugagcaucaucagcagcaacgcccugauccugaucggccagacccagaccagaaacaagguggugugcacccugguggccgccuuccugcacuucuucuuccugagcagcuucugcugggugcugaccgaggccuggcagagcuacauggccgugaccggccaccugagaaacagacugaucagaaagagauuccugugccugggcuggggccugcccgcccuggugguggccaucagcgugggcuucaccaaggccaagggcuacagcaccaugaacuacugcuggcugagccuggagggcggccugcuguacgccuucgugggccccgccgccgccguggugcuggugaacauggugaucggcauccugguguucaacaagcuggugagcaaggacggcaucaccgacaagaagcugaaggagagagccggcgccagccuguggagcagcugcguggugcugccccugcuggcccugaccuggaugagcgccgugcuggccgugaccgacagaagaagcgcccuguuccagauccuguucgccguguucgacagccuggagggcuucgugaucgugauggugcacugcauccugagaagagaggugcaggacgccgugaagugcagagugguggacagacaggaggagggcaacggcgacagcggcggcagcuuccagaacggccacgcccagcugaugaccgacuucgagaaggacguggaccuggccugcagaagcgugcugaacaaggacaucgccgccugcagaaccgccaccaucaccggcacccugaagagacccagccugcccgaggaggagaagcugaagcuggcccacgccaagggcccccccaccaacuucaacagccugcccgccaacgugagcaagcugcaccugcacggcagccccagauaccccggcggcccccugcccgacuuccccaaccacagccugacccugaagagagacaaggcccccaagagcagcuucgugggcgacggcgacaucuucaagaagcuggacagcgagcugagcagagcccaggagaaggcccuggacaccagcuacgugauccugcccaccgccaccgccacccugagacccaagcccaaggaggagcccaaguacagcauccacaucgaccagaugccccagaccagacugauccaccugagcaccgcccccgaggccagccugcccgccagaagcccccccagcagacagccccccagcggcggcccccccgaggccccccccgcccagcccccccccccccccccccccccccccccccccccccagcagccccugccccccccccccaaccuggagcccgccccccccagccugggcgaccccggcgagcccgccgcccaccccggccccagcaccggccccagcaccaagaacgagaacguggccacccugagcgugagcagccuggagagaagaaagagcagauacgccgagcuggacuucgagaagaucaugcacaccagaaagagacaccaggacauguuccaggaccugaacagaaagcugcagcacgccgccgagaaggacaaggaggugcugggccccgacagcaagcccgagaagcagcagacccccaacaagagacccugggagagccugagaaaggcccacggcacccccaccugggugaagaaggagcuggagccccugcagcccagcccccuggagcugagaagcguggagugggagagaagcggcgccaccaucccccuggugggccaggacaucaucgaccugcagaccgagguguaa

SEQ ID NO: 13316 - RNA, 4755 nt, Artificial Sequence
  ADGRB2__Homo_sapiens__NP_001281264
auggagaacaccggcuggaugggcaagggccacagaaugacccccgccugcccccugcugcugagcgugauccugagccugagacuggccaccgccuucgaccccgcccccagcgccugcagcgcccuggccagcggcgugcuguacggcgccuucagccugcaggaccuguuccccaccaucgccagcggcugcagcuggacccuggagaaccccgaccccaccaaguacagccuguaccugagauucaacagacaggagcaggugugcgcccacuucgcccccagacugcugccccuggaccacuaccuggugaacuucaccugccugagacccagccccgaggaggccguggcccaggccgagagcgaggugggcagacccgaggaggaggaggccgaggccgccgccggccuggagcugugcagcggcagcggccccuucaccuuccugcacuucgacaagaacuucgugcagcugugccugagcgccgagcccagcgaggcccccagacugcuggcccccgccgcccuggccuucagauucguggaggugcugcugaucaacaacaacaacagcagccaguucaccugcggcgugcugugcagauggagcgaggagugcggcagagccgccggcagagccugcggcuucgcccagcccggcugcagcugccccggcgaggccggcgccggcagcaccaccaccaccagccccggcccccccgccgcccacacccugagcaacgcccuggugcccggcggccccgccccccccgccgaggccgaccugcacagcggcagcagcaacgaccuguucaccaccgagaugagauacggcgaggagcccgaggaggagcccaaggugaagacccaguggcccagaagcgccgacgagcccggccuguacauggcccagaccggcgaccccgccgccgaggaguggagccccuggagcgugugcagccugaccugcggccagggccugcaggugagaaccagaagcugcgugagcagccccuacggcacccugugcagcggcccccugagagagaccagacccugcaacaacagcgccaccugccccgugcacggcgugugggaggaguggggcagcuggagccugugcagcagaagcugcggcagaggcagcagaagcagaaugagaaccugcgugcccccccagcacggcggcaaggccugcgagggccccgagcugcagaccaagcugugcagcauggccgccugccccguggagggccaguggcuggaguggggccccuggggccccugcagcaccagcugcgccaacggcacccagcagagaagcagaaagugcagcguggccggccccgccugggccaccugcaccggcgcccugaccgacaccagagagugcagcaaccuggagugccccgccaccgacagcaaguggggccccuggaacgccuggagccugugcagcaagaccugcgacaccggcuggcagagaagauucagaaugugccaggccaccggcacccagggcuaccccugcgagggcaccggcgaggaggugaagcccugcagcgagaagagaugccccgccuuccacgagaugugcagagacgaguacgugaugcugaugaccuggaagaaggccgccgccggcgagaucaucuacaacaagugcccccccaacgccagcggcagcgccagcagaagaugccugcugagcgcccagggcguggccuacuggggccugcccagcuucgccagaugcaucagccacgaguacagauaccuguaccugagccugagagagcaccuggccaagggccagagaaugcuggccggcgagggcaugagccagguggugagaagccugcaggagcugcuggccagaagaaccuacuacagcggcgaccugcuguucagcguggacauccugagaaacgugaccgacaccuucaagagagccaccuacgugcccagcgccgacgacgugcagagauucuuccagguggugagcuucaugguggacgccgagaacaaggagaagugggacgacgcccagcaggugagccccggcagcgugcaccugcugagagugguggaggacuucauccaccuggugggcgacgcccugaaggccuuccagagcagccugaucgugaccgacaaccuggugaucagcauccagagagagcccgugagcgccgugagcagcgacaucaccuuccccaugagaggcagaagaggcaugaaggacugggugagacacagcgaggacagacuguuccugcccaaggaggugcugagccugagcagccccggcaagcccgccaccagcggcgccgccggcagccccggcagaggcagaggccccggcaccgugccccccggccccggccacagccaccagagacugcugcccgccgaccccgacgagagcagcuacuucgugaucggcgccgugcuguacagaacccugggccugauccugcccccccccagacccccccuggccgugaccagcagagugaugaccgugaccgugagaccccccacccagccccccgccgagccccugaucaccguggagcugagcuacaucaucaacggcaccaccgacccccacugcgccagcugggacuacagcagagccgacgccagcagcggcgacugggacaccgagaacugccagacccuggagacccaggccgcccacaccagaugccagugccagcaccugagcaccuucgccgugcuggcccagccccccaaggaccugacccuggagcuggccggcagccccagcgugccccuggugaucggcugcgccgugagcugcauggcccugcugacccugcuggccaucuacgccgccuucuggagauucaucaagagcgagagaagcaucauccugcugaacuucugccugagcauccuggccagcaacauccugauccuggugggccagagcagagugcugagcaagggcgugugcaccaugaccgccgccuuccugcacuucuucuuccugagcagcuucugcugggugcugaccgaggccuggcagagcuaccuggccgugaucggcagaaugagaaccagacuggugagaaagagauuccugugccugggcuggggccugcccgcccuggugguggccgugagcgugggcuucaccagaaccaagggcuacggcaccagcagcuacugcuggcugagccuggagggcggccugcuguacgccuucgugggccccgccgccgugaucgugcuggugaacaugcugaucggcaucaucguguucaacaagcugauggccagagacggcaucagcgacaagagcaagaagcagagagccggcagcgagagaugccccugggccagccugcugcugcccugcagcgccugcggcgccgugcccagcccccugcugagcagcgccagcgccagaaacgccauggccagccuguggagcagcugcguggugcugccccugcuggcccugaccuggaugagcgccgugcuggccaugaccgacagaagaagcgugcuguuccaggcccuguucgccguguucaacagcgcccagggcuucgugaucaccgccgugcacugcuuccugagaagagaggugcaggacguggugaagugccagaugggcgugugcagagccgacgagagcgaggacagccccgacagcugcaagaacggccagcugcagauccugagcgacuucgagaaggacguggaccuggccugccagaccgugcuguucaaggaggugaacaccugcaaccccagcaccaucaccggcacccugagcagacugagccuggacgaggacgaggagcccaagagcugccuggugggccccgagggcagccugagcuucagcccccugcccggcaacauccuggugcccauggccgccagccccggccugggcgagcccccccccccccaggaggccaaccccguguacaugugcggcgagggcggccugagacagcuggaccugaccuggcugagacccaccgagcccggcagcgagggcgacuacauggugcugcccagaagaacccugagccugcagcccggcggcggcggcggcggcggcgaggacgcccccagagccagacccgagggcacccccagaagagccgccaagaccguggcccacaccgagggcuaccccagcuuccugagcguggaccacagcggccugggccugggccccgccuacggcagccugcagaaccccuacggcaugaccuuccagccccccccccccacccccagcgccagacaggugcccgagcccggcgagagaagcagaaccaugcccagaaccgugcccggcagcaccaugaagaugggcagccuggagagaaagaagcugagauacagcgaccuggacuucgaggugaugcacaccagaaagagacacagcgagcuguaccacgagcugaaccagaaguuccacaccuucgacagauacagaagccagagcaccgccaagagagagaagagauggagcgugagcagcggcggcgccgccgagagaagcgugugcaccgacaagcccagccccggcgagagacccagccugagccagcacagaagacaccagagcuggagcaccuucaagagcaugacccugggcagccugccccccaagcccagagagagacugacccugcacagagccgccgccugggagcccaccgagccccccgacggcgacuuccagaccgagguguaa

SEQ ID NO: 13317 - RNA, 4569 nt, Artificial Sequence
  ADGRB3__Homo_sapiens__NP_001695
augaaggccgugagaaaccugcugaucuacaucuucagcaccuaccugcuggugauguucggcuucaacgccgcccaggacuucuggugcagcacccuggugaagggcgugaucuacggcagcuacagcgugagcgagauguuccccaagaacuucaccaacugcaccuggacccuggagaaccccgaccccaccaaguacagcaucuaccugaaguucagcaagaaggaccugagcugcagcaacuucagccugcuggccuaccaguucgaccacuucagccacgagaagaucaaggaccugcugagaaagaaccacagcaucaugcagcugugcaacagcaagaacgccuucguguuccugcaguacgacaagaacuucauccagaucagaagaguguuccccaccaacuuccccggccugcagaagaagggcgaggaggaccagaagagcuucuucgaguuccuggugcugaacaaggugagccccagccaguucggcugccacgugcugugcaccuggcuggagagcugccugaagagcgagaacggcagaaccgagagcugcggcaucauguacaccaagugcaccugcccccagcaccugggcgaguggggcaucgacgaccagagccugauccugcugaacaacguggugcugccccugaacgagcagaccgagggcugccugacccaggagcugcagaccacccaggugugcaaccugaccagagaggccaagagaccccccaaggaggaguucggcaugaugggcgaccacaccaucaagagccagagacccagaagcgugcacgagaagagagugccccaggagcaggccgacgccgccaaguucauggcccagaccggcgagagcggcguggaggaguggagccaguggagcaccugcagcgugaccugcggccagggcagccaggugagaaccagaaccugcgugagccccuacggcacccacugcagcggcccccugagagagagcagagugugcaacaacaccgcccugugccccgugcacggcgugugggaggaguggagccccuggagccugugcagcuucaccugcggcagaggccagagaaccagaaccagaagcugcacccccccccaguacggcggcagacccugcgagggccccgagacccaccacaagcccugcaacaucgcccugugccccguggacggccaguggcaggaguggagcagcuggagccagugcagcgugaccugcagcaacggcacccagcagagaagcagacagugcaccgccgccgcccacggcggcagcgagugcagaggccccugggccgagagcagagagugcuacaaccccgagugcaccgccaacggccaguggaaccaguggggccacuggagcggcugcagcaagagcugcgacggcggcugggagagaagaaucagaaccugccagggcgccgugaucaccggccagcagugcgagggcaccggcgaggaggugagaagaugcagcgagcagagaugccccgcccccuacgagaucugccccgaggacuaccugaugagcaugguguggaagagaacccccgccggcgaccuggccuucaaccagugcccccugaacgccaccggcaccaccagcagaagaugcagccugagccugcacggcguggccuucugggagcagcccagcuucgccagaugcaucagcaacgaguacagacaccugcagcacagcaucaaggagcaccuggccaagggccagagaaugcuggccggcgacggcaugagccaggugaccaagacccugcuggaccugacccagagaaagaacuucuacgccggcgaccugcugaugagcguggagauccugagaaacgugaccgacaccuucaagagagccagcuacauccccgccagcgacggcgugcagaacuucuuccagaucgugagcaaccugcuggacgaggagaacaaggagaagugggaggacgcccagcagaucuaccccggcagcaucgagcugaugcaggugaucgaggacuucauccacaucgugggcaugggcaugauggacuuccagaacagcuaccugaugaccggcaacgugguggccagcauccagaagcugcccgccgccagcgugcugaccgacaucaacuuccccaugaagggcagaaagggcaugguggacugggccagaaacagcgaggacagaguggugauccccaagagcaucuucacccccgugagcagcaaggagcuggacgagagcagcguguucgugcugggcgccgugcuguacaagaaccuggaccugauccugcccacccugagaaacuacaccgugaucaacagcaagaucaucguggugaccaucagacccgagcccaagaccaccgacagcuuccuggagaucgagcuggcccaccuggccaacggcacccugaaccccuacugcgugcugugggacgacagcaagaccaacgagagccugggcaccuggagcacccagggcugcaagaccgugcugaccgacgccagccacaccaagugccugugcgacagacugagcaccuucgccauccuggcccagcagcccagagagaucaucauggagagcagcggcacccccagcgugacccugaucgugggcagcggccugagcugccuggcccugaucacccuggccgugguguacgccgcccuguggagauacaucagaagcgagagaagcaucauccugaucaacuucugccugagcaucaucagcagcaacauccugauccuggugggccagacccagacccacaacaagagcaucugcaccaccaccaccgccuuccugcacuucuucuuccuggccagcuucugcugggugcugaccgaggccuggcagagcuacauggccgugaccggcaagaucagaaccagacugaucagaaagagauuccugugccugggcuggggccugcccgcccuggugguggccaccagcgugggcuucaccagaaccaagggcuacggcaccgaccacuacugcuggcugagccuggagggcggccugcuguacgccuucgugggccccgccgccgccguggugcuggugaacauggugaucggcauccugguguucaacaagcuggugagcagagacggcauccuggacaagaagcugaagcacagagccggccagaugagcgagccccacagcggccugacccugaagugcgccaagugcggcguggugagcaccaccgcccugagcgccaccaccgccagcaacgccauggccagccuguggagcagcugcguggugcugccccugcuggcccugaccuggaugagcgccgugcuggccaugaccgacaagagaagcauccuguuccagauccuguucgccguguucgacagccugcagggcuucgugaucgugauggugcacugcauccugagaagagaggugcaggacgccuucagaugcagacugagaaacugccaggaccccaucaacgccgacagcagcagcagcuuccccaacggccacgcccagaucaugaccgacuucgagaaggacguggacaucgccugcagaagcgugcugcacaaggacaucggccccugcagagccgccaccaucaccggcacccugagcagaaucagccugaacgacgacgaggaggagaagggcaccaaccccgagggccugagcuacagcacccugcccggcaacgugaucagcaaggugaucauccagcagcccaccggccugcacaugcccaugagcaugaacgagcugagcaaccccugccugaagaaggagaacagcgagcugagaagaaccguguaccugugcaccgacgacaaccugagaggcgccgacauggacaucgugcacccccaggagagaaugauggagagcgacuacaucgugaugcccagaagcagcgugaacaaccagcccagcaugaaggaggagagcaagaugaacaucggcauggagacccugccccacgagagacugcugcacuacaaggugaaccccgaguucaacaugaacccccccgugauggaccaguucaacaugaaccuggagcagcaccuggccccccaggagcacaugcagaaccugcccuucgagcccagaaccgccgugaagaacuucauggccagcgagcuggacgacaacgccggccugagcagaagcgagaccggcagcaccaucagcaugagcagccuggagagaagaaagagcagauacagcgaccuggacuucgagaaggugaugcacaccagaaagagacacauggagcuguuccaggagcugaaccagaaguuccagacccuggacagauucagagacauccccaacaccagcagcauggagaaccccgcccccaacaagaaccccugggacaccuucaagaaccccagcgaguacccccacuacaccaccaucaacgugcuggacaccgaggccaaggacgcccuggagcugagacccgccgagugggagaagugccugaaccugccccuggacgugcaggagggcgacuuccagaccgagguguaa

SEQ ID NO: 13318 - RNA, 2625 nt, Artificial Sequence
  ADGRD1__Homo_sapiens__NP_942122
auggagaagcugcugagacugugcugcugguacagcuggcugcugcuguucuacuacaacuuccaggugagaggcguguacagcagaagccaggaccaccccggcuuccaggugcuggccagcgccagccacuacuggccccuggagaacguggacggcauccacgagcugcaggacaccaccggcgacaucguggagggcaaggugaacaagggcaucuaccugaaggaggagaagggcgugacccugcuguacuacggcagauacaacagcagcugcaucagcaagcccgagcagugcggccccgagggcgugaccuucagcuucuucuggaagacccagggcgagcagagcagacccauccccagcgccuacggcggccaggugaucagcaacggcuucaaggugugcagcagcggcggcagaggcagcguggagcuguacaccagagacaacagcaugaccugggaggccagcuucagcccccccggccccuacuggacccacgugcuguucaccuggaagagcaaggagggccugaagguguacgugaacggcacccugagcaccagcgaccccagcggcaaggugagcagagacuacggcgagagcaacgugaaccuggugaucggcagcgagcaggaccaggccaagugcuacgagaacggcgccuucgacgaguucaucaucugggagagagcccugacccccgacgagaucgccauguacuucaccgccgccaucggcaagcacgcccugcugagcagcacccugcccagccuguucaugaccagcaccgccagccccgugaugcccaccgacgccuaccaccccaucaucaccaaccugaccgaggagagaaagaccuuccagagccccggcgugauccugagcuaccugcagaacgugagccugagccugcccagcaagagccugagcgagcagaccgcccugaaccugaccaagaccuuccugaaggccgugggcgagauccugcugcugcccggcuggaucgcccugagcgaggacagcgccguggugcugagccugaucgacaccaucgacaccgugaugggccacgugagcagcaaccugcacggcagcaccccccaggugaccguggagggcagcagcgccauggccgaguucagcguggccaagauccugcccaagaccgugaacagcagccacuacagauuccccgcccacggccagagcuucauccagaucccccacgaggccuuccacagacacgccuggagcaccguggugggccugcuguaccacagcaugcacuacuaccugaacaacaucuggcccgcccacaccaagaucgccgaggccaugcaccaccaggacugccugcuguucgccaccagccaccugaucagccuggaggugagccccccccccacccugagccagaaccugagcggcagcccccugaucaccgugcaccugaagcacagacugaccagaaagcagcacagcgaggccaccaacagcagcaacagaguguucguguacugcgccuuccuggacuucagcagcggcgagggcguguggagcaaccacggcugcgcccugaccagaggcaaccugaccuacagcgugugcagaugcacccaccugaccaacuucgccauccugaugcagguggugccccuggagcuggccagaggccaccagguggcccugagcagcaucagcuacgugggcugcagccugagcgugcugugccugguggccacccuggugaccuucgccgugcugagcagcgugagcaccaucagaaaccagagauaccacauccacgccaaccugagcuucgccgugcugguggcccaggugcugcugcugaucagcuucagacuggagcccggcaccacccccugccaggugauggccgugcugcugcacuacuucuuccugagcgccuucgccuggaugcugguggagggccugcaccuguacagcauggugaucaagguguucggcagcgaggacagcaagcacagauacuacuacggcaugggcuggggcuucccccugcugaucugcaucaucagccugagcuucgccauggacagcuacggcaccagcaacaacugcuggcugagccuggccagcggcgccaucugggccuucguggcccccgcccuguucgugaucguggugaacaucggcauccugaucgccgugaccagagugaucagccagaucagcgccgacaacuacaagauccacggcgaccccagcgccuucaagcugaccgccaaggccguggccgugcugcugcccauccugggcaccagcuggguguucggcgugcuggccgugaacggcugcgccgugguguuccaguacauguucgccacccugaacagccugcagggccuguucaucuuccuguuccacugccugcugaacagcgaggugagagccgccuucaagcacaagaccaagguguggagccugaccagcagcagcgccagaaccagcaacgccaagcccuuccacagcgaccugaugaacggcaccagacccggcauggccagcaccaagcugagccccugggacaagagcagccacagcgcccacagaguggaccugagcgccguguaa

SEQ ID NO: 13319 - RNA, 2925 nt, Artificial Sequence
  ADGRD2__Homo_sapiens__XP_006717411
auggugaccggccccgaggagggcaacagcgagauggacgcccccuggggcgccggcgagagauggcugcacggcgccgccguggacagaagcggcgugagccugggccccccccccaccccccaggugaaccagggcacccugggcccccagguggcccccguggccgccggcgagguggugaagaccgccggcggcgugugcaaguucagcggccagagacugagcugguggcaggcccaggagagcugcgagcagcaguucggccaccuggcccugcagccccccgacggcgugcuggccagcagacugagagaccccgugugggugggccagagagaggccccccugagaagacccccccagagaagagccagaaccaccgccgugcugguguucgacgagagaaccgccgacagagccgccagacugagaagcccccugcccgagcuggccgcccugaccgccugcacccacgugcagugggacugcgccagccccgaccccgccgcccuguucagcguggccgcccccgcccugcccaacgcccugcagcugagagccuucgccgagcccggcggcguggugagagccgcccugguggugagaggccagcacgcccccuuccuggccgccuucagagccgacggcagauggcaccacgugugcgccaccugggagcagagaggcggcagaugggcccuguucagcgacggcagaagaagagccggcgccagaggccugggcgccggccaccccgugcccagcggcggcauccuggugcugggccaggaccaggacagccugggcggcggcuucagcgugagacacgcccugagcggcaaccugaccgacuuccaccugugggccagagcccugagccccgcccagcugcacagagccagagccugcgccccccccagcgagggccugcuguucagaugggaccccggcgcccuggacgugacccccagccugcugcccaccgugugggugagacugcugugccccgugcccagcgaggagugccccaccuggaaccccggccccagaagcgagggcagcgagcugugccuggagccccagcccuuccugugcugcuacagaaccgagcccuacagaagacugcaggacgcccagagcuggcccggccaggacgugaucagcagagugaacgcccuggccaacgacaucgugcugcugcccgacccccugagcgaggugcacggcgcccugagccccgccgaggccagcagcuuccugggccugcuggagcacgugcuggccauggagauggccccccugggccccgccgcccugcuggccguggugagauuccugaagagagugguggcccugggcgccggcgaccccgagcugcugcugaccggccccugggagcagcugagccagggcguggugagcguggccagccuggugcuggaggagcagguggccgacaccuggcugagccugagagaggugaucggcggccccauggcccugguggccagcgugcagagacuggccccccugcugagcaccagcaugaccagcgagagacccagaaugagaauccagcacagacacgccggccugagcggcgugaccgugauccacagcugguucaccagcagaguguuccagcacacccuggagggccccgaccuggagccccaggcccccgccagcagcgaggaggccaacagagugcagagauuccugagcacccaggugggcagcgccaucaucagcagcgaggugugggacgugaccggcgaggugaacguggccaugaccuuccaccugcagcacagagcccagagcccccuguuccccccccacccccccagccccuacaccggcggcgccugggccaccaccggcugcagcguggccgcccuguaccuggacagcaccgccugcuucugcaaccacagcaccagcuucgccauccugcugcagaucuacgaggugcagagaggccccgaggaggagagccugcugagaacccugagcuucgugggcugcggcgugagcuucugcgcccugaccaccaccuuccugcuguuccugguggccggcgugcccaagagcgagagaaccaccgugcacaagaaccugaccuucagccuggccagcgccgagggcuuccugaugaccagcgagugggccaaggccaacgagguggccugcguggccgugaccguggccaugcacuuccuguuccugguggccuucagcuggaugcugguggagggccugcugcuguggagaaaggugguggccgugagcaugcaccccggccccggcaugagacuguaccacgccaccggcuggggcgugcccgugggcaucguggccgugacccuggccaugcugccccacgacuacguggcccccggccacugcuggcugaacgugcacaccaacgccaucugggccuucgugggccccgugcuguucgugcugaccgccaacaccugcauccuggccagaguggugaugaucaccgugagcagcgccagaagaagagccagaaugcugagcccccagcccugccugcagcagcagaucuggacccagaucugggccaccgugaagcccgugcuggugcugcugcccgugcugggccugaccuggcuggccggcauccuggugcaccugagccccgccugggccuacgccgccgugggccugaacagcauccagggccuguacaucuuccugguguacgccgccugcaacgaggaggugagaagcgcccugcagagaauggccgagaagaagguggccgaggugcugagagcccugggcguguggggcggcgccgccaaggagcacagccugcccuucagcgugcugccccuguuccugccccccaagcccagcacccccagacacccccugaaggcccccgccuaa

SEQ ID NO: 13320 - RNA, 2604 nt, Artificial Sequence
  ADGRE1__Homo_sapiens__NP_001243181
augagaggcuucaaccugcugcuguucuggggcugcugcgugaugcacagcugggagggccacaucagacccaccagaaagcccaacaccaagggcaacaacugcagagacagcacccugugccccgccuacgccaccugcaccaacaccguggacagcuacuacugcgccugcaagcagggcuuccugagcagcaacggccagaaccacuucaaggaccccggcgugagaugcaaggacaucaacgagugccugaccagcagcgugugccccgagcacagcgacugcgugaacagcaugggcagcuacagcugcagcugccaggugggcuucaucagcagaaacagcaccugcgaggacguggacgagugcgccgaccccagagccugccccgagcacgccaccugcaacaacaccgugggcaacuacagcugcuucugcaaccccggcuucgagagcagcagcggccaccugagcuuccagggccugaaggccagcugcgaggacaucgacgagugcaccgagaugugccccaucaacagcaccugcaccaacacccccggcagcuacuucugcaccugccaccccggcuucgcccccagcaacggccagcugaacuucaccgaccagggcguggagugcagagacaucgacgagugcagacaggaccccagcaccugcggccccaacagcaucugcaccaacgcccugggcagcuacagcugcggcugcaucgccggcuuccaccccaaccccgagggcagccagaaggacggcaacuucagcugccagagagugcuguucaagugcaaggaggacgugauccccgacaacaagcagauccagcagugccaggagggcaccgccgugaagcccgccuacgugagcuucugcgcccagaucaacaacaucuucagcgugcuggacaaggugugcgagaacaagaccaccguggugagccugaagaacaccaccgagagcuucgugcccgugcugaagcagaucagcaccuggaccaaguucaccaaggaggagaccagcagccuggccaccguguuccuggagagcguggagagcaugacccuggccagcuucuggaagcccagcgccaacaucacccccgccgugagaaccgaguaccuggacaucgagagcaaggugaucaacaaggagugcagcgaggagaacgugacccuggaccugguggccaagggcgacaagaugaagaucggcugcagcaccaucgaggagagcgagagcaccgagaccaccggcguggccuucgugagcuucgugggcauggagagcgugcugaacgagagauucuucaaggaccaccaggccccccugaccaccagcgagaucaagcugaagaugaacagcagaguggugggcggcaucaugaccggcgagaagaaggacggcuucagcgaccccaucaucuacacccuggagaacauccagcccaagcagaaguucgagagacccaucugcgugagcuggagcaccgacgugaagggcggcagauggaccagcuucggcugcgugauccuggaggccagcgagaccuacaccaucugcagcugcaaccagauggccaaccuggccgugaucauggccagcggcgagcugaccauggacuucagccuguacaucaucagccacgugggcaucaucaucagccuggugugccuggugcuggccaucgccaccuuccugcugugcagaagcaucagaaaccacaacaccuaccugcaccugcaccugugcgugugccugcugcuggccaagacccuguuccuggccggcauccacaagaccgacaacaagaugggcugcgccaucaucgccggcuuccugcacuaccuguuccuggccugcuucuucuggaugcugguggaggccgugauccuguuccugauggugagaaaccugaagguggugaacuacuucagcagcagaaacaucaagaugcugcacaucugcgccuucggcuacggccugcccaugcuggugguggugaucagcgccagcgugcagccccagggcuacggcaugcacaacagaugcuggcugaacaccgagaccggcuucaucuggagcuuccugggccccgugugcaccgugaucguggugagcaaguacuacaacagccuggccaagugcgugcugaaggaggagcagggcgaccugagagaccuggaguuccccggcaccugcgccgccgagagaaucaacagccugcugcugaccuggacccuguggauccugagacagagacugagcagcgugaacgccgaggugagcacccugaaggacaccagacugcugaccuucaaggccuucgcccagcuguucauccugggcugcagcugggugcugggcaucuuccagaucggccccguggccggcgugauggccuaccuguucaccaucaucaacagccugcagggcgccuucaucuuccugauccacugccugcugaacggccaggugagagaggaguacaagagauggaucaccggcaagaccaagcccagcagccagagccagaccagcagaauccugcugagcagcaugcccagcgccagcaagaccggcuaa

SEQ ID NO: 13321 - RNA, 2298 nt, Artificial Sequence
  ADGRE2__Homo_sapiens__NP_001257981
augggcggcagaguguuccugguguuccuggccuucugcguguggcugacccugcccggcgccgagacccaggacagcagaggcugcgccagauggugcccccaggacagcagcugcgugaacgccaccgccugcagaugcaaccccggcuucagcagcuucagcgagaucaucaccacccccauggagaccugcgacgacaucaacgagugcgccacccugagcaaggugagcugcggcaaguucagcgacugcuggaacaccgagggcagcuacgacugcgugugcagccccggcuacgagcccgugagcggcgccaagaccuucaagaacgagagcgagaacaccugccaggacguggacgagugccagcagaaccccagacugugcaagagcuacggcaccugcgugaacacccugggcagcuacaccugccagugccugcccggcuucaagcugaagcccgaggaccccaagcugugcaccgacgugaacgagugcaccagcggccagaaccccugccacagcagcacccacugccugaacaacgugggcagcuaccagugcagaugcagacccggcuggcagcccauccccggcagccccaacggccccaacaacaccgugugcgaggacguggacgagugcagcagcggccagcaccagugcgacagcagcaccgugugcuucaacaccgugggcagcuacagcugcagaugcagacccggcuggaagcccagacacggcauccccaacaaccagaaggacaccgugugcgaggacaugaccuucagcaccuggacccccccccccggcgugcacagccagacccugagcagauucuucgacaaggugcaggaccugggcagagacuacaagcccggccuggccaacaacaccauccagagcauccugcaggcccuggacgagcugcuggaggcccccggcgaccuggagacccugcccagacugcagcagcacugcguggccagccaccugcuggacggccuggaggacgugcugagaggccugagcaagaaccugagcaacggccugcugaacuucagcuaccccgccggcaccgagcugagccuggaggugcagaagcagguggacagaagcgugacccugagacagaaccaggccgugaugcagcuggacuggaaccaggcccagaagagcggcgaccccggccccagcguggugggccuggugagcauccccggcaugggcaagcugcuggccgaggccccccuggugcuggagcccgagaagcagaugcugcugcacgagacccaccagggccugcugcaggacggcagccccauccugcugagcgacgugaucagcgccuuccugagcaacaacgacacccagaaccugagcagccccgugaccuucaccuucagccacagagaggaggaccccgugcugaccgugaucaccuacaugggccugagcgugagccugcugugccugcugcuggccgcccugaccuuccugcugugcaaggccauccagaacaccagcaccagccugcaccugcagcugagccugugccuguuccuggcccaccugcuguuccugguggccaucgaccagaccggccacaaggugcugugcagcaucaucgccggcacccugcacuaccuguaccuggccacccugaccuggaugcugcuggaggcccuguaccuguuccugaccgccagaaaccugaccguggugaacuacagcagcaucaacagauucaugaagaagcugauguuccccgugggcuacggcgugcccgccgugaccguggccaucagcgccgccagcagaccccaccuguacggcacccccagcagaugcuggcugcagcccgagaagggcuucaucuggggcuuccugggccccgugugcgccaucuucagcgugaaccuggugcuguuccuggugacccuguggauccugaagaacagacugagcagccugaacagcgaggugagcacccugagaaacaccagaaugcuggccuucaaggccaccgcccagcuguucauccugggcugcaccuggugccugggcauccugcaggugggccccgccgccagagugauggccuaccuguucaccaucaucaacagccugcagggcguguucaucuuccugguguacugccugcugagccagcaggugagagagcaguacggcaaguggagcaagggcaucagaaagcugaagaccgagagcgagaugcacacccugagcagcagcgccaaggccgacaccagcaagcccagcaccgugaacuaa

SEQ ID NO: 13322 - RNA, 2361 nt, Artificial Sequence
  ADGRE5__Homo_sapiens__NP_001020331
augggcggcagaguguuccuggccuucugcguguggcugacccugcccggcgccgagacccaggacagcagaggcugcgccagauggugcccccagaacagcagcugcgugaacgccaccgccugcagaugcaaccccggcuucagcagcuucagcgagaucaucaccacccccaccgagaccugcgacgacaucaacgagugcgccacccccagcaaggugagcugcggcaaguucagcgacugcuggaacaccgagggcagcuacgacugcgugugcagccccggcuacgagcccgugagcggcgccaagaccuucaagaacgagagcgagaacaccugccaggacguggacgagugccagcagaaccccagacugugcaagagcuacggcaccugcgugaacacccugggcagcuacaccugccagugccugcccggcuucaaguucauccccgaggaccccaaggugugcaccgacguggacgagugcagcagcggccagcaccagugcgacagcagcaccgugugcuucaacaccgugggcagcuacagcugcagaugcagacccggcuggaagcccagacacggcauccccaacaaccagaaggacaccgugugcgaggacaugaccuucagcaccuggacccccccccccggcgugcacagccagacccugagcagauucuucgacaaggugcaggaccugggcagagacagcaagaccagcagcgccgaggugaccauccagaacgugaucaagcugguggacgagcugauggaggcccccggcgacguggaggcccuggccccccccgugagacaccugaucgccacccagcugcugagcaaccuggaggacaucaugagaauccuggccaagagccugcccaagggccccuucaccuacaucagccccagcaacaccgagcugacccugaugauccaggagagaggcgacaagaacgugaccaugggccagagcagcgccagaaugaagcugaacugggccguggccgccggcgccgaggaccccggccccgccguggccggcauccugagcauccagaacaugaccacccugcuggccaacgccagccugaaccugcacagcaagaagcaggccgagcuggaggagaucuacgagagcagcaucagaggcgugcagcugagaagacugagcgccgugaacagcaucuuccugagccacaacaacaccaaggagcugaacagccccauccuguucgccuucagccaccuggagagcagcgacggcgaggccggcagagacccccccgccaaggacgugaugcccggccccagacaggagcugcugugcgccuucuggaagagcgacagcgacagaggcggccacugggccaccgagggcugccaggugcugggcagcaagaacggcagcaccaccugccagugcagccaccugagcagcuucgccauccugauggcccacuacgacguggaggacuggaagcugacccugaucaccagagugggccuggcccugagccuguucugccugcugcugugcauccugaccuuccugcuggugagacccauccagggcagcagaaccaccauccaccugcaccugugcaucugccuguucgugggcagcaccaucuuccuggccggcaucgagaacgagggcggccaggugggccugagaugcagacugguggccggccugcugcacuacugcuuccuggccgccuucugcuggaugagccuggagggccuggagcuguacuuccugguggugagaguguuccagggccagggccugagcaccagauggcugugccugaucggcuacggcgugccccugcugaucgugggcgugagcgccgccaucuacagcaagggcuacggcagacccagauacugcuggcuggacuucgagcagggcuuccuguggagcuuccugggccccgugaccuucaucauccugugcaacgccgugaucuucgugaccaccguguggaagcugacccagaaguucagcgagaucaaccccgacaugaagaagcugaagaaggccagagcccugaccaucaccgccaucgcccagcuguuccugcugggcugcaccuggguguucggccuguucaucuucgacgacagaagccuggugcugaccuacguguucaccauccugaacugccugcagggcgccuuccuguaccugcugcacugccugcugaacaagaaggugagagaggaguacagaaagugggccugccugguggccggcggcagcaaguacagcgaguucaccagcaccaccagcggcaccggccacaaccagaccagagcccugagagccagcgagagcggcaucuaa

SEQ ID NO: 13323 - RNA, 4041 nt, Artificial Sequence
  ADGRF5__Homo_sapiens__NP_056049
augaagagccccagaagaaccacccugugccugauguucaucgugaucuacagcagcaaggccgcccugaacuggaacuacgagagcaccauccacccccugagccugcacgagcacgagcccgccggcgaggaggcccugagacagaagagagccguggccaccaagagccccaccgccgaggaguacaccgugaacaucgagaucagcuucgagaacgccagcuuccuggaccccaucaaggccuaccugaacagccugagcuuccccauccacggcaacaacaccgaccagaucaccgacauccugagcaucaacgugaccaccgugugcagacccgccggcaacgagaucuggugcagcugcgagaccggcuacggcuggcccagagagagaugccugcacaaccugaucugccaggagagagacguguuccugcccggccaccacugcagcugccugaaggagcugccccccaacggccccuucugccugcugcaggaggacgugacccugaacaugagagugagacugaacgugggcuuccaggaggaccugaugaacaccagcagcgcccuguacagaagcuacaagaccgaccuggagaccgccuucagaaagggcuacggcauccugcccggcuucaagggcgugaccgugaccggcuucaagagcggcagcgugguggugaccuacgaggugaagaccaccccccccagccuggagcugauccacaaggccaacgagcagguggugcagagccugaaccagaccuacaagauggacuacaacagcuuccaggccgugaccaucaacgagagcaacuucuucgugacccccgagaucaucuucgagggcgacaccgugagccuggugugcgagaaggaggugcugagcagcaacgugagcuggagauacgaggagcagcagcuggagauccagaacagcagcagauucagcaucuacaccgcccuguucaacaacaugaccagcgugagcaagcugaccauccacaacaucacccccggcgacgccggcgaguacgugugcaagcugauccuggacaucuucgaguacgagugcaagaagaagaucgacgugaugcccauccagauccuggccaacgaggagaugaaggugaugugcgacaacaaccccgugagccugaacugcugcagccagggcaacgugaacuggagcaagguggaguggaagcaggagggcaagaucaacauccccggcacccccgagaccgacaucgacagcagcugcagcagauacacccugaaggccgacggcacccagugccccagcggcagcagcggcaccaccgugaucuacaccugcgaguucaucagcgccuacggcgccagaggcagcgccaacaucaaggugaccuucaucagcguggccaaccugaccaucacccccgaccccaucagcgugagcgagggccagaacuucagcaucaagugcaucagcgacgugagcaacuacgacgagguguacuggaacaccagcgccggcaucaagaucuaccagagauucuacaccaccagaagauaccuggacggcgccgagagcgugcugaccgugaagaccagcaccagagaguggaacggcaccuaccacugcaucuucagauacaagaacagcuacagcaucgccaccaaggacgugaucgugcacccccugccccugaagcugaacaucaugguggacccccuggaggccaccgugagcugcagcggcagccaccacaucaagugcugcaucgaggaggacggcgacuacaaggugaccuuccacaccggcagcagcagccugcccgccgccaaggaggugaacaagaagcaggugugcuacaagcacaacuucaacgccagcagcgugagcuggugcagcaagaccguggacgugugcugccacuucaccaacgccgccaacaacagcguguggagccccagcaugaagcugaaccuggugcccggcgagaacaucaccugccaggaccccgugaucggcgugggcgagcccggcaaggugauccagaagcugugcagauucagcaacgugcccagcagccccgagagccccaucggcggcaccaucaccuacaagugcgugggcagccagugggaggagaagagaaacgacugcaucagcgcccccaucaacagccugcugcagauggccaaggcccugaucaagagccccagccaggacgagaugcugcccaccuaccugaaggaccugagcaucagcaucgacaaggccgagcacgagaucagcagcagccccggcagccugggcgccaucaucaacauccuggaccugcugagcaccgugcccacccaggugaacagcgagaugaugacccacgugcugagcaccgugaacgugauccugggcaagcccgugcugaacaccuggaaggugcugcagcagcaguggaccaaccagagcagccagcugcugcacagcguggagagauucagccaggcccugcagagcggcgacagccccccccugagcuucagccagaccaacgugcagaugagcagcauggugaucaagagcagccaccccgagaccuaccagcagagauucguguuccccuacuucgaccuguggggcaacguggugaucgacaagagcuaccuggagaaccugcagagcgacagcagcaucgugaccauggccuuccccacccugcaggccauccuggcccaggacauccaggagaacaacuucgccgagagccuggugaugaccaccaccgugagccacaacaccaccaugcccuucagaaucagcaugaccuucaagaacaacagccccagcggcggcgagaccaagugcguguucuggaacuucagacuggccaacaacaccggcggcugggacagcagcggcugcuacguggaggagggcgacggcgacaacgugaccugcaucugcgaccaccugaccagcuucagcauccugaugagccccgacagccccgaccccagcagccugcugggcauccugcuggacaucaucagcuacgugggcgugggcuucagcauccugagccuggccgccugccuggugguggaggccgugguguggaagagcgugaccaagaacagaaccagcuacaugagacacaccugcaucgugaacaucgccgccagccugcugguggccaacaccugguucaucgugguggccgccauccaggacaacagauacauccugugcaagaccgccugcguggccgccaccuucuucauccacuucuucuaccugagcguguucuucuggaugcugacccugggccugaugcuguucuacagacugguguucauccugcacgagaccagcagaagcacccagaaggccaucgccuucugccugggcuacggcugcccccuggccaucagcgugaucacccugggcgccacccagcccagagagguguacaccagaaagaacgugugcuggcugaacugggaggacaccaaggcccugcuggccuucgccauccccgcccugaucaucgugguggugaacaucaccaucaccaucguggugaucaccaagauccugagacccagcaucggcgacaagcccugcaagcaggagaagagcagccuguuccagaucagcaagagcaucggcgugcugaccccccugcugggccugaccuggggcuucggccugaccaccguguuccccggcaccaaccugguguuccacaucaucuucgccauccugaacguguuccagggccuguucauccugcuguucggcugccugugggaccugaaggugcaggaggcccugcugaacaaguucagccugagcagauggagcagccagcacagcaagagcaccagccugggcagcagcacccccguguucagcaugagcagccccaucagcagaagauucaacaaccuguucggcaagaccggcaccuacaacgugagcacccccgaggccaccagcagcagccuggagaacagcagcagcgccagcagccugcugaacuaa

SEQ ID NO: 13324 - RNA, 1572 nt, Artificial Sequence
  ADGRG1__Homo_sapiens__NP_001277071
augaccccccagagccugcugcagaccacccuguuccugcugagccugcuguuccuggugcagggcgcccacggcagaggccacagagaggacuucagauucugcagccagcagcugcagagccuggagagcaagcugaccagcgugagauucaugggcgacauggugagcuucgaggaggacagaaucaacgccaccguguggaagcugcagcccaccgccggccugcaggaccugcacauccacagcagacaggaggaggagcagagcgagaucauggaguacagcgugcugcugcccagaacccuguuccagagaaccaagggcagaagcggcgaggccgagaagagacugcugcugguggacuucagcagccaggcccuguuccaggacaagaacagcagccaggugcugggcgagaaggugcugggcaucguggugcagaacaccaagguggccaaccugaccgagcccguggugcugaccuuccagcaccagcugcagcccaagaacgugacccugcagugcguguucuggguggaggaccccacccugagcagccccggccacuggagcagcgccggcugcgagaccgugagaagagagacccagaccagcugcuucugcaaccaccugaccuacuucgccgugcugauggugagcagcguggagguggacgccgugcacaagcacuaccugagccugcugagcuacgugggcugcguggugagcgcccuggccugccuggugaccaucgccgccuaccugugcagcagagugccccugcccugcagaagaaagcccagagacuacaccaucaaggugcacaugaaccugcugcuggccguguuccugcuggacaccagcuuccugcugagcgagcccguggcccugaccggcagcgaggccggcugcagagccagcgccaucuuccugcacuucagccugcugaccugccugagcuggaugggccuggagggcuacaaccuguacagacuggugguggagguguucggcaccuacgugcccggcuaccugcugaagcugagcgccaugggcuggggcuuccccaucuuccuggugacccugguggcccugguggacguggacaacuacggccccaucauccuggccgugcacagaacccccgagggcgugaucuaccccagcaugugcuggaucagagacagccuggugagcuacaucaccaaccugggccuguucagccugguguuccuguucaacauggccaugcuggccaccaugguggugcagauccugagacugagaccccacacccagaaguggagccacgugcugacccugcugggccugagccuggugcugggccugcccugggcccugaucuucuucagcuucgccagcggcaccuuccagcugguggugcuguaccuguucagcaucaucaccagcuuccagggcuuccugaucuucaucugguacuggagcaugagacugcaggccagaggcggccccagcccccugaagagcaacagcgacagcgccagacugcccaucagcagcggcagcaccagcagcagcagaaucuaa

SEQ ID NO: 13325 - RNA, 3054 nt, Artificial Sequence
  ADGRG2__Homo_sapiens__NP_001073327
augguguucagcgugagacagugcggccacgugggcagaaccgaggaggugcugcugaccuucaagaucuuccuggugaucaucugccugcacguggugcuggugaccagccuggaggaggacaccgacaacagcagccugagccccccccccgccaagcugagcguggugagcuucgcccccagcagcaacggcacccccgagguggagaccaccagccugaacgacgugacccugagccugcugcccagcaacgagaccgagaagaccaagaucaccaucgugaagaccuucaacgccagcggcgugaagccccagagaaacaucugcaaccugagcagcaucugcaacgacagcgccuucuucagaggcgagaucauguuccaguacgacaaggagagcaccgugccccagaaccagcacaucaccaacggcacccugaccggcgugcugagccugagcgagcugaagagaagcgagcugaacaagacccugcagacccugagcgagaccuacuucaucaugugcgccaccgccgaggcccagagcacccugaacugcaccuucaccaucaagcugaacaacaccaugaacgccugcgccgugaucgccgcccuggagagagugaagaucagacccauggagcacugcugcugcagcgugagaauccccugccccagcagccccgaggagcuggagaagcugcagugcgaccugcaggaccccaucgugugccuggccgaccaccccagaggcccccccuucagcagcagccagagcauccccguggugcccagagccaccgugcugagccaggugcccaaggccaccagcuucgccgagccccccgacuacagccccgugacccacaacgugcccagccccaucggcgagauccagccccugagcccccagcccagcgcccccaucgccagcagccccgccaucgacaugcccccccagagcgagaccaucagcagccccaugccccagacccacgugagcggcacccccccccccgugaaggccagcuucagcagccccaccgugagcgcccccgccaacgugaacaccaccagcgccccccccgugcagaccgacaucgugaacaccagcagcaucagcgaccuggagaaccaggugcugcagauggagaaggcccugagccugggcagccuggagcccaaccuggccggcgagaugaucaaccaggugagcagacugcugcacagcccccccgacaugcuggccccccuggcccagagacugcugaaggugguggacgacaucggccugcagcugaacuucagcaacaccaccaucagccugaccagccccagccuggcccuggccgugaucagagugaacgccagcagcuucaacaccaccaccuucguggcccaggaccccgccaaccugcaggugagccuggagacccaggcccccgagaacagcaucggcaccaucacccugcccagcagccugaugaacaaccugcccgcccacgacauggagcuggccagcagagugcaguucaacuucuucgagacccccgcccuguuccaggaccccagccuggagaaccugagccugaucagcuacgugaucagcagcagcguggccaaccugaccgugagaaaccugaccagaaacgugaccgugacccugaagcacaucaaccccagccaggacgagcugaccgugagaugcguguucugggaccugggcagaaacggcggcagaggcggcuggagcgacaacggcugcagcgugaaggacagaagacugaacgagaccaucugcaccugcagccaccugaccagcuucggcgugcugcuggaccugagcagaaccagcgugcugcccgcccagaugauggcccugaccuucaucaccuacaucggcugcggccugagcagcaucuuccugagcgugacccuggugaccuacaucgccuucgagaagaucagaagagacuaccccagcaagauccugauccagcugugcgccgcccugcugcugcugaaccugguguuccugcuggacagcuggaucgcccuguacaagaugcagggccugugcaucagcguggccguguuccugcacuacuuccugcuggugagcuucaccuggaugggccuggaggccuuccacauguaccuggcccuggugaagguguucaacaccuacaucagaaaguacauccugaaguucugcaucgugggcuggggcgugcccgccgugguggugaccaucauccugaccaucagccccgacaacuacggccugggcagcuacggcaaguuccccaacggcagccccgacgacuucugcuggaucaacaacaacgccguguucuacaucaccguggugggcuacuucugcgugaucuuccugcugaacgugagcauguucaucguggugcuggugcagcugugcagaaucaagaagaagaagcagcugggcgcccagagaaagaccagcauccaggaccugagaagcaucgccggccugaccuuccugcugggcaucaccuggggcuucgccuucuucgccuggggccccgugaacgugaccuucauguaccuguucgccaucuucaacacccugcagggcuucuucaucuucaucuucuacugcguggccaaggagaacgugagaaagcaguggagaagauaccugugcugcggcaagcugagacuggccgagaacagcgacuggagcaagaccgccaccaacggccugaagaagcagaccgugaaccagggcgugagcagcagcagcaacagccugcagagcagcagcaacagcaccaacagcaccacccugcuggugaacaacgacugcagcgugcacgccagcggcaacggcaacgccagcaccgagagaaacggcgugagcuucagcgugcagaacggcgacgugugccugcacgacuucaccggcaagcagcacauguucaacgagaaggaggacagcugcaacggcaagggcagaauggcccugagaagaaccagcaagagaggcagccugcacuucaucgagcagauguaa

SEQ ID NO: 13326 - RNA, 1650 nt, Artificial Sequence
  ADGRG3__Homo_sapiens__NP_740746
auggccacccccagaggccugggcgcccugcugcugcugcugcugcugcccaccagcggccaggagaagcccaccgagggccccagaaacaccugccugggcagcaacaacauguacgacaucuucaaccugaacgacaaggcccugugcuucaccaagugcagacagagcggcagcgacagcugcaacguggagaaccugcagagauacuggcugaacuacgaggcccaccugaugaaggagggccugacccagaaggugaacacccccuuccugaaggcccuggugcagaaccugagcaccaacaccgccgaggacuucuacuucagccuggagcccagccaggugcccagacaggugaugaaggacgaggacaagccccccgacagagugagacugcccaagagccuguucagaagccugcccggcaacagaagcguggugagacuggccgugaccauccuggacaucggccccggcacccuguucaagggccccagacugggccugggcgacggcagcggcgugcugaacaacagacuggugggccugagcgugggccagaugcacgugaccaagcuggccgagccccuggagaucguguucagccaccagagacccccccccaacaugacccugaccugcguguucugggacgugaccaagggcaccaccggcgacuggagcagcgagggcugcagcaccgaggugagacccgagggcaccgugugcugcugcgaccaccugaccuucuucgcccugcugcugagacccacccuggaccagagcaccgugcacauccugaccagaaucagccaggccggcugcggcgugagcaugaucuuccuggccuucaccaucauccuguacgccuuccugagacugagcagagagagauucaagagcgaggacgcccccaagauccacguggcccugggcggcagccuguuccugcugaaccuggccuuccuggugaacgugggcagcggcagcaagggcagcgacgccgccugcugggccagaggcgccguguuccacuacuuccugcugugcgccuucaccuggaugggccuggaggccuuccaccuguaccugcuggccgugagaguguucaacaccuacuucggccacuacuuccugaagcugagccuggugggcuggggccugcccgcccugauggugaucggcaccggcagcgccaacagcuacggccuguacaccaucagagacagagagaacagaaccagccuggagcugugcugguucagagagggcaccaccauguacgcccuguacaucaccgugcacggcuacuuccugaucaccuuccuguucggcaugguggugcuggcccuggugguguggaagaucuucacccugagcagagccaccgccgugaaggagagaggcaagaacagaaagaaggugcugacccugcugggccugagcagccuggugggcgugaccuggggccuggccaucuucaccccccugggccugagcaccguguacaucuucgcccuguucaacagccugcagggcguguucaucugcugcugguucaccauccuguaccugcccagccagagcaccaccgugagcagcagcaccgccagacuggaccaggcccacagcgccagccaggaguaa

SEQ ID NO: 13327 - RNA, 3582 nt, Artificial Sequence
  ADGRG6__Homo_sapiens__NP_001027566
augauguucagaagcgacagaauguggagcugccacuggaaguggaagcccagcccccugcuguuccuguucgcccuguacaucaugugcgugccccacagcguguggggcugcgccaacugcagaguggugcugagcaaccccagcggcaccuucaccagccccugcuaccccaacgacuaccccaacagccaggccugcauguggacccugagagcccccaccggcuacaucauccagaucaccuucaacgacuucgacaucgaggaggcccccaacugcaucuacgacagccugagccuggacaacggcgagagccagaccaaguucugcggcgccaccgccaagggccugagcuucaacagcagcgccaacgagaugcacgugagcuucagcagcgacuucagcauccagaagaagggcuucaacgccagcuacaucagaguggccgugagccugagaaaccagaaggugauccugccccagaccagcgacgccuaccaggugagcguggccaagagcaucagcauccccgagcugagcgccuucacccugugcuucgaggccaccaaggugggccacgaggacagcgacuggaccgccuucagcuacagcaacgccagcuucacccagcugcugagcuucggcaaggccaagagcggcuacuuccugagcaucagcgacagcaagugccugcugaacaacgcccugcccgugaaggagaaggaggacaucuucgccgagagcuucgagcagcugugccugguguggaacaacagccugggcagcaucggcgugaacuucaagagaaacuacgagaccgugcccugcgacagcaccaucagcaaggugauccccggcaacggcaagcugcugcugggcagcaaccagaacgagaucgugagccugaagggcgacaucuacaacuucagacuguggaacuucaccaugaacgccaagauccugagcaaccugagcugcaacgugaagggcaacgugguggacuggcagaacgacuucuggaacauccccaaccuggcccugaaggccgagagcaaccugagcugcggcagcuaccugaucccccugcccgccgccgagcuggccagcugcgccgaccugggcacccugugccaggacggcaucaucuacagaaucagcguggugauccagaacauccugagacaccccgaggugaaggugcagagcaagguggccgaguggcugaacagcaccuuccagaacuggaacuacaccguguacguggugaacaucagcuuccaccugagcgccggcgaggacaagaucaaggugaagagaagccuggaggacgagcccagacuggugcugugggcccugcugguguacaacgccaccaacaacaccaaccuggagggcaagaucauccagcagaagcugcugaagaacaacgagagccuggacgagggccugagacugcacaccgugaacgugagacagcugggccacugccuggccauggaggagcccaagggcuacuacuggcccagcauccagcccagcgaguacgugcugcccugccccgacaagcccggcuucagcgccagcagaaucugcuucuacaacgccaccaacccccuggugaccuacuggggccccguggacaucagcaacugccugaaggaggccaacgagguggccaaccagauccugaaccugaccgccgacggccagaaccugaccagcgccaacaucaccaacaucguggagcaggugaagagaaucgugaacaaggaggagaacaucgacaucacccugggcagcacccugaugaacaucuucagcaacauccugagcagcagcgacagcgaccugcuggagagcagcagcgaggcccugaagaccaucgacgagcuggccuucaagaucgaccugaacagcaccagccacgugaacaucaccaccagaaaccuggcccugagcgugagcagccugcugcccggcaccaacgccaucagcaacuucagcaucggccugcccagcaacaacgagagcuacuuccagauggacuucgagagcggccagguggacccccuggccagcgugauccugccccccaaccugcuggagaaccugagccccgaggacagcgugcuggugagaagagcccaguucaccuucuucaacaagaccggccuguuccaggacgugggcccccagagaaagacccuggugagcuacgugauggccugcagcaucggcaacaucaccauccagaaccugaaggaccccgugcagaucaagaucaagcacaccagaacccaggaggugcaccaccccaucugcgccuucugggaccugaacaagaacaagagcuucggcggcuggaacaccagcggcugcguggcccacagagacagcgacgccagcgagaccgugugccugugcaaccacuucacccacuucggcgugcugauggaccugcccagaagcgccagccagcuggacgccagaaacaccaaggugcugaccuucaucagcuacaucggcugcggcaucagcgccaucuucagcgccgccacccugcugaccuacguggccuucgagaagcugagaagagacuaccccagcaagauccugaugaaccugagcaccgcccugcuguuccugaaccugcuguuccugcuggacggcuggaucaccagcuucaacguggacggccugugcaucgccguggccgugcugcugcacuucuuccugcuggccaccuucaccuggaugggccuggaggccauccacauguacaucgcccuggugaagguguucaacaccuacaucagaagauacauccugaaguucugcaucaucggcuggggccugcccgcccugguggugagcguggugcuggccagcagaaacaacaacgagguguacggcaaggagagcuacggcaaggagaagggcgacgaguucugcuggauccaggaccccgugaucuucuacgugaccugcgccggcuacuucggcgugauguucuuccugaacaucgccauguucaucguggugauggugcagaucugcggcagaaacggcaagagaagcaacagaacccugagagaggaggugcugagaaaccugagaagcguggugagccugaccuuccugcugggcaugaccuggggcuucgccuucuucgccuggggcccccugaacauccccuucauguaccuguucagcaucuucaacagccugcagggccuguucaucuucaucuuccacugcgccaugaaggagaacgugcagaagcaguggagaagacaccugugcugcggcagauucagacuggccgacaacagcgacuggagcaagaccgccaccaacaucaucaagaagagcagcgacaaccugggcaagagccugagcagcagcagcaucggcagcaacagcaccuaccugaccagcaagagcaagagcagcagcaccaccuacuucaagagaaacagccacaccgacaacgugagcuacgagcacagcuucaacaagagcggcagccugagacagugcuuccacggccaggugcuggugaagaccggccccugcuaa

SEQ ID NO: 13328 - RNA, 2394 nt, Artificial Sequence
  ADGRG7__Homo_sapiens__NP_116176
auggccagcugcagagccuggaaccugagagugcugguggccguggugugcggccugcugaccggcaucauccugggccugggcaucuggagaaucgugaucagaauccagagaggcaagagcaccagcagcagcagcacccccaccgaguucugcagaaacggcggcaccugggagaacggcagaugcaucugcaccgaggaguggaagggccugagaugcaccaucgccaacuucugcgagaacagcaccuacaugggcuucaccuucgccagaauccccgugggcagauacggccccagccugcagaccugcggcaaggacacccccaacgccggcaaccccauggccgugagacugugcagccugagccuguacggcgagaucgagcugcagaaggugaccaucggcaacugcaacgagaaccuggagacccuggagaagcaggugaaggacgugaccgccccccugaacaacaucagcagcgaggugcagauccugaccagcgacgccaacaagcugaccgccgagaacaucaccagcgccaccagaguggugggccagaucuucaacaccagcagaaacgccagccccgaggccaagaagguggccaucgugaccgugagccagcugcuggacgccagcgaggacgccuuccagagaguggccgccaccgccaacgacgacgcccugaccacccugaucgagcagauggagaccuacagccugagccugggcaaccagagcgugguggagcccaacaucgccauccagagcgccaacuucagcagcgagaacgccgugggccccagcaacgugagauucagcgugcagaagggcgccagcagcagccuggugagcagcagcaccuucauccacaccaacguggacggccugaaccccgacgcccagaccgagcugcaggugcugcugaacaugaccaagaacuacaccaagaccugcggcuucgugguguaccagaacgacaagcuguuccagagcaagaccuucaccgccaagagcgacuucagccagaagaucaucagcagcaagaccgacgagaacgagcaggaccagagcgccagcguggacaugguguucagccccaaguacaaccagaaggaguuccagcuguacagcuacgccugcguguacuggaaccugagcgccaaggacugggacaccuacggcugccagaaggacaagggcaccgacggcuuccugagaugcagaugcaaccacaccaccaacuucgccgugcugaugaccuucaagaaggacuaccaguaccccaagagccuggacauccugagcaacgugggcugcgcccugagcgugaccggccuggcccugaccgugaucuuccagaucgugaccagaaaggugagaaagaccagcgugaccugggugcuggugaaccugugcaucagcaugcugaucuucaaccugcuguucguguucggcaucgagaacagcaacaagaaccugcagaccagcgacggcgacaucaacaacaucgacuucgacaacaacgacauccccagaaccgacaccaucaacauccccaaccccaugugcaccgccaucgccgcccugcugcacuacuuccugcuggugaccuucaccuggaacgcccugagcgccgcccagcuguacuaccugcugaucagaaccaugaagccccugcccagacacuucauccuguucaucagccugaucggcuggggcgugcccgccaucgugguggccaucaccgugggcgugaucuacagccagaacggcaacaacccccagugggagcuggacuacagacaggagaagaucugcuggcuggccauccccgagcccaacggcgugaucaagagcccccugcuguggagcuucaucgugcccgugaccaucauccugaucagcaacguggugauguucaucaccaucagcaucaaggugcuguggaagaacaaccagaaccugaccagcaccaagaaggugagcagcaugaagaagaucgugagcacccugagcguggccgugguguucggcaucaccuggauccuggccuaccugaugcuggugaacgacgacagcaucagaaucguguucagcuacaucuucugccuguucaacaccacccagggccugcagaucuucauccuguacaccgugagaaccaagguguuccagagcgaggccagcaaggugcugaugcugcugagcagcaucggcagaagaaagagccugcccagcgugaccagacccagacugagagugaagauguacaacuuccugagaagccugcccacccugcacgagagauucagacugcuggagaccagccccagcaccgaggagaucacccugagcgagagcgacaacgccaaggagagcaucuaa

SEQ ID NO: 13329 - RNA, 4425 nt, Artificial Sequence
  ADGRL1__Homo_sapiens__NP_001008701
auggccagacuggccgccgugcuguggaaccugugcgugaccgccgugcuggugaccagcgccacccagggccugagcagagccggccugcccuucggccugaugagaagagagcuggccugcgagggcuaccccaucgagcugagaugccccggcagcgacgugaucaugguggagaacgccaacuacggcagaaccgacgacaagaucugcgacgccgaccccuuccagauggagaacgugcagugcuaccugcccgacgccuucaagaucaugagccagagaugcaacaacagaacccagugcguggugguggccggcagcgacgccuuccccgaccccugccccggcaccuacaaguaccuggaggugcaguacgacugcgugcccuacaagguggagcagaagguguucgugugccccggcacccugcagaaggugcuggagcccaccagcacccacgagagcgagcaccagagcggcgccuggugcaaggacccccugcaggccggcgacagaaucuacgugaugcccuggauccccuacagaaccgacacccugaccgaguacgccagcugggaggacuacguggccgccagacacaccaccaccuacagacugcccaacagaguggacggcaccggcuucgugguguacgacggcgccguguucuacaacaaggagagaaccagaaacaucgugaaguacgaccugagaaccagaaucaagagcggcgagaccgugaucaacaccgccaacuaccacgacaccagccccuacagauggggcggcaagaccgacaucgaccuggccguggacgagaacggccugugggugaucuacgccaccgagggcaacaacggcagacugguggugagccagcugaaccccuacacccugagauucgagggcaccugggagaccggcuacgacaagagaagcgccagcaacgccuucauggugugcggcgugcuguacgugcugagaagcguguacguggacgacgacagcgaggccgccggcaacagaguggacuacgccuucaacaccaacgccaacagagaggagcccgugagccugaccuuccccaaccccuaccaguucaucagcagcguggacuacaaccccagagacaaccagcuguacguguggaacaacuacuucguggugagauacagccuggaguucggcccccccgaccccagcgccggccccgccaccagccccccccugagcaccaccaccaccgccagacccaccccccugaccagcaccgccagccccgccgccaccaccccccugagaagagccccccugaccacccaccccgugggcgccaucaaccagcugggccccgaccugccccccgccaccgcccccgugcccagcaccagaagaccccccgcccccaaccugcacgugagccccgagcuguucugcgagcccagagaggugagaagagugcaguggcccgccacccagcagggcaugcugguggagagacccugccccaagggcaccagaggcaucgccagcuuccagugccugcccgcccugggccuguggaaccccagaggccccgaccugagcaacugcaccagccccugggugaaccagguggcccagaagaucaagagcggcgagaacgccgccaacaucgccagcgagcuggccagacacaccagaggcagcaucuacgccggcgacgugagcagcagcgugaagcugauggagcagcugcuggacauccuggacgcccagcugcaggcccugagacccaucgagagagagagcgccggcaagaacuacaacaagaugcacaagagagagagaaccugcaaggacuacaucaaggccgugguggagaccguggacaaccugcugagacccgaggcccuggagagcuggaaggacaugaacgccaccgagcaggugcacaccgccaccaugcugcuggacgugcuggaggagggcgccuuccugcuggccgacaacgugagagagcccgccagauuccuggccgccaaggagaacguggugcuggaggugaccgugcugaacaccgagggccaggugcaggagcugguguucccccaggaggaguaccccagaaagaacagcauccagcugagcgccaagaccaucaagcagaacagcagaaacggcguggugaaggugguguucauccuguacaacaaccugggccuguuccugagcaccgagaacgccaccgugaagcuggccggcgaggccggccccggcggccccggcggcgccagccugguggugaacagccaggugaucgccgccagcaucaacaaggagagcagcagaguguuccugauggaccccgugaucuucaccguggcccaccuggaggacaagaaccacuucaacgccaacugcagcuucuggaacuacagcgagagaagcaugcugggcuacuggagcacccagggcugcagacugguggagagcaacaagacccacaccaccugcgccugcagccaccugaccaacuucgccgugcugauggcccacagagagaucuaccagggcagaaucaacgagcugcugcugagcgugaucaccugggugggcaucgugaucagccuggugugccuggccaucugcaucagcaccuucugcuuccugagaggccugcagaccgacagaaacaccauccacaagaaccugugcaucaaccuguuccuggccgagcugcuguuccuggugggcaucgacaagacccaguacgagaucgccugccccaucuucgccggccugcugcacuacuucuuccuggccgccuucagcuggcugugccuggagggcgugcaccuguaccugcugcugguggagguguucgagagcgaguacagcagaaccaaguacuacuaccugggcggcuacugcuuccccgcccugguggugggcaucgccgccgccaucgacuacagaagcuacggcaccgagaaggccugcuggcugagaguggacaacuacuucaucuggagcuucaucggccccgugagcuucgugaucguggugaaccugguguuccugauggugacccugcacaagaugaucagaagcagcagcgugcugaagcccgacagcagcagacuggacaacaucaagagcugggcccugggcgccaucgcccugcuguuccugcugggccugaccugggccuucggccugcuguucaucaacaaggagagcguggugauggccuaccuguucaccaccuucaacgccuuccagggcguguucaucuucguguuccacugcgcccugcagaagaaggugcacaaggaguacagcaagugccugagacacagcuacugcugcaucagaagcccccccggcggcacccacggcagccugaagaccagcgccaugagaagcaacaccagauacuacaccggcacccagagcagaaucagaagaauguggaacgacaccgugagaaagcagaccgagagcagcuucauggccggcgacaucaacagcacccccacccugaacagaggcaccaugggcaaccaccugcugaccaaccccgugcugcagcccagaggcggcaccagccccuacaacacccugaucgccgagagcgugggcuucaaccccagcagcccccccguguucaacagccccggcagcuacagagagcccaagcacccccugggcggcagagaggccugcggcauggacacccugccccugaacggcaacuucaacaacagcuacagccugagaagcggcgacuucccccccggcgacggcggccccgagccccccagaggcagaaaccuggccgacgccgccgccuucgagaagaugaucaucagcgagcuggugcacaacaaccugagaggcagcagcagcgccgccaagggcccccccccccccgagccccccgugccccccgugcccggcggcggcggcgaggaggaggccggcggccccggcggcgccgacagagccgagaucgagcugcuguacaaggcccuggaggagccccugcugcugcccagagcccagagcgugcuguaccagagcgaccuggacgagagcgagagcugcaccgccgaggacggcgccaccagcagaccccugagcagcccccccggcagagacagccuguacgccagcggcgccaaccugagagacagccccagcuaccccgacagcagccccgagggccccagcgaggcccugcccccccccccccccgccccccccggcccccccgagaucuacuacaccagcagaccccccgcccugguggccagaaacccccugcagggcuacuaccaggugagaagacccagccacgagggcuaccuggccgcccccggccuggagggccccggccccgacggcgacggccagaugcagcuggugaccagccuguaa

SEQ ID NO: 13330 - RNA, 4410 nt, Artificial Sequence
  ADGRL3__Homo_sapiens__NP_056051
auguggcccagccagcugcugaucuucaugaugcugcuggcccccaucauccacgccuucagcagagcccccauccccauggccguggugagaagagagcugagcugcgagagcuaccccaucgagcugagaugccccggcaccgacgugaucaugaucgagagcgccaacuacggcagaaccgacgacaagaucugcgacagcgaccccgcccagauggagaacaucagaugcuaccugcccgacgccuacaagaucaugagccagagaugcaacaacagaacccagugcgccgugguggccggccccgacguguuccccgaccccugccccggcaccuacaaguaccuggaggugcaguacgagugcgugcccuacaagguggagcagaagguguuccugugccccggccugcugaagggcguguaccagagcgagcaccuguucgagagcgaccaccagagcggcgccuggugcaaggacccccugcaggccagcgacaagaucuacuacaugcccuggacccccuacagaaccgacacccugaccgaguacagcagcaaggacgacuucaucgccggcagacccaccaccaccuacaagcugccccacagaguggacggcaccggcuucgugguguacgacggcgcccuguucuucaacaaggagagaaccagaaacaucgugaaguucgaccugagaaccagaaucaagagcggcgaggccaucaucgccaacgccaacuaccacgacaccagccccuacagauggggcggcaagagcgacaucgaccuggccguggacgagaacggccugugggugaucuacgccaccgagcagaacaacggcaagaucgugaucagccagcugaaccccuacacccugagaaucgagggcaccugggacaccgccuacgacaagagaagcgccagcaacgccuucaugaucugcggcauccuguacguggugaagagcguguacgaggacgacgacaacgaggccaccggcaacaagaucgacuacaucuacaacaccgaccagagcaaggacagccugguggacgugcccuuccccaacagcuaccaguacaucgccgccguggacuacaaccccagagacaaccugcuguacguguggaacaacuaccacguggugaaguacagccuggacuucggcccccuggacagcagaagcggccaggcccaccacggccaggugagcuacaucagcccccccauccaccuggacagcgagcuggagagacccagcgugaaggacaucagcaccaccggcccccugggcaugggcagcaccaccaccagcaccacccugagaaccaccacccugagccccggcagaagcaccacccccagcgugagcggcagaagaaacagaagcaccagcacccccagccccgccguggaggugcuggacgacaugaccacccaccugcccagcgccagcagccagauccccgcccuggaggagagcugcgaggccguggaggccagagagaucaugugguucaagaccagacagggccagaucgccaagcagcccugccccgccggcaccaucggcgugagcaccuaccugugccuggcccccgacggcaucugggacccccagggccccgaccugagcaacugcagcagccccugggugaaccacaucacccagaagcugaagagcggcgagaccgccgccaacaucgccagagagcuggccgagcagaccagaaaccaccugaacgccggcgacaucaccuacagcgugagagccauggaccagcuggugggccugcuggacgugcagcugagaaaccugacccccggcggcaaggacagcgccgccagaagccugaacaagcugcagaagagagagagaagcugcagagccuacgugcaggccaugguggagaccgugaacaaccugcugcagccccaggcccugaacgccuggagagaccugaccaccagcgaccagcugagagccgccaccaugcugcugcacaccguggaggagagcgccuucgugcuggccgacaaccugcugaagaccgacaucgugagagagaacaccgacaacaucaagcuggagguggccagacugagcaccgagggcaaccuggaggaccugaaguuccccgagaacaugggccacggcagcaccauccagcugagcgccaacacccugaagcagaacggcagaaacggcgagaucagaguggccuucgugcuguacaacaaccugggccccuaccugagcaccgagaacgccagcaugaagcugggcaccgaggcccugagcaccaaccacagcgugaucgugaacagccccgugaucaccgccgccaucaacaaggaguucagcaacaagguguaccuggccgaccccgugguguucaccgugaagcacaucaagcagagcgaggagaacuucaaccccaacugcagcuucuggagcuacagcaagagaaccaugaccggcuacuggagcacccagggcugcagacugcugaccaccaacaagacccacaccaccugcagcugcaaccaccugaccaacuucgccgugcugauggcccacguggaggugaagcacagcgacgccgugcacgaccugcugcuggacgugaucaccugggugggcauccugcugagccuggugugccugcugaucugcaucuucaccuucugcuucuucagaggccugcagagcgacagaaacaccauccacaagaaccugugcaucagccuguucguggccgagcugcuguuccugaucggcaucaacagaaccgaccagcccaucgccugcgccguguucgccgcccugcugcacuucuucuuccuggccgccuucaccuggauguuccuggagggcgugcagcuguacaucaugcugguggagguguucgagagcgagcacagcagaagaaaguacuucuaccuggugggcuacggcaugcccgcccugaucguggccgugagcgccgccguggacuacagaagcuacggcaccgacaaggugugcuggcugagacuggacaccuacuucaucuggagcuucaucggccccgccacccugaucaucaugcugaacgugaucuuccugggcaucgcccuguacaagauguuccaccacaccgccauccugaagcccgagagcggcugccuggacaacaucaacuacgaggacaacagacccuucaucaagagcugggugaucggcgccaucgcccugcugugccugcugggccugaccugggccuucggccugauguacaucaacgagagcaccgugaucauggccuaccuguucaccaucuucaacagccugcagggcauguucaucuucaucuuccacugcgugcugcagaagaaggugagaaaggaguacggcaagugccugagaacccacugcugcagcggcaagagcaccgagagcagcaucggcagcggcaagaccagcggcagcagaacccccggcagauacagcaccggcagccagagcagaaucagaagaauguggaacgacaccgugagaaagcagagcgagagcagcuucaucaccggcgacaucaacagcagcgccagccugaacagagagggccugcugaacaacgccagagacaccagcgugauggacacccugccccugaacggcaaccacggcaacagcuacagcaucgccagcggcgaguaccugagcaacugcgugcagaucaucgacagaggcuacaaccacaacgagaccgcccuggagaagaagauccugaaggagcugaccagcaacuacauccccagcuaccugaacaaccacgagagaagcagcgagcagaacagaaaccugaugaacaagcuggugaacaaccugggcagcggcagagaggacgacgccaucgugcuggacgacgccaccagcuucaaccacgaggagagccugggccuggagcugauccacgaggagagcgacgccccccugcugccccccagaguguacagcaccgagaaccaccagccccaccacuacaccagaagaagaaucccccaggaccacagcgagagcuucuucccccugcugaccaacgagcacaccgaggaccugcagagcccccacagagacagccuguacaccagcaugcccacccuggccggcguggccgccaccgagagcgugaccaccagcacccagaccgagcccccccccgccaagugcggcgacgccgaggacguguacuacaagagcaugcccaaccugggcagcagaaaccacgugcaccagcugcacaccuacuaccagcugggcagaggcagcagcgacggcuucaucgugccccccaacaaggacggcaccccccccgagggcagcagcaagggccccgcccaccuggugaccagccuguaa

SEQ ID NO: 13331 - RNA, 18921 nt, Artificial Sequence
  ADGRV1__Homo_sapiens__NP_115495
augagcguguuccugggccccggcaugcccagcgccagccugcuggugaaccugcugagcgcccugcugauccuguucguguucggcgagaccgagaucagauucaccggccagaccgaguucguggugaacgagaccagcaccaccgugaucagacugaucaucgagagaaucggcgagcccgccaacgugaccgccaucgugagccuguacggcgaggacgccggcgacuucuucgacaccuacgccgccgccuucauccccgccggcgagaccaacagaaccguguacaucgccgugugcgacgacgaccugcccgagcccgacgagaccuucaucuuccaccugacccugcagaagcccagcgccaacgugaagcugggcuggcccagaaccgugaccgugaccauccugagcaacgacaacgccuucggcaucaucagcuucaacaugcugcccagcaucgccgugagcgagcccaagggcagaaacgagagcaugccccugacccugaucagagagaagggcaccuacggcauggugauggugaccuucgagguggagggcggccccaacccccccgacgaggaccugagccccgugaagggcaacaucaccuucccccccggcagagccaccgugaucuacaaccugaccgugcuggacgacgaggugcccgagaacgacgagaucuuccugauccagcugaagagcguggagggcggcgccgagaucaacaccagcagaaacagcaucgagaucaucaucaagaagaacgacagccccgugagauuccugcagagcaucuaccuggugcccgaggaggaccacauccugaucauccccguggugagaggcaaggacaacaacggcaaccugaucggcagcgacgaguacgaggugagcaucagcuacgccgugaccaccggcaacagcaccgcccacgcccagcagaaccuggacuucaucgaccugcagcccaacaccaccgugguguucccccccuucauccacgagagccaccugaaguuccagaucguggacgacaccauccccgagaucgccgagagcuuccacaucaugcugcugaaggacacccugcagggcgacgccgugcugaucagccccagcguggugcaggugaccaucaagcccaacgacaagcccuacggcgugcugagcuucaacagcgugcuguucgagagaaccgugaucaucgacgaggacagaaucagcagauacgaggagaucaccguggugagaaacggcggcacccacggcaacgugagcgccaacugggugcugaccagaaacagcaccgaccccagccccgugaccgccgacaucagacccagcagcggcgugcugcacuucgcccagggccagaugcuggccaccaucccccugaccgugguggacgacgaccugcccgaggaggccgaggccuaccugcugcagauccugccccacaccaucagaggcggcgccgaggugagcgagcccgccgagcugcuguucuacauccaggacagcgacgacguguacggccugaucaccuucuuccccauggagaaccagaagaucgagagcagccccggcgagagauaccugagccugagcuucaccagacugggcggcaccaagggcgacgugagacugcuguacagcgugcuguacauccccgccggcgccguggacccccugcaggccaaggagggcauccugaacaucagcagaagaaacgaccugaucuuccccgagcagaagacccaggugaccaccaagcugcccaucagaaacgacgccuuccugcagaacggcgcccacuuccuggugcagcuggagaccguggagcugcugaacaucaucccccugaucccccccaucagccccagauucggcgagaucugcaacaucagccugcuggugacccccgccaucgccaacggcgagaucggcuuccugagcaaccugcccaucauccugcacgagcccgaggacuucgccgccgaggugguguacaucccccugcacagagacggcaccgacggccaggccaccguguacuggagccugaagcccagcggcuucaacagcaaggccgugacccccgacgacaucggccccuucaacggcagcgugcuguuccugagcggccagagcgacaccaccaucaacaucaccaucaagggcgacgacauccccgagaugaacgagaccgugacccugagccuggacagagugaacguggagaaccaggugcugaagagcggcuacaccagcagagaccugaucauccuggagaacgacgaccccggcggcguguucgaguucagccccgccagcagaggccccuacgugaucaaggagggcgagagcguggagcugcacaucaucagaagcagaggcagccuggugaagcaguuccugcacuacagaguggagcccagagacagcaacgaguucuacggcaacaccggcgugcuggaguucaagcccggcgagagagagaucgugaucacccugcuggccagacuggacggcauccccgagcuggacgagcacuacuggguggugcugagcagccacggcgagagagagagcaagcugggcagcgccaccaucgugaacaucaccauccugaagaacgacgacccccacggcaucaucgaguucgugagcgacggccugaucgugaugaucaacgagagcaagggcgacgccaucuacagcgccguguacgacguggugagaaacagaggcaacuucggcgacgugagcgugagcuggguggugagccccgacuucacccaggacguguuccccgugcagggcaccgugguguucggcgaccaggaguucagcaagaacaucaccaucuacagccugcccgacgagauccccgaggagauggaggaguucaccgugauccugcugaacggcaccggcggcgccaaggugggcaacagaaccaccgccacccugagaaucagaagaaacgacgaccccaucuacuucgccgagcccagaguggugagagugcaggagggcgagaccgccaacuucaccgugcugagaaacggcagcguggacgugaccugcauggugcaguacgccaccaaggacggcaaggccaccgccagagagagagacuucauccccguggagaagggcgagacccugaucuucgaggugggcagcagacagcagagcaucagcaucuucgugaacgaggacggcauccccgagaccgacgagcccuucuacaucauccugcugaacagcaccggcgacaccgugguguaccaguacggcguggccaccgugaucaucgaggccaacgacgaccccaacggcaucuucagccuggagcccaucgacaaggccguggaggagggcaagaccaacgccuucuggauccugagacacagaggcuacuucggcagcgugagcgugagcuggcagcuguuccagaacgacagcgcccugcagcccggccaggaguucuacgagaccagcggcaccgugaacuucauggacggcgaggaggccaagcccaucauccugcacgccuuccccgacaagauccccgaguucaacgaguucuacuuccugaagcuggugaacaucagcggcggcagccccggccccggcggccagcuggccgagaccaaccugcaggugaccgugauggugcccuucaacgacgaccccuucggcguguucauccuggaccccgagugccuggagagagagguggccgaggacgugcugagcgaggacgacaugagcuacaucaccaacuucaccauccugagacagcagggcguguucggcgacgugcagcugggcugggagauccugagcagcgaguuccccgccggccugccccccaugaucgacuuccugcuggugggcaucuuccccaccaccgugcaccugcagcagcacaugagaagacaccacagcggcaccgacgcccuguacuucaccggccuggagggcgccuucggcaccgugaaccccaaguaccaccccagcagaaacaacaccaucgccaacuucaccuucagcgccugggugaugcccaacgccaacaccaacggcuucaucaucgccaaggacgacggcaacggcagcaucuacuacggcgugaagauccagaccaacgagagccacgugacccugagccugcacuacaagacccugggcagcaacgccaccuacaucgccaagaccaccgugaugaaguaccuggaggagagcguguggcugcaccugcugaucauccuggaggacggcaucaucgaguucuaccuggacggcaacgccaugcccagaggcaucaagagccugaagggcgaggccaucaccgacggccccggcauccugagaaucggcgccggcaucaacggcaacgacagauucaccggccugaugcaggacgugagaagcuacgagagaaagcugacccuggaggagaucuacgagcugcacgccaugcccgccaagagcgaccugcaccccaucagcggcuaccuggaguucagacagggcgagaccaacaagagcuucaucaucagcgccagagacgacaacgacgaggagggcgaggagcuguucauccugaagcuggugagcguguacggcggcgccagaaucagcgaggagaacaccaccgccagacugaccauccagaagagcgacaacgccaacggccuguucggcuucaccggcgccugcauccccgagaucgccgaggagggcagcaccaucagcugcgugguggagagaaccagaggcgcccuggacuacgugcacguguucuacaccaucagccagaucgagaccgacggcaucaacuaccugguggacgacuucgccaacgccagcggcaccaucaccuuccugcccuggcagagaagcgaggugcugaacaucuacgugcuggacgacgacauccccgagcugaacgaguacuucagagugacccuggugagcgccauccccggcgacggcaagcugggcagcacccccaccagcggcgccagcaucgaccccgagaaggagaccaccgacaucaccaucaaggccagcgaccaccccuacggccugcugcaguucagcaccggccugcccccccagcccaaggacgccaugacccugcccgccagcagcgugccccacaucaccguggaggaggaggacggcgagaucagacugcuggugaucagagcccagggccugcugggcagagugaccgccgaguucagaaccgugagccugaccgccuucagccccgaggacuaccagaacguggccggcacccuggaguuccagcccggcgagagauacaaguacaucuucaucaacaucaccgacaacagcauccccgagcuggagaagagcuucaagguggagcugcugaaccuggagggcggcguggccgagcuguucagaguggacggcagcggcagcggcgacggcgacauggaguucuuccugcccaccauccacaagagagccagccugggcguggccagccagauccuggugaccaucgccgccagcgaccacgcccacggcguguucgaguucagccccgagagccuguucgugagcggcaccgagcccgaggacggcuacagcaccgugacccugaacgugaucagacaccacggcacccugagccccgugacccugcacuggaacaucgacagcgaccccgacggcgaccuggccuucaccagcggcaacaucaccuucgagaucggccagaccagcgccaacaucaccguggagauccugcccgacgaggaccccgagcuggacaaggccuucagcgugagcgugcugagcgugagcagcggcagccugggcgcccacaucaacgccacccugaccgugcuggccagcgacgaccccuacggcaucuucaucuucagcgagaagaacagacccgugaagguggaggaggccacccagaacaucacccugagcaucaucagacugaagggccugaugggcaaggugcuggugagcuacgccacccuggacgacauggagaagccccccuacuucccccccaaccuggccagagccacccagggcagagacuacauccccgccagcggcuucgcccuguucggcgccaaccagagcgaggccaccaucgccaucagcauccuggacgacgacgagcccgagagaagcgagagcguguucaucgagcugcugaacagcacccugguggccaaggugcagagcagaagcauccccaacagccccagacugggccccaagguggagaccaucgcccagcugaucaucaucgccaacgacgacgccuucggcacccugcagcugagcgcccccaucgugagaguggccgagaaccacgugggccccaucaucaacgugaccagaaccggcggcgccuucgccgacgugagcgugaaguucaaggccgugcccaucaccgccaucgccggcgaggacuacagcaucgccagcagcgacguggugcugcuggagggcgagaccagcaaggccgugcccaucuacgugaucaacgacaucuaccccgagcuggaggagagcuuccuggugcagcugaugaacgagaccaccggcggcgccagacugggcgcccugaccgaggccgugaucaucaucgaggccagcgacgaccccuacggccuguucggcuuccagaucaccaagcugaucguggaggagcccgaguucaacagcgugaaggugaaccugcccaucaucagaaacagcggcacccugggcaacgugaccgugcaguggguggccaccaucaacggccagcuggccaccggcgaccugagaguggugagcggcaacgugaccuucgcccccggcgagaccauccagacccugcugcuggaggugcuggccgacgacgugcccgagaucgaggaggugauccaggugcagcugaccgacgccagcggcggcggcaccaucggccuggacagaaucgccaacaucaucauccccgccaacgacgaccccuacggcaccguggccuucgcccagaugguguacagagugcaggagccccuggagagaagcagcugcgccaacaucaccgugagaagaagcggcggccacuucggcagacugcugcuguucuacagcaccagcgacaucgacgugguggcccuggccauggaggagggccaggaccugcugagcuacuacgagagccccauccagggcgugcccgacccccuguggagaaccuggaugaacgugagcgccgugggcgagccccuguacaccugcgccacccugugccugaaggagcaggccugcagcgccuucagcuucuucagcgccagcgagggcccccagugcuucuggaugaccagcuggaucagccccgccgugaacaacagcgacuucuggaccuacagaaagaacaugaccagaguggccagccuguucagcggccaggccguggccggcagcgacuacgagcccgugaccagacagugggccaucaugcaggagggcgacgaguucgccaaccugaccgugagcauccugcccgacgacuuccccgagauggacgagagcuuccugaucagccugcuggaggugcaccugaugaacaucagcgccagccugaagaaccagcccaccaucggccagcccaacaucagcaccguggugaucgcccugaacggcgacgccuucggcguguucgugaucuacaacaucagccccaacaccagcgaggacggccuguucguggaggugcaggagcagccccagacccugguggagcugaugauccacagaaccggcggcagccugggccagguggccguggaguggagaguggugggcggcaccgccaccgagggccuggacuucaucggcgccggcgagauccugaccuucgccgagggcgagaccaagaagaccgugauccugaccauccuggacgacagcgagcccgaggacgacgagagcaucaucgugagccugguguacaccgagggcggcagcagaauccugcccagcagcgacaccgugagagugaacauccuggccaacgacaacguggccggcaucgugagcuuccagaccgccagcagaagcgugaucggccacgagggcgagauccugcaguuccacgugaucagaaccuuccccggcagaggcaacgugaccgugaacuggaagaucaucggccagaaccuggagcugaacuucgccaacuucagcggccagcuguucuuccccgagggcagccugaacaccacccuguucgugcaccugcuggacgacaacauccccgaggagaaggagguguaccaggugauccuguacgacgugagaacccagggcgugccccccgccggcaucgcccugcuggacgcccagggcuacgccgccgugcugaccguggaggccagcgacgagccccacggcgugcugaacuucgcccugagcagcagauucgugcugcugcaggaggccaacaucaccauccagcuguucaucaacagagaguucggcagccugggcgccaucaacgugaccuacaccaccgugcccggcaugcugagccugaagaaccagaccgugggcaaccuggccgagcccgagguggacuucgugcccaucaucggcuuccugauccuggaggagggcgagaccgccgccgccaucaacaucaccauccuggaggacgacgugcccgagcuggaggaguacuuccuggugaaccugaccuacgugggccugaccauggccgccagcaccagcuucccccccagacuggacagcgagggccugaccgcccaggugaucaucgacgccaacgacggcgccagaggcgugaucgaguggcagcagagcagauucgaggugaacgagacccacggcagccugacccugguggcccagagaagcagagagccccugggccacgugagccuguucguguacgcccagaaccuggaggcccaggugggccuggacuacaucuucacccccaugauccugcacuucgccgacggcgagagauacaagaacgugaacaucaugauccuggacgacgacauccccgagggcgacgagaaguuccagcugauccugaccaaccccagccccggccuggagcugggcaagaacaccaucgcccugaucaucgugcuggccaacgacgacggccccggcgugcugagcuucaacaacagcgagcacuucuuccugagagagcccaccgcccuguacgugcaggagagcguggccgugcuguacaucgugagagagcccgcccagggccuguucggcaccgugaccgugcaguucaucgugaccgaggugaacagcagcaacgagagcaaggaccugacccccagcaagggcuacaucgugcuggaggagggcgugagauucaaggcccugcagaucagcgccauccuggacaccgagcccgagauggacgaguacuucgugugcacccuguucaaccccaccggcggcgccagacugggcgugcacgugcagacccugaucaccgugcugcagaaccaggccccccugggccuguucagcaucagcgccguggagaacagagccaccagcaucgacaucgaggaggccaacagaaccguguaccugaacgugagcagaaccaacggcaucgaccuggccgugagcgugcagugggagaccgugagcgagaccgccuucggcaugagaggcauggacgugguguucagcguguuccagagcuuccuggacgagagcgccagcggcuggugcuucuucacccuggagaaccugaucuacggcaucaugcugagaaagagcagcgugaccguguacagauggcagggcaucuucauccccguggaggaccugaacaucgagaaccccaagaccugcgaggccuucaacaucggcuucagccccuacuucgugaucacccacgaggagagaaacgaggagaagcccagccugaacagcguguucaccuucaccagcggcuucaagcuguuccuggugcagaccaucaucauccuggagagcagccaggugagauacuucaccagcgacagccaggacuaccugaucaucgccagccagagagacgacagcgagcugacccagguguucagauggaacggcggcagcuucgugcugcaccagaagcugcccgugagaggcgugcugaccguggcccuguucaacaagggcggcagcguguuccuggccaucagccaggccaacgccagacugaacagccugcuguucagauggagcggcagcggcuucaucaacuuccaggaggugcccgugagcggcaccaccgagguggaggcccugagcagcgccaacgacaucuaccugaucuucgccgagaacguguuccugggcgaccagaacagcaucgacaucuucaucugggagaugggccagagcagcuucagauacuuccagagcguggacuucgccgccgugaacagaauccacagcuucacccccgccagcggcaucgcccacauccugcugaucggccaggacaugagcgcccuguacugcuggaacagcgagagaaaccaguucagcuucgugcuggaggugcccagcgccuacgacguggccagcgugaccgugaagagccugaacagcagcaagaaccugaucgcccuggugggcgcccacagccacaucuacgagcuggccuacaucagcagccacagcgacuucauccccagcagcggcgagcugaucuucgagcccggcgagagagaggccaccaucgccgugaacauccuggacgacaccgugcccgagaaggaggagagcuucaaggugcagcugaagaaccccaagggcggcgccgagaucggcaucaacgacagcgugaccaucaccauccugagcaacgacgacgccuacggcaucguggccuucgcccagaacagccuguacaagcagguggaggagauggagcaggacagccuggugacccugaacguggagagacugaagggcaccuacggcagaaucaccaucgccugggaggccgacggcagcaucagcgacaucuuccccaccagcggcgugauccuguucaccgagggccaggugcugagcaccaucacccugaccauccuggccgacaacauccccgagcugagcgagguggugaucgugacccugaccagaaucaccaccgagggcguggaggacagcuacaagggcgccaccaucgaccaggacagaagcaagagcgugaucaccacccugcccaacgacagccccuucggccuggugggcuggagagccgccagcguguucaucagaguggccgagcccaaggagaacaccaccacccugcagcugcagaucgccagagacaagggccugcugggcgacaucgccauccaccugagagcccagcccaacuuccugcugcacguggacaaccaggccaccgagaacgaggacuacgugcugcaggagaccaucaucaucaugaaggagaacaucaaggaggcccacgccgaggugagcauccugcccgacgaccugcccgagcuggaggagggcuucaucgugaccaucaccgaggugaaccuggugaacagcgacuucagcaccggccagcccagcgugagaagacccggcauggagaucgccgagaucaugaucgaggagaacgacgaccccagaggcaucuucauguuccacgugaccagaggcgccggcgaggugaucaccgccuacgaggugccccccccccugaacgugcugcaggugcccguggugagacuggccggcagcuucggcgccgugaacguguacuggaaggccagccccgacagcgccggccuggaggacuucaagcccagccacggcauccuggaguucgccgacaagcaggugaccgccaugaucgagaucaccaucaucgacgacgccgaguucgagcugaccgagaccuucaacaucagccugaucagcguggccggcggcggcagacugggcgacgacgugguggugaccguggugaucccccagaacgacagccccuucggcguguucggcuucgaggagaagaccgugaugaucgacgagagccugagcagcgacgaccccgacagcuacgugacccugaccguggugagaagccccggcggcaagggcaccgugagacuggaguggaccaucgacgagaaggccaagcacaaccugagcccccugaacggcacccugcacuucgacgagaccgagagccagaagaccaucgugcugcacacccugcaggacaccgugcuggaggaggacagaagauucaccauccagcugaucagcaucgacgagguggagaucagccccgugaagggcagcgccagcaucaucaucagaggcgacaagagagccagcggcgaggugggcaucgcccccagcagcagacacauccugaucggcgagcccagcgccaaguacaacggcaccgccaucaucagccuggugagaggccccggcauccugggcgaggugaccguguucuggagaaucuucccccccagcgugggcgaguucgccgagaccagcggcaagcugaccaugagagacgagcagagcgccgugaucguggugauccaggcccugaacgacgacauccccgaggagaagagcuucuacgaguuccagcugaccgccgugagcgagggcggcgugcugagcgagagcagcagcaccgccaacaucaccgugguggccagcgacagccccuacggcagauucgccuucagccacgagcagcugagagugagcgaggcccagagagugaacaucaccaucaucagaagcagcggcgacuucggccacgugagacugugguacaagaccaugagcggcaccgccgaggccggccuggacuucgugcccgccgccggcgagcugcuguucgaggccggcgagaugagaaagagccugcacguggagauccuggacgacgacuaccccgagggccccgaggaguucagccugaccaucaccaagguggagcugcagggcagaggcuacgacuucaccauccaggagaacggccugcagaucgaccagccccccgagaucggcaacaucagcaucgugagaaucaucaucaugaagaacgacaacgccgagggcaucaucgaguucgaccccaaguacaccgccuucgagguggaggaggacgugggccugaucaugauccccguggugagacugcacggcaccuacggcuacgugaccgccgacuucaucagccagagcagcagcgccagccccggcggcguggacuacauccugcacggcagcaccgugaccuuccagcacggccagaaccugagcuucaucaacaucagcaucaucgacgacaacgagagcgaguucgaggagcccaucgagauccugcugaccggcgccaccggcggcgccgugcugggcagacaccuggugagcagaaucaucaucgccaagagcgacagccccuucggcgugaucagauuccugaaccagagcaagaucagcaucgccaaccccaacagcaccaugauccugagccuggugcuggagagaaccggcggccugcugggcgagauccaggugaacugggagaccgugggccccaacagccaggaggcccugcugccccagaacagagacaucgccgaccccgugagcggccuguucuacuucggcgagggcgagggcggcgugagaaccaucauccugaccaucuacccccacgaggagaucgagguggaggagaccuucaucaucaagcugcaccuggugaagggcgaggccaagcuggacagcagagccaaggacgugacccugaccauccaggaguucggcgaccccaacggcguggugcaguucgcccccgagacccugagcaagaagaccuacagcgagccccuggcccuggagggcccccugcugaucaccuucuucgugagaagagugaagggcaccuucggcgagaucaugguguacugggagcugagcagcgaguucgacaucaccgaggacuuccugagcaccagcggcuucuucaccaucgccgacggcgagagcgaggccagcuucgacgugcaccugcugcccgacgaggugcccgagaucgaggaggacuacgugauccagcuggugagcguggagggcggcgccgagcuggaccuggagaagagcaucaccugguucagcguguacgccaacgacgacccccacggcguguucgcccuguacagcgacagacagagcauccugaucggccagaaccugaucagaagcauccagaucaacaucaccagacuggccggcaccuucggcgacguggccgugggccugagaaucagcagcgaccacaaggagcagcccaucgugaccgagaacgccgagagacagcugguggugaaggacggcgccaccuacaagguggacguggugcccaucaagaaccagguguuccugagccugggcagcaacuucacccugcagcuggugaccgugaugcuggugggcggcagauucuacggcaugcccaccauccugcaggaggccaagagcgccgugcugcccgugagcgagaaggccgccaacagccaggugggcuucgagagcaccgccuuccagcugaugaacaucaccgccggcaccagccacgugaugaucagcagaagaggcaccuacggcgcccugagcguggccuggaccaccggcuacgcccccggccuggagauccccgaguucaucguggugggcaacaugacccccacccugggcagccugagcuucagccacggcgagcagagaaagggcguguuccuguggaccuuccccagccccggcuggcccgaggccuucgugcugcaccugagcggcgugcagagcagcgcccccggcggcgcccagcugagaagcggcuucaucguggccgagaucgagcccaugggcguguuccaguucagcaccagcagcagaaacaucaucgugagcgaggacacccagaugaucagacugcacgugcagagacuguucggcuuccacagcgaccugaucaaggugagcuaccagaccaccgccggcagcgccaagccccuggaggacuucgagcccgugcagaacggcgagcuguucuuccagaaguuccagaccgagguggacuucgagaucaccaucaucaacgaccagcugagcgagaucgaggaguucuucuacaucaaccugaccagcguggagaucagaggccugcagaaguucgacgugaacuggagccccagacugaaccuggacuucagcguggccgugaucaccauccuggacaacgacgaccuggccggcauggacaucagcuuccccgagaccaccguggccguggccguggacaccacccugauccccguggagaccgagagcaccaccuaccugagcaccagcaagaccaccaccauccugcagcccaccaacgugguggccaucgugaccgaggccaccggcgugagcgccauccccgagaagcuggugacccugcacggcacccccgccgugagcgagaagcccgacguggccaccgugaccgccaacgugagcauccacggcaccuucagccugggccccagcaucguguacaucgaggaggagaugaagaacggcaccuucaacaccgccgaggugcugaucagaagaaccggcggcuucaccggcaacgugagcaucaccgugaagaccuucggcgagagaugcgcccagauggagcccaacgcccugcccuucagaggcaucuacggcaucagcaaccugaccugggccguggaggaggaggacuucgaggagcagacccugacccugaucuuccuggacggcgagagagagagaaaggugagcgugcagauccuggacgacgacgagcccgagggccaggaguucuucuacguguuccugaccaacccccagggcggcgcccagaucguggaggagaaggacgacaccggcuucgccgccuucgccauggugaucaucaccggcagcgaccugcacaacggcaucaucggcuucagcgaggagagccagagcggccuggagcugagagagggcgccgugaugagaagacugcaccugaucgugaccagacagcccaacagagccuucgaggacgugaagguguucuggagagugacccugaacaagaccgugguggugcugcagaaggacggcgugaaccugguggaggagcugcagagcgugagcggcaccaccaccugcaccaugggccagaccaagugcuucaucagcaucgagcugaagcccgagaaggugccccagguggagguguacuucuucguggagcuguacgaggccaccgccggcgccgccaucaacaacagcgccagauucgcccagaucaagauccuggagagcgacgagagccagagccugguguacuucagcgugggcagcagacuggccguggcccacaagaaggccacccugaucagccugcagguggccagagacagcggcaccggccugaugaugagcgugaacuucagcacccaggagcugagaagcgccgagaccaucggcagaaccaucaucagccccgccaucagcggcaaggacuucgugaucaccgagggcacccugguguucgagcccggccagagaagcaccgugcuggacgugauccugacccccgagaccggcagccugaacagcuuccccaagagauuccagaucgugcuguucgaccccaagggcggcgccagaaucgacaagguguacggcaccgccaacaucacccuggugagcgacgccgacagccaggccaucuggggccuggccgaccagcugcaccagcccgugaacgacgacauccugaacagagugcugcacaccaucagcaugaagguggccaccgagaacaccgacgagcagcugagcgccaugaugcaccugaucgagaagaucaccaccgagggcaagauccaggccuucagcguggccagcagaacccuguucuacgagauccugugcagccugaucaaccccaagagaaaggacaccagaggcuucagccacuucgccgaggugaccgagaacuucgccuucagccugcugaccaacgugaccugcggcagccccggcgagaagagcaagaccauccuggacagcugccccuaccugagcauccuggcccugcacugguacccccagcagaucaacggccacaaguucgagggcaaggagggcgacuacaucagaauccccgagagacugcuggacgugcaggacgccgagaucauggccggcaagagcaccugcaagcuggugcaguucaccgaguacagcagccagcagugguucaucagcggcaacaaccugcccacccugaagaacaaggugcugagccugagcgugaagggccagagcagccagcugcugaccaacgacaacgaggugcuguacagaaucuacgccgccgagcccagaaucaucccccagaccagccugugccugcuguggaaccaggccgccgccagcuggcugagcgacagccaguucugcaaggugguggaggagaccgccgacuacguggagugcgccugcagccacaugagcguguacgccguguacgccagaaccgacaaccugagcagcuacaacgaggccuucuucaccagcggcuucaucugcaucagcggccugugccuggccgugcugagccacaucuucugcgccagauacagcauguucgccgccaagcugcugacccacaugauggccgccagccugggcacccagauccuguuccuggccagcgccuacgccagcccccagcuggccgaggagagcugcagcgccauggccgccgugacccacuaccuguaccugugccaguucagcuggaugcugauccagagcgugaacuucugguacgugcuggugaugaacgacgagcacaccgagagaagauaccugcuguucuuccugcugagcuggggccugcccgccuucguggugauccugcugaucgugauccugaagggcaucuaccaccagagcaugagccagaucuacggccugauccacggcgaccugugcuucauccccaacguguacgccgcccuguucaccgccgcccuggugccccugaccugccugguggugguguucgugguguucauccacgccuaccaggugaagccccaguggaaggccuacgacgacguguucagaggcagaaccaacgccgccgagaucccccugauccuguaccuguucgcccugaucagcgugaccuggcuguggggcggccugcacauggccuacagacacuucuggaugcuggugcuguucgugaucuucaacagccugcagggccuguacguguucaugguguacuucauccugcacaaccagaugugcugccccaugaaggccagcuacaccguggagaugaacggccaccccggccccagcaccgccuucuucacccccggcagcggcaugccccccgccggcggcgagaucagcaagagcacccagaaccugaucggcgccauggaggaggugccccccgacugggagagagccagcuuccagcagggcagccaggccagccccgaccugaagcccagcccccagaacggcgccaccuuccccagcagcggcggcuacggccagggcagccugaucgccgacgaggagagccaggaguucgacgaccugaucuucgcccugaagaccggcgccggccugagcgugagcgacaacgagagcggccagggcagccaggagggcggcacccugaccgacagccagaucguggagcugagaagaauccccaucgccgacacccaccuguaa

SEQ ID NO: 13332 - RNA, 1128 nt, Artificial Sequence
  ADH1A__Homo_sapiens__NP_000658
augagcaccgccggcaaggugaucaagugcaaggccgccgugcugugggagcugaagaagcccuucagcaucgaggagguggagguggccccccccaaggcccacgaggugagaaucaagaugguggccgugggcaucugcggcaccgacgaccacguggugagcggcaccauggugaccccccugcccgugauccugggccacgaggccgccggcaucguggagagcgugggcgagggcgugaccaccgugaagcccggcgacaaggugaucccccuggccaucccccagugcggcaagugcagaaucugcaagaaccccgagagcaacuacugccugaagaacgacgugagcaacccccagggcacccugcaggacggcaccagcagauucaccugcagaagaaagcccauccaccacuuccugggcaucagcaccuucagccaguacaccgugguggacgagaacgccguggccaagaucgacgccgccagcccccuggagaaggugugccugaucggcugcggcuucagcaccggcuacggcagcgccgugaacguggccaaggugacccccggcagcaccugcgccguguucggccugggcggcgugggccugagcgccaucaugggcugcaaggccgccggcgccgccagaaucaucgccguggacaucaacaaggacaaguucgccaaggccaaggagcugggcgccaccgagugcaucaacccccaggacuacaagaagcccauccaggaggugcugaaggagaugaccgacggcggcguggacuucagcuucgaggugaucggcagacuggacaccaugauggccagccugcugugcugccacgaggccugcggcaccagcgugaucgugggcgugccccccgacagccagaaccugagcaugaaccccaugcugcugcugaccggcagaaccuggaagggcgccauccugggcggcuucaagagcaaggagugcgugcccaagcugguggccgacuucauggccaagaaguucagccuggacgcccugaucacccacgugcugcccuucgagaagaucaacgagggcuucgaccugcugcacagcggcaagagcaucagaaccauccugauguucuaa

SEQ ID NO: 13333 - RNA, 1128 nt, Artificial Sequence
  ADH1B__Homo_sapiens__NP_000659
augagcaccgccggcaaggugaucaagugcaaggccgccgugcugugggaggugaagaagcccuucagcaucgaggacguggagguggccccccccaaggccuacgaggugagaaucaagaugguggccgugggcaucugccacaccgacgaccacguggugagcggcaaccuggugaccccccugcccgugauccugggccacgaggccgccggcaucguggagagcgugggcgagggcgugaccaccgugaagcccggcgacaaggugaucccccuguucaccccccagugcggcaagugcagagugugcaagaaccccgagagcaacuacugccugaagaacgaccugggcaaccccagaggcacccugcaggacggcaccagaagauucaccugcagaggcaagcccauccaccacuuccugggcaccagcaccuucagccaguacaccgugguggacgagaacgccguggccaagaucgacgccgccagcccccuggagaaggugugccugaucggcugcggcuucagcaccggcuacggcagcgccgugaacguggccaaggugacccccggcagcaccugcgccguguucggccugggcggcgugggccugagcgccgugaugggcugcaaggccgccggcgccgccagaaucaucgccguggacaucaacaaggacaaguucgccaaggccaaggagcugggcgccaccgagugcaucaacccccaggacuacaagaagcccauccaggaggugcugaaggagaugaccgacggcggcguggacuucagcuucgaggugaucggcagacuggacaccaugauggccagccugcugugcugccacgaggccugcggcaccagcgugaucgugggcgugccccccgccagccagaaccugagcaucaaccccaugcugcugcugaccggcagaaccuggaagggcgccguguacggcggcuucaagagcaaggagggcauccccaagcugguggccgacuucauggccaagaaguucagccuggacgcccugaucacccacgugcugcccuucgagaagaucaacgagggcuucgaccugcugcacagcggcaagagcaucagaaccgugcugaccuucuaa

SEQ ID NO: 13334 - RNA, 1143 nt, Artificial Sequence
  ADH4__Homo_sapiens__NP_000661
augggcaccaagggcaaggugaucaagugcaaggccgccaucgccugggaggccggcaagccccugugcaucgaggagguggagguggccccccccaaggcccacgaggugagaauccagaucaucgccaccagccugugccacaccgacgccaccgugaucgacagcaaguucgagggccuggccuuccccgugaucgugggccacgaggccgccggcaucguggagagcaucggccccggcgugaccaacgugaagcccggcgacaaggugaucccccuguacgccccccugugcagaaagugcaaguucugccugagcccccugaccaaccugugcggcaagaucagcaaccugaagagccccgccagcgaccagcagcugauggaggacaagaccagcagauucaccugcaagggcaagcccguguaccacuucuucggcaccagcaccuucagccaguacaccguggugagcgacaucaaccuggccaagaucgacgacgacgccaaccuggagagagugugccugcugggcugcggcuucagcaccggcuacggcgccgccaucaacaacgccaaggugacccccggcagcaccugcgccguguucggccugggcggcgugggccugagcgccgugaugggcugcaaggccgccggcgccagcagaaucaucggcaucgacaucaacagcgagaaguucgugaaggccaaggcccugggcgccaccgacugccugaaccccagagaccugcacaagcccauccaggaggugaucaucgagcugaccaagggcggcguggacuucgcccuggacugcgccggcggcagcgagaccaugaaggccgcccuggacugcaccaccgccggcuggggcagcugcaccuucaucggcguggccgccggcagcaagggccugaccaucuuccccgaggagcugaucaucggcagaaccaucaacggcaccuucuucggcggcuggaagagcguggacagcauccccaagcuggugaccgacuacaagaacaagaaguucaaccuggacgcccuggugacccacacccugcccuucgacaagaucagcgaggccuucgaccugaugaaccagggcaagagcgugagaaccauccugaucuucuaa

SEQ ID NO: 13335 - RNA, 1125 nt, Artificial Sequence
  ADH5__Homo_sapiens__NP_000662
auggccaacgaggugaucaagugcaaggccgccguggccugggaggccggcaagccccugagcaucgaggagaucgagguggccccccccaaggcccacgaggugagaaucaagaucaucgccaccgccgugugccacaccgacgccuacacccugagcggcgccgaccccgagggcugcuuccccgugauccugggccacgagggcgccggcaucguggagagcgugggcgagggcgugaccaagcugaaggccggcgacaccgugaucccccuguacaucccccagugcggcgagugcaaguucugccugaaccccaagaccaaccugugccagaagaucagagugacccagggcaagggccugaugcccgacggcaccagcagauucaccugcaagggcaagaccauccugcacuacaugggcaccagcaccuucagcgaguacaccgugguggccgacaucagcguggccaagaucgacccccuggccccccuggacaaggugugccugcugggcugcggcaucagcaccggcuacggcgccgccgugaacaccgccaagcuggagcccggcagcgugugcgccguguucggccugggcggcgugggccuggccgugaucaugggcugcaagguggccggcgccagcagaaucaucggcguggacaucaacaaggacaaguucgccagagccaaggaguucggcgccaccgagugcaucaacccccaggacuucagcaagcccauccaggaggugcugaucgagaugaccgacggcggcguggacuacagcuucgagugcaucggcaacgugaaggugaugagagccgcccuggaggccugccacaagggcuggggcgugagcgugguggugggcguggccgccagcggcgaggagaucgccaccagacccuuccagcuggugaccggcagaaccuggaagggcaccgccuucggcggcuggaagagcguggagagcgugcccaagcuggugagcgaguacaugagcaagaagaucaagguggacgaguucgugacccacaaccugagcuucgacgagaucaacaaggccuucgagcugaugcacagcggcaagagcaucagaaccguggugaagaucuaa

SEQ ID NO: 13336 - RNA, 1107 nt, Artificial Sequence
  ADH6__Homo_sapiens__NP_000663
augagcaccaccggccaggugaucagaugcaaggccgccauccuguggaagcccggcgcccccuucagcaucgaggagguggagguggccccccccaaggccaaggaggugagaaucaaggugguggccaccggccugugcggcaccgagaugaaggugcugggcagcaagcaccuggaccugcuguaccccaccauccugggccacgagggcgccggcaucguggagagcaucggcgagggcgugagcaccgugaagcccggcgacaaggugaucacccuguuccugccccagugcggcgagugcaccagcugccugaacagcgagggcaacuucugcauccaguucaagcagagcaagacccagcugaugagcgacggcaccagcagauucaccugcaagggcaagagcaucuaccacuucggcaacaccagcaccuucugcgaguacaccgugaucaaggagaucagcguggccaagaucgacgccguggccccccuggagaaggugugccugaucagcugcggcuucagcaccggcuucggcgccgccaucaacaccgccaaggugacccccggcagcaccugcgccguguucggccugggcggcgugggccugagcguggugaugggcugcaaggccgccggcgccgccagaaucaucggcguggacgugaacaaggagaaguucaagaaggcccaggagcugggcgccaccgagugccugaacccccaggaccugaagaagcccauccaggaggugcuguucgacaugaccgacgccggcaucgacuucugcuucgaggccaucggcaaccuggacgugcuggccgccgcccuggccagcugcaacgagagcuacggcgugugcgugguggugggcgugcugcccgccagcgugcagcugaagaucagcggccagcuguucuucagcggcagaagccugaagggcagcguguucggcggcuggaagagcagacagcacauccccaagcugguggccgacuacauggccgagaagcugaaccuggacccccugaucacccacacccugaaccuggacaagaucaacgaggccguggagcugaugaagaccggcaagugguaa

SEQ ID NO: 13337 - RNA, 1161 nt, Artificial Sequence
  ADH7__Homo_sapiens__NP_000664
auguucgccgagauccagauccaggacaaggacagaaugggcaccgccggcaaggugaucaagugcaaggccgccgugcugugggagcagaagcagcccuucagcaucgaggagaucgagguggccccccccaagaccaaggaggugagaaucaagauccuggccaccggcaucugcagaaccgacgaccacgugaucaagggcaccauggugagcaaguuccccgugaucgugggccacgaggccaccggcaucguggagagcaucggcgagggcgugaccaccgugaagcccggcgacaaggugaucccccuguuccugccccagugcagagagugcaacgccugcagaaaccccgacggcaaccugugcaucagaagcgacaucaccggcagaggcgugcuggccgacggcaccaccagauucaccugcaagggcaagcccgugcaccacuucaugaacaccagcaccuucaccgaguacaccgugguggacgagagcagcguggccaagaucgacgacgccgccccccccgagaaggugugccugaucggcugcggcuucagcaccggcuacggcgccgccgugaagaccggcaaggugaagcccggcagcaccugcgugguguucggccugggcggcgugggccugagcgugaucaugggcugcaagagcgccggcgccagcagaaucaucggcaucgaccugaacaaggacaaguucgagaaggccauggccgugggcgccaccgagugcaucagccccaaggacagcaccaagcccaucagcgaggugcugagcgagaugaccggcaacaacgugggcuacaccuucgaggugaucggccaccuggagaccaugaucgacgcccuggccagcugccacaugaacuacggcaccagcgugguggugggcgugccccccagcgccaagaugcugaccuacgaccccaugcugcuguucaccggcagaaccuggaagggcugcguguucggcggccugaagagcagagacgacgugcccaagcuggugaccgaguuccuggccaagaaguucgaccuggaccagcugaucacccacgugcugcccuucaagaagaucagcgagggcuucgagcugcugaacagcggccagagcaucagaaccgugcugaccuucuaa

SEQ ID NO: 13338 - RNA, 1404 nt, Artificial Sequence
  ADHFE1__Homo_sapiens__NP_653251
auggccgccgccgccagagccagaguggccuaccugcugagacagcugcagagagccgccugccagugccccacccacagccacaccuacagccaggcccccggccugagccccagcggcaagaccaccgacuacgccuucgagauggccgugagcaacaucagauacggcgccgccgugaccaaggaggugggcauggaccugaagaacaugggcgccaagaacgugugccugaugaccgacaagaaccugagcaagcugccccccgugcagguggccauggacagccuggugaagaacggcauccccuucaccguguacgacaacgugagaguggagcccaccgacagcagcuucauggaggccaucgaguucgcccagaagggcgccuucgacgccuacguggccgugggcggcggcagcaccauggacaccugcaaggccgccaaccuguacgccagcagcccccacagcgacuuccuggacuacgugagcgcccccaucggcaagggcaagcccgugagcgugccccugaagccccugaucgccgugcccaccaccagcggcaccggcagcgagaccaccggcguggccaucuucgacuacgagcaccugaaggugaagaucggcaucaccagcagagccaucaagcccacccugggccugaucgacccccugcacacccugcacaugcccgccagagugguggccaacagcggcuucgacgugcugugccacgcccuggagagcuacaccacccugcccuaccaccugagaagccccugccccagcaaccccaucaccagacccgccuaccagggcagcaaccccaucagcgacaucugggccauccacgcccugagaaucguggccaaguaccugaagagagccgugagaaaccccgacgaccuggaggccagaagccacaugcaccuggccagcgccuucgccggcaucggcuucggcaacgccggcgugcaccugugccacggcaugagcuaccccaucagcggccuggugaagauguacaaggccaaggacuacaacguggaccacccccuggugccccacggccugagcguggugcugaccagccccgccguguucaccuucaccgcccagauguuccccgagagacaccuggagauggccgagauccugggcgccgacaccagaaccgccagaauccaggacgccggccuggugcuggccgacacccugagaaaguuccuguucgaccuggacguggacgacggccuggccgccgugggcuacagcaaggccgacauccccgcccuggugaagggcacccugccccaggagagagugaccaagcuggcccccugcccccagagcgaggaggaccuggccgcccuguucgaggccagcaugaagcuguacuaa

SEQ ID NO: 13339 - RNA, 540 nt, Artificial Sequence
  ADI1__Homo_sapiens__NP_060739
auggugcaggccugguacauggacgacgcccccggcgaccccagacagccccacagacccgaccccggcagacccgugggccuggagcagcugagaagacugggcgugcuguacuggaagcuggacgccgacaaguacgagaacgaccccgagcuggagaagaucagaagagagagaaacuacagcuggauggacaucaucaccaucugcaaggacaagcugcccaacuacgaggagaagaucaagauguucuacgaggagcaccugcaccuggacgacgagaucagauacauccuggacggcagcggcuacuucgacgugagagacaaggaggaccaguggaucagaaucuucauggagaagggcgacauggugacccugcccgccggcaucuaccacagauucaccguggacgagaagaacuacaccaaggccaugagacuguucgugggcgagcccguguggaccgccuacaacagacccgccgaccacuucgaggccagaggccaguacgugaaguuccuggcccagaccgccuaa

SEQ ID NO: 13340 - RNA, 243 nt, Artificial Sequence
  ADIG__Homo_sapiens__NP_001018092
augaaguacccccugaugccccuggugaacgaccugaccuucagcuuccugguguucugguucugccugcccgugggccugcugcugcugcugaucaucuggcugagauuccugcugagccaggacagcgaggagaacgacagcagcgugugccuggacugggagcccuggagcaagggccccgccgaguucugcuggaagggcacccugcacggccaggagaaggagagacccugcugguaa

SEQ ID NO: 13341 - RNA, 735 nt, Artificial Sequence
  ADIPOQ__Homo_sapiens__NP_001171271
augcugcugcugggcgccgugcugcugcugcuggcccugcccggccacgaccaggagaccaccacccagggccccggcgugcugcugccccugcccaagggcgccugcaccggcuggauggccggcauccccggccaccccggccacaacggcgcccccggcagagacggcagagacggcacccccggcgagaagggcgagaagggcgaccccggccugaucggccccaagggcgacaucggcgagaccggcgugcccggcgccgagggccccagaggcuuccccggcauccagggcagaaagggcgagcccggcgagggcgccuacguguacagaagcgccuucagcgugggccuggagaccuacgugaccauccccaacaugcccaucagauucaccaagaucuucuacaaccagcagaaccacuacgacggcagcaccggcaaguuccacugcaacauccccggccuguacuacuucgccuaccacaucaccguguacaugaaggacgugaaggugagccuguucaagaaggacaaggccaugcuguucaccuacgaccaguaccaggagaacaacguggaccaggccagcggcagcgugcugcugcaccuggaggugggcgaccagguguggcugcagguguacggcgagggcgagagaaacggccuguacgccgacaacgacaacgacagcaccuucaccggcuuccugcuguaccacgacaccaacuaa

SEQ ID NO: 13342 - RNA, 1128 nt, Artificial Sequence
  ADIPOR1__Homo_sapiens__NP_001277558
augagcagccacaagggcagcgugguggcccagggcaacggcgcccccgccagcaacagagaggccgacaccguggagcuggccgagcugggcccccugcuggaggagaagggcaagagagugaucgccaacccccccaaggccgaggaggagcagaccugccccgugccccaggaggaggaggaggaggugagagugcugacccugccccugcaggcccaccacgccauggagaagauggaggaguucguguacaaggugugggagggcagauggagagugauccccuacgacgugcugcccgacuggcugaaggacaacgacuaccugcugcacggccacagaccccccaugcccagcuucagagccugcuucaagagcaucuucagaauccacaccgagaccggcaacaucuggacccaccugcugggcuucgugcuguuccuguuccugggcauccugaccaugcugagacccaacauguacuucauggccccccugcaggagaaggugguguucggcauguucuuccugggcgccgugcugugccugagcuucagcuggcuguuccacaccguguacugccacagcgagaaggugagcagaaccuucagcaagcuggacuacagcggcaucgcccugcugaucaugggcagcuucgugcccuggcuguacuacagcuucuacugcagcccccagcccagacugaucuaccugagcaucgugugcgugcugggcaucagcgccaucaucguggcccagugggacagauucgccacccccaagcacagacagaccagagccggcguguuccugggccugggccugagcggcguggugcccaccaugcacuucaccaucgccgagggcuucgugaaggccaccaccgugggccagaugggcugguucuuccugauggccgugauguacaucaccggcgccggccuguacgccgccagaauccccgagagauucuuccccggcaaguucgacaucugguuccagagccaccagaucuuccacgugcuggugguggccgccgccuucgugcacuucuacggcgugagcaaccugcaggaguucagauacggccuggagggcggcugcaccgacgacacccugcuguaa

SEQ ID NO: 13343 - RNA, 1161 nt, Artificial Sequence
  ADIPOR2__Homo_sapiens__XP_006719081
augaacgagcccaccgagaacagacugggcugcagcagaacccccgagcccgacaucagacugagaaagggccaccagcuggacggcaccagaagaggcgacaacgacagccaccagggcgaccuggagcccauccuggaggccagcgugcugagcagccaccacaagaagagcagcgaggagcacgaguacagcgacgaggccccccaggaggacgagggcuucaugggcaugagcccccugcugcaggcccaccacgccauggagaagauggaggaguucgugugcaaggugugggagggcagauggagagugaucccccacgacgugcugcccgacuggcugaaggacaacgacuuccugcugcacggccacagaccccccaugcccagcuucagagccugcuucaagagcaucuucagaauccacaccgagaccggcaacaucuggacccaccugcugggcugcguguucuuccugugccugggcaucuucuacauguucagacccaacaucagcuucguggccccccugcaggagaaggugguguucggccuguucuuccugggcgccauccugugccugagcuucagcuggcuguuccacaccguguacugccacagcgagggcgugagcagacuguucagcaagcuggacuacagcggcaucgcccugcugaucaugggcagcuucgugcccuggcuguacuacagcuucuacugcaacccccagcccugcuucaucuaccugaucgugaucugcgugcugggcaucgccgccaucaucgugagccagugggacauguucgccaccccccaguacagaggcgugagagccggcguguuccugggccugggccugagcggcaucauccccacccugcacuacgugaucagcgagggcuuccugaaggccgccaccaucggccagaucggcuggcugaugcugauggccagccuguacaucaccggcgccgcccuguacgccgccagaauccccgagagauucuuccccggcaagugcgacaucugguuccacagccaccagcuguuccacaucuucgugguggccggcgccuucgugcacuuccacggcgugagcaaccugcaggaguucagauucaugaucggcggcggcugcagcgaggaggacgcccuguaa

SEQ ID NO: 13344 - RNA, 231 nt, Artificial Sequence
  ADIRF__Homo_sapiens__NP_006820
auggccagcaagggccugcaggaccugaagcagcagguggagggcaccgcccaggaggccgugagcgccgccggcgccgccgcccagcaggugguggaccaggccaccgaggccggccagaaggccauggaccagcuggccaagaccacccaggagaccaucgacaagaccgccaaccaggccagcgacaccuucagcggcaucggcaagaaguucggccugcugaaguaa

SEQ ID NO: 13345 - RNA, 1038 nt, Artificial Sequence
  ADK__Homo_sapiens__NP_001114
augaccagcgugagagagaacauccuguucggcaugggcaacccccugcuggacaucagcgccgugguggacaaggacuuccuggacaaguacagccugaagcccaacgaccagauccuggccgaggacaagcacaaggagcuguucgacgagcuggugaagaaguucaagguggaguaccacgccggcggcagcacccagaacagcaucaagguggcccaguggaugauccagcagccccacaaggccgccaccuucuucggcugcaucggcaucgacaaguucggcgagauccugaagagaaaggccgccgaggcccacguggacgcccacuacuacgagcagaacgagcagcccaccggcaccugcgccgccugcaucaccggcgacaacagaagccugaucgccaaccuggccgccgccaacugcuacaagaaggagaagcaccuggaccuggagaagaacuggaugcugguggagaaggccagagugugcuacaucgccggcuucuuccugaccgugagccccgagagcgugcugaagguggcccaccacgccagcgagaacaacagaaucuucacccugaaccugagcgcccccuucaucagccaguucuacaaggagagccugaugaaggugaugcccuacguggacauccuguucggcaacgagaccgaggccgccaccuucgccagagagcagggcuucgagaccaaggacaucaaggagaucgccaagaagacccaggcccugcccaagaugaacagcaagagacagagaaucgugaucuucacccagggcagagacgacaccaucauggccaccgagagcgaggugaccgccuucgccgugcuggaccaggaccagaaggagaucaucgacaccaacggcgccggcgacgccuucgugggcggcuuccugagccagcuggugagcgacaagccccugaccgagugcaucagagccggccacuacgccgccagcaucaucaucagaagaaccggcugcaccuuccccgagaagcccgacuuccacuaa

SEQ ID NO: 13346 - RNA, 447 nt, Artificial Sequence
  ADM2__Homo_sapiens__NP_001240774
auggccagaauccccaccgccgcccugggcugcaucagccugcugugccugcagcugcccggcagccugagcagaagccugggcggcgaccccagacccgugaagcccagagagccccccgccagaagccccagcagcagccugcagcccagacaccccgcccccagacccgugguguggaagcugcacagagcccugcaggcccagagaggcgccggccuggcccccgugaugggccagccccugagagacggcggcagacagcacagcggccccagaagacacagcggccccagaagaacccaggcccagcugcugagagugggcugcgugcugggcaccugccaggugcagaaccugagccacagacuguggcagcugaugggccccgccggcagacaggacagcgcccccguggaccccagcagcccccacagcuacggcuaa

SEQ ID NO: 13347 - RNA, 558 nt, Artificial Sequence
  ADM__Homo_sapiens__NP_001115
augaagcuggugagcguggcccugauguaccugggcagccuggccuuccugggcgccgacaccgccagacuggacguggccagcgaguucagaaagaaguggaacaagugggcccugagcagaggcaagagagagcugagaaugagcagcagcuaccccaccggccuggccgacgugaaggccggccccgcccagacccugaucagaccccaggacaugaagggcgccagcagaagccccgaggacagcagccccgacgccgccagaaucagagugaagagauacagacagagcaugaacaacuuccagggccugagaagcuucggcugcagauucggcaccugcaccgugcagaagcuggcccaccagaucuaccaguucaccgacaaggacaaggacaacguggcccccagaagcaagaucagcccccagggcuacggcagaagaagaagaagaagccugcccgaggccggccccggcagaacccuggugagcagcaagccccaggcccacggcgcccccgccccccccagcggcagcgccccccacuuccuguaa

SEQ ID NO: 13348 - RNA, 3309 nt, Artificial Sequence
  ADNP__Homo_sapiens__XP_011527049
auguuccagcugcccgugaacaaccugggcagccugagaaaggccagaaagaccgugaagaagauccugagcgacaucggccuggaguacugcaaggagcacaucgaggacuucaagcaguucgagcccaacgacuucuaccugaagaacaccaccugggaggacgugggccugugggaccccagccugaccaagaaccaggacuacagaaccaagcccuucugcugcagcgccugccccuucagcagcaaguucuucagcgccuacaagagccacuucagaaacgugcacagcgaggacuucgagaacagaauccugcugaacugccccuacugcaccuucaacgccgacaagaagacccuggagacccacaucaagaucuuccacgcccccaacgccagcgcccccagcagcagccugagcaccuucaaggacaagaacaagaacgacggccugaagcccaagcaggccgacagcguggagcaggccguguacuacugcaagaagugcaccuacagagacccccuguacgagaucgugagaaagcacaucuacagagagcacuuccagcacguggccgcccccuacaucgccaaggccggcgagaagagccugaacggcgccgugccccugggcagcaacgccagagaggagagcagcauccacugcaagagaugccuguucaugcccaagagcuacgaggcccuggugcagcacgugaucgaggaccacgagagaaucggcuaccaggugaccgccaugaucggccacaccaacgugguggugcccagaagcaagccccugaugcugaucgcccccaagccccaggacaagaagagcaugggccugccccccagaaucggcagccuggccagcggcaacgugagaagccugcccagccagcagauggugaacagacugagcauccccaagcccaaccugaacagcaccggcgugaacaugaugagcagcgugcaccugcagcagaacaacuacggcgugaagagcgugggccagggcuacagcgugggccagagcaugagacugggccugggcggcaacgcccccgugagcaucccccagcagagccagagcgugaagcagcugcugcccagcggcaacggcagaagcuacggccugggcagcgagcagagaagccaggcccccgccagauacagccugcagagcgccaacgccagcagccugagcagcggccagcugaagagccccagccugagccagagccaggccagcagagugcugggccagagcagcagcaagcccgccgccgccgccaccggccccccccccggcaacaccagcagcacccagaaguggaagaucugcaccaucugcaacgagcuguuccccgagaacguguacagcgugcacuucgagaaggagcacaaggccgagaaggugcccgccguggccaacuacaucaugaagauccacaacuucaccagcaagugccuguacugcaacagauaccugcccaccgacacccugcugaaccacaugcugauccacggccugagcugccccuacugcagaagcaccuucaacgacguggagaagauggccgcccacaugagaauggugcacaucgacgaggagaugggccccaagaccgacagcacccugagcuucgaccugacccugcagcagggcagccacaccaacauccaccugcuggugaccaccuacaaccugagagacgcccccgccgagagcguggccuaccacgcccagaacaacccccccgugccccccaagccccagcccaaggugcaggagaaggccgacauccccgugaagagcagcccccaggccgccgugcccuacaagaaggacgugggcaagacccugugcccccugugcuucagcauccugaagggccccaucagcgacgcccuggcccaccaccugagagagagacaccaggugauccagaccgugcaccccguggagaagaagcugaccuacaagugcauccacugccugggcguguacaccagcaacaugaccgccagcaccaucacccugcaccuggugcacugcagaggcgugggcaagacccagaacggccaggacaagaccaacgcccccagcagacugaaccagagccccagccuggcccccgugaagagaaccuacgagcagauggaguucccccugcugaagaagagaaagcuggacgacgacagcgacagccccagcuucuucgaggagaagcccgaggagcccguggugcuggcccuggaccccaagggccacgaggacgacagcuacgaggccagaaagagcuuccugaccaaguacuucaacaagcagcccuaccccaccagaagagagaucgagaagcuggccgccagccuguggcuguggaagagcgacaucgccagccacuucagcaacaagagaaagaagugcgugagagacugcgagaaguacaagcccggcgugcugcugggcuucaacaugaaggagcugaacaaggugaagcacgagauggacuucgacgccgaguggcuguucgagaaccacgacgagaaggacagcagagugaacgccagcaagaccgccgacaagaagcugaaccugggcaaggaggacgacagcagcagcgacagcuucgagaaccuggaggaggagagcaacgagagcggcagccccuucgaccccguguucgagguggagcccaagaucagcaacgacaaccccgaggagcacgugcugaaggugauccccgaggacgccagcgagagcgaggagaagcuggaccagaaggaggacggcagcaaguacgagaccauccaccugaccgaggagcccaccaagcugaugcacaacgccagcgacagcgagguggaccaggacgacgugguggaguggaaggacggcgccagccccagcgagagcggccccggcagccagcaggugagcgacuucgaggacaacaccugcgagaugaagcccggcaccuggagcgacgagagcagccagagcgaggacgccagaagcagcaagcccgccgccaagaagaaggccaccaugcagggcgacagagagcagcugaaguggaagaacagcagcuacggcaagguggagggcuucuggagcaaggaccagagccaguggaagaacgccagcgagaacgacgagagacugagcaacccccagaucgaguggcagaacagcaccaucgacagcgaggacggcgagcaguucgacaacaugaccgacggcguggccgagcccaugcacggcagccuggccggcgugaagcugagcagccagcaggccuaa

SEQ ID NO: 13349 - RNA, 813 nt, Artificial Sequence
  ADO__Homo_sapiens__NP_116193
augcccagagacaacauggccagccugauccagagaaucgccagacaggccugccugaccuucagaggcagcggcggcggcagaggcgccagcgacagagacgccgccagcggccccgaggcccccaugcagcccggcuuccccgagaaccugagcaagcugaagagccugcugacccagcugagagccgaggaccugaacaucgcccccagaaaggccacccugcagccccugccccccaaccugccccccgugaccuacaugcacaucuacgagaccgacggcuucagccugggcguguuccugcugaagagcggcaccagcaucccccugcacgaccaccccggcaugcacggcaugcugaaggugcuguacggcaccgugagaaucagcugcauggacaagcuggacgccggcggcggccagagacccagagcccugccccccgagcagcaguucgagcccccccugcagcccagagagagagaggccgugagacccggcgugcugagaagcagagccgaguacaccgaggccagcggccccugcauccugaccccccacagagacaaccugcaccagaucgacgccguggagggccccgccgccuuccuggacauccuggccccccccuacgaccccgacgacggcagagacugccacuacuacagagugcuggagcccgugagacccaaggaggccagcagcagcgccugcgaccugcccagagagguguggcugcuggagaccccccaggccgacgacuucuggugcgagggcgagcccuaccccggccccaagguguuccccuaa

SEQ ID NO: 13350 - RNA, 981 nt, Artificial Sequence
  ADORA1__Homo_sapiens__NP_000665
augccccccagcaucagcgccuuccaggccgccuacaucggcaucgaggugcugaucgcccuggugagcgugcccggcaacgugcuggugaucugggccgugaaggugaaccaggcccugagagacgccaccuucugcuucaucgugagccuggccguggccgacguggccgugggcgcccuggugaucccccuggccauccugaucaacaucggcccccagaccuacuuccacaccugccugaugguggccugccccgugcugauccugacccagagcagcauccuggcccugcuggccaucgccguggacagauaccugagagugaagaucccccugagauacaagaugguggugacccccagaagagccgccguggccaucgccggcugcuggauccugagcuucguggugggccugacccccauguucggcuggaacaaccugagcgccguggagagagccugggccgccaacggcagcaugggcgagcccgugaucaagugcgaguucgagaaggugaucagcauggaguacaugguguacuucaacuucuucgugugggugcugcccccccugcugcugauggugcugaucuaccuggagguguucuaccugaucagaaagcagcugaacaagaaggugagcgccagcagcggcgacccccagaaguacuacggcaaggagcugaagaucgccaagagccuggcccugauccuguuccuguucgcccugagcuggcugccccugcacauccugaacugcaucacccuguucugccccagcugccacaagcccagcauccugaccuacaucgccaucuuccugacccacggcaacagcgccaugaaccccaucguguacgccuucagaauccagaaguucagagugaccuuccugaagaucuggaacgaccacuucagaugccagcccgccccccccaucgacgaggaccugcccgaggagagacccgacgacuaa

SEQ ID NO: 13351 - RNA, 1239 nt, Artificial Sequence
  ADORA2A__Homo_sapiens__NP_001265429
augcccaucaugggcagcagcguguacaucaccguggagcuggccaucgccgugcuggccauccugggcaacgugcuggugugcugggccguguggcugaacagcaaccugcagaacgugaccaacuacuucguggugagccuggccgccgccgacaucgccgugggcgugcuggccauccccuucgccaucaccaucagcaccggcuucugcgccgccugccacggcugccuguucaucgccugcuucgugcuggugcugacccagagcagcaucuucagccugcuggccaucgccaucgacagauacaucgccaucagaaucccccugagauacaacggccuggugaccggcaccagagccaagggcaucaucgccaucugcugggugcugagcuucgccaucggccugacccccaugcugggcuggaacaacugcggccagcccaaggagggcaagaaccacagccagggcugcggcgagggccagguggccugccuguucgaggacguggugcccaugaacuacaugguguacuucaacuucuucgccugcgugcuggugccccugcugcugaugcugggcguguaccugagaaucuuccuggccgccagaagacagcugaagcagauggagagccagccccugcccggcgagagagccagaagcacccugcagaaggaggugcacgccgccaagagccuggccaucaucgugggccuguucgcccugugcuggcugccccugcacaucaucaacugcuucaccuucuucugccccgacugcagccacgccccccuguggcugauguaccuggccaucgugcugagccacaccaacagcguggugaaccccuucaucuacgccuacagaaucagagaguucagacagaccuucagaaagaucaucagaagccacgugcugagacagcaggagcccuucaaggccgccggcaccagcgccagagugcuggccgcccacggcagcgacggcgagcaggugagccugagacugaacggccacccccccggcgugugggccaacggcagcgccccccaccccgagagaagacccaacggcuacgcccugggccuggugagcggcggcagcgcccaggagagccagggcaacaccggccugcccgacguggagcugcugagccacgagcugaagggcgugugccccgagccccccggccuggacgacccccuggcccaggacggcgccggcgugagcuaa

SEQ ID NO: 13352 - RNA, 999 nt, Artificial Sequence
  ADORA2B__Homo_sapiens__NP_000667
augcugcuggagacccaggacgcccuguacguggcccuggagcuggugaucgccgcccugagcguggccggcaacgugcuggugugcgccgccgugggcaccgccaacacccugcagacccccaccaacuacuuccuggugagccuggccgccgccgacguggccgugggccuguucgccauccccuucgccaucaccaucagccugggcuucugcaccgacuucuacggcugccuguuccuggccugcuucgugcuggugcugacccagagcagcaucuucagccugcuggccguggccguggacagauaccuggccaucugcgugccccugagauacaagagccuggugaccggcaccagagccagaggcgugaucgccgugcugugggugcuggccuucggcaucggccugacccccuuccugggcuggaacagcaaggacagcgccaccaacaacugcaccgagcccugggacggcaccaccaacgagagcugcugccuggugaagugccuguucgagaacguggugcccaugagcuacaugguguacuucaacuucuucggcugcgugcugcccccccugcugaucaugcuggugaucuacaucaagaucuuccugguggccugcagacagcugcagagaaccgagcugauggaccacagcagaaccacccugcagagagagauccacgccgccaagagccuggccaugaucgugggcaucuucgcccugugcuggcugcccgugcacgccgugaacugcgugacccuguuccagcccgcccagggcaagaacaagcccaagugggccaugaacauggccauccugcugagccacgccaacagcguggugaaccccaucguguacgccuacagaaacagagacuucagauacaccuuccacaagaucaucagcagauaccugcugugccaggccgacgugaagagcggcaacggccaggccggcgugcagcccgcccugggcgugggccuguaa

SEQ ID NO: 13353 - RNA, 1491 nt, Artificial Sequence
  ADPGK__Homo_sapiens__NP_112574
auggcccuguggagaggcagcgccuacgccggcuuccuggcccuggccgugggcugcguguuccugcuggagcccgagcugcccggcagcgcccugagaagccuguggagcagccugugccugggccccgcccccgccccccccggccccgugagccccgagggcagacuggccgccgccugggacgcccugaucgugagacccgugagaagauggagaagaguggccgugggcgugaacgccugcguggacguggugcugagcggcgugaagcugcugcaggcccugggccugagccccggcaacggcaaggaccacagcauccugcacagcagaaacgaccuggaggaggccuucauccacuucaugggcaagggcgccgccgccgagagauucuucagcgacaaggagaccuuccacgacaucgcccagguggccagcgaguuccccggcgcccagcacuacgugggcggcaacgccgcccugaucggccagaaguucgccgccaacagcgaccugaaggugcugcugugcggccccgugggccccaagcugcacgagcugcuggacgacaacguguucgugccccccgagagccugcaggagguggacgaguuccaccugauccuggaguaccaggccggcgaggaguggggccagcugaaggccccccacgccaacagauucaucuucagccacgaccugagcaacggcgccaugaacaugcuggagguguucgugagcagccuggaggaguuccagcccgaccugguggugcugagcggccugcacaugauggagggccagagcaaggagcugcagagaaagagacugcuggagguggugaccagcaucagcgacauccccaccggcauccccgugcaccuggagcuggccagcaugaccaacagagagcugaugagcagcaucgugcaccagguguuccccgccgugaccagccugggccugaacgagcaggagcugcuguuccugacccagagcgccagcggcccccacagcagccugagcagcuggaacggcgugcccgacgugggcauggugagcgacauccuguucuggauccugaaggagcacggcagaagcaagagcagagccagcgaccugaccagaauccacuuccacacccugguguaccacauccuggccaccguggacggccacugggccaaccagcuggccgccguggccgccggcgccagaguggccggcacccaggccugcgccaccgagaccaucgacaccagcagagugagccugagagccccccaggaguucaugaccagccacagcgaggccggcagcagaaucgugcugaaccccaacaagcccgugguggaguggcacagagagggcaucagcuuccacuucacccccgugcuggugugcaaggaccccaucagaaccgugggccugggcgacgccaucagcgccgagggccuguucuacagcgaggugcacccccacuacuaa

SEQ ID NO: 13354 - RNA, 1074 nt, Artificial Sequence
  ADPRH__Homo_sapiens__NP_001278878
auggagaaguacguggccgccauggugcugagcgccgccggcgacgcccugggcuacuacaacggcaagugggaguuccugcaggacggcgagaagauccacagacagcuggcccagcugggcggccuggacgcccuggacgugggcagauggagagugagcgacgacaccgugaugcaccuggccaccgccgaggcccugguggaggccggcaaggcccccaagcugacccagcuguacuaccugcuggccaagcacuaccaggacugcauggaggacauggacggcagagcccccggcggcgccagcgugcacaacgccaugcagcugaagcccggcaagcccaacggcuggagaauccccuucaacagccacgagggcggcugcggcgccgccaugagagccaugugcaucggccugagauucccccaccacagccagcuggacacccugauccaggugagcaucgagagcggcagaaugacccaccaccaccccaccggcuaccugggcgcccuggccagcgcccuguucaccgccuacgccgugaacagcagacccccccugcaguggggcaagggccugauggagcugcugcccgaggccaagaaguacaucgugcagagcggcuacuucguggaggagaaccugcagcacuggagcuacuuccagaccaagugggagaacuaccugaagcugagaggcauccuggacggcgagagcgcccccaccuuccccgagagcuucggcgugaaggagagagaccaguucuacaccagccugagcuacagcggcuggggcggcagcagcggccacgacgcccccaugaucgccuacgacgccgugcuggccgccggcgacagcuggaaggagcuggcccacagagccuucuuccacggcggcgacagcgacagcaccgccgccaucgccggcugcugguggggcgugauguacggcuucaagggcgugagccccagcaacuacgagaagcuggaguacagaaacagacuggaggagaccgccagagcccuguacagccugggcagcaaggaggacaccgugaucagccuguaa

SEQ ID NO: 13355 - RNA, 1065 nt, Artificial Sequence
  ADPRHL1__Homo_sapiens__NP_612439
auggagaaguucaaggccgccaugcugcugggcagcgugggcgacgcccugggcuacagaaacgugugcaaggagaacagcaccgugggcaugaagauccaggaggagcugcagagaagcggcggccuggaccaccuggugcugagccccggcgaguggcccgugagcgacaacaccaucaugcacaucgccaccgccgaggcccugaccaccgacuacuggugccuggacgaccuguacagagagauggugagaugcuacguggagaucguggagaagcugcccgagagaagacccgaccccgccaccaucgagggcugcgcccagcugaagcccaacaacuaccugcuggccuggcacacccccuucaacgagaagggcagcggcuucggcgccgccaccaaggccaugugcaucggccugagauacuggaagcccgagagacuggagacccugaucgaggugagcguggagugcggcagaaugacccacaaccaccccaccggcuuccugggcagccugugcaccgcccuguucgugagcuucgccgcccagggcaagccccuggugcaguggggcagagacaugcugagagccgugccccuggccgaggaguacugcagaaagaccaucagacacaccgccgaguaccaggagcacugguucuacuucgaggccaaguggcaguucuaccuggaggagagaaagaucagcaaggacagcgagaacaaggccaucuuccccgacaacuacgacgccgaggagagagagaagaccuacagaaaguggagcagcgagggcagaggcggcagaagaggccacgacgcccccaugaucgccuacgacgcccugcuggccgccggcaacagcuggaccgagcugugccacagagccauguuccacggcggcgagagcgccgccaccggcaccaucgccggcugccuguucggccugcuguacggccuggaccuggugcccaagggccuguaccaggaccuggaggacaaggagaagcuggaggaccugggcgccgcccuguacagacugagcaccgaggagaaguaa

SEQ ID NO: 13356 - RNA, 630 nt, Artificial Sequence
  ADPRHL2__Homo_sapiens__XP_011539938
augagaguggccggcaucagccuggccuacagcagcgugcaggacgugcagaaguucgccagacugagcgcccagcugacccacgccagcagccugggcuacaacggcgccauccugcaggcccuggccgugcaccuggcccugcagggcgagagcagcagcgagcacuuccugaagcagcugcugggccacauggaggaccuggagggcgacgcccagagcgugcuggacgccagagagcugggcauggaggagagacccuacagcagcagacugaagaagaucggcgagcugcuggaccaggccagcgugaccagagaggagguggugagcgagcugggcaacggcaucgccgccuucgagagcgugcccaccgccaucuacugcuuccugagaugcauggagcccgaccccgagauccccagcgccuucaacagccugcagagaacccugaucuacagcaucagccugggcggcgacaccgacaccaucgccaccauggccggcgccaucgccggcgccuacuacggcauggaccaggugcccgagagcuggcagcagagcugcgagggcuacgaggagaccgacauccuggcccagagccugcacagaguguuccagaagagcuaa

SEQ ID NO: 13357 - RNA, 1401 nt, Artificial Sequence
  ADRA1A__Homo_sapiens__NP_000671
augguguuccugagcggcaacgccagcgacagcagcaacugcacccagccccccgcccccgugaacaucagcaaggccauccugcugggcgugauccugggcggccugauccuguucggcgugcugggcaacauccuggugauccugagcguggccugccacagacaccugcacagcgugacccacuacuacaucgugaaccuggccguggccgaccugcugcugaccagcaccgugcugcccuucagcgccaucuucgaggugcugggcuacugggccuucggcagaguguucugcaacaucugggccgccguggacgugcugugcugcaccgccagcaucaugggccugugcaucaucagcaucgacagauacaucggcgugagcuacccccugagauaccccaccaucgugacccagagaagaggccugauggcccugcugugcgugugggcccugagccuggugaucagcaucggcccccuguucggcuggagacagcccgcccccgaggacgagaccaucugccagaucaacgaggagcccggcuacgugcuguucagcgcccugggcagcuucuaccugccccuggccaucauccuggugauguacugcagaguguacgugguggccaagagagagagcagaggccugaagagcggccugaagaccgacaagagcgacagcgagcaggugacccugagaauccacagaaagaacgcccccgccggcggcagcggcauggccagcgccaagaccaagacccacuucagcgugagacugcugaaguucagcagagagaagaaggccgccaagacccugggcaucguggugggcugcuucgugcugugcuggcugcccuucuuccuggugaugcccaucggcagcuucuuccccgacuucaagcccagcgagaccguguucaagaucguguucuggcugggcuaccugaacagcugcaucaaccccaucaucuaccccugcagcagccaggaguucaagaaggccuuccagaacgugcugagaauccagugccugugcagaaagcagagcagcaagcacgcccugggcuacacccugcacccccccagccaggccguggagggccagcacaaggacauggugagaauccccgugggcagcagagagaccuucuacagaaucagcaagaccgacggcgugugcgaguggaaguucuucagcagcaugcccagaggcagcgccagaaucaccgugagcaaggaccagagcagcugcaccaccgccagagugagaagcaagagcuuccugcaggugugcugcugcgugggccccagcacccccagccuggacaagaaccaccaggugcccaccaucaaggugcacaccaucagccugagcgagaacggcgaggagguguaa

SEQ ID NO: 13358 - RNA, 1563 nt, Artificial Sequence
  ADRA1B__Homo_sapiens__NP_000670
augaaccccgaccuggacaccggccacaacaccagcgcccccgcccacuggggcgagcugaagaacgccaacuucaccggccccaaccagaccagcagcaacagcacccugccccagcuggacaucaccagagccaucagcgugggccuggugcugggcgccuucauccuguucgccaucgugggcaacauccuggugauccugagcguggccugcaacagacaccugagaacccccaccaacuacuucaucgugaaccuggccauggccgaccugcugcugagcuucaccgugcugcccuucagcgccgcccuggaggugcugggcuacugggugcugggcagaaucuucugcgacaucugggccgccguggacgugcugugcugcaccgccagcauccugagccugugcgccaucagcaucgacagauacaucggcgugagauacagccugcaguaccccacccuggugaccagaagaaaggccauccuggcccugcugagcgugugggugcugagcaccgugaucagcaucggcccccugcugggcuggaaggagcccgcccccaacgacgacaaggagugcggcgugaccgaggagcccuucuacgcccuguucagcagccugggcagcuucuacaucccccuggccgugauccuggugauguacugcagaguguacaucguggccaagagaaccaccaagaaccuggaggccggcgugaugaaggagaugagcaacagcaaggagcugacccugagaauccacagcaagaacuuccacgaggacacccugagcagcaccaaggccaagggccacaaccccagaagcagcaucgccgugaagcuguucaaguucagcagagagaagaaggccgccaagacccugggcaucguggugggcauguucauccugugcuggcugcccuucuucaucgcccugccccugggcagccuguucagcacccugaagccccccgacgccguguucaaggugguguucuggcugggcuacuucaacagcugccugaaccccaucaucuaccccugcagcagcaaggaguucaagagagccuucgugagaauccugggcugccagugcagaggcagaggcagaagaagaagaagaagaagaagaagacugggcggcugcgccuacaccuacagacccuggaccagaggcggcagccuggagagaagccagagcagaaaggacagccuggacgacagcggcagcugccugagcggcagccagagaacccugcccagcgccagccccagccccggcuaccugggcagaggcgcccccccccccguggagcugugcgccuuccccgaguggaaggcccccggcgcccugcugagccugcccgcccccgagccccccggcagaagaggcagacacgacagcggcccccuguucaccuucaagcugcugaccgagcccgagagccccggcaccgacggcggcgccagcaacggcggcugcgaggccgccgccgacguggccaacggccagcccggcuucaagagcaacaugccccuggcccccggccaguucuaa

SEQ ID NO: 13359 - RNA, 1719 nt, Artificial Sequence
  ADRA1D__Homo_sapiens__NP_000669
augaccuucagagaccugcugagcgugagcuucgagggccccagacccgacagcagcgccggcggcagcagcgccggcggcggcggcggcagcgccggcggcgccgcccccagcgagggccccgccgugggcggcgugcccggcggcgccggcggcggcggcggcguggugggcgccggcagcggcgaggacaacagaagcagcgccggcgagcccggcagcgccggcgccggcggcgacgugaacggcaccgccgccgugggcggccugguggugagcgcccagggcgugggcgugggcguguuccuggccgccuucauccugauggccguggccggcaaccugcuggugauccugagcguggccugcaacagacaccugcagaccgugaccaacuacuucaucgugaaccuggccguggccgaccugcugcugagcgccaccgugcugcccuucagcgccaccauggaggugcugggcuucugggccuucggcagagccuucugcgacgugugggccgccguggacgugcugugcugcaccgccagcauccugagccugugcaccaucagcguggacagauacgugggcgugagacacagccugaaguaccccgccaucaugaccgagagaaaggccgccgccauccuggcccugcugugggugguggcccugguggugagcgugggcccccugcugggcuggaaggagcccgugccccccgacgagagauucugcggcaucaccgaggaggccggcuacgccguguucagcagcgugugcagcuucuaccugcccauggccgugaucguggugauguacugcagaguguacgugguggccagaagcaccaccagaagccuggaggccggcgugaagagagagagaggcaaggccagcgagguggugcugagaauccacugcagaggcgccgccaccggcgccgacggcgcccacggcaugagaagcgccaagggccacaccuucagaagcagccugagcgugagacugcugaaguucagcagagagaagaaggccgccaagacccuggccaucguggugggcguguucgugcugugcugguuccccuucuucuucgugcugccccugggcagccuguucccccagcugaagcccagcgagggcguguucaaggugaucuucuggcugggcuacuucaacagcugcgugaacccccugaucuaccccugcagcagcagagaguucaagagagccuuccugagacugcugagaugccagugcagaagaagaagaagaagaagaccccuguggagaguguacggccaccacuggagagccagcaccagcggccugagacaggacugcgcccccagcagcggcgacgccccccccggcgccccccuggcccugaccgcccugcccgaccccgaccccgagccccccggcacccccgagaugcaggcccccguggccagcagaagaaagccccccagcgccuucagagaguggagacugcugggccccuucagaagacccaccacccagcugagagccaaggugagcagccugagccacaagaucagagccggcggcgcccagagagccgaggccgccugcgcccagagaagcgagguggaggccgugagccugggcgugccccacgagguggccgagggcgccaccugccaggccuacgagcuggccgacuacagcaaccugagagagaccgacaucuaa

SEQ ID NO: 13360 - RNA, 1398 nt, Artificial Sequence
  ADRA2A__Homo_sapiens__NP_000672
auguucagacaggagcagccccuggccgagggcagcuucgcccccaugggcagccugcagcccgacgccggcaacgccagcuggaacggcaccgaggcccccggcggcggcgccagagccacccccuacagccugcaggugacccugacccuggugugccuggccggccugcugaugcugcugaccguguucggcaacgugcuggugaucaucgccguguucaccagcagagcccugaaggccccccagaaccuguuccuggugagccuggccagcgccgacauccugguggccacccuggugauccccuucagccuggccaacgaggugaugggcuacugguacuucggcaaggccuggugcgagaucuaccuggcccuggacgugcuguucugcaccagcagcaucgugcaccugugcgccaucagccuggacagauacuggagcaucacccaggccaucgaguacaaccugaagagaacccccagaagaaucaaggccaucaucaucaccgugugggugaucagcgccgugaucagcuuccccccccugaucagcaucgagaagaagggcggcggcggcggcccccagcccgccgagcccagaugcgagaucaacgaccagaagugguacgugaucagcagcugcaucggcagcuucuucgcccccugccugaucaugauccugguguacgugagaaucuaccagaucgccaagagaagaaccagagugccccccagcagaagaggccccgacgccguggccgccccccccggcggcaccgagagaagacccaacggccugggccccgagagaagcgccggccccggcggcgccgaggccgagccccugcccacccagcugaacggcgcccccggcgagcccgcccccgccggccccagagacaccgacgcccuggaccuggaggagagcagcagcagcgaccacgccgagagaccccccggccccagaagacccgagagaggccccagaggcaagggcaaggccagagccagccaggugaagcccggcgacagccugcccagaagaggccccggcgccaccggcaucggcacccccgccgccggccccggcgaggagagagugggcgccgccaaggccagcagauggagaggcagacagaacagagagaagagauucaccuucgugcuggccguggugaucggcguguucguggugugcugguuccccuucuucuucaccuacacccugaccgccgugggcugcagcgugcccagaacccuguucaaguucuucuucugguucggcuacugcaacagcagccugaaccccgugaucuacaccaucuucaaccacgacuucagaagagccuucaagaagauccugugcagaggcgacagaaagagaaucguguaa

SEQ ID NO: 13361 - RNA, 1353 nt, Artificial Sequence
  ADRA2B__Homo_sapiens__NP_000673
auggaccaccaggaccccuacagcgugcaggccaccgccgccaucgccgccgccaucaccuuccugauccuguucaccaucuucggcaacgcccuggugauccuggccgugcugaccagcagaagccugagagccccccagaaccuguuccuggugagccuggccgccgccgacauccugguggccacccugaucauccccuucagccuggccaacgagcugcugggcuacugguacuucagaagaaccuggugcgagguguaccuggcccuggacgugcuguucugcaccagcagcaucgugcaccugugcgccaucagccuggacagauacugggccgugagcagagcccuggaguacaacagcaagagaacccccagaagaaucaagugcaucauccugaccguguggcugaucgccgccgugaucagccugcccccccugaucuacaagggcgaccagggcccccagcccagaggcagaccccagugcaagcugaaccaggaggccugguacauccuggccagcagcaucggcagcuucuucgcccccugccugaucaugauccugguguaccugagaaucuaccugaucgccaagagaagcaacagaagaggccccagagccaagggcggccccggccagggcgagagcaagcagcccagacccgaccacggcggcgcccuggccagcgccaagcugcccgcccuggccagcguggccagcgccagagaggugaacggccacagcaagagcaccggcgagaaggaggagggcgagacccccgaggacaccggcaccagagcccugccccccagcugggccgcccugcccaacagcggccagggccagaaggagggcgugugcggcgccagccccgaggacgaggccgaggaggaggaggaggaggaggaggaggaggaggagugcgagccccaggccgugcccgugagccccgccagcgccugcagccccccccugcagcagccccagggcagcagagugcuggccacccugagaggccaggugcugcugggcagaggcgugggcgccaucggcggccagugguggagaagaagagcccagcugaccagagagaagagauucaccuucgugcuggccguggugaucggcguguucgugcugugcugguuccccuucuucuucagcuacagccugggcgccaucugccccaagcacugcaaggugccccacggccuguuccaguucuucuucuggaucggcuacugcaacagcagccugaaccccgugaucuacaccaucuucaaccaggacuucagaagagccuucagaagaauccugugcagacccuggacccagaccgccugguaa

SEQ ID NO: 13362 - RNA, 1389 nt, Artificial Sequence
  ADRA2C__Homo_sapiens__NP_000674
auggccagccccgcccuggccgccgcccuggccguggccgccgccgccggccccaacgccagcggcgccggcgagagaggcagcggcggcguggccaacgccagcggcgccagcuggggcccccccagaggccaguacagcgccggcgccguggccggccuggccgccguggugggcuuccugaucguguucaccguggugggcaacgugcugguggugaucgccgugcugaccagcagagcccugagagccccccagaaccuguuccuggugagccuggccagcgccgacauccugguggccacccuggugaugcccuucagccuggccaacgagcugauggccuacugguacuucggccagguguggugcggcguguaccuggcccuggacgugcuguucugcaccagcagcaucgugcaccugugcgccaucagccuggacagauacuggagcgugacccaggccguggaguacaaccugaagagaacccccagaagagugaaggccaccaucguggccguguggcugaucagcgccgugaucagcuuccccccccuggugagccuguacagacagcccgacggcgccgccuacccccagugcggccugaacgacgagaccugguacauccugagcagcugcaucggcagcuucuucgcccccugccugaucaugggccugguguacgccagaaucuacagaguggccaagcugagaaccagaacccugagcgagaagagagcccccgugggccccgacggcgccagccccaccaccgagaacggccugggcgccgccgccggcgccggcgagaacggccacugcgcccccccccccgccgacguggagcccgacgagagcagcgccgccgccgagagaagaagaagaagaggcgcccugagaagaggcggcagaagaagagccggcgccgagggcggcgccggcggcgccgacggccagggcgccggccccggcgccgccgagagcggcgcccugaccgccagcagaagccccggccccggcggcagacugagcagagccagcagcagaagcguggaguucuuccugagcagaagaagaagagccagaagcagcgugugcagaagaaagguggcccaggccagagagaagagauucaccuucgugcuggccguggugaugggcguguucgugcugugcugguuccccuucuucuucagcuacagccuguacggcaucugcagagaggccugccaggugcccggcccccuguucaaguucuucuucuggaucggcuacugcaacagcagccugaaccccgugaucuacaccguguucaaccaggacuucagaagaagcuucaagcacauccuguucagaagaagaagaagaggcuucagacaguaa

SEQ ID NO: 13363 - RNA, 1434 nt, Artificial Sequence
  ADRB1__Homo_sapiens__NP_000675
augggcgccggcgugcuggugcugggcgccagcgagcccggcaaccugagcagcgccgccccccugcccgacggcgccgccaccgccgccagacugcuggugcccgccagcccccccgccagccugcugccccccgccagcgagagccccgagccccugagccagcaguggaccgccggcaugggccugcugauggcccugaucgugcugcugaucguggccggcaacgugcuggugaucguggccaucgccaagacccccagacugcagacccugaccaaccuguucaucaugagccuggccagcgccgaccuggugaugggccugcugguggugcccuucggcgccaccaucgugguguggggcagaugggaguacggcagcuucuucugcgagcuguggaccagcguggacgugcugugcgugaccgccagcaucgagacccugugcgugaucgcccuggacagauaccuggccaucaccagccccuucagauaccagagccugcugaccagagccagagccagaggccuggugugcaccgugugggccaucagcgcccuggugagcuuccugcccauccugaugcacugguggagagccgagagcgacgaggccagaagaugcuacaacgaccccaagugcugcgacuucgugaccaacagagccuacgccaucgccagcagcguggugagcuucuacgugccccugugcaucauggccuucguguaccugagaguguucagagaggcccagaagcaggugaagaagaucgacagcugcgagagaagauuccugggcggccccgccagaccccccagccccagccccagccccgugcccgcccccgcccccccccccggcccccccagacccgccgccgccgccgccaccgccccccuggccaacggcagagccggcaagagaagacccagcagacugguggcccugagagagcagaaggcccugaagacccugggcaucaucaugggcguguucacccugugcuggcugcccuucuuccuggccaacguggugaaggccuuccacagagagcuggugcccgacagacuguucguguucuucaacuggcugggcuacgccaacagcgccuucaaccccaucaucuacugcagaagccccgacuucagaaaggccuuccagggccugcugugcugcgccagaagagccgccagaagaagacacgccacccacggcgacagacccagagccagcggcugccuggccagacccggccccccccccagccccggcgccgccagcgacgacgacgacgacgacguggugggcgccaccccccccgccagacugcuggagcccugggccggcugcaacggcggcgccgccgccgacagcgacagcagccuggacgagcccugcagacccggcuucgccagcgagagcaagguguaa

SEQ ID NO: 13364 - RNA, 1242 nt, Artificial Sequence
  ADRB2__Homo_sapiens__NP_000015
augggccagcccggcaacggcagcgccuuccugcuggcccccaacagaagccacgcccccgaccacgacgugacccagcagagagacgagguguggguggugggcaugggcaucgugaugagccugaucgugcuggccaucguguucggcaacgugcuggugaucaccgccaucgccaaguucgagagacugcagaccgugaccaacuacuucaucaccagccuggccugcgccgaccuggugaugggccuggccguggugcccuucggcgccgcccacauccugaugaagauguggaccuucggcaacuucuggugcgaguucuggaccagcaucgacgugcugugcgugaccgccagcaucgagacccugugcgugaucgccguggacagauacuucgccaucaccagccccuucaaguaccagagccugcugaccaagaacaaggccagagugaucauccugaugguguggaucgugagcggccugaccagcuuccugcccauccagaugcacugguacagagccacccaccaggaggccaucaacugcuacgccaacgagaccugcugcgacuucuucaccaaccaggccuacgccaucgccagcagcaucgugagcuucuacgugccccuggugaucaugguguucguguacagcagaguguuccaggaggccaagagacagcugcagaagaucgacaagagcgagggcagauuccacgugcagaaccugagccagguggagcaggacggcagaaccggccacggccugagaagaagcagcaaguucugccugaaggagcacaaggcccugaagacccugggcaucaucaugggcaccuucacccugugcuggcugcccuucuucaucgugaacaucgugcacgugauccaggacaaccugaucagaaaggagguguacauccugcugaacuggaucggcuacgugaacagcggcuucaacccccugaucuacugcagaagccccgacuucagaaucgccuuccaggagcugcugugccugagaagaagcagccugaaggccuacggcaacggcuacagcagcaacggcaacaccggcgagcagagcggcuaccacguggagcaggagaaggagaacaagcugcugugcgaggaccugcccggcaccgaggacuucgugggccaccagggcaccgugcccagcgacaacaucgacagccagggcagaaacugcagcaccaacgacagccugcuguaa

SEQ ID NO: 13365 - RNA, 1227 nt, Artificial Sequence
  ADRB3__Homo_sapiens__NP_000016
auggcccccuggccccacgagaacagcagccuggcccccuggcccgaccugcccacccuggcccccaacaccgccaacaccagcggccugcccggcgugcccugggaggccgcccuggccggcgcccugcuggcccuggccgugcuggccaccgugggcggcaaccugcuggugaucguggccaucgccuggacccccagacugcagaccaugaccaacguguucgugaccagccuggccgccgccgaccuggugaugggccugcugguggugccccccgccgccacccuggcccugaccggccacuggccccugggcgccaccggcugcgagcuguggaccagcguggacgugcugugcgugaccgccagcaucgagacccugugcgcccuggccguggacagauaccuggccgugaccaacccccugagauacggcgcccuggugaccaagagaugcgccagaaccgccguggugcugguguggguggugagcgccgccgugagcuucgcccccaucaugagccagugguggagagugggcgccgacgccgaggcccagagaugccacagcaaccccagaugcugcgccuucgccagcaacaugcccuacgugcugcugagcagcagcgugagcuucuaccugccccugcuggugaugcuguucguguacgccagaguguucgugguggccaccagacagcugagacugcugagaggcgagcugggcagauucccccccgaggagagcccccccgcccccagcagaagccuggcccccgcccccgugggcaccugcgccccccccgagggcgugcccgccugcggcagaagacccgccagacugcugccccugagagagcacagagcccugugcacccugggccugaucaugggcaccuucacccugugcuggcugcccuucuuccuggccaacgugcugagagcccugggcggccccagccuggugcccggccccgccuuccuggcccugaacuggcugggcuacgccaacagcgccuucaacccccugaucuacugcagaagccccgacuucagaagcgccuucagaagacugcugugcagaugcggcagaagacugccccccgagcccugcgccgccgccagacccgcccuguuccccagcggcgugcccgccgccagaagcagccccgcccagcccagacugugccagagacuggacggcgccagcuggggcgugagcuaa

SEQ ID NO: 13366 - RNA, 2070 nt, Artificial Sequence
  ADRBK1__Homo_sapiens__NP_001610
auggccgaccuggaggccgugcuggccgacgugagcuaccugauggccauggagaagagcaaggccacccccgccgccagagccagcaagaagauccugcugcccgagcccagcaucagaagcgugaugcagaaguaccuggaggacagaggcgaggugaccuucgagaagaucuucagccagaagcugggcuaccugcuguucagagacuucugccugaaccaccuggaggaggccagaccccugguggaguucuacgaggagaucaagaaguacgagaagcuggagaccgaggaggagagaguggccagaagcagagagaucuucgacagcuacaucaugaaggagcugcuggccugcagccaccccuucagcaagagcgccaccgagcacgugcagggccaccugggcaagaagcaggugccccccgaccuguuccagcccuacaucgaggagaucugccagaaccugagaggcgacguguuccagaaguucaucgagagcgacaaguucaccagauucugccaguggaagaacguggagcugaacauccaccugaccaugaacgacuucagcgugcacagaaucaucggcagaggcggcuucggcgagguguacggcugcagaaaggccgacaccggcaagauguacgccaugaagugccuggacaagaagagaaucaagaugaagcagggcgagacccuggcccugaacgagagaaucaugcugagccuggugagcaccggcgacugccccuucaucgugugcaugagcuacgccuuccacacccccgacaagcugagcuucauccuggaccugaugaacggcggcgaccugcacuaccaccugagccagcacggcguguucagcgaggccgacaugagauucuacgccgccgagaucauccugggccuggagcacaugcacaacagauucgugguguacagagaccugaagcccgccaacauccugcuggacgagcacggccacgugagaaucagcgaccugggccuggccugcgacuucagcaagaagaagccccacgccagcgugggcacccacggcuacauggcccccgaggugcugcagaagggcguggccuacgacagcagcgccgacugguucagccugggcugcaugcuguucaagcugcugagaggccacagccccuucagacagcacaagaccaaggacaagcacgagaucgacagaaugacccugaccauggccguggagcugcccgacagcuucagccccgagcugagaagccugcuggagggccugcugcagagagacgugaacagaagacugggcugccugggcagaggcgcccaggaggugaaggagagccccuucuucagaagccuggacuggcagaugguguuccugcagaaguacccccccccccugaucccccccagaggcgaggugaacgccgccgacgccuucgacaucggcagcuucgacgaggaggacaccaagggcaucaagcugcuggacagcgaccaggagcuguacagaaacuucccccugaccaucagcgagagauggcagcaggagguggccgagaccguguucgacaccaucaacgccgagaccgacagacuggaggccagaaagaaggccaagaacaagcagcugggccacgaggaggacuacgcccugggcaaggacugcaucaugcacggcuacaugagcaagaugggcaaccccuuccugacccaguggcagagaagauacuucuaccuguuccccaacagacuggaguggagaggcgagggcgaggccccccagagccugcugaccauggaggagauccagagcguggaggagacccagaucaaggagagaaagugccugcugcugaagaucagaggcggcaagcaguucauccugcagugcgacagcgaccccgagcuggugcaguggaagaaggagcugagagacgccuacagagaggcccagcagcuggugcagagagugcccaagaugaagaacaagcccagaagccccgugguggagcugagcaaggugccccuggugcagagaggcagcgccaacggccuguaa

SEQ ID NO: 13367 - RNA, 2067 nt, Artificial Sequence
  ADRBK2__Homo_sapiens__NP_005151
auggccgaccuggaggccgugcuggccgacgugagcuaccugauggccauggagaagagcaaggccacccccgccgccagagccagcaagagaaucgugcugcccgagcccagcaucagaagcgugaugcagaaguaccuggccgagagaaacgagaucaccuucgacaagaucuucaaccagaagaucggcuuccugcuguucaaggacuucugccugaacgagaucaacgaggccgugccccaggugaaguucuacgaggagaucaaggaguacgagaagcuggacaacgaggaggacagacugugcagaagcagacagaucuacgacgccuacaucaugaaggagcugcugagcugcagccaccccuucagcaagcaggccguggagcacgugcagagccaccugagcaagaagcaggugaccagcacccuguuccagcccuacaucgaggagaucugcgagagccugagaggcgacaucuuccagaaguucauggagagcgacaaguucaccagauucugccaguggaagaacguggagcugaacauccaccugaccaugaacgaguucagcgugcacagaaucaucggcagaggcggcuucggcgagguguacggcugcagaaaggccgacaccggcaagauguacgccaugaagugccuggacaagaagagaaucaagaugaagcagggcgagacccuggcccugaacgagagaaucaugcugagccuggugagcaccggcgacugccccuucaucgugugcaugaccuacgccuuccacacccccgacaagcugugcuucauccuggaccugaugaacggcggcgaccugcacuaccaccugagccagcacggcguguucagcgagaaggagaugagauucuacgccaccgagaucauccugggccuggagcacaugcacaacagauucgugguguacagagaccugaagcccgccaacauccugcuggacgagcacggccacgccagaaucagcgaccugggccuggccugcgacuucagcaagaagaagccccacgccagcgugggcacccacggcuacauggcccccgaggugcugcagaagggcaccgccuacgacagcagcgccgacugguucagccugggcugcaugcuguucaagcugcugagaggccacagccccuucagacagcacaagaccaaggacaagcacgagaucgacagaaugacccugaccgugaacguggagcugcccgacaccuucagccccgagcugaagagccugcuggagggccugcugcagagagacgugagcaagagacugggcugccacggcggcggcagccaggaggugaaggagcacagcuucuucaagggcguggacuggcagcacguguaccugcagaaguacccccccccccugaucccccccagaggcgaggugaacgccgccgacgccuucgacaucggcagcuucgacgaggaggacaccaagggcaucaagcugcuggacugcgaccaggagcuguacaagaacuucccccuggugaucagcgagagauggcagcaggaggugaccgagaccguguacgaggccgugaacgccgacaccgacaagaucgaggccagaaagagagccaagaacaagcagcugggccacgaggaggacuacgcccugggcaaggacugcaucaugcacggcuacaugcugaagcugggcaaccccuuccugacccaguggcagagaagauacuucuaccuguuccccaacagacuggaguggagaggcgagggcgagagcagacagaaccugcugaccauggagcagauccugagcguggaggagacccagaucaaggacaagaagugcauccuguucagaaucaagggcggcaagcaguucgugcugcagugcgagagcgaccccgaguucgugcaguggaagaaggagcugaacgagaccuucaaggaggcccagagacugcugagaagagcccccaaguuccugaacaagcccagaagcggcaccguggagcugcccaagcccagccugugccacagaaacagcaacggccuguaa

SEQ ID NO: 13368 - RNA, 1224 nt, Artificial Sequence
  ADRM1__Homo_sapiens__XP_011526804
augaccaccagcggcgcccuguuccccagccuggugcccggcagcagaggcgccagcaacaaguaccugguggaguucagagccggcaagaugagccugaagggcaccaccgugacccccgacaagagaaagggccugguguacauccagcagaccgacgacagccugauccacuucugcuggaaggacagaaccagcggcaacguggaggacgaccugaucaucuuccccgacgacugcgaguucaagagagugccccagugccccagcggcagaguguacgugcugaaguucaaggccggcagcaagagacuguucuucuggaugcaggagcccaagaccgaccaggacgaggagcacugcagaaaggugaacgaguaccugaacaacccccccaugcccggcgcccugggcgccagcggcagcagcggccacgagcugagcgcccugggcggcgagggcggccugcagagccugcugggcaacaugagccacagccagcugaugcagcugaucggccccgccggccugggcggccugggcggccugggcgcccugaccggccccggccuggccagccugcugggcagcagcggcccccccggcagcagcagcagcagcagcagcagaagccagagcgccgccgugacccccagcagcaccaccagcagcaccagagccacccccgcccccagcgcccccgccgccgccagcgccaccagccccagccccgcccccagcagcggcaacggcgccagcaccgccgccagccccacccagcccauccagcugagcgaccugcagagcauccuggccaccaugaacgugcccgccggccccgccggcggccagcagguggaccuggccagcgugcugacccccgagaucauggcccccauccuggccaacgccgacgugcaggagagacugcugcccuaccugcccagcggcgagagccugccccagaccgccgacgagauccagaacacccugaccagcccccaguuccagcaggcccugggcauguucagcgccgcccuggccagcggccagcugggcccccugaugugccaguucggccugcccgccgaggccguggaggccgccaacaagggcgacguggaggccuucgccaaggccaugcagaacaacgccaagcccgagcagaaggagggcgacaccaaggacaagaaggacgaggaggaggacaugagccuggacuaa

SEQ ID NO: 13369 - RNA, 1455 nt, Artificial Sequence
  ADSL__Homo_sapiens__NP_000017
auggccgccggcggcgaccacggcagccccgacagcuacagaagcccccuggccagcagauacgccagccccgagaugugcuucguguucagcgacagauacaaguucagaaccuggagacagcuguggcuguggcuggccgaggccgagcagacccugggccugcccaucaccgacgagcagauccaggagaugaagagcaaccuggagaacaucgacuucaagauggccgccgaggaggagaagagacugagacacgacgugauggcccacgugcacaccuucggccacugcugccccaaggccgccggcaucauccaccugggcgccaccagcugcuacgugggcgacaacaccgaccugaucauccugagaaacgcccuggaccugcugcugcccaagcuggccagagugaucagcagacuggccgacuucgccaaggagagagccagccugcccacccugggcuucacccacuuccagcccgcccagcugaccaccgugggcaagagaugcugccuguggauccaggaccugugcauggaccugcagaaccugaagagagugagagacgaccugagauucagaggcgugaagggcaccaccggcacccaggccagcuuccugcagcuguucgagggcgacgaccacaagguggagcagcuggacaagauggugaccgagaaggccggcuucaagagagccuucaucaucaccggccagaccuacaccagaaagguggacaucgaggugcugagcgugcuggccagccugggcgccagcgugcacaagaucugcaccgacaucagacugcuggccaaccugaaggagauggaggagcccuucgagaagcagcagaucggcagcagcgccaugcccuacaagagaaaccccaugagaagcgagagaugcugcagccuggccagacaccugaugacccuggugauggacccccugcagaccgccagcgugcagugguucgagagaacccuggacgacagcgccaacagaagaaucugccuggccgaggccuuccugaccgccgacaccauccugaacacccugcagaacaucagcgagggccuggugguguaccccaaggugaucgagagaagaaucagacaggagcugcccuucauggccaccgagaacaucaucauggccauggugaaggccggcggcagcagacaggacugccacgagaagaucagagugcugagccagcaggccgccagcguggugaagcaggagggcggcgacaacgaccugaucgagagaauccagguggacgccuacuucagccccauccacagccagcuggaccaccugcuggaccccagcagcuucaccggcagagccagccagcaggugcagagauuccuggaggaggagguguacccccugcugaagcccuacgagagcgugaugaaggugaaggccgagcugugccuguaa

SEQ ID NO: 13370 - RNA, 1371 nt, Artificial Sequence
  ADSS__Homo_sapiens__NP_001117
auggccuucgccgagaccuaccccgccgccagcagccugcccaacggcgacugcggcagacccagagccagacccggcggcaacagagugaccguggugcugggcgcccaguggggcgacgagggcaagggcaaggugguggaccugcuggcccaggacgccgacaucgugugcagaugccagggcggcaacaacgccggccacaccguggugguggacagcguggaguacgacuuccaccugcugcccagcggcaucaucaaccccaacgugaccgccuucaucggcaacggcguggugauccaccugcccggccuguucgaggaggccgagaagaacgugcagaagggcaagggccuggagggcugggagaagagacugaucaucagcgacagagcccacaucguguucgacuuccaccaggccgccgacggcauccaggagcagcagagacaggagcaggccggcaagaaccugggcaccaccaagaagggcaucggccccguguacagcagcaaggccgccagaagcggccugagaaugugcgaccuggugagcgacuucgacggcuucagcgagagauucaaggugcuggccaaccaguacaagagcaucuaccccacccuggagaucgacaucgagggcgagcugcagaagcugaagggcuacauggagaagaucaagcccauggugagagacggcguguacuuccuguacgaggcccugcacggcccccccaagaagauccugguggagggcgccaacgccgcccugcuggacaucgacuucggcaccuaccccuucgugaccagcagcaacugcaccgugggcggcgugugcaccggccugggcaugcccccccagaacgugggcgagguguacggcguggugaaggccuacaccaccagagugggcaucggcgccuuccccaccgagcaggacaacgagaucggcgagcugcugcagaccagaggcagagaguucggcgugaccaccggcagaaagagaagaugcggcuggcuggaccuggugcugcugaaguacgcccacaugaucaacggcuucaccgcccuggcccugaccaagcuggacauccuggacauguucaccgagaucaaggugggcguggccuacaagcuggacggcgagaucaucccccacauccccgccaaccaggaggugcugaacaagguggaggugcaguacaagacccugcccggcuggaacaccgacaucagcaacgccagagccuucaaggagcugcccgugaacgcccagaacuacgugagauucaucgaggacgagcugcagauccccgugaaguggaucggcgugggcaagagcagagagagcaugauccagcuguucuaa

SEQ ID NO: 13371 - RNA, 1374 nt, Artificial Sequence
  ADSSL1__Homo_sapiens__NP_689541
augagcggcaccagagccagcaacgacagaccccccggcgccggcggcgugaagagaggcagacugcagcaggaggccgccgccaccggcagcagagugaccguggugcugggcgcccaguggggcgacgagggcaagggcaaggugguggaccugcuggccaccgacgccgacaucaucagcagaugccagggcggcaacaacgccggccacaccguggugguggacggcaaggaguacgacuuccaccugcugcccagcggcaucaucaacaccaaggccgugagcuucaucggcaacggcguggugauccaccugcccggccuguucgaggaggccgagaagaacgagaagaagggccugaaggacugggagaagagacugaucaucagcgacagagcccaccugguguucgacuuccaccaggccguggacggccugcaggaggugcagagacaggcccaggagggcaagaacaucggcaccaccaagaagggcaucggccccaccuacagcagcaaggccgccagaaccggccugagaaucugcgaccugcugagcgacuucgacgaguucagcagcagauucaagaaccuggcccaccagcaccagagcauguuccccacccuggagaucgacaucgagggccagcugaagagacugaagggcuucgccgagagaaucagacccauggugagagacggcguguacuucauguacgaggcccugcacggcccccccaagaagauccugguggagggcgccaacgccgcccugcuggacaucgacuucggcaccuaccccuucgugaccagcagcaacugcaccgugggcggcgugugcaccggccugggcauccccccccagaacaucggcgacguguacggcguggugaaggccuacaccaccagagugggcaucggcgccuuccccaccgagcagaucaacgagaucggcggccugcugcagaccagaggccacgaguggggcgugaccaccggcagaaagagaagaugcggcuggcuggaccugaugauccugagauacgcccacauggugaacggcuucaccgcccuggcccugaccaagcuggacauccuggacgugcugggcgaggugaaggugggcgugagcuacaagcugaacggcaagagaauccccuacuuccccgccaaccaggagaugcugcagaagguggagguggaguacgagacccugcccggcuggaaggccgacaccaccggcgccagaagaugggaggaccugcccccccaggcccagaacuacaucagauucguggagaaccacgugggcguggccgugaagugggugggcgugggcaagagcagagagagcaugauccagcuguucuaa

SEQ ID NO: 13372 - RNA, 747 nt, Artificial Sequence
  ADTRP__Homo_sapiens__NP_001137420
augaccaagaccagcaccugcaucuaccacuuccuggugcugagcugguacaccuuccugaacuacuacaucagccaggagggcaaggacgaggugaagcccaagauccuggccaacggcgccagauggaaguacaugacccugcugaaccugcugaagaacagaaccgccggcuucgacaucuaccagcccggcagcuucagacagcugcugcagaccaucuucuacggcgugaccugccuggacgacgugcugaagagaaccaagggcggcaaggacaucaaguuccugaccgccuucagagaccugcuguucaccacccuggccuuccccgugagcaccuucguguuccuggccuucuggauccuguuccuguacaacagagaccugaucuaccccaaggugcuggacaccgugauccccguguggcugaaccacgccaugcacaccuucaucuuccccaucacccuggccgagguggugcugagaccccacagcuaccccagcaagaagaccggccugacccugcuggccgccgccagcaucgccuacaucagcagaauccuguggcuguacuucgagaccggcaccuggguguaccccguguucgccaagcugagccugcugggccuggccgccuucuucagccugagcuacguguucaucgccagcaucuaccugcugggcgagaagcugaaccacuggaaguggggcgacaugagacagcccagaaagaagagaaaguaa

SEQ ID NO: 13373 - RNA, 1554 nt, Artificial Sequence
  AEBP2__Homo_sapiens__NP_001107648
auggccgccgccaucaccgacauggccgaccuggaggagcugagcagacugagcccccugccccccggcagccccggcagcgccgccagaggcagagccgagccccccgaggaggaggaggaggaggaggaggaggaggaggaggccgaggccgaggccguggccgcccugcugcugaacggcggcagcggcggcggcggcggcggcggcggcggcggcgugggcggcggcgaggccgagaccaugagcgagcccagccccgagagcgccagccaggccggcgaggacgaggacgaggaggaggacgacgaggaggaggaggacgagagcagcagcagcggcggcggcgaggaggagagcagcgccgagagccuggugggcagcagcggcggcagcagcagcgacgagaccagaagccugagccccggcgccgccagcagcagcagcggcgacggcgacggcaaggagggccuggaggagcccaagggccccagaggcagccagggcggcggcggcggcggcagcagcagcagcagcguggugagcagcggcggcgacgagggcuacggcaccggcggcggcggcagcagcgccaccagcggcggcagaagaggcagccuggagaugagcagcgacggcgagccccugagcagaauggacagcgaggacagcaucagcagcaccaucauggacguggacagcaccaucagcagcggcagaagcacccccgccaugaugaacggccagggcagcaccaccagcagcagcaagaacaucgccuacaacugcugcugggaccagugccaggccugcuucaacagcagccccgaccuggccgaccacaucagaagcauccacguggacggccagagaggcggcguguucgugugccuguggaagggcugcaagguguacaacacccccagcaccagccagagcuggcugcagagacacaugcugacccacagcggcgacaagcccuucaagugcguggugggcggcugcaacgccagcuucgccagccagggcggccuggccagacacgugcccacccacuucagccagcagaacagcagcaaggugagcagccagcccaaggccaaggaggagagccccagcaaggccggcaugaacaagagaagaaagcugaagaacaagagaagaagaagccugcccagaccccacgacuucuucgacgcccagacccuggacgccaucagacacagagccaucugcuucaaccugagcgcccacaucgagagccugggcaagggccacagcgugguguuccacagcaccgugaucgccaagagaaaggaggacagcggcaagaucaagcugcugcugcacuggaugcccgaggacauccugcccgacgugugggugaacgagagcgagagacaccagcugaagaccaagguggugcaccugagcaagcugcccaaggacaccgcccugcugcuggaccccaacaucuacagaaccaugccccagaagagacugaagagaacccugaucagaaagguguucaaccuguaccugagcaagcaguaa

SEQ ID NO: 13374 - RNA, 978 nt, Artificial Sequence
  AEN__Homo_sapiens__NP_073604
auggugcccagagaggcccccgagagcgcccagugccugugccccagccugaccauccccaacgccaaggacgugcugagaaagagacacaagagaagaagcagacagcaccagagauucauggccagaaaggcccugcugcaggagcagggccugcugagcaugccccccgagcccggcagcagcccccugcccacccccuucggcgccgccaccgccaccgaggccgccagcagcggcaagcagugccugagagccggcagcggcagcgcccccugcagcagaagacccgcccccggcaaggccagcggcccccugcccagcaagugcguggccaucgacugcgagauggugggcaccggccccagaggcagagugagcgagcuggccagaugcagcaucgugagcuaccacggcaacgugcuguacgacaaguacaucagacccgagaugcccaucgccgacuacagaaccagauggagcggcaucaccagacagcacaugagaaaggccgugcccuuccagguggcccagaaggagauccugaagcugcugaagggcaaggugguggugggccacgcccugcacaacgacuuccaggcccugaaguacgugcaccccagaagccagaccagagacaccaccuacgugcccaacuuccugagcgagcccggccugcacaccagagccagagugagccugaaggaccuggcccugcagcugcugcacaagaagauccaggugggccagcacggccacagcagcguggaggacgccaccaccgccauggagcuguacagacugguggaggugcagugggagcagcaggaggccagaagccuguggaccugccccgaggacagagagcccgacagcagcaccgacauggagcaguacauggaggaccaguacuggcccgacgaccuggcccacggcagcagaggcggcgccagagaggcccaggacagaagaaacuaa

SEQ ID NO: 13375 - RNA, 795 nt, Artificial Sequence
  AES__Homo_sapiens__NP_945320
augugccacaagaacggcuucccccaggagggcggcaucaccgccgccuuccugcagaagagaaagcugagacugagcaagaaccacagacccgccagagccaaggugaccgagcacgugagaggcaccagacccggcagagccaccgccggccccgccgccagcaccagagccgccggcagccuguucuucgacagauggggcaacagaggccccgccggcugcagaggcagcagccaccugccccagcagcugaaguucaccaccagcgacagcugcgacagaaucaaggacgaguuccagcugcugcaggcccaguaccacagccugaagcuggagugcgacaagcuggccagcgagaagagcgagaugcagagacacuacgugauguacuacgagaugagcuacggccugaacaucgagaugcacaagcaggccgagaucgugaagagacugaacggcaucugcgcccaggugcugcccuaccugagccaggagcaccagcagcaggugcugggcgccaucgagagagccaagcaggugaccgcccccgagcugaacagcaucaucagacagcagcugcaggcccaccagcugagccagcugcaggcccuggcccugccccugaccccccugcccgugggccugcagccccccagccugcccgccgugagcgccggcaccggccugcugagccugagcgcccugggcagccaggcccaccugagcaaggaggacaagaacggccacgacggcgacacccaccaggaggacgacggcgagaagagcgacuaa

SEQ ID NO: 13376 - RNA, 2445 nt, Artificial Sequence
  AFAP1__Homo_sapiens__NP_001128119
auggaggagcugaucguggagcugagacuguuccuggagcugcuggaccacgaguaccugaccagcaccgugagagagaagaaggccgugaucaccaacauccugcugagaauccagagcagcaagggcuucgacgugaaggaccacgcccagaagcaggagaccgccaacagccugcccgcccccccccagaugccccugcccgagaucccccagcccuggcugccccccgacagcggcccccccccccugcccaccagcagccugcccgagggcuacuacgaggaggccgugccccugagccccggcaaggcccccgaguacaucaccagcaacuacgacagcgacgccaugagcagcagcuacgagagcuacgacgaggaggaggaggacggcaagggcaagaagaccagacaccaguggcccagcgaggaggccagcauggaccuggugaaggacgccaagaucugcgccuuccugcugagaaagaagagauucggccaguggaccaagcugcugugcgugaucaaggacaccaagcugcugugcuacaagagcagcaaggaccagcagccccagauggagcugccccugcagggcugcaacaucaccuacauccccaaggacagcaagaagaagaagcacgagcugaagaucacccagcagggcaccgacccccuggugcuggccgugcagagcaaggagcaggccgagcaguggcugaaggugaucaaggaggccuacagcggcugcagcggccccguggacagcgagugcccccccccccccagcagccccgugcacaaggccgagcuggagaagaagcugagcagcgagagacccagcagcgacggcgagggcgugguggagaacggcaucaccaccugcaacggcaaggagcaggugaagagaaagaagagcagcaagagcgaggccaagggcaccgugagcaaggugaccggcaagaagaucaccaagaucaucagccugggcaagaagaagcccagcaccgacgagcagaccagcagcgccgaggaggacgugcccaccugcggcuaccugaacgugcugagcaacagcagauggagagagagauggugcagagugaaggacaacaagcugaucuuccacaaggacagaaccgaccugaagacccacaucgugagcaucccccugagaggcugcgaggugauccccggccuggacagcaagcacccccugaccuucagacugcugagaaacggccaggagguggccgugcuggaggccagcagcagcgaggacaugggcagauggaucggcauccugcuggccgagaccggcagcagcaccgaccccgaggcccugcacuacgacuacaucgacguggagaugagcgccagcgugauccagaccgccaagcagaccuucugcuucaugaacagaagagugaucagcgccaaccccuaccugggcggcaccagcaacggcuacgcccaccccagcggcaccgcccugcacuacgacgacgugcccugcaucaacggcagcugggagcccgaggacggcuuccccgccagcugcagcagaggccugggcgaggaggugcuguacgacaacgccggccuguacgacaaccugccccccccccacaucuucgccagauacagccccgccgacagaaaggccagcagacugagcgccgacaagcugagcagcaaccacuacaaguaccccgccagcgcccagagcgugaccaacaccagcagcgugggcagagccagccugggccugaacagccagcugaagggcaagaagccccccguggccagcaacggcgugaccggcaagggcaagacccugagcagccagcccaagaaggccgaccccgccgccguggugaagagaaccggcagcaacgccgcccaguacaaguacggcaagaacagaguggaggccgacgccaagagacugcagaccaaggaggaggagcugcugaagagaaaggaggcccugagaaacagacuggcccagcugagaaaggagagaaaggaccugagagccgccaucgaggugaacgccggcagaaagccccaggccauccuggaggagaagcugaagcagcuggaggaggagugcagacagaaggaggccgagagagugagccuggagcuggagcugaccgaggugaaggagagccugaagaaggcccuggccggcggcgugacccugggccuggccaucgagcccaagagcggcaccagcagcccccagagccccguguucagacacagaacccuggagaacagccccaucagcagcugcgacaccagcgacaccgagggccccgugcccgugaacagcgccgccgugcugaagaagagccaggccgcccccggcagcagccccugcagaggccacgugcugagaaaggccaaggagugggagcugaagaacggcaccuaa

SEQ ID NO: 13377 - RNA, 2178 nt, Artificial Sequence
  AFAP1L1__Homo_sapiens__NP_001139809
auggacagaggccaggugcuggagcagcugcugcccgagcugaccggccugcugagccugcuggaccacgaguaccugagcgacaccacccuggagaagaagauggccguggccagcauccugcagagccugcagccccugcccgccaaggaggugagcuaccuguacgugaacaccgccgaccugcacagcggccccagcuucguggagagccuguucgaggaguucgacugcgaccugagcgaccugagagacaugcccgaggacgacggcgagcccagcaagggcgccagccccgagcuggccaagagccccagacugagaaacgccgccgaccugccccccccccugcccaacaagcccccccccgaggacuacuacgaggaggcccugccccugggccccggcaagagccccgaguacaucagcagccacaacggcugcagccccagccacagcaucguggacggcuacuacgaggacgccgacagcagcuaccccgccaccagagugaacggcgagcugaagagcagcuacaacgacagcgacgccaugagcagcagcuacgagagcuacgacgaggaggaggaggagggcaagagcccccagcccagacaccaguggcccagcgaggaggccagcaugcaccuggugagagagugcagaaucugcgccuuccugcugagaaagaagagauucggccagugggccaagcagcugaccgugaucagagaggaccagcugcugugcuacaagagcagcaaggacagacagccccaccugagacuggcccuggacaccugcagcaucaucuacgugcccaaggacagcagacacaagagacacgagcugagauucacccagggcgccaccgaggugcuggugcuggcccugcagagcagagagcaggccgaggaguggcugaaggugaucagagaggugagcaagcccgugggcggcgccgagggcguggaggugcccagaagccccgugcugcugugcaagcuggaccuggacaagagacugagccaggagaagcagaccagcgacagcgacagcgugggcgugggcgacaacugcagcacccugggcagaagagagaccugcgaccacggcaagggcaagaagagcagccuggccgagcugaagggcagcaugagcagagccgccggcagaaagaucaccagaaucaucggcuucagcaagaagaagacccuggccgacgaccugcagaccagcagcaccgaggaggaggugcccugcugcggcuaccugaacgugcuggugaaccagggcuggaaggagagauggugcagacugaagugcaacacccuguacuuccacaaggaccacauggaccugagaacccacgugaacgccaucgcccugcagggcugcgagguggcccccggcuucggccccagacaccccuucgccuucagaauccugagaaacagacaggagguggccauccuggaggccagcugcagcgaggacaugggcagauggcugggccugcugcugguggagaugggcagcagagugacccccgaggcccugcacuacgacuacguggacguggagacccugaccagcaucgugagcgccggcagaaacagcuuccuguacgccagaagcugccagaaccaguggcccgagcccagaguguacgacgacgugcccuacgagaagaugcaggacgaggagcccgagagacccaccggcgcccaggugaagagacacgccagcagcugcagcgagaagagccacagaguggacccccaggugaaggugaagagacacgccagcagcgccaaccaguacaaguacggcaagaacagagccgaggaggacgccagaagauaccugguggagaaggagaagcuggagaaggagaaggagaccaucagaaccgagcugaucgcccugagacaggagaagagagagcugaaggaggccaucagaagcagccccggcgccaagcugaaggcccuggaggaggccguggccacccuggaggcccagugcagagccaaggaggagagaagaaucgaccuggagcugaagcugguggccgugaaggagagacugcagcagagccuggccggcggccccgcccugggccugagcgugagcagcaagcccaagagcggcgagugggagaugaagaagaccuaa

SEQ ID NO: 13378 - RNA, 2457 nt, Artificial Sequence
  AFAP1L2__Homo_sapiens__NP_001001936
auggagagauacaaggcccuggagcagcugcugaccgagcuggacgacuuccugaagauccuggaccaggagaaccugagcagcaccgcccuggugaagaagagcugccuggccgagcugcugagacuguacaccaagagcagcagcagcgacgaggaguacaucuacaugaacaaggugaccaucaacaagcagcagaacgccgagagccagggcaaggcccccgaggagcagggccugcugcccaacggcgagcccagccagcacagcagcgccccccagaagagccugcccgaccugcccccccccaagaugauccccgagagaaagcagcuggccauccccaagaccgagagccccgagggcuacuacgaggaggccgagcccuacgacaccagccugaacgaggacggcgaggccgugagcagcagcuacgagagcuacgacgaggaggacggcagcaagggcaagagcgcccccuaccaguggcccagccccgaggccggcaucgagcugaugagagacgccagaaucugcgccuuccuguggagaaagaaguggcugggccagugggccaagcagcugugcgugaucaaggacaacagacugcugugcuacaagagcagcaaggaccacagcccccagcuggacgugaaccugcugggcagcagcgugauccacaaggagaagcaggugagaaagaaggagcacaagcugaagaucacccccaugaacgccgacgugaucgugcugggccugcagagcaaggaccaggccgagcaguggcugagagugauccaggaggugagcggccugcccagcgagggcgccagcgagggcaaccaguacacccccgacgcccagagauucaacugccagaagcccgacaucgccgagaaguaccugagcgccagcgaguacggcagcagcguggacggccaccccgaggugcccgagaccaaggacgugaagaagaagugcagcgccggccugaagcugagcaaccugaugaaccugggcagaaagaagagcaccagccuggagcccguggagagaagccuggagaccagcagcuaccugaacgugcuggugaacagccaguggaagagcagauggugcagcgugagagacaaccaccugcacuucuaccaggacagaaacagaagcaagguggcccagcagccccugagccuggugggcugcgagguggugcccgaccccagccccgaccaccuguacagcuucagaauccugcacaagggcgaggagcuggccaagcuggaggccaagagcagcgaggagaugggccacuggcugggccugcugcugagcgagagcggcagcaagaccgaccccgaggaguucaccuacgacuacguggacgccgacagagugagcugcaucgugagcgccgccaagaacagccugcugcugaugcagagaaaguucagcgagcccaacaccuacaucgacggccugcccagccaggacagacaggaggagcuguacgacgacguggaccugagcgagcugaccgccgccguggagcccaccgaggaggccacccccguggccgacgaccccaacgagagagagagcgacagaguguaccuggaccugacccccgugaagagcuuccugcacggccccagcagcgcccaggcccaggccagcagccccacccugagcugccuggacaacgccaccgaggcccugcccgccgacagcggccccggccccacccccgacgagcccugcaucaagugccccgagaaccugggcgagcagcagcuggagagccuggagcccgaggaccccagccugagaaucaccaccgugaagauccagaccgagcagcagagaaucagcuucccccccagcugccccgacgccgugguggccaccccccccggcgccagcccccccgugaaggacagacugagagugaccagcgccgagaucaagcugggcaagaacagaaccgaggccgaggugaagagauacaccgaggagaaggagagacuggagaagaagaaggaggagaucagaggccaccuggcccagcugagaaaggagaagagagagcugaaggagacccugcugaagugcaccgacaaggaggugcuggccagccuggagcagaagcugaaggagaucgacgaggagugcagaggcgaggagagcagaagaguggaccuggagcugagcaucauggaggugaaggacaaccugaagaaggccgaggccggccccgugacccugggcaccaccguggacaccacccaccuggagaacgugagccccagacccaaggccgugacccccgccagcgcccccgacugcacccccgugaacagcgccaccacccugaagaacagaccccugagcgugguggugaccggcaagggcaccgugcugcagaaggccaaggagugggagaagaagggcgccagcuaa

SEQ ID NO: 13379 - RNA, 3657 nt, Artificial Sequence
  AFF1__Homo_sapiens__NP_001160165
auggccuucaccgagagagugaacagcagcggcaacagccuguacaacgacgacagaaaccugcugagaaucagagagaaggagagaagaaaccaggaggcccaccaggagaaggaggccuuccccgagaagaucccccuguucggcgagcccuacaagaccgccaagggcgacgagcugagcagcagaauccagaacaugcugggcaacuacgaggaggugaaggaguuccugagcaccaagagccacacccacagacuggacgccagcgagaacagacugggcaagcccaaguacccccugauccccgacaagggcagcagcauccccagcagcagcuuccacaccagcgugcaccaccagagcauccacacccccgccagcggcccccugagcgugggcaacaucagccacaaccccaagauggcccagcccagaaccgagcccaugcccagccugcacgccaagagcugcggcccccccgacagccagcaccugacccaggacagacugggccaggagggcuucggcagcagccaccacaagaagggcgacagaagagccgacggcgaccacugcgccagcgugaccgacagcgcccccgagagagagcugagcccccugaucagccugcccagccccgugcccccccugagccccauccacagcaaccagcagacccugcccagaacccagggcagcagcaaggugcacggcagcagcaacaacagcaagggcuacugccccgccaagagccccaaggaccuggccgugaaggugcacgacaaggagaccccccaggacagccugguggcccccgcccagccccccagccagaccuuccccccccccagccugcccagcaagagcguggccaugcagcagaagcccaccgccuacgugagacccauggacggccaggaccaggcccccagcgagagccccgagcugaagccccugcccgaggacuacagacagcagaccuucgagaagaccgaccugaaggugcccgccaaggccaagcugaccaagcugaagaugcccagccagagcguggagcagaccuacagcaacgaggugcacugcguggaggagauccugaaggagaugacccacagcuggccccccccccugaccgccauccacacccccagcaccgccgagcccagcaaguuccccuuccccaccaaggacagccagcacgugagcagcgugacccagaaccagaagcaguacgacaccagcagcaagacccacagcaacagccagcagggcaccagcagcaugcuggaggacgaccugcagcugagcgacagcgaggacagcgacagcgagcagacccccgagaagccccccagcagcagcgccccccccagcgccccccagagccugcccgagcccguggccagcgcccacagcagcagcgccgagagcgagagcaccagcgacagcgacagcagcagcgacagcgagagcgagagcagcagcagcgacagcgaggagaacgagccccuggagacccccgcccccgagcccgagccccccaccaccaacaaguggcagcuggacaacuggcugaccaaggugagccagcccgccgccccccccgagggccccagaagcaccgagccccccagaagacaccccgagagcaagggcagcagcgacagcgccaccagccaggagcacagcgagagcaaggaccccccccccaagagcagcagcaaggcccccagagccccccccgaggccccccaccccggcaagagaagcugccagaagagccccgcccagcaggagcccccccagagacagaccgugggcaccaagcagcccaagaagcccgugaaggccagcgccagagccggcagcagaaccagccugcagggcgagagagagcccggccugcugcccuacggcagcagagaccagaccagcaaggacaagcccaaggugaagaccaagggcagacccagagccgccgccagcaacgagcccaagcccgccgugccccccagcagcgagaagaagaagcacaagagcagccugcccgcccccagcaaggcccugagcggccccgagcccgccaaggacaacguggaggacagaacccccgagcacuucgcccuggugccccugaccgagagccagggccccccccacagcggcagcggcagcagaaccagcggcugcagacaggccgugguggugcaggaggacagcagaaaggacagacugccccugccccugagagacaccaagcugcugagcccccugagagacaccccccccccccagagccugauggugaagaucacccuggaccugcugagcagaaucccccagccccccggcaagggcagcagacagagaaaggccgaggacaagcagccccccgccggcaagaagcacagcagcgagaagagaagcagcgacagcagcagcaagcuggccaagaagagaaagggcgaggccgagagagacugcgacaacaagaagaucagacuggagaaggagaucaagagccagagcagcagcagcagcagcagccacaaggagagcagcaagaccaagcccagcagacccagcagccagagcagcaagaaggagaugcugccccccccccccgugagcagcagcagccagaagcccgccaagcccgcccugaagagaagcagaagagaggccgacaccugcggccaggacccccccaagagcgccagcagcaccaagagcaaccacaaggacagcagcauccccaagcagagaagaguggagggcaagggcagcagaagcagcagcgagcacaagggcagcagcggcgacaccgccaaccccuuccccgugcccagccugcccaacggcaacagcaagcccggcaagccccaggugaaguucgacaagcagcaggccgaccugcacaugagagaggccaagaagaugaagcagaaggccgagcugaugaccgacagagugggcaaggccuucaaguaccuggaggccgugcugagcuucaucgagugcggcaucgccaccgagagcgagagccagagcagcaagagcgccuacagcguguacagcgagaccguggaccugaucaaguucaucaugagccugaagagcuucagcgacgccaccgcccccacccaggagaagaucuucgccgugcugugcaugagaugccagagcauccugaacauggccauguucagaugcaagaaggacaucgccaucaaguacagcagaacccugaacaagcacuucgagagcagcagcaagguggcccaggcccccagccccugcaucgccagaagcaccggcacccccagcccccugagccccaugcccagccccgccagcagcgugggcagccagagcagcgccggcagcgugggcagcagcggcguggccgccaccaucagcacccccgugaccauccagaacaugaccagcagcuacgugaccaucaccagccacgugcugaccgccuucgaccugugggagcaggccgaggcccugaccagaaagaacaaggaguucuucgccagacugagcaccaacgugugcacccuggcccugaacagcagccugguggaccuggugcacuacaccagacagggcuuccagcagcugcaggagcugaccaagacccccuaa

SEQ ID NO: 13380 - RNA, 3831 nt, Artificial Sequence
  AFF2__Homo_sapiens__NP_001162593
auggaccuguucgacuucuucagagacugggaccuggagcagcagugccacuacgagcaggacagaagcgcccugaagaagagagagugggagagaagaaaccaggaggugcagcaggaggacgaccuguucagcagcggcuucgaccuguucggcgagcccuacaagaccaacaagggcgacgcccuggccaacagagugcagaacacccugggcaacuacgacgagaugaagaaccugcugaccaaccacagcaaccagaaccaccuggugggcauccccaagaacagcgugccccagaaccccaacaacaagaacgagcccagcuucuuccccgagcagaagaacagaaucauccccccccaccaggacaacacccaccccagcgcccccaugcccccccccagcguggugauccugaacagcacccugauccacagcaacagaaagagcaagcccgaguggagcagagacagccacaaccccagcaccgugcuggccagccaggccagcggccagcccaacaagaugcagacccugacccaggaccagagccaggccaagcuggaggacuucuucguguaccccgccgagcagccccagaucggcgagguggaggagagcaaccccagcgccaaggaggacagcaaccccaacagcagcggcgaggacgccuucaaggagaucuuccagagcaacagccccgaggagagcgaguucgccgugcaggcccccggcagcccccugguggccagcagccugcuggcccccagcagcggccugagcgugcagaacuucccccccggccuguacugcaagaccagcaugggccagcagaagcccaccgccuacgugagacccauggacggccaggaccaggcccccgacaucagccccacccugaagcccagcaucgaguucgagaacagcuucggcaaccugagcuucggcacccugcuggacggcaagcccagcgccgccagcagcaagaccaagcugcccaaguucaccauccugcagaccagcgaggugagccugcccagcgaccccagcugcguggaggagauccugagagagagccagcaccugacccccggcuucacccugcagaaguggaacgaccccaccaccagagccagcaccaagagcgugagcuucaagagcaugcuggaggacgaccugaagcugagcagcgacgaggacgaccuggagcccgugaagacccugaccacccagugcaccgccaccgagcuguaccaggccguggagaaggccaagcccagaaacaaccccgugaaccccccccuggccaccccccagcccccccccgccgugcaggccagcggcggcagcggcagcagcagcgagagcgagagcagcagcgagagcgacagcgacaccgagagcagcaccaccgacagcgagagcaacgaggcccccagaguggccacccccgagcccgagccccccagcaccaacaaguggcagcuggacaaguggcugaacaaggugaccagccagaacaagagcuucaucugcggccagaacgagacccccauggagaccaucagccugcccccccccaucauccagcccauggaggugcagaugaaggugaagaccaacgccagccaggugcccgccgagcccaaggagagaccccugcugagccugaucagagagaaggccagacccagacccacccagaagauccccgagaccaaggcccugaagcacaagcugagcaccaccagcgagaccgugagccagagaaccaucggcaagaagcagcccaagaagguggagaagaacaccagcaccgacgaguucaccuggcccaagcccaacaucaccagcagcacccccaaggagaaggagagcguggagcugcacgacccccccagaggcagaaacaaggccaccgcccacaagcccgcccccagaaaggagcccagacccaacaucccccuggcccccgagaagaagaaguacagaggccccggcaagaucgugcccaagagcagagaguucaucgagaccgacagcagcaccagcgacagcaacaccgaccaggaggagacccugcagaucaaggugcugccccccugcaucaucagcggcggcaacaccgccaagagcaaggagaucugcggcgccagccugacccugagcacccugaugagcagcagcggcagcaacaacaaccugagcaucagcaacgaggagcccaccuucagccccauccccgugaugcagaccgagauccugagcccccugagagaccacgagaaccugaagaaccugugggugaagaucgaccuggaccugcugagcagagugcccggccacagcagccugcacgccgcccccgccaagcccgaccacaaggagaccgccaccaagcccaagagacagaccgccgugaccgccguggagaagcccgcccccaagggcaagagaaagcacaagcccaucgagguggccgagaagauccccgagaagaagcagagacuggaggaggccaccaccaucugccugcugccccccugcaucagccccgcccccccccacaagccccccaacaccagagagaacaacagcagcagaagagccaacagaagaaaggaggagaagcuguucccccccccccugagcccccugcccgaggacccccccagaagaagaaacgugagcggcaacaacggccccuucggccaggacaagaacaucgccaugaccggccagaucaccagcaccaagcccaagagaaccgagggcaaguucugcgccaccuucaagggcaucagcgagggcgacacccccaagaaggccagcagcgccaccaucaccgugaccaacaccgccaucgccaccgccaccgugaccgccaccgccaucgugaccaccaccgugaccgccaccgccaccgccaccgccaccaccaccaccaccaccaccaccaucagcaccaucaccagcaccaucaccaccggccugauggacagcagccaccuggagaugaccagcugggccgcccugccccugcugagcagcagcagcaccaacgugagaagacccaagcugaccuucgacgacagcgugcacaacgccgacuacuacaugcaggaggccaagaagcugaagcacaaggccgacgcccuguucgagaaguucggcaaggccgugaacuacgccgacgccgcccugagcuucaccgagugcggcaacgccauggagagagacccccuggaggccaagagccccuacaccauguacagcgagaccguggagcugcugagauacgccaugagacugaagaacuucgccagcccccuggccagcgacggcgacaagaagcuggccgugcugugcuacagaugccugagccugcuguaccugagaauguucaagcugaagaaggaccacgccaugaaguacagcagaagccugauggaguacuucaagcagaacgccagcaagguggcccagauccccagccccugggugagcaacggcaagaacacccccagccccgugagccugaacaacgugagccccaucaacgccaugggcaacugcaacaacggccccgugaccaucccccagagaauccaccacauggccgccagccacgugaacaucaccagcaacgugcugagaggcuacgagcacugggacauggccgacaagcugaccagagagaacaaggaguucuucggcgaccuggacacccugaugggcccccugacccagcacagcagcaugaccaaccuggugagauacgugagacagggccugugcuggcugagaaucgacgcccaccugcuguaa

SEQ ID NO: 13381 - RNA, 3756 nt, Artificial Sequence
  AFF3__Homo_sapiens__NP_001020279
auggacagcuucgaccuggcccugcugcaggagugggaccuggagagccuguggggcgaggacauccugaaccagagaaacgacagccuggugguggaguuccagagcagcgccagcagaugcagaagcguguacgagcccgacagaaacgcccugagaagaaaggagagagagagaagaaaccaggagacccagcaggacgacggcaccuucaacagcagcuacagccuguucagcgagcccuacaagaccaacaagggcgacgagcugagcaacagaauccagaacacccugggcaacuacgacgagaugaaggacuuccugaccgacagaagcaaccagagccaccuggugggcgugcccaagcccggcgugccccagacccccgugaacaagaucgacgagcacuucguggccgacagcagagcccagaaccagcccagcagcaucugcagcaccaccaccagcacccccgccgccgugcccgugcagcagagcaagagaggcaccaugggcuggcagaaggccggccacccccccagcgacggccagcagagagccacccagcagggcagccugagaacccugcugggcgacggcgugggcagacagcagcccagagccaagcaggugugcaacguggaggugggccugcagacccaggagagaccccccgccauggccgccaagcacagcagcagcggccacugcgugcagaacuucccccccagccuggccagcaagcccagccuggugcagcagaagcccaccgccuacgugagacccauggacggccaggaccaggcccccgacgagagccccaagcugaagagcagcagcgagaccagcgugcacugcaccagcuacagaggcgugcccgccagcaagcccgagcccgccagagccaaggccaagcugagcaaguucagcauccccaagcagggcgaggagagcagaagcggcgagaccaacagcugcguggaggagaucaucagagagaugaccuggcugcccccccugagcgccauccaggcccccggcaagguggagcccaccaaguuccccuuccccaacaaggacagccagcuggugagcagcggccacaacaaccccaagaagggcgacgccgagcccgagagccccgacaacggcaccagcaacaccagcaugcuggaggacgaccugaagcugagcagcgacgaggaggagaacgagcagcaggccgcccagagaaccgcccugagagcccugagcgacagcgccguggugcagcagcccaacugcagaaccagcgugcccagcagcaagggcagcagcagcagcagcagcagcggcagcagcagcagcagcagcgacagcgagagcagcagcggcagcgacagcgagaccgagagcagcagcagcgagagcgagggcagcaagcccccccacuucagcagccccgaggccgagcccgccagcagcaacaaguggcagcuggacaaguggcugaacaaggugaacccccacaagccccccauccugauccagaacgagagccacggcagcgagagcaaccaguacuacaaccccgugaaggaggacgugcaggacugcggcaaggugcccgacgugugccagcccagccugagagagaaggagaucaagagcaccugcaaggaggagcagagacccagaaccgccaacaaggcccccggcagcaagggcgugaagcagaagagcccccccgccgccguggccguggccgugagcgccgccgcccccccccccgccgugcccugcgcccccgccgagaacgcccccgcccccgccagaagaagcgccggcaagaagcccaccagaagaaccgagagaaccagcgccggcgacggcgccaacugccacagacccgaggagcccgccgccgccgacgcccugggcaccagcgugguggugccccccgagcccaccaagaccagacccugcggcaacaacagagccagccacagaaaggagcugagaagcagcgugaccugcgagaagagaagaaccagaggccugagcagaaucgugcccaagagcaaggaguucaucgagaccgagagcagcagcagcagcagcagcagcgacagcgaccuggagagcgagcaggaggaguacccccugagcaaggcccagaccguggccgccagcgccagcagcggcaacgaccagagacugaaggaggccgccgccaacggcggcagcggccccagagcccccgugggcagcaucaacgccagaaccaccagcgacaucgccaaggagcuggaggagcaguucuacacccuggugcccuucggcagaaacgagcugcugagcccccugaaggacagcgacgagaucagaagccugugggugaagaucgaccugacccugcugagcagaauccccgagcaccugccccaggagcccggcgugcugagcgcccccgccaccaaggacagcgagagcgccccccccagccacaccagcgacacccccgccgagaaggcccugcccaagagcaagagaaagagaaagugcgacaacgaggacgacuacagagagaucaagaagagccagggcgagaaggacagcagcagcagacuggccaccagcaccagcaacacccugagcgccaaccacugcaacaugaacaucaacagcguggccauccccaucaacaagaacgagaagaugcugagaagccccaucagcccccugagcgacgccagcaagcacaaguacaccagcgaggaccugaccagcagcagcagacccaacggcaacagccuguucaccagcgccagcagcagcaagaagcccaaggccgacagccagcugcagccccacggcggcgaccugaccaaggccgcccacaacaacagcgagaacaucccccugcacaagagcagaccccagaccaagcccuggagccccggcagcaacggccacagagacugcaagagacagaagcugguguucgacgacaugcccagaagcgccgacuacuucaugcaggaggccaagagaaugaagcacaaggccgacgccaugguggagaaguucggcaaggcccugaacuacgccgaggccgcccugagcuucaucgagugcggcaacgccauggagcagggccccauggagagcaagagccccuacaccauguacagcgagaccguggagcugaucagauacgccaugagacugaagacccacagcggccccaacgccacccccgaggacaagcagcuggccgcccugugcuacagaugccuggcccugcuguacuggagaauguucagacugaagagagaccacgccgugaaguacagcaaggcccugaucgacuacuucaagaacagcagcaaggccgcccaggcccccagccccuggggcgccagcggcaagagcaccggcacccccagccccaugagccccaaccccagccccgccagcagcgugggcagccagggcagccugagcaacgccagcgcccugagccccagcaccaucgugagcaucccccagagaauccaccagauggccgccaaccacgugagcaucaccaacagcauccugcacagcuacgacuacugggagauggccgacaaccuggccaaggagaacagagaguucuucaacgaccuggaccugcugaugggccccgugacccugcacagcagcauggagcaccuggugcaguacagccagcagggccugcacuggcugagaaacagcgcccaccugagcuaa

SEQ ID NO: 13382 - RNA, 3492 nt, Artificial Sequence
  AFF4__Homo_sapiens__NP_055238
augaacagagaggacagaaacgugcugagaaugaaggagagagagagaagaaaccaggagauccagcagggcgaggacgccuucccccccagcagcccccuguucgccgagcccuacaaggugaccagcaaggaggacaagcugagcagcagaauccagagcaugcugggcaacuacgacgagaugaaggacuucaucggcgacagaagcauccccaagcugguggccauccccaagcccaccgugccccccagcgccgacgagaagagcaaccccaacuucuucgagcagagacacggcggcagccaccagagcagcaaguggacccccgugggccccgcccccagcaccagccagagccagaagagaagcagcggccugcagagcggccacagcagccagagaaccagcgccggcagcagcagcggcaccaacagcagcggccagagacacgacagagagagcuacaacaacagcggcagcagcagcagaaagaagggccagcacggcagcgagcacagcaagagcagaagcagcagccccggcaagccccaggccgugagcagccugaacagcagccacagcagaagccacggcaacgaccaccacagcaaggagcaccagagaagcaagagccccagagaccccgacgccaacugggacagccccagcagagugcccuucagcagcggccagcacagcacccagagcuucccccccagccugaugagcaagagcaacagcaugcugcagaagcccaccgccuacgugagacccauggacggccaggagagcauggagcccaagcugagcagcgagcacuacagcagccagagccacggcaacagcaugaccgagcugaagcccagcagcaaggcccaccugaccaagcugaagauccccagccagccccuggacgccagcgccagcggcgacgugagcugcguggacgagauccugaaggagaugacccacagcuggccccccccccugaccgccauccacacccccugcaagaccgagcccagcaaguuccccuuccccaccaaggagagccagcagagcaacuucggcaccggcgagcagaagagauacaaccccagcaagaccagcaacggccaccagagcaagagcaugcugaaggacgaccugaagcugagcagcagcgaggacagcgacggcgagcaggacugcgacaagaccaugcccagaagcacccccggcagcaacagcgagcccagccaccacaacagcgagggcgccgacaacagcagagacgacagcagcagccacagcggcagcgagagcagcagcggcagcgacagcgagagcgagagcagcagcagcgacagcgaggccaacgagcccagccagagcgccagccccgagcccgagcccccccccaccaacaaguggcagcuggacaacuggcugaacaaggugaacccccacaaggugagccccgccagcagcguggacagcaacauccccagcagccagggcuacaagaaggagggcagagagcagggcaccggcaacagcuacaccgacaccagcggccccaaggagaccagcagcgccacccccggcagagacagcaagaccauccagaagggcagcgagagcggcagaggcagacagaagagccccgcccagagcgacagcaccacccagagaagaaccgugggcaagaagcagcccaagaaggccgagaaggccgccgccgaggagcccagaggcggccugaagaucgagagcgagacccccguggaccuggccagcagcaugcccagcagcagacacaaggccgccaccaagggcagcagaaagcccaacaucaagaaggagagcaagagcagccccagacccaccgccgagaagaagaaguacaagagcaccagcaagagcagccagaagagcagagagaucaucgagaccgacaccagcagcagcgacagcgacgagagcgagagccugccccccagcagccagacccccaaguaccccgagagcaacagaacccccgugaagcccagcagcguggaggaggaggacagcuucuucagacagagaauguucagccccauggaggagaaggagcugcugagcccccugagcgagcccgacgacagauacccccugaucgugaagaucgaccugaaccugcugaccagaauccccggcaagcccuacaaggagaccgagccccccaagggcgagaagaagaacgugcccgagaagcacaccagagaggcccagaagcaggccagcgagaaggugagcaacaagggcaagagaaagcacaagaacgaggacgacaacagagccagcgagagcaagaagcccaagaccgaggacaagaacagcgccggccacaagcccagcagcaacagagagagcagcaagcagagcgccgccaaggagaaggaccugcugcccagccccgccggccccgugcccagcaaggaccccaagaccgagcacggcagcagaaagagaaccaucagccagagcagcagccugaagagcagcagcaacagcaacaaggagaccagcggcagcagcaagaacagcagcagcaccagcaagcagaagaagaccgagggcaagaccagcagcagcagcaaggaggugaaggagaaggcccccagcagcagcagcaacugcccccccagcgcccccacccuggacagcagcaagcccagaagaaccaagcugguguucgacgacagaaacuacagcgccgaccacuaccugcaggaggccaagaagcugaagcacaacgccgacgcccugagcgacagauucgagaaggccguguacuaccuggacgccguggugagcuucaucgagugcggcaacgcccuggagaagaacgcccaggagagcaagagccccuuccccauguacagcgagaccguggaccugaucaaguacaccaugaagcugaagaacuaccuggcccccgacgccaccgccgccgacaagagacugaccgugcugugccugagaugcgagagccugcuguaccugagacuguucaagcugaagaaggagaacgcccugaaguacagcaagacccugaccgagcaccugaagaacagcuacaacaacagccaggcccccagccccggccugggcagcaaggccgugggcaugcccagccccgugagccccaagcugagccccggcaacagcggcaacuacagcagcggcgccagcagcgccagcgccagcggcagcagcgugaccaucccccagaagauccaccagauggccgccagcuacgugcaggugaccagcaacuuccuguacgccaccgagaucugggaccaggccgagcagcugagcaaggagcagaaggaguucuucgccgagcuggacaaggugaugggcccccugaucuucaacgccagcaucaugaccgaccuggugagauacaccagacagggccugcacuggcugagacaggacgccaagcugaucagcuaa

SEQ ID NO: 13383 - RNA, 2394 nt, Artificial Sequence
  AFG3L2__Homo_sapiens__NP_006787
auggcccacagaugccugagacuguggggcagaggcggcugcuggcccagaggccugcagcagcugcuggugcccggcggcgugggccccggcgagcagcccugccugagaacccuguacagauucgugaccacccaggccagagccagcagaaacagccugcugaccgacaucaucgccgccuaccagagauucugcagcagaccccccaagggcuucgagaaguacuuccccaacggcaagaacggcaagaaggccagcgagcccaaggaggugaugggcgagaagaaggagagcaagcccgccgccaccaccagaagcagcggcggcggcggcggcggcggcggcaagagaggcggcaagaaggacgacagccacugguggagcagauuccagaagggcgacauccccugggacgacaaggacuucagaauguucuuccuguggaccgcccuguucuggggcggcgugauguucuaccugcugcugaagagaagcggcagagagaucaccuggaaggacuucgugaacaacuaccugagcaagggcgugguggacagacuggagguggugaacaagagauucgugagagugaccuucacccccggcaagacccccguggacggccaguacgugugguucaacaucggcagcguggacaccuucgagagaaaccuggagacccugcagcaggagcugggcaucgagggcgagaacagagugcccgugguguacaucgccgagagcgacggcagcuuccugcugagcaugcugcccaccgugcugaucaucgccuuccugcuguacaccaucagaagaggccccgccggcaucggcagaaccggcagaggcaugggcggccuguucagcgugggcgagaccaccgccaaggugcugaaggacgagaucgacgugaaguucaaggacguggccggcugcgaggaggccaagcuggagaucauggaguucgugaacuuccugaagaaccccaagcaguaccaggaccugggcgccaagauccccaagggcgccauccugaccggcccccccggcaccggcaagacccugcuggccaaggccaccgccggcgaggccaacgugcccuucaucaccgugagcggcagcgaguuccuggagauguucgugggcgugggccccgccagagugagagaccuguucgcccuggccagaaagaacgcccccugcauccuguucaucgacgagaucgacgccgugggcagaaagagaggcagaggcaacuucggcggccagagcgagcaggagaacacccugaaccagcugcugguggagauggacggcuucaacaccaccaccaacguggugauccuggccggcaccaacagacccgacauccuggaccccgcccugcugagacccggcagauucgacagacagaucuucaucggcccccccgacaucaagggcagagccagcaucuucaaggugcaccugagaccccugaagcuggacagcacccuggagaaggacaagcuggccagaaagcuggccagccugacccccggcuucagcggcgccgacguggccaacgugugcaacgaggccgcccugaucgccgccagacaccugagcgacagcaucaaccagaagcacuucgagcaggccaucgagagagugaucggcggccuggagaagaagacccaggugcugcagcccgaggagaagaagaccguggccuaccacgaggccggccacgccguggccggcugguaccuggagcacgccgacccccugcugaaggugagcaucauccccagaggcaagggccugggcuacgcccaguaccugcccaaggagcaguaccuguacaccaaggagcagcugcuggacagaaugugcaugacccugggcggcagagugagcgaggagaucuucuucggcagaaucaccaccggcgcccaggacgaccugagaaaggugacccagagcgccuacgcccagaucgugcaguucggcaugaacgagaaggugggccagaucagcuucgaccugcccagacagggcgacauggugcuggagaagcccuacagcgaggccaccgccagacugaucgacgacgaggugagaauccugaucaacgacgccuacaagagaaccguggcccugcugaccgagaagaaggccgacguggagaagguggcccugcugcugcuggagaaggaggugcuggacaagaacgacaugguggagcugcugggccccagacccuucgccgagaagagcaccuacgaggaguucguggagggcaccggcagccuggacgaggacaccagccugcccgagggccugaaggacuggaacaaggagagagagaaggagaaggaggagccccccggcgagaagguggccaacuaa

SEQ ID NO: 13384 - RNA, 1800 nt, Artificial Sequence
  AFM__Homo_sapiens__NP_001124
augaagcugcugaagcugaccggcuucaucuucuuccuguucuuccugaccgagagccugacccugcccacccagcccagagacaucgagaacuucaacagcacccagaaguucaucgaggacaacaucgaguacaucaccaucaucgccuucgcccaguacgugcaggaggccaccuucgaggagauggagaagcuggugaaggacaugguggaguacaaggacagaugcauggccgacaagacccugcccgagugcagcaagcugcccaacaacgugcugcaggagaagaucugcgccauggagggccugccccagaagcacaacuucagccacugcugcagcaagguggacgcccagagaagacugugcuucuucuacaacaagaagagcgacgugggcuuccugccccccuuccccacccuggaccccgaggagaagugccaggccuacgagagcaacagagagagccugcugaaccacuuccuguacgagguggccagaagaaaccccuucguguucgcccccacccugcugaccguggccgugcacuucgaggagguggccaagagcugcugcgaggagcagaacaaggugaacugccugcagaccagagccauccccgugacccaguaccugaaggccuucagcagcuaccagaagcacgugugcggcgcccugcugaaguucggcaccaagguggugcacuucaucuacaucgccauccugagccagaaguuccccaagaucgaguucaaggagcugaucagccugguggaggacgugagcagcaacuacgacggcugcugcgagggcgacguggugcagugcaucagagacaccagcaaggugaugaaccacaucugcagcaagcaggacagcaucagcagcaagaucaaggagugcugcgagaagaagauccccgagagaggccagugcaucaucaacagcaacaaggacgacagacccaaggaccugagccugagagagggcaaguucaccgacagcgagaacgugugccaggagagagacgccgaccccgacaccuucuucgccaaguucaccuucgaguacagcagaagacaccccgaccugagcauccccgagcugcugagaaucgugcagaucuacaaggaccugcugagaaacugcugcaacaccgagaacccccccggcugcuacagauacgccgaggacaaguucaacgagaccaccgagaagagccugaagauggugcagcaggagugcaagcacuuccagaaccugggcaaggacggccugaaguaccacuaccugaucagacugaccaagaucgccccccagcugagcaccgaggagcuggugagccugggcgagaagauggugaccgccuucaccaccugcugcacccugagcgaggaguucgccugcguggacaaccuggccgaccugguguucggcgagcugugcggcgugaacgagaacagaaccaucaaccccgccguggaccacugcugcaagaccaacuucgccuucagaagacccugcuucgagagccugaaggccgacaagaccuacgugcccccccccuucagccaggaccuguucaccuuccacgccgacaugugccagagccagaacgaggagcugcagagaaagaccgacagauuccuggugaaccuggugaagcugaagcacgagcugaccgacgaggagcugcagagccuguucaccaacuucgccaacgugguggacaagugcugcaaggccgagagccccgaggugugcuucaacgaggagagccccaagaucggcaacuaa

SEQ ID NO: 13385 - RNA, 1830 nt, Artificial Sequence
  AFP__Homo_sapiens__NP_001125
augaaguggguggagagcaucuuccugaucuuccugcugaacuucaccgagagcagaacccugcacagaaacgaguacggcaucgccagcauccuggacagcuaccagugcaccgccgagaucagccuggccgaccuggccaccaucuucuucgcccaguucgugcaggaggccaccuacaaggaggugagcaagauggugaaggacgcccugaccgccaucgagaagcccaccggcgacgagcagagcagcggcugccuggagaaccagcugcccgccuuccuggaggagcugugccacgagaaggagauccuggagaaguacggccacagcgacugcugcagccagagcgaggagggcagacacaacugcuuccuggcccacaagaagcccacccccgccagcaucccccuguuccaggugcccgagcccgugaccagcugcgaggccuacgaggaggacagagagaccuucaugaacaaguucaucuacgagaucgccagaagacaccccuuccuguacgcccccaccauccugcugugggccgccagauacgacaagaucauccccagcugcugcaaggccgagaacgccguggagugcuuccagaccaaggccgccaccgugaccaaggagcugagagagagcagccugcugaaccagcacgccugcgccgugaugaagaacuucggcaccagaaccuuccaggccaucaccgugaccaagcugagccagaaguucaccaaggugaacuucaccgagauccagaagcuggugcuggacguggcccacgugcacgagcacugcugcagaggcgacgugcuggacugccugcaggacggcgagaagaucaugagcuacaucugcagccagcaggacacccugagcaacaagaucaccgagugcugcaagcugaccacccuggagagaggccagugcaucauccacgccgagaacgacgagaagcccgagggccugagccccaaccugaacagauuccugggcgacagagacuucaaccaguucagcagcggcgagaagaacaucuuccuggccagcuucgugcacgaguacagcagaagacacccccagcuggccgugagcgugauccugagaguggccaagggcuaccaggagcugcuggagaagugcuuccagaccgagaacccccuggagugccaggacaagggcgaggaggagcugcagaaguacauccaggagagccaggcccuggccaagagaagcugcggccuguuccagaagcugggcgaguacuaccugcagaacgccuuccugguggccuacaccaagaaggccccccagcugaccagcagcgagcugauggccaucaccagaaagauggccgccaccgccgccaccugcugccagcugagcgaggacaagcugcuggccugcggcgagggcgccgccgacaucaucaucggccaccugugcaucagacacgagaugacccccgugaaccccggcgugggccagugcugcaccagcagcuacgccaacagaagacccugcuucagcagccuggugguggacgagaccuacgugccccccgccuucagcgacgacaaguucaucuuccacaaggaccugugccaggcccagggcguggcccugcagaccaugaagcaggaguuccugaucaaccuggugaagcagaagccccagaucaccgaggagcagcuggaggccgugaucgccgacuucagcggccugcuggagaagugcugccagggccaggagcaggaggugugcuucgccgaggagggccagaagcugaucagcaagaccagagccgcccugggcguguaa

SEQ ID NO: 13386 - RNA, 1041 nt, Artificial Sequence
  AGA__Homo_sapiens__NP_000018
auggccagaaagagcaaccugcccgugcugcuggugcccuuccugcugugccaggcccuggugagaugcagcagcccccugccccugguggugaacaccuggcccuucaagaacgccaccgaggccgccuggagagcccuggccagcggcggcagcgcccuggacgccguggagagcggcugcgccaugugcgagagagagcagugcgacggcagcgugggcuucggcggcagccccgacgagcugggcgagaccacccuggacgccaugaucauggacggcaccaccauggacgugggcgccgugggcgaccugagaagaaucaagaacgccaucggcguggccagaaaggugcuggagcacaccacccacacccugcuggugggcgagagcgccaccaccuucgcccagagcaugggcuucaucaacgaggaccugagcaccaccgccagccaggcccugcacagcgacuggcuggccagaaacugccagcccaacuacuggagaaacgugauccccgaccccagcaaguacugcggccccuacaagccccccggcauccugaagcaggacauccccauccacaaggagaccgaggacgacagaggccacgacaccaucggcaugguggugauccacaagaccggccacaucgccgccggcaccagcaccaacggcaucaaguucaagauccacggcagagugggcgacagccccauccccggcgccggcgccuacgccgacgacaccgccggcgccgccgccgccaccggcaacggcgacauccugaugagauuccugcccagcuaccaggccguggaguacaugagaagaggcgaggaccccaccaucgccugccagaaggugaucagcagaauccagaagcacuuccccgaguucuucggcgccgugaucugcgccaacgugaccggcagcuacggcgccgccugcaacaagcugagcaccuucacccaguucagcuucaugguguacaacagcgagaagaaccagcccaccgaggagaagguggacugcaucuaa

SEQ ID NO: 13387 - RNA, 2574 nt, Artificial Sequence
  AGAP1__Homo_sapiens__NP_001032208
augaacuaccagcagcagcuggccaacagcgccgccaucagagccgagauccagagauucgagagcgugcaccccaacaucuacagcaucuacgagcugcuggagagaguggaggagcccgugcugcagaaccagaucagagagcacgugaucgccaucgaggacgccuucgugaacagccaggaguggacccugagcagaagcgugcccgagcugaaggugggcaucgugggcaaccuggccagcggcaagagcgcccuggugcacagauaccugaccggcaccuacgugcaggaggagagccccgagggcggcagauucaagaaggagaucgugguggacggccagagcuaccugcugcugaucagagacgagggcggcccccccgaggcccaguucgccauguggguggacgccgugaucuucguguucagccuggaggacgagaucagcuuccagaccguguaccacuacuacagcagaauggccaacuacagaaacaccagcgagaucccccuggugcuggugggcacccaggacgccaucagcagcgccaaccccagagugaucgacgacgccagagccagaaagcugagcaacgaccugaagagaugcaccuacuacgagaccugcgccaccuacggccugaacguggagagaguguuccaggacguggcccagaagaucguggccaccagaaagaagcagcagcugagcaucggccccugcaagagccugcccaacagccccagccacagcagcgugugcagcgcccaggugagcgccgugcacaucagccagaccagcaacggcggcggcagccugagcgacuacagcagcagcgugcccagcacccccagcaccagccagaaggagcugagaaucgacgugccccccaccgccaacacccccacccccgugagaaagcagagcaagagaagaagcaaccuguucaccagcagaaagggcagcgaccccgacaaggagaagaagggccuggagagcagagccgacagcaucggcagcggcagagccauccccaucaagcagggcaugcugcugaagagaagcggcaagagccugaacaaggaguggaagaagaaguacgugacccugugcgacaacggcgugcugaccuaccaccccagccugcacgacuacaugcagaacgugcacggcaaggagaucgaccugcugagaaccaccgugaaggugcccggcaagagaccccccagagccaccagcgccugcgcccccaucagcagccccaagaccaacggccugagcaaggacaugagcagccugcacaucagccccaacagcggcaacgugaccagcgccagcggcagccagauggccagcggcaucagccuggugagcuucaacagcagacccgacggcaugcaccagagaagcuacagcgugagcagcgccgaccaguggagcgaggccaccgugaucgccaacagcgccaucagcagcgacaccggccugggcgacagcgugugcagcagccccagcaucagcagcaccaccagccccaagcuggaccccccccccagcccccacgccaacagaaagaagcacagaagaaagaagagcaccagcaacuucaaggccgacggccugagcggcaccgccgaggagcaggaggagaacuucgaguucaucaucgugagccugaccggccagaccuggcacuucgaggccaccaccuacgaggagagagacgccugggugcaggccaucgagagccagauccuggccagccugcagagcugcgagagcagcaagaacaagagcagacugaccagccagagcgaggccauggcccugcagagcaucagaaacaugagaggcaacagccacugcguggacugcgagacccagaaccccaacugggccagccugaaccugggcgcccugaugugcaucgagugcagcggcauccacagaaaccugggcacccaccugagcagagugagaagccuggaccuggacgacuggcccguggagcugaucaaggugaugagcagcaucggcaacgagcuggccaacagcgugugggaggagagcagccagggcagaaccaagcccagcguggacagcaccagagaggagaaggagagauggaucagagccaaguacgagcagaagcuguuccuggccccccugcccugcaccgagcugagccugggccagcaccugcugagagccaccgccgacgaggaccugagaaccgccauccugcugcuggcccacggcagcagagacgaggugaacgagaccugcggcgagggcgacggcagaaccgcccugcaccuggccugcagaaagggcaacguggugcuggcccagcugcugaucugguacggcguggacgugaccgccagagacgcccacggcaacaccgcccuggccuacgccagacaggccagcagccaggagugcaucgacgugcugcugcaguacggcugccccgacgagagauucgugcugauggccacccccaaccugagcagaagaaacaacaacagaaacaacagcagcggcagagugcccaccaucaucuaa

SEQ ID NO: 13388 - RNA, 3579 nt, Artificial Sequence
  AGAP2__Homo_sapiens__NP_001116244
augagcagaggcgccggcgcccugcagagaagaaccaccaccuaccugaucagccugacccuggugaagcuggagagcgugcccccccccccccccagccccagcgccgccgccgccggcgccgccggcgccagaggcagcgagaccggcgaccccggcagccccagaggcgccgaggagcccggcaagaagagacacgagagacuguuccacagacaggacgcccuguggaucagcaccagcagcgccggcaccggcggcgccgagccccccgcccugagccccgcccccgccagccccgccagacccgugagccccgcccccggcagaagacugagccugugggccgugccccccggccccccccugagcggcggccugagccccgaccccaagcccggcggcgcccccaccagcagcagaagaccccugcugagcagccccagcuggggcggccccgagcccgagggcagagccggcggcggcauccccggcagcagcagcccccaccccggcaccggcagcagaagacugaagguggccccccccccccccgcccccaagcccugcaagaccgugaccaccagcggcgccaaggccggcggcggcaagggcgccggcagcagacugagcuggcccgagagcgagggcaagcccagagugaagggcagcaagagcagcgccggcaccggcgccagcgugagcgccgccgccaccgccgccgccgccggcggcggcggcagcaccgccagcaccagcggcggcgugggcgccggcgccggcgccagaggcaagcugagccccagaaagggcaagagcaagacccuggacaacagcgaccugcaccccggcccccccgccggcagcccccccccccugacccugccccccacccccagccccgccaccgccgugaccgccgccagcgcccagccccccggccccgccccccccaucacccuggagccccccgcccccggccugaagagaggcagagagggcggcagagccagcaccagagacagaaagaugcugaaguucaucagcggcaucuucaccaagagcaccggcggcccccccggcagcggcccccugcccggcccccccagccugagcagcggcagcggcagcagagagcugcugggcgccgagcugagagccagccccaaggccgugaucaacagccaggaguggacccugagcagaagcauccccgagcugagacugggcgugcugggcgacgccagaagcggcaagagcagccugauccacagauuccugaccggcagcuaccaggugcuggagaagaccgagagcgagcaguacaagaaggagaugcugguggacggccagacccaccuggugcugaucagagaggaggccggcgcccccgacgccaaguucagcggcugggccgacgccgugaucuucguguucagccuggaggacgagaacagcuuccaggccgugagcagacugcacggccagcugagcagccugagaggcgagggcagaggcggccuggcccuggcccuggugggcacccaggacagaaucagcgccagcagccccagaguggugggcgacgccagagccagagcccugugcgccgacaugaagagaugcagcuacuacgagaccugcgccaccuacggccugaacguggacagaguguuccaggagguggcccagaagguggugacccugagaaagcagcagcagcugcuggccgccugcaagagccugcccagcagccccagccacagcgccgccagcacccccguggccggccaggccagcaacggcggccacaccagcgacuacagcagcagccugcccagcagccccaacgugggccacagagagcugagagccgaggccgccgccguggccggccugagcacccccggcagccugcacagagccgccaagagaagaaccagccuguucgccaacagaagaggcagcgacagcgagaagagaagccuggacagcagaggcgagaccaccggcagcggcagagccauccccaucaagcagagcuuccugcugaagagaagcggcaacagccugaacaaggaguggaagaagaaguacgugacccugagcagcaacggcuuccugcuguaccaccccagcaucaacgacuacauccacagcacccacggcaaggagauggaccugcugagaaccaccgugaaggugcccggcaagagaccccccagagccaucagcgccuucggccccagcgccagcaucaacggccuggugaaggacaugagcaccgugcagaugggcgagggccuggaggccaccacccccaugcccagccccagccccagccccagcagccugcagcccccccccgaccagaccagcaagcaccugcugaagcccgacagaaaccuggccagagcccugagcaccgacugcacccccagcggcgaccugagcccccugagcagagagcccccccccagccccauggugaagaagcagagaagaaagaagcugaccacccccagcaagaccgagggcagcgccggccaggccgaggccaagagaaagauguggaagcugaagagcuucggcagccugagaaacaucuacaaggccgaggagaacuucgaguuccugaucgugagcagcaccggccagaccuggcacuucgaggccgccagcuucgaggagagagacgccugggugcaggccaucgagagccagauccuggccagccugcagugcugcgagagcagcaaggugaagcugagaaccgacagccagagcgaggccguggccauccaggccaucagaaacgccaagggcaacagcaucugcguggacugcggcgcccccaaccccaccugggccagccugaaccugggcgcccugaucugcaucgagugcagcggcauccacagaaaccugggcacccaccugagcagagugagaagccuggaccuggacgacuggcccagagagcugacccuggugcugaccgccaucggcaacgacaccgccaacagagugugggagagcgacaccagaggcagagccaagcccagcagagacagcagcagagaggagagagagagcuggaucagagccaaguacgagcagcugcuguuccuggccccccugagcaccagcgaggagccccugggcagacagcugugggccgccgugcaggcccaggacguggccaccgugcugcugcugcuggcccacgccagacacggcccccuggacaccagcguggaggacccccagcugagaagcccccugcaccuggccgccgagcuggcccacguggugaucacccagcugcugcugugguacggcgccgacguggccgccagagacgcccagggcagaaccgcccuguucuacgccagacaggccggcagccagcugugcgccgacauccugcugcagcacggcugccccggcgagggcggcagcgccgccaccacccccagcgccgccaccacccccagcaucaccgccacccccagccccagaagaagaagcagcgccgccagcgugggcagagccgacgcccccguggcccugguguaa

SEQ ID NO: 13389 - RNA, 1191 nt, Artificial Sequence
  AGAP3__Homo_sapiens__NP_001036000
augaacuuccaggccggcggcggccagagcccccagcagcagcagagccuggccgcccccggcggcggcggcgccgccgcccagcagcuggugugcggcggccaguucggcggcgccggccccggcgccggcggcggcggcggccccagccagcagcuggccggcggccccccccagcaguucgcccugagcaacagcgccgccaucagagccgagauccagagauucgagagcgugcaccccaacaucuacgccaucuacgaccugaucgagagaaucgaggaccuggcccugcagaaccagaucagagagcacgugaucagcaucgaggacagcuucgugaacagccaggaguggacccugagcagaagcgugcccgagcugaaggugggcaucgugggcaaccugagcagcggcaagagcgcccuggugcacagauaccugaccggcaccuacgugcaggaggagagccccgagggcggcagauucaagaaggagaucgugguggacggccagagcuaccugcugcugaucagagacgagggcggcccccccgagcugcaguucgccgccuggguggacgccgugguguucguguucagccuggaggacgagaucagcuuccagaccguguacaacuacuuccugagacugugcagcuucagaaacgccagcgaggugcccauggugcuggugggcacccaggacgccaucagcgccgccaaccccagagugaucgacgacagcagagccagaaagcugagcaccgaccugaagagaugcaccuacuacgagaccugcgccaccuacggccugaacguggagagaguguuccaggacguggcccagaaggugguggcccugagaaagaagcagcagcuggccaucggccccugcaagagccugcccaacagccccagccacagcgccgugagcgccgccagcauccccgccgugcacaucaaccaggccaccaacggcggcggcagcgccuucagcgacuacagcagcagcgugcccagcacccccagcaucagccagagagagcugagaaucgagaccaucgccgccagcagcacccccacccccaucagaaagcagagcaagagaagaagcaacaucuucaccaucugcgccaccgugagcaacuucagcagcaccaagagacccuuccagcugcugcccaacuaa

SEQ ID NO: 13390 - RNA, 1992 nt, Artificial Sequence
  AGAP4__Homo_sapiens__NP_597703
augggcaacauccugaccugcagagugcaccccagcgugagccuggaguucgaccagcagcagggcagcgugugccccagcgagagcgagaucuacgaggccggcgccggcgacagaauggccggcgcccccauggccgccgccgugcagcccgccgaggugaccguggaggugggcgaggaccugcacaugcaccacgugagagacagagagaugcccgaggcccuggaguucaaccccagcgccaaccccgaggccagcaccaucuuccagagaaacagccagaccgacgugguggagaucagaagaagcaacugcaccaaccacgugagcaccgugagauucagccagcaguacagccugugcagcaccaucuuccuggacgacagcaccgccauccagcacuaccugaccaugaccaucaucagcgugacccuggagaucccccaccacaucacccagagagacgccgacagaagccugagcauccccgacgagcagcugcacagcuucgccgugagcaccgugcacaucaugaagaagagaaacggcggcggcagccugaacaacuacagcagcagcauccccagcacccccagcaccagccaggaggacccccaguucagcgugccccccaccgccaacacccccacccccgugugcaagagaagcaugagauggagcaaccuguucaccagcgagaagggcagcgaccccgacaaggagagaaaggcccccgagaaccacgccgacaccaucggcagcggcagagccauccccaucaagcagggcaugcugcugaagagaagcggcaaguggcugaagaccuggaagaagaaguacgugacccugugcagcaacggcgugcugaccuacuacagcagccugggcgacuacaugaagaacauccacaagaaggagaucgaccugcagaccagcaccaucaaggugcccggcaaguggcccagccuggccaccagcgccugcacccccaucagcaccagcaagagcaacggccugagcaaggacauggacaccggccugggcgacagcaucugcuucagccccagcaucagcagcaccaccagccccaagcugaaccccccccccagcccccacgccaacaagaagaagcaccugaagaagaagagcaccaacaacuucaugaucgugagcgccaccggccagaccuggcacuucgaggccaccaccuacgaggagagagacgccugggugcaggccauccagagccagauccuggccagccugcagagcugcgagagcagcaagagcaagagccagcugaccagccagagcaaggccauggcccugcagagcauccagaacaugagaggcaacgcccacugcguggacugcgagacccagaaccccaagugggccagccugaaccugggcgugcugaugugcaucgagugcagcggcauccacagaagccugggcaccagacugagcagagugagaagccuggagcuggacgacuggcccguggagcugagaaaggugaugagcagcaucggcaacgaccuggccaacagcaucugggagggcagcagccagggccagaccaagcccagcgagaagagcaccagagaggagaaggagagauggaucagaagcaaguacgaggagaagcuguuccuggccccccugcccugcaccgagcugagccugggccagcagcugcugagagccaccgccgacgaggaccugcagaccgccauccugcugcuggcccacggcagcagagaggaggugaacgagaccugcggcgagggcgacggcugcaccgcccugcaccuggccugcagaaagggcaacguggugcuggcccagcugcugaucugguacggcguggacgugauggccagagacgcccacggcaacaccgcccugaccuacgccagacaggccagcagccaggagugcaucaacgugcugcugcaguacggcugccccgacaagugcguguaa

SEQ ID NO: 13391 - RNA, 3201 nt, Artificial Sequence
  AGBL1__Homo_sapiens__NP_689549
augaucagcaagggcggcagcgaggcccugcugcagacccugguggacaccgccagaaccgccccccccgacuacgacauccugcugccccuguucagacugcuggccaaggugggccugagagacaagaagaucggcagaaaggcccuggagcuggaggcccuggacgugacccugauccuggccagaaagaaccugagccacggccagaaccugcugcacugccugugggcccugagaguguucgccagcagcgugagcaugggcgccaugcugggcaucaacggcgccauggagcugcuguucaaggugaucacccccuacaccagaaagagaacccaggccaucagagccgccaccgaggugcuggccgcccugcugaagagcaagagcaacggcagaagagccgugaacagaggcuacgugaccagccugcugggccugcaccaggacuggcacagccacgacaccgccaacgccuacgugcagaucagaagaggccugcugcugugccugagacacaucgccgcccugagaagcggcagagaggccuuccuggccgcccagggcauggagauccuguucagcaccacccagaacugccuggacgacaagagcauggagcccgugaucagcguggugcugcagauccugagacagugcuaccccaccagcccccugccccuggugaccgccagcagcgccuacgccuuccccgugcccggcugcaucaccaccgagcccccccacgaccugcccgaggaggacuucgaggacgacggcgacgacgagguggacaaggacagcgacaccgaggacggcaagguggaggacgacgaccuggagaccgacgugaacaagcugagcagcaagcccggccuggacagacccgaggaggagcugaugcaguacgaggugaugugccuggagcugagcuacagcuucgaggagcugcagagcaagcugggcgacgaccugaacagcgagaagacccaguacgccaaccaccaccacauccccgccgccgccagcagcaagcagcacugcuacagcaaggaccagagcagcugcggccaggagagagaguacgccgugcagaccagccugcugugcagagugaagaccggcagaagcaccgugcaccugggcagcaagaagaaccccggcgugaaccuguaccagaacgugcagagcaacagccugagaagagacagcagcgagagcgagauccccgacauccaggccagccccaaggccgacgccugggacguggacgccaucuucugccccagaaugagcgccagcuucagcaacagcaccagaaccagagagguggugaaggugaucgacaagcugcugcagacccaccugaagagagugcccuuccacgaccccuaccuguacauggccaaggccagaagaaccagcagcgugguggacuucaagaugauggccuuccccgacguguggggccacugccccccccccaccacccagcccaugcuggagagaaagugcggcgugcagagaaucagaaucuucgaggacaucagaagacugauccagcccagcgacgugaucaacaaggugguguucagccuggacgagcccuggccccugcaggacaacgccagcaacugccugagauucuucagcaaguucgagagcggcaaccugagaaaggccauccaggugagagaguucgaguacgaccugcuggugaacgccgacgugaacagcacccagcaccagcagugguucuacuucaaggugagcggcaugcaggccgccauccccuaccacuucaacaucaucaacugcgagaagcccaacagccaguucaacuacggcaugcagcccacccuguacagcgugaaggaggcccugcugggcaagcccaccuggaucagaaccggccacgagaucugcuacuacaagaaccacuacagacagagcaccgccguggccggcggcgccagcggcaagugcuacuacacccugaccuucgccgugaccuucccccacagcgaggacgugugcuaccuggccuaccacuaccccuacaccuacaccgcccugaugacccaccuggacauccuggagaagagcgugaaccugaaggagguguacuucagacaggacgugcugugccagacccugggcggcaaccccugcccccuggugaccaucaccgccaugcccgagagcaacagcgacgagcaccuggagcaguucagacacagacccuaccaggugaucaccgccagagugcaccccggcgagagcaacgccagcugggugaugaagggcacccuggaguuccuggugagcagcgaccccguggccagacugcugagagagaacuucaucuucaagaucauccccaugcugaaccccgacggcgugaucaacggcaaccacagaugcagccugagcggcgaggaccugaacagacaguggcugagccccagcgcccaccugcagcccaccaucuaccacgccaagggccugcuguaccaccugagcagcaucggcagaagccccgugguguucugcgacuuccacggccacagccagaagaagaacguguuccuguacggcugcagcaucaaggagacccuguggcaggccgccugcaccgugggcaccagcaccauccuggaggaggugaacuacagaacccugcccaagauccuggacaagcuggcccccgccuucaccaugagcagcugcagcuuccugguggagaagagcagagccagcaccgccagaguggugguguggagagagaugggcgugagcagaagcuacaccauggagagcagcuacugcggcugcaaccagggccccuaccagugcacccagagacugcuggagagaaccaagaacgagagagcccaccccguggacggccugcagggccugcaguucggcaccagagagcuggaggagaugggcgccauguucugccugggccugcugauccuggagcugaagagcgccagcugcagccaccagcugcuggcccaggccgccacccugcugagcgccgaggaggacgcccuggaccagcaccugcagagacugaagagcagcaacuuccugcccaagcacaucugguucgccuaccacuucuucgccaucaccaacuucuucaagaugaaccugcugcugcacgugagccccgugugcgacaccuaa

SEQ ID NO: 13392 - RNA, 2709 nt, Artificial Sequence
  AGBL2__Homo_sapiens__NP_079059
auguuccccgcccuggagacccaccugaagcagaccauccccgaccccuacgaggacuucauguacagacaccugcaguacuacggcuacuucaaggcccagagaggcagccugcccaacagcgccacccaccagcacgugagaaagaacaacccccagugccugcugaacggcagccugggcgagaaggacgaccugauccccgacacccugcagaaggagaagcugcuguggcccaucagccugagcagcgccgugcacagacagaucgaggccaucaacagagacuuccacagcugccugggcuggaugcaguggagaggccugagcagccugcagccccccccccccagauucaaggacagccccgccagcgccuucagaguggccggcaucaccgacagccacaugcugagccugccccaccugagaagcagacagcugcuguacgacgagcuggacgaggugaaccccagacugagagagccccaggagcuguucagcauccugagcaccaagagaccccugcaggcccccagauggcccaucgagugcgaggugaucaaggagaacauccaccacaucgagugggcccccccccagcccgaguacuucuaccagcccaagggcaacgagaaggugcccgagaucgugggcgagaagaagggcaccgugguguaccagcuggacagcgugcccaucgagggcagcuacuucaccagcagcagagugggcggcaagagaggcaucgugaaggagcuggccgugacccugcagggccccgaggacaacacccugcuguucgagagcagauucgagagcggcaaccugcagaaggccgugagaguggacaccuacgaguacgagcugacccugagaaccgaccuguacaccaacaagcacacccagugguucuacuucagagugcagaacaccagaaaggacgccaccuacagauucaccaucgugaaccugcugaagcccaagagccuguacaccgugggcaugaagccccugcuguacagccagcuggacgccaacaccagaaacaucggcuggagaagagagggcaacgagaucaaguacuacaagaacaacaccgacgacggccagcagcccuucuacugccugaccuggaccauccaguuccccuacgaccaggacaccugcuucuucgcccacuucuaccccuacaccuacaccgaccugcagugcuaccugcugagcguggccaacaaccccauccagagccaguucugcaagcugcagacccugugcagaagccuggccggcaacaccguguaccugcugaccaucaccaaccccagccagaccccccaggaggccgccgccaagaaggccguggugcugagcgccagagugcaccccggcgagagcaacggcagcugggugaugaagggcuuccuggacuucauccugagcaacagccccgacgcccagcugcugagagacaucuucguguucaaggugcugcccaugcugaaccccgacggcgugaucgugggcaacuacagaugcagccuggccggcagagaccugaacagacacuacaagaccauccugaaggagagcuuccccugcaucugguacaccagaaacaugaucaagagacugcuggaggagagagaggugcugcuguacugcgacuuccacggccacagcagaaagaacaacaucuuccuguacggcugcaacaacaacaacagaaaguacuggcugcacgagagaguguucccccugaugcugugcaagaacgcccccgacaaguucagcuuccacagcugcaacuucaaggugcagaagugcaaggagggcaccggcagaguggugauguggagaaugggcauccugaacagcuacaccauggagagcaccuucggcggcagcacccugggcaacaagagagacacccacuucaccaucgaggaccugaagagccugggcuaccacgugugcgacacccugcuggacuucugcgaccccgaccagaugaaguucacccagugccuggccgagcugaaggagcugcugagacaggagauccacaagaaguuccacgagcugggccaggacguggaccuggagggcagcuggagcgacaucagccugagcgacaucgagagcagcaccagcggcagcgacagcagccugagcgacggccugcccgugcaccuggccaacaucgccgacgagcugacccagaagaagaagauguucaagaagaagaagaagaagagccugcagaccagaaagcagagaaacgagcaguaccagaagaagaaccugaugcagaagcugaagcugaccgaggacaccagcgagaaggccggcuucgccagcacccugcagaagcagcccaccuucuucaagaacagcgagaacagcagcuuccugcccaugaagaacgagaaccccagacugaacgagaccaaccugaacagaagagacaaggacaccccccuggaccccagcauggccacccugauccugcccaagaacaagggcagaaugcagaacaagaagcccggcuucaccgugagcugcagccccaagagaaccaucaacagcagccaggagcccgcccccggcaugaagcccaacuggcccagaagcagauaccccgccaccaagagaggcugcgccgccauggccgccuaccccagccugcacaucuacaccuaccccuaa

SEQ ID NO: 13393 - RNA, 2763 nt, Artificial Sequence
  AGBL3__Homo_sapiens__NP_848658
augagcgaggacagcgagaaggaggacuacagcgacagaaccaucagcgacgaggacgagagcgacgaggacauguucaugaaguucgugagcgaggaccugcacagaugcgcccugcugaccgccgacagcuucggcgaccccuucuuccccagaaccacccagauccugcuggaguaccagcugggcagaugggugcccagacugagagagcccagagaccuguacggcgugagcagcagcggcccccugagccccaccagauggcccuaccacugcgaggugaucgacgagaaggugcagcacaucgacuggacccccagcugccccgagcccguguacauccccaccggccuggagaccgagccccuguaccccgacagcaaggaggccaccgugguguaccuggccgaggacgccuacaaggagcccugcuucguguacagcagagugggcggcaacagaaccccccugaagcagcccguggacuacagagacaacacccugauguucgaggccagauucgagagcggcaaccugcagaagguggugaagguggccgaguacgaguaccagcugaccgugagacccgaccuguucaccaacaagcacacccagugguacuacuuccaggugaccaacaugagagccggcaucguguacagauucaccaucgugaacuucaccaagcccgccagccuguacagcagaggcaugagaccccuguucuacagcgagaaggaggccaaggcccaccacaucggcuggcagagaaucggcgaccagaucaaguacuacagaaacaaccccggccaggacggcagacacuacuucagccugaccuggaccuuccaguucccccacaacaaggacaccugcuacuucgcccacugcuaccccuacaccuacaccaaccugcaggaguaccugagcggcaucaacaacgaccccgugagaagcaaguucugcaagaucagagugcugugccacacccuggccagaaacaugguguacauccugaccaucaccaccccccugaagaacagcgacagcagaaagagaaaggccgugauccugaccgccagagugcaccccggcgagaccaacagcagcuggaucaugaagggcuuccuggacuacauccugggcaacagcagcgacgcccagcugcugagagacaccuucguguucaagguggugcccaugcugaaccccgacggcgugaucgugggcaacuacagaugcagccuggccggcagagaccugaacagaaacuacaccagccugcugaaggagagcuuccccagcgugugguacaccagaaacauggugcacagacugauggagaagagagaggugauccuguacugcgaccugcacggccacagcagaaaggagaacaucuucauguacggcugcgacggcagcgacagaagcaagacccuguaccugcagcagagaaucuucccccugaugcugagcaagaacugccccgacaaguucagcuucagcgccugcaaguucaacgugcagaagagcaaggagggcaccggcagaguggugauguggaagaugggcaucagaaacagcuucaccauggaggccaccuucugcggcagcacccugggcaacaagagaggcacccacuucagcaccaaggaccuggagagcaugggcuaccacuucugcgacagccugcuggacuacugcgaccccgacagaaccaaguacuacagaugccugaaggagcuggaggagauggagagacacaucacccuggagaagguguucgaggacagcgacacccccgugaucgacaucacccuggacguggagagcagcagcagaggcagcgacagcagcgagagcaucgacagccugaccuaccugcugaagcugaccagccagaagaagcaccugaagaccaagaaggagagaaacagcaccaucgccagccaccagaacgccagaggccaggagguguacgacagaggccaccugcugcagagacacacccagagcaacagcgacgugaaggacaccagacccaacgagcccgacgacuacaugguggacuacuucagaagacagcugcccaaccagggccuggaccugcaccacaaccugaagagcaagaucaaggagugcaucagcuuccagagcaagaagaccggcaucaacuggaccgacgacgagaagagaagcuacaaggacaagggcaucgugcagacccaggagauccugcaguaccugcugcccaucgugcacagcaccaagaacaugcagaccacccagaucaagcagcuguucaaccccagaaccaacuuccagauccagcaccagcugaaccccgccaccugcagaaacaucaagaaguacagcaccagcuggaccgcccccagaaaccaccccuucgugauccagggcgacgugauggccaacagcagcgagugggugcagagcaagccccacagaagccuggagagccugagcccccugaagggccccaagaagaacaagcacagccagaucugggccaucaagaacgaggacaucaagccccugagcagcaagugggagaccgccagcagcagcuucggcauggacgccaacgugcugaaguacaagagccugcaggccgaggagaccaaccagcagagcagcaagcacaccgcccugcaccugaccaagaacaaggacgagcaggccaacaagaacgacggccagcccacccuguaccugaaguuccagagagagagcuaa

SEQ ID NO: 13394 - RNA, 1521 nt, Artificial Sequence
  AGBL4__Homo_sapiens__XP_011540611
auggccgagggcagccagagcgcccccgaggccggcaacgacaugggcaacgacgacgccaucggcggcaacgugagcaaguacaucgugcugcccaccggcuacugcggccagcccaagaagggccaccugaucuucgacgccugcuucgagagcggcaaccugggcagaguggaccaggugagcgaguucgaguacgaccuguucaucagacccgacaccugcaaccccagauucagagugugguucaacuucaccguggagaacgugaaggagagccaggugagagagaucguggacaccuucagaguggugcugagagugaucuucaacaucgugaacuucagcaagaccaagagccuguacagagacggcauggcccccauggugaagagcaccagcagacccaaguggcagagacugccccccaagaacguguacuacuacagaugccccgaccacagaaagaacuacgugaugagcuucgccuucugcuucgacagagaggaggacaucuaccaguucgccuacugcuaccccuacaccuacaccagauuccagcacuaccuggacagccugcagaagagaaacauggacuacuucuucagagagcagcugggccagagcgugcagcagagaaagcuggaccugcugaccaucaccagccccgacaaccugagagagggcgccgagcagaaggugguguucaucaccggcagagugcaccccggcgagacccccagcagcuucgugugccagggcaucaucgacuuccuggugagccagcaccccaucgccugcgugcugagagaguaccugguguucaagaucgcccccaugcugaaccccgacggcguguaccugggcaacuacagaugcagccugaugggcuucgaccugaacagacacuggcuggaccccagccccugggugcaccccacccugcacggcgugaagcagcugaucgugcagauguacaacgaccccaagaccagccuggaguucuacaucgacauccacgcccacagcaccaugaugaacggcuucauguacggcaacaucuucgaggacgaggagagauuccagagacaggccaucuuccccaagcugcugugccagaacgccgaggacuucagcuacagcagcaccagcuucaacagagacgccgugaaggccggcaccggcagaagauuccugggcggccugcuggaccacaccagcuacugcuacacccuggaggugagcuucuacagcuacaucaucagcggcaccaccgccgccgugcccuacaccgaggaggccuacaugaagcugggcagaaacguggccagaaccuuccuggacuacuacagacugaaccccgugguggagaagguggccauccccaugcccagacugagaaaggagaagagcccccccuacaagcacccccugcugagaggccccgccagcaacuaccccaacagcaagggcgacaagaagagcagcgugaaccacaaggaccccagcacccccuucuaa

SEQ ID NO: 13395 - RNA, 1215 nt, Artificial Sequence
  AGER__Homo_sapiens__NP_001127
auggccgccggcaccgccgugggcgccugggugcuggugcugagccuguggggcgccguggugggcgcccagaacaucaccgccagaaucggcgagccccuggugcugaagugcaagggcgcccccaagaagcccccccagagacuggaguggaagcugaacaccggcagaaccgaggccuggaaggugcugagcccccagggcggcggccccugggacagcguggccagagugcugcccaacggcagccuguuccugcccgccgugggcauccaggacgagggcaucuucagaugccaggccaugaacagaaacggcaaggagaccaagagcaacuacagagugagaguguaccagauccccggcaagcccgagaucguggacagcgccagcgagcugaccgccggcgugcccaacaaggugggcaccugcgugagcgagggcagcuaccccgccggcacccugagcuggcaccuggacggcaagccccuggugcccaacgagaagggcgugagcgugaaggagcagaccagaagacaccccgagaccggccuguucacccugcagagcgagcugauggugacccccgccagaggcggcgaccccagacccaccuucagcugcagcuucagccccggccugcccagacacagagcccugagaaccgcccccauccagcccagagugugggagcccgugccccuggaggaggugcagcuggugguggagcccgagggcggcgccguggcccccggcggcaccgugacccugaccugcgaggugcccgcccagcccagcccccagauccacuggaugaaggacggcgugccccugccccugccccccagccccgugcugauccugcccgagaucggcccccaggaccagggcaccuacagcugcguggccacccacagcagccacggcccccaggagagcagagccgugagcaucagcaucaucgagcccggcgaggagggccccaccgccggcagcgugggcggcagcggccugggcacccuggcccuggcccugggcauccugggcggccugggcaccgccgcccugcugaucggcgugauccuguggcagagaagacagagaagaggcgaggagagaaaggcccccgagaaccaggaggaggaggaggagagagccgagcugaaccagagcgaggagcccgaggccggcgagagcagcaccggcggccccuaa

SEQ ID NO: 13396 - RNA, 1755 nt, Artificial Sequence
  AGFG1__Homo_sapiens__NP_001128659
auggccgccagcgccaagagaaagcaggaggagaagcaccugaagaugcugagagacaugaccggccugccccacaacagaaagugcuucgacugcgaccagagaggccccaccuacgugaacaugaccgugggcagcuucgugugcaccagcugcagcggcagccugagaggccugaaccccccccacagagugaagagcaucagcaugaccaccuucacccagcaggagaucgaguuccugcagaagcacggcaacgaggugugcaagcagaucuggcugggccuguucgacgacagaagcagcgccauccccgacuucagagacccccagaaggugaaggaguuccugcaggagaaguacgagaagaagagaugguacgugccccccgagcaggccaaggugguggccagcgugcacgccagcaucagcggcagcagcgccagcagcaccagcagcacccccgaggugaagccccugaagagccugcugggcgacagcgcccccacccugcaccugaacaagggcacccccagccagagccccguggugggcagaagccagggccagcagcaggagaagaagcaguucgaccugcugagcgaccugggcagcgacaucuucgccgcccccgccccccagagcaccgccaccgccaacuucgccaacuucgcccacuucaacagccacgccgcccagaacagcgccaacgccgacuucgccaacuucgacgccuucggccagagcagcggcagcagcaacuucggcggcuuccccaccgccagccacagccccuuccagccccagaccaccgccuucagaaugcugagcagcagcugcagcuucggcgaguucaccagcgccuucccccugcaggccacccacagcggcagcgccgccagcgugaacgccaacuucgcccacuucgacaacuuccccaagagcagcagcgccgacuucggcaccuucaacaccagccagagccaccagaccgccagcgccgugagcaaggugagcaccaacaaggccggccugcagaccgccgacaaguacgccgcccuggccaaccuggacaacaucuucagcgccggccagggcggcgaccagggcagcggcuucggcaccaccggcaaggcccccgugggcagcguggugagcgugcccagccagagcagcgccagcagcgacaaguacgccgcccuggccgagcuggacagcguguucagcagcgccgccaccagcagcaacgccuacaccagcaccagcaacgccagcagcaacguguucggcaccgugcccgugguggccagcgcccagacccagcccgccagcagcagcgugcccgcccccuucggcgccacccccagcaccaaccccuucguggccgccgccggccccagcguggccagcagcaccaaccccuuccagaccaacgccagaggcgccaccgccgccaccuucggcaccgccagcaugagcaugcccaccggcuucggcacccccgcccccuacagccugcccaccagcuucagcggcagcuuccagcagcccgccuuccccgcccaggccgccuucccccagcagaccgccuucagccagcagcccaacggcuucgccgccuucggccagaccaagcccguggugacccccuucggccagguggccgccgccggcgugagcagcaaccccuucaugaccggcgcccccaccggccaguuccccaccggcagcagcagcaccaaccccuuccuguaa

SEQ ID NO: 13397 - RNA, 1446 nt, Artificial Sequence
  AGFG2__Homo_sapiens__NP_006067
auggugauggccgccaagaagggccccggccccggcggcggcgugagcggcggcaaggccgaggccgaggccgccagcgagguguggugcagaagagugagagagcugggcggcugcagccaggccggcaacagacacugcuucgagugcgcccagagaggcgugaccuacguggacaucaccgugggcagcuucgugugcaccaccugcagcggccugcugagaggccugaaccccccccacagagugaagagcaucagcaugaccaccuucaccgagcccgaggugguguuccugcagagcagaggcaacgaggugugcagaaagaucuggcugggccuguucgacgccagaaccagccuggugcccgacagcagagacccccagaaggugaaggaguuccugcaggagaaguacgagaagaagagaugguacgugccccccgaccaggugaagggccccaccuacaccaagggcagcgccagcacccccgugcagggcagcauccccgagggcaagccccugagaacccugcugggcgaccccgcccccagccugagcguggccgccagcaccagcagccagcccgugagccagagccacgccagaaccagccaggccagaagcacccagccccccccccacagcagcgugaagaaggccagcaccgaccugcuggccgacaucggcggcgaccccuucgccgccccccagauggcccccgccuucgccgccuuccccgccuucggcggccagacccccagccagggcggcuucgccaacuucgacgccuucagcagcggccccagcagcagcguguucggcagccugccccccgccggccaggccagcuuccaggcccagcccacccccgccggcagcagccagggcacccccuucggcgccaccccccuggcccccgccagccagcccaacagccuggccgacgugggcagcuuccugggccccggcgugcccgccgccggcgugcccagcagccuguucggcauggccggccaggugcccccccugcagagcgugaccaugggcggcggcggcggcagcagcaccggccuggccuucggcgccuucaccaaccccuucaccgcccccgccgcccagagcccccugcccagcaccaaccccuuccagcccaacggccuggcccccggccccggcuucggcaugagcagcgccggccccggcuucccccaggccgugccccccaccggcgccuucgccagcagcuuccccgccccccuguuccccccccagaccccccuggugcagcagcagaacggcagcagcuucggcgaccugggcagcgccaagcugggccagagaccccugagccagcccgccggcaucagcaccaaccccuucaugaccggccccagcagcagccccuucgccagcaagccccccaccaccaaccccuuccuguaa

SEQ ID NO: 13398 - RNA, 2145 nt, Artificial Sequence
  AGGF1__Homo_sapiens__NP_060516
auggccagcgaggcccccagcccccccagaagcccccccccccccaccagccccgagcccgagcuggcccagcugagaagaaagguggagaagcuggagagagagcugagaagcugcaagagacaggugagagagaucgagaagcugcugcaccacaccgagagacuguaccagaacgccgagagcaacaaccaggagcugagaacccagguggaggagcugagcaagauccugcagagaggcagaaacgaggacaacaagaagagcgacguggaggugcagaccgagaaccacgcccccuggagcaucagcgacuacuucuaccagaccuacuacaacgacgugagccugcccaacaaggugaccgagcugagcgaccagcaggaccaggccaucgagaccagcauccugaacagcaaggaccaccugcagguggagaacgacgccuaccccggcaccgacagaaccgagaacgugaaguacagacagguggaccacuucgccagcaacagccaggagcccgccagcgcccuggccaccgaggacaccagccuggagggcagcagccuggccgagagccugagagccgccgccgaggccgccgugagccagaccggcuucagcuacgacgagaacaccggccuguacuucgaccacagcaccggcuucuacuacgacagcgagaaccagcuguacuacgaccccagcaccggcaucuacuacuacugcgacguggagagcggcagauaccaguuccacagcagaguggaccugcagcccuaccccaccagcagcaccaagcagagcaaggacaagaagcugaagaagaagagaaaggaccccgacagcagcgccaccaacgaggagaaggaccugaacagcgaggaccagaaggccuucagcguggagcacaccagcugcaacgaggaggagaacuucgccaacaugaagaagaaggccaagaucggcauccaccacaagaacagcccccccaaggugaccgugcccaccagcggcaacaccaucgagagcccccugcacgagaacaucagcaacagcaccagcuucaaggacgagaagaucauggagaccgacagcgagcccgaggagggcgagaucaccgacagccagaccgaggacagcuacgacgaggccaucaccagcgagggcaacgugaccgccgaggacagcgaggacgaggacgaggacaagaucuggccccccugcaucagagugaucgugaucagaagccccgugcugcagaucggcagccuguucaucaucaccgccgugaaccccgccaccaucggcagagagaaggacauggagcacacccugagaauccccgaggugggcgugagcaaguuccacgccgagaucuacuucgaccacgaccugcagagcuacgugcugguggaccagggcagccagaacggcaccaucgugaacggcaagcagauccugcagcccaagaccaagugcgaccccuacgugcuggagcacggcgacgaggugaagaucggcgagaccgugcugagcuuccacauccaccccggcagcgacaccugcgacggcugcgagcccggccaggugagagcccaccugagacuggacaagaaggacgagagcuucgugggccccacccugagcaaggaggagaaggagcuggagagaagaaaggagcugaagaagaucagagugaaguacggccugcagaacaccgaguacgaggacgagaagacccugaagaaccccaaguacaaggacagagccggcaagagaagagagcaggugggcagcgagggcaccuuccagagagacgacgcccccgccagcgugcacagcgagaucaccgacagcaacaagggcagaaagaugcuggagaagaugggcuggaagaagggcgagggccugggcaaggacggcggcggcaugaagacccccauccagcugcagcugagaagaacccacgccggccugggcaccggcaagcccagcagcuucgaggacgugcaccugcugcagaacaagaacaagaagaacugggacaaggccagagagagauucaccgagaacuuccccgagaccaagccccagaaggacgaccccggcaccaugcccugggugaagggcacccuggaguaa

SEQ ID NO: 13399 - RNA, 1053 nt, Artificial Sequence
  AGK__Homo_sapiens__XP_005250080
augaccguguucuucaagacccugagaaaccacuggaagaagaccaccgccggccugugccugcugaccuggggcggccacuggcuguacggcaagcacugcgacaaccugcugagaagagccgccugccaggaggcccagguguucggcaaccagcugaucccccccaacgcccaggugaagaaggccaccguguuccugaaccccgccgccugcaagggcaaggccagaacccuguucgagaagaacgccgcccccauccugcaccugagcggcauggacgugaccaucgugaagaccgacuacgagggccaggccaagaagcugcuggagcugauggagaacaccgacgugaucaucguggccggcggcgacggcacccugcaggagguggugaccggcgugcugagaagaaccgacgaggccaccuucagcaagauccccaucggcuucaucccccugggcgagaccagcagccugagccacacccuguucgccgagagcggcaacaaggugcagcacaucaccgacgccacccuggccaucgugaagggcgagaccgugccccuggacgugcugcagaucaagggcgagaaggagcagcccguguucgccaugaccggccugagauggggcagcuucagagacgccggcgugaaggugagcaaguacugguaccugggcccccugaagaucaaggccgcccacuucuucagcacccugaaggaguggccccagacccaccaggccagcaucagcuacaccggccccaccgagagaccccccaacgagcccgaggagacccccgugcagagacccagccuguacagaagaauccugagaagacuggccagcuacugggcccagccccaggacgcccugagccaggaggugagccccgagguguggaaggacgugcagcugagcaccaucgagcugagcaucaccaccagaaacaaccagcuggaccccaccagcaaggaggacuuccugaacaucugcaucgagcccgacaccaucagcaagggcgacuucaucaccaucggcaaguaa

SEQ ID NO: 13400 - RNA, 1338 nt, Artificial Sequence
  AGMO__Homo_sapiens__NP_001004320
augaagaaccccgaggcccagcaggacgugagcgugagccagggcuucagaaugcuguucuacaccaugaagcccagcgagaccagcuuccagacccuggaggaggugcccgacuacgugaagaaggccacccccuucuucaucagccugaugcugcuggagcugguggugagcuggauccugaagggcaagccccccggcagacuggacgacgcccugaccagcaucagcgccggcgugcugagcagacugcccagccuguucuucagaagcaucgagcugaccagcuacaucuacaucugggagaacuacagacuguucaaccugcccugggacagccccuggaccugguacagcgccuuccugggcguggacuucggcuacuacugguuccacagaauggcccacgaggugaacaucaugugggccggccaccagacccaccacagcagcgaggacuacaaccugagcaccgcccugagacagagcgugcugcagaucuacaccagcuggaucuucuacagcccccuggcccuguucaucccccccagcguguacgccgugcaccugcaguucaaccugcuguaccaguucuggauccacaccgaggugaucaacaaccugggcccccuggagcugauccugaacacccccagccaccacagagugcaccacggcagaaacagauacugcaucgacaagaacuacgccggcgugcugaucaucugggacaagaucuucggcaccuucgaggccgagaacgagaaggugguguacggccugacccaccccaucaacaccuucgagcccaucaaggugcaguuccaccaccuguucagcaucuggaccaccuucugggccacccccggcuucuucaacaaguucagcgugaucuucaagggccccggcuggggccccggcaagcccagacugggccugagcgaggagauccccgaggugaccggcaaggaggugcccuucagcagcagcagcagccagcugcugaagaucuacaccguggugcaguucgcccugaugcuggccuucuacgaggagaccuucgccgacaccgccgcccugagccaggugacccugcugcugagagugugcuucaucauccugacccugaccagcaucggcuuccugcuggaccagagacccaaggccgccaucauggagacccugagaugccugauguuccugaugcuguacagauucggccaccugaagccccuggugcccagccugagcagcgccuucgagaucguguucagcaucugcaucgccuucuggggcgugagaagcaugaagcagcugaccagccaccccuggaaguaa

SEQ ID NO: 13401 - RNA, 2478 nt, Artificial Sequence
  AGO2__Homo_sapiens__NP_001158095
auguacagcggcgccggccccgcccuggccccccccgccccccccccccccauccagggcuacgccuucaagcccccccccagacccgacuucggcaccagcggcagaaccaucaagcugcaggccaacuucuucgagauggacauccccaagaucgacaucuaccacuacgagcuggacaucaagcccgagaagugccccagaagagugaacagagagaucguggagcacauggugcagcacuucaagacccagaucuucggcgacagaaagcccguguucgacggcagaaagaaccuguacaccgccaugccccugcccaucggcagagacaagguggagcuggaggugacccugcccggcgagggcaaggacagaaucuucaaggugagcaucaagugggugagcugcgugagccugcaggcccugcacgacgcccugagcggcagacugcccagcgugcccuucgagaccauccaggcccuggacguggugaugagacaccugcccagcaugagauacacccccgugggcagaagcuucuucaccgccagcgagggcugcagcaacccccugggcggcggcagagaggugugguucggcuuccaccagagcgugagacccagccuguggaagaugaugcugaacaucgacgugagcgccaccgccuucuacaaggcccagcccgugaucgaguucgugugcgaggugcuggacuucaagagcaucgaggagcagcagaagccccugaccgacagccagagagugaaguucaccaaggagaucaagggccugaagguggagaucacccacugcggccagaugaagagaaaguacagagugugcaacgugaccagaagacccgccagccaccagaccuucccccugcagcaggagagcggccagaccguggagugcaccguggcccaguacuucaaggacagacacaagcuggugcugagauacccccaccugcccugccugcaggugggccaggagcagaagcacaccuaccugccccuggaggugugcaacaucguggccggccagagaugcaucaagaagcugaccgacaaccagaccagcaccaugaucagagccaccgccagaagcgcccccgacagacaggaggagaucagcaagcugaugagaagcgccagcuucaacaccgaccccuacgugagagaguucggcaucauggugaaggacgagaugaccgacgugaccggcagagugcugcagccccccagcauccuguacggcggcagaaacaaggccaucgccacccccgugcagggcgugugggacaugagaaacaagcaguuccacaccggcaucgagaucaaggugugggccaucgccugcuucgccccccagagacagugcaccgaggugcaccugaagagcuucaccgagcagcugagaaagaucagcagagacgccggcaugcccauccagggccagcccugcuucugcaaguacgcccagggcgccgacagcguggagcccauguucagacaccugaagaacaccuacgccggccugcagcuggugguggugauccugcccggcaagacccccguguacgccgaggugaagagagugggcgacaccgugcugggcauggccacccagugcgugcagaugaagaacgugcagagaaccaccccccagacccugagcaaccugugccugaagaucaacgugaagcugggcggcgugaacaacauccugcugccccagggcagaccccccguguuccagcagcccgugaucuuccugggcgccgacgugacccacccccccgccggcgacggcaagaagcccagcaucgccgccguggugggcagcauggacgcccaccccaacagauacugcgccaccgugagagugcagcagcacagacaggagaucauccaggaccuggccgccauggugagagagcugcugauccaguucuacaagagcaccagauucaagcccaccagaaucaucuucuacagagacggcgugagcgagggccaguuccagcaggugcugcaccacgagcugcuggccaucagagaggccugcaucaagcuggagaaggacuaccagcccggcaucaccuucaucguggugcagaagagacaccacaccagacuguucugcaccgacaagaacgagagaggcaccagcagacccagccacuaccacgugcugugggacgacaacagauucagcagcgacgagcugcagauccugaccuaccagcugugccacaccuacgugagaugcaccagaagcgugagcauccccgcccccgccuacuacgcccaccugguggccuucagagccagauaccaccugguggacaaggagcacgacagcgccgagggcagccacaccagcggccagagcaacggcagagaccaccaggcccuggccaaggccgugcaggugcaccaggacacccugagaaccauguacuucgccuaa

SEQ ID NO: 13402 - RNA, 864 nt, Artificial Sequence
  AGPAT1__Homo_sapiens__XP_005248862
augguggccagaauggaccuguggcccggcgccuggaugcugcugcugcugcuguuccugcugcugcuguuccugcugcccacccugugguucugcagccccagcgccaaguacuucuucaagauggccuucuacaacggcuggauccuguuccuggccgugcuggccauccccgugugcgccgugagaggcagaaacguggagaacaugaagauccugagacugaugcugcugcacaucaaguaccuguacggcaucagaguggaggugagaggcgcccaccacuucccccccagccagcccuacgugguggugagcaaccaccagagcagccuggaccugcugggcaugauggaggugcugcccggcagaugcgugcccaucgccaagagagagcugcugugggccggcagcgccggccuggccugcuggcuggccggcgugaucuucaucgacagaaagagaaccggcgacgccaucagcgugaugagcgagguggcccagacccugcugacccaggacgugagaguguggguguuccccgagggcaccagaaaccacaacggcagcaugcugcccuucaagagaggcgccuuccaccuggccgugcaggcccaggugcccaucgugcccaucgugaugagcagcuaccaggacuucuacugcaagaaggagagaagauucaccagcggccagugccaggugagagugcugccccccgugcccaccgagggccugacccccgacgacgugcccgcccuggccgacagagugagacacagcaugcugaccguguucagagagaucagcaccgacggcagaggcggcggcgacuaccugaagaagcccggcggcggcggcuaa

SEQ ID NO: 13403 - RNA, 741 nt, Artificial Sequence
  AGPAT2__Homo_sapiens__NP_001012745
auggagcuguggcccugccuggccgccgcccugcugcugcugcugcugcuggugcagcugagcagagccgccgaguucuacgccaagguggcccuguacugcgcccugugcuucaccgugagcgccguggccagccuggugugccugcugagacacggcggcagaaccguggagaacaugagcaucaucggcugguucgugagaagcuucaaguacuucuacggccugagauucgaggugagagaccccagaagacugcaggaggccagacccugcgugaucgugagcaaccaccagagcauccuggacaugaugggccugauggaggugcugcccgagagaugcgugcagaucgccaagagagagcugcuguuccugggccccgugggccugaucauguaccugggcggcguguucuucaucaacagacagagaagcagcaccgccaugaccgugauggccgaccugggcgagagaauggugagagagaacgugcccaucgugcccgugguguacagcagcuucagcagcuucuacaacaccaagaagaaguucuucaccagcggcaccgugaccgugcaggugcuggaggccauccccaccagcggccugaccgccgccgacgugcccgcccugguggacaccugccacagagccaugagaaccaccuuccugcacaucagcaagaccccccaggagaacggcgccaccgccggcagcggcgugcagcccgcccaguaa

SEQ ID NO: 13404 - RNA, 1131 nt, Artificial Sequence
  AGPAT3__Homo_sapiens__XP_006724093
augggccugcuggccuuccugaagacccaguucgugcugcaccugcuggugggcuucguguucguggugagcggccuggugaucaacuucgugcagcugugcacccuggcccuguggcccgugagcaagcagcuguacagaagacugaacugcagacuggccuacagccuguggagccagcuggugaugcugcuggagugguggagcugcaccgagugcacccuguucaccgaccaggccaccguggagagauucggcaaggagcacgccgugaucauccugaaccacaacuucgagaucgacuuccugugcggcuggaccaugugcgagagauucggcgugcugggcagcagcaaggugcuggccaagaaggagcugcuguacgugccccugaucggcuggaccugguacuuccuggagaucguguucugcaagagaaagugggaggaggacagagacaccgugguggagggccugagaagacugagcgacuaccccgaguacaugugguuccugcuguacugcgagggcaccagauucaccgagaccaagcacagagugagcauggagguggccgccgccaagggccugcccgugcugaaguaccaccugcugcccagaaccaagggcuucaccaccgccgugaagugccugagaggcaccguggccgccguguacgacgugacccugaacuucagaggcaacaagaaccccagccugcugggcauccuguacggcaagaaguacgaggccgacaugugcgugagaagauucccccuggaggacaucccccuggacgagaaggaggccgcccaguggcugcacaagcuguaccaggagaaggacgcccugcaggagaucuacaaccagaagggcauguuccccggcgagcaguucaagcccgccagaagacccuggacccugcugaacuuccugagcugggccaccauccugcugagcccccuguucagcuucgugcugggcguguucgccagcggcagcccccugcugauccugaccuuccugggcuucgugggcgccgccagcuucggcgugagaagacugaucggcgugaccgagaucgagaagggcagcagcuacggcaaccaggaguucaagaagaaggaguaa

SEQ ID NO: 13405 - RNA, 1137 nt, Artificial Sequence
  AGPAT4__Homo_sapiens__NP_064518
auggaccuggccggccugcugaagagccaguuccugugccaccugguguucugcuacguguucaucgccagcggccugaucaucaacaccauccagcuguucacccugcugcuguggcccaucaacaagcagcuguucagaaagaucaacugcagacugagcuacugcaucagcagccagcuggugaugcugcuggagugguggagcggcaccgagugcaccaucuucaccgaccccagagccuaccugaaguacggcaaggagaacgccaucguggugcugaaccacaaguucgagaucgacuuccugugcggcuggagccugagcgagagauucggccugcugggcggcagcaaggugcuggccaagaaggagcuggccuacgugcccaucaucggcuggaugugguacuucaccgagaugguguucugcagcagaaagugggagcaggacagaaagaccguggccaccagccugcagcaccugagagacuaccccgagaaguacuucuuccugauccacugcgagggcaccagauucaccgagaagaagcacgagaucagcaugcagguggccagagccaagggccugcccagacugaagcaccaccugcugcccagaaccaagggcuucgccaucaccgugagaagccugagaaacguggugagcgccguguacgacugcacccugaacuucagaaacaacgagaaccccacccugcugggcgugcugaacggcaagaaguaccacgccgaccuguacgugagaagaaucccccuggaggacauccccgaggacgacgacgagugcagcgccuggcugcacaagcuguaccaggagaaggacgccuuccaggaggaguacuacagaaccggcaccuuccccgagacccccauggugccccccagaagacccuggacccuggugaacuggcuguucugggccagccuggugcuguaccccuucuuccaguuccuggugagcaugaucagaagcggcagcagccugacccuggccagcuucauccugguguucuucguggccagcgugggcgugagauggaugaucggcgugaccgagaucgacaagggcagcgccuacggcaacagcgacagcaagcagaagcugaacgacuaa

SEQ ID NO: 13406 - RNA, 1305 nt, Artificial Sequence
  AGPAT9__Homo_sapiens__NP_001243350
auggagggcgccgagcuggccggcaagauccugagcaccuggcugacccuggugcugggcuucauccugcugcccagcguguucggcgugagccugggcaucagcgagaucuacaugaagauccuggugaagacccuggagugggccaccaucagaaucgagaagggcacccccaaggagagcauccugaagaacagcgccagcgugggcaucauccagagagacgagagccccauggagaagggccugagcggccugagaggcagagacuucgagcugagcgacguguucuacuucagcaagaagggccuggaggccaucguggaggacgaggugacccagagauucagcagcgaggagcuggugagcuggaaccugcugaccagaaccaacgugaacuuccaguacaucagccugagacugaccauggugugggugcugggcgugaucgugagauacugcgugcugcugccccugagagugacccuggccuucaucggcaucagccugcuggugaucggcaccacccuggugggccagcugcccgacagcagccugaagaacuggcugagcgagcuggugcaccugaccugcugcagaaucugcgugagagcccugagcggcaccauccacuaccacaacaagcaguacagaccccagaagggcggcaucugcguggccaaccacaccagccccaucgacgugcugauccugaccaccgacggcugcuacgccauggugggccaggugcacggcggccugaugggcaucauccagagagccauggugaaggccugcccccacgugugguucgagagaagcgagaugaaggacagacaccuggugaccaagagacugaaggagcacaucgccgacaagaagaagcugcccauccugaucuuccccgagggcaccugcaucaacaacaccagcgugaugauguucaagaagggcagcuucgagaucggcggcaccauccaccccguggccaucaaguacaacccccaguucggcgacgccuucuggaacagcagcaaguacaacauggugagcuaccugcugagaaugaugaccagcugggccaucgugugcgacgugugguacaugccccccaugaccagagaggagggcgaggacgccgugcaguucgccaacagagugaagagcgccaucgccauccagggcggccugaccgagcugcccugggacggcggccugaagagagccaaggugaaggacaucuucaaggaggagcagcagaagaacuacagcaagaugaucgugggcaacggcagccugagcuaa

SEQ ID NO: 13407 - RNA, 1977 nt, Artificial Sequence
  AGPS__Homo_sapiens__NP_003650
auggccgaggccgccgccgccgccggcggcaccggccugggcgccggcgccagcuacggcagcgccgccgacagagacagagaccccgaccccgacagagccggcagaagacugagagugcugagcggccaccugcugggcagacccagagaggcccugagcaccaacgagugcaaggccagaagagccgccagcgccgccaccgccgcccccaccgccacccccgccgcccaggagagcggcaccauccccaagaagagacaggaggugaugaaguggaacggcuggggcuacaacgacagcaaguucaucuucaacaagaagggccagaucgagcugaccggcaagagauacccccugagcggcaugggccugcccaccuucaaggaguggauccagaacacccugggcgugaacguggagcacaagaccaccagcaaggccagccugaaccccagcgacaccccccccagcguggugaacgaggacuuccugcacgaccugaaggagaccaacaucagcuacagccaggaggccgacgacagaguguucagagcccacggccacugccugcacgagaucuuccugcugagagagggcauguucgagagaauccccgacaucgugcuguggcccaccugccacgacgacguggugaagaucgugaaccuggccugcaaguacaaccugugcaucauccccaucggcggcggcaccagcgugagcuacggccugaugugccccgccgacgagaccagaaccaucaucagccuggacaccagccagaugaacagaauccuguggguggacgagaacaaccugaccgcccacguggaggccggcaucaccggccaggagcuggagagacagcugaaggagagcggcuacugcaccggccacgagcccgacagccuggaguucagcaccgugggcggcugggugagcaccagagccagcggcaugaagaagaacaucuacggcaacaucgaggaccugguggugcacaucaagauggugacccccagaggcaucaucgagaagagcugccagggccccagaaugagcaccggccccgacauccaccacuucaucaugggcagcgagggcacccugggcgugaucaccgaggccaccaucaagaucagacccgugcccgaguaccagaaguacggcagcguggccuuccccaacuucgagcagggcguggccugccugagagagaucgccaagcagagaugcgcccccgccagcaucagacugauggacaacaagcaguuccaguucggccacgcccugaagccccaggugagcagcaucuucaccagcuuccuggacggccugaagaaguucuacaucaccaaguucaagggcuucgaccccaaccagcugagcguggccacccugcuguucgagggcgacagagagaaggugcugcagcacgagaagcagguguacgacaucgccgccaaguucggcggccuggccgccggcgaggacaacggccagagaggcuaccugcugaccuacgugaucgccuacaucagagaccuggcccuggaguacuacgugcugggcgagagcuucgagaccagcgcccccugggacagagugguggaccugugcagaaacgugaaggagagaaucaccagagagugcaaggagaagggcgugcaguucgcccccuucagcaccugcagagugacccagaccuacgacgccggcgccugcaucuacuucuacuucgccuucaacuacagaggcaucagcgacccccugaccguguucgagcagaccgaggccgccgccagagaggagauccuggccaacggcggcagccugagccaccaccacggcgugggcaagcugagaaagcaguggcugaaggagagcaucagcgacgugggcuucggcaugcugaagagcgugaaggaguacguggaccccaacaacaucuucggcaacagaaaccugcuguaa

SEQ ID NO: 13408 - RNA, 528 nt, Artificial Sequence
  AGR2__Homo_sapiens__NP_006399
auggagaagauccccgugagcgccuuccugcugcugguggcccugagcuacacccuggccagagacaccaccgugaagcccggcgccaagaaggacaccaaggacagcagacccaagcugccccagacccugagcagaggcuggggcgaccagcugaucuggacccagaccuacgaggaggcccuguacaagagcaagaccagcaacaagccccugaugaucauccaccaccuggacgagugcccccacagccaggcccugaagaagguguucgccgagaacaaggagauccagaagcuggccgagcaguucgugcugcugaaccugguguacgagaccaccgacaagcaccugagccccgacggccaguacgugcccagaaucauguucguggaccccagccugaccgugagagccgacaucaccggcagauacagcaacagacuguacgccuacgagcccgccgacaccgcccugcugcuggacaacaugaagaaggcccugaagcugcugaagaccgagcuguaa

SEQ ID NO: 13409 - RNA, 501 nt, Artificial Sequence
  AGR3__Homo_sapiens__NP_789783
augaugcugcacagcgcccugggccugugccugcugcuggugaccgugagcagcaaccuggccaucgccaucaagaaggagaagagacccccccagacccugagcagaggcuggggcgacgacaucaccugggugcagaccuacgaggagggccuguucuacgcccagaagagcaagaagccccugauggugauccaccaccuggaggacugccaguacagccaggcccugaagaagguguucgcccagaacgaggagauccaggagauggcccagaacaaguucaucaugcugaaccugaugcacgagaccaccgacaagaaccugagccccgacggccaguacgugcccagaaucauguucguggaccccagccugaccgugagagccgacaucgccggcagauacagcaacagacuguacaccuacgagcccagagaccugccccugcugaucgagaacaugaagaaggcccugagacugauccagagcgagcuguaa

SEQ ID NO: 13410 - RNA, 4416 nt, Artificial Sequence
  AGRN__Homo_sapiens__XP_011539733
augcugcacgugcacgccugcacccaccagaucagccugcacguggccagcgccggccccugcgagaccugcggcgacgccgugugcgccuucggcgccgugugcagcgccggccagugcgugugccccagaugcgagcaccccccccccggccccgugugcggcagcgacggcgugaccuacggcagcgccugcgagcugagagaggccgccugccugcagcagacccagaucgaggaggccagagccggccccugcgagcaggccgagugcggcagcggcggcagcggcagcggcgaggacggcgacugcgagcaggagcugugcagacagagaggcggcaucugggacgaggacagcgaggacggccccugcgugugcgacuucagcugccagagcgugcccggcagccccgugugcggcagcgacggcgugaccuacagcaccgagugcgagcugaagaaggccagaugcgagagccagagaggccuguacguggccgcccagggcgccugcagaggccccaccuucgccccccugccccccguggccccccugcacugcgcccagacccccuacggcugcugccaggacaacaucaccgccgccagaggcgugggccuggccggcugccccagcgccugccagugcaacccccacggcagcuacggcggcaccugcgaccccgccaccggccagugcagcugcagacccggcgugggcggccugagaugcgacagaugcgagcccggcuucuggaacuucagaggcaucgugaccgacggcagaagcggcugcacccccugcagcugcgacccccagggcgccgugagagacgacugcgagcagaugaccggccugugcagcugcaagcccggcguggccggccccaagugcggccagugccccgacggcagagcccugggccccgccggcugcgaggccgacgccagcgcccccgccaccugcgccgagaugagaugcgaguucggcgccagaugcguggaggagagcggcagcgcccacugcgugugccccaugcugaccugccccgaggccaacgccaccaaggugugcggcagcgacggcgugaccuacggcaacgagugccagcugaagaccaucgccugcagacagggccugcagaucagcauccagagccugggccccugccaggaggccguggcccccagcacccaccccaccagcgccagcgugaccgugaccacccccggccugcugcugagccaggcccugcccgccccccccggcgcccugccccuggcccccagcagcaccgcccacagccagaccacccccccccccagcagcagacccagaaccaccgccagcgugcccagaaccaccguguggcccgugcugaccgugccccccaccgcccccagccccgcccccagccugguggccagcgccuucggcgagagcggcagcaccgacggcagcagcgacgaggagcugagcggcgaccaggaggccagcggcggcggcagcggcggccuggagccccuggagggcagcagcguggccacccccggcccccccguggagagagccagcugcuacaacagcgcccugggcugcugcagcgacggcaagacccccagccuggacgccgagggcagcaacugccccgccaccaagguguuccagggcgugcuggagcuggagggcguggagggccaggagcuguucuacacccccgagauggccgaccccaagagcgagcuguucggcgagaccgccagaagcaucgagagcacccuggacgaccuguucagaaacagcgacgugaagaaggacuucagaagcgugagacugagagaccugggccccggcaagagcgugagagccaucguggacgugcacuucgaccccaccaccgccuucagagcccccgacguggccagagcccugcugagacagauccaggugagcagaagaagaagccugggcgugagaagaccccugcaggagcacgugagauucauggacuucgacugguuccccgccuucaucaccggcgccaccagcggcgccaucgccgccggcgccaccgccagagccaccaccgccagcagacugcccagcagcgccgugacccccagagccccccaccccagccacaccagccagcccguggccaagaccaccgccgcccccaccaccagaagaccccccaccaccgcccccagcagagugcccggcagaagaccccccgccccccagcagccccccaagcccugcgacagccagcccugcuuccacggcggcaccugccaggacugggcccugggcggcggcuucaccugcagcugccccgccggcagaggcggcgccgugugcgagaaggugcugggcgcccccgugcccgccuucgagggcagaagcuuccuggccuuccccacccugagagccuaccacacccugagacuggcccuggaguucagagcccuggagccccagggccugcugcuguacaacggcaacgccagaggcaaggacuuccuggcccuggcccugcuggacggcagagugcagcugagauucgacaccggcagcggccccgccgugcugaccagcgccgugcccguggagcccggccaguggcacagacuggagcugagcagacacuggagaagaggcacccugagcguggacggcgagacccccgugcugggcgagagccccagcggcaccgacggccugaaccuggacaccgaccuguucgugggcggcgugcccgaggaccaggccgccguggcccuggagagaaccuucgugggcgccggccugagaggcugcaucagacugcuggacgugaacaaccagagacuggagcugggcaucggccccggcgccgccaccagaggcagcggcgugggcgagugcggcgaccaccccugccugcccaaccccugccacggcggcgcccccugccagaaccuggaggccggcagauuccacugccagugcccccccggcagagugggccccaccugcgccgacgagaagagccccugccagcccaaccccugccacggcgccgcccccugcagagugcugcccgagggcggcgcccagugcgagugcccccugggcagagagggcaccuucugccagaccgccagcggccaggacggcagcggccccuuccuggccgacuucaacggcuucagccaccuggagcugagaggccugcacaccuucgccagagaccugggcgagaagauggcccuggaggugguguuccuggccagaggccccagcggccugcugcuguacaacggccagaagaccgacggcaagggcgacuucgugagccuggcccugagagacagaagacuggaguucagauacgaccugggcaagggcgccgccgugaucagaagcagagagcccgugacccugggcgccuggaccagagugagccuggagagaaacggcagaaagggcgcccugagagugggcgacggccccagagugcugggcgagagccccaagagcagaaaggugccccacaccgugcugaaccugaaggagccccuguacgugggcggcgcccccgacuucagcaagcuggccagagccgccgccgugagcagcggcuucgacggcgccauccagcuggugagccugggcggcagacagcugcugacccccgagcacgugcugagacagguggacgugaccagcuucgccggccaccccugcaccagagccagcggccaccccugccugaacggcgccagcugcgugcccagagaggccgccuacgugugccugugccccggcggcuucagcggcccccacugcgagaagggccugguggagaagagcgccggcgacguggacacccuggccuucgacggcagaaccuucguggaguaccugaacgccgugaccgagagcgagaaggcccugcagagcaaccacuucgagcugagccugagaaccgaggccacccagggccuggugcuguggagcggcaaggccaccgagagagccgacuacguggcccuggccaucguggacggccaccugcagcugagcuacaaccugggcagccagcccguggugcugagaagcaccgugcccgugaacaccaacagauggcugagagugguggcccacagagagcagagagagggcagccugcaggugggcaacgaggcccccgugaccggcagcagcccccugggcgccacccagcuggacaccgacggcgcccuguggcugggcggccugcccgagcugcccgugggccccgcccugcccaaggccuacggcaccggcuucgugggcugccugagagacgugguggugggcagacacccccugcaccugcuggaggacgccgugaccaagcccgagcugagacccugccccacccccuaa

SEQ ID NO: 13411 - RNA, 399 nt, Artificial Sequence
  AGRP__Homo_sapiens__XP_011521229
augcugaccgccgccgugcugagcugcgcccugcugcuggcccugcccgccaccagaggcgcccagaugggccuggcccccauggagggcaucagaagacccgaccaggcccugcugcccgagcugcccggccugggccugagagccccccugaagaagaccaccgccgagcaggccgaggaggaccugcugcaggaggcccaggcccuggccgaggugcuggaccugcaggacagagagcccagaagcagcagaagaugcgugagacugcacgagagcugccugggccagcaggugcccugcugcgaccccugcgccaccugcuacugcagauucuucaacgccuucugcuacugcagaaagcugggcaccgccaugaaccccugcagcagaaccuaa

SEQ ID NO: 13412 - RNA, 1458 nt, Artificial Sequence
  AGT__Homo_sapiens__NP_000020
augagaaagagagccccccagagcgagauggcccccgccggcgugagccugagagccaccauccugugccugcuggccugggccggccuggccgccggcgacagaguguacauccaccccuuccaccuggugauccacaacgagagcaccugcgagcagcuggccaaggccaacgccggcaagcccaaggaccccaccuucauccccgcccccauccaggccaagaccagccccguggacgagaaggcccugcaggaccagcuggugcugguggccgccaagcuggacaccgaggacaagcugagagccgccauggugggcaugcuggccaacuuccugggcuucagaaucuacggcaugcacagcgagcuguggggcguggugcacggcgccaccgugcugagccccaccgccguguucggcacccuggccagccuguaccugggcgcccuggaccacaccgccgacagacugcaggccauccugggcgugcccuggaaggacaagaacugcaccagcagacuggacgcccacaaggugcugagcgcccugcaggccgugcagggccugcugguggcccagggcagagccgacagccaggcccagcugcugcugagcaccguggugggcguguucaccgcccccggccugcaccugaagcagcccuucgugcagggccuggcccuguacacccccguggugcugcccagaagccuggacuucaccgagcuggacguggccgccgagaagaucgacagauucaugcaggccgugaccggcuggaagaccggcugcagccugaugggcgccagcguggacagcacccuggccuucaacaccuacgugcacuuccagggcaagaugaagggcuucagccugcuggccgagccccaggaguucuggguggacaacagcaccagcgugagcgugcccaugcugagcggcaugggcaccuuccagcacuggagcgacauccaggacaacuucagcgugacccaggugcccuucaccgagagcgccugccugcugcugauccagccccacuacgccagcgaccuggacaagguggagggccugaccuuccagcagaacagccugaacuggaugaagaagcugagccccagaaccauccaccugaccaugccccagcuggugcugcagggcagcuacgaccugcaggaccugcuggcccaggccgagcugcccgccauccugcacaccgagcugaaccugcagaagcugagcaacgacagaaucagagugggcgaggugcugaacagcaucuucuucgagcuggaggccgacgagagagagcccaccgagagcacccagcagcugaacaagcccgaggugcuggaggugacccugaacagacccuuccuguucgccguguacgaccagagcgccaccgcccugcacuuccugggcagaguggccaacccccugagcaccgccuaa

SEQ ID NO: 13413 - RNA, 3837 nt, Artificial Sequence
  AGTPBP1__Homo_sapiens__NP_001273644
augagaaccggcagcgccgccagcagcgccgccgccgccgccgccgccgccgccgccagcgccagccccgccaccggcgugugcaugaagacccccggcggcggcagaagaggcaucagaagagaccccggcgccgagcccggcgccgccgcccugagaggccccagacagagacccauccugagcagacugaccaacaacagcagaaucgugggccugcuggcccagcuggagaagaucaacgccgagcccagcgagagcgacaccgccagauacgugaccagcaagauccugcaccuggcccagagccaggagaagaccagaagagagaugaccgccaagggcagcaccggcauggagauccugcugagcacccuggagaacaccaaggaccugcagaccacccugaacauccugagcauccugguggagcuggugagcgccggcggcggcagaagagugagcuuccuggugaccaagggcggcagccagauccugcugcagcugcugaugaacgccagcaaggagagccccccccacgaggaccugauggugcagauccacagcauccuggccaagaucggccccaaggacaagaaguucggcgugaaggccagaaucaacggcgcccugaacaucacccugaaccuggugaagcagaaccugcagaaccacagacuggugcugcccugccugcagcugcugagaguguacagcgccaacagcgugaacagcgugagccugggcaagaacggcgugguggagcugauguucaagaucaucggccccuucagcaagaagaacagcagccugaucaagguggcccuggacacccuggccgcccugcugaagagcaagaccaacgccagaagagccguggacagaggcuacgugcaggugcugcugaccaucuacguggacuggcacagacacgacaacagacacagaaacaugcugaucagaaagggcauccugcagagccugaagagcgugaccaacaucaagcugggcagaaaggccuucaucgacgccaacggcaugaagauccuguacaacaccagccaggagugccuggccgugagaacccuggacccccuggugaacaccagcagccugaucaugagaaagugcuuccccaagaacagacugccccugcccaccaucaagagcagcuuccacuuccagcugcccgugauccccgugaccggccccguggcccagcuguacagccugccccccgagguggacgacgugguggacgagagcgacgacaacgacgacaucgacguggaggccgagaacgagaccgagaacgaggacgaccuggaccagaacuucaagaacgacgacaucgagaccgacaucaacaagcugaagccccagcaggagcccggcagaaccaucgaggaccugaagauguacgagcaccuguuccccgagcugguggacgacuuccaggacuacgaccugaucagcaaggagcccaagcccuucguguucgagggcaaggugagaggccccaucguggugcccaccgccggcgaggagaccagcggcaacagcggcaaccugagaaagguggugaugaaggagaacaucagcagcaagggcgacgagggcgagaagaagagcaccuucauggaccuggccaaggaggacaucaaggacaacgacagaacccugcagcagcagcccggcgaccagaacagaaccaucagcagcgugcacggccugaacaacgacaucgugaaggcccuggacagaaucacccugcagaacauccccagccagaccgcccccggcuucaccgccgagaugaagaaggacugcagccugccccugaccgugcugaccugcgccaaggccugcccccacauggccaccugcggcaacgugcuguucgagggcagaaccgugcagcugggcaagcugugcugcaccggcguggagaccgaggacgacgaggacaccgagagcaacagcagcguggagcaggccagcguggaggugcccgacggccccacccugcacgaccccgaccuguacaucgagaucgugaagaacaccaagagcgugcccgaguacagcgagguggccuaccccgacuacuucggccacauccccccccccuucaaggagcccauccuggagagacccuacggcgugcagagaaccaagaucgcccaggacaucgagagacugauccaccagagcgacaucaucgacagagugguguacgaccuggacaaccccaacuacaccauccccgaggagggcgacauccugaaguucaacagcaaguucgagagcggcaaccugagaaaggugauccagaucagaaagaacgaguacgaccugauccugaacagcgacaucaacagcaaccacuaccaccagugguucuacuucgaggugagcggcaugagacccggcguggccuacagauucaacaucaucaacugcgagaagagcaacagccaguucaacuacggcaugcagccccugauguacagcgugcaggaggcccugaacgccagacccugguggaucagaaugggcaccgacaucugcuacuacaagaaccacuucagcagaagcagcguggccgccggcggccagaagggcaagagcuacuacaccaucaccuucaccgugaacuucccccacaaggacgacgugugcuacuucgccuaccacuaccccuacaccuacagcacccugcagaugcaccugcagaagcuggagagcgcccacaacccccagcagaucuacuucagaaaggacgugcugugcgagacccugagcggcaacagcugcccccuggugaccaucaccgccaugcccgagagcaacuacuacgagcacaucugccacuucagaaacagacccuacguguuccugagcgccagagugcaccccggcgagaccaacgccagcugggugaugaagggcacccuggaguaccugaugagcaacaaccccaccgcccagagccugagagagagcuacaucuucaagaucgugcccaugcugaaccccgacggcgugaucaacggcaaccacagaugcagccugagcggcgaggaccugaacagacaguggcagagccccagccccgaccugcaccccaccaucuaccacgccaagggccugcugcaguaccuggccgccgugaagagacugccccugguguacugcgacuaccacggccacagcagaaagaagaacguguucauguacggcugcagcaucaaggagaccguguggcacaccaacgacaacgccaccagcugcgacgugguggaggacaccggcuacagaacccugcccaagauccugagccacaucgcccccgccuucugcaugagcagcugcagcuucgugguggagaagagcaaggagagcaccgccagaguggugguguggagagagaucggcgugcagagaagcuacaccauggagagcacccugugcggcugcgaccagggcaaguacaagggccugcagaucggcaccagagagcuggaggagaugggcgccaaguucugcgugggccugcugagacugaagagacugaccagcccccuggaguacaaccugcccagcagccugcuggacuucgagaacgaccugaucgagagcagcugcaaggugaccagccccaccaccuacgugcuggacgaggacgagcccagauuccuggaggagguggacuacagcgccgagagcaacgacgagcuggacaucgagcuggccgagaacgugggcgacuacgagcccagcgcccaggaggaggugcugagcgacagcgagcugagcagaaccuaccugcccuaa

SEQ ID NO: 13414 - RNA, 1185 nt, Artificial Sequence
  AGTR1__Homo_sapiens__NP_004826
augaagaagaugaaccacaagagcaccgacagccccaaggccccccagcugagaggcggcguguucgacaucguguucgccaccaacagcacccaggugaucaagaugauccugaacagcagcaccgaggacggcaucaagagaauccaggacgacugccccaaggccggcagacacaacuacaucuucgugaugauccccacccuguacagcaucaucuucguggugggcaucuucggcaacagccugguggugaucgugaucuacuucuacaugaagcugaagaccguggccagcguguuccugcugaaccuggcccuggccgaccugugcuuccugcugacccugccccugugggccguguacaccgccauggaguacagauggcccuucggcaacuaccugugcaagaucgccagcgccagcgugagcuucaaccuguacgccagcguguuccugcugaccugccugagcaucgacagauaccuggccaucgugcaccccaugaagagcagacugagaagaaccaugcugguggccaaggugaccugcaucaucaucuggcugcuggccggccuggccagccugcccgccaucauccacagaaacguguucuucaucgagaacaccaacaucaccgugugcgccuuccacuacgagagccagaacagcacccugcccaucggccugggccugaccaagaacauccugggcuuccuguuccccuuccugaucauccugaccagcuacacccugaucuggaaggcccugaagaaggccuacgagauccagaagaacaagcccagaaacgacgacaucuucaagaucaucauggccaucgugcuguucuucuucuucagcuggaucccccaccagaucuucaccuuccuggacgugcugauccagcugggcaucaucagagacugcagaaucgccgacaucguggacaccgccaugcccaucaccaucugcaucgccuacuucaacaacugccugaacccccuguucuacggcuuccugggcaagaaguucaagagauacuuccugcagcugcugaaguacaucccccccaaggccaagagccacagcaaccugagcaccaagaugagcacccugagcuacagacccagcgacaacgugagcagcagcaccaagaagcccgcccccugcuucgagguggaguaa

SEQ ID NO: 13415 - RNA, 1092 nt, Artificial Sequence
  AGTR2__Homo_sapiens__XP_011535835
augaagggcaacagcacccuggccaccaccagcaagaacaucaccagcggccugcacuucggccuggugaacaucagcggcaacaacgagagcacccugaacugcagccagaagcccagcgacaagcaccuggacgccauccccauccuguacuacaucaucuucgugaucggcuuccuggugaacaucgugguggugacccuguucugcugccagaagggccccaagaaggugagcagcaucuacaucuucaaccuggccguggccgaccugcugcugcuggccacccugccccugugggccaccuacuacagcuacagauacgacuggcuguucggccccgugaugugcaagguguucggcagcuuccugacccugaacauguucgccagcaucuucuucaucaccugcaugagcguggacagauaccagagcgugaucuaccccuuccugagccagagaagaaaccccuggcaggccagcuacaucgugccccugguguggugcauggccugccugagcagccugcccaccuucuacuucagagacgugagaaccaucgaguaccugggcgugaacgccugcaucauggccuucccccccgagaaguacgcccaguggagcgccggcaucgcccugaugaagaacauccugggcuucaucaucccccugaucuucaucgccaccugcuacuucggcaucagaaagcaccugcugaagaccaacagcuacggcaagaacagaaucaccagagaccaggugcugaagauggccgccgccguggugcuggccuucaucaucugcuggcugcccuuccacgugcugaccuuccuggacgcccuggccuggaugggcgugaucaacagcugcgaggugaucgccgugaucgaccuggcccugcccuucgccauccugcugggcuucaccaacagcugcgugaaccccuuccuguacugcuucgugggcaacagauuccagcagaagcugagaagcguguucagagugcccaucaccuggcugcagggcaagagagagagcaugagcugcagaaagagcagcagccugagagagauggagaccuucgugagcuaa

SEQ ID NO: 13416 - RNA, 1545 nt, Artificial Sequence
  AGXT2__Homo_sapiens__NP_114106
augacccugaucuggagacaccugcugagaccccugugccuggugaccagcgcccccagaauccuggagaugcaccccuuccugagccugggcaccagcagaaccagcgugaccaagcugagccugcacaccaagcccagaaugccccccugcgacuucaugcccgagagauaccagagccugggcuacaacagagugcuggagauccacaaggagcaccugagccccguggugaccgccuacuuccagaagccccugcugcugcaccagggccacauggaguggcuguucgacgccgagggcagcagauaccuggacuucuucagcggcaucgugaccgugagcgugggccacugccaccccaaggugaacgccguggcccagaagcagcugggcagacuguggcacaccagcaccguguucuuccacccccccaugcacgaguacgccgagaagcuggccgcccugcugcccgagccccugaaggugaucuuccuggugaacagcggcagcgaggccaacgagcuggccaugcugauggccagagcccacagcaacaacaucgacaucaucagcuucagaggcgccuaccacggcugcagccccuacacccugggccugaccaacgugggcaccuacaagauggagcugcccggcggcaccggcugccagcccaccaugugccccgacguguucagaggccccuggggcggcagccacugcagagacagccccgugcagaccaucagaaagugcagcugcgcccccgacugcugccaggccaaggaccaguacaucgagcaguucaaggacacccugagcaccagcguggccaagagcaucgccggcuucuucgccgagcccauccagggcgugaacggcguggugcaguaccccaagggcuuccugaaggaggccuucgagcuggugagagccagaggcggcgugugcaucgccgacgaggugcagaccggcuucggcagacugggcagccacuucuggggcuuccagacccacgacgugcugcccgacaucgugaccauggccaagggcaucggcaacggcuuccccauggccgccgugaucaccacccccgagaucgccaagagccuggccaagugccugcagcacuucaacaccuucggcggcaaccccauggccugcgccaucggcagcgccgugcuggaggugaucaaggaggagaaccugcaggagaacagccaggaggugggcaccuacaugcugcugaaguucgccaagcugagagacgaguucgagaucgugggcgacgugagaggcaagggccugaugaucggcaucgagauggugcaggacaagaucagcugcagaccccugcccagagaggaggugaaccagauccacgaggacugcaagcacaugggccugcuggugggcagaggcagcaucuucagccagaccuucagaaucgcccccagcaugugcaucaccaagcccgagguggacuucgccguggagguguucagaagcgcccugacccagcacauggagagaagagccaaguaa

SEQ ID NO: 13417 - RNA, 1179 nt, Artificial Sequence
  AGXT__Homo_sapiens__NP_000021
auggccagccacaagcugcuggugaccccccccaaggcccugcugaagccccugagcauccccaaccagcugcugcugggccccggccccagcaaccugccccccagaaucauggccgccggcggccugcagaugaucggcagcaugagcaaggacauguaccagaucauggacgagaucaaggagggcauccaguacguguuccagaccagaaacccccugacccuggugaucagcggcagcggccacugcgcccuggaggccgcccuggugaacgugcuggagcccggcgacagcuuccuggugggcgccaacggcaucuggggccagagagccguggacaucggcgagagaaucggcgccagagugcaccccaugaccaaggaccccggcggccacuacacccugcaggagguggaggagggccuggcccagcacaagcccgugcugcuguuccugacccacggcgagagcagcaccggcgugcugcagccccuggacggcuucggcgagcugugccacagauacaagugccugcugcugguggacagcguggccagccugggcggcaccccccuguacauggacagacagggcaucgacauccuguacagcggcagccagaaggcccugaacgccccccccggcaccagccugaucagcuucagcgacaaggccaagaagaagauguacagcagaaagaccaagcccuucagcuucuaccuggacaucaaguggcuggccaacuucuggggcugcgacgaccagcccagaauguaccaccacaccauccccgugaucagccuguacagccugagagagagccuggcccugaucgccgagcagggccuggagaacagcuggagacagcacagagaggccgccgccuaccugcacggcagacugcaggcccugggccugcagcuguucgugaaggaccccgcccugagacugcccaccgugaccaccguggccgugcccgccggcuacgacuggagagacaucgugagcuacgugaucgaccacuucgacaucgagaucaugggcggccugggccccagcaccggcaaggugcugagaaucggccugcugggcugcaacgccaccagagagaacguggacagagugaccgaggcccugagagccgcccugcagcacugccccaagaagaagcuguaa

SEQ ID NO: 13418 - RNA, 1299 nt, Artificial Sequence
  AHCY__Homo_sapiens__NP_000678
augagcgacaagcugcccuacaagguggccgacaucggccuggccgccuggggcagaaaggcccuggacaucgccgagaacgagaugcccggccugaugagaaugagagagagauacagcgccagcaagccccugaagggcgccagaaucgccggcugccugcacaugaccguggagaccgccgugcugaucgagacccuggugacccugggcgccgaggugcaguggagcagcugcaacaucuucagcacccaggaccacgccgccgccgccaucgccaaggccggcauccccguguacgccuggaagggcgagaccgacgaggaguaccuguggugcaucgagcagacccuguacuucaaggacggcccccugaacaugauccuggacgacggcggcgaccugaccaaccugauccacaccaaguacccccagcugcugcccggcaucagaggcaucagcgaggagaccaccaccggcgugcacaaccuguacaagaugauggccaacggcauccugaaggugcccgccaucaacgugaacgacagcgugaccaagagcaaguucgacaaccuguacggcugcagagagagccugaucgacggcaucaagagagccaccgacgugaugaucgccggcaagguggccgugguggccggcuacggcgacgugggcaagggcugcgcccaggcccugagaggcuucggcgccagagugaucaucaccgagaucgaccccaucaacgcccugcaggccgccauggagggcuacgaggugaccaccauggacgaggccugccaggagggcaacaucuucgugaccaccaccggcugcaucgacaucauccugggcagacacuucgagcagaugaaggacgacgccaucgugugcaacaucggccacuucgacguggagaucgacgugaaguggcugaacgagaacgccguggagaaggugaacaucaagccccagguggacagauacagacugaagaacggcagaagaaucauccugcuggccgagggcagacuggugaaccugggcugcgccaugggccaccccagcuucgugaugagcaacagcuucaccaaccaggugauggcccagaucgagcuguggacccaccccgacaaguaccccgugggcgugcacuuccugcccaagaagcuggacgaggccguggccgaggcccaccugggcaagcugaacgugaagcugaccaagcugaccgagaagcaggcccaguaccugggcaugagcugcgacggccccuucaagcccgaccacuacagauacuaa

SEQ ID NO: 13419 - RNA, 1833 nt, Artificial Sequence
  AHCYL2__Homo_sapiens__NP_001124192
augagcgugcagguggugagcgccgccgccgccgccaaggugcccgagguggagcugaaggaccugagccccagcgaggccgagagccagcugggccugagcaccgccgccgugggcgccauggccccccccgccggcggcggcgaccccgaggcccccgcccccgccgccgagagaccccccgugcccggccccggcagcggccccgccgccgcccugagccccgccgccggcaaggugccccaggccagcgccaugaagagaagcgacccccaccaccagcaccagagacacagagacggcggcgaggcccuggugagccccgacggcaccgugaccgaggcccccagaaccgugaagaagauccaguucgccgaccagaagcaggaguucaacaagagacccaccaagaucggcagaagaagccugagcagaagcaucagccagagcagcaccgacagcuacagcagcgccgccagcuacaccgacagcagcgacgacgagaccagccccagagacaagcagcagaagaacagcaagggcagcagcgacuucugcgugaagaacaucaagcaggccgaguucggcagaagagagaucgagaucgccgagcaggagaugcccgcccugauggcccugagaaagagagcccagggcgagaagccccuggccggcgccaagaucgugggcugcacccacaucaccgcccagaccgccgugcugauggagacccugggcgcccugggcgcccagugcagaugggccgccugcaacaucuacagcacccugaacgagguggccgccgcccuggccgagagcggcuuccccguguucgccuggaagggcgagagcgaggacgacuucugguggugcaucgacagaugcgugaacguggagggcuggcagcccaacaugauccuggacgacggcggcgaccugacccacuggaucuacaagaaguaccccaacauguucaagaagaucaagggcaucguggaggagagcgugaccggcgugcacagacuguaccagcugagcaaggccggcaagcugugcgugcccgccaugaacgugaacgacagcgugaccaagcagaaguucgacaaccuguacugcugcagagagagcauccuggacggccugaagagaaccaccgacaugauguucggcggcaagcaggugguggugugcggcuacggcgaggugggcaagggcugcugcgccgcccugaaggccaugggcagcaucguguacgugaccgagaucgaccccaucugcgcccugcaggccugcauggacggcuucagacuggugaagcugaacgaggugaucagacagguggacaucgugaucaccugcaccggcaacaagaacguggugaccagagagcaccuggacagaaugaagaacagcugcaucgugugcaacaugggccacagcaacaccgagaucgacguggccagccugagaacccccgagcugaccugggagagagugagaagccagguggaccacgugaucuggcccgacggcaagagaaucgugcugcuggccgagggcagacugcugaaccugagcugcagcaccgugcccaccuucgugcugagcaucaccgccaccacccaggcccuggcccugaucgagcuguacaacgcccccgagggcagauacaagcaggacguguaccugcugcccaagaagauggacgaguacguggccagccugcaccugcccaccuucgacgcccaccugaccgagcugaccgacgagcaggccaaguaccugggccugaacaagaacggccccuucaagcccaacuacuacagauacuaa

SEQ ID NO: 13420 - RNA, 3162 nt, Artificial Sequence
  AHI1__Homo_sapiens__NP_001128304
augcccaccgccgagagcgaggccaaggugaagaccaaggugagauucgaggagcugcugaagacccacagcgaccugaugagagagaagaagaagcugaagaagaagcuggugagaagcgaggagaacaucagccccgacaccaucagaagcaaccugcacuacaugaaggagaccaccagcgacgaccccgacaccaucagaagcaaccugccccacaucaaggagaccaccagcgacgacgugagcgccgccaacaccaacaaccugaagaagagcaccagagugaccaagaacaagcugagaaacacccagcuggccaccgagaaccccaacggcgacgccagcguggaggaggacaagcagggcaagcccaacaagaaggugaucaagaccgugccccagcugaccacccaggaccugaagcccgagacccccgagaacaagguggacagcacccaccagaagacccacaccaagccccagcccggcguggaccaccagaagagcgagaaggccaacgagggcagagaggagaccgaccuggaggaggacgaggagcugaugcaggccuaccagugccacgugaccgaggagauggccaaggagaucaagagaaagaucagaaagaagcugaaggagcagcugaccuacuuccccagcgacacccuguuccacgacgacaagcugagcagcgagaagagaaagaagaagaaggaggugcccguguucagcaaggccgagaccagcacccugaccaucagcggcgacaccguggagggcgagcagaagaaggagagcagcgugagaagcgugagcagcgacagccaccaggacgacgagaucagcagcauggagcagagcaccgaggacagcaugcaggacgacaccaagcccaagcccaagaagaccaagaagaagaccaaggccguggccgacaacaacgaggacguggacggcgacggcgugcacgagaucaccagcagagacagccccguguaccccaagugccugcuggacgacgaccuggugcugggcguguacauccacagaaccgacagacugaagagcgacuucaugaucagccaccccauggugaagauccacgugguggacgagcacaccggccaguacgugaagaaggacgacagcggcagacccgugagcagcuacuacgagaaggagaacguggacuacauccugcccaucaugacccagcccuacgacuucaagcagcugaagagcagacugcccgagugggaggagcagaucguguucaacgagaacuuccccuaccugcugagaggcagcgacgagagccccaaggugauccuguucuucgagauccuggacuuccugagcguggacgagaucaagaacaacagcgaggugcagaaccaggagugcggcuucagaaagaucgccugggccuuccugaagcugcugggcgccaacggcaacgccaacaucaacagcaagcugagacugcagcuguacuacccccccaccaagcccagaagcccccugagcgugguggaggccuucgagugguggagcaagugccccagaaaccacuaccccagcacccuguacgugaccgugagaggccugaaggugcccgacugcaucaagcccagcuacagaagcaugauggcccugcaggaggagaagggcaagcccgugcacugcgagagacaccacgagagcagcagcguggacaccgagcccggccuggaggagagcaaggaggugaucaaguggaagagacugcccggccaggccugcagaauccccaacaagcaccuguucagccugaacgccggcgagagaggcugcuucugccuggacuucagccacaacggcagaauccuggccgccgccugcgccagcagagacggcuaccccaucauccuguacgagauccccagcggcagauucaugagagagcugugcggccaccugaacaucaucuacgaccugagcuggagcaaggacgaccacuacauccugaccagcagcagcgacggcaccgccagaaucuggaagaacgagaucaacaacaccaacaccuucagagugcugccccaccccagcuucguguacaccgccaaguuccaccccgccgugagagagcugguggugaccggcugcuacgacagcaugaucagaaucuggaagguggagaugagagaggacagcgccauccuggugagacaguucgacgugcacaagagcuucaucaacagccugugcuucgacaccgagggccaccacauguacagcggcgacugcaccggcgugaucgugguguggaacaccuacgugaagaucaacgaccuggagcacagcgugcaccacuggaccaucaacaaggagaucaaggagaccgaguucaagggcauccccaucagcuaccuggagauccaccccaacggcaagagacugcugauccacaccaaggacagcacccugagaaucauggaccugagaauccugguggccagaaaguucgugggcgccgccaacuacagagagaagauccacagcacccugacccccugcggcaccuuccuguucgccggcagcgaggacggcaucguguacguguggaaccccgagaccggcgagcagguggccauguacagcgaccugcccuucaagagccccaucagagacaucagcuaccaccccuucgagaacaugguggccuucugcgccuucggccagaacgagcccauccugcuguacaucuacgacuuccacguggcccagcaggaggccgagauguucaagagauacaacggcaccuucccccugcccggcauccaccagagccaggacgcccugugcaccugccccaagcugccccaccagggcagcuuccagaucgacgaguucgugcacaccgagagcagcagcaccaagaugcagcuggugaagcagagacuggagaccgugaccgaggugaucagaagcugcgccgccaaggugaacaagaaccugagcuucaccagcccccccgccgugagcagccagcagagcaagcugaagcagagcaacaugcugaccgcccaggagauccugcaccaguucggcuucacccagaccgacagccacuucgccgaguucaacaccugcauccugugguggaagaagcacuaa

SEQ ID NO: 13421 - RNA, 450 nt, Artificial Sequence
  AHNAK__Homo_sapiens__NP_076965
auggagaaggaggagaccaccagagagcugcugcugcccaacuggcagggcagcggcagccacggccugaccaucgcccagagagacgacggcguguucgugcaggaggugacccagaacagccccgccgccagaaccggcguggugaaggagggcgaccagaucgugggcgccaccaucuacuucgacaaccugcagagcggcgaggugacccagcugcugaacaccaugggccaccacaccgugggccugaagcugcacagaaagggcgacagaagccccgagcccggccagaccuggaccagagagguguucagcagcugcagcagcgagguggugcugaacaccccccagcccagcgcccuggagugcaaggaccagaacaagcagaaggaggccagcagccaggccggcgccgugagcgugagcacccccaacgccggccuguaa

SEQ ID NO: 13422 - RNA, 2547 nt, Artificial Sequence
  AHR__Homo_sapiens__NP_001612
augaacagcagcagcgccaacaucaccuacgccagcagaaagagaagaaagcccgugcagaagaccgugaagcccauccccgccgagggcaucaagagcaaccccagcaagagacacagagacagacugaacaccgagcuggacagacuggccagccugcugcccuucccccaggacgugaucaacaagcuggacaagcugagcgugcugagacugagcgugagcuaccugagagccaagagcuucuucgacguggcccugaagagcagccccaccgagagaaacggcggccaggacaacugcagagccgccaacuucagagagggccugaaccugcaggagggcgaguuccugcugcaggcccugaacggcuucgugcugguggugaccaccgacgcccugguguucuacgccagcagcaccauccaggacuaccugggcuuccagcagagcgacgugauccaccagagcguguacgagcugauccacaccgaggacagagccgaguuccagagacagcugcacugggcccugaaccccagccagugcaccgagagcggccagggcaucgaggaggccaccggccugccccagaccguggugugcuacaaccccgaccagaucccccccgagaacagcccccugauggagagaugcuucaucugcagacugagaugccugcuggacaacagcagcggcuuccuggccaugaacuuccagggcaagcugaaguaccugcacggccagaagaagaagggcaaggacggcagcauccugcccccccagcuggcccuguucgccaucgccaccccccugcagccccccagcauccuggagaucagaaccaagaacuucaucuucagaaccaagcacaagcuggacuucacccccaucggcugcgacgccaagggcagaaucgugcugggcuacaccgaggccgagcugugcaccagaggcagcggcuaccaguucauccacgccgccgacaugcuguacugcgccgagagccacaucagaaugaucaagaccggcgagagcggcaugaucguguucagacugcugaccaagaacaacagauggaccugggugcagagcaacgccagacugcuguacaagaacggcagacccgacuacaucaucgugacccagagaccccugaccgacgaggagggcaccgagcaccugagaaagagaaacaccaagcugcccuucauguucaccaccggcgaggccgugcuguacgaggccaccaaccccuuccccgccaucauggacccccugccccugagaaccaagaacggcaccagcggcaaggacagcgccaccaccagcacccugagcaaggacagccugaaccccagcagccugcuggccgccaugaugcagcaggacgagagcaucuaccuguaccccgccagcagcaccagcagcaccgcccccuucgagaacaacuucuucaacgagagcaugaacgagugcagaaacuggcaggacaacaccgcccccaugggcaacgacaccauccugaagcacgagcagaucgaccagccccaggacgugaacagcuucgccggcggccaccccggccuguuccaggacagcaagaacagcgaccuguacagcaucaugaagaaccugggcaucgacuucgaggacaucagacacaugcagaacgagaaguucuucagaaacgacuucagcggcgagguggacuucagagacaucgaccugaccgacgagauccugaccuacgugcaggacagccugagcaagagccccuucauccccagcgacuaccagcagcagcagagccuggcccugaacagcagcugcauggugcaggagcaccugcaccuggagcagcagcagcagcaccaccagaagcagguggugguggagccccagcagcagcugugccagaagaugaagcacaugcaggugaacggcauguucgagaacuggaacagcaaccaguucgugcccuucaacugcccccagcaggacccccagcaguacaacguguucaccgaccugcacggcaucagccaggaguuccccuacaagagcgagauggacagcaugcccuacacccagaacuucaucagcugcaaccagcccgugcugccccagcacagcaagugcaccgagcuggacuaccccaugggcagcuucgagcccagccccuaccccaccaccagcagccuggaggacuucgugaccugccugcagcugcccgagaaccagaagcacggccugaacccccagagcgccaucaucaccccccagaccugcuacgccggcgccgugagcauguaccagugccagcccgagccccagcacacccacgugggccagaugcaguacaaccccgugcugcccggccagcaggccuuccugaacaaguuccagaacggcgugcugaacgagaccuaccccgccgagcugaacaacaucaacaacacccagaccaccacccaccugcagccccugcaccaccccagcgaggccagacccuuccccgaccugaccagcagcggcuuccuguaa

SEQ ID NO: 13423 - RNA, 2106 nt, Artificial Sequence
  AHRR__Homo_sapiens__NP_001229341
augcccagaaccaugaucccccccggcgagugcaccuacgccggcagaaagagaagaagaccccugcagaagcagagacccgccgugggcgccgagaagagcaaccccagcaagagacacagagacagacugaacgccgagcuggaccaccuggccagccugcugcccuucccccccgacaucaucagcaagcuggacaagcugagcgugcugagacugagcgugagcuaccugagagugaagagcuucuuccagguggugcaggagcagagcagcagacagcccgccgccggcgcccccagccccggcgacagcugcccccuggccggcagcgccgugcuggagggcagacugcugcuggagagccugaacggcuucgcccugguggugagcgccgagggcaccaucuucuacgccagcgccaccaucguggacuaccugggcuuccaccagaccgacgugaugcaccagaacaucuacgacuacauccacguggacgacagacaggacuucugcagacagcugcacugggccauggaccccccccaggugguguucggccagccccccccccuggagaccggcgacgacgccauccugggcagacugcugagagcccaggaguggggcaccggcacccccaccgaguacagcgccuuccugaccagaugcuucaucugcagagugagaugccugcuggacagcaccagcggcuuccugaccaugcaguuccagggcaagcugaaguuccuguucggccagaagaagaaggcccccagcggcgccaugcugccccccagacugagccuguucugcaucgccgcccccgugcugcugcccagcgccgccgagaugaagaugagaagcgcccugcugagagccaagcccagagccgacaccgccgccaccgccgacgccaaggugaaggccaccaccagccugugcgagagcgagcugcacggcaagcccaacuacagcgccggcagaagcagcagagagagcggcgugcuggugcugagagagcagaccgacgccggcagaugggcccaggugcccgccagagcccccugccugugccugagaggcggccccgaccuggugcuggaccccaagggcggcagcggcgacagagaggaggagcagcacagaaugcugagcagagccagcggcgugaccggcagaagagagacccccggccccaccaagccccugcccuggaccgccggcaagcacagcgaggacggcgccagacccagacugcagcccagcaagaacgacccccccagccugagacccaugcccagaggcagcugccugcccugccccugcgugcagggcaccuucagaaacagccccaucagccacccccccagccccagccccagcgccuacagcagcagaaccagcagacccaugagagacgugggcgaggaccaggugcaccccccccugugccacuucccccagagaagccugcagcaccagcugccccagcccggcgcccagagauucgccaccagaggcuaccccauggaggacaugaagcugcagggcgugcccaugccccccggcgaccugugcggccccacccugcugcuggacgugagcaucaagauggagaaggacagcggcugcgagggcgccgccgacggcugcgugcccagccagguguggcugggcgccagcgacagaagccaccccgccaccuuccccaccagaaugcaccugaagaccgagcccgacagcagacagcagguguacaucagccaccugggccacggcgugagaggcgcccagccccacggcagagccaccgccggcagaagcagagagcugacccccuuccaccccgcccacugcgccugccuggagcccaccgacggccugccccagagcgagcccccccaccagcugugcgccagaggcagaggcgagcagagcugcaccugcagagccgccgaggccgcccccguggugaagagagagccccuggacagcccccagugggccacccacagccagggcauggugcccggcaugcugcccaagagcgcccuggccacccuggugcccccccaggccagcggcugcaccuuccugcccuaa

SEQ ID NO: 13424 - RNA, 1017 nt, Artificial Sequence
  AHSA1__Homo_sapiens__NP_036243
auggccaaguggggcgagggcgaccccagauggaucguggaggagagagccgacgccaccaacgugaacaacuggcacuggaccgagagagacgccagcaacuggagcaccgacaagcugaagacccuguuccuggccgugcaggugcagaacgaggagggcaagugcgaggugaccgaggugagcaagcuggacggcgaggccagcaucaacaacagaaagggcaagcugaucuucuucuacgaguggagcgugaagcugaacuggaccggcaccagcaagagcggcgugcaguacaagggccacguggagauccccaaccugagcgacgagaacagcguggacgagguggagaucagcgugagccuggccaaggacgagcccgacaccaaccugguggcccugaugaaggaggagggcgugaagcugcugagagaggccaugggcaucuacaucagcacccugaagaccgaguucacccagggcaugauccugcccaccaugaacggcgagagcguggaccccgugggccagcccgcccugaagaccgaggagagaaaggccaagcccgcccccagcaagacccaggccagacccgugggcgugaagauccccaccugcaagaucacccugaaggagaccuuccugaccagccccgaggagcuguacagaguguucaccacccaggagcuggugcaggccuucacccacgcccccgccacccuggaggccgacagaggcggcaaguuccacaugguggacggcaacgugagcggcgaguucaccgaccuggugcccgagaagcacaucgugaugaaguggagauucaagagcuggcccgagggccacuucgccaccaucacccugaccuucaucgacaagaacggcgagaccgagcugugcauggagggcagaggcauccccgcccccgaggaggagagaaccagacagggcuggcagagauacuacuucgagggcaucaagcagaccuucggcuacggcgccagacuguucuaa

SEQ ID NO: 13425 - RNA, 414 nt, Artificial Sequence
  AHSA2__Homo_sapiens__NP_689605
augauccugcccaccaaggccauggccacccaggagcugaccgugaagagaaagcugagcggcaacacccugcaggugcaggccagcagccccguggcccugggcgugagaauccccaccguggcccugcacaugauggagcuguucgacaccaccguggagcagcuguacagcaucuucaccgugaaggagcugaccaacaagaagaucaucaugaaguggagaugcggcaacuggcccgaggagcacuacgccaugguggcccugaacuucgugcccacccugggccagaccgagcugcagcugaaggaguuccugagcaucugcaaggaggagaacaugaaguucugcuggcagaagcagcacuucgaggagaucaagggcagccugcagcugaccccccugaacggcuaa

SEQ ID NO: 13426 - RNA, 1104 nt, Artificial Sequence
  AHSG__Homo_sapiens__NP_001613
augaagagccuggugcugcugcugugccuggcccagcuguggggcugccacagcgccccccacggccccggccugaucuacagacagcccaacugcgacgaccccgagaccgaggaggccgcccugguggccaucgacuacaucaaccagaaccugcccuggggcuacaagcacacccugaaccagaucgacgaggugaagguguggccccagcagcccagcggcgagcuguucgagaucgagaucgacacccuggagaccaccugccacgugcuggaccccacccccguggccagaugcagcgugagacagcugaaggagcacgccguggagggcgacugcgacuuccagcugcugaagcuggacggcaaguucagcgugguguacgccaagugcgacagcagccccgacagcgccgaggacgugagaaaggugugccaggacugcccccugcuggccccccugaacgacaccagaguggugcacgccgccaaggccgcccuggccgccuucaacgcccagaacaacggcagcaacuuccagcuggaggagaucagcagagcccagcuggugccccugccccccagcaccuacguggaguucaccgugagcggcaccgacugcguggccaaggaggccaccgaggccgccaagugcaaccugcuggccgagaagcaguacggcuucugcaaggccacccugagcgagaagcugggcggcgccgagguggccgugaccugcaugguguuccagacccagcccgugagcagccagccccagcccgagggcgccaacgaggccgugcccacccccgugguggaccccgacgccccccccagccccccccugggcgcccccggccugccccccgccggcagcccccccgacagccacgugcugcuggccgccccccccggccaccagcugcacagagcccacuacgaccugagacacaccuucaugggcguggugagccugggcagccccagcggcgaggugagccaccccagaaagaccagaaccguggugcagcccagcgugggcgccgccgccggccccguggugccccccugccccggcagaaucagacacuucaagguguaa

SEQ ID NO: 13427 - RNA, 597 nt, Artificial Sequence
  AICDA__Homo_sapiens__NP_065712
auggacagccugcugaugaacagaagaaaguuccuguaccaguucaagaacgugagaugggccaagggcagaagagagaccuaccugugcuacguggugaagagaagagacagcgccaccagcuucagccuggacuucggcuaccugagaaacaagaacggcugccacguggagcugcuguuccugagauacaucagcgacugggaccuggaccccggcagaugcuacagagugaccugguucaccagcuggagccccugcuacgacugcgccagacacguggccgacuuccugagaggcaaccccaaccugagccugagaaucuucaccgccagacuguacuucugcgaggacagaaaggccgagcccgagggccugagaagacugcacagagccggcgugcagaucgccaucaugaccuucaaggacuacuucuacugcuggaacaccuucguggagaaccacgagagaaccuucaaggccugggagggccugcacgagaacagcgugagacugagcagacagcugagaagaauccugcugccccuguacgagguggacgaccugagagacgccuucagaacccugggccuguaa

SEQ ID NO: 13428 - RNA, 921 nt, Artificial Sequence
  AIDA__Homo_sapiens__NP_073742
augagcgaggugaccagaagccugcugcagagauggggcgccagcuucagaagaggcgccgacuucgacagcuggggccagcugguggaggccaucgacgaguaccagauccuggccagacaccugcagaaggaggcccaggcccagcacaacaacagcgaguucaccgaggagcagaagaagaccaucggcaagaucgccaccugccuggagcugagaagcgccgcccugcagagcacccagagccaggaggaguucaagcuggaggaccugaagaagcuggagcccauccugaagaacauccugaccuacaacaaggaguuccccuucgacgugcagcccgugccccugagaagaauccuggcccccggcgaggaggagaaccuggaguucgaggaggacgaggaggagggcggcgccggcgccggcagccccgacagcuuccccgccagagugcccggcacccugcugcccagacugcccagcgagcccggcaugacccugcugaccaucagaaucgagaagaucggccugaaggacgccggccagugcaucgaccccuacaucaccgugagcgugaaggaccugaacggcaucgaccugacccccgugcaggacacccccguggccagcagaaaggaggacaccuacgugcacuucaacguggacaucgagcugcagaagcacguggagaagcugaccaagggcgccgccaucuucuucgaguucaagcacuacaagcccaagaagagauucaccagcaccaagugcuucgccuucauggagauggacgagaucaagcccggccccaucgugaucgagcuguacaagaagcccaccgacuucaagagaaagaagcugcagcugcugaccaagaagccccuguaccugcaccugcaccagacccugcacaaggaguaa

SEQ ID NO: 13429 - RNA, 444 nt, Artificial Sequence
  AIF1__Homo_sapiens__NP_001614
augagccagaccagagaccugcagggcggcaaggccuucggccugcugaaggcccagcaggaggagagacuggacgagaucaacaagcaguuccuggacgaccccaaguacagcagcgacgaggaccugcccagcaagcuggagggcuucaaggagaaguacauggaguucgaccugaacggcaacggcgacaucgacaucaugagccugaagagaaugcuggagaagcugggcgugcccaagacccaccuggagcugaagaagcugaucggcgaggugagcagcggcagcggcgagaccuucagcuaccccgacuuccugagaaugaugcugggcaagagaagcgccauccugaagaugauccugauguacgaggagaaggccagagagaaggagaagcccaccggcccccccgccaagaaggccaucagcgagcugcccuaa

SEQ ID NO: 13430 - RNA, 825 nt, Artificial Sequence
  AIFM1__Homo_sapiens__NP_001124318
augggcaagauccugcccgaguaccugagcaacuggaccauggagaaggugagaagagagggcgugaaggugaugcccaacgccaucgugcagagcgugggcgugagcagcggcaagcugcugaucaagcugaaggacggcagaaagguggagaccgaccacaucguggccgccgugggccuggagcccaacguggagcuggccaagaccggcggccuggagaucgacagcgacuucggcggcuucagagugaacgccgagcugcaggccagaagcaacaucuggguggccggcgacgccgccugcuucuacgacaucaagcugggcagaagaagaguggagcaccacgaccacgccguggugagcggcagacuggccggcgagaacaugaccggcgccgccaagcccuacuggcaccagagcauguucuggagcgaccugggccccgacgugggcuacgaggccaucggccugguggacagcagccugcccaccgugggcguguucgccaaggccaccgcccaggacaaccccaagagcgccaccgagcagagcggcaccggcaucagaagcgagagcgagaccgagagcgaggccagcgagaucaccaucccccccagcacccccgccgugccccaggcccccgugcagggcgaggacuacggcaagggcgugaucuucuaccugagagacaaggugguggugggcaucgugcuguggaacaucuucaacagaaugcccaucgccagaaagaucaucaaggacggcgagcagcacgaggaccugaacgagguggccaagcuguucaacauccacgaggacuaa

SEQ ID NO: 13431 - RNA, 1122 nt, Artificial Sequence
  AIFM2__Homo_sapiens__NP_001185625
augggcagccaggugagcguggagagcggcgcccugcacguggugaucgugggcggcggcuucggcggcaucgccgccgccagccagcugcaggcccugaacgugcccuucaugcugguggacaugaaggacagcuuccaccacaacguggccgcccugagagccagcguggagaccggcuucgccaagaagaccuucaucagcuacagcgugaccuucaaggacaacuucagacagggccugguggugggcaucgaccugaagaaccagauggugcugcugcagggcggcgaggcccugcccuucagccaccugauccuggccaccggcagcaccggccccuuccccggcaaguucaacgaggugagcagccagcaggccgccauccaggccuacgaggacauggugagacaggugcagagaagcagauucaucgugguggugggcggcggcagcgccggcguggagauggccgccgagaucaagaccgaguaccccgagaaggaggugacccugauccacagccagguggcccuggccgacaaggagcugcugcccagcgugagacaggaggugaaggagauccugcugagaaagggcgugcagcugcugcugagcgagagagugagcaaccuggaggagcugccccugaacgaguacagagaguacaucaaggugcagaccgacaagggcaccgagguggccaccaaccuggugauccugugcaccggcaucaagaucaacagcagcgccuacagaaaggccuucgagagcagacuggccagcagcggcgcccugagagugaacgagcaccugcagguggagggccacagcaacguguacgccaucggcgacugcgccgacgugagaacccccaagauggccuaccuggccggccugcacgccaacaucgccguggccaacaucgugaacagcgugaagcagagaccccugcaggccuacaagcccggcgcccugaccuuccugcugagcaugggcagaaacgacggcgugggccagaucagcggcuucuacgugggcagacugauggugagacugaccaagagcagagaccuguucgugagcaccagcuggaagaccaugagacagagcccccccuaa

SEQ ID NO: 13432 - RNA, 1797 nt, Artificial Sequence
  AIFM3__Homo_sapiens__NP_001018070
augggcggcugcuucagcaagcccaagcccguggagcugaagaucgagguggugcugcccgagaaggagagaggcaaggaggagcugagcgccagcggcaagggcagccccagagccuaccagggcaacggcaccgccagacacuuccacaccgaggagagacugagcaccccccaccccuaccccagcccccaggacugcguggaggccgccgugugccacgugaaggaccuggagaacggccagaugagagagguggagcugggcuggggcaaggugcugcuggugaaggacaacggcgaguuccacgcccugggccacaagugcccccacuacggcgccccccuggugaagggcgugcugagcagaggcagagugagaugccccuggcacggcgccugcuucaacaucagcaccggcgaccuggaggacuuccccggccuggacagccugcacaaguuccaggugaagaucgagaaggagaagguguacgugagagccagcaagcaggcccugcagcugcagagaagaaccaaggugauggccaagugcaucagccccagcgccggcuacagcagcagcaccaacgugcugaucgugggcgccggcgccgccggccuggugugcgccgagacccugagacaggagggcuucagcgacagaaucgugcugugcacccuggacagacaccugcccuacgacagacccaagcugagcaagagccuggacacccagcccgagcagcuggcccugagacccaaggaguucuucagagccuacggcaucgaggugcugaccgaggcccagguggugaccguggacgugagaaccaagaaggugguguucaaggacggcuucaagcuggaguacagcaagcugcugcuggcccccggcagcagccccaagacccugagcugcaagggcaaggagguggagaacguguucaccaucagaacccccgaggacgccaacagaguggugagacuggccagaggcagaaacguggugguggugggcgccggcuuccugggcauggagguggccgccuaccugaccgagaaggcccacagcgugagcgugguggagcuggaggagacccccuucagaagauuccugggcgagagagugggcagagcccugaugaagauguucgagaacaacagagugaaguucuacaugcagaccgaggugagcgagcugagaggccaggagggcaagcugaaggagguggugcugaagagcagcaagguggugagagccgacgugugcguggugggcaucggcgccgugcccgccaccggcuuccugagacagagcggcaucggccuggacagcagaggcuucauccccgugaacaagaugaugcagaccaacgugcccggcguguucgccgccggcgacgccgugaccuucccccuggccuggagaaacaacagaaaggugaacaucccccacuggcagauggcccacgcccagggcagaguggccgcccagaacaugcuggcccaggaggccgagaugagcaccgugcccuaccuguggaccgccauguucggcaagagccugagauacgccggcuacggcgagggcuucgacgacgugaucauccagggcgaccuggaggagcugaaguucguggccuucuacaccaagggcgacgaggugaucgccguggccagcaugaacuacgaccccaucgugagcaagguggccgaggugcuggccagcggcagagccaucagaaagagagagguggagaccggcgacaugagcuggcugaccggcaagggcagcuaa

SEQ ID NO: 13433 - RNA, 687 nt, Artificial Sequence
  AIG1__Homo_sapiens__NP_001273516
auggccauccugcugagcuacugcagcauccugugcaacuacaaggccaucgagaugcccagccaccagaccuacggcggcagcuggaaguuccugaccuucaucgaccuggugauccaggccguguucuucggcaucugcgugcugaccgaccugagcagccugcugaccagaggcagcggcaaccaggagcaggagagacagcugaagaagcugaucagccugagagacuggaugcuggccgugcuggccuuccccgugggcguguucgugguggccguguucuggaucaucuacgccuacgacagagagaugaucuaccccaagcugcuggacaacuucauccccggcuggcugaaccacggcaugcacaccaccgugcugcccuucauccugaucgagaugagaaccagccaccaccaguaccccagcagaagcagcggccugaccgccaucugcaccuucagcgugggcuacauccugugggugugcugggugcaccacgugaccggcauguggguguaccccuuccuggagcacaucggccccggcgccagaaucaucuucuucggcagcaccaccauccugaugaacuuccuguaccugcugggcgaggugcugaacaacuacaucugggacacccagaagagcauggaggaggagaaggagaagcccaagcuggaguaa

SEQ ID NO: 13434 - RNA, 5172 nt, Artificial Sequence
  AIM1__Homo_sapiens__NP_001615
auggagaagagaagcagcggcagaagaagcggcagaagaagaggcagccagaagagcaccgacagccccggcgccgacgccgagcugcccgagagcgccgccagagacgacgccguguucgacgacgagguggcccccaacgccgccagcgacaacgccagcgccgagaagaaggugaagagccccagagccgcccuggacggcggcguggccagcgccgccagccccgagagcaagcccagccccggcaccaagggccagcugagaggcgagagcgacagaagcaagcagcccccccccgccagcagccccaccaagagaaagggcagaagcagagcccuggaggccgugcccgccccccccgccagcggccccagagcccccgccaaggagagcccccccaagagagugcccgaccccagccccgugaccaagggcaccgccgccgagagcggcgaggaggccgccagagccauccccagagagcugcccgugaagagcagcagccugcugcccgagaucaagcccgagcacaagagaggcccccugcccaaccacuucaacggcagagccgagggcggcagaagcagagagcugggcagagccgccggcgcccccggcgccagcgacgccgacggccugaagcccagaaaccacuucggcgugggcagaagcaccgugaccaccaaggugacccugcccgccaagcccaagcacguggagcugaaccugaagacccccaagaaccuggacagccugggcaacgagcacaaccccuucagccagcccgugcacaagggcaacaccgccaccaagaucagccuguucgagaacaagagaaccaacagcagccccagacacaccgacaucagaggccagagaaacacccccgccagcagcaagaccuucgugggcagagccaagcugaaccuggccaagaaggccaaggagauggagcagcccgagaagaaggugaugcccaacagcccccagaacggcgugcuggugaaggagaccgccaucgagaccaaggugaccgugagcgaggaggagauccugcccgccaccagaggcaugaacggcgacagcagcgagaaccaggcccugggcccccagcccaaccaggacgacaaggccgacgugcagaccgacgccggcugccugagcgagcccguggccagcgcccugauccccgugaaggaccacaagcugcuggagaaggaggacagcgaggccgccgacagcaagagccuggugcuggagaacgugaccgacaccgcccaggacauccccaccaccguggacaccaaggaccugccccccaccgccaugcccaagccccagcacaccuucagcgacagccagagccccgccgagagcagccccggccccagccugagccugagcgcccccgcccccggcgacgugcccaaggacaccugcgugcagagccccaucagcagcuuccccugcaccgaccugaaggugagcgagaaccacaagggcugcgugcugcccgugagcagacagaacaacgagaagaugccccugcuggagcugggcggcgagaccacccccccccugagcaccgagagaagccccgaggccgugggcagcgagugccccagcagagugcuggugcaggugagaagcuucgugcugcccguggagagcacccaggacgugagcagccaggugauccccgagagcagcgaggugagagaggugcagcugcccaccugccacagcaacgagcccgagguggugagcguggccagcugcgcccccccccaggaggaggugcugggcaacgagcacagccacugcaccgccgagcuggccgccaagagcggcccccaggugaucccccccgccagcgagaagacccugcccauccaggcccagagccagggcagcagaaccccccugauggccgagagcagccccaccaacagccccagcagcggcaaccaccuggccaccccccagagacccgaccagaccgugaccaacggccaggacagccccgccagccugcugaacaucagcgccggcagcgacgacagcguguucgacagcagcagcgacauggagaaguucaccgagaucaucaagcagauggacagcgccgugugcaugcccaugaagagaaagaaggccagaaugcccaacagccccgccccccacuucgccaugccccccauccacgaggaccaccuggagaagguguucgaccccaagguguucaccuucggccugggcaagaagaaggagagccagcccgagaugagccccgcccugcaccugaugcagaaccuggacaccaagagcaagcugagacccaagagagccagcgccgagcagagcgugcuguucaagagccugcacaccaacaccaacggcaacagcgagccccuggugaugcccgagaucaacgacaaggagaacagagacgugaccaacggcggcaucaagagaagcagacuggagaagagcgcccuguucagcagccugcugagcagccugccccaggacaagaucuucagccccagcgugaccagcgugaacaccaugaccaccgccuucagcaccagccagaacggcagccugagccagagcagcgugagccagcccaccaccgagggcgccccccccugcggccugaacaaggagcagagcaaccugcugcccgacaacagccugaagguguucaacuucaacagcagcagcaccagccacagcagccugaagagccccagccacauggagaaguacccccagaaggagaagaccaaggaggaccuggacagcagaagcaaccugcaccugcccgagaccaaguucagcgagcugagcaagcugaagaacgacgacauggagaaggccaaccacaucgagagcgugaucaagagcaaccugcccaacugcgccaacagcgacaccgacuucaugggccuguucaagagcagcagauacgaccccagcaucagcuucagcggcaugagccugagcgacaccaugacccugagaggcagcgugcagaacaagcugaaccccagacccggcaagguggugaucuacagcgagcccgacgugagcgagaagugcaucgagguguucagcgacauccaggacugcagcagcuggagccugagccccgugauccugaucaagguggugagaggcugcuggauccuguacgagcagcccaacuucgagggccacagcaucccccuggaggagggcgagcuggagcugagcggccuguggggcaucgaggacauccuggagagacacgaggaggccgagagcgacaagcccguggugaucggcagcaucagacacguggugcaggacuacagagugagccacaucgaccuguucaccgagcccgagggccugggcauccugagcagcuacuucgacgacaccgaggagaugcagggcuucggcgugaugcagaagaccugcagcaugaaggugcacuggggcaccuggcugaucuacgaggagcccggcuuccagggcgugcccuucauccuggagcccggcgaguaccccgaccugagcuucugggacaccgaggaggccuacaucggcagcaugagaccccugaagaugggcggcagaaagguggaguuccccaccgaccccaagguggugguguacgagaagcccuucuucgagggcaagugcguggagcuggagaccggcaugugcagcuucgugauggagggcggcgagaccgaggaggccaccggcgacgaccaccugcccuucaccagcgugggcagcaugaaggugcugagaggcaucuggguggccuacgagaagcccggcuucaccggccaccaguaccugcuggaggagggcgaguacagagacuggaaggccuggggcggcuacaacggcgagcugcagagccugagacccauccugggcgacuucagcaacgcccacaugaucauguacagcgagaagaacuucggcagcaagggcagcagcaucgacgugcugggcaucguggccaaccugaaggagaccggcuacggcgugaagacccagagcaucaacgugcugagcggcguguggguggccuacgagaaccccgacuucaccggcgagcaguacauccuggacaagggcuucuacaccagcuucgaggacuggggcggcaagaacugcaagaucagcagcgugcagcccaucugccuggacagcuucaccggccccagaagaagaaaccagauccaccuguucagcgagccccaguuccagggccacagccagagcuucgaggagaccaccagccagaucgacgacagcuucagcaccaagagcugcagagugagcggcggcagcugggugguguacgacggcgagaacuucaccggcaaccaguacgugcuggaggagggccacuaccccugccugagcgccaugggcugcccccccggcgccaccuucaagagccugagauucaucgacguggaguucagcgagcccaccaucauccuguucgagagagaggacuucaagggcaagaagaucgagcugaacgccgagaccgugaaccugagaagccugggcuucaacacccagaucagaagcgugcaggugaucggcggcaucugggugaccuacgaguacggcagcuacagaggcagacaguuccugcugagccccgccgaggugcccaacugguacgaguucagcggcugcagacagaucggcagccugagacccuucgugcagaagagaaucuacuucagacugagaaacaaggccaccggccuguucaugagcaccaacggcaaccuggaggaccugaagcugcugagaauccaggugauggaggacgugggcgccgacgaccagaucuggaucuaccaggagggcugcaucaagugcagaaucgccgaggacugcugccugaccaucgugggcagccuggugaccagcggcagcaagcugggccuggcccuggaccagaacgccgacagccaguucuggagccugaagagcgacggcagaaucuacagcaagcugaagcccaaccuggugcuggacaucaagggcggcacccaguacgaccagaaccacaucauccugaacaccgugagcaaggagaaguucacccaggugugggaggccauggugcuguacaccuaa

SEQ ID NO: 13435 - RNA, 1032 nt, Artificial Sequence
  AIM2__Homo_sapiens__NP_004824
auggagagcaaguacaaggagauccugcugcugaccggccuggacaacaucaccgacgaggagcuggacagauucaaguucuuccugagcgacgaguucaacaucgccaccggcaagcugcacaccgccaacagaauccagguggccacccugaugauccagaacgccggcgccgugagcgccgugaugaagaccaucagaaucuuccagaagcugaacuacaugcugcuggccaagagacugcaggaggagaaggagaagguggacaagcaguacaagagcgugaccaagcccaagccccugagccaggccgagaugagccccgccgccagcgccgccaucagaaacgacguggccaagcagagagccgcccccaaggugagcccccacgugaagcccgagcagaagcagaugguggcccagcaggagagcaucagagagggcuuccagaagagaugccugcccgugauggugcugaaggccaagaagcccuucaccuucgagacccaggagggcaagcaggagauguuccacgccaccguggccaccgagaaggaguucuucuucgugaagguguucaacacccugcugaaggacaaguucauccccaagagaaucaucaucaucgccagauacuacagacacagcggcuuccuggaggugaacagcgccagcagagugcuggacgccgagagcgaccagaaggugaacgugccccugaacaucaucagaaaggccggcgagacccccaagaucaacacccugcagacccagccccugggcaccaucgugaacggccuguucguggugcagaaggugaccgagaagaagaagaacauccuguucgaccugagcgacaacaccggcaagauggaggugcugggcgugagaaacgaggacaccaugaagugcaaggagggcgacaaggugagacugaccuucuucacccugagcaagaacggcgagaagcugcagcugaccagcggcgugcacagcaccaucaaggugaucaaggccaagaagaagaccuaa

SEQ ID NO: 13436 - RNA, 939 nt, Artificial Sequence
  AIMP1__Homo_sapiens__NP_001135887
auggccaacaacgacgccgugcugaagagacuggagcagaagggcgccgaggccgaccagaucaucgaguaccugaagcagcaggugagccugcugaaggagaaggccauccugcaggccacccugagagaggagaagaagcugagaguggagaacgccaagcugaagaaggagaucgaggagcugaagcaggagcugauccaggccgagauccagaacggcgugaagcagauccccuuccccagcggcaccccccugcacgccaacagcauggugagcgagaacgugauccagagcaccgccgugaccaccgugagcagcggcaccaaggagcagaucaagggcggcaccggcgacgagaagaaggccaaggagaagaucgagaagaagggcgagaagaaggagaagaagcagcagagcaucgccggcagcgccgacagcaagcccaucgacgugagcagacuggaccugagaaucggcugcaucaucaccgccagaaagcaccccgacgccgacagccuguacguggaggagguggacgugggcgagaucgcccccagaaccguggugagcggccuggugaaccacgugccccuggagcagaugcagaacagaauggugauccugcugugcaaccugaagcccgccaagaugagaggcgugcugagccaggccauggugaugugcgccagcagccccgagaagaucgagauccuggccccccccaacggcagcgugcccggcgacagaaucaccuucgacgccuuccccggcgagcccgacaaggagcugaaccccaagaagaagaucugggagcagauccagcccgaccugcacaccaacgacgagugcguggccaccuacaagggcgugcccuucgaggugaagggcaagggcgugugcagagcccagaccaugagcaacagcggcaucaaguaa

SEQ ID NO: 13437 - RNA, 963 nt, Artificial Sequence
  AIMP2__Homo_sapiens__NP_006294
augcccauguaccaggugaagcccuaccacggcggcggcgccccccugagaguggagcugcccaccugcauguacagacugcccaacgugcacggcagaagcuacggccccgcccccggcgccggccacgugcaggaggagagcaaccugagccugcaggcccuggagagcagacaggacgacauccugaagagacuguacgagcugaaggccgccguggacggccugagcaagaugauccagacccccgacgccgaccuggacgugaccaacaucauccaggccgacgagcccaccacccugaccaccaacgcccuggaccugaacagcgugcugggcaaggacuacggcgcccugaaggacaucgugaucaacgccaaccccgccagccccccccugagccugcuggugcugcacagacugcugugcgagcacuucagagugcugagcaccgugcacacccacagcagcgugaagagcgugcccgagaaccugcugaagugcuucggcgagcagaacaagaagcagcccagacaggacuaccagcugggcuucacccugaucuggaagaacgugcccaagacccagaugaaguucagcauccagaccaugugccccaucgagggcgagggcaacaucgccagauuccuguucagccuguucggccagaagcacaacgccgugaacgccacccugaucgacagcuggguggacaucgccaucuuccagcugaaggagggcagcagcaaggagaaggccgccguguucagaagcaugaacagcgcccugggcaagagccccuggcuggccggcaacgagcugaccguggccgacguggugcuguggagcgugcugcagcagaucggcggcugcagcgugaccgugcccgccaacgugcagagauggaugagaagcugcgagaaccuggcccccuucaacaccgcccugaagcugcugaaguaa

SEQ ID NO: 13438 - RNA, 993 nt, Artificial Sequence
  AIP__Homo_sapiens__NP_003968
auggccgacaucaucgccagacugagagaggacggcauccagaagagagugauccaggagggcagaggcgagcugcccgacuuccaggacggcaccaaggccaccuuccacuacagaacccugcacagcgacgacgagggcaccgugcuggacgacagcagagccagaggcaagcccauggagcugaucaucggcaagaaguucaagcugcccgugugggagaccaucgugugcaccaugagagagggcgagaucgcccaguuccugugcgacaucaagcacguggugcuguacccccugguggccaagagccugagaaacaucgccgugggcaaggacccccuggagggccagagacacugcugcggcguggcccagaugagagagcacagcagccugggccacgccgaccuggacgcccugcagcagaacccccagccccugaucuuccacauggagaugcugaagguggagagccccggcaccuaccagcaggaccccugggccaugaccgacgaggagaaggccaaggccgugccccugauccaccaggagggcaacagacuguacagagagggccacgugaaggaggccgccgccaaguacuacgacgccaucgccugccugaagaaccugcagaugaaggagcagcccggcagccccgaguggauccagcuggaccagcagaucaccccccugcugcugaacuacugccagugcaagcuggugguggaggaguacuacgaggugcuggaccacugcagcagcauccugaacaaguacgacgacaacgugaaggccuacuucaagagaggcaaggcccacgccgccguguggaacgcccaggaggcccaggccgacuucgccaaggugcuggagcuggaccccgcccuggcccccguggugagcagagagcugagagcccuggaggccagaaucagacagaaggacgaggaggacaaggccagauucagaggcaucuucagccacuaa

SEQ ID NO: 13439 - RNA, 966 nt, Artificial Sequence
  AIPL1__Homo_sapiens__NP_001028226
auggacgccgcccugcugcugaacguggagggcgugaagaagaccauccugcacggcggcaccggcgagcugcccaacuucaucaccggcagcagagugaucuuccacuucagaaccaugaagugcgacgaggagagaaccgugaucgacgacagcagacaggugggccagcccaugcacaucaucaucggcaacauguucaagcuggaggugugggagauccugcugaccagcaugagagugcacgagguggccgaguucuggugcgacaccaucguggacgcccccagcgacuaccagagagagaccuggaaccugagcaaccacgagaagaugaaggccgugcccgugcugcacggcgagggcaacagacuguucaagcugggcagauacgaggaggccagcagcaaguaccaggaggccaucaucugccugagaaaccugcagaccaaggagaagcccugggaggugcaguggcugaagcuggagaagaugaucaacacccugauccugaacuacugccagugccugcugaagaaggaggaguacuacgaggugcuggagcacaccagcgacauccugagacaccaccccggcaucgugaaggccuacuacgugagagccagagcccacgccgagguguggaacgaggccgaggccaaggccgaccugcagaaggugcuggagcuggagcccagcaugcagaaggccgugagaagagagcugagacugcuggagaacagaauggccgagaagcaggaggaggagagacugagaugcagaaacaugcugagccagggcgccacccagccccccgccgagccccccaccgagccccccgcccagagcagcaccgagccccccgccgagccccccaccgcccccagcgccgagcugagcgccggcccccccgccgagcccgccaccgagcccccccccagccccggccacagccugcagcacuaa

SEQ ID NO: 13440 - RNA, 1638 nt, Artificial Sequence
  AIRE__Homo_sapiens__NP_000374
auggccaccgacgccgcccugagaagacugcugagacugcacagaaccgagaucgccguggccguggacagcgccuucccccugcugcacgcccuggccgaccacgacguggugcccgaggacaaguuccaggagacccugcaccugaaggagaaggagggcugcccccaggccuuccacgcccugcugagcuggcugcugacccaggacagcaccgccauccuggacuucuggagagugcuguucaaggacuacaaccuggagagauacggcagacugcagcccauccuggacagcuuccccaaggacguggaccugagccagcccagaaagggcagaaagccccccgccgugcccaaggcccuggugcccccccccagacugcccaccaagagaaaggccagcgaggaggccagagccgccgcccccgccgcccugacccccagaggcaccgccagccccggcagccagcugaaggccaagccccccaagaagcccgagagcagcgccgagcagcagagacugccccugggcaacggcauccagaccaugagcgccagcgugcagagagccguggccaugagcagcggcgacgugcccggcgccagaggcgccguggagggcauccugauccagcagguguucgagagcggcggcagcaagaagugcauccaggugggcggcgaguucuacacccccagcaaguucgaggacagcggcagcggcaagaacaaggccagaagcagcagcggccccaagccccuggugagagccaagggcgcccagggcgccgcccccggcggcggcgaggccagacugggccagcagggcagcgugcccgccccccuggcccugcccagcgacccccagcugcaccagaagaacgaggacgagugcgccgugugcagagacggcggcgagcugaucugcugcgacggcugccccagagccuuccaccuggccugccugagccccccccugagagagauccccagcggcaccuggagaugcagcagcugccugcaggccaccgugcaggaggugcagcccagagccgaggagcccagaccccaggagccccccguggagaccccccugccccccggccugagaagcgccggcgaggaggugagaggcccccccggcgagccccuggccggcauggacaccacccugguguacaagcaccugcccgccccccccagcgccgccccccugcccggccuggacagcagcgcccugcacccccugcugugcgugggccccgagggccagcagaaccuggcccccggcgccagaugcggcgugugcggcgacggcaccgacgugcugagaugcacccacugcgccgccgccuuccacuggagaugccacuuccccgccggcaccagcagacccggcaccggccugagaugcagaagcugcagcggcgacgugacccccgcccccguggagggcgugcuggcccccagccccgccagacuggcccccggccccgccaaggacgacaccgccagccacgagcccgcccugcacagagacgaccuggagagccugcugagcgagcacaccuucgacggcauccugcagugggccauccagagcauggccagacccgccgcccccuuccccagcuaa

SEQ ID NO: 13441 - RNA, 1236 nt, Artificial Sequence
  AJAP1__Homo_sapiens__XP_011540088
auguggauccagcagcugcugggccugagcagcaugagcaucagauggcccggcagaccccugggcagccacgccuggauccugaucgccauguuccagcuggccguggaccugcccgccugcgaggcccugggccccggccccgaguucuggcugcugcccagaagcccccccagaccccccagacuguggagcuucagaagcggccagcccgccagagugcccgcccccguguggagccccagaccccccagaguggagagaauccacggccagaugcagaugcccagagccagaagagcccacagacccagagaccaggccgccgcccuggugcccaaggccggccuggccaagccccccgccgccgccaagagcagccccagccuggccagcagcagcagcagcagcagcagcgccguggccggcggcgcccccgagcagcaggcccugcugagaagaggcaagagacaccugcagggcgacggccugagcagcuucgacagcagaggcagcagacccaccaccgagaccgaguucaucgccuggggccccaccggcgacgaggaggcccuggagagcaacaccuuccccggcguguacggccccaccaccgugagcauccugcagaccagaaagaccaccguggccgccaccaccaccaccaccaccaccgccacccccaugacccugcagaccaagggcuucaccgagagccuggaccccagaagaagaauccccggcggcgugagcaccaccgagcccagcaccagccccagcaacaacggcgaggugacccagccccccagaauccugggcgaggccagcggccuggccgugcaccagaucaucaccaucaccgugagccugaucauggugaucgccgcccugaucaccacccuggugcugaagaacugcugcgcccagagcggcaacaccagaagaaacagccaccagagaaagaccaaccagcaggaggagagcugccagaaccugaccgacuuccccagcgccagagugcccagcagccuggacaucuucaccgccuacaacgagacccugcagugcagccacgagugcgugagagccagcgugcccguguacaccgacgagacccugcacagcaccaccggcgaguacaagagcaccuucaacggcaacagacccagcagcagcgacagacaccugauccccguggccuucgugagcgagaagugguucgagaucagcugcuaa

SEQ ID NO: 13442 - RNA, 1617 nt, Artificial Sequence
  AJUBA__Homo_sapiens__NP_116265
auggagagacugggcgagaaggccagcagacugcuggagaaguucggcagaagaaagggcgagagcagcagaagcggcagcgacggcacccccggccccggcaagggcagacugagcggccugggcggccccagaaagagcggccccagaggcgccaccggcggccccggcgacgagccccuggagcccgccagagagcagggcagccuggacgccgagagaaaccagagaggcagcuucgaggcccccagauacgagggcagcuuccccgccggccccccccccaccagagcccugccccugccccagagccugccccccgacuucagacuggagcccaccgcccccgcccugagccccagaagcagcuucgccagcagcagcgccagcgacgccagcaagcccagcagccccagaggcagccugcugcuggacggcgccggcgccggcggcgccggcggcagcagacccugcagcaacagaaccagcggcaucagcaugggcuacgaccagagacacggcagcccccugcccgccggccccugccuguucggccccccccuggccggcgcccccgccggcuacagccccggcggcgugcccagcgccuaccccgagcugcacgccgcccuggacagacuguacgcccagagacccgccggcuucggcugccaggagagcagacacagcuacccccccgcccugggcagccccggcgcccuggccggcgccggcgugggcgccgccggcccccuggagagaagaggcgcccagcccggcagacacagcgugaccggcuacggcgacugcgccgugggcgccagauaccaggacgagcugaccgcccugcugagacugaccgugggcaccggcggcagagaggccggcgccagaggcgagcccagcggcaucgagcccagcggccuggaggagccccccggccccuucgugcccgaggccgccagagccagaaugagagagcccgaggccagagaggacuacuucggcaccugcaucaagugcaacaagggcaucuacggccagagcaacgccugccaggcccuggacagccuguaccacacccagugcuucgugugcugcagcugcggcagaacccugagaugcaaggccuucuacagcgugaacggcagcguguacugcgaggaggacuaccuguucagcggcuuccaggaggccgccgagaagugcugcgugugcggccaccugauccuggagaagauccugcaggccaugggcaagagcuaccaccccggcugcuucagaugcaucgugugcaacaagugccuggacggcauccccuucaccguggacuucagcaaccagguguacugcgugaccgacuaccacaagaacuacgcccccaagugcgccgccugcggccagcccauccugcccagcgagggcugcgaggacaucgugagagugaucagcauggacagagacuaccacuucgagugcuaccacugcgaggacugcagaaugcagcugagcgacgaggagggcugcugcugcuucccccuggacggccaccugcugugccacggcugccacaugcagagacugaacgccagacagccccccgccaacuacaucuaa

SEQ ID NO: 13443 - RNA, 585 nt, Artificial Sequence
  AK1__Homo_sapiens__NP_000467
auggaggagaagcugaagaagaccaagaucaucuucguggugggcggccccggcagcggcaagggcacccagugcgagaagaucgugcagaaguacggcuacacccaccugagcaccggcgaccugcugagaagcgaggugagcagcggcagcgccagaggcaagaagcugagcgagaucauggagaagggccagcuggugccccuggagaccgugcuggacaugcugagagacgccaugguggccaaggugaacaccagcaagggcuuccugaucgacggcuaccccagagaggugcagcagggcgaggaguucgagagaagaaucggccagcccacccugcugcuguacguggacgccggccccgagaccaugacccagagacugcugaagagaggcgagaccagcggcagaguggacgacaacgaggagaccaucaagaagagacuggagaccuacuacaaggccaccgagcccgugaucgccuucuacgagaagagaggcaucgugagaaaggugaacgccgagggcagcguggacagcguguucagccaggugugcacccaccuggacgcccugaaguaa

SEQ ID NO: 13444 - RNA, 564 nt, Artificial Sequence
  AK3__Homo_sapiens__NP_001186781
augggcgccagcgccagacugcugagagccgugaucaugggcgcccccggcagcggcaagggcaccgugagcagcagaaucaccacccacuucgagcugaagcaccugagcagcggcgaccugcugagagacaacaugcugagaggcaccggcuuccccagaacccugccccaggccgaggcccuggacagagccuaccagaucgacaccgugaucaaccugaacgugcccuucgaggugaucaagcagagacugaccgccagauggauccaccccgccagcggcagaguguacaacaucgaguucaacccccccaagaccgugggcaucgacgaccugaccggcgagccccugauccagagagaggacgacaagcccgagaccgugaucaagagacugaaggccuacgaggaccagaccaagcccgugcuggaguacuaccagaagaagggcgugcuggagaccuucagcggcaccgagaccaacaagaucuggcccuacguguacgccuuccugcagaccaaggugccccagagaagccagaaggccagcgugacccccuaa

SEQ ID NO: 13445 - RNA, 510 nt, Artificial Sequence
  AK6__Homo_sapiens__NP_001015891
augugccacagaaagcccggcacccccggcgugggcaagaccacccugggcaaggagcuggccagcaagagcggccugaaguacaucaacgugggcgaccuggccagagaggagcagcuguacgacggcuacgacgaggaguacgacugccccauccuggacgaggacagagugguggacgagcuggacaaccagaugagagagggcggcgugaucguggacuaccacggcugcgacuucuuccccgagagaugguuccacaucguguucgugcugagaaccgacaccaacgugcuguacgagagacuggagaccagaggcuacaacgagaagaagcugaccgacaacauccagugcgagaucuuccaggugcuguacgaggaggccaccgccagcuacaaggaggagaucgugcaccagcugcccagcaacaagcccgaggagcuggagaacaacguggaccagauccugaaguggaucgagcaguggaucaaggaccacaacagcuaa

SEQ ID NO: 13446 - RNA, 2172 nt, Artificial Sequence
  AK7__Homo_sapiens__NP_689540
auggccgaggaggaggagaccgccgcccugaccgagaaggugaucagaacccagagaguguucaucaaccugcuggacagcuacagcagcggcaacaucggcaaguuccugagcaacugcguggugggcgccagccuggaggagaucaccgaggaggaggaggaggaggacgagaacaagagcgccaugcuggaggccagcagcaccaaggugaaggagggcaccuuccagaucgugggcacccugagcaagcccgacagccccagacccgacuucgccguggagaccuacagcgccaucagcagagaggaccugcugaugagacugcuggagugcgacgugaucaucuacaacaucaccgagagcagccagcagauggaggaggccaucugggccgugagcgcccugagcgaggaggugagccacuucgagaagagaaagcuguucauccugcugagcaccgugaugaccugggccagaagcaaggcccuggaccccgaggacagcgaggugcccuucaccgaggaggacuacagaagaagaaagagccaccccaacuuccuggaccacaucaacgccgagaagauggugcugaaguucggcaagaaggccagaaaguucgccgccuacgugguggccgccggccugcaguacggcgccgagggcggcaugcugcacaccuucuucaagauggccuggcugggcgagauccccgcccugcccguguucggcgacggcaccaacgugauccccaccauccacgugcuggaccuggccggcgugauccagaacgugaucgaccacgugcccaagccccacuaccugguggccguggacgagagcgugcacacccuggaggacaucgugaagugcaucagcaagaacaccggccccggcaagauccagaagauccccagagagaacgccuaccugaccaaggaccugacccaggacugccuggaccaccugcuggugaaccugagaauggaggcccuguucgugaaggagaacuucaacaucagaugggccgcccagaccggcuucguggagaacaucaacaccauccugaaggaguacaagcagagcagaggccugaugcccaucaagaucugcauccugggcccccccgccgugggcaagagcagcaucgccaaggagcuggccaacuacuacaagcugcaccacauccagcugaaggacgugaucagcgaggccaucgccaagcuggaggccaucguggcccccaacgacgugggcgagggcgaggaggagguggaggaggaggaggaggaggagaacguggaggacgcccaggagcugcuggacggcaucaaggagagcauggagcagaacgccggccagcuggacgaccaguacaucaucagauucaugaaggagaagcugaagagcaugcccugcagaaaccagggcuacauccuggacggcuuccccaagaccuacgaccaggccaaggaccuguucaaccaggaggacgaggaggaggaggacgacgugagaggcagaauguuccccuucgacaagcugaucauccccgaguucgugugcgcccuggacgccagcgacgaguuccugaaggagagagugaucaaccugcccgagagcaucguggccggcacccacuacagccaggacagauuccugagagcccugagcaacuacagagacaucaacaucgacgacgagaccguguucaacuacuucgacgagcuggagauccaccccauccacaucgacgugggcaagcuggaggacgcccagaacagacuggccaucaagcagcugaucaaggagaucggcgagcccagaaacuacggccugaccgacgaggagaaggccgaggaggagagaaaggccgccgaggagagacuggccagagaggccgccgaggaggccgagagagagcaccaggaggccguggagauggccgagaagaucgccagaugggaggaguggaacaagagacuggaggaggugaagagagaggagagagagcugcuggaggcccagagcaucccccugagaaacuaccugaugaccuacgugaugcccacccugauccagggccugaacgagugcugcaacgugagacccgaggaccccguggacuuccuggccgaguaccuguucaagaacaaccccgaggcccaguaa

SEQ ID NO: 13447 - RNA, 1440 nt, Artificial Sequence
  AK8__Homo_sapiens__NP_689785
auggacgccaccaucgccccccacagaaucccccccgagaugccccaguacggcgaggagaaccacaucuucgagcugaugcagaacaugcuggagcagcugcugauccaccagcccgaggaccccauccccuucaugauccagcaccugcacagagacaacgacaacgugcccagaaucgugauccugggcccccccgccagcggcaagaccaccaucgccauguggcugugcaagcaccugaacagcagccugcugacccuggagaaccugauccugaacgaguucagcuacaccgccaccgaggccagaagacuguaccugcagagaaagaccgugcccagcgcccugcuggugcagcugauccaggagagacuggccgaggaggacugcaucaagcagggcuggauccuggacggcauccccgagaccagagagcaggcccugagaauccagacccugggcaucacccccagacacgugaucgugcugagcgcccccgacaccgugcugaucgagagaaaccugggcaagagaaucgacccccagaccggcgagaucuaccacaccaccuucgacuggccccccgagagcgagauccagaacagacugauggugcccgaggacaucagcgagcuggagaccgcccagaagcugcuggaguaccacagaaacaucgugagagugauccccagcuaccccaagauccugaaggugaucagcgccgaccagcccugcguggacguguucuaccaggcccugaccuacgugcagagcaaccacagaaccaacgcccccuucacccccagagugcugcugcugggccccgugggcagcggcaagagccugcaggccgcccugcuggcccagaaguacagacuggugaacgugugcugcggccagcugcugaaggaggccguggccgacagaaccaccuucggcgagcugauccagcccuucuucgagaaggagauggccgugcccgacagccugcugaugaaggugcugagccagagacuggaccagcaggacugcauccagaagggcugggugcugcacggcgugcccagagaccuggaccaggcccaccugcugaacagacugggcuacaaccccaacagaguguucuuccugaacgugcccuucgacagcaucauggagagacugacccugagaagaaucgaccccgugaccggcgagagauaccaccugauguacaagcccccccccaccauggagauccaggccagacugcugcagaaccccaaggacgccgaggagcaggugaagcugaagauggaccuguucuacagaaacagcgccgaccuggagcagcuguacggcagcgccaucacccugaacggcgaccaggaccccuacaccguguucgaguacaucgagagcggcaucaucaacccccugcccaagaagauccccuaa

SEQ ID NO: 13448 - RNA, 1266 nt, Artificial Sequence
  AK9__Homo_sapiens__NP_659462
augaccagccaggagaagaccgaggaguaccccuucgccgacaucuucgacgaggacgagaccgagagaaacuuccugcugagcaagcccgugugcuucgugguguucggcaagcccggcgugggcaagaccacccuggccagauacaucacccaggccuggaagugcaucagaguggaggcccugcccauccuggaggagcagaucgccgccgagaccgagagcggcgugaugcugcagagcaugcugaucagcggccagagcauccccgacgagcuggugaucaagcugaugcuggagaagcugaacagccccgaggugugccacuucggcuacaucaucaccgagauccccagccugagccaggacgccaugaccacccugcagcagaucgagcugaucaagaaccugaaccugaagcccgacgugaucaucaacaucaagugccccgacuacgaccugugccagagaaucagcggccagagacagcacaacaacaccggcuacaucuacagcagagaccagugggaccccgaggugaucgagaaccacagaaagaagaagaaggaggcccagaaggacggcaagggcgaggaggaggaggaggaggaggagcaggaggaggaggaggccuucaucgccgagaugcagaugguggccgagauccugcaccaccuggugcagagacccgaggacuaccuggagaacguggagaacaucgugaagcuguacaaggagaccauccugcagacccuggaggaggugauggccgagcacaacccccaguaccugaucgagcugaacggcaacaagcccgccgaggagcuguucaugaucgugauggacagacugaaguaccugaaccugaagagagccgccauccugaccaagcugcagggcgccgaggaggagaucaacgacaccauggagaacgacgagcuguucagaacccuggccagcuacaagcugaucgcccccagauacagauggcagagaagcaaguggggcagaaccugccccgugaaccugaaggacggcaacaucuacagcggccugcccgacuacagcgugagcuuccugggcaagaucuacugccugagcagcgaggaggcccugaagcccuuccugcugaaccccagacccuaccugcugccccccaugcccggcccccccugcaagguguucauccugggcccccaguacagcggcaagaccacccugugcaacaugcuggccgagaacuacaagggcaaggugaccaacuaa

SEQ ID NO: 13449 - RNA, 1989 nt, Artificial Sequence
  AKAP10__Homo_sapiens__NP_009133
augagaggcgccggccccagccccagacagagccccagaacccugagacccgaccccggccccgccaugagcuucuucagaagaaaggugaagggcaaggagcaggagaagaccagcgacgugaagagcaucaaggccagcaucagcgugcacagcccccagaagagcaccaagaaccacgcccugcuggaggccgccggccccagccacguggccaucaacgccaucagcgccaacauggacagcuucagcagcagcagaaccgccacccugaagaagcagcccagccacauggaggccgcccacuucggcgaccugggcagaagcugccuggacuaccagacccaggagaccaagagcagccugagcaagacccuggagcaggugcugcacgacaccaucgugcugcccuacuucauccaguucauggagcugagaagaauggagcaccuggugaaguucuggcuggaggccgagagcuuccacagcaccaccuggagcagaaucagagcccacagccugaacaccgugaagcagagcagccuggccgagcccgugagccccagcaagaagcacgagaccaccgccagcuuccugaccgacagccuggacaagagacuggaggacagcggcagcgcccagcuguucaugacccacagcgagggcaucgaccugaacaacagaaccaacagcacccagaaccaccugcugcugagccaggagugcgacagcgcccacagccugagacuggagauggccagagccggcacccaccaggugagcauggagacccaggagagcagcagcacccugaccguggccagcagaaacagccccgccagcccccugaaggagcugagcggcaagcugaugaagagcaucgagcaggacgccgugaacaccuucaccaaguacaucagccccgacgccgccaagcccauccccaucaccgaggccaugagaaacgacaucaucgccagaaucugcggcgaggacggccagguggaccccaacugcuucgugcuggcccagagcaucguguucagcgccauggagcaggagcacuucagcgaguuccugagaagccaccacuucugcaaguaccagaucgaggugcugaccagcggcaccguguaccuggccgacauccuguucugcgagagcgcccuguucuacuucagcgaguacauggagaaggaggacgccgugaacauccugcaguucuggcuggccgccgacaacuuccagagccagcuggccgccaagaagggccaguacgacggccaggaggcccagaacgacgccaugauccuguacgacaaguacuucagccugcaggccacccacccccugggcuucgacgacguggugagacuggagaucgagagcaacaucugcagagagggcggcccccugcccaacugcuucaccaccccccugagacaggccuggaccaccauggagaagguguuccugcccggcuuccugagcagcaaccuguacuacaaguaccugaacgaccugauccacagcgugagaggcgacgaguuccugggcggcaacgugagccugaccgcccccggcagcgugggcccccccgacgagagccaccccggcagcagcgacagcagcgccagccagagcagcgugaagaaggccagcaucaagauccugaagaacuucgacgaggccaucaucguggacgccgccagccuggaccccgagagccuguaccagagaaccuacgccggcaagaugaccuucggcagagugagcgaccugggccaguucaucagagagagcgagcccgagcccgacgugagaaagagcaagggcagcauguucagccaggccaugaagaagugggugcagggcaacaccgacgaggcccaggaggagcuggccuggaagaucgccaagaugaucgugagcgacaucaugcagcaggcccaguacgaccagccccuggagaagagcaccaagcuguaa

SEQ ID NO: 13450 - RNA, 5349 nt, Artificial Sequence
  AKAP12__Homo_sapiens__NP_005091
augggcgccggcagcagcaccgagcagagaagccccgagcagccccccgagggcagcagcacccccgccgagcccgagcccagcggcggcggccccagcgccgaggccgcccccgacaccaccgccgaccccgccaucgccgccagcgaccccgccaccaagcugcugcagaagaacggccagcugagcaccaucaacggcguggccgagcaggacgagcugagccugcaggagggcgaccugaacggccagaagggcgcccugaacggccagggcgcccugaacagccaggaggaggaggaggugaucgugaccgaggugggccagagagacagcgaggacgugagcaagagagacagcgacaaggagauggccaccaagagcgccguggugcacgacaucaccgacgacggccaggaggagacccccgagaucaucgagcagauccccagcagcgagagcaaccuggaggagcugacccagcccaccgagagccaggccaacgacaucggcuucaagaagguguucaaguucgugggcuucaaguucaccgugaagaaggacaagaccgagaagcccgacaccgugcagcugcugaccgugaagaaggacgagggcgagggcgccgccggcgccggcgaccacaaggaccccagccugggcgccggcgaggccgccagcaaggagagcgagcccaagcagagcaccgagaagcccgaggagacccugaagagagagcagagccacgccgagaucagcccccccgccgagagcggccaggccguggaggagugcaaggaggagggcgaggagaagcaggagaaggagcccagcaagagcgccgagagccccaccagccccgugaccagcgagaccggcagcaccuucaagaaguucuucacccagggcugggccggcuggagaaagaagaccagcuucagaaagcccaaggaggacgagguggaggccagcgagaagaagaaggagcaggagcccgagaagguggacaccgaggaggacggcaaggccgagguggccagcgagaagcugaccgccagcgagcaggcccacccccaggagcccgccgagagcgcccacgagcccagacugagcgccgaguacgagaagguggagcugcccagcgaggagcaggugagcggcagccagggccccagcgaggagaagcccgccccccuggccaccgagguguucgacgagaagaucgaggugcaccaggaggaggugguggccgaggugcacgugagcaccguggaggagagaaccgaggagcagaagaccgagguggaggagaccgccggcagcgugcccgccgaggagcugguggagauggacgccgagccccaggaggccgagcccgccaaggagcuggugaagcugaaggagaccugcgugagcggcgaggaccccacccagggcgccgaccugagccccgacgagaaggugcugagcaagccccccgagggcguggugagcgagguggagaugcugagcagccaggagagaaugaaggugcagggcagcccccugaagaagcuguucaccagcaccggccugaagaagcugagcggcaagaagcagaagggcaagagaggcggcggcgacgaggagagcggcgagcacacccaggugcccgccgacagccccgacagccaggaggagcagaagggcgagagcagcgccagcagccccgaggagcccgaggagaucaccugccuggagaagggccuggccgaggugcagcaggacggcgaggccgaggagggcgccaccagcgacggcgagaagaagagagagggcgugacccccugggccagcuucaagaagauggugacccccaagaagagagugagaagacccagcgagagcgacaaggaggacgagcuggacaaggugaagagcgccacccugagcagcaccgagagcaccgccagcgagaugcaggaggagaugaagggcagcguggaggagcccaagcccgaggagcccaagagaaagguggacaccagcgugagcugggaggcccugaucugcgugggcagcagcaagaagagagccagaagaggcagcagcagcgacgaggagggcggccccaaggccaugggcggcgaccaccagaaggccgacgaggccggcaaggacaaggagaccggcaccgacggcauccuggccggcagccaggagcacgaccccggccagggcagcagcagccccgagcaggccggcagccccaccgagggcgagggcgugagcaccugggagagcuucaagagacuggugacccccagaaagaagagcaagagcaagcuggaggagaagagcgaggacagcaucgccggcagcggcguggagcacagcacccccgacaccgagcccggcaaggaggagagcugggugagcaucaagaaguucauccccggcagaagaaagaagagacccgacggcaagcaggagcaggcccccguggaggacgccggccccaccggcgccaacgaggacgacagcgacgugcccgccguggugccccugagcgaguacgacgccguggagagagagaagauggaggcccagcaggcccagaagagcgccgagcagcccgagcagaaggccgccaccgaggugagcaaggagcugagcgagagccaggugcacaugauggccgccgccguggccgacggcaccagagccgccaccaucaucgaggagagaagccccagcuggaucagcgccagcgugaccgagccccuggagcagguggaggccgaggccgcccugcugaccgaggaggugcuggagagagaggugaucgccgaggaggagccccccaccgugaccgagccccugcccgagaacagagaggccagaggcgacaccguggugagcgaggccgagcugacccccgaggccgugaccgccgccgagaccgccggcccccugggcgccgaggagggcaccgaggccagcgccgccgaggagaccaccgagauggugagcgccgugagccagcugaccgacagccccgacaccaccgaggaggccacccccgugcaggagguggagggcggcgugcccgacaucgaggagcaggagagaagaacccaggaggugcugcaggccguggccgagaaggugaaggaggagagccagcugcccggcaccggcggccccgaggacgugcugcagcccgugcagagagccgaggccgagagacccgaggagcaggccgaggccagcggccugaagaaggagaccgacguggugcugaagguggacgcccaggaggccaagaccgagcccuucacccagggcaagguggugggccagaccacccccgagagcuucgagaaggccccccaggugaccgagagcaucgagagcagcgagcuggugaccaccugccaggccgagacccuggccggcgugaagagccaggagauggugauggagcaggccaucccccccgacagcguggagacccccaccgacagcgagaccgacggcagcacccccguggccgacuucgacgcccccggcaccacccagaaggacgagaucguggagauccacgaggagaacgagguggccagcggcacccagagcggcggcaccgaggccgaggccgugcccgcccagaaggagagaccccccgcccccagcagcuucguguuccaggaggagaccaaggagcagagcaagauggaggacacccuggagcacaccgacaaggaggugagcguggagaccgugagcauccugagcaagaccgagggcacccaggaggccgaccaguacgccgacgagaagaccaaggacgugcccuucuucgagggccuggagggcagcaucgacaccggcaucaccgugagcagagagaaggugaccgagguggcccugaagggcgagggcaccgaggaggccgagugcaagaaggacgacgcccuggagcugcagagccacgccaagagcccccccagccccguggagagagagaugguggugcagguggagagagagaagaccgaggccgagcccacccacgugaacgaggagaagcuggagcacgagaccgccgugaccgugagcgaggaggugagcaagcagcugcugcagaccgugaacgugcccaucaucgacggcgccaaggaggugagcagccuggagggcagccccccccccugccugggccaggaggaggccgugugcaccaagauccaggugcagagcagcgaggccagcuucacccugaccgccgccgccgaggaggagaaggugcugggcgagaccgccaacauccuggagaccggcgagacccuggagcccgccggcgcccaccuggugcuggaggagaagagcagcgagaagaacgaggacuucgccgcccaccccggcgaggacgccgugcccaccggccccgacugccaggccaagagcacccccgugaucgugagcgccaccaccaagaagggccugagcagcgaccuggagggcgagaagaccaccagccugaaguggaagagcgacgagguggacgagcagguggccugccaggaggugaaggugagcguggccaucgaggaccuggagcccgagaacggcauccuggagcuggagaccaagagcagcaagcuggugcagaacaucauccagaccgccguggaccaguucgugagaaccgaggagaccgccaccgagaugcugaccagcgagcugcagacccaggcccacgugaucaaggccgacagccaggacgccggccaggagaccgagaaggagggcgaggagccccaggccagcgcccaggacgagacccccaucaccagcgccaaggaggagagcgagagcaccgccgugggccaggcccacagcgacaucagcaaggacaugagcgaggccagcgagaagaccaugaccguggagguggagggcagcaccgugaacgaccagcagcuggaggagguggugcugcccagcgaggaggagggcggcggcgccggcaccaagagcgugcccgaggacgacggccacgcccugcuggccgagagaaucgagaagagccugguggagcccaaggaggacgagaagggcgacgacguggacgaccccgagaaccagaacagcgcccuggccgacaccgacgccagcggcggccugaccaaggagagccccgacaccaacggccccaagcagaaggagaaggaggacgcccaggagguggagcugcaggagggcaaggugcacagcgagagcgacaaggccaucaccccccaggcccaggaggagcugcagaagcaggagagagagagcgccaagagcgagcugaccgagagcuaa

SEQ ID NO: 13451 - RNA, 4305 nt, Artificial Sequence
  AKAP13__Homo_sapiens__NP_001257475
auguacgagagacacaagagaagauacagccugugcgacaucagcaagguggacagaaccguggacguggugcugcugaagaucaacagagagaacuggugcaccaucgagcccugccccgacgccgccagccugcuggccagcaagcagagccccgagugcgagaacuuccuggacgugggccugggcagagagugcaccagcaagcagggcgugcugaagagagagagcggcagcgacagcgaccuguuccacagccccagcgacgacauggacagcaucaucuuccccaagcccgaggaggagcaccuggccugcgacaucaccggcagcagcagcagcaccgacgacaccgccagccuggacagacacagcagccacggcagcgacgugagccugagccagauccugaagcccaacagaagcagagacagacagagccuggacggcuucuacagccacggcaugggcgccgagggcagagagagcgagagcgagcccgccgaccccggcgacguggaggaggaggagauggacagcaucaccgaggugcccgccaacugcagcgugcugagaagcagcaugagaagccugagccccuucagaagacacagcuggggccccggcaagaacgccgccagcgacgccgagaugaaccacagaagcuucagccuggagggccugaccggcggcgccggcgugggcaacaagcccagcagcagccuggaggugagcagcgccaacgccgaggagcugagacaccccuucagcggcgaggagagaguggacagccuggugagccugagcgaggaggaccuggagagcgaccagagagagcacagaauguucgaccagcagaucugccacagaagcaagcagcagggcuucaacuacugcaccagcgccaucagcagcccccugaccaagagcaucagccugaugaccaucagccaccccggccuggacaacagcagacccuuccacagcaccuuccacaacaccagcgccaaccugaccgagagcaucaccgaggagaacuacaacuuccugccccacagccccagcaagaaggacagcgaguggaagagcggcaccaaggugagcagaaccuucagcuacaucaagaacaagaugagcagcagcaagaagagcaaggagaaggagaaggagaaggacaagaucaaggagaaggagaaggacagcaaggacaaggagaaggacaagaagaccgugaacggccacaccuucagcagcauccccguggugggccccaucagcugcagccagugcaugaagcccuucaccaacaaggacgccuacaccugcgccaacugcagcgccuucgugcacaagggcugcagagagagccuggccagcugcgccaaggugaagaugaagcccaagggcagccugcaggcccacgacaccagcagccugcccaccgugaucaugagaaacaagcccagccagcccaaggagagacccagaagcgccgugcugcugguggacgagaccgccaccacccccaucuucgccaacagaagaagccagcagagcgugagccugagcaagagcgugagcauccagaacaucaccggcgugggcaacgacgagaacaugagcaacaccuggaaguuccugagccacagcaccgacagccugaacaagaucagcaaggugaacgagagcaccgagagccugaccgacgagggcgugggcaccgacaugaacgagggccagcugcugggcgacuucgagaucgagagcaagcagcuggaggccgagagcuggagcagaaucaucgacagcaaguuccugaagcagcagaagaaggacguggugaagagacaggaggugaucuacgagcugaugcagaccgaguuccaccacgugagaacccugaagaucaugagcggcguguacagccagggcaugauggccgaccugcuguucgagcagcagaugguggagaagcuguuccccugccuggacgagcugaucagcauccacagccaguucuuccagagaauccuggagagaaagaaggagagccugguggacaagagcgagaagaacuuccugaucaagagaaucggcgacgugcuggugaaccaguucagcggcgagaacgccgagagacugaagaagaccuacggcaaguucugcggccagcacaaccagagcgugaacuacuucaaggaccuguacgccaaggacaagagauuccaggccuucgugaagaagaagaugagcagcagcguggugagaagacugggcauccccgagugcauccugcuggugacccagagaaucaccaaguaccccgugcuguuccagagaauccugcagugcaccaaggacaacgagguggagcaggaggaccuggcccagagccugagccuggugaaggacgugaucggcgccguggacagcaagguggccagcuacgagaagaaggugagacugaacgagaucuacaccaagaccgacagcaagagcaucaugagaaugaagagcggccagauguucgccaaggaggaccugaagagaaagaagcuggugagagacggcagcguguuccugaagaacgccgccggcagacugaaggaggugcaggccgugcugcugaccgacauccugguguuccugcaggagaaggaccagaaguacaucuucgccagccuggaccagaagagcaccgugaucagccugaagaagcugaucgugagagagguggcccacgaggagaagggccuguuccugaucagcaugggcaugaccgaccccgagaugguggaggugcacgccagcagcaaggaggagagaaacagcuggauccagaucauccaggacaccaucaacacccugaacagagacgaggacgagggcauccccagcgagaacgaggaggagaagaagaugcuggacaccagagccagagagcugaaggagcagcugcaccagaaggaccagaagauccugcugcugcuggaggagaaggagaugaucuucagagacauggccgagugcagcaccccccugcccgaggacugcagccccacccacagccccagagugcuguucagaagcaacaccgaggaggcccugaagggcggcccccugaugaagagcgccaucaacgagguggagauccugcagggccuggugagcggcaaccugggcggcacccugggccccaccgugagcagccccaucgagcaggacguggugggccccgugagccugcccagaagagccgagaccuucggcggcuucgacagccaccagaugaacgccagcaagggcggcgagaaggaggagggcgacgacggccaggaccugagaagaaccgagagcgacagcggccugaagaagggcggcaacgccaaccugguguucaugcugaagagaaacagcgagcagguggugcagagcguggugcaccuguacgagcugcugagcgcccugcagggcguggugcugcagcaggacagcuacaucgaggaccagaagcuggugcugagcgagagagcccugaccagaagccugagcagacccagcagccugaucgagcaggagaagcagagaagccuggagaagcagagacaggaccuggccaaccugcagaagcagcaggcccaguaccuggaggagaagagaagaagagagagagagugggaggccagagagagagagcugagagagagagaggcccugcuggcccagagagaggaggaggugcagcagggccagcaggaccuggagaaggagagagaggagcugcagcagaagaagggcaccuaccaguacgaccuggagagacugagagccgcccagaagcagcuggagagagagcaggagcagcugagaagagaggccgagagacugagccagagacagaccgagagagaccugugccaggugagccacccccacaccaagcugaugagaauccccagcuucuuccccagccccgaggagccccccagccccagcgcccccagcaucgccaagagcggcagccuggacagcgagcugagcgugagccccaagagaaacagcaucagcagaacccacaaggacaagggccccuuccacauccugagcagcaccagccagaccaacaagggccccgagggccagagccaggcccccgccagcaccagcgccagcaccagacuguucggccugaccaagcccaaggagaagaaggagaagaagaagaagaacaagaccagcagaagccagcccggcgacggccccgccagcgaggugagcgccgagggcgaggagaucuucugcuaa

SEQ ID NO: 13452 - RNA, 2088 nt, Artificial Sequence
  AKAP17A__Homo_sapiens__NP_005079
auggccgccgccaccaucgugcacgacaccagcgaggccguggagcugugccccgccuacggccuguaccugaagcccaucaccaagaugaccaucagcguggcccugccccagcugaagcagcccggcaagagcaucagcaacugggaggugauggagagacugaagggcauggugcagaaccaccaguucagcacccugagaaucagcaagagcaccauggacuucaucagauucgagggcgagguggagaacaagagccuggugaagagcuuccuggccugccuggacggcaagaccaucaagcugagcggcuucagcgacauccugaaggugagagccgccgaguucaagaucgacuuccccaccagacacgacugggacagcuucuucagagacgccaaggacaugaacgagacccugcccggcgagagacccgacaccauccaccuggagggccugcccugcaagugguucgcccugaaggagagcggcagcgagaagcccagcgaggacgugcuggugaagguguucgagaaguucggcgagaucagaaacguggacauccccaugcuggaccccuacagagaggagaugaccggcagaaacuuccacaccuucagcuucggcggccaccugaacuucgaggccuacgugcaguacagagaguacaugggcuucauccaggccaugagcgcccugagaggcaugaagcugauguacaagggcgaggacggcaaggccguggccugcaacaucaaggugagcuucgacagcaccaagcaccugagcgacgccagcaucaagaagagacagcuggagagacagaagcugcaggagcuggagcagcagagagaggagcagaagagaagagagaaggaggccgaggagagacagagagccgaggagagaaagcagaaggagcuggaggagcuggagagagagagaaagagagaggagaagcugagaaagagagagcagaagcagagagacagagagcugagaagaaaccagaagaagcuggagaagcugcaggccgaggagcagaagcagcugcaggagaagaucaagcuggaggagagaaagcugcugcuggcccagagaaaccugcagagcaucagacugaucgccgagcugcugagcagagccaaggccgugaagcugagagagcaggagcagaaggaggagaagcugagacugcagcagcaggaggagagaagaagacugcaggaggccgagcugagaagaguggaggaggagaaggagagagcccugggccugcagagaaaggagagagagcugagagagagacugcugagcauccugcugagcaagaagcccgacgacagccacacccacgacgagcugggcguggcccacgccgaccugcugcagcccgugcuggacauccugcagaccgugagcagcggcugcgugagcgccaccacccugcacccccugggcggccagccccccgccggcgcccccaaggagagccccgcccaccccgaggccgacggcgcccccaagagcgugaacggcagcguggccgaggaggcccccugcaaggaggugcagagcagcugcagaguggugcccgaggacggcagccccgagaagagaugccccggcggcgugcugagcugcauccccgacaacaaccagcagcccaagggcauccccgccugcgagcagaacgugagcagaaaggacaccagaagcgagcaggacaagugcaacagagagcccagcaagggcagaggcagagccaccggcgacggccuggccgacagacacaagagagagagaagcagagccagaagagccagcagcagagaggacggcagacccagaaaggagagaagaccccacaagaagcacgccuacaaggacgacagccccagaagaagaagcaccagccccgaccacaccagaagcagaagaagccacagcaaggacagacacagaagagagagaagcagagagagaagaggcagcgccagcagaaagcacagcagacacagaagaagaagcgagagaagcagaagcagaagccccagcagacacagaagcaccuggaacagauaa

SEQ ID NO: 13453 - RNA, 2712 nt, Artificial Sequence
  AKAP1__Homo_sapiens__NP_003479
auggccauccaguucagaagccuguucccccuggcccugcccggcaugcuggcccugcugggcugguggugguucuucagcagaaagaagggccacgugagcagccacgacgagcagcagguggaggccggcgccgugcagcugagagccgaccccgccaucaaggagccccugcccguggaggacgugugccccaagguggugagcaccccccccagcgugaccgagccccccgagaaggagcugagcaccgugagcaagcugcccgccgagccccccgcccugcugcagacccacccccccugcagaagaagcgagagcagcggcauccugcccaacaccaccgacaugagacugagacccggcaccagaagagacgacagcaccaagcuggagcuggcccugaccggcggcgaggccaagagcaucccccuggagugcccccugagcagccccaagggcgugcuguucagcagcaagagcgccgaggugugcaagcaggacagccccuucagcagagugcccagaaaggugcagcccggcuaccccguggugcccgccgagaagagaagcagcggcgagagagccagagagaccggcggcgccgagggcaccggcgacgccgugcugggcgagaaggugcuggaggaggcccugcugagcagagagcacgugcuggagcuggagaacagcaagggccccagccuggccagccuggagggcgaggaggacaagggcaagagcagcagcagccagguggugggccccgugcaggaggaggaguacguggccgagaagcugcccagcagauucaucgagagcgcccacaccgagcuggccaaggacgacgccgcccccgccccccccguggccgacgccaaggcccaggacagaggcguggagggcgagcugggcaacgaggagagccuggacagaaacgaggagggccuggacagaaacgaggagggccuggacagaaacgaggagagccuggacagaaacgaggagggccuggacagaaacgaggagaucaagagagccgccuuccagaucaucagccaggugaucagcgaggccaccgagcaggugcuggccaccaccgugggcaagguggccggcagagugugccaggccagccagcugcagggccagaaggaggagagcugcgugcccgugcaccagaagaccgugcugggccccgacaccgccgagcccgccaccgccgaggccgccguggccccccccgacgccggccugccccugcccggccugcccgccgagggcagccccccccccaagaccuacgugagcugccugaagagccugcugagcagccccaccaaggacagcaagcccaacaucagcgcccaccacaucagccuggccagcugccuggcccugaccacccccagcgaggagcugcccgacagagccggcauccugguggaggacgccaccugcgugaccugcaugagcgacagcagccagagcgugccccugguggccagccccggccacugcagcgacagcuucagcaccagcggccuggaggacagcugcaccgagaccagcagcagccccagagacaaggccaucacccccccccugcccgagagcaccgugcccuucagcaacggcgugcugaagggcgagcugagcgaccugggcgccgaggacggcuggaccauggacgccgaggccgaccacagcggcggcagcgacagaaacagcauggacagcguggacagcugcugcagccugaagaagaccgagagcuuccagaacgcccaggccggcagcaaccccaagaagguggaccugaucaucugggagaucgaggugcccaagcaccuggugggcagacugaucggcaagcagggcagauacgugagcuuccugaagcagaccagcggcgccaagaucuacaucagcacccugcccuacacccagagcgugcagaucugccacaucgagggcagccagcaccacguggacaaggcccugaaccugaucggcaagaaguucaaggagcugaaccugaccaacaucuacgcccccccccugcccagccuggcccugcccagccugcccaugaccagcuggcugaugcugcccgacggcaucaccguggaggugaucguggugaaccaggugaacgccggccaccuguucgugcagcagcacacccaccccaccuuccacgcccugagaagccuggaccagcagauguaccugugcuacagccagcccggcauccccacccugcccacccccguggagaucaccgugaucugcgccgcccccggcgccgacggcgccugguggagagcccaggugguggccagcuacgaggagaccaacgagguggagaucagauacguggacuacggcggcuacaagagagugaagguggacgugcugagacagaucagaagcgacuucgugacccugcccuuccagggcgccgaggugcugcuggacagcgugaugccccugagcgacgacgaccaguucagccccgaggccgacgccgccaugagcgagaugaccggcaacaccgcccugcuggcccaggugaccagcuacagccccaccggccugccccugauccagcuguggagcguggugggcgacgagguggugcugaucaacagaagccugguggagagaggccuggcccaguggguggacagcuacuacaccagccuguaa

SEQ ID NO: 13454 - RNA, 2847 nt, Artificial Sequence
  AKAP2__Homo_sapiens__NP_001004065
augagauggccccagcccggcgccgccgccagacugccccccgagagccccggcccccccgagagccccggcccccccgagagagaggccgccgccgccagaagauggaccggcgccgagccccaggacugcgcccccggcagcggcagacccgagaagcccccccagcugagcgaggacgacaucuggcugaagagcgagggcgacaacuacagcgccacccugcuggagcccgccgccagcagccugagccccgaccacaagaacauggagaucgaggugagcguggccgagugcaagagcgugcccggcaucaccagcaccccccaccccauggaccaccccagcgccuucuacagccccccccacaacggccugcugaccgaccaccacgagagccuggacaacgacguggccagagagaucagauaccuggacgaggugcuggaggccaacugcugcgacagcgccguggacggcaccuacaacggcaccagcagccccgagcccggcgccguggugcuggugggcggccugagcccccccgugcacgaggccacccagcccgagcccaccgagagaaccgccagcagacaggcccccccccacaucgagcugagcaacagcagccccgaccccauggccgaggccgagagaaccaacggccacagccccagccagcccagagacgcccugggcgacagccugcaggugcccgugagccccagcagcaccaccagcagcagaugcagcagcagagacggcgaguucacccugaccacccugaagaaggaggccaaguucgagcugagagccuuccacgaggacaagaagcccagcaagcuguucgaggacgacgagcacgagaaggagcaguacugcaucagaaaggugagacccagcgaggagaugcuggagcuggagaaggagagaagagagcugaucagaagccaggccgugaagaagaaccccggcaucgccgccaagugguggaaccccccccaggagaagaccaucgaggagcagcuggacgaggagcaccuggagagccacaagaaguacaaggagagaaaggagagaagagcccagcaggagcagcugcugcugcagaagcagcugcagcagcagcagcagcagccccccagccagcugugcaccgcccccgccagcagccacgagagagccagcaugaucgacaaggccaaggaggacaucgugaccgagcagaucgacuucagcgccgccagaaagcaguuccagcugauggagaacagcagacaggccguggccaagggccagagcacccccagacuguucagcaucaagcccuucuacagaccccugggcagcgugaacagcgacaagccccugaccaaccccagaccccccagcgugggcggcccccccgaggacagcggcgccagcgccgccaagggccagaagagccccggcgcccuggagacccccagcgccgccggcagccagggcaacaccgccagccagggcaaggagggccccuacagcgagcccagcaagagaggcccccugagcaagcugugggccgaggacggcgaguucaccagcgccagagccgugcugaccguggugaaggacgacgaccacggcauccuggaccaguucagcagaagcgugaacgugagccugacccaggaggagcuggacagcggccuggacgagcugagcgugagaagccaggacaccaccgugcuggagacccugagcaacgacuucagcauggacaacaucagcgacagcggcgccagcaacgagaccaccaacgcccugcaggagaacagccuggccgacuucagccugccccagaccccccagaccgacaaccccagcgagggcagaggcgagggcgugagcaagagcuucagcgaccacggcuucuacagccccagcagcacccugggcgacagcccccugguggacgacccccuggaguaccaggccggccugcuggugcagaacgccauccagcaggccaucgccgagcagguggacaaggccgugagcaagaccagcagagacggcgccgagcagcagggccccgaggccaccguggaggaggccgaggccgccgccuucggcagcgagaagccccagagcauguucgagcccccccaggugagcagccccgugcaggagaagagagacgugcugcccaagauccugcccgccgaggacagagcccugagagagagaggccccccccagccccugcccgccgugcagcccagcggccccaucaacauggaggagaccagacccgagggcagcuacuucagcaaguacagcgaggccgccgagcugagaagcaccgccagccugcuggccacccaggagagcgacgugauggugggccccuucaagcugagaagcagaaagcagagaacccugagcaugaucgaggaggagaucagagccgcccaggagagagaggaggagcugaagagacagagacaggugcugcagagcacccagagccccagaaccaagaacgcccccagccugcccagcagaaccugcuacaagaccgcccccggcaagaucgagaaggugaagcccccccccagccccaccaccgagggccccagccugcagcccgaccuggcccccgaggaggccgccggcacccagagacccaagaaccugaugcagacccugauggaggacuacgagacccacaagagcaagagaagagagagaauggacgacagcagcgugcuggaggccaccagagugaacagaagaaagagcgcccuggcccugagaugggaggccggcaucuacgccaaccaggaggaggaggacaacgaguaa

SEQ ID NO: 13455 - RNA, 2562 nt, Artificial Sequence
  AKAP3__Homo_sapiens__NP_001265238
augagcgagaagguggacuggcugcagagccagaacggcgugugcaagguggacguguacagccccggcgacaaccaggcccaggacuggaagauggacaccagcaccgaccccgugagagugcugagcuggcugagaagagaccuggagaagagcaccgccgaguuccaggacgugagauucaagcccggcgagagcuucggcggcgagaccagcaacagcggcgacccccacaagggcuucagcguggacuacuacaacaccaccaccaagggcacccccgagagacugcacuucgagaugacccacaaggagauccccugccagggccccagagcccagcugggcaacggcagcagcguggacgaggugagcuucuacgccaacagacugaccaaccuggugaucgccauggccagaaaggagaucaacgagaagaucgacggcagcgagaacaagugcguguaccagagccuguacaugggcaacgagcccacccccaccaagagccugagcaagaucgccagcgagcuggugaacgagaccgugagcgccugcagcagaaacgccgcccccgacaaggcccccggcagcggcgacagagugagcggcagcagccagagcccccccaaccugaaguacaagagcacccugaagaucaaggagagcaccaaggagagacagggccccgacgacaagccccccagcaagaagagcuucuucuacaaggagguguucgagagcagaaacggcgacuacgccagagagggcggcagauucuuccccagagagagaaagagauucagaggccaggagagacccgacgacuucaccgccagcgugagcgagggcaucaugaccuacgccaacagcguggugagcgacaugauggugagcaucaugaagacccugaagauccaggugaaggacaccaccaucgccaccauccugcugaagaaggugcugcugaagcacgccaaggagguggugagcgaccugaucgacagcuuccugagaaaccugcacagcgugaccggcacccugaugaccgacacccaguucgugagcgccgugaagagaaccguguucagccacggcagccagaaggccaccgacaucauggacgccaugcugagaaagcuguacaacgugauguucgccaagaaggugcccgagcacgugagaaaggcccaggacaaggccgagagcuacagccugaucagcaugaagggcaugggcgaccccaagaacagaaacgugaacuucgccaugaagagcgagaccaagcugagagagaagauguacagcgagcccaagagcgaggaggagaccugcgccaagacccugggcgagcacaucaucaaggagggccugacccuguggcacaagagccagcagaaggagugcaagagccugggcuuccagcacgccgccuucgaggcccccaacacccagagaaagcccgccagcgacaucagcuucgaguaccccgaggacaucggcaaccugagccugccccccuacccccccgagaagcccgagaacuucauguacgacagcgacagcugggccaaggaccugaucgugagcgcccugcugcugauccaguaccaccuggcccagggcggcagaagagacgccagaagcuucguggaggccgccggcaccaccaacuuccccgccaacgagccccccguggcccccgacgagagcugccugaagagcgcccccaucgugggcgaccaggagcaggccgagaagaaggaccugagaagcguguucuucaacuucaucagaaaccugcugagcgagaccaucuucaagagagaccagagccccgagcccaaggugcccgagcagcccgugaaggaggacagaaagcugugcgagagaccccuggccagcagcccccccagacuguacgaggacgacgagacccccggcgcccugagcggccugaccaagauggccgugagccagaucgacggccacaugagcggccagaugguggagcaccugaugaacagcgugaugaagcugugcgugaucaucgccaagagcugcgacgccagccuggccgagcugggcgacgacaagagcggcgacgccagcagacugaccagcgccuuccccgacagccuguacgagugccugcccgccaagggcaccggcagcgccgaggccgugcugcagaacgccuaccaggccauccacaacgagaugagaggcaccagcggccagccccccgagggcugcgccgcccccaccgugaucgugagcaaccacaaccugaccgacaccgugcagaacaagcagcugcaggccgugcugcaguggguggccgccagcgagcugaacgugcccauccuguacuucgccggcgacgacgagggcauccaggagaagcugcugcagcugagcgccgccgccguggacaagggcugcagcgugggcgaggugcugcagagcgugcugagauacgagaaggagagacagcugaacgaggccgugggcaacgugaccccccugcagcugcuggacuggcugauggugaaccuguaa

SEQ ID NO: 13456 - RNA, 2565 nt, Artificial Sequence
  AKAP4__Homo_sapiens__NP_003877
augauggccuacagcgacaccaccaugaugagcgacgacaucgacuggcugagaagccacagaggcgugugcaagguggaccuguacaaccccgagggccagcaggaccaggacagaaaggugaucugcuucguggacgugagcacccugaacguggaggacaaggacuacaaggacgccgccagcagcagcagcgagggcaaccugaaccugggcagccuggaggagaaggagaucaucgugaucaaggacaccgagaagaaggaccagagcaagaccgagggcagcgugugccuguucaagcaggcccccagcgaccccgugagcgugcugaacuggcugcugagcgaccugcagaaguacgcccugggcuuccagcacgcccugagccccagcaccagcaccugcaagcacaaggugggcgacaccgagggcgaguaccacagagccagcagcgagaacugcuacagcguguacgccgaccaggugaacaucgacuaccugaugaacagaccccagaaccugagacuggagaugaccgccgccaagaacaccaacaacaaccagagccccagcgccccccccgccaagccccccagcacccagagagccgugaucagccccgacggcgagugcagcaucgacgaccugagcuucuacgugaacagacugagcagccuggugauccagauggcccacaaggagaucaaggagaagcuggagggcaagagcaagugccugcaccacagcaucugccccagccccggcaacaaggagagaaucagccccagaacccccgccagcaagaucgccagcgagauggccuacgaggccguggagcugaccgccgccgagaugagaggcaccggcgaggagagcagagagggcggccagaagagcuuccuguacagcgagcugagcaacaagagcaagagcggcgacaagcagaugagccagagagagagcaaggaguucgccgacagcaucagcaagggccugaugguguacgccaaccagguggccagcgacaugauggugagccugaugaagacccugaaggugcacagcagcggcaagcccauccccgccagcguggugcugaagagagugcugcugagacacaccaaggagaucgugagcgaccugaucgacagcugcaugaagaaccugcacaacaucaccggcgugcugaugaccgacagcgacuucgugagcgccgugaagagaaaccuguucaaccaguggaagcagaacgccaccgacaucauggaggccaugcugaagagacuggugagcgcccugaucggcgaggagaaggagaccaagagccagagccugagcuacgccagccugaaggccggcagccacgaccccaagugcagaaaccagagccuggaguucagcaccaugaaggccgagaugaaggagagagacaagggcaagaugaagagcgaccccugcaagagccugaccagcgccgagaaggugggcgagcacauccugaaggagggccugaccaucuggaaccagaagcagggcaacagcugcaagguggccaccaaggccugcagcaacaaggacgagaagggcgagaagaucaacgccagcaccgacagccuggccaaggaccugaucgugagcgcccugaagcugauccaguaccaccugacccagcagaccaagggcaaggacaccugcgaggaggacugccccggcagcaccaugggcuacauggcccagagcacccaguacgagaagugcggcggcggccagagcgccaaggcccugagcgugaagcagcuggagagccacagagcccccggccccagcaccugccagaaggagaaccagcaccuggacagccagaagauggacaugagcaacaucgugcugaugcugauccagaagcugcugaacgagaaccccuucaagugcgaggaccccugcgagggcgagaacaagugcagcgagcccagagccagcaaggccgccagcaugagcaacagaagcgacaaggccgaggagcagugccaggagcaccaggagcuggacugcaccagcggcaugaagcaggccaacggccaguucaucgacaagcugguggagagcgugaugaagcugugccugaucauggccaaguacagcaacgacggcgccgcccuggccgagcuggaggagcaggccgccagcgccaacaagcccaacuucagaggcaccagaugcauccacagcggcgccaugccccagaacuaccaggacagccugggccacgaggugaucgugaacaaccagugcagcaccaacagccugcagaagcagcugcaggccgugcugcaguggaucgccgccagccaguucaacgugcccaugcuguacuucaugggcgacaaggacggccagcuggagaagcugccccaggugagcgccaaggccgccgagaagggcuacagcgugggcggccugcugcaggaggugaugaaguucgccaaggagagacagcccgacgaggccgugggcaagguggccagaaagcagcugcuggacuggcugcuggccaaccuguaa

SEQ ID NO: 13457 - RNA, 1284 nt, Artificial Sequence
  AKAP5__Homo_sapiens__NP_004848
auggagaccaccaucagcgagauccacguggagaacaaggacgagaagagaagcgccgagggcagccccggcgccgagagacagaaggagaaggccagcaugcugugcuucaagagaagaaagaaggccgccaaggcccugaagcccaaggccggcagcgaggccgccgacguggccagaaagugcccccaggaggccggcgccagcgaccagcccgagcccaccagaggcgccugggccagccugaagagacuggugaccagaagaaagagaagcgagagcagcaagcagcagaagccccuggagggcgagaugcagcccgccaucaacgccgaggacgccgaccugagcaagaagaaggccaagagcagacugaagauccccugcaucaaguuccccagaggccccaagagaagcaaccacagcaagaucaucgaggacagcgacugcagcaucaaggugcaggaggaggccgagauccuggacauccagacccagaccccccugaacgaccaggccaccaaggccaagagcacccaggaccugagcgagggcaucagcagaaaggacggcgacgaggugugcgagagcaacgugagcaacagcaccaccagcggcgagaaggugaucagcguggagcugggccuggacaacggccacagcgccauccagaccggcacccugauccuggaggagaucgagaccaucaaggagaagcaggacgugcagccccagcaggccagcccccuggagaccagcgagaccgaccaccagcagcccgugcugagcgacgugcccccccugcccgccauccccgaccagcagaucguggaggaggccagcaacagcacccuggagagcgcccccaacggcaaggacuacgagagcaccgagaucguggccgaggagaccaagcccaaggacaccgagcugagccaggagagcgacuucaaggagaacggcaucaccgaggagaagagcaagagcgaggagagcaagagaauggagcccaucgccaucaucaucaccgacaccgagaucagcgaguucgacgugaccaagagcaagaacgugcccaagcaguuccugaucagcgccgagaacgagcaggugggcguguucgccaacgacaacggcuucgaggacagaaccagcgagcaguacgagacccugcugaucgagaccgccagcagccuggugaagaacgccauccagcugagcaucgagcagcuggugaacgagauggccagcgacgacaacaagaucaacaaccugcugcaguaa

SEQ ID NO: 13458 - RNA, 6960 nt, Artificial Sequence
  AKAP6__Homo_sapiens__NP_004265
augcugaccaugagcgugacccugagcccccugagaagccaggaccuggaccccauggccaccgacgccagccccauggccaucaacaugacccccaccguggagcagggcgagggcgaggaggccaugaaggacauggacagcgaccagcaguacgagaagccccccccccugcacaccggcgccgacuggaagaucgugcugcaccugcccgagaucgagaccuggcugagaaugaccagcgagagagugagagaccugaccuacagcgugcagcaggacagcgacagcaagcacguggacgugcaccuggugcagcugaaggacaucugcgaggacaucagcgaccacguggagcagauccacgcccugcuggagaccgaguucagccugaagcugcugagcuacagcgugaacgugaucguggacauccacgccgugcagcugcuguggcaccagcugagagugagcgugcuggugcugagagagagaauccugcagggccugcaggacgccaacggcaacuacaccagacagaccgacauccugcaggccuucagcgaggagaccaaggagggcagacuggacagccugaccgagguggacgacagcggccagcugaccaucaagugcagccagaacuaccugagccuggacugcggcaucaccgccuucgagcugagcgacuacagccccagcgaggaccugcugagcggccugggcgacaugaccagcagccaggugaagaccaagcccuucgacagcuggagcuacagcgagauggagaaggaguuccccgagcugaucagaagcgugggccugcugaccguggccgccgacagcaucagcaccaacggcagcgaggccgugaccgaggaggugagccaggugagccugagcguggacgacaagggcggcugcgaggaggacaacgccagcgccguggaggagcagcccggccugacccugggcgugagcagcagcagcggcgaggcccugaccaacgccgcccagcccagcagcgagaccgugcagcaggagagcagcagcagcagccaccacgacgccaagaaccagcagcccgugcccugcgagaacgccacccccaagagaaccaucagagacugcuucaacuacaacgaggacagccccacccagcccacccugcccaagagaggccuguuccugaaggaggagaccuucaagaacgaccugaagggcaacggcggcaagagacagaugguggaccugaagcccgagaugagcagaagcacccccagccugguggacccccccgacagaagcaagcugugccuggugcugcagagcagcuaccccaacagccccagcgccgccagccagagcuacgagugccugcacaaggugggcaacggcaaccuggagaacaccgugaaguuccacaucaaggagaucagcagcagccugggcagacugaacgacugcuacaaggagaagagcagacugaagaagccccacaagaccagcgaggaggugccccccugcagaacccccaagagaggcaccggcagcggcaagcaggccaagaacaccaagagcagcgccgugcccaacggcgagcugagcuacaccagcaaggccaucgagggcccccagaccaacagcgccagcaccagcagccuggagcccugcaaccagagaagcuggaacgccaagcugcagcugcagagcgagaccagcagcagccccgccuucacccagagcagcgagagcagcgugggcagcgacaacaucaugagccccgugccccugcugagcaagcacaagagcaagaagggccaggccagcagccccagccacgugaccagaaacggcgaggugguggaggccugguacggcagcgacgaguaccuggcccugcccagccaccugaagcagaccgaggugcuggcccugaagcuggagaaccugaccaagcugcugccccagaagcccagaggcgagaccauccagaacaucgacgacugggagcugagcgagaugaacagcgacagcgagaucuaccccaccuaccacgugaagaagaagcacaccagacugggcagagugagccccagcagcagcagcgacaucgccagcagccugggcgagagcaucgagagcggcccccugagcgacauccugagcgacgaggagagcagcaugccccuggccggcaugaagaaguacgccgacgagaagagcgagagagccagcagcagcgagaagaacgagagccacagcgccaccaagagcgcccugauccagaagcugaugcaggacauccagcaccaggacaacuacgaggccaucugggagaagaucgagggcuucgugaacaagcuggacgaguucauccaguggcugaacgaggccauggagaccaccgagaacuggaccccccccaaggccgagauggacgaccugaagcuguaccuggagacccaccugagcuucaagcugaacguggacagccacugcgcccugaaggaggccguggaggaggagggccaccagcugcuggagcugaucgccagccacaaggccggccugaaggacaugcugagaaugaucgccagccaguggaaggagcugcagagacagaucaagagacagcacagcuggauccugagagcccuggacaccaucaaggccgagauccuggccaccgacgugagcguggaggacgaggagggcaccggcagccccaaggccgaggugcagcugugcuaccuggaggcccagagagacgccguggagcagaugagccugaagcuguacagcgagcaguacaccagcagcagcaagagaaaggaggaguucgccgacaugagcaaggugcacagcgugggcagcaacggccugcuggacuucgacagcgaguaccaggagcugugggacuggcugaucgacauggagagccuggugauggacagccacgaccugaugaugagcgaggagcagcagcagcaccuguacaagagauacagcguggagaugagcaucagacaccugaagaagaccgagcugcugagcaagguggaggcccugaagaagggcggcgugcugcugcccaacgaccugcuggagaagguggacagcaucaacgagaagugggagcugcugggcaagacccugggcgagaagauccaggacaccauggccggccacagcggcagcagccccagagaccugcugagccccgagagcggcagccuggugagacagcuggaggugagaaucaaggagcugaagggcuggcugagagacaccgagcuguucaucuucaacagcugccugagacaggagaaggagggcaccaugaacaccgagaagcagcugcaguacuucaagagccugugcagagagaucaagcagagaagaagaggcguggccagcauccugagacugugccagcaccugcuggacgacagagagaccugcaaccugaacgccgaccaccagcccaugcagcugaucaucgugaaccuggagagaagaugggaggccaucgugaugcaggccgugcaguggcagaccagacugcagaagaagaugggcaaggagagcgagacccugaacgugaucgaccccggccugauggaccugaacggcaugagcgaggacgcccuggagugggacgagauggacaucagcaacaagcugaucagccugaacgaggagagcaacgaccuggaccaggagcugcagcccgugauccccagccugaagcugggcgagaccagcaacgaggaccccggcuacgacgaggaggccgacaaccacggcggcagccaguacgccagcaacaucaccgcccccagcagcccccacaucuaccagguguacagccugcacaacguggagcuguacgaggacaaccacaugcccuuccugaagaacaaccccaaggugaccggcaugacccagcccaacgugcugaccaagagccugagcaaggacagcagcuucagcagcaccaagagccugcccgaccugcugggcggcagcaaccuggugaagcccugcgccugccacggcggcgacaugagccagaacagcggcagcgagagcggcaucgugagcgagggcgacaccgagaccaccaccaacagcgagaugugccugcugaacgccguggacggcagccccagcaaccuggagaccgagcaccuggacccccagaugggcgacgccgugaacgugcugaagcagaaguucaccgacgagggcgagagcaucaagcugcccaacagcagccagagcagcaucagccccgugggcugcgugaacggcaaggugggcgaccugaacagcaucaccaagcacacccccgacugccugggcgaggagcugcagggcaagcacgacguguucaccuucuacgacuacagcuaccugcagggcagcaagcugaagcugcccaugaucaugaagcagagccagagcgagaaggcccacguggaggacccccugcugagaggcuucuacuucgacaagaagagcugcaagagcaagcaccagaccaccgagcugcagcccgacgugcccccccacgagagaauccuggccagcgccagccacgagauggacagaaucagcuacaagagcggcaacaucgagaagaccuucaccggcaugcagaacgccaagcagcugagccugcugagccacagcagcagcaucgagagccugagccccggcggcgaccuguucggccugggcaucuucaagaacggcagcgacagccugcagagaagcaccagccuggagagcuggcugaccagcuacaagagcaacgaggaccuguucagcugccacagcagcggcgacaucagcgugagcagcggcagcgugggcgagcugagcaagagaacccuggaccugcugaacagacuggagaacauccagagccccagcgagcagaagaucaagagaagcgugagcgacaucacccugcagagcagcagccagaagaugagcuucaccggccagaugagccuggacaucgccagcagcaucaacgaggacagcgccgccagccugaccgagcugagcagcagcgacgagcugagccugugcagcgaggacaucgugcugcacaagaacaagauccccgagagcaacgccagcuucagaaagagacugaccagaagcguggccgacgagagcgacgugaacgugagcaugaucgugaacgugagcugcaccagcgccugcaccgacgacgaggacgacagcgaccugcugagcagcagcacccugacccugaccgaggaggagcugugcaucaaggacgaggacgacgacagcagcaucgccaccgacgacgagaucuacgaggacugcacccugaugagcggccuggacuacaucaagaacgagcugcagaccuggaucagacccaagcugagccugaccagagacaagaagagaugcaacgugagcgacgagaugaagggcagcaaggacaucagcagcagcgagaugaccaaccccagcgacacccugaacaucgagacccugcugaacggcagcgugaagagagugagcgagaacaacggcaacggcaagaacagcagccacacccacgagcugggcaccaagagagagaacaagaagaccaucuucaaggugaacaaggaccccuacguggccgacauggagaacggcaacaucgagggcauccccgagagacagaagggcaagcccaacgugaccagcaaggugagcgagaaccugggcagccacggcaaggagaucagcgagagcgagcacugcaagugcaaggcccugauggacagccuggacgacagcaacaccgccggcaaggaguucgugagccaggacgugagacaccugcccaagaagugccccaaccaccaccacuucgagaaccagagcaccgccagcacccccaccgagaagagcuucagcgagcuggcccuggagaccagauucaacaacagacaggacagcgacgcccugaagagcagcgacgacgcccccagcauggccggcaagagcgccggcugcugccuggcccuggagcagaacggcaccgaggagaacgccagcaucagcaacaucagcugcugcaacugcgagcccgacguguuccaccagaaggacgccgaggacugcagcgugcacaacuucgugaaggagaucaucgacauggccagcaccgcccugaagagcaagagccagcccgagaacgagguggccgcccccaccagccugacccagaucaaggagaaggugcuggagcacagccacagacccauccagcugagaaagggcgacuucuacagcuaccugagccugagcagccacgacagcgacugcggcgaggugaccaacuacaucgaggagaagagcagcaccccccugccccuggacaccaccgacagcggccuggacgacaaggaggacaucgagugcuucuucgaggccugcguggagggcgacagcgacggcgaggagcccugcuucagcagcgccccccccaacgagagcgccgugcccagcgaggccgccaugccccugcaggccaccgccugcagcagcgaguucagcgacagcagccugagcgccgacgacgccgacaccguggcccugagcagccccagcagccaggagagagccgaggugggcaaggaggugaacggccugccccagaccagcagcggcugcgccgagaaccuggaguucacccccagcaagcuggacagcgagaaggagagcagcggcaagcccggcgagagcggcaugcccgaggagcacaacgccgccagcgccaagagcaaggugcaggaccugagccugaaggccaaccagcccaccgacaaggccgcccugcaccccagccccaagacccugaccugcgaggagaaccugcugaaccugcacgagaagagacacagaaacaugcacagauaa

SEQ ID NO: 13459 - RNA, 246 nt, Artificial Sequence
  AKAP7__Homo_sapiens__NP_004833
augggccagcugugcugcuuccccuucagcagagacgagggcaagaucagcgagaagaacggcggcgagcccgacgacgccgagcuggugagacugagcaagagacugguggagaacgccgugcugaaggccgugcagcaguaccuggaggagacccagaacaagaacaagcccggcgagggcagcagcgugaagaccgaggccgccgaccagaacggcaacgacaacgagaacaacagaaaguaa

SEQ ID NO: 13460 - RNA, 11724 nt, Artificial Sequence
  AKAP9__Homo_sapiens__NP_005742
auggaggacgaggagagacagaagaagcuggaggccggcaaggccaagcuggcccaguucagacagagaaaggcccagagcgacggccagagccccagcaagaagcagaagaagaagagaaagaccagcagcagcaagcacgacgugagcgcccaccacgaccugaacaucgaccagagccagugcaacgagauguacaucaacagcagccagagaguggagagcaccgugauccccgagagcaccaucaugagaacccugcacagcggcgagaucaccagccacgagcagggcuucagcguggagcuggagagcgagaucagcaccaccgccgacgacugcagcagcgaggugaacggcugcagcuucgugaugagaaccggcaagcccaccaaccugcugagagaggaggaguucggcguggacgacagcuacagcgagcagggcgcccaggacagccccacccaccuggagaugauggagagcgagcuggccggcaagcagcacgagaucgaggagcugaacagagagcuggaggagaugagagugaccuacggcaccgagggccugcagcagcugcaggaguucgaggccgccaucaagcagagagacggcaucaucacccagcugaccgccaaccugcagcaggccagaagagagaaggacgagaccaugagagaguuccuggagcugaccgagcagagccagaagcugcagauccaguuccagcagcugcaggccagcgagacccugagaaacagcacccacagcagcaccgccgccgaccugcugcaggccaagcagcagauccugacccaccagcagcagcuggaggagcaggaccaccugcuggaggacuaccagaagaagaaggaggacuucaccaugcagaucagcuuccugcaggagaagaucaagguguacgagauggagcaggacaagaagguggagaacagcaacaaggaggagauccaggagaaggagaccaucaucgaggagcugaacaccaagaucaucgaggaggagaagaagacccuggagcugaaggacaagcugaccaccgccgacaagcugcugggcgagcugcaggagcagaucgugcagaagaaccaggagaucaagaacaugaagcuggagcugaccaacagcaagcagaaggagagacagagcagcgaggagaucaagcagcugaugggcaccguggaggagcugcagaagagaaaccacaaggacagccaguucgagaccgacaucgugcagagaauggagcaggagacccagagaaagcuggagcagcugagagccgagcuggacgagauguacggccagcagaucgugcagaugaagcaggagcugaucagacagcacauggcccagauggaggagaugaagaccagacacaagggcgagauggagaacgcccugagaagcuacagcaacaucaccgugaacgaggaccagaucaagcugaugaacguggccaucaacgagcugaacaucaagcugcaggacaccaacagccagaaggagaagcugaaggaggagcugggccugauccuggaggagaagugcgcccugcagagacagcuggaggaccugguggaggagcugagcuucagcagagagcagauccagagagccagacagaccaucgccgagcaggagagcaagcugaacgaggcccacaagagccugagcaccguggaggaccugaaggccgagaucgugagcgccagcgagagcagaaaggagcuggagcugaagcacgaggccgaggugaccaacuacaagaucaagcuggagaugcuggagaaggagaagaacgccgugcuggacagaauggccgagagccaggaggccgagcuggagagacugagaacccagcugcuguucagccacgaggaggagcugagcaagcugaaggaggaccuggagaucgagcacagaaucaacaucgagaagcugaaggacaaccugggcauccacuacaagcagcagaucgacggccugcagaacgagaugagccagaagaucgagaccaugcaguucgagaaggacaaccugaucaccaagcagaaccagcugauccuggagaucagcaagcugaaggaccugcagcagagccuggugaacagcaagagcgaggagaugacccugcagaucaacgagcugcagaaggagaucgagauccugagacaggaggagaaggagaagggcacccuggagcaggaggugcaggagcugcagcugaagaccgagcugcuggagaagcagaugaaggagaaggagaacgaccugcaggagaaguucgcccagcuggaggccgagaacagcauccugaaggacgagaagaagacccuggaggacaugcugaagauccacacccccgugagccaggaggagagacugaucuuccuggacagcaucaagagcaagagcaaggacagcgugugggagaaggagaucgagauccugaucgaggagaacgaggaccugaagcagcagugcauccagcugaacgaggagaucgagaagcagagaaacaccuucagcuucgccgagaagaacuucgaggugaacuaccaggagcugcaggaggaguacgccugccugcugaaggugaaggacgaccuggaggacagcaagaacaagcaggagcuggaguacaagagcaagcugaaggcccugaacgaggagcugcaccugcagagaaucaaccccaccaccgugaagaugaagagcagcguguucgacgaggacaagaccuucguggccgagacccuggagaugggcgaggugguggagaaggacaccaccgagcugauggagaagcuggaggugaccaagagagagaagcuggagcugagccagagacugagcgaccugagcgagcagcugaagcagaagcacggcgagaucagcuuccugaacgaggaggugaagagccugaagcaggagaaggagcaggugagccugagaugcagagagcuggagaucaucaucaaccacaacagagccgagaacgugcagagcugcgacacccaggugagcagccugcuggacggcguggugaccaugaccagcagaggcgccgagggcagcgugagcaaggugaacaagagcuucggcgaggagagcaagaucaugguggaggacaaggugagcuucgagaacaugaccgugggcgaggagagcaagcaggagcagcugauccuggaccaccugcccagcgugaccaaggagagcagccugagagccacccagcccagcgagaacgacaagcugcagaaggagcugaacgugcugaagagcgagcagaacgaccugagacugcagauggaggcccagagaaucugccugagccugguguacagcacccacguggaccaggugagagaguacauggagaacgagaaggacaaggcccugugcagccugaaggaggagcugaucuucgcccaggaggagaagaucaaggagcugcagaagauccaccagcuggagcugcagaccaugaagacccaggagaccggcgacgagggcaagccccugcaccugcugaucggcaagcugcagaaggccgugagcgaggagugcagcuacuuccugcagacccugugcagcgugcugggcgaguacuacacccccgcccugaagugcgaggugaacgccgaggacaaggagaacagcggcgacuacaucagcgagaacgaggaccccgagcugcaggacuacagauacgaggugcaggacuuccaggagaacaugcacacccugcugaacaaggugaccgaggaguacaacaagcugcuggugcugcagaccagacugagcaagaucuggggccagcagaccgacggcaugaagcuggaguucggcgaggagaaccugcccaaggaggagaccgaguuccugagcauccacagccagaugaccaaccuggaggacaucgacgugaaccacaagagcaagcugagcagccugcaggaccuggagaagaccaagcuggaggagcaggugcaggagcuggagagccugaucagcagccugcagcagcagcugaaggagaccgagcagaacuacgaggccgagauccacugccugcagaagagacugcaggccgugagcgagagcaccgugccccccagccugcccguggacagcguggugaucaccgagagcgacgcccagagaaccauguaccccggcagcugcgugaagaagaacaucgacggcaccaucgaguucagcggcgaguucggcgugaaggaggagaccaacaucgugaagcugcuggagaagcaguaccaggagcagcuggaggaggagguggccaaggugaucgugagcaugagcaucgccuucgcccagcagaccgagcugagcagaaucagcggcggcaaggagaacaccgccagcagcaagcaggcccacgccgugugccagcaggagcagcacuacuucaacgagaugaagcugagccaggaccagaucggcuuccagaccuucgagaccguggacgugaaguucaaggaggaguucaagccccugagcaaggagcugggcgagcacggcaaggagauccugcugagcaacagcgacccccacgacauccccgagagcaaggacugcgugcugaccaucagcgaggagauguucagcaaggacaagaccuucaucgugagacagagcauccacgacgagaucagcgugagcagcauggacgccagcagacagcugaugcugaacgaggagcagcuggaggacaugagacaggagcuggugagacaguaccaggagcaccagcaggccaccgagcugcugagacaggcccacaugagacagauggagagacagagagaggaccaggagcagcugcaggaggagaucaagagacugaacagacagcuggcccagagaagcagcaucgacaacgagaaccuggugagcgagagagagagagugcugcuggaggagcuggaggcccugaagcagcugagccuggccggcagagagaagcugugcugcgagcugagaaacagcagcacccagacccagaacggcaacgagaaccagggcgagguggaggagcagaccuucaaggagaaggagcuggacagaaagcccgaggacgugccccccgagauccugagcaacgagagauacgcccugcagaaggccaacaacagacugcugaagauccugcuggagguggugaagaccaccgccgccguggaggagaccaucggcagacacgugcugggcauccuggacagaagcagcaagagccagagcagcgccagccugaucuggagaagcgaggccgaggccagcgugaagagcugcgugcacgaggagcacaccagagugaccgacgagagcauccccagcuacagcggcagcgacaugcccagaaacgacaucaacauguggagcaaggugaccgaggagggcaccgagcugagccagagacuggugagaagcggcuucgccggcaccgagaucgaccccgagaacgaggagcugaugcugaacaucagcagcagacugcaggccgccguggagaagcugcuggaggccaucagcgagaccagcagccagcuggagcacgccaaggugacccagaccgagcugaugagagagagcuucagacagaagcaggaggccaccgagagccugaagugccaggaggagcugagagagagacugcacgaggagagcagagccagagagcagcuggccguggagcugagcaaggccgagggcgugaucgacggcuacgccgacgagaagacccuguucgagagacagauccaggagaagaccgacaucaucgacagacuggagcaggagcugcugugcgccagcaacagacugcaggagcuggaggccgagcagcagcagauccaggaggagagagagcugcugagcagacagaaggaggccaugaaggccgaggccggccccguggagcagcagcugcugcaggagaccgagaagcugaugaaggagaagcuggaggugcagugccaggccgagaaggugagagacgaccugcagaagcaggugaaggcccuggagaucgacguggaggagcaggugagcagauucaucgagcuggagcaggagaagaacaccgagcugauggaccugagacagcagaaccaggcccuggagaagcagcuggagaagaugagaaaguuccuggacgagcaggccaucgacagagagcacgagagagacguguuccagcaggagauccagaagcuggagcagcagcugaagguggugcccagauuccagcccaucagcgagcaccagaccagagagguggagcagcuggccaaccaccugaaggagaagaccgacaagugcagcgagcugcugcugagcaaggagcagcugcagagagacauccaggagagaaacgaggagaucgagaagcuggaguucagagugagagagcuggagcaggcccugcuggugagcgccgacaccuuccagaagguggaggacagaaagcacuucggcgccguggaggccaagcccgagcugagccuggaggugcagcugcaggccgagagagacgccaucgacagaaaggagaaggagaucaccaaccuggaggagcagcuggagcaguucagagaggagcuggagaacaagaacgaggaggugcagcagcugcacaugcagcuggagauccagaagaaggagagcaccaccagacugcaggagcuggagcaggagaacaagcuguucaaggacgacauggagaagcugggccuggccaucaaggagagcgacgccaugagcacccaggaccagcacgugcuguucggcaaguucgcccagaucauccaggagaaggagguggagaucgaccagcugaacgagcaggugaccaagcugcagcagcagcugaagaucaccaccgacaacaaggugaucgaggagaagaacgagcugaucagagaccuggagacccagaucgagugccugaugagcgaccaggagugcgugaagagaaacagagaggaggagaucgagcagcugaacgaggugaucgagaagcugcagcaggagcuggccaacaucggccagaagaccagcaugaacgcccacagccugagcgaggaggccgacagccugaagcaccagcuggacguggugaucgccgagaagcuggcccuggagcagcagguggagaccgccaacgaggagaugaccuucaugaagaacgugcugaaggagaccaacuucaagaugaaccagcugacccaggagcuguucagccugaagagagagagagagagcguggagaagauccagagcauccccgagaacagcgugaacguggccaucgaccaccugagcaaggacaagcccgagcuggagguggugcugaccgaggacgcccugaagagccuggagaaccagaccuacuucaagagcuucgaggagaacggcaagggcagcaucaucaaccuggagaccagacugcugcagcuggagagcaccgugagcgccaaggaccuggagcugacccagugcuacaagcagaucaaggacaugcaggagcagggccaguucgagaccgagaugcugcagaagaagaucgugaaccugcagaagaucguggaggagaagguggccgccgcccuggugagccagauccagcuggaggccgugcaggaguacgccaaguucugccaggacaaccagaccaucagcagcgagcccgagagaaccaacauccagaaccugaaccagcugagagaggacgagcugggcagcgacaucagcgcccugacccugagaaucagcgagcuggagagccaggugguggagaugcacaccagccugauccuggagaaggagcagguggagaucgccgagaagaacgugcuggagaaggagaagaagcugcuggagcugcagaagcugcuggagggcaacgagaagaagcagagagagaaggagaagaagagaagcccccaggacguggaggugcugaagaccaccaccgagcuguuccacagcaacgaggagagcggcuucuucaacgagcuggaggcccugagagccgagagcguggccaccaaggccgagcuggccagcuacaaggagaaggccgagaagcugcaggaggagcugcuggugaaggagaccaacaugaccagccugcagaaggaccugagccaggugagagaccaccuggccgaggccaaggagaagcugagcauccuggagaaggaggacgagaccgaggugcaggagagcaagaaggccugcauguucgagccccugcccaucaagcugagcaagagcaucgccagccagaccgacggcacccugaagaucagcagcagcaaccagaccccccagauccuggugaagaacgccggcauccagaucaaccugcagagcgagugcagcagcgaggaggugaccgagaucaucagccaguucaccgagaagaucgagaagaugcaggagcugcacgccgccgagauccuggacauggagagcagacacaucagcgagaccgagacccugaagagagagcacuacguggccgugcagcugcugaaggaggagugcggcacccugaaggccgugauccagugccugagaagcaaggagggcagcagcauccccgagcuggcccacagcgacgccuaccagaccagagagaucugcagcagcgacagcggcagcgacuggggccagggcaucuaccugacccacagccagggcuucgacaucgccagcgagggcagaggcgaggagagcgagagcgccaccgacagcuuccccaagaagaucaagggccugcugagagccgugcacaacgagggcaugcaggugcugagccugaccgagagccccuacagcgacggcgaggaccacagcauccagcaggugagcgagcccuggcuggaggagagaaaggccuacaucaacaccaucagcagccugaaggaccugaucaccaagaugcagcugcagagagaggccgagguguacgacagcagccagagccacgagagcuucagcgacuggagaggcgagcugcugcuggcccugcagcagguguuccuggaggagagaagcgugcugcuggccgccuucagaaccgagcugaccgcccugggcaccaccgacgccgugggccugcugaacugccuggagcagagaauccaggagcagggcguggaguaccaggccgccauggagugccugcagaaggccgacagaagaagccugcugagcgagauccaggcccugcacgcccagaugaacggcagaaagaucacccugaagagagagcaggagagcgagaagcccagccaggagcugcuggaguacaacauccagcagaagcagagccagaugcuggagaugcagguggagcugagcagcaugaaggacagagccaccgagcugcaggagcagcugagcagcgagaagauggugguggccgagcugaagagcgagcuggcccagaccaagcuggagcuggagaccacccugaaggcccagcacaagcaccugaaggagcuggaggccuucagacuggaggugaaggacaagaccgacgaggugcaccugcugaacgacacccuggccagcgagcagaagaagagcagagagcugcagugggcccuggagaaggagaaggccaagcugggcagaagcgaggagagagacaaggaggagcuggaggaccugaaguucagccuggagagccagaagcagagaaaccugcagcugaaccugcugcuggagcagcagaagcagcugcugaacgagagccagcagaagaucgagagccagagaaugcuguacgacgcccagcugagcgaggagcagggcagaaaccuggagcugcaggugcugcuggagagcgagaaggugagaaucagagagaugagcagcacccuggacagagagagagagcugcacgcccagcugcagagcagcgacggcaccggccagagcagacccccccugcccagcgaggaccugcugaaggagcugcagaagcagcuggaggagaagcacagcagaaucguggagcugcugaacgagaccgagaaguacaagcuggacagccugcagaccagacagcagauggagaaggacagacaggugcacagaaagacccugcagaccgagcaggaggccaacaccgagggccagaagaagaugcacgagcugcagagcaagguggaggaccugcagagacagcuggaggagaagagacagcagguguacaagcuggaccuggagggccagagacugcagggcaucaugcaggaguuccagaagcaggagcuggagagagaggagaagagagagagcagaagaauccuguaccagaaccugaacgagcccaccaccuggagccugaccagcgacagaaccagaaacugggugcugcagcagaagaucgagggcgagaccaaggagagcaacuacgccaagcugaucgagaugaacggcggcggcaccggcugcaaccacgagcuggagaugaucagacagaagcugcagugcguggccagcaagcugcaggugcugccccagaaggccagcgagagacugcaguucgagaccgccgacgacgaggacuucaucugggugcaggagaacaucgacgagaucauccugcagcugcagaagcugaccggccagcagggcgaggagcccagccuggugagccccagcaccagcugcggcagccugaccgagagacugcugagacagaacgccgagcugaccggccacaucagccagcugaccgaggagaagaacgaccugagaaacauggugaugaagcuggaggagcagaucagaugguacagacagaccggcgccggcagagacaacagcagcagauucagccugaacggcggcgccaacaucgaggccaucaucgccagcgagaaggagguguggaacagagagaagcugacccugcagaagagccugaagagagccgaggccgagguguacaagcugaaggccgagcugagaaacgacagccugcugcagacccugagccccgacagcgagcacgugacccugaagagaaucuacggcaaguaccugagagccgagagcuucagaaaggcccugaucuaccagaagaaguaccugcugcugcugcugggcggcuuccaggagugcgaggacgccacccuggcccugcuggccagaaugggcggccagcccgccuucaccgaccuggaggugaucaccaacagacccaagggcuucaccagauucagaagcgccgugagagugagcaucgccaucagcagaaugaaguuccuggugagaagauggcacagagugaccggcagcgugagcaucaacaucaacagagacggcuucggccugaaccagggcgccgagaagaccgacagcuucuaccacagcagcggcggccuggagcuguacggcgagcccagacacaccaccuacagaagcagaagcgaccuggacuacaucagaagcccccugcccuuccagaacagauaccccggcacccccgccgacuucaaccccggcagccuggccugcagccagcugcagaacuacgaccccgacagagcccugaccgacuacaucaccagacuggaggcccugcagagaagacugggcaccauccagagcggcagcaccacccaguuccacgccggcaugagaagauaa

SEQ ID NO: 13461 - RNA, 552 nt, Artificial Sequence
  AKIP1__Homo_sapiens__NP_001193575
auggacaacugccuggccgccgccgcccugaacggcguggacagaagaagccugcagagaagcgccagacuggcccuggaggugcuggagagagccaagagaagagccguggacuggcacgcccuggagagacccaagggcugcaugggcgugcuggccagagaggccccccaccuggagaagcagcccgccgccggcccccagagagugcugcccggcgagaaguacuacagcagcgugcccgaggagggcggcgccacccacguguacagauaccacagaggcgagagcaagcugcacaugugccuggacaucggcaacggccagagaaaggacagaaagaagaccagccugggccccggcggcagcuaccagaucagcgagcacgcccccgaggccagccagcccgccgagaacaucagcaaggaccuguacaucgagguguaccccggcaccuacagcgugaccgugggcagcaacgaccugaccaagaagacccacgugguggccguggacagcggccagagcguggaccugguguuccccguguaa

SEQ ID NO: 13462 - RNA, 612 nt, Artificial Sequence
  AKIRIN2__Homo_sapiens__NP_060534
auggccugcggcgccacccugaagagaacccuggacuucgacccccugcugagccccgccagccccaagagaagaagaugcgccccccugagcgcccccaccagcgccgccgccagcccccugagcgccgccgccgccaccgccgccagcuucagcgccgccgccgccagcccccagaaguaccugagaauggagcccagccccuucggcgacgugagcagcagacugaccaccgagcagauccuguacaacaucaagcaggaguacaagagaaugcagaagagaagacaccuggagaccagcuuccagcagaccgaccccugcugcaccagcgacgcccagccccacgccuuccugcugagcggccccgccagccccggcaccagcagcgccgccagcagcccccugaagaaggagcagccccuguucacccugagacaggugggcaugaucugcgagagacugcugaaggagagagaggagaaggugagagaggaguacgaggagauccugaacaccaagcuggccgagcaguacgacgccuucgugaaguucacccacgaccagaucaugagaagauacggcgagcagcccgccagcuacgugagcuaa

SEQ ID NO: 13463 - RNA, 4320 nt, Artificial Sequence
  AKNA__Homo_sapiens__NP_110394
auggccagcagcgagaccgagaucagaugggccgagcccggccugggcaagggcccccagagaagaagaugggccugggccgaggacaagagagacguggacagaagcagcagccagagcugggaggaggagagacuguuccccaacgccaccagccccgagcugcuggaggacuucagacuggcccagcagcaccugcccccccuggagugggacccccacccccagcccgacggccaccaggacagcgagagcggcgagaccagcggcgaggaggccgaggccgaggacguggacagccccgccagcagccacgagccccuggccuggcugccccagcagggcagacagcuggacaugaccgaggaggagcccgacggcacccugggcagccuggagguggaggaggccggcgagagcagcagcagacugggcuacgaggccggccugagccuggagggccacggcaacaccagccccauggcccugggccacggccaggccagaggcuggguggccagcggcgagcaggccagcggcgacaagcugagcgagcacagcgaggugaaccccagcguggagcugagccccgccagaagcuggagcagcggcaccgugagccuggaccaccccagcgacagccuggacagcaccugggagggcgagaccgacggcccccagcccaccgcccuggccgagacccugcccgagggccccagccaccaccugcugagccccgacggcagaaccggcggcagcguggccagagccacccccauggaguuccaggacagcagcgccccccccgcccagagcccccagcacgccaccgacagauggagaagagagaccaccagauucuucugcccccagcccaaggagcacaucuggaagcagaccaagaccagccccaagccccugcccagcagauucaucggcagcaucagcccccugaacccccagcccagacccaccagacagggcagaccccugcccagacagggcgccacccuggccggcagaagcagcagcaacgcccccaaguacggcagaggccagcugaacuacccccugcccgacuucagcaaggugggccccagagugagauuccccaaggacgagagcuacagaccccccaagagcagaagccacaacagaaagccccaggcccccgccagaccccugaucuucaagagccccgccgagaucgugcaggaggugcugcugagcagcggcgaggccgcccuggccaaggacaccccccccgcccaccccaucaccagagugccccaggaguuccagacccccgagcaggccaccgagcuggugcaccagcugcaggaggacuaccacagacugcugaccaaguacgccgaggccgagaacaccaucgaccagcugagacugggcgccaaggugaaccuguucagcgaccccccccagcccaaccacagcauccacaccggcauggugccccagggcaccaaggugcugagcuucaccaucccccagcccagaagcgccgagugguggcccggccccgccgaggacccccaggccagcgccgccagcggcuggcccagcgccagaggcgaccugagccccagcagccugaccagcaugcccacccugggcuggcugcccgagaacagagacaucagcgaggaccagagcagcgccgagcagacccaggcccuggccagccaggccagccaguuccuggccaagguggagagcuucgagagacugauccaggccggcagacugaugccccaggaccaggugaagggcuuccagagacugaaggccgcccacgccgcccuggaggaggaguaccugaaggccugcagagagcagcaccccgcccagccccuggccggcagcaagggcacccccggcagauucgaccccagaagagagcuggaggccgagaucuacagacugggcagcugccuggaggagcugaaggagcacaucgaccagacccagcaggagcccgagccccccggcagcgacagcgcccuggacagcacccccgcccugcccugccugcaccagcccacccaccugcccgcccccagcggccaggcccccaugcccgccaucaagaccagcugccccgagcccgccaccaccaccgccgccgccagcaccggccccugcccccugcacgugaacguggaggugagcagcggcaacagcgagguggaggacagaccccaggacccccuggccagacugagacacaaggagcugcagauggagcagguguaccacggccugauggagagauaccugagcgugaagagccugcccgaggccaugagaauggaggaggaggaggagggcgaggaggaggaggaggaggagggcggcggcgacagccuggagguggacggcguggccgccacccccggcaaggccgaggccaccagagugcugcccagacagugccccgugcaggccgagaagagccacggcgccccccuggaggaggccaccgagaagauggugagcaugaagccccccggcuuccaggccagccuggccagagacggccacaugagcggccugggcaaggccgaggccgccccccccggccccggcgugcccccccacccccccggcaccaagagcgccgccagccaccagagcagcaugaccagccuggagggcagcggcaucagcgagagacugccccagaagccccugcacagaggcggcggcccccaccuggaggagaccuggauggccagccccgagaccgacagcggcuucgugggcagcgagaccagcagagugagcccccugacccagacccccgagcacagacugagccacaucagcaccgccggcacccuggcccagcccuucgccgccagcgugcccagagacggcgccagcuaccccaaggccagaggcagccugauccccagaagagccaccgagcccagcacccccagaagccaggcccagagauaccugagcagccccagcggcccccugagacagagagcccccaacuucagccuggagagaacccuggccgccgagauggccgugcccggcagcgaguucgagggccacaagagaaucagcgagcagccccugcccaacaagaccaucagccccccccccgcccccgcccccgccgccgccccccugcccugcggccccaccgagaccauccccagcuuccugcugaccagagccggcagagaccaggccaucugcgagcugcaggaggaggugagcagacugagacugagacuggaggacagccugcaccagccccugcagggcagccccaccagacccgccagcgccuucgacagacccgccagaaccagaggcagacccgccgacagccccgccaccuggggcagccacuacggcagcaagagcaccgagagacugcccggcgagcccagaggcgaggagcagaucgugccccccggcagacagagagccagaagcagcagcgugcccagagaggugcugagacugagccugagcagcgagagcgagcugcccagccugccccuguucagcgagaagagcaagaccaccaaggacagcccccaggccgccagagacggcaagagaggcgugggcagcgccggcuggcccgacagagugaccuucagaggccaguacaccggccacgaguaccacgugcugagccccaaggccgugcccaagggcaacggcaccgugagcugcccccacugcagacccaucagaacccaggacgccggcggcgccgugaccggcgacccccugggccccccccccgccgacacccugcagugcccccugugcggccaggugggcagcccccccgaggccgacggccccggcagcgccaccagcggcgccgagaaggccaccaccagaagaaaggccagcagcacccccagccccaagcagagaagcaagcaggccggcagcagccccagacccccccccggccugugguaccuggccaccgccccccccgcccccgccccccccgccuucgccuacaucagcagcgugcccaucaugcccuacccccccgccgccguguacuacgcccccgccggccccaccagcgcccagcccgccgccaaguggccccccaccgccagccccccccccgccagaagacacagacacagcauccagcuggaccugggcgaccuggaggagcugaacaaggcccugagcagagccgugcaggccgccgagagcgugagaagcaccaccagacagaugagaagcagccugagcgccgaccugagacaggcccacagccugagaggcagcugccuguucuaa

SEQ ID NO: 13464 - RNA, 951 nt, Artificial Sequence
  AKR1B10__Homo_sapiens__NP_064695
auggccaccuucguggagcugagcaccaaggccaagaugcccaucgugggccugggcaccuggaagagcccccugggcaaggugaaggaggccgugaagguggccaucgacgccggcuacagacacaucgacugcgccuacguguaccagaacgagcacgaggugggcgaggccauccaggagaagauccaggagaaggccgugaagagagaggaccuguucaucgugagcaagcuguggcccaccuucuucgagagaccccuggugagaaaggccuucgagaagacccugaaggaccugaagcugagcuaccuggacguguaccugauccacuggccccagggcuucaagagcggcgacgaccuguuccccaaggacgacaagggcaacgccaucggcggcaaggccaccuuccuggacgccugggaggccauggaggagcugguggacgagggccuggugaaggcccugggcgugagcaacuucagccacuuccagaucgagaagcugcugaacaagcccggccugaaguacaagcccgugaccaaccagguggagugccaccccuaccugacccaggagaagcugauccaguacugccacagcaagggcaucaccgugaccgccuacagcccccugggcagccccgacagacccugggccaagcccgaggaccccagccugcuggaggaccccaagaucaaggagaucgccgccaagcacaagaagaccgccgcccaggugcugaucagauuccacauccagagaaacgugaucgugauccccaagagcgugacccccgccagaaucguggagaacauccagguguucgacuucaagcugagcgacgaggagauggccaccauccugagcuucaacagaaacuggagagccugcaacgugcugcagagcagccaccuggaggacuaccccuucaacgccgaguacuaa

SEQ ID NO: 13465 - RNA, 951 nt, Artificial Sequence
  AKR1B1__Homo_sapiens__NP_001619
auggccagcagacugcugcugaacaacggcgccaagaugcccauccugggccugggcaccuggaagagcccccccggccaggugaccgaggccgugaagguggccaucgacgugggcuacagacacaucgacugcgcccacguguaccagaacgagaacgaggugggcguggccauccaggagaagcugagagagcagguggugaagagagaggagcuguucaucgugagcaagcuguggugcaccuaccacgagaagggccuggugaagggcgccugccagaagacccugagcgaccugaagcuggacuaccuggaccuguaccugauccacuggcccaccggcuucaagcccggcaaggaguucuucccccuggacgagagcggcaacguggugcccagcgacaccaacauccuggacaccugggccgccauggaggagcugguggacgagggccuggugaaggccaucggcaucagcaacuucaaccaccugcagguggagaugauccugaacaagcccggccugaaguacaagcccgccgugaaccagaucgagugccaccccuaccugacccaggagaagcugauccaguacugccagagcaagggcaucguggugaccgccuacagcccccugggcagccccgacagacccugggccaagcccgaggaccccagccugcuggaggaccccagaaucaaggccaucgccgccaagcacaacaagaccaccgcccaggugcugaucagauuccccaugcagagaaaccugguggugauccccaagagcgugacccccgagagaaucgccgagaacuucaagguguucgacuucgagcugagcagccaggacaugaccacccugcugagcuacaacagaaacuggagagugugcgcccugcugagcugcaccagccacaaggacuaccccuuccacgaggaguucuaa

SEQ ID NO: 13466 - RNA, 972 nt, Artificial Sequence
  AKR1C1__Homo_sapiens__NP_001344
auggacagcaaguaccagugcgugaagcugaacgacggccacuucaugcccgugcugggcuucggcaccuacgcccccgccgaggugcccaagagcaaggcccuggaggccaccaagcuggccaucgaggccggcuucagacacaucgacagcgcccaccuguacaacaacgaggagcaggugggccuggccaucagaagcaagaucgccgacggcagcgugaagagagaggacaucuucuacaccagcaagcuguggugcaacagccacagacccgagcuggugagacccgcccuggagagaagccugaagaaccugcagcuggacuacguggaccuguaccugauccacuuccccgugagcgugaagcccggcgaggaggugauccccaaggacgagaacggcaagauccuguucgacaccguggaccugugcgccaccugggaggccguggagaagugcaaggacgccggccuggccaagagcaucggcgugagcaacuucaacagaagacagcuggagaugauccugaacaagcccggccugaaguacaagcccgugugcaaccagguggagugccaccccuacuucaaccagagaaagcugcuggacuucugcaagagcaaggacaucgugcugguggccuacagcgcccugggcagccacagagaggagcccuggguggaccccaacagccccgugcugcuggaggaccccgugcugugcgcccuggccaagaagcacaagagaacccccgcccugaucgcccugagauaccagcugcagagaggcgugguggugcuggccaagagcuacaacgagcagagaaucagacagaacgugcagguguucgaguuccagcugaccagcgaggagaugaaggccaucgacggccugaacagaaacgugagauaccugacccuggacaucuucgccggcccccccaacuaccccuucagcgacgaguacuaa

SEQ ID NO: 13467 - RNA, 420 nt, Artificial Sequence
  AKR1C2__Homo_sapiens__NP_001128713
auggacagcaaguaccagugcgugaagcugaacgacggccacuucaugcccgugcugggcuucggcaccuacgcccccgccgaggugcccaagagcaaggcccuggaggccgugaagcuggccaucgaggccggcuuccaccacaucgacagcgcccacguguacaacaacgaggagcaggugggccuggccaucagaagcaagaucgccgacggcagcgugaagagagaggacaucuucuacaccagcaagcuguggagcaacagccacagacccgagcuggugagacccgcccuggagagaagccugaagaaccugcagcuggacuacguggaccuguaccugauccacuuccccgugagcgugaaggaggacaucggcauccugaccuggaagaagagccccaagcacaacagcuaa

SEQ ID NO: 13468 - RNA, 972 nt, Artificial Sequence
  AKR1C3__Homo_sapiens__NP_001240837
auggacagcaagcaccagugccugaagcugaacgacggccacuucaugcccgugcugggcuucggcaccuacgccccccccgaggugcccagaagcaaggcccuggaggugaccaagcuggccaucgaggccggcuucagacacaucgacagcgcccaccuguacaacaacgaggagcaggugggccuggccaucagaagcaagaucgccgacggcagcgugaagagagaggacaucuucuacaccagcaagcuguggagcaccuuccacagacccgagcuggugagacccgcccuggagaacagccugaagaaggcccagcuggacuacguggaccuguaccugauccacagccccaugagccugaagcccggcgaggagcugagccccaccgacgagaacggcaaggugaucuucgacaucguggaccugugcaccaccugggaggccauggagaagugcaaggacgccggccuggccaagagcaucggcgugagcaacuucaacagaagacagcuggagaugauccugaacaagcccggccugaaguacaagcccgugugcaaccagguggagugccaccccuacuucaacagaagcaagcugcuggacuucugcaagagcaaggacaucgugcugguggccuacagcgcccugggcagccagagagacaagagauggguggaccccaacagccccgugcugcuggaggaccccgugcugugcgcccuggccaagaagcacaagagaacccccgcccugaucgcccugagauaccagcugcagagaggcgugguggugcuggccaagagcuacaacgagcagagaaucagacagaacgugcagguguucgaguuccagcugaccgccgaggacaugaaggccaucgacggccuggacagaaaccugcacuacuucaacagcgacagcuucgccagccaccccaacuaccccuacagcgacgaguacuaa

SEQ ID NO: 13469 - RNA, 972 nt, Artificial Sequence
  AKR1C4__Homo_sapiens__NP_001809
auggaccccaaguaccagagaguggagcugaacgacggccacuucaugcccgugcugggcuucggcaccuacgccccccccgaggugcccagaaacagagccguggaggugaccaagcuggccaucgaggccggcuucagacacaucgacagcgccuaccuguacaacaacgaggagcaggugggccuggccaucagaagcaagaucgccgacggcagcgugaagagagaggacaucuucuacaccagcaagcuguggugcaccuucuuccagccccagauggugcagcccgcccuggagagcagccugaagaagcugcagcuggacuacguggaccuguaccugcugcacuuccccauggcccugaagcccggcgagaccccccugcccaaggacgagaacggcaaggugaucuucgacaccguggaccugagcgccaccugggaggugauggagaagugcaaggacgccggccuggccaagagcaucggcgugagcaacuucaacugcagacagcuggagaugauccugaacaagcccggccugaaguacaagcccgugugcaaccagguggagugccaccccuaccugaaccagagcaagcugcuggacuucugcaagagcaaggacaucgugcugguggcccacagcgcccugggcacccagagacacaagcuguggguggaccccaacagccccgugcugcuggaggaccccgugcugugcgcccuggccaagaagcacaagagaacccccgcccugaucgcccugagauaccagcugcagagaggcgugguggugcuggccaagagcuacaacgagcagagaaucagagagaacauccagguguucgaguuccagcugaccagcgaggacaugaaggugcuggacggccugaacagaaacuacagauacguggugauggacuuccugauggaccaccccgacuaccccuucagcgacgaguacuaa

SEQ ID NO: 13470 - RNA, 858 nt, Artificial Sequence
  AKR1D1__Homo_sapiens__NP_001177835
auggaccugagcgccgccagccacagaaucccccugagcgacggcaacagcauccccaucaucggccugggcaccuacagcgagcccaagagcacccccaagggcgccugcgccaccagcgugaagguggccaucgacaccggcuacagacacaucgacggcgccuacaucuaccagaacgagcacgaggugggcgaggccaucagagagaagaucgccgagggcaaggugagaagagaggacaucuucuacugcggcaagcugugggccaccaaccacgugcccgagauggugagacccacccuggagagaacccugagagugcugcagcuggacuacguggaccuguacaucaucgaggugcccauggccuucaagcccggcgacgagaucuaccccagagacgagaacggcaaguggcuguaccacaagagcaaccugugcgccaccugggagguggagugccaccccuacuucacccagcccaagcugcugaaguucugccagcagcacgacaucgugaucaccgccuacagcccccugggcaccagcagaaaccccaucugggugaacgugagcagccccccccugcugaaggacgcccugcugaacagccugggcaagagauacaacaagaccgccgcccagaucgugcugagauucaacauccagagaggcgugguggugauccccaagagcuucaaccuggagagaaucaaggagaacuuccagaucuucgacuucagccugaccgaggaggagaugaaggacaucgaggcccugaacaagaacgugagauucguggagcugcugauguggagagaccaccccgaguaccccuuccacgacgaguacuaa

SEQ ID NO: 13471 - RNA, 963 nt, Artificial Sequence
  AKR1E2__Homo_sapiens__NP_001035267
augggcgacauccccgccgugggccugagcagcuggaaggccagccccggcaaggugaccgaggccgugaaggaggccaucgacgccggcuacagacacuucgacugcgccuacuucuaccacaacgagagagaggugggcgccggcaucagaugcaagaucaaggagggcgccgugagaagagaggaccuguucaucgccaccaagcuguggugcaccugccacaagaagagccugguggagaccgccugcagaaagagccugaaggcccugaagcugaacuaccuggaccuguaccugauccacuggcccaugggcuucaagcccccccaccccgaguggaucaugagcugcagcgagcugagcuucugccugagccaccccagagugcaggaccugccccuggacgagagcaacauggugauccccagcgacaccgacuuccuggacaccugggaggccauggaggaccuggugaucaccggccuggugaagaacaucggcgugagcaacuucaaccacgagcagcuggagagacugcugaacaagcccggccugagauucaagccccugaccaaccagaucgagugccaccccuaccugacccagaagaaccugaucagcuucugccagagcagagacgugagcgugaccgccuacagaccccugggcggcagcugcgagggcguggaccugaucgacaaccccgugaucaagagaaucgccaaggagcacggcaagagccccgcccagauccugaucagauuccagauccagagaaacgugaucgugauccccggcagcaucacccccagccacaucaaggagaacauccagguguucgacuucgagcugacccagcacgacauggacaacauccugagccugaacagaaaccugagacuggccauguuccccaucaccaagaaccacaaggacuaccccuuccacaucgaguacuaa

SEQ ID NO: 13472 - RNA, 519 nt, Artificial Sequence
  AKR7A3__Homo_sapiens__XP_011539349
augagcagacagcugagcagagccagacccgccaccgugcugggcgccauggagaugggcagaagaauggacgcccccaccagcgccgccgugaccagagccuuccuggagagaggccacaccgagaucgacaccgccuucguguacagcgagggccagagcgagaccauccugggcggccugggccugagacugggcggcagcgacugcagagugaagaucgacaccaaggccaucccccuguucggcaacagccugaagcccgacagccugagauuccagcuggagaccagccugaagagacugcagugccccagaguggaccuguucuaccugcacaugcccgaccacagcacccccguggaggagacccugagagccugccaccagcugcaccaggagggcaaguucguggagcugggccugagcaacuacgccgccugggagguggccgagaucugcacccugugcaagagcaacggcuggauccugcccaccguguaccagggcgccugcuaa

SEQ ID NO: 13473 - RNA, 1443 nt, Artificial Sequence
  AKT1__Homo_sapiens__NP_001014431
augagcgacguggccaucgugaaggagggcuggcugcacaagagaggcgaguacaucaagaccuggagacccagauacuuccugcugaagaacgacggcaccuucaucggcuacaaggagagaccccaggacguggaccagagagaggccccccugaacaacuucagcguggcccagugccagcugaugaagaccgagagacccagacccaacaccuucaucaucagaugccugcaguggaccaccgugaucgagagaaccuuccacguggagacccccgaggagagagaggaguggaccaccgccauccagaccguggccgacggccugaagaagcaggaggaggaggagauggacuucagaagcggcagccccagcgacaacagcggcgccgaggagauggaggugagccuggccaagcccaagcacagagugaccaugaacgaguucgaguaccugaagcugcugggcaagggcaccuucggcaaggugauccuggugaaggagaaggccaccggcagauacuacgccaugaagauccugaagaaggaggugaucguggccaaggacgagguggcccacacccugaccgagaacagagugcugcagaacagcagacaccccuuccugaccgcccugaaguacagcuuccagacccacgacagacugugcuucgugauggaguacgccaacggcggcgagcuguucuuccaccugagcagagagagaguguucagcgaggacagagccagauucuacggcgccgagaucgugagcgcccuggacuaccugcacagcgagaagaacgugguguacagagaccugaagcuggagaaccugaugcuggacaaggacggccacaucaagaucaccgacuucggccugugcaaggagggcaucaaggacggcgccaccaugaagaccuucugcggcacccccgaguaccuggcccccgaggugcuggaggacaacgacuacggcagagccguggacugguggggccugggcguggugauguacgagaugaugugcggcagacugcccuucuacaaccaggaccacgagaagcuguucgagcugauccugauggaggagaucagauuccccagaacccugggccccgaggccaagagccugcugagcggccugcugaagaaggaccccaagcagagacugggcggcggcagcgaggacgccaaggagaucaugcagcacagauucuucgccggcaucguguggcagcacguguacgagaagaagcugagcccccccuucaagccccaggugaccagcgagaccgacaccagauacuucgacgaggaguucaccgcccagaugaucaccaucaccccccccgaccaggacgacagcauggagugcguggacagcgagagaagaccccacuucccccaguucagcuacagcgccagcggcaccgccuaa

SEQ ID NO: 13474 - RNA, 771 nt, Artificial Sequence
  AKT1S1__Homo_sapiens__NP_001092103
auggccagcggcagacccgaggagcugugggaggccguggugggcgccgccgagagauucagagccagaaccggcaccgagcuggugcugcugaccgccgcccccccccccccccccagacccggccccugcgccuacgccgcccacggcagaggcgcccuggccgaggccgccagaagaugccugcacgacaucgcccuggcccacagagccgccaccgccgccagaccccccgcccccccccccgccccccagccccccagccccacccccagcccccccagacccacccuggccagagaggacaacgaggaggacgaggacgagcccaccgagaccgagaccagcggcgagcagcugggcaucagcgacaacggcggccuguucgugauggacgaggacgccacccugcaggaccugccccccuucugcgagagcgaccccgagagcaccgacgacggcagccugagcgaggagacccccgccggcccccccaccugcagcgugccccccgccagcgcccugcccacccagcaguacgccaagagccugcccgugagcgugcccguguggggcuucaaggagaagagaaccgaggccagaagcagcgacgaggagaacggcccccccagcagccccgaccuggacagaaucgccgccagcaugagagcccuggugcugagagaggccgaggacacccagguguucggcgaccugcccagacccagacugaacaccagcgacuuccagaagcugaagagaaaguacuaa

SEQ ID NO: 13475 - RNA, 1260 nt, Artificial Sequence
  AKT2__Homo_sapiens__NP_001229957
augaagaccgagagacccagacccaacaccuucgugaucagaugccugcaguggaccaccgugaucgagagaaccuuccacguggacagccccgacgagagagaggaguggaugagagccauccagaugguggccaacagccugaagcagagagcccccggcgaggaccccauggacuacaagugcggcagccccagcgacagcagcaccaccgaggagauggagguggccgugagcaaggccagagccaaggugaccaugaacgacuucgacuaccugaagcugcugggcaagggcaccuucggcaaggugauccuggugagagagaaggccaccggcagauacuacgccaugaagauccugagaaaggaggugaucaucgccaaggacgagguggcccacaccgugaccgagagcagagugcugcagaacaccagacaccccuuccugaccgcccugaaguacgccuuccagacccacgacagacugugcuucgugauggaguacgccaacggcggcgagcuguucuuccaccugagcagagagagaguguucaccgaggagagagccagauucuacggcgccgagaucgugagcgcccuggaguaccugcacagcagagacgugguguacagagacaucaagcuggagaaccugaugcuggacaaggacggccacaucaagaucaccgacuucggccugugcaaggagggcaucagcgacggcgccaccaugaagaccuucugcggcacccccgaguaccuggcccccgaggugcuggaggacaacgacuacggcagagccguggacugguggggccugggcguggugauguacgagaugaugugcggcagacugcccuucuacaaccaggaccacgagagacuguucgagcugauccugauggaggagaucagauuccccagaacccugagccccgaggccaagagccugcuggccggccugcugaagaaggaccccaagcagagacugggcggcggccccagcgacgccaaggaggugauggagcacagauucuuccugagcaucaacuggcaggacguggugcagaagaagcugcugccccccuucaagccccaggugaccagcgagguggacaccagauacuucgacgacgaguucaccgcccagagcaucaccaucaccccccccgacagauacgacagccugggccugcuggagcuggaccagagaacccacuucccccaguucagcuacagcgccagcaucagagaguaa

SEQ ID NO: 13476 - RNA, 1398 nt, Artificial Sequence
  AKT3__Homo_sapiens__NP_001193658
augagcgacgugaccaucgugaaggagggcugggugcagaagagaggcgaguacaucaagaacuggagacccagauacuuccugcugaagaccgacggcagcuucaucggcuacaaggagaagccccaggacguggaccugcccuacccccugaacaacuucagcguggccaagugccagcugaugaagaccgagagacccaagcccaacaccuucaucaucagaugccugcaguggaccaccgugaucgagagaaccuuccacguggacacccccgaggagagagaggaguggaccgaggccauccaggccguggccgacagacugcagagacaggaggaggagagaaugaacugcagccccaccagccagaucgacaacaucggcgaggaggagauggacgccagcaccacccaccacaagagaaagaccaugaacgacuucgacuaccugaagcugcugggcaagggcaccuucggcaaggugauccuggugagagagaaggccagcggcaaguacuacgccaugaagauccugaagaaggaggugaucaucgccaaggacgagguggcccacacccugaccgagagcagagugcugaagaacaccagacaccccuuccugaccagccugaaguacagcuuccagaccaaggacagacugugcuucgugauggaguacgugaacggcggcgagcuguucuuccaccugagcagagagagaguguucagcgaggacagaaccagauucuacggcgccgagaucgugagcgcccuggacuaccugcacagcggcaagaucguguacagagaccugaagcuggagaaccugaugcuggacaaggacggccacaucaagaucaccgacuucggccugugcaaggagggcaucaccgacgccgccaccaugaagaccuucugcggcacccccgaguaccuggcccccgaggugcuggaggacaacgacuacggcagagccguggacugguggggccugggcguggugauguacgagaugaugugcggcagacugcccuucuacaaccaggaccacgagaagcuguucgagcugauccugauggaggacaucaaguuccccagaacccugagcagcgacgccaagagccugcugagcggccugcugaucaaggaccccaacaagagacugggcggcggccccgacgacgccaaggagaucaugagacacagcuucuucagcggcgugaacuggcaggacguguacgacaagaagcuggugccccccuucaagccccaggugaccagcgagaccgacaccagauacuucgacgaggaguucaccgcccagaccaucaccaucaccccccccgagaagugccagcagagcgacugcggcaugcugggcaacuggaagaaguaa

SEQ ID NO: 13477 - RNA, 879 nt, Artificial Sequence
  AKTIP__Homo_sapiens__NP_071921
augaaccccuucuggagcaugagcaccagcagcgugagaaagagaagcgagggcgaggagaagacccugaccggcgacgugaagaccagcccccccagaaccgcccccaagaagcagcugcccagcauccccaagaacgcccugcccaucaccaagcccaccagccccgcccccgccgcccagagcaccaacggcacccacgccagcuacggccccuucuaccuggaguacagccugcuggccgaguucacccugguggugaagcagaagcugcccggcguguacgugcagcccagcuacagaagcgcccugaugugguucggcgugaucuucaucagacacggccuguaccaggacggcguguucaaguucaccguguacauccccgacaacuaccccgacggcgacugccccagacugguguucgacauccccguguuccacccccugguggaccccaccagcggcgagcuggacgugaagagagccuucgccaaguggagaagaaaccacaaccacaucuggcaggugcugauguacgccagaagaguguucuacaagaucgacaccgccagcccccugaaccccgaggccgccgugcuguacgagaaggacauccagcuguucaagagcaaggugguggacagcgugaaggugugcaccgccagacuguucgaccagcccaagaucgaggaccccuacgccaucagcuucagccccuggaaccccagcgugcacgacgaggccagagagaagaugcugacccagaagaagcccgaggagcagcacaacaagagcgugcacguggccggccugagcugggugaagcccggcagcgugcagcccuucagcaaggaggagaagaccguggccaccuaa

SEQ ID NO: 13478 - RNA, 993 nt, Artificial Sequence
  ALAD__Homo_sapiens__NP_000022
augcagccccagagcgugcugcacagcggcuacuuccacccccugcugagagccuggcagaccgccaccaccacccugaacgccagcaaccugaucuaccccaucuucgugaccgacgugcccgacgacauccagcccaucaccagccugcccggcguggccagauacggcgugaagagacuggaggagaugcugagaccccugguggaggagggccugagaugcgugcugaucuucggcgugcccagcagagugcccaaggacgagagaggcagcgccgccgacagcgaggagagccccgccaucgaggccauccaccugcugagaaagaccuuccccaaccugcugguggccugcgacgugugccugugccccuacaccagccacggccacugcggccugcugagcgagaacggcgccuucagagccgaggagagcagacagagacuggccgagguggcccuggccuacgccaaggccggcugccaggugguggcccccagcgacaugauggacggcagaguggaggccaucaaggaggcccugauggcccacggccugggcaacagagugagcgugaugagcuacagcgccaaguucgccagcugcuucuacggccccuucagagacgccgccaagagcagccccgccuucggcgacagaagaugcuaccagcugccccccggcgccagaggccuggcccugagagccguggacagagacgugagagagggcgccgacaugcugauggugaagcccggcaugcccuaccuggacaucgugagagaggugaaggacaagcaccccgaccugccccuggccguguaccacgugagcggcgaguucgccaugcuguggcacggcgcccaggccggcgccuucgaccugaaggccgccgugcuggaggccaugaccgccuucagaagagccggcgccgacaucaucaucaccuacuacaccccccagcugcugcaguggcugaaggaggaguaa

SEQ ID NO: 13479 - RNA, 1923 nt, Artificial Sequence
  ALAS1__Homo_sapiens__NP_001291372
auggagagcguggugagaagaugccccuuccugagcagagugccccaggccuuccugcagaaggccggcaagagccugcuguucuacgcccagaacugccccaagaugauggaggugggcgccaagcccgcccccagagcccugagcaccgccgccgugcacuaccagcagaucaaggagaccccccccgccagcgagaaggacaagaccgccaaggccaaggugcagcagacccccgacggcagccagcagagccccgacggcacccagcugcccagcggccacccccugcccgccaccagccagggcaccgccagcaagugccccuuccuggccgcccagaugaaccagagaggcagcagcguguucugcaaggccagccuggagcugcaggaggacgugcaggagaugaacgccgugagaaaggagguggccgagaccagcgccggccccagcguggugagcgugaagaccgacggcggcgaccccagcggccugcugaagaacuuccaggacaucaugcagaagcagagacccgagagagugagccaccugcugcaggacaaccugcccaagagcgugagcaccuuccaguacgacagauucuucgagaagaagaucgacgagaagaagaacgaccacaccuacagaguguucaagaccgugaacagaagagcccacaucuuccccauggccgacgacuacagcgacagccugaucaccaagaagcaggugagcguguggugcagcaacgacuaccugggcaugagcagacaccccagagugugcggcgccgugauggacacccugaagcagcacggcgccggcgccggcggcaccagaaacaucagcggcaccagcaaguuccacguggaccuggagagagagcuggccgaccugcacggcaaggacgccgcccugcuguucagcagcugcuucguggccaacgacagcacccuguucacccuggccaagaugaugcccggcugcgagaucuacagcgacagcggcaaccacgccagcaugauccagggcaucagaaacagcagagugcccaaguacaucuucagacacaacgacgugagccaccugagagagcugcugcagagaagcgaccccagcgugcccaagaucguggccuucgagaccgugcacagcauggacggcgccgugugcccccuggaggagcugugcgacguggcccacgaguucggcgccaucaccuucguggacgaggugcacgccgugggccuguacggcgccagaggcggcggcaucggcgacagagacggcgugaugcccaagauggacaucaucagcggcacccugggcaaggccuucggcugcgugggcggcuacaucgccagcaccagcagccugaucgacaccgugagaagcuacgccgccggcuucaucuucaccaccagccugccccccaugcugcuggccggcgcccuggagagcgugagaauccugaagagcgccgagggcagagugcugagaagacagcaccagagaaacgugaagcugaugagacagaugcugauggacgccggccugcccguggugcacugccccagccacaucauccccgugagaguggccgacgccgccaagaacaccgaggugugcgacgagcugaugagcagacacaacaucuacgugcaggccaucaacuaccccaccgugcccagaggcgaggagcugcugagaaucgcccccaccccccaccacaccccccagaugaugaacuacuuccuggagaaccugcuggugaccuggaagcaggugggccuggagcugaagccccacagcagcgccgagugcaacuucugcagaagaccccugcacuucgaggugaugagcgagagagagaagagcuacuucagcggccugagcaagcuggugagcgcccaggccuaa

SEQ ID NO: 13480 - RNA, 1764 nt, Artificial Sequence
  ALAS2__Homo_sapiens__NP_000023
auggugaccgccgccaugcugcugcagugcugccccgugcuggccagaggccccaccagccugcugggcaagguggugaagacccaccaguuccuguucggcaucggcagaugccccauccuggccacccagggccccaacugcagccagauccaccugaaggccaccaaggccggcggcgacagccccagcugggccaagggccacugccccuucaugcugagcgagcugcaggacggcaagagcaagaucgugcagaaggccgcccccgaggugcaggaggacgugaaggccuucaagaccgaccugcccagcagccuggugagcgugagccugagaaagcccuucagcggcccccaggagcaggagcagaucagcggcaaggugacccaccugauccagaacaacaugcccggcaacuacguguucagcuacgaccaguucuucagagacaagaucauggagaagaagcaggaccacaccuacagaguguucaagaccgugaacagaugggccgacgccuaccccuucgcccagcacuucagcgaggccagcguggccagcaaggacgugagcguguggugcagcaacgacuaccugggcaugagcagacacccccaggugcugcaggccacccaggagacccugcagagacacggcgccggcgccggcggcaccagaaacaucagcggcaccagcaaguuccacguggagcuggagcaggagcuggccgagcugcaccagaaggacagcgcccugcuguucagcagcugcuucguggccaacgacagcacccuguucacccuggccaagauccugcccggcugcgagaucuacagcgacgccggcaaccacgccagcaugauccagggcaucagaaacagcggcgccgccaaguucguguucagacacaacgaccccgaccaccugaagaagcugcuggagaagagcaaccccaagauccccaagaucguggccuucgagaccgugcacagcauggacggcgccaucugcccccuggaggagcugugcgacgugagccaccaguacggcgcccugaccuucguggacgaggugcacgccgugggccuguacggcagcagaggcgccggcaucggcgagagagacggcaucaugcacaagaucgacaucaucagcggcacccugggcaaggccuucggcugcgugggcggcuacaucgccagcaccagagaccugguggacauggugagaagcuacgccgccggcuucaucuucaccaccagccugccccccauggugcugagcggcgcccuggagagcgugagacugcugaagggcgaggagggccaggcccugagaagagcccaccagagaaacgugaagcacaugagacagcugcugauggacagaggccugcccgugauccccugccccagccacaucauccccaucagagugggcaacgccgcccugaacagcaagcugugcgaccugcugcugagcaagcacggcaucuacgugcaggccaucaacuaccccaccgugcccagaggcgaggagcugcugagacuggcccccagcccccaccacagcccccagaugauggaggacuucguggagaagcugcugcuggccuggaccgccgugggccugccccugcaggacgugagcguggccgccugcaacuucugcagaagacccgugcacuucgagcugaugagcgagugggagagaagcuacuucggcaacaugggcccccaguacgugaccaccuacgccuaa

SEQ ID NO: 13481 - RNA, 1830 nt, Artificial Sequence
  ALB__Homo_sapiens__NP_000468
augaagugggugaccuucaucagccugcuguuccuguucagcagcgccuacagcagaggcguguucagaagagacgcccacaagagcgagguggcccacagauucaaggaccugggcgaggagaacuucaaggcccuggugcugaucgccuucgcccaguaccugcagcagugccccuucgaggaccacgugaagcuggugaacgaggugaccgaguucgccaagaccugcguggccgacgagagcgccgagaacugcgacaagagccugcacacccuguucggcgacaagcugugcaccguggccacccugagagagaccuacggcgagauggccgacugcugcgccaagcaggagcccgagagaaacgagugcuuccugcagcacaaggacgacaaccccaaccugcccagacuggugagacccgagguggacgugaugugcaccgccuuccacgacaacgaggagaccuuccugaagaaguaccuguacgagaucgccagaagacaccccuacuucuacgcccccgagcugcuguucuucgccaagagauacaaggccgccuucaccgagugcugccaggccgccgacaaggccgccugccugcugcccaagcuggacgagcugagagacgagggcaaggccagcagcgccaagcagagacugaagugcgccagccugcagaaguucggcgagagagccuucaaggccugggccguggccagacugagccagagauuccccaaggccgaguucgccgaggugagcaagcuggugaccgaccugaccaaggugcacaccgagugcugccacggcgaccugcuggagugcgccgacgacagagccgaccuggccaaguacaucugcgagaaccaggacagcaucagcagcaagcugaaggagugcugcgagaagccccugcuggagaagagccacugcaucgccgagguggagaacgacgagaugcccgccgaccugcccagccuggccgccgacuucguggagagcaaggacgugugcaagaacuacgccgaggccaaggacguguuccugggcauguuccuguacgaguacgccagaagacaccccgacuacagcguggugcugcugcugagacuggccaagaccuacgagaccacccuggagaagugcugcgccgccgccgacccccacgagugcuacgccaagguguucgacgaguucaagccccugguggaggagccccagaaccugaucaagcagaacugcgagcuguucgagcagcugggcgaguacaaguuccagaacgcccugcuggugagauacaccaagaaggugccccaggugagcacccccacccugguggaggugagcagaaaccugggcaaggugggcagcaagugcugcaagcaccccgaggccaagagaaugcccugcgccgaggacuaccugagcguggugcugaaccagcugugcgugcugcacgagaagacccccgugagcgacagagugaccaagugcugcaccgagagccuggugaacagaagacccugcuucagcgcccuggagguggacgagaccuacgugcccaaggaguucaacgccgagaccuucaccuuccacgccgacaucugcacccugagcgagaaggagagacagaucaagaagcagaccgcccugguggagcuggugaagcacaagcccaaggccaccaaggagcagcugaaggccgugauggacgacuucgccgccuucguggagaagugcugcaaggccgacgacaaggagaccugcuucgccgaggagggcaagaagcugguggccgccagccaggccgcccugggccuguaa

SEQ ID NO: 13482 - RNA, 1713 nt, Artificial Sequence
  ALCAM__Homo_sapiens__NP_001230209
auggagagcaagggcgccagcagcugcagacugcuguucugccugcugaucagcgccaccguguucagacccggccugggcugguacaccgugaacagcgccuacggcgacaccaucaucauccccugcagacuggacgugccccagaaccugauguucggcaaguggaaguacgagaagcccgacggcagccccguguucaucgccuucagaagcagcaccaagaagagcgugcaguacgacgacgugcccgaguacaaggacagacugaaccugagcgagaacuacacccugagcaucagcaacgccagaaucagcgacgagaagagauucgugugcaugcuggugaccgaggacaacguguucgaggcccccaccaucgugaagguguucaagcagcccagcaagcccgagaucgugagcaaggcccuguuccuggagaccgagcagcugaagaagcugggcgacugcaucagcgaggacagcuaccccgacggcaacaucaccugguacagaaacggcaaggugcugcacccccuggagggcgccguggugaucaucuucaagaaggagauggaccccgugacccagcuguacaccaugaccagcacccuggaguacaagaccaccaaggccgacauccagaugcccuucaccugcagcgugaccuacuacggccccagcggccagaagaccauccacagcgagcaggccguguucgacaucuacuaccccaccgagcaggugaccauccaggugcugccccccaagaacgccaucaaggagggcgacaacaucacccugaagugccugggcaacggcaaccccccccccgaggaguuccuguucuaccugcccggccagcccgagggcaucagaagcagcaacaccuacacccugaccgacgugagaagaaacgccaccggcgacuacaagugcagccugaucgacaagaagagcaugaucgccagcaccgccaucaccgugcacuaccuggaccugagccugaaccccagcggcgaggugaccagacagaucggcgacgcccugcccgugagcugcaccaucagcgccagcagaaacgccaccgugguguggaugaaggacaacaucagacugagaagcagccccagcuucagcagccugcacuaccaggacgccggcaacuacgugugcgagaccgcccugcaggagguggagggccugaagaagagagagagccugacccugaucguggagggcaagccccagaucaagaugaccaagaagaccgaccccagcggccugagcaagaccaucaucugccacguggagggcuuccccaagcccgccauccaguggaccaucaccggcagcggcagcgugaucaaccagaccgaggagagccccuacaucaacggcagauacuacagcaagaucaucaucagccccgaggagaacgugacccugaccugcaccgccgagaaccagcuggagagaaccgugaacagccugaacgugagcgccaacgagaacagagagaaggugaacgaccaggccaagcugaucgugggcaucguggugggccugcugcuggccgcccugguggccggcgugguguacuggcuguacaugaagaagagcaagaccgccagcaagcacgugaacaaggaccugggcaacauggaggagaacaagaagcuggaggagaacaaccacaagaccgaggccuaa

SEQ ID NO: 13483 - RNA, 2256 nt, Artificial Sequence
  ALDH16A1__Homo_sapiens__NP_001138868
auggccgccaccagagccggccccagagccagagagaucuucaccagccuggaguacggccccgugcccgagagccacgccugcgcccuggccuggcuggacacccaggacagaugccugggccacuacgugaacggcaaguggcugaagcccgagcacagaaacagcgugcccugccaggaccccaucaccggcgagaaccuggccagcugccugcaggcccaggccgaggacguggccgccgccguggaggccgccagaauggccuucaagggcuggagcgcccaccccggcguggugagagcccagcaccugaccagacuggccgaggugauccagaagcaccagagacugcuguggacccuggagagccuggugaccggcagagccgugagagaggugagagacggcgacgugcagcuggcccagcagcugcugcacuaccacgccauccaggccagcacccaggaggaggcccuggccggcugggagcccaugggcgugaucggccugauccugccccccaccuucagcuuccuggagaugauguggagaaucugccccgcccuggccgugggcugcaccgugguggcccuggugccccccgccagccccgccccccugcugcuggcccagcuggccggcgagcugggccccuuccccggcauccugaacgugcugagcggccccgccagccuggugcccauccuggccagccagcccggcaucagaaagguggccuucugcggcgcccccgagggcggccugagacugcugauccaggagagcgugugggacgaggccaugagaagacugcaggagagaaugggcagacugagaagcggcagaggccuggacggcgccguggacaugggcgccagaggcgccgccgccugcgaccuggugcagagauucgugagagaggcccagagccagggcgcccagguguuccaggccggcgacgugcccagcgagagacccuucuacccccccacccuggugagcaaccugccccccgccagccccugcgcccagguggaggugcccuggcccguggugguggccagccccuucagaaccgccaaggaggcccugcugguggccaacggcacccccagaggcggcagcgccagcguguggagcgagagacugggccaggcccuggagcugggcuacggccugcaggugggcaccguguggaucaacgcccacggccugagagaccccagcgugcccaccggcggcugcaaggagagcggcugcagcuggcacggcggccccgacggccuguacgaguaccugagacccagcggcacccccgccagacugagcugccugagcaagaaccugaacuacgacaccuucggccuggccgugcccagcacccugcccgccggccccgagaucggccccagccccgccccccccuacggccuguucgugggcggcagauuccaggcccccggcgccagaagcagcagacccaucagagacagcagcggcaaccugcacggcuacguggccgagggcggcgccaaggacaucagaggcgccguggaggccgcccaccaggccuuccccggcugggccggccagagccccggcgccagagccgcccugcugugggcccuggccgccgcccuggagagaagaaagagcacccuggccagcagacuggagagacagggcgccgagcugaaggccgccgaggccgagguggagcugagcgccagaagacugagagccuggggcgccagagugcaggcccagggccacacccugcagguggccggccugagaggccccgugcugagacugagagagccccugggcgugcuggccguggugugccccgacgaguggccccugcuggccuucgugagccugcuggcccccgcccuggccuacggcaacaccguggugauggugcccagcgccgccugcccccugcuggcccuggaggugugccaggacauggccaccguguuccccgccggccuggccaacguggugaccggcgacagagaccaccugaccagaugccuggcccugcaccaggacgugcaggccaugugguacuucggcagcgcccagggcagccaguucguggagugggccagcgccggcaaccugaagcccgugugggccagcagaggcugccccagagccugggaccaggaggccgagggcgccggccccgagcugggccugagaguggccagaaccaaggcccuguggcugcccaugggcgacuaa

SEQ ID NO: 13484 - RNA, 2382 nt, Artificial Sequence
  ALDH18A1__Homo_sapiens__NP_001017423
augcugagccagguguacagaugcggcuuccagcccuucaaccagcaccugcugcccugggugaagugcaccaccguguucagaagccacugcauccagcccagcgugaucagacacgugagaagcuggagcaacauccccuucaucaccgugccccugagcagaacccacggcaagagcuucgcccacagaagcgagcugaagcacgccaagagaaucguggugaagcugggcagcgccguggugaccagaggcgacgagugcggccuggcccugggcagacuggccagcaucguggagcaggugagcgugcugcagaaccagggcagagagaugaugcuggugaccagcggcgccguggccuucggcaagcagagacugagacacgagauccugcugagccagagcgugagacaggcccugcacagcggccagaaccagcugaaggagauggccauccccgugcuggaggccagagccugcgccgccgccggccagagcggccugauggcccuguacgaggccauguucacccaguacagcaucugcgccgcccagauccuggugaccaaccuggacuuccacgacgagcagaagagaagaaaccugaacggcacccugcacgagcugcugagaaugaacaucgugcccaucgugaacaccaacgacgccguggugccccccgccgagcccaacagcgaccugcagggcgugaucagcgugaaggacaacgacagccuggccgccagacuggccguggagaugaagaccgaccugcugaucgugcugagcgacguggagggccuguucgacagcccccccggcagcgacgacgccaagcugaucgacaucuucuaccccggcgaccagcagagcgugaccuucggcaccaagagcagagugggcaugggcggcauggaggccaaggugaaggccgcccugugggcccugcagggcggcaccagcguggugaucgccaacggcacccaccccaaggugagcggccacgugaucaccgacaucguggagggcaagaaggugggcaccuucuucagcgaggugaagcccgccggccccaccguggagcagcagggcgagauggccagaagcggcggcagaaugcuggccacccuggagcccgagcagagagccgagaucauccaccaccuggccgaccugcugaccgaccagagagacgagauccugcuggccaacaagaaggaccuggaggaggccgagggcagacuggccgccccccugcugaagagacugagccugagcaccagcaagcugaacagccuggccaucggccugagacagaucgccgccagcagccaggacagcgugggcagagugcugagaagaaccagaaucgccaagaaccuggagcuggagcaggugaccgugcccaucggcgugcugcuggugaucuucgagagcagacccgacugccugccccagguggccgcccuggccaucgccagcggcaacggccugcugcugaagggcggcaaggaggccgcccacagcaacagaauccugcaccugcugacccaggaggcccugagcauccacggcgugaaggaggccgugcagcuggugaacaccagagaggagguggaggaccugugcagacuggacaagaugaucgaccugaucauccccagaggcagcagccagcuggugagagacauccagaaggccgccaagggcauccccgugaugggccacagcgagggcaucugccacauguacguggacagcgaggccagcguggacaaggugaccagacuggugagagacagcaagugcgaguaccccgccgccugcaacgcccuggagacccugcugauccacagagaccugcugagaaccccccuguucgaccagaucaucgacaugcugagaguggagcaggugaagauccacgccggccccaaguucgccagcuaccugaccuucagccccagcgaggugaagagccugagaaccgaguacggcgaccuggagcugugcaucgaggugguggacaacgugcaggacgccaucgaccacauccacaaguacggcagcagccacaccgacgugaucgugaccgaggacgagaacaccgccgaguucuuccugcagcacguggacagcgccugcguguucuggaacgccagcaccagauucagcgacggcuacagauucggccugggcgccgaggugggcaucagcaccagcagaauccacgccagaggccccgugggccuggagggccugcugaccaccaaguggcugcugagaggcaaggaccacguggugagcgacuucagcgagcacggcagccugaaguaccugcacgagaaccugcccaucccccagagaaacaccaacuaa

SEQ ID NO: 13485 - RNA, 1506 nt, Artificial Sequence
  ALDH1A1__Homo_sapiens__NP_000680
augagcagcagcggcacccccgaccugcccgugcugcugaccgaccugaagauccaguacaccaagaucuucaucaacaacgaguggcacgacagcgugagcggcaagaaguuccccguguucaaccccgccaccgaggaggagcugugccagguggaggagggcgacaaggaggacguggacaaggccgugaaggccgccagacaggccuuccagaucggcagccccuggagaaccauggacgccagcgagagaggcagacugcuguacaagcuggccgaccugaucgagagagacagacugcugcuggccaccauggagagcaugaacggcggcaagcuguacagcaacgccuaccugaacgaccuggccggcugcaucaagacccugagauacugcgccggcugggccgacaagauccagggcagaaccauccccaucgacggcaacuucuucaccuacaccagacacgagcccaucggcgugugcggccagaucauccccuggaacuucccccuggugaugcugaucuggaagaucggccccgcccugagcugcggcaacaccgugguggugaagcccgccgagcagaccccccugaccgcccugcacguggccagccugaucaaggaggccggcuucccccccggcguggugaacaucgugcccggcuacggccccaccgccggcgccgccaucagcagccacauggacaucgacaagguggccuucaccggcagcaccgaggugggcaagcugaucaaggaggccgccggcaagagcaaccugaagagagugacccuggagcugggcggcaagagccccugcaucgugcuggccgacgccgaccuggacaacgccguggaguucgcccaccacggcguguucuaccaccagggccagugcugcaucgccgccagcagaaucuucguggaggagagcaucuacgacgaguucgugagaagaagcguggagagagccaagaaguacauccugggcaacccccugacccccggcgugacccagggcccccagaucgacaaggagcaguacgacaagauccuggaccugaucgagagcggcaagaaggagggcgccaagcuggagugcggcggcggccccuggggcaacaagggcuacuucgugcagcccaccguguucagcaacgugaccgacgagaugagaaucgccaaggaggagaucuucggccccgugcagcagaucaugaaguucaagagccuggacgacgugaucaagagagccaacaacaccuucuacggccugagcgccggcguguucaccaaggacaucgacaaggccaucaccaucagcagcgcccugcaggccggcaccgugugggugaacugcuacggcguggugagcgcccagugccccuucggcggcuucaagaugagcggcaacggcagagagcugggcgaguacggcuuccacgaguacaccgaggugaagaccgugaccgugaagaucagccagaagaacagcuaa

SEQ ID NO: 13486 - RNA, 1494 nt, Artificial Sequence
  ALDH1A2__Homo_sapiens__NP_001193826
augaagaaccagugcgagaccguguggcugaagagccccaucaagcugaagcugaucuucaucaacaacgaguggcagaacagcgagagcggcagaguguuccccguguacaaccccgccaccggcgagcaggugugcgaggugcaggaggccgacaaggccgacaucgacaaggccgugcaggccgccagacuggccuucagccugggcagcguguggagaagaauggacgccagcgagagaggcagacugcuggacaagcuggccgaccugguggagagagacagagccgugcuggccaccauggagagccugaacggcggcaagcccuuccugcaggccuucuacguggaccugcagggcgugaucaagaccuucagauacuacgccggcugggccgacaagauccacggcaugaccauccccguggacggcgacuacuucaccuucaccagacacgagcccaucggcgugugcggccagaucauccccuggaacuucccccugcugauguucgccuggaagaucgcccccgcccugugcugcggcaacaccguggugaucaagcccgccgagcagaccccccugagcgcccuguacaugggcgcccugaucaaggaggccggcuucccccccggcgugaucaacauccugcccggcuacggccccaccgccggcgccgccaucgccagccacaucggcaucgacaagaucgccuucaccggcagcaccgaggugggcaagcugauccaggaggccgccggcagaagcaaccugaagagagugacccuggagcugggcggcaagagccccaacaucaucuucgccgacgccgaccuggacuacgccguggagcaggcccaccagggcguguucuucaaccagggccagugcugcaccgccggcagcagaaucuucguggaggagagcaucuacgaggaguucgugagaagaagcguggagagagccaagagaagaguggugggcagccccuucgaccccaccaccgagcagggcccccagaucgacaagaagcaguacaacaagauccuggagcugauccagagcggcguggccgagggcgccaagcuggagugcggcggcaagggccugggcagaaagggcuucuucaucgagcccaccguguucagcaacgugaccgacgacaugagaaucgccaaggaggagaucuucggccccgugcaggagauccugagauucaagaccauggacgaggugaucgagagagccaacaacagcgacuucggccugguggccgccguguucaccaacgacaucaacaaggcccugaccgugagcagcgccaugcaggccggcaccguguggaucaacugcuacaacgcccugaacgcccagagccccuucggcggcuucaagaugagcggcaacggcagagagaugggcgaguucggccugagagaguacagcgaggugaagaccgugaccgugaagaucccccagaagaacagcuaa

SEQ ID NO: 13487 - RNA, 1539 nt, Artificial Sequence
  ALDH1A3__Homo_sapiens__NP_000684
auggccaccgccaacggcgccguggagaacggccagcccgacagaaagccccccgcccugcccagacccaucagaaaccuggaggugaaguucaccaagaucuucaucaacaacgaguggcacgagagcaagagcggcaagaaguucgccaccugcaaccccagcaccagagagcagaucugcgagguggaggagggcgacaagcccgacguggacaaggccguggaggccgcccagguggccuuccagagaggcagccccuggagaagacuggacgcccugagcagaggcagacugcugcaccagcuggccgaccugguggagagagacagagccacccuggccgcccuggagaccauggacaccggcaagcccuuccugcacgccuucuucaucgaccuggagggcugcaucagaacccugagauacuucgccggcugggccgacaagauccagggcaagaccauccccaccgacgacaacguggugugcuucaccagacacgagcccaucggcgugugcggcgccaucacccccuggaacuucccccugcugaugcugguguggaagcuggcccccgcccugugcugcggcaacaccauggugcugaagcccgccgagcagaccccccugaccgcccuguaccugggcagccugaucaaggaggccggcuucccccccggcguggugaacaucgugcccggcuucggccccaccgugggcgccgccaucagcagccacccccagaucaacaagaucgccuucaccggcagcaccgaggugggcaagcuggugaaggaggccgccagcagaagcaaccugaagagagugacccuggagcugggcggcaagaaccccugcaucgugugcgccgacgccgaccuggaccuggccguggagugcgcccaccagggcguguucuucaaccagggccagugcugcaccgccgccagcagaguguucguggaggagcagguguacagcgaguucgugagaagaagcguggaguacgccaagaagagacccgugggcgaccccuucgacgugaagaccgagcagggcccccagaucgaccagaagcaguucgacaagauccuggagcugaucgagagcggcaagaaggagggcgccaagcuggagugcggcggcagcgccauggaggacaagggccuguucaucaagcccaccguguucagcgaggugaccgacaacaugagaaucgccaaggaggagaucuucggccccgugcagcccauccugaaguucaagagcaucgaggaggugaucaagagagccaacagcaccgacuacggccugaccgccgccguguucaccaagaaccuggacaaggcccugaagcuggccagcgcccuggagagcggcaccguguggaucaacugcuacaacgcccuguacgcccaggcccccuucggcggcuucaagaugagcggcaacggcagagagcugggcgaguacgcccuggccgaguacaccgaggugaagaccgugaccaucaagcugggcgacaagaaccccuaa

SEQ ID NO: 13488 - RNA, 1554 nt, Artificial Sequence
  ALDH1B1__Homo_sapiens__NP_000683
augcugagauuccuggcccccagacugcugagccugcagggcagaaccgccagauacagcagcgccgccgcccugcccagccccauccugaaccccgacauccccuacaaccagcuguucaucaacaacgaguggcaggacgccgugagcaagaagaccuuccccaccgugaaccccaccaccggcgaggugaucggccacguggccgagggcgacagagccgacguggacagagccgugaaggccgccagagaggccuucagacugggcagccccuggagaagaauggacgccagcgagagaggcagacugcugaacagacuggccgaccugguggagagagacagaguguaccuggccagccuggagacccuggacaacggcaagcccuuccaggagagcuacgcccuggaccuggacgaggugaucaagguguacagauacuucgccggcugggccgacaaguggcacggcaagaccauccccauggacggccagcacuucugcuucaccagacacgagcccgugggcgugugcggccagaucauccccuggaacuucccccuggugaugcagggcuggaagcuggcccccgcccuggccaccggcaacaccguggugaugaagguggccgagcagaccccccugagcgcccuguaccuggccagccugaucaaggaggccggcuucccccccggcguggugaacaucaucaccggcuacggccccaccgccggcgccgccaucgcccagcacguggacguggacaagguggccuucaccggcagcaccgaggugggccaccugauccagaaggccgccggcgacagcaaccugaagagagugacccuggagcugggcggcaagagccccagcaucgugcuggccgacgccgacauggagcacgccguggagcagugccacgaggcccuguucuucaacaugggccagugcugcugcgccggcagcagaaccuucguggaggagagcaucuacaacgaguuccuggagagaaccguggagaaggccaagcagagaaaggugggcaaccccuucgagcuggacacccagcagggcccccagguggacaaggagcaguucgagagagugcugggcuacauccagcugggccagaaggagggcgccaagcugcugugcggcggcgagagauucggcgagagaggcuucuucaucaagcccaccguguucggcggcgugcaggacgacaugagaaucgccaaggaggagaucuucggccccgugcagccccuguucaaguucaagaagaucgaggaggugguggagagagccaacaacaccagauacggccuggccgccgccguguucaccagagaccuggacaaggccauguacuucacccaggcccugcaggccggcaccgugugggugaacaccuacaacaucgugaccugccacacccccuucggcggcuucaaggagagcggcaacggcagagagcugggcgaggacggccugaaggccuacaccgaggugaagaccgugaccaucaaggugccccagaagaacagcuaa

SEQ ID NO: 13489 - RNA, 2739 nt, Artificial Sequence
  ALDH1L1__Homo_sapiens__NP_001257293
auggccggccccagcaacccccccgccaccaugaagaucgccgugaucggccagagccuguucggccaggagguguacugccaccugagaaaggagggccacgagguggugggcguguucaccgugcccgacaaggacggcaaggccgacccccugggccuggaggccgagaaggacggcgugcccguguucaaguacagcagauggagagccaagggccaggcccugcccgacgugguggccaaguaccaggcccugggcgccgagcugaacgugcugcccuucugcagccaguucauccccauggagaucaucagcgcccccagacacggcagcaucaucuaccaccccagccugcugcccagacacagaggcgccagcgccaucaacuggacccugauccacggcgacaagaagggcggcuucagcaucuucugggccgacgacggccuggacaccggcgaccugcugcugcagaaggagugcgaggugcugcccgacgacaccgugagcacccuguacaacagauuccuguuccccgagggcaucaagggcauggugcaggccgugagacugaucgccgagggcaaggcccccagacugccccagcccgaggagggcgccaccuacgagggcauccagaagaaggagaccgccaagaucaacugggaccagcccgccgaggccauccacaacuggaucagaggcaacgacaaggugcccggcgccuggaccgaggccugcgagcagaagcugaccuucuucaacagcacccugaacaccagcggccuggugcccgagggcgacgcccugcccauccccggcgcccacagacccggcguggugaccaaggccggccugauccuguucggcaacgacgacaagaugcugcuggugaagaacauccagcuggaggacggcaagaugauccuggccagcaacuucuucaagggcgccgccagcagcgugcuggagcugaccgaggccgagcuggugaccgccgaggccgugagaagcguguggcagagaauccugcccaaggugcuggagguggaggacagcaccgacuucuucaagagcggcgccgccagcguggacguggugagacugguggaggaggugaaggagcugugcgacggccuggagcuggagaacgaggacguguacauggccagcaccuucggcgacuucauccagcugcuggugagaaagcugagaggcgacgacgaggagggcgagugcagcaucgacuacguggagauggccgugaacaagagaaccgugagaaugccccaccagcuguucaucggcggcgaguucguggacgccgagggcgccaagaccagcgagaccaucaaccccaccgacggcagcgugaucugccaggugagccuggcccaggugaccgacguggacaaggccguggccgccgccaaggacgccuucgagaacggcagauggggcaagaucagcgccagagacagaggcagacugauguacagacuggccgaccugauggagcagcaccaggaggagcuggccaccaucgaggcccuggacgccggcgccguguacacccuggcccugaagacccacgugggcaugagcauccagaccuucagauacuucgccggcuggugcgacaagauccagggcagcaccauccccaucaaccaggccagacccaacagaaaccugacccugaccagaaaggagcccgugggcgugugcggcaucaucauccccuggaacuacccccugaugaugcugagcuggaagaccgccgccugccuggccgccggcaacaccguggugaucaagcccgcccaggugaccccccugaccgcccugaaguucgccgagcugacccugaaggccggcauccccaagggcguggugaacgugcugcccggcagcggcagccuggugggccagagacugagcgaccaccccgacgugagaaagaucggcuucaccggcagcaccgaggugggcaagcacaucaugaagagcugcgccaucagcaacgugaagaaggugagccuggagcugggcggcaagagcccccugaucaucuucgccgacugcgaccugaacaaggccgugcagaugggcaugagcagcguguucuucaacaagggcgagaacugcaucgccgccggcagacuguucguggaggacagcauccacgacgaguucgugagaagagugguggaggaggugagaaagaugaaggugggcaacccccuggacagagacaccgaccacggcccccagaaccaccacgcccaccuggugaagcugauggaguacugccagcacggcgugaaggagggcgccacccuggugugcggcggcaaccaggugcccagacccggcuucuucuucgagcccaccguguucaccgacguggaggaccacauguucaucgccaaggaggagagcuucggccccgugaugaucaucagcagauucgccgacggcgaccuggacgccgugcugagcagagccaacgccaccgaguucggccuggccagcggcguguucaccagagacaucaacaaggcccuguacgugagcgacaagcugcaggccggcaccguguucgugaacaccuacaacaagaccgacguggccgcccccuucggcggcuucaagcagagcggcuucggcaaggaccugggcgaggccgcccugaacgaguaccugagagugaagaccgugaccuucgaguacuaa

SEQ ID NO: 13490 - RNA, 1554 nt, Artificial Sequence
  ALDH2__Homo_sapiens__NP_000681
augcugagagccgccgccagauucggccccagacugggcagaagacugcugagcgccgccgccacccaggccgugcccgcccccaaccagcagcccgagguguucugcaaccagaucuucaucaacaacgaguggcacgacgccgugagcagaaagaccuuccccaccgugaaccccagcaccggcgaggugaucugccagguggccgagggcgacaaggaggacguggacaaggccgugaaggccgccagagccgccuuccagcugggcagccccuggagaagaauggacgccagccacagaggcagacugcugaacagacuggccgaccugaucgagagagacagaaccuaccuggccgcccuggagacccuggacaacggcaagcccuacgugaucagcuaccugguggaccuggacauggugcugaagugccugagauacuacgccggcugggccgacaaguaccacggcaagaccauccccaucgacggcgacuucuucagcuacaccagacacgagcccgugggcgugugcggccagaucauccccuggaacuucccccugcugaugcaggccuggaagcugggccccgcccuggccaccggcaacgugguggugaugaagguggccgagcagaccccccugaccgcccuguacguggccaaccugaucaaggaggccggcuucccccccggcguggugaacaucgugcccggcuucggccccaccgccggcgccgccaucgccagccacgaggacguggacaagguggccuucaccggcagcaccgagaucggcagagugauccagguggccgccggcagcagcaaccugaagagagugacccuggagcugggcggcaagagccccaacaucaucaugagcgacgccgacauggacugggccguggagcaggcccacuucgcccuguucuucaaccagggccagugcugcugcgccggcagcagaaccuucgugcaggaggacaucuacgacgaguucguggagagaagcguggccagagccaagagcagaguggugggcaaccccuucgacagcaagaccgagcagggcccccagguggacgagacccaguucaagaagauccugggcuacaucaacaccggcaagcaggagggcgccaagcugcugugcggcggcggcaucgccgccgacagaggcuacuucauccagcccaccguguucggcgacgugcaggacggcaugaccaucgccaaggaggagaucuucggccccgugaugcagauccugaaguucaagaccaucgaggagguggugggcagagccaacaacagcaccuacggccuggccgccgccguguucaccaaggaccuggacaaggccaacuaccugagccaggcccugcaggccggcaccgugugggugaacugcuacgacguguucggcgcccagagccccuucggcggcuacaagaugagcggcagcggcagagagcugggcgaguacggccugcaggccuacaccgaggugaagaccgugaccgugaaggugccccagaagaacagcuaa

SEQ ID NO: 13491 - RNA, 1362 nt, Artificial Sequence
  ALDH3A1__Homo_sapiens__NP_000682
augagcaagaucagcgaggccgugaagagagccagagccgccuucagcagcggcagaaccagaccccugcaguucagaauccagcagcuggaggcccugcagagacugauccaggagcaggagcaggagcuggugggcgcccuggccgccgaccugcacaagaacgaguggaacgccuacuacgaggaggugguguacgugcuggaggagaucgaguacaugauccagaagcugcccgagugggccgccgacgagcccguggagaagaccccccagacccagcaggacgagcuguacauccacagcgagccccugggcguggugcuggugaucggcaccuggaacuaccccuucaaccugaccauccagcccauggugggcgccaucgccgccggcaacagcguggugcugaagcccagcgagcugagcgagaacauggccagccugcuggccaccaucaucccccaguaccuggacaaggaccuguaccccgugaucaacggcggcgugcccgagaccaccgagcugcugaaggagagauucgaccacauccuguacaccggcagcaccggcgugggcaagaucaucaugaccgccgccgccaagcaccugacccccgugacccuggagcugggcggcaagagccccugcuacguggacaagaacugcgaccuggacguggccugcagaagaaucgccuggggcaaguucaugaacagcggccagaccugcguggcccccgacuacauccugugcgaccccagcauccagaaccagaucguggagaagcugaagaagagccugaaggaguucuacggcgaggacgccaagaagagcagagacuacggcagaaucaucagcgccagacacuuccagagagugaugggccugaucgagggccagaagguggccuacggcggcaccggcgacgccgccaccagauacaucgcccccaccauccugaccgacguggacccccagagccccgugaugcaggaggagaucuucggccccgugcugcccaucgugugcgugagaagccuggaggaggccauccaguucaucaaccagagagagaagccccuggcccuguacauguucagcagcaacgacaaggugaucaagaagaugaucgccgagaccagcagcggcggcguggccgccaacgacgugaucgugcacaucacccugcacagccugcccuucggcggcgugggcaacagcggcaugggcagcuaccacggcaagaagagcuucgagaccuucagccacagaagaagcugccuggugagaccccugaugaacgacgagggccugaaggugagauacccccccagccccgccaagaugacccagcacuaa

SEQ ID NO: 13492 - RNA, 1458 nt, Artificial Sequence
  ALDH3A2__Homo_sapiens__NP_000373
auggagcuggaggugagaagagugagacaggccuuccugagcggcagaagcagaccccugagauucagacugcagcagcuggaggcccugagaagaauggugcaggagagagagaaggacauccugaccgccaucgccgccgaccugugcaagagcgaguucaacguguacagccaggaggugaucaccgugcugggcgagaucgacuucaugcuggagaaccugcccgagugggugaccgccaagcccgugaagaagaacgugcugaccaugcuggacgaggccuacauccagccccagccccugggcguggugcugaucaucggcgccuggaacuaccccuucgugcugaccauccagccccugaucggcgccaucgccgccggcaacgccgugaucaucaagcccagcgagcugagcgagaacaccgccaagauccuggccaagcugcugccccaguaccuggaccaggaccuguacaucgugaucaacggcggcguggaggagaccaccgagcugcugaagcagagauucgaccacaucuucuacaccggcaacaccgccgugggcaagaucgugauggaggccgccgccaagcaccugacccccgugacccuggagcugggcggcaagagccccugcuacaucgacaaggacugcgaccuggacaucgugugcagaagaaucaccuggggcaaguacaugaacugcggccagaccugcaucgcccccgacuacauccugugcgaggccagccugcagaaccagaucguguggaagaucaaggagaccgugaaggaguucuacggcgagaacaucaaggagagccccgacuacgagagaaucaucaaccugagacacuucaagagaauccugagccugcuggagggccagaagaucgccuucggcggcgagaccgacgaggccaccagauacaucgcccccaccgugcugaccgacguggaccccaagaccaaggugaugcaggaggagaucuucggccccauccugcccaucgugcccgugaagaacguggacgaggccaucaacuucaucaacgagagagagaagccccuggcccuguacguguucagccacaaccacaagcugaucaagagaaugaucgacgagaccagcagcggcggcgugaccggcaacgacgugaucaugcacuucacccugaacagcuuccccuucggcggcgugggcagcagcggcaugggcgccuaccacggcaagcacagcuucgacaccuucagccaccagagacccugccugcugaagagccugaagagagagggcgccaacaagcugagauacccccccaacagccagagcaagguggacuggggcaaguucuuccugcugaagagauucaacaaggagaagcugggccugcugcugcugaccuuccugggcaucguggccgccgugcuggugaaggccgaguacuacuaa

SEQ ID NO: 13493 - RNA, 1407 nt, Artificial Sequence
  ALDH3B1__Homo_sapiens__NP_000685
auggacccccugggcgacacccugagaagacugagagaggccuuccacgccggcagaaccagacccgccgaguucagagccgcccagcugcagggccugggcagauuccugcaggagaacaagcagcugcugcacgacgcccuggcccaggaccugcacaagagcgccuucgagagcgaggugagcgagguggccaucagccagggcgaggugacccuggcccugagaaaccugagagccuggaugaaggacgagagagugcccaagaaccuggccacccagcuggacagcgccuucaucagaaaggagcccuucggccuggugcugaucaucgcccccuggaacuacccccugaaccugacccuggugccccuggugggcgcccuggccgccggcaacugcguggugcugaagcccagcgagaucagcaagaacguggagaagauccuggccgaggugcugccccaguacguggaccagagcugcuucgccguggugcugggcggcccccaggagaccggccagcugcuggagcacagauucgacuacaucuucuucaccggcagccccagagugggcaagaucgugaugaccgccgccgccaagcaccugacccccgugacccuggagcugggcggcaagaaccccugcuacguggacgacaacugcgacccccagaccguggccaacagaguggccugguucagauacuucaacgccggccagaccugcguggcccccgacuacgugcugugcagccccgagaugcaggagagacugcugcccgcccugcagagcaccaucaccagauucuacggcgacgacccccagagcagccccaaccugggcagaaucaucaaccagaagcaguuccagagacugagagcccugcugggcugcggcagaguggccaucggcggccagagcgacgagagcgacagauacaucgcccccaccgugcugguggacgugcaggagauggagcccgugaugcaggaggagaucuucggccccauccugcccaucgugaacgugcagagccuggacgaggccaucgaguucaucaacagaagagagaagccccuggcccuguacgccuucagcaacagcagccagguggugaagagagugcugacccagaccagcagcggcggcuucugcggcaacgacggcuucaugcacaugacccuggccagccugcccuucggcggcgugggcgccagcggcaugggcagauaccacggcaaguucagcuucgacaccuucagccaccacagagccugccugcugagaagccccggcauggagaagcugaacgcccugagauaccccccccagagccccagaagacugagaaugcugcugguggccauggaggcccagggcugcagcugcacccugcuguaa

SEQ ID NO: 13494 - RNA, 1539 nt, Artificial Sequence
  ALDH4A1__Homo_sapiens__NP_001306147
augcugcugcccgcccccgcccugagaagagcccugcugagcagacccuggaccggcgccggccugagauggaagcacaccagcagccugaagguggccaacgagcccgugcuggccuucacccagggcagccccgagagagacgcccugcagaaggcccugaaggaccugaagggcagaauggaggccauccccugcguggugggcgacgaggagguguggaccagcgacgugcaguaccaggugagccccuucaaccacggccacaagguggccaaguucugcuacgccgacaagagccugcugaacaaggccaucgaggccgcccuggccgccagaaaggagugggaccugaagcccaucgccgacagagcccagaucuuccugaaggccgccgacaugcugagcggccccagaagagccgagauccuggccaagaccauggugggccagggcaagaccgugauccaggccgagaucgacgccgccgccgagcugaucgacuucuucagauucaacgccaaguacgccguggagcuggagggccagcagcccaucagcgugccccccagcaccaacagcaccguguacagaggccuggagggcuucguggccgccaucagccccuucaacuucaccgccaucggcggcaaccuggccggcgcccccgcccugaugggcaacguggugcuguggaagcccagcgacaccgccaugcuggccagcuacgccguguacagaauccugagagaggccggccugccccccaacaucauccaguucgugcccgccgacggcccccuguucggcgacaccgugaccagcagcgagcaccugugcggcaucaacuucaccggcagcgugcccaccuucaagcaccuguggaagcagguggcccagaaccuggacagauuccacaccuuccccagacuggccggcgagugcggcggcaagaacuuccacuucgugcacagaagcgccgacguggagagcguggugagcggcacccugagaagcgccuucgaguacggcggccagaagugcagcgccugcagcagacuguacgugccccacagccuguggccccagaucaagggcagacugcuggaggagcacagcagaaucaaggugggcgaccccgccgaggacuucggcaccuucuucagcgccgugaucgacgccaaggagaucuucggccccgugcugagcguguacguguaccccgacgacaaguacaaggagacccugcagcugguggacagcaccaccagcuacggccugaccggcgccguguucagccaggacaaggacguggugcaggaggccaccaaggugcugagaaacgccgccggcaacuucuacaucaacgacaagagcaccggcagcaucgugggccagcagcccuucggcggcgccagagccagcggcaccaacgacaagcccggcggcccccacuacauccugagauggaccagcccccaggugaucaaggagacccacaagccccugggcgacuggagcuacgccuacaugcaguaa

SEQ ID NO: 13495 - RNA, 1647 nt, Artificial Sequence
  ALDH5A1__Homo_sapiens__NP_733936
auggccaccugcaucuggcugagaagcugcggcgccagaagacugggcagcaccuuccccggcugcagacugagacccagagccggcggccuggugcccgccagcggccccgcccccggccccgcccagcugagaugcuacgccggcagacuggccggccugagcgccgcccugcugagaaccgacagcuucgugggcggcagauggcugcccgccgccgccaccuuccccgugcaggaccccgccagcggcgccgcccugggcaugguggccgacugcggcgugagagaggccagagccgccgugagagccgccuacgaggccuucugcagauggagagaggugagcgccaaggagagaagcagccugcugagaaagugguacaaccugaugauccagaacaaggacgaccuggccagaaucaucaccgccgagagcggcaagccccugaaggaggcccacggcgagauccuguacagcgccuucuuccuggagugguucagcgaggaggccagaagaguguacggcgacaucauccacacccccgccaaggacagaagagcccuggugcugaagcagcccaucggcguggccgccgugaucacccccuggaacuuccccagcgccaugaucaccagaaaggugggcgccgcccuggccgccggcugcaccgugguggugaagcccgccgaggacacccccuucagcgcccuggcccuggccgaggugaaccagggcuuccugcuggaccuggacccccugcugcuggccagccaggccggcauccccagcggcguguacaacgugauccccugcagcagaaagaacgccaaggaggugggcgaggccaucugcaccgacccccuggugagcaagaucagcuucaccggcagcaccaccaccggcaagauccugcugcaccacgccgccaacagcgugaagagagugagcauggagcugggcggccuggcccccuucaucguguucgacagcgccaacguggaccaggccguggccggcgccauggccagcaaguucagaaacaccggccagaccugcgugugcagcaaccaguuccuggugcagagaggcauccacgacgccuucgugaaggccuucgccgaggccaugaagaagaaccugagagugggcaacggcuucgaggagggcaccacccagggcccccugaucaacgagaaggccguggagaagguggagaagcaggugaacgacgccgugagcaagggcgccaccguggugaccggcggcaagagacaccagcugggcaagaacuucuucgagcccacccugcugugcaacgugacccaggacaugcugugcacccacgaggagaccuucggcccccuggcccccgugaucaaguucgacaccgaggaggaggccaucgccaucgccaacgccgccgacgugggccuggccggcuacuucuacagccaggaccccgcccagaucuggagaguggccgagcagcuggaggugggcauggugggcgugaacgagggccugaucagcagcguggagugccccuucggcggcgugaagcagagcggccugggcagagagggcagcaaguacggcaucgacgaguaccuggagcugaaguacgugugcuacggcggccuguaa

SEQ ID NO: 13496 - RNA, 1608 nt, Artificial Sequence
  ALDH6A1__Homo_sapiens__NP_005580
auggccgcccugcuggccgccgccgccgugagagccagaauccugcaggugagcagcaaggugaagagcagccccaccugguacagcgccagcagcuucagcagcagcgugcccaccgugaagcuguucaucggcggcaaguucguggagagcaagagcgacaaguggaucgacauccacaaccccgccaccaacgaggugaucggcagagugccccaggccaccaaggccgagauggacgccgccaucgccagcugcaagagagccuuccccgccugggccgacaccagcgugcugagcagacagcaggugcugcugagauaccagcagcugaucaaggagaaccugaaggagaucgccaagcugaucacccuggagcagggcaagacccuggccgacgccgagggcgacguguucagaggccugcaggugguggagcacgccugcagcgugaccagccugaugaugggcgagaccaugcccagcaucaccaaggacauggaccuguacagcuacagacugccccugggcgugugcgccggcaucgcccccuucaacuuccccgccaugaucccccuguggauguuccccauggccauggugugcggcaacaccuuccugaugaagcccagcgagagagugcccggcgccaccaugcugcuggccaagcugcugcaggacagcggcgcccccgacggcacccugaacaucauccacggccagcacgaggccgugaacuucaucugcgaccaccccgacaucaaggccaucagcuucgugggcagcaacaaggccggcgaguacaucuucgagagaggcagcagacacggcaagagagugcaggccaacaugggcgccaagaaccacggcguggugaugcccgacgccaacaaggagaacacccugaaccagcuggugggcgccgccuucggcgccgccggccagagaugcauggcccugagcaccgccgugcuggugggcgaggccaagaaguggcugcccgagcugguggagcacgccaagaaccugagagugaacgccggcgaccagcccggcgccgaccugggcccccugaucaccccccaggccaaggagagagugugcaaccugaucgacagcggcaccaaggagggcgccagcauccugcuggacggcagaaagaucaaggugaagggcuacgagaacggcaacuucgugggccccaccaucaucagcaacgugaagcccaacaugaccugcuacaaggaggagaucuucggccccgugcugguggugcuggagaccgagacccuggacgaggccauccagaucgugaacaacaaccccuacggcaacggcaccgccaucuucaccaccaacggcgccaccgccagaaaguacgcccaccugguggacgugggccaggugggcgugaacgugcccauccccgugccccugcccauguucagcuucaccggcagcagaagcagcuucagaggcgacaccaacuucuacggcaagcagggcauccaguucuacacccagcugaagaccaucaccagccaguggaaggaggaggacgccacccugagcagccccgccguggugaugcccaccaugggcagauaa

SEQ ID NO: 13497 - RNA, 1620 nt, Artificial Sequence
  ALDH7A1__Homo_sapiens__NP_001173
auguggagacugcccagagcccugugcgugcacgccgccaagaccagcaagcugagcggccccuggagcagacccgccgccuucaugagcacccugcugaucaaccagccccaguacgccuggcugaaggagcugggccugagagaggagaacgagggcguguacaacggcagcuggggcggcagaggcgaggugaucaccaccuacugccccgccaacaacgagcccaucgccagagugagacaggccagcguggccgacuacgaggagaccgugaagaaggccagagaggccuggaagaucugggccgacauccccgcccccaagagaggcgagaucgugagacagaucggcgacgcccugagagagaagauccaggugcugggcagccuggugagccuggagaugggcaagauccugguggagggcgugggcgaggugcaggaguacguggacaucugcgacuacgccgugggccugagcagaaugaucggcggccccauccugcccagcgagagaagcggccacgcccugaucgagcaguggaaccccgugggccuggugggcaucaucaccgccuucaacuuccccguggccguguacggcuggaacaacgccaucgccaugaucugcggcaacgugugccuguggaagggcgcccccaccaccagccugaucagcguggccgugaccaagaucaucgccaaggugcuggaggacaacaagcugcccggcgccaucugcagccugaccugcggcggcgccgacaucggcaccgccauggccaaggacgagagagugaaccugcugagcuucaccggcagcacccaggugggcaagcaggugggccugauggugcaggagagauucggcagaagccugcuggagcugggcggcaacaacgccaucaucgccuucgaggacgccgaccugagccugguggugcccagcgcccuguucgccgccgugggcaccgccggccagagaugcaccaccgccagaagacuguucauccacgagagcauccacgacgagguggugaacagacugaagaaggccuacgcccagaucagagugggcaaccccugggaccccaacgugcuguacggcccccugcacaccaagcaggccgugagcauguuccugggcgccguggaggaggccaagaaggagggcggcaccgugguguacggcggcaaggugauggacagacccggcaacuacguggagcccaccaucgugaccggccugggccacgacgccagcaucgcccacaccgagaccuucgcccccauccuguacguguucaaguucaagaacgaggaggagguguucgccuggaacaacgaggugaagcagggccugagcagcagcaucuucaccaaggaccugggcagaaucuucagauggcugggccccaagggcagcgacugcggcaucgugaacgugaacauccccaccagcggcgccgagaucggcggcgccuucggcggcgagaagcacaccggcggcggcagagagagcggcagcgacgccuggaagcaguacaugagaagaagcaccugcaccaucaacuacagcaaggaccugccccuggcccagggcaucaaguuccaguaa

SEQ ID NO: 13498 - RNA, 1557 nt, Artificial Sequence
  ALDH9A1__Homo_sapiens__NP_000687
auguuccugagagccggccuggccgcccugagcccccugcugagaagccugagacccagccccguggccgccaugagcaccggcaccuucguggugagccagccccugaacuacagaggcggcgccagaguggagcccgccgacgccagcggcaccgagaaggccuucgagcccgccaccggcagagugaucgccaccuucaccugcagcggcgagaaggaggugaaccuggccgugcagaacgccaaggccgccuucaagaucuggagccagaagagcggcauggagagaugcagaauccugcuggaggccgccagaaucaucagagagagagaggacgagaucgccaccauggagugcaucaacaacggcaagagcaucuucgaggccagacuggacaucgacaucagcuggcagugccuggaguacuacgccggccuggccgccagcauggccggcgagcacauccagcugcccggcggcagcuucggcuacaccagaagagagccccugggcgugugcgugggcaucggcgccuggaacuaccccuuccagaucgccagcuggaagagcgcccccgcccuggccugcggcaacgccaugguguucaagcccagccccuucacccccgugagcgcccugcugcuggccgagaucuacagcgaggccggcgugccccccggccuguucaacguggugcagggcggcgccgccaccggccaguuccugugccagcaccccgacguggccaaggugagcuucaccggcagcgugcccaccggcaugaagaucauggagaugagcgccaagggcaucaagcccgugacccuggagcugggcggcaagagcccccugaucaucuucagcgacugcgacaugaacaacgccgugaagggcgcccugauggccaacuuccugacccagggccaggugugcugcaacggcaccagaguguucgugcagaaggagauccuggacaaguucaccgaggagguggugaagcagacccagagaaucaagaucggcgacccccugcuggaggacaccagaaugggcccccugaucaacagaccccaccuggagagagugcugggcuucgugaagguggccaaggagcagggcgccaaggugcugugcggcggcgacaucuacgugcccgaggaccccaagcugaaggacggcuacuacaugagacccugcgugcugaccaacugcagagacgacaugaccugcgugaaggaggagaucuucggccccgugaugagcauccugagcuucgacaccgaggccgaggugcuggagagagccaacgacaccaccuucggccuggccgccggcguguucaccagagacauccagagagcccacagagugguggccgagcugcaggccggcaccugcuucaucaacaacuacaacgugagccccguggagcugcccuucggcggcuacaagaagagcggcuucggcagagagaacggcagagugaccaucgaguacuacagccagcugaagaccgugugcguggagaugggcgacguggagagcgccuucuaa

SEQ ID NO: 13499 - RNA, 1257 nt, Artificial Sequence
  ALDOA__Homo_sapiens__NP_001230106
auggccagaagaaagcccgagggcagcagcuucaacaugacccaccugagcauggccauggccuucagcuucccccccguggccagcggccagcugcacccccagcugggcaacacccagcaccagaccgagcugggcaaggagcuggccaccaccagcaccaugcccuaccaguaccccgcccugacccccgagcagaagaaggagcugagcgacaucgcccacagaaucguggcccccggcaagggcauccuggccgccgacgagagcaccggcagcaucgccaagagacugcagagcaucggcaccgagaacaccgaggagaacagaagauucuacagacagcugcugcugaccgccgacgacagagugaaccccugcaucggcggcgugauccuguuccacgagacccuguaccagaaggccgacgacggcagacccuucccccaggugaucaagagcaagggcggcguggugggcaucaagguggacaagggcguggugccccuggccggcaccaacggcgagaccaccacccagggccuggacggccugagcgagagaugcgcccaguacaagaaggacggcgccgacuucgccaaguggagaugcgugcugaagaucggcgagcacacccccagcgcccuggccaucauggagaacgccaacgugcuggccagauacgccagcaucugccagcagaacggcaucgugcccaucguggagcccgagauccugcccgacggcgaccacgaccugaagagaugccaguacgugaccgagaaggugcuggccgccguguacaaggcccugagcgaccaccacaucuaccuggagggcacccugcugaagcccaacauggugacccccggccacgccugcacccagaaguucagccacgaggagaucgccauggccaccgugaccgcccugagaagaaccgugccccccgccgugaccggcaucaccuuccugagcggcggccagagcgaggaggaggccagcaucaaccugaacgccaucaacaagugcccccugcugaagcccugggcccugaccuucagcuacggcagagcccugcaggccagcgcccugaaggccuggggcggcaagaaggagaaccugaaggccgcccaggaggaguacgugaagagagcccuggccaacagccuggccugccagggcaaguacacccccagcggccaggccggcgccgccgccagcgagagccuguucgugagcaaccacgccuacuaa

SEQ ID NO: 13500 - RNA, 1095 nt, Artificial Sequence
  ALDOB__Homo_sapiens__NP_000026
auggcccacagauuccccgcccugacccaggagcagaagaaggagcugagcgagaucgcccagagcaucguggccaacggcaagggcauccuggccgccgacgagagcgugggcaccaugggcaacagacugcagagaaucaagguggagaacaccgaggagaacagaagacaguucagagagauccuguucagcguggacagcagcaucaaccagagcaucggcggcgugauccuguuccacgagacccuguaccagaaggacagccagggcaagcuguucagaaacauccugaaggagaagggcaucguggugggcaucaagcuggaccagggcggcgccccccuggccggcaccaacaaggagaccaccauccagggccuggacggccugagcgagagaugcgcccaguacaagaaggacggcguggacuucggcaaguggagagccgugcugagaaucgccgaccagugccccagcagccuggccauccaggagaacgccaacgcccuggccagauacgccagcaucugccagcagaacggccuggugcccaucguggagcccgaggugauccccgacggcgaccacgaccuggagcacugccaguacgugaccgagaaggugcuggccgccguguacaaggcccugaacgaccaccacguguaccuggagggcacccugcugaagcccaacauggugaccgccggccacgccugcaccaagaaguacacccccgagcagguggccauggccaccgugaccgcccugcacagaaccgugcccgccgccgugcccggcaucugcuuccugagcggcggcaugagcgaggaggacgccacccugaaccugaacgccaucaaccugugcccccugcccaagcccuggaagcugagcuucagcuacggcagagcccugcaggccagcgcccuggccgccuggggcggcaaggccgccaacaaggaggccacccaggaggccuucaugaagagagccauggccaacugccaggccgccaagggccaguacgugcacaccggcagcagcggcgccgccagcacccagagccuguucaccgccugcuacaccuacuaa

SEQ ID NO: 13501 - RNA, 1095 nt, Artificial Sequence
  ALDOC__Homo_sapiens__NP_005156
augccccacagcuaccccgcccugagcgccgagcagaagaaggagcugagcgacaucgcccugagaaucguggcccccggcaagggcauccuggccgccgacgagagcgugggcagcauggccaagagacugagccagaucggcguggagaacaccgaggagaacagaagacuguacagacaggugcuguucagcgccgacgacagagugaagaagugcaucggcggcgugaucuucuuccacgagacccuguaccagaaggacgacaacggcgugcccuucgugagaaccauccaggacaagggcaucguggugggcaucaagguggacaagggcguggugccccuggccggcaccgacggcgagaccaccacccagggccuggacggccugagcgagagaugcgcccaguacaagaaggacggcgccgacuucgccaaguggagaugcgugcugaagaucagcgagagaacccccagcgcccuggccauccuggagaacgccaacgugcuggccagauacgccagcaucugccagcagaacggcaucgugcccaucguggagcccgagauccugcccgacggcgaccacgaccugaagagaugccaguacgugaccgagaaggugcuggccgccguguacaaggcccugagcgaccaccacguguaccuggagggcacccugcugaagcccaacauggugacccccggccacgccugccccaucaaguacacccccgaggagaucgccauggccaccgugaccgcccugagaagaaccgugccccccgccgugcccggcgugaccuuccugagcggcggccagagcgaggaggaggccagcuucaaccugaacgccaucaacagaugcccccugcccagacccugggcccugaccuucagcuacggcagagcccugcaggccagcgcccugaacgccuggagaggccagagagacaacgccggcgccgccaccgaggaguucaucaagagagccgaggugaacggccuggccgcccagggcaaguacgagggcagcggcgaggacggcggcgccgccgcccagagccuguacaucgccaaccacgccuacuaa

SEQ ID NO: 13502 - RNA, 1422 nt, Artificial Sequence
  ALG10B__Homo_sapiens__NP_001013642
auggcccagcuggagggcuacugcuucagcgccgcccugagcugcaccuuccuggugagcugccugcuguucagcgccuucagcagagcccugagagagcccuacauggacgagaucuuccaccugccccaggcccagagauacugcgagggccacuucagccugagccagugggaccccaugaucaccacccugcccggccuguaccuggugagcgugggcguggugaagcccgccaucuggaucuucggcuggagcgagcacguggugugcagcaucggcaugcugagauucgugaaccugcuguucagcgugggcaacuucuaccugcuguaccugcuguuccacaaggugcagcccagaaacaaggccgccagcagcauccagagagugcugagcacccugacccuggccguguuccccacccuguacuucuucaacuuccuguacuacaccgaggccggcagcauguucuucacccuguucgccuaccugaugugccuguacggcaaccacaagaccagcgccuuccugggcuucugcggcuucauguucagacagaccaacaucaucugggccguguucugcgccggcaacgugaucgcccagaagcugaccgaggccuggaagaccgagcugcagaagaaggaggacagacugccccccaucaagggccccuucgccgaguucagaaagauccugcaguuccugcuggccuacagcaugagcuucaagaaccugagcaugcuguucugccugaccuggcccuacauccugcugggcuuccuguucugcgccuucgugguggugaacggcggcaucgugaucggcgacagaagcagccacgaggccugccugcacuucccccagcuguucuacuucuucagcuucacccuguucuucagcuucccccaccugcugagccccagcaagaucaagaccuuccugagccugguguggaagcacggcauccuguuccugguggugacccuggugagcguguuccugguguggaaguucaccuacgcccacaaguaccugcuggccgacaacagacacuacaccuucuacguguggaagagaguguuccagagauacgccauccugaaguaccugcuggugcccgccuacaucuucgccggcuggagcaucgccgacagccugaagagcaagcccaucuucuggaaccugauguucuucaucugccuguucaucgugaucgugccccagaagcugcuggaguucagauacuucauccugcccuacgugaucuacagacugaacaucacccugccccccaccagcagacuggugugcgagcugagcugcuacgccaucgugaacuucaucaccuucuacaucuuccugaacaagaccuuccaguggcccaacagccaggacauccagagauucaugugguaa

SEQ ID NO: 13503 - RNA, 1422 nt, Artificial Sequence
  ALG10__Homo_sapiens__NP_116223
auggcccagcuggagggcuacuacuucagcgccgcccugagcugcaccuuccuggugagcugccugcuguucagcgccuucagcagagcccugagagagcccuacauggacgagaucuuccaccugccccaggcccagagauacugcgagggccacuucagccugagccagugggaccccaugaucaccacccugcccggccuguaccuggugagcaucggcgugaucaagcccgccaucuggaucuucggcuggagcgagcacguggugugcagcaucggcaugcugagauucgugaaccugcuguucagcgugggcaacuucuaccugcuguaccugcuguucugcaaggugcagcccagaaacaaggccgccagcagcauccagagagugcugagcacccugacccuggccguguuccccacccuguacuucuucaacuuccuguacuacaccgaggccggcagcauguucuucacccuguucgccuaccugaugugccuguacggcaaccacaagaccagcgccuuccugggcuucugcggcuucauguucagacagaccaacaucaucugggccguguucugcgccggcaacgugaucgcccagaagcugaccgaggccuggaagaccgagcugcagaagaaggaggacagacugccccccaucaagggccccuucgccgaguucagaaagauccugcaguuccugcuggccuacagcaugagcuucaagaaccugagcaugcugcugcugcugaccuggcccuacauccugcugggcuuccuguucugcgccuucgugguggugaacggcggcaucgugaucggcgacagaagcagccacgaggccugccugcacuucccccagcuguucuacuucuucagcuucacccuguucuucagcuucccccaccugcugagccccagcaagaucaagaccuuccugagccugguguggaagagaagaauccuguucuucguggugacccuggugagcguguuccugguguggaaguucaccuacgcccacaaguaccugcuggccgacaacagacacuacaccuucuacguguggaagagaguguuccagagauacgagaccgugaaguaccugcuggugcccgccuacaucuucgccggcuggagcaucgccgacagccugaagagcaagagcaucuucuggaaccugauguucuucaucugccuguucaccgugaucgugccccagaagcugcuggaguucagauacuucauccugcccuacgugaucuacagacugaacaucccccugccccccaccagcagacugaucugcgagcugagcugcuacgccguggugaacuucaucaccuucuucaucuuccugaacaagaccuuccaguggcccaacagccaggacauccagagauucaugugguaa

SEQ ID NO: 13504 - RNA, 1479 nt, Artificial Sequence
  ALG11__Homo_sapiens__NP_001004127
auggccgccggcgagagaagcuggugccugugcaagcugcugagauucuucuacagccuguucuuccccggccugaucgugugcggcacccugugcgugugccuggugaucgugcuguggggcaucagacugcugcugcagagaaagaagaagcuggugagcaccagcaagaacggcaagaaccagauggugaucgccuucuuccaccccuacugcaacgccggcggcggcggcgagagagugcuguggugcgcccugagagcccugcagaagaaguaccccgaggccguguacgugguguacaccggcgacgugaacgugaacggccagcagauccuggagggcgccuucagaagauucaacaucagacugauccaccccgugcaguucguguuccugagaaagagauaccugguggaggacagccuguacccccacuucacccugcugggccagagccugggcagcaucuuccugggcugggaggcccugaugcagugcgugcccgacguguacaucgacagcaugggcuacgccuucacccugccccuguucaaguacaucggcggcugccaggugggcagcuacgugcacuaccccaccaucagcaccgacaugcugagcguggugaagaaccagaacaucggcuucaacaacgccgccuucaucaccagaaaccccuuccugagcaaggugaagcugaucuacuacuaccuguucgccuucaucuacggccuggugggcagcugcagcgacguggugauggugaacagcagcuggacccugaaccacauccugagccuguggaaggugggcaacugcaccaacaucguguacccccccugcgacgugcagaccuuccuggacaucccccugcacgagaagaagaugacccccggccaccugcuggugagcgugggccaguucagacccgagaagaaccacccccugcagaucagagccuucgccaagcugcugaacaagaagaugguggagagcccccccagccugaagcuggugcugaucggcggcugcagaaacaaggacgacgagcugagagugaaccagcugagaagacugagcgaggaccugggcgugcaggaguacguggaguucaagaucaacauccccuucgacgagcugaagaacuaccugagcgaggccaccaucggccugcacaccauguggaacgagcacuucggcaucggcgugguggagugcauggccgccggcaccaucauccuggcccacaacagcggcggccccaagcuggacaucguggugccccacgagggcgacaucaccggcuuccuggccgagagcgaggaggacuacgccgagaccaucgcccacauccugagcaugagcgccgagaagagacugcagaucagaaagagcgccagagccagcgugagcagauucagcgaccaggaguucgaggugaccuuccugagcagcguggagaagcuguucaaguaa

SEQ ID NO: 13505 - RNA, 1467 nt, Artificial Sequence
  ALG12__Homo_sapiens__NP_077010
auggccggcaagggcagcagcggcagaagaccccugcugcugggccugcugguggccguggccaccgugcaccuggugaucugccccuacaccaagguggaggagagcuucaaccugcaggccacccacgaccugcuguaccacuggcaggaccuggagcaguacgaccaccuggaguuccccggcguggugcccagaaccuuccugggccccguggugaucgccguguucagcagccccgccguguacgugcugagccugcuggagaugagcaaguucuacagccagcugaucgugagaggcgugcugggccugggcgugaucuucggccuguggacccugcagaaggaggugagaagacacuucggcgccaugguggccaccauguucugcugggugaccgccaugcaguuccaccugauguucuacugcaccagaacccugcccaacgugcuggcccugcccguggugcugcuggcccuggccgccuggcugagacacgagugggccagauucaucuggcugagcgccuucgccaucaucguguucagaguggagcugugccuguuccugggccugcugcugcugcuggcccugggcaacagaaaggugagcguggugagagcccugagacacgccgugcccgccggcauccugugccugggccugaccguggccguggacagcuacuucuggagacagcugaccuggcccgagggcaaggugcugugguacaacaccgugcugaacaagagcagcaacuggggcaccagcccccugcugugguacuucuacagcgcccugcccagaggccugggcugcagccugcuguucaucccccugggccugguggacagaagaacccacgcccccaccgugcuggcccugggcuucauggcccuguacagccugcugccccacaaggagcugagauucaucaucuacgccuuccccaugcugaacaucaccgccgccagaggcugcagcuaccugcugaacaacuacaagaagagcuggcuguacaaggccggcagccugcuggugaucggccaccugguggugaacgccgccuacagcgccaccgcccuguacgugagccacuucaacuaccccggcggcguggccaugcagagacugcaccagcuggugcccccccagaccgacgugcugcugcacaucgacguggccgccgcccagaccggcgugagcagauuccugcaggugaacagcgccuggagauacgacaagagagaggacgugcagcccggcaccggcaugcuggccuacacccacauccugauggaggccgcccccggccugcuggcccuguacagagacacccacagagugcuggccagcguggugggcaccaccggcgugagccugaaccugacccagcugccccccuucaacgugcaccugcagaccaagcuggugcugcuggagagacugcccagacccagcuaa

SEQ ID NO: 13506 - RNA, 3414 nt, Artificial Sequence
  ALG13__Homo_sapiens__NP_001093392
augaagugcguguucgugaccgugggcaccaccagcuucgacgaccugaucgccugcgugagcgcccccgacagccugcagaagaucgagagccugggcuacaacagacugauccugcagaucggcagaggcaccguggugcccgagcccuucagcaccgagagcuucacccuggacguguacagauacaaggacagccugaaggaggacauccagaaggccgaccuggugaucagccacgccggcgccggcagcugccuggagacccuggagaagggcaagccccuggugguggugaucaacgagaagcugaugaacaaccaccagcuggagcuggccaagcagcugcacaaggagggccaccuguucuacugcaccugcagagugcugaccugccccggccaggccaagagcaucgccagcgcccccggcaagugccaggacagcgccgcccugaccagcaccgccuucagcggccuggacuucggccugcugagcggcuaccugcacaagcaggcccuggugaccgccacccaccccaccugcacccugcuguuccccagcugccacgccuucuucccccugccccugacccccacccuguacaagaugcacaagggcuggaagaacuacugcagccagaagagccugaacgaggccagcauggacgaguaccugggcagccugggccuguucagaaagcugaccgccaaggacgccagcugccuguucagagccaucagcgagcagcuguucugcagccaggugcaccaccuggagaucagaaaggccugcgugagcuacaugagagagaaccagcagaccuucgagagcuacguggagggcagcuucgagaaguaccuggagagacugggcgaccccaaggagagcgccggccagcuggagaucagagcccugagccugaucuacaacagagacuucauccuguacagauuccccggcaagccccccaccuacgugaccgacaacggcuacgaggacaagauccugcugugcuacagcagcagcggccacuacgacagcguguacagcaagcaguuccagagcagcgccgccgugugccaggccgugcuguacgagauccuguacaaggacguguucgugguggacgaggaggagcugaagaccgccaucaagcuguucagaagcggcagcaagaagaacagaaacaacgccgugaccggcagcgaggacgcccacaccgacuacaagagcagcaaccagaacagaauggaggaguggggcgccugcuacaacgccgagaacauccccgagggcuacaacaagggcaccgaggagaccaagagccccgagaaccccagcaagaugcccuuccccuacaaggugcugaaggcccuggaccccgagaucuacagaaacguggaguucgacguguggcuggacagcagaaaggagcugcagaagagcgacuacauggaguacgccggcagacaguacuaccugggcgacaagugccaggugugccuggagagcgagggcagauacuacaacgcccacauccaggaggugggcaacgagaacaacagcgugaccguguucaucgaggagcuggccgagaagcacguggugccccuggccaaccugaagcccgugacccaggugaugagcgugcccgccuggaacgccaugcccagcagaaagggcagaggcuaccagaagaugcccggcggcuacgugcccgagaucgugaucagcgagauggacaucaagcagcagaagaagauguucaagaagaucagaggcaaggagguguacaugaccauggccuacggcaagggcgacccccugcugccccccagacugcagcacagcaugcacuacggccacgacccccccaugcacuacagccagaccgccggcaacgugaugagcaacgagcacuuccacccccagcaccccagccccagacagggcagaggcuacggcaugcccagaaacagcagcagauucaucaacagacacaacaugcccggccccaagguggacuucuaccccggccccggcaagagaugcugccagagcuacgacaacuucagcuacagaagcagaagcuucagaagaagccacagacagaugagcugcgugaacaaggagagccaguacggcuucacccccggcaacggccagaugcccagaggccuggaggagaccaucaccuucuacgagguggaggagggcgacgagaccgccuaccccacccugcccaaccacggcggccccagcaccauggugcccgccaccagcggcuacugcgugggcagaagaggccacagcagcggcaagcagacccugaaccuggaggagggcaacggccagagcgagaacggcagauaccacgaggaguaccuguacagagccgagcccgacuacgagaccagcggcguguacagcaccaccgccagcaccgccaaccugagccugcaggacagaaagagcugcagcaugagcccccaggacaccgugaccagcuacaacuacccccagaagaugaugggcaacaucgccgccguggccgccagcugcgccaacaacgugcccgcccccgugcugagcaacggcgccgccgccaaccaggccaucagcaccaccagcgugagcagccagaacgccauccagccccuguucgugagcccccccacccacggcagacccgugaucgccagccccagcuaccccugccacagcgccaucccccacgccggcgccagccugcccccccccccccccccccccccccccccccccccccccccccccccccccccccccccccccccccccccccccccccccgcccuggacgugggcgagaccagcaaccugcagcccccccccccccugccccccccccccuacagcugcgaccccagcggcagcgaccugccccaggacaccaaggugcugcaguacuacuucaaccugggccugcagugcuacuaccacagcuacuggcacagcaugguguacgugccccagaugcagcagcagcugcacguggagaacuaccccguguacaccgagcccccccugguggaccagaccgugccccagugcuacagcgaggugagaagagaggacggcauccaggccgaggccagcgccaacgacaccuuccccaacgccgacagcagcagcgugccccacggcgccguguacuaccccgugaugagcgaccccuacggccagcccccccugcccggcuucgacagcugccugcccguggugcccgacuacagcugcgugccccccuggcaccccgugggcaccgccuacggcggcagcagccagauccacggcgccaucaaccccggccccaucggcugcaucgcccccagcccccccgccagccacuacgugccccagggcauguaa

SEQ ID NO: 13507 - RNA, 1395 nt, Artificial Sequence
  ALG1__Homo_sapiens__NP_061982
auggccgccagcugccuggugcugcuggcccugugccugcugcugccccugcugcugcugggcggcuggaagagauggagaagaggcagagccgccagacacgugguggccguggugcugggcgacgugggcagaagccccagaaugcaguaccacgcccugagccuggccaugcacggcuucagcgugacccugcugggcuucugcaacagcaagccccacgacgagcugcugcagaacaacagaauccagaucgugggccugaccgagcugcagagccuggccgugggccccagaguguuccaguacggcgugaagguggugcugcaggccauguaccugcuguggaagcugauguggagagagcccggcgccuacaucuuccugcagaacccccccggccugcccagcaucgccgugugcugguucgugggcugccugugcggcagcaagcuggugaucgacuggcacaacuacggcuacagcaucaugggccuggugcacggccccaaccacccccuggugcugcuggccaagugguacgagaaguucuucggcagacugagccaccugaaccugugcgugaccaacgccaugagagaggaccuggccgacaacuggcacaucagagccgugaccguguacgacaagcccgccagcuucuucaaggagaccccccuggaccugcagcacagacuguucaugaagcugggcagcaugcacagccccuucagagccagaagcgagcccgaggaccccgugaccgagagaagcgccuucaccgagagagacgccggcagcggccuggugaccagacugagagagagacccgcccugcuggugagcagcaccagcuggaccgaggacgaggacuucagcauccugcuggccgcccuggagaaguucgagcagcugacccuggacggccacaaccugcccagccuggugugcgugaucaccggcaagggcccccugagagaguacuacagcagacugauccaccagaagcacuuccagcacauccaggugugcacccccuggcuggaggccgaggacuacccccugcugcugggcagcgccgaccugggcgugugccugcacaccagcagcagcggccuggaccugcccaugaaggugguggacauguucggcugcugccugcccgugugcgccgugaacuucaagugccugcacgagcuggugaagcacgaggagaacggccugguguucgaggacagcgaggagcuggccgcccagcugcagaugcuguucagcaacuuccccgaccccgccggcaagcugaaccaguucagaaagaaccugagagagagccagcagcugagaugggacgagagcugggugcagaccgugcugccccuggugauggacaccuaa

SEQ ID NO: 13508 - RNA, 564 nt, Artificial Sequence
  ALG1L__Homo_sapiens__NP_001015050
auggagagaagcgccuucauggagcuggacgccggcagcagacuggugaugcaccugagagaguggcccgcccugcuggugagcagcaccggcuggaccgaguucgagcagcugacccuggacggccacaaccugcccagccuggugugcgugaucaccggcagcguggaccugggcgugugccugcacaugagcagcagcggccuggaccugcccaugaaggugguggacauguucggcugcugccugcccgugugcgccgugaacuucaagugccugcacgagcuggugaagcacgaggagaacggccugguguucgaggacagcgaggagcuggccgcccugcagaugcuguucagcaacuuccccgaccccgccggcaagcugaaccaguucuggaagaaccugagagagagccagcagcugagaugggacgagagcugggugcagaccgugcugccccuggugauggacauccagcugcugggccagagacugaagcccagagaccccugcugccccagcagaagcuucuucagcgagagccagggcaagcccuucuaa

SEQ ID NO: 13509 - RNA, 1251 nt, Artificial Sequence
  ALG2__Homo_sapiens__NP_149078
auggccgaggagcagggcagagagagagacagcgugcccaagcccagcgugcuguuccugcaccccgaccugggcgugggcggcgccgagagacuggugcuggacgccgcccuggcccugcaggccagaggcugcagcgugaagaucuggaccgcccacuacgaccccggccacugcuucgccgagagcagagagcugcccgugagaugcgccggcgacuggcugcccagaggccugggcuggggcggcagaggcgccgccgugugcgccuacgugagaaugguguuccuggcccuguacgugcuguuccuggccgacgaggaguucgacgugguggugugcgaccaggugagcgccugcauccccguguucagacuggccagaagaagaaagaagauccuguucuacugccacuuccccgaccugcugcugaccaagagagacagcuuccugaagagacuguacagagcccccaucgacuggaucgaggaguacaccaccggcauggccgacugcauccuggugaacagccaguucaccgccgccguguucaaggagaccuucaagagccugagccacaucgaccccgacgugcuguaccccagccugaacgugaccagcuucgacagcguggugcccgagaagcuggacgaccuggugcccaagggcaagaaguuccugcugcugagcaucaacagauacgagagaaagaagaaccugacccuggcccuggaggcccuggugcagcugagaggcagacugaccagccaggacugggagagagugcaccugaucguggccggcggcuacgacgagagagugcuggagaacguggagcacuaccaggagcugaagaagauggugcagcagagcgaccugggccaguacgugaccuuccugagaagcuucagcgacaagcagaagaucagccugcugcacagcugcaccugcgugcuguacacccccagcaacgagcacuucggcaucgugccccuggaggccauguacaugcagugccccgugaucgccgugaacagcggcggcccccuggagagcaucgaccacagcgugaccggcuuccugugcgagcccgaccccgugcacuucagcgaggccaucgagaaguucaucagagagcccagccugaaggccaccaugggccuggccggcagagccagagugaaggagaaguucagccccgaggccuucaccgagcagcuguacagauacgugaccaagcugcugguguaa

SEQ ID NO: 13510 - RNA, 1173 nt, Artificial Sequence
  ALG3__Homo_sapiens__NP_001006942
auguuccccgcccaggccaaggagaacgccggcuucagcggcugcggcggcgacaccgagaucgacuggaaggccuacauggccgagguggagggcgugaucaacggcaccuacgacuacacccagcugcagggcgacaccggcccccugguguaccccgccggcuucguguacaucuucaugggccuguacuacgccaccagcagaggcaccgacaucagaauggcccagaacaucuucgccgugcuguaccuggccacccugcugcugguguuccugaucuaccaccagaccugcaaggugccccccuucguguucuucuucaugugcugcgccagcuacagagugcacagcaucuucgugcugagacuguucaacgaccccguggccauggugcugcuguuccugagcaucaaccugcugcuggcccagagauggggcuggggcugcugcuucuucagccuggccgugagcgugaagaugaacgugcugcuguucgcccccggccugcuguuccugcugcugacccaguucggcuucagaggcgcccugcccaagcugggcaucugcgccggccugcagguggugcugggccugcccuuccugcuggagaaccccagcggcuaccugagcagaagcuucgaccugggcagacaguuccuguuccacuggaccgugaacuggagauuccugcccgaggcccuguuccugcacagagccuuccaccuggcccugcugaccgcccaccugacccugcugcugcuguucgcccugugcagauggcacagaaccggcgagagcauccugagccugcugagagaccccagcaagagaaaggugcccccccagccccugacccccaaccagaucgugagcacccuguucaccagcaacuucaucggcaucugcuucagcagaagccugcacuaccaguucuacgugugguacuuccacacccugcccuaccugcugugggccaugcccgccagauggcugacccaccugcugagacugcuggugcugggccugaucgagcugagcuggaacaccuaccccagcaccagcugcagcagcgccgcccugcacaucugccacgccgugauccugcugcagcuguggcugggcccccagcccuuccccaagagcacccagcacagcaagaaggcccacuaa

SEQ ID NO: 13511 - RNA, 1404 nt, Artificial Sequence
  ALG8__Homo_sapiens__NP_001007028
auggccgcccugaccaucgccaccggcaccggcaacugguucagcgcccuggcccugggcgugacccugcugaagugccugcugauccccaccuaccacagcaccgacuucgaggugcacagaaacuggcuggccaucacccacagccugcccaucagccagugguacuacgaggccaccagcgaguggacccuggacuacccccccuucuucgccugguucgaguacauccugagccacguggccaaguacuucgaccaggagaugcugaacgugcacaaccugaacuacagcagcagcagaacccugcuguuccagagauucagcgugaucuucauggacgugcuguucguguacgccgugagagagugcugcaagugcaucgacggcaagaaggugggcaaggagcugaccgagaagcccaaguucauccugagcgugcugcugcuguggaacuucggccugcugaucguggaccacauccacuuccaguacaacggcuuccuguucggccugaugcugcugagcaucgccagacuguuccagaagagacacauggagggcgccuuccuguucgccgugcugcugcacuucaagcacaucuaccuguacguggcccccgccuacggcguguaccugcugagaagcuacugcuucaccgccaacaagcccgacggcagcaucagauggaagagcuucagcuucgugagagugaucagccugggccuggugguguuccuggugagcgcccugagccugggccccuuccuggcccugaaccagcugccccagguguucagcagacuguuccccuucaagagaggccugugccacgccuacugggcccccaacuucugggcccuguacaacgcccuggacaaggugcugagcgugaucggccugaagcugaaguuccuggaccccaacaacauccccaaggccagcaugaccagcggccuggugcagcaguuccagcacaccgugcugcccagcgugaccccccuggccacccugaucugcacccugaucgccauccugcccagcaucuucugccugugguucaagccccagggccccagaggcuuccugagaugccugacccugugcgcccugagcagcuucauguucggcuggcacgugcacgagaaggccauccugcuggccauccugcccaugagccugcugagcgugggcaaggccggcgacgccagcaucuuccugauccugaccaccaccggccacuacagccuguucccccugcuguucaccgcccccgagcugcccaucaagauccugcugaugcugcuguucaccaucuacagcaucagcagccugaagacccuguucagaagaagcuucacccugguggcccaggccggcgugcaguggcacgaccugagcuaa

SEQ ID NO: 13512 - RNA, 1836 nt, Artificial Sequence
  ALG9__Homo_sapiens__NP_001071158
auggccagcagaggcgccagacagagacugaagggcagcggcgccagcagcggcgacaccgcccccgccgccgacaagcugagagagcugcugggcagcagagaggccggcggcgccgagcacagaaccgagcugagcggcaacaaggccggccaggugugggcccccgagggcagcaccgccuucaagugccugcugagcgccagacugugcgccgcccugcugagcaacaucagcgacugcgacgagaccuucaacuacugggagcccacccacuaccugaucuacggcgagggcuuccagaccugggaguacagccccgccuacgccaucagaagcuacgccuaccugcugcugcacgccuggcccgccgccuuccacgccagaauccugcagaccaacaagauccugguguucuacuuccugagaugccugcuggccuucgugagcugcaucugcgagcuguacuucuacaaggccgugugcaagaaguucggccugcacgugagcagaaugaugcuggccuuccuggugcugagcaccggcauguucugcagcagcagcgccuuccugcccagcagcuucugcauguacaccacccugaucgccaugaccggcugguacauggacaagaccagcaucgccgugcugggcguggccgccggcgccauccugggcuggcccuucagcgccgcccugggccugcccaucgccuucgaccugcuggugaugaagcacagauggaagagcuucuuccacuggagccugauggcccugauccuguuccuggugcccgugguggugaucgacagcuacuacuacggcaagcuggugaucgccccccugaacaucgugcuguacaacguguucaccccccacggccccgaccuguacggcaccgagcccugguacuucuaccugaucaacggcuuccugaacuucaacguggccuucgcccuggcccugcuggugcugccccugaccagccugauggaguaccugcugcagagauuccacgugcagaaccugggccaccccuacuggcugacccuggcccccauguacaucugguucaucaucuucuucauccagccccacaaggaggagagauuccuguuccccguguacccccugaucugccugugcggcgccguggcccugagcgcccugcagaagugcuaccacuucguguuccagagauacagacuggagcacuacaccgugaccagcaacuggcuggcccugggcaccguguuccuguucggccugcugagcuucagcagaagcguggcccuguucagaggcuaccacggcccccuggaccuguaccccgaguucuacagaaucgccaccgaccccaccauccacaccgugcccgagggcagacccgugaacgugugcgugggcaaggagugguacagauuccccagcagcuuccugcugcccgacaacuggcagcugcaguucauccccagcgaguucagaggccagcugcccaagcccuucgccgagggcccccuggccaccagaaucgugcccaccgacaugaacgaccagaaccuggaggagcccagcagauacaucgacaucagcaagugccacuaccugguggaccuggacaccaugagagagacccccagagagcccaaguacagcagcaacaaggaggaguggaucagccuggccuacagacccuuccuggacgccagcagaagcagcaagcugcugagagccuucuacgugcccuuccugagcgaccaguacaccguguacgugaacuacaccauccugaagcccagaaaggccaagcagaucagaaagaagagcggcggcuaa

SEQ ID NO: 13513 - RNA, 1170 nt, Artificial Sequence
  ALKBH1__Homo_sapiens__NP_006011
augggcaagauggccgccgccgugggcagcguggccacccuggccaccgagcccggcgaggacgccuucagaaagcuguucagauucuacagacagagcagacccggcaccgccgaccuggagggcgugaucgacuucagcgccgcccacgccgccagaggcaagggccccggcgcccagaaggugaucaagagccagcugaacgugagcagcgugagcgagcagaacgccuacagagccggccugcagcccgugagcaaguggcaggccuacggccugaagggcuaccccggcuucaucuucauccccaaccccuuccugcccggcuaccaguggcacugggugaagcagugccugaagcuguacagccagaagcccaacgugugcaaccuggacaagcacaugagcaaggaggagacccaggaccugugggagcagagcaaggaguuccugagauacaaggaggccaccaagagaagacccagaagccugcuggagaagcugagaugggugaccgugggcuaccacuacaacugggacagcaagaaguacagcgccgaccacuacacccccuuccccagcgaccugggcuuccugagcgagcagguggccgccgccugcggcuucgaggacuucagagccgaggccggcauccugaacuacuacagacuggacagcacccugggcauccacguggacagaagcgagcuggaccacagcaagccccugcugagcuucagcuucggccagagcgccaucuuccugcugggcggccugcagagagacgaggcccccaccgccauguucaugcacagcggcgacaucaugaucaugagcggcuucagcagacugcugaaccacgccgugcccagagugcugcccaaccccgagggcgagggccugccccacugccuggaggccccccugcccgccgugcugcccagagacagcaugguggagcccugcagcauggaggacuggcaggugugcgccagcuaccugaagaccgccagagugaacaugaccgugagacaggugcuggccaccgaccagaacuucccccuggagcccaucgaggacgagaagagagacaucagcaccgagggcuucugccaccuggacgaccagaacagcgaggugaagagagccagaaucaaccccgacagcuaa

SEQ ID NO: 13514 - RNA, 786 nt, Artificial Sequence
  ALKBH2__Homo_sapiens__NP_001001655
auggacagauuccuggugaagggcgcccagggcggccugcugagaaagcaggaggagcaggagcccaccggcgaggagcccgccgugcugggcggcgacaaggagagcaccagaaagagacccagaagagaggcccccggcaacggcggccacagcgccggccccagcuggagacacaucagagccgagggccuggacugcagcuacaccgugcuguucggcaaggccgaggccgacgagaucuuccaggagcuggagaaggagguggaguacuucaccggcgcccuggccagagugcagguguucggcaaguggcacagcgugcccagaaagcaggccaccuacggcgacgccggccugaccuacaccuucagcggccugacccugagccccaagcccuggauccccgugcuggagagaaucagagaccacgugagcggcgugaccggccagaccuucaacuucgugcugaucaacagauacaaggacggcugcgaccacaucggcgagcacagagacgacgagagagagcuggcccccggcagccccaucgccagcgugagcuucggcgccugcagagacuucguguucagacacaaggacagcagaggcaagagccccagcagaagaguggccguggugagacugccccuggcccacggcagccugcugaugaugaaccaccccaccaacacccacugguaccacagccugcccgugagaaagaaggugcuggcccccagagugaaccugaccuucagaaagauccugcugaccaagaaguaa

SEQ ID NO: 13515 - RNA, 861 nt, Artificial Sequence
  ALKBH3__Homo_sapiens__NP_631917
auggaggagaagagaagaagagccagagugcagggcgccugggccgcccccgugaagagccaggccaucgcccagcccgccaccaccgccaagagccaccugcaccagaagcccggccagaccuggaagaacaaggagcaccaccugagcgacagagaguucguguucaaggagccccagcagguggugagaagagcccccgagcccagagugaucgacagagagggcguguacgagaucagccugagccccaccggcgugagcagagugugccuguaccccggcuucguggacgugaaggaggccgacuggauccuggagcagcugugccaggacgugcccuggaagcagagaaccggcaucagagaggacaucaccuaccagcagcccagacugaccgccugguacggcgagcugcccuacaccuacagcagaaucaccauggagcccaacccccacuggcaccccgugcugagaacccugaagaacagaaucgaggagaacaccggccacaccuucaacagccugcugugcaaccuguacagaaacgagaaggacagcguggacuggcacagcgacgacgagcccagccugggcagaugccccaucaucgccagccugagcuucggcgccaccagaaccuucgagaugagaaagaagcccccccccgaggagaacggcgacuacaccuacguggagagagugaagaucccccuggaccacggcacccugcugaucauggagggcgccacccaggccgacuggcagcacagagugcccaaggaguaccacagcagagagcccagagugaaccugaccuucagaaccguguaccccgaccccagaggcgcccccugguaa

SEQ ID NO: 13516 - RNA, 666 nt, Artificial Sequence
  ALKBH7__Homo_sapiens__NP_115682
auggccggcaccggccugcuggcccugagaacccugcccggccccagcugggugagaggcagcggccccagcgugcugagcagacugcaggacgccgccguggugagacccggcuuccugagcaccgccgaggaggagacccugagcagagagcuggagcccgagcugagaagaagaagauacgaguacgaccacugggacgccgccauccacggcuucagagagaccgagaagagcagauggagcgaggccagcagagccauccugcagagagugcaggccgccgccuucggccccggccagacccugcugagcagcgugcacgugcuggaccuggaggccagaggcuacaucaagccccacguggacagcaucaaguucugcggcgccaccaucgccggccugagccugcugagccccagcgugaugagacuggugcacacccaggagcccggcgaguggcuggagcugcugcuggagcccggcagccuguacauccugagaggcagcgccagauacgacuucagccacgagauccugagagacgaggagagcuucuucggcgagagaagaauccccagaggcagaagaaucagcgugaucugcagaagccugcccgagggcaugggccccggcgagagcggccagcccccccccgccugcuaa

SEQ ID NO: 13517 - RNA, 2004 nt, Artificial Sequence
  ALKBH8__Homo_sapiens__NP_001287939
auguucgccauggacagcaaccaccagagcaacuacaagcugagcaagaccgagaagaaguuccugagaaagcagaucaaggccaagcacacccugcugagacacgagggcaucgagaccgugagcuacgccacccagagccuggugguggccaacggcggccugggcaacggcgugagcagaaaccagcugcugcccgugcuggagaagugcggccugguggacgcccugcugaugccccccaacaagcccuacagcuucgccagauacagaaccaccgaggagagcaagagagccuacgugacccugaacggcaaggaggugguggacgaccugggccagaagaucacccuguaccugaacuucguggagaaggugcaguggaaggagcugagaccccaggcccugccccccggccugauggugguggaggagaucaucagcagcgaggaggagaagaugcugcuggagagcguggacuggaccgaggacaccgacaaccagaacagccagaagagccugaagcacagaagagugaagcacuucggcuacgaguuccacuacgagaacaacaacguggacaaggacaagccccugagcggcggccugcccgacaucugcgagagcuuccuggagaaguggcugagaaagggcuacaucaagcacaagcccgaccagaugaccaucaaccaguacgagcccggccagggcauccccgcccacaucgacacccacagcgccuucgaggacgagaucgugagccugagccugggcagcgagaucgugauggacuucaagcaccccgacggcaucgccgugcccgugaugcugcccagaagaagccugcuggugaugaccggcgagagcagauaccuguggacccacggcaucaccugcagaaaguucgacaccgugcaggccagcgagagccugaagagcggcaucaucaccagcgacgugggcgaccugacccugagcaagagaggccugagaaccagcuucaccuucagaaaggugagacagacccccugcaacugcagcuacccccuggugugcgacagccagagaaaggagaccccccccagcuuccccgagagcgacaaggaggccagcagacuggagcaggaguacgugcaccagguguacgaggagaucgccggccacuucagcagcaccagacacacccccuggccccacaucguggaguuccugaaggcccugcccagcggcagcaucguggccgacaucggcugcggcaacggcaaguaccugggcaucaacaaggagcuguacaugaucggcugcgacagaagccagaaccugguggacaucugcagagagagacaguuccaggccuucgugugcgacgcccuggccgugcccgugagaagcggcagcugcgacgccugcaucagcaucgccgugauccaccacuucgccaccgccgagagaagaguggccgcccugcaggagaucgugagacugcugagacccggcggcaaggcccugaucuacgugugggccauggagcaggaguacaacaagcagaagagcaaguaccugagaggcaacagaaacagccagggcaagaaggaggagaugaacagcgacaccagcgugcagagaagccugguggagcagaugagagacaugggcagcagagacagcgccagcagcgugcccagaaucaacgacagccaggagggcggcugcaacagcagacaggugagcaacagcaagcugcccgugcacgugaacagaaccagcuucuacagccaggacgugcuggugcccuggcaccugaagggcaaccccgacaagggcaagcccguggagcccuucggccccaucggcagccaggaccccagccccguguuccacagauacuaccacguguucagagagggcgagcuggagggcgccugcagaaccgugagcgacgugagaauccugcagagcuacuacgaccagggcaacuggugcgugauccugcagaaggccuaa

SEQ ID NO: 13518 - RNA, 4863 nt, Artificial Sequence
  ALK__Homo_sapiens__NP_004295
augggcgccaucggccugcuguggcugcugccccugcugcugagcaccgccgccgugggcagcggcaugggcaccggccagagagccggcagccccgccgccggccccccccugcagcccagagagccccugagcuacagcagacugcagagaaagagccuggccguggacuucguggugcccagccuguucagaguguacgccagagaccugcugcugccccccagcagcagcgagcugaaggccggcagacccgaggccagaggcagccuggcccuggacugcgccccccugcugagacugcugggccccgcccccggcgugagcuggaccgccggcagccccgcccccgccgaggccagaacccugagcagagugcugaagggcggcagcgugagaaagcugagaagagccaagcagcuggugcuggagcugggcgaggaggccauccuggagggcugcgugggcccccccggcgaggccgccgugggccugcugcaguucaaccugagcgagcuguucagcugguggaucagacagggcgagggcagacugagaaucagacugaugcccgagaagaaggccagcgaggugggcagagagggcagacugagcgccgccaucagagccagccagcccagacugcuguuccagaucuucggcaccggccacagcagccuggagagccccaccaacaugcccagccccagccccgacuacuucaccuggaaccugaccuggaucaugaaggacagcuuccccuuccugagccacagaagcagauacggccuggagugcagcuucgacuuccccugcgagcuggaguacagccccccccugcacgaccugagaaaccagagcuggagcuggagaagaauccccagcgaggaggccagccagauggaccugcuggacggccccggcgccgagagaagcaaggagaugcccagaggcagcuuccugcugcugaacaccagcgccgacagcaagcacaccauccugagccccuggaugagaagcagcagcgagcacugcacccuggccgugagcgugcacagacaccugcagcccagcggcagauacaucgcccagcugcugccccacaacgaggccgccagagagauccugcugaugcccacccccggcaagcacggcuggaccgugcugcagggcagaaucggcagacccgacaaccccuucagaguggcccuggaguacaucagcagcggcaacagaagccugagcgccguggacuucuucgcccugaagaacugcagcgagggcaccagccccggcagcaagauggcccugcagagcagcuucaccugcuggaacggcaccgugcugcagcugggccaggccugcgacuuccaccaggacugcgcccagggcgaggacgagagccagaugugcagaaagcugcccgugggcuucuacugcaacuucgaggacggcuucugcggcuggacccagggcacccugagcccccacaccccccaguggcaggugagaacccugaaggacgccagauuccaggaccaccaggaccacgcccugcugcugagcaccaccgacgugcccgccagcgagagcgccaccgugaccagcgccaccuuccccgcccccaucaagagcagccccugcgagcugagaaugagcuggcugaucagaggcgugcugagaggcaacgugagccuggugcugguggagaacaagaccggcaaggagcagggcagaaugguguggcacguggccgccuacgagggccugagccuguggcaguggauggugcugccccugcuggacgugagcgacagauucuggcugcagaugguggccugguggggccagggcagcagagccaucguggccuucgacaacaucagcaucagccuggacugcuaccugaccaucagcggcgaggacaagauccugcagaacaccgcccccaagagcagaaaccuguucgagagaaaccccaacaaggagcugaagcccggcgagaacagccccagacagacccccaucuucgaccccaccgugcacuggcuguucaccaccugcggcgccagcggcccccacggccccacccaggcccagugcaacaacgccuaccagaacagcaaccugagcguggaggugggcagcgagggcccccugaagggcauccagaucuggaaggugcccgccaccgacaccuacagcaucagcggcuacggcgccgccggcggcaagggcggcaagaacaccaugaugagaagccacggcgugagcgugcugggcaucuucaaccuggagaaggacgacaugcuguacauccuggugggccagcagggcgaggacgccugccccagcaccaaccagcugauccagaaggugugcaucggcgagaacaacgugaucgaggaggagaucagagugaacagaagcgugcacgagugggccggcggcggcggcggcggcggcggcgccaccuacguguucaagaugaaggacggcgugcccgugccccugaucaucgccgccggcggcggcggcagagccuacggcgccaagaccgacaccuuccaccccgagagacuggagaacaacagcagcgugcugggccugaacggcaacagcggcgccgccggcggcggcggcggcuggaacgacaacaccagccugcugugggccggcaagagccugcaggagggcgccaccggcggccacagcugcccccaggccaugaagaaguggggcugggagaccagaggcggcuucggcggcggcggcggcggcugcagcagcggcggcggcggcggcggcuacaucggcggcaacgccgccagcaacaacgaccccgagauggacggcgaggacggcgugagcuucaucagcccccugggcauccuguacacccccgcccugaaggugauggagggccacggcgaggugaacaucaagcacuaccugaacugcagccacugcgagguggacgagugccacauggaccccgagagccacaaggugaucugcuucugcgaccacggcaccgugcuggccgaggacggcgugagcugcaucgugagccccacccccgagccccaccugccccugagccugauccugagcguggugaccagcgcccugguggccgcccuggugcuggccuucagcggcaucaugaucguguacagaagaaagcaccaggagcugcaggccaugcagauggagcugcagagccccgaguacaagcugagcaagcugagaaccagcaccaucaugaccgacuacaaccccaacuacugcuucgccggcaagaccagcagcaucagcgaccugaaggaggugcccagaaagaacaucacccugaucagaggccugggccacggcgccuucggcgagguguacgagggccaggugagcggcaugcccaacgaccccagcccccugcagguggccgugaagacccugcccgaggugugcagcgagcaggacgagcuggacuuccugauggaggcccugaucaucagcaaguucaaccaccagaacaucgugagaugcaucggcgugagccugcagagccugcccagauucauccugcuggagcugauggccggcggcgaccugaagagcuuccugagagagaccagacccagacccagccagcccagcagccuggccaugcuggaccugcugcacguggccagagacaucgccugcggcugccaguaccuggaggagaaccacuucauccacagagacaucgccgccagaaacugccugcugaccugccccggccccggcagaguggccaagaucggcgacuucggcauggccagagacaucuacagagccagcuacuacagaaagggcggcugcgccaugcugcccgugaaguggaugccccccgaggccuucauggagggcaucuucaccagcaagaccgacaccuggagcuucggcgugcugcugugggagaucuucagccugggcuacaugcccuaccccagcaagagcaaccaggaggugcuggaguucgugaccagcggcggcagaauggacccccccaagaacugccccggccccguguacagaaucaugacccagugcuggcagcaccagcccgaggacagacccaacuucgccaucauccuggagagaaucgaguacugcacccaggaccccgacgugaucaacaccgcccugcccaucgaguacggcccccugguggaggaggaggagaaggugcccgugagacccaaggaccccgagggcgugcccccccugcuggugagccagcaggccaagagagaggaggagagaagccccgccgccccccccccccugcccaccaccagcagcggcaaggccgccaagaagcccaccgccgccgagaucagcgugagagugcccagaggccccgccguggagggcggccacgugaacauggccuucagccagagcaacccccccagcgagcugcacaaggugcacggcagcagaaacaagcccaccagccuguggaaccccaccuacggcagcugguucaccgagaagcccaccaagaagaacaaccccaucgccaagaaggagccccacgacagaggcaaccugggccuggagggcagcugcaccgugccccccaacguggccaccggcagacugcccggcgccagccugcugcuggagcccagcagccugaccgccaacaugaaggaggugccccuguucagacugagacacuuccccugcggcaacgugaacuacggcuaccagcagcagggccugccccuggaggccgccaccgcccccggcgccggccacuacgaggacaccauccugaagagcaagaacagcaugaaccagcccggccccuaa

SEQ ID NO: 13519 - RNA, 1176 nt, Artificial Sequence
  ALLC__Homo_sapiens__NP_060906
auggacauggccagcgagagcgugggcggcaagauccuguucgccaccgacgacuucuucgcccccgccgagaaccugaucaagagcgacagccccugcuucaaggagcacgaguacaccgaguucggcaaguggauggacggcugggagaccagaagaaagagaauccccggccacgacuggugcgugcugagacugggcauccagggcgugaucagaggcuucgacguggacgugagcuacuucaccggcgacuacgcccccagagugagcauccaggccgccaaccuggaggaggacaagcugcccgagauccccgagagaggcaccagaaccggcgccgccgccacccccgaggaguucgaggccaucgccgagcugaagagcgacgacuggagcuaccuggugcccaugaccgagcugaagcccggcaaccccgccagcggccacaacuacuuccuggugaacagccagcagagauggacccacaucagacugaacaucuuccccgacggcggcaucgccagacugagaguguucggcaccggccagaaggacuggaccgccaccgaccccaaggagcccgccgaccugguggccaucgccuucggcggcgugugcgugggcuucagcaacgccaaguucggccaccccaacaacaucaucggcgugggcggcgccaagagcauggccgacggcugggagaccgccagaagacuggacagaccccccauccuggagaacgacgagaacggcauccugcuggugcccggcugcgagugggccguguucagacuggcccaccccggcgugaucaccagaaucgagaucgacaccaaguacuucgagggcaacgcccccgacagcugcaagguggacggcugcauccugaccacccaggaggaggaggccgugaucagacagaaguggauccugcccgcccacaaguggaagccccugcugcccgugaccaagcugagccccaaccagagccaccuguucgacagccugacccuggagcugcaggacgugaucacccacgccagacugaccaucgugcccgacggcggcgugagcagacugagacugagaggcuuccccagcagcaucugccugcugagacccagagagaagcccaugcugaaguucagcgugagcuucaaggccaaccccuaa

SEQ ID NO: 13520 - RNA, 12510 nt, Artificial Sequence
  ALMS1__Homo_sapiens__NP_055935
auggagcccgaggaccugcccuggcccggcgagcuggaggaggaggaggaggaggaggaggaggaggaggaggaggaggaggaggaggccgccgccgccgccgccgccaacguggacgacgugguggugguggaggagguggaggaggaggccggcagagagcuggacagcgacagccacuacggcccccagcaccuggagagcaucgacgacgaggaggacgaggaggccaaggccuggcugcaggcccaccccggcagaauccugcccccccugagccccccccagcacagauacagcgagggcgagagaaccagccuggagaagaucgugccccugaccugccacguguggcagcagaucguguaccagggcaacagcagaacccagaucagcgacaccaacguggugugccuggagaccaccgcccagagaggcagcggcgacgaccagaagaccgagagcuggcacugccugccccaggagauggacagcagccagacccuggacaccagccagaccagauucaacgugagaaccgaggacaccgaggugaccgacuuccccagccuggaggagggcauccugacccagagcgagaaccaggugaaggagcccaacagagaccuguucugcagcccccugcuggugauccaggacagcuucgccagccccgaccugccccugcugaccugccugacccaggaccaggaguucgcccccgacagccuguuccaccagagcgagcugagcuucgccccccugagaggcauccccgacaagagcgaggacaccgaguggagcagcagacccagcgaggugagcgaggcccuguuccaggccaccgccgagguggccagcgaccuggccagcagcagauucagcgugagccagcacccccugaucggcagcaccgccgugggcagccagugccccuuccugcccagcgagcagggcaacaacgaggagaccaucagcagcguggacgagcugaagauccccaaggacugcgacagauacgacgaccugugcagcuacaugagcuggaagaccagaaaggacacccaguggcccgagaacaaccuggccgacaaggaccaggugagcguggccaccagcuucgacaucaccgacgagaacaucgccaccaagagaagcgaccacuucgacgccgccagaagcuacggccaguacuggacccaggaggacagcagcaagcaggccgagaccuaccugaccaagggccugcagggcaagguggagagcgacgugaucacccuggacggccugaacgagaacgccguggugugcagcgagagaguggccgagcugcagagaaagcccaccagagagagcgaguaccacagcagcgaccugagaaugcugagaaugagccccgacaccgugcccaaggcccccaagcaccugaaggccggcgacaccagcaagggcggcaucgccaaggugacccagagcaaccugaagagcggcaucaccaccacccccguggacagcgacaucggcagccaccugagccugagccuggaggaccugagccagcuggccgugagcagcccccuggagaccaccaccggccagcacaccgacacccugaaccagaagacccuggccgacacccaccugaccgaggagacccugaaggugaccgccauccccgagcccgccgaccagaagaccgccacccccaccgugcugagcagcagccacagccacagaggcaagcccagcaucuucuaccagcagggccugcccgacagccaccugaccgaggaggcccugaaggugagcgccgcccccggccuggccgaccagaccaccggcaugagcacccugaccagcaccagcuacagccacagagagaagcccggcaccuucuaccagcaggagcugcccgagagcaaccugaccgaggagccccuggaggugagcgccgcccccggccccguggagcagaagaccggcauccccaccgugagcagcaccagccacagccacguggaggaccugcuguucuucuacagacagacccugcccgacggccaccugaccgaccaggcccugaaggugagcgccgugagcggccccgccgaccagaagaccggcaccgccaccgugcugagcaccccccacagccacagagagaagcccggcaucuucuaccagcaggaguucgccgacagccaccagaccgaggagacccugaccaaggugagcgccacccccggccccgccgaccagaagaccgagauccccgccgugcagagcagcagcuacagccagagagagaagcccagcauccuguacccccaggaccuggccgacagccaccugcccgaggagggccugaaggugagcgccguggccggccccgccgaccagaagaccggccugcccaccgugcccagcagcgccuacagccacagagagaagcugcugguguucuaccagcaggcccugcuggacagccaccugcccgaggaggcccugaaggugagcgccgugagcggccccgccgacggcaagaccggcacccccgccgugaccagcaccagcagcgccagcagcagccugggcgagaagcccagcgccuucuaccagcagacccugcccaacagccaccugaccgaggaggcccugaaggugagcaucgugcccggccccggcgaccagaagaccggcauccccagcgcccccagcagcuucuacagccacagagagaagcccaucaucuucagccagcagacccugcccgacuuccuguuccccgaggaggcccugaaggugagcgccgugagcgugcuggccgcccagaagaccggcacccccaccgugagcagcaacagccacagccacagcgagaagagcagcguguucuaccagcaggagcugcccgacagcgaccugcccagagagagccugaagaugagcgccauccccggccugaccgaccagaagaccgugcccacccccaccgugcccagcggcagcuucagccacagagagaagcccagcaucuucuaccagcaggaguggcccgacagcuacgccaccgagaaggcccugaaggugagcaccggccccggccccgccgaccagaagaccgagauccccgccgugcagagcagcagcuacccccagagagagaagcccagcgugcuguacccccaggugcugagcgacagccaccugcccgaggagagccugaaggugagcgccuuccccggccccgccgaccagaugaccgacacccccgccgugcccagcaccuucuacagccagagagagaagcccggcaucuucuaccagcagacccugcccgagagccaccugcccaaggaggcccugaagaucagcguggcccccggccuggccgaccagaagaccggcacccccaccgugaccagcaccagcuacagccagcacagagagaagcccagcaucuuccaccagcaggcccugcccggcacccacauccccgaggaggcccagaaggugagcgccgugaccggccccggcaaccagaagaccuggauccccagagugcugagcaccuucuacagccagagagagaagcccggcaucuucuaccagcagacccugcccggcagccacauccccgaggaggcccagaaggugagccccgugcugggccccgccgaccagaagaccggcacccccacccccaccagcgccagcuacagccacaccgagaagcccggcaucuucuaccagcaggugcugcccgacaaccaccccaccgaggaggcccugaagaucagcguggccagcgagcccguggaccagaccaccggcacccccgccgugaccagcaccagcuacagccaguacagagagaagcccagcaucuucuaccagcagagccugcccagcagccaccugaccgaggaggccaagaacgugagcgccgugcccggccccgccgaccagaagaccgugauccccauccugcccagcaccuucuacagccacaccgagaagcccggcguguucuaccagcaggugcugccccacagccaccccaccgaggaggcccugaagaucagcguggccagcgagcccguggaccagaccaccggcacccccaccgugaccagcaccagcuacagccagcacaccgagaagcccagcaucuucuaccagcagagccugcccggcagccaccugaccgaggaggccaagaacgugagcgccgugcccggccccggcgacagaaagaccggcauccccacccugcccagcaccuucuacagccacaccgagaagcccggcagcuucuaccagcaggugcugccccacagccaccugcccgaggaggcccuggaggugagcguggcccccggccccguggaccagaccaucggcacccccaccgugaccagccccagcagcagcuucggcgagaagcccaucgugaucuacaagcaggccuuccccgagggccaccugcccgaggagagccugaaggugagcguggcccccggccccgugggccagaccaccggcgcccccaccaucaccagccccagcuacagccagcacagagccaagagcggcagcuucuaccagcuggcccugcugggcagccagauccccgaggaggcccugagagugagcagcgcccccggccccgccgaccagaccaccggcauccccaccaucaccagcaccagcuacagcuucggcgagaagcccaucgugaacuacaagcaggccuuccccgacggccaccugcccgaggaggcccugaaggugagcaucgugagcggccccaccgagaagaagaccgacauccccgccggcccccugggcagcagcgcccugggcgagaagcccaucaccuucuacagacaggcccugcuggacagcccccugaacaaggagguggugaaggugagcgccgcccccggccccgccgaccagaagaccgagacccugcccgugcacagcaccagcuacagcaacagaggcaagcccgugaucuucuaccagcagacccugagcgacagccaccugcccgaggaggcccugaaggugccccccgugcccggccccgacgcccagaagaccgagacccccagcgugagcagcagccuguacagcuacagagagaagcccaucguguucuaccagcaggcccugcccgacagcgagcugacccaggaggcccugaaggugagcgccgugccccagcccgccgaccagaagaccggccugagcaccgugaccagcagcuucuacagccacaccgagaagcccaacaucagcuaccagcaggagcugcccgacagccaccugaccgaggaggcccugaaggugagcaacgugcccggccccgccgaccagaagaccggcgugagcaccgugaccagcaccagcuacagccacagagagaagcccaucgugagcuaccagagagagcugccccacuucaccgaggccggccugaagauccugagagugcccggccccgccgaccagaagaccggcaucaacauccugcccagcaacagcuacccccagagagagcacagcgugaucagcuacgagcaggagcugcccgaccugaccgaggugacccugaaggccaucggcgugcccggccccgccgaccagaagaccggcauccagaucgccagcagcagcagcuacagcaacagagagaaggccagcaucuuccaccagcaggagcugcccgacgugaccgaggaggcccugaacguguucguggugcccggccagggcgacagaaagaccgagauccccaccgugccccugagcuacuacagcagaagagagaagcccagcgugaucagccagcaggagcugcccgacagccaccugaccgaggaggcccugaaggugagccccgugagcauccccgccgagcagaagaccggcauccccaucggccugagcagcagcuacagccacagccacaaggagaagcugaagaucagcaccgugcacauccccgacgaccagaagaccgaguuccccgccgccacccugagcagcuacagccagaucgagaagcccaagaucagcaccgugaucggccccaacgaccagaagacccccagccagaccgccuuccacagcagcuacagccagaccgugaagcccaacauccuguuccagcagcagcugcccgacagagaccagagcaagggcauccugaagaucagcgccgugcccgagcugaccgacgugaacaccggcaagcccgugagccugagcagcagcuacuuccacagagagaagagcaacaucuucagcccccaggagcugcccggcagccacgugaccgaggacgugcugaaggugagcaccauccccggccccgccggccagaagaccgugcugcccaccgcccugcccagcagcuucagccacagagagaagcccgacaucuucuaccagaaggaccugcccgacagacaccugaccgaggacgcccugaagaucagcagcgcccugggccaggccgaccagaucaccggccugcagaccgugcccagcggcaccuacagccacggcgagaaccacaagcuggugagcgagcacgugcagagacugaucgacaaccugaacagcagcgacagcagcgugagcagcaacaacgugcugcugaacagccaggccgacgacagaguggugaucaacaagcccgagagcgccggcuucagagacgugggcagcgaggagauccaggacgccgagaacagcgccaagacccugaaggagaucagaacccugcugauggaggccgagaacauggcccugaagagaugcaacuuccccgccccccuggccagauucagagacaucagcgacaucagcuucauccagagcaagaagguggugugcuucaaggagcccagcagcaccggcgugagcaacggcgaccugcugcacagacagcccuucaccgaggagagccccagcagcagaugcauccagaaggacaucggcacccagaccaaccugaagugcagaagaggcaucgagaacugggaguucaucagcagcaccaccgugagaagcccccugcaggaggccgagagcaaggugagcauggcccuggaggagacccugagacaguaccaggccgccaagagcgugaugagaagcgagcccgagggcugcagcggcaccaucggcaacaagaucaucauccccaugaugaccgugaucaagagcgacagcagcagcgacgccagcgacggcaacggcagcugcagcugggacagcaaccugcccgagagccuggagagcgugagcgacgugcugcugaacuucuuccccuacgugagccccaagaccagcaucaccgacagcagagaggaggagggcgugagcgagagcgaggacggcggcggcagcagcguggacagccuggccgcccacgugaagaaccugcugcagugcgagagcagccugaaccacgccaaggagauccugagaaacgccgaggaggaggagagcagagugagagcccacgccuggaacaugaaguucaaccuggcccacgacugcggcuacagcaucagcgagcugaacgaggacgacagaagaaagguggaggagaucaaggccgagcuguucggccacggcagaaccaccgaccugagcaagggccugcagagccccagaggcaugggcugcaagcccgaggccgugugcagccacaucaucaucgagagccacgagaagggcugcuucagaacccugaccagcgagcacccccagcuggacagacaccccugcgccuucagaagcgccggccccagcgagaugaccagaggcagacagaaccccagcagcugcagagccaagcacgugaaccugagcgccagccuggaccagaacaacagccacuucaagguguggaacagccugcagcugaagagccacagccccuuccagaacuucauccccgacgaguucaagaucagcaagggccugagaaugcccuucgacgagaagauggaccccuggcugagcgagcugguggagcccgccuucgugccccccaaggagguggacuuccacagcagcagccagaugcccagccccgagcccaugaagaaguucaccaccagcaucaccuucagcagccacagacacagcaagugcaucagcaacagcagcguggugaaggugggcgugaccgagggcagccagugcaccggcgccagcgugggcguguucaacagccacuucaccgaggagcagaacccccccagagaccugaagcagaagaccagcagccccagcagcuucaagaugcacagcaacagccaggacaaggaggugaccauccuggccgagggcagaagacagagccagaagcugcccguggacuucgagagaagcuuccaggaggagaagccccuggagagaagcgacuucaccggcagccacagcgagcccagcaccagagccaacugcagcaacuucaaggagauccagaucagcgacaaccacacccugaucagcaugggcagacccagcagcacccugggcgugaacagaagcagcagcagacugggcgugaaggagaagaacgugaccaucacccccgaccugcccagcugcaucuuccuggagcagagagagcuguucgagcagagcaaggcccccagagccgacgaccacgugagaaagcaccacagccccagcccccagcaccaggacuacguggcccccgaccugcccagcugcaucuuccuggagcagagagagcuguucgagcagugcaaggcccccuacguggaccaccagaugagagagaaccacagcccccugccccagggccaggacagcaucgccagcgaccugcccagccccaucagccuggagcagugccagagcaaggcccccggcguggacgaccagaugaacaagcaccacuucccccugccccagggccaggacugcgugguggagaagaacaaccagcacaagcccaagagccacaucagcaacaucaacguggaggccaaguucaacaccguggugagccagagcgcccccaaccacugcacccuggccgccagcgccagcaccccccccagcaacagaaaggcccugagcugcgugcacaucacccugugccccaagaccagcagcaagcuggacagcggcacccuggacgagagauuccacagccuggacgccgccagcaaggccagaaugaacagcgaguucaacuucgaccugcacaccgugagcagcagaagccuggagcccaccagcaagcugcugaccagcaagcccguggcccaggaccaggagagccugggcuuccugggccccaagagcagccuggacuuccagguggugcagcccagccugcccgacagcaacaccaucacccaggaccugaagaccauccccagccagaacagccagaucgugaccagcagacagauccaggugaacaucagcgacuucgagggccacagcaaccccgagggcacccccguguucgccgacagacugcccgagaagaugaagaccccccugagcgccuucagcgagaagcugagcagcgacgccgugacccagaucaccaccgagagccccgagaagacccuguucagcagcgagaucuucaucaacgccgaggacagaggccacgagaucaucgagcccggcaaccagaagcugagaaaggcccccgugaaguucgccagcagcagcagcgugcagcaggugaccuucagcagaggcaccgacggccagccccugcugcugcccuacaagcccagcggcagcaccaagauguacuacgugccccagcugagacagaucccccccagccccgacagcaagagcgacaccaccguggagagcagccacagcggcagcaacgacgccaucgcccccgacuuccccgcccaggugcugggcaccagagacgacgaccugagcgccaccgugaacaucaagcacaaggagggcaucuacagcaagagaguggugaccaaggccagccugcccgugggcgagaagccccugcagaacgagaacgccgacgccagcgugcaggugcugaucaccggcgacgagaaccugagcgacaagaagcagcaggagauccacagcaccagagccgugaccgaggccgcccaggccaaggagaaggagagccugcagaaggacaccgccgacagcagcgccgccgccgccgccgagcacagcgcccaggugggcgaccccgagaugaagaaccugcccgacaccaaggccaucacccagaaggaggagauccacagaaagaagaccgugcccgaggaggccuggcccaacaacaaggagagccugcagaucaacaucgaggagagcgagugccacagcgaguucgagaacaccaccagaagcguguucagaagcgccaaguucuacauccaccaccccgugcaccugcccagcgaccaggacaucugccacgagagccugggcaagagcguguucaugagacacagcuggaaggacuucuuccagcaccaccccgacaagcacagagagcacaugugccugccccugcccuaccagaacauggacaagaccaagaccgacuacaccagaaucaagagccugagcaucaacgugaaccugggcaacaaggaggugauggacaccaccaagagccaggugagagacuaccccaagcacaacggccagaucagcgacccccagagagaccagaaggugacccccgagcagaccacccagcacaccgugagccugaacgagcuguggaacaaguacagagagagacagagacagcagagacagcccgagcugggcgacagaaaggagcugagccugguggacagacuggacagacuggccaagauccugcagaaccccaucacccacagccugcaggugagcgagagcacccacgacgacagcagaggcgagagaagcgugaaggaguggagcggcagacagcagcagagaaacaagcugcagaagaagaagagauucaagagccuggagaagagccacaagaacaccggcgagcugaagaagagcaaggugcugagccaccacagagccggcagaagcaaccagaucaagaucgagcagaucaaguucgacaaguacauccugagcaagcagcccggcuucaacuacaucagcaacaccagcagcgacugcagacccagcgaggagagcgagcugcugaccgacaccaccaccaacauccugagcggcaccaccagcaccguggagagcgacauccugacccagaccgacagagagguggcccugcacgagagaagcagcagcgugagcaccaucgacaccgccagacugauccaggccuucggccacgagagagugugccugagccccagaagaaucaagcuguacagcagcaucaccaaccagcagagaagauaccuggagaagagaagcaagcacagcaagaaggugcugaacaccggccacccccuggugaccagcgagcacaccagaagaagacacauccagguggccaaccacgugaucagcagcgacagcaucagcagcagcgccagcagcuuccugagcagcaacagcaccuucugcaacaagcagaacgugcacaugcugaacaagggcauccaggccggcaaccuggagaucgugaacggcgccaagaagcacaccagagacgugggcaucaccuuccccacccccagcagcagcgaggccaagcuggaggagaacagcgacgugaccagcuggagcgaggagaagagagaggagaagaugcuguucaccggcuaccccgaggacagaaagcugaagaagaacaagaagaacagccacgagggcgugagcugguucgugcccguggagaacguggagagcagaagcaagaaggagaacgugcccaacaccugcggccccggcaucagcugguucgagcccaucaccaagaccagacccuggagagagccccugagagagcagaacugccagggccagcaccuggacggcagaggcuaccuggccggccccggcagagaggccggcagagaccugcugagacccuucgugagagccacccugcaggagagccugcaguuccacagacccgacuucaucagcagaagcggcgagagaaucaagagacugaagcugaucgugcaggagagaaagcugcagagcaugcugcagaccgagagagacgcccuguucaacaucgacagagagagacagggccaccagaacagaaugugcccccugcccaagagaguguuccuggccauccagaagaacaagcccaucagcaagaaggagaugauccagagaagcaagagaaucuacgagcagcugcccgaggugcagaagaagagagaggaggagaagagaaagagcgaguacaagagcuacagacugagagcccagcuguacaagaagagagugaccaaccagcugcugggcagaaaggugcccugggacuaa

SEQ ID NO: 13521 - RNA, 2106 nt, Artificial Sequence
  ALOX12B__Homo_sapiens__NP_001130
auggccaccuacaaggugagaguggccaccggcaccgaccugcugagcggcaccagagacagcaucagccugaccaucgugggcacccagggcgagagccacaagcagcugcugaaccacuucggcagagacuucgccaccggcgccgugggccaguacaccgugcagugcccccaggaccugggcgagcugaucaucaucagacugcacaaggagagauacgccuucuuccccaaggaccccugguacugcaacuacgugcagaucugcgcccccaacggcagaaucuaccacuuccccgccuaccaguggauggacggcuacgagacccuggcccugagagaggccaccggcaagaccaccgccgacgacagccugcccgugcugcuggagcacagaaaggaggagaucagagccaagcaggacuucuaccacuggagaguguuccugcccggccugcccagcuacgugcacauccccagcuacagaccccccgugagaagacacagaaaccccaacagacccgaguggaacggcuacauccccggcuuccccauccugaucaacuucaaggccaccaaguuccugaaccugaaccugagauacagcuuccugaagaccgccagcuucuucgugagacugggccccauggcccuggccuucaaggugagaggccugcuggacugcaagcacagcuggaagagacugaaggacaucagaaagaucuuccccggcaagaagagcguggugagcgaguacguggccgagcacugggccgaggacaccuucuucggcuaccaguaccugaacggcgugaaccccggccugaucagaagaugcaccagaauccccgacaaguuccccgugaccgacgacaugguggcccccuuccugggcgagggcaccugccugcaggccgagcuggagaagggcaacaucuaccuggccgacuacagaaucauggagggcauccccaccguggagcugagcggcagaaagcagcaccacugcgccccccugugccugcugcacuucggccccgagggcaagaugaugcccaucgccauccagcugagccagacccccggccccgacugccccaucuuccugcccagcgacagcgagugggacuggcugcuggccaagaccugggugagauacgccgaguucuacagccacgaggccaucgcccaccugcuggagacccaccugaucgccgaggccuucugccuggcccugcugagaaaccugcccaugugccacccccuguacaagcugcugaucccccacaccagauacaccgugcagaucaacagcaucggcagagccgugcugcugaacgagggcggccugagcgccaagggcaugagccugggcguggagggcuucgccggcgugauggugagagcccugagcgagcugaccuacgacagccuguaccugcccaacgacuucguggagagaggcgugcaggaccugcccggcuacuacuacagagacgacagccuggccguguggaacgcccuggagaaguacgugaccgagaucaucaccuacuacuaccccagcgacgccgccguggagggcgaccccgagcugcagagcugggugcaggagaucuucaaggagugccugcugggcagagagagcagcggcuuccccagaugccugagaaccgugcccgagcugaucagauacgugaccaucgugaucuacaccugcagcgccaagcacgccgccgugaacaccggccagauggaguucaccgccuggaugcccaacuuccccgccagcaugagaaacccccccauccagaccaagggccugaccacccuggagaccuucauggacacccugcccgacgugaagaccaccugcaucacccugcuggugcuguggacccugagcagagagcccgacgacagaagaccccugggccacuuccccgacauccacuucguggaggaggcccccagaagaagcaucgaggccuucagacagagacugaaccagaucagccacgacaucagacagagaaacaagugccugcccauccccuacuacuaccuggaccccgugcugaucgagaacagcaucagcaucuaa

SEQ ID NO: 13522 - RNA, 1992 nt, Artificial Sequence
  ALOX12__Homo_sapiens__NP_000688
augggcagauacagaaucagaguggccaccggcgccuggcuguucagcggcagcuacaacagagugcagcuguggcuggugggcaccagaggcgaggccgagcuggagcugcagcugagacccgccagaggcgaggaggaggaguucgaccacgacguggccgaggaccugggccugcugcaguucgugagacugagaaagcaccacuggcugguggacgacgccugguucugcgacagaaucaccgugcagggccccggcgccugcgccgagguggccuuccccugcuacagaugggugcagggcgaggacauccugagccugcccgagggcaccgccagacugcccggcgacaacgcccuggacauguuccagaagcacagagagaaggagcugaaggacagacagcagaucuacugcugggccaccuggaaggagggccugccccugaccaucgccgccgacagaaaggacgaccugccccccaacaugagauuccacgaggagaagagacuggacuucgaguggacccugaaggccggcgcccuggagauggcccugaagagaguguacacccugcugagcagcuggaacugccuggaggacuucgaccagaucuucuggggccagaagagcgcccuggccgagaaggugagacagugcuggcaggacgacgagcuguucagcuaccaguuccugaacggcgccaaccccaugcugcugagaagaagcaccagccugcccagcagacuggugcugcccagcggcauggaggagcugcaggcccagcuggagaaggagcugcagaacggcagccuguucgaggccgacuucauccugcuggacggcauccccgccaacgugaucagaggcgagaagcaguaccuggccgccccccuggugaugcugaagauggagcccaacggcaagcugcagcccauggugauccagauccagccccccaaccccagcagccccacccccacccuguuccugcccagcgaccccccccuggccuggcugcuggccaagagcugggugagaaacagcgacuuccagcugcacgagauccaguaccaccugcugaacacccaccugguggccgaggugaucgccguggccaccaugagaugccugcccggccugcaccccaucuucaaguuccugaucccccacaucagauacaccauggagaucaacaccagagccagaacccagcugaucagcgacggcggcaucuucgacaaggccgugagcaccggcggcggcggccacgugcagcugcugagaagagccgccgcccagcugaccuacugcagccugugcccccccgacgaccuggccgacagaggccugcugggccugcccggcgcccuguacgcccacgacgcccugagacugugggagaucaucgccagauacguggagggcaucgugcaccuguucuaccagagagacgacaucgugaagggcgaccccgagcugcaggccuggugcagagagaucaccgaggugggccugugccaggcccaggacagaggcuuccccgugagcuuccagagccagagccagcugugccacuuccugaccaugugcguguucaccugcaccgcccagcacgccgccaucaaccagggccagcuggacugguacgccugggugcccaacgcccccugcaccaugagaaugcccccccccaccaccaaggaggacgugaccauggccaccgugaugggcagccugcccgacgugagacaggccugccugcagauggccaucagcuggcaccugagcagaagacagcccgacauggugccccugggccaccacaaggagaaguacuucagcggccccaagcccaaggccgugcugaaccaguucagaaccgaccuggagaagcuggagaaggagaucaccgccagaaacgagcagcuggacuggcccuacgaguaccugaagcccagcugcaucgagaacagcgugaccaucuaa

SEQ ID NO: 13523 - RNA, 1944 nt, Artificial Sequence
  ALOX15B__Homo_sapiens__NP_001034219
auggccgaguucagagugagagugagcaccggcgaggccuucggcgccggcaccugggacaaggugagcgugagcaucgugggcaccagaggcgagagccccccccugccccuggacaaccugggcaaggaguucaccgccggcgccgaggaggacuuccaggugacccugcccgaggacgugggcagagugcugcugcugagagugcacaaggccccccccgugcugccccugcugggcccccuggcccccgacgccugguucugcagaugguuccagcugaccccccccagaggcggccaccugcuguuccccugcuaccaguggcuggagggcgccggcacccuggugcugcaggagggcaccgccaaggugagcugggccgaccaccaccccgugcugcagcagcagagacaggaggagcugcaggccagacaggagauguaccaguggaaggccuacaaccccggcuggccccacugccuggacgagaagaccguggaggaccuggagcugaacaucaaguacagcaccgccaagaacgccaacuucuaccugcaggccggcagcgccuucgccgagaugaagaucaagggccugcuggacagaaagggccuguggagaagccugaacgagaugaagagaaucuucaacuucagaagaacccccgccgccgagcacgccuucgagcacuggcaggaggacgccuucuucgccagccaguuccugaacggccugaaccccgugcugaucagaagaugccacuaccugcccaagaacuuccccgugaccgacgccaugguggccagcgugcugggccccggcaccagccugcaggccgagcuggagaagggcagccuguuccugguggaccacggcauccugagcggcauccagaccaacgugaucaacggcaagccccaguucagcgccgcccccaugacccugcuguaccagagccccggcugcggcccccugcugccccuggccauccagcugagccagacccccggccccaacagccccaucuuccugcccaccgacgacaagugggacuggcugcuggccaagaccugggugagaaacgccgaguucagcuuccacgaggcccugacccaccugcugcacagccaccugcugcccgagguguucacccuggccacccugagacagcugccccacugccacccccuguucaagagcaccggcaucggcaucgagggcuucagcgagcugauccagagaaacaugaagcagcugaacuacagccugcugugccugcccgaggacaucagaaccagaggcguggaggacauccccggcuacuacuacagagacgacggcaugcagaucuggggcgccguggagagauucgugagcgagaucaucggcaucuacuaccccagcgacgagagcgugcaggacgacagagagcugcaggccugggugagagagaucuucagcaagggcuuccugaaccaggagagcagcggcauccccagcagccuggagaccagagaggcccuggugcaguacgugaccauggugaucuucaccugcagcgccaagcacgccgccgugagcgccggccaguucgacagcugcgccuggaugcccaaccugccccccagcaugcagcugcccccccccaccagcaagggccuggccaccugcgagggcuucaucgccacccugccccccgugaacgccaccugcgacgugauccuggcccuguggcugcugagcaaggagcccggcgaccagagaccccugggcaccuaccccgacgagcacuucaccgaggaggcccccagaagaagcaucgccaccuuccagagcagacuggcccagaucagcagaggcauccaggagagaaaccagggccuggugcugcccuacaccuaccuggaccccccccugaucgagaacagcgugagcaucuaa

SEQ ID NO: 13524 - RNA, 1989 nt, Artificial Sequence
  ALOX15__Homo_sapiens__NP_001131
augggccuguacagaaucagagugagcaccggcgccagccuguacgccggcagcaacaaccaggugcagcuguggcuggugggccagcacggcgaggccgcccugggcaagagacuguggcccgccagaggcaaggagaccgagcugaagguggaggugcccgaguaccugggcccccugcuguucgugaagcugagaaagagacaccugcugaaggacgacgccugguucugcaacuggaucagcgugcagggccccggcgccggcgacgaggugagauuccccugcuacagauggguggagggcaacggcgugcugagccugcccgagggcaccggcagaaccgugggcgaggacccccagggccuguuccagaagcacagagaggaggagcuggaggagagaagaaagcuguacagauggggcaacuggaaggacggccugauccugaacauggccggcgccaagcuguacgaccugcccguggacgagagauuccuggaggacaagagaguggacuucgaggugagccuggccaagggccuggccgaccuggccaucaaggacagccugaacgugcugaccugcuggaaggaccuggacgacuucaacagaaucuucuggugcggccagagcaagcuggccgagagagugagagacagcuggaaggaggacgcccuguucggcuaccaguuccugaacggcgccaaccccguggugcugagaagaagcgcccaccugcccgccagacugguguucccccccggcauggaggagcugcaggcccagcuggagaaggagcuggagggcggcacccuguucgaggccgacuucagccugcuggacggcaucaaggccaacgugauccugugcagccagcagcaccuggccgccccccuggugaugcugaagcugcagcccgacggcaagcugcugcccauggugauccagcugcagcugcccagaaccggcagccccccccccccccuguuccugcccaccgacccccccauggccuggcugcuggccaagugcugggugagaagcagcgacuuccagcugcacgagcugcagagccaccugcugagaggccaccugauggccgaggugaucgugguggccaccaugagaugccugcccagcauccaccccaucuucaagcugaucaucccccaccugagauacacccuggagaucaacgugagagccagaaccggccuggugagcgacaugggcaucuucgaccagaucaugagcaccggcggcggcggccacgugcagcugcugaagcaggccggcgccuuccugaccuacagcagcuucugcccccccgacgaccuggccgacagaggccugcugggcgugaagagcagcuucuacgcccaggacgcccugagacugugggagaucaucuacagauacguggagggcaucgugagccugcacuacaagaccgacguggccgugaaggacgaccccgagcugcagaccuggugcagagagaucaccgagaucggccugcagggcgcccaggacagaggcuuccccgugagccugcaggccagagaccaggugugccacuucgugaccaugugcaucuucaccugcaccggccagcacgccagcgugcaccugggccagcuggacugguacagcugggugcccaacgcccccugcaccaugagacugcccccccccaccaccaaggacgccacccuggagaccgugauggccacccugcccaacuuccaccaggccagccugcagaugagcaucaccuggcagcugggcagaagacagcccgugaugguggccgugggccagcacgaggaggaguacuucagcggccccgagcccaaggccgugcugaagaaguucagagaggagcuggccgcccuggacaaggagaucgagaucagaaacgccaagcuggacaugcccuacgaguaccugagacccagcgugguggagaacagcguggccaucuaa

SEQ ID NO: 13525 - RNA, 657 nt, Artificial Sequence
  ALOX5AP__Homo_sapiens__NP_001191335
augcugaccuucaaccacgacgcccccuggcacacccagaagacccugaagaccagcgaguucggcaagagcuucggcacccugggccacaucggcaacaucagccaccagugcugggccggcugcgccgccggcggcagagccgugcugagcggcgagcccgaggccaacauggaccaggagaccgugggcaacguggugcugcuggccaucgugacccugaucagcguggugcagaacggcuucuucgcccacaagguggagcacgagagcagaacccagaacggcagaagcuuccagagaaccggcacccuggccuucgagagaguguacaccgccaaccagaacugcguggacgccuaccccaccuuccuggccgugcuguggagcgccggccugcugugcagccaggugcccgccgccuucgccggccugauguaccuguucgugagacagaaguacuucgugggcuaccugggcgagagaacccagagcacccccggcuacaucuucggcaagagaaucauccuguuccuguuccugaugagcguggccggcaucuucaacuacuaccugaucuucuucuucggcagcgacuucgagaacuacaucaagaccaucagcaccaccaucagcccccugcugcugauccccuaa

SEQ ID NO: 13526 - RNA, 2025 nt, Artificial Sequence
  ALOX5__Homo_sapiens__NP_000689
augcccagcuacaccgugaccguggccaccggcagccagugguucgccggcaccgacgacuacaucuaccugagccuggugggcagcgccggcugcagcgagaagcaccugcuggacaagcccuucuacaacgacuucgagagaggcgccguggacagcuacgacgugaccguggacgaggagcugggcgagauccagcuggugagaaucgagaagagaaaguacuggcugaacgacgacugguaccugaaguacaucacccugaagaccccccacggcgacuacaucgaguuccccugcuacagauggaucaccggcgacguggagguggugcugagagacggcagagccaagcuggccagagacgaccagauccacauccugaagcagcacagaagaaaggagcuggagaccagacagaagcaguacagauggauggaguggaaccccggcuucccccugagcaucgacgccaagugccacaaggaccugcccagagacauccaguucgacagcgagaagggcguggacuucgugcugaacuacagcaaggccauggagaaccuguucaucaacagauucaugcacauguuccagagcagcuggaacgacuucgccgacuucgagaagaucuucgugaagaucagcaacaccaucagcgagagagugaugaaccacuggcaggaggaccugauguucggcuaccaguuccugaacggcugcaaccccgugcugaucagaagaugcaccgagcugcccgagaagcugcccgugaccaccgagaugguggagugcagccuggagagacagcugagccuggagcaggaggugcagcagggcaacaucuucaucguggacuucgagcugcuggacggcaucgacgccaacaagaccgaccccugcacccugcaguuccuggccgcccccaucugccugcuguacaagaaccuggccaacaagaucgugcccaucgccauccagcugaaccagauccccggcgacgagaaccccaucuuccugcccagcgacgccaaguacgacuggcugcuggccaagaucugggugagaagcagcgacuuccacgugcaccagaccaucacccaccugcugagaacccaccuggugagcgagguguucggcaucgccauguacagacagcugcccgccgugcaccccaucuucaagcugcugguggcccacgugagauucaccaucgccaucaacaccaaggccagagagcagcugaucugcgagugcggccuguucgacaaggccaacgccaccggcggcggcggccacgugcagauggugcagagagccaugaaggaccugaccuacgccagccugugcuuccccgaggccaucaaggccagaggcauggagagcaaggaggacauccccuacuacuucuacagagacgacggccugcuggugugggaggccaucagaaccuucaccgccgaggugguggacaucuacuacgagggcgaccaggugguggaggaggaccccgagcugcaggacuucgugaacgacguguacguguacggcaugagaggcagaaagagcagcggcuuccccaagagcgugaagagcagagagcagcugagcgaguaccugaccguggugaucuucaccgccagcgcccagcacgccgccgugaacuucggccaguacgacuggugcagcuggauccccaacgccccccccaccaugagagcccccccccccaccgccaagggcguggugaccaucgagcagaucguggacacccugcccgacagaggcagaagcugcuggcaccugggcgccgugugggcccugagccaguuccaggagaacgagcuguuccugggcauguaccccgaggagcacuucaucgagaagcccgugaaggaggccauggccagauucagaaagaaccuggaggccaucgugagcgugaucgccgagagaaacaagaagaagcagcugcccuacuacuaccugagccccgacagaauccccaacagcguggccaucuaa

SEQ ID NO: 13527 - RNA, 2532 nt, Artificial Sequence
  ALOXE3__Homo_sapiens__NP_001159432
augcccagaggcgccuucagacccugccugcccgcccuguacuucgccuuccugaccugccccacccccgagcagagaaugagcggcacccaggcccccgacauccaccugggcgagcccgccagaggcaccggcugcgugagaggcaagcagaccagcaucagagugcaggacugcggcagaagagaggaggccagagccgccagcagagagcugagaagagagaaggcccaggagcaccccagagagagcugggcccacccccagcccuaccccgccccccagccccuggcccugagacccgagacccagcccugccccgccugcagaagcagcccccccggcagacugcugcugagacccgcccugcccggccaccccuuccugcugcccaucauggccguguacagacugugcgugaccaccggccccuaccugagagccggcacccuggacaacaucagcgugacccuggugggcaccugcggcgagagccccaagcagagacuggacagaaugggcagagacuucgcccccggcagcgugcagaaguacaaggugagaugcaccgccgagcugggcgagcugcugcugcugagagugcacaaggagagauacgccuucuucagaaaggacagcugguacugcagcagaaucugcgugaccgagcccgacggcagcgugagccacuuccccugcuaccaguggaucgagggcuacugcaccguggagcugagacccggcaccgccagaaccaucugccaggacagccugccccugcugcuggaccacagaaccagagagcugagagccagacaggagugcuacagauggaagaucuacgcccccggcuuccccugcaugguggacgugaacagcuuccaggagauggagagcgacaagaaguucgcccugaccaagaccaccaccugcguggaccagggcgacagcagcggcaacagauaccugcccggcuuccccaugaagaucgacauccccagccugauguacauggagcccaacgugagauacagcgccaccaagaccaucagccugcuguucaacgccauccccgccagccugggcaugaagcugagaggccugcuggacagaaagggcagcuggaagaagcuggacgacaugcagaacaucuucuggugccacaagaccuucaccaccaaguacgugaccgagcacuggugcgaggaccacuucuucggcuaccaguaccugaacggcgugaaccccgugaugcugcacugcaucagcagccugcccagcaagcugcccgugaccaacgacaugguggccccccugcugggccaggacaccugccugcagaccgagcuggagagaggcaacaucuuccuggccgacuacuggauccuggccgaggcccccacccacugccugaacggcagacagcaguacguggccgccccccugugccugcuguggcugagcccccagggcgcccuggugccccuggccauccagcugagccagacccccggccccgacagccccaucuuccugcccaccgacagcgagugggacuggcugcuggccaagaccugggugagaaacagcgaguuccuggugcacgagaacaacacccacuuccugugcacccaccugcugugcgaggccuucgccauggccacccugagacagcugccccugugccaccccaucuacaagcugcugcugccccacaccagauacacccugcaggugaacaccaucgccagagccacccugcugaaccccgagggccugguggaccaggugaccagcaucggcagacagggccugaucuaccugaugagcaccggccuggcccacuucaccuacaccaacuucugccugcccgacagccugagagccagaggcgugcuggccauccccaacuaccacuacagagacgacggccugaagaucugggccgccaucgagagcuucgugagcgagaucgugggcuacuacuaccccagcgacgccagcgugcagcaggacagcgagcugcaggccuggaccggcgagaucuucgcccaggccuuccugggcagagagagcagcggcuuccccagcagacugugcacccccggcgagauggugaaguuccugaccgccaucaucuucaacugcagcgcccagcacgccgccgugaacagcggccagcacgacuucggcgccuggaugcccaacgcccccagcagcaugagacagccccccccccagaccaagggcaccaccacccugaagaccuaccuggacacccugcccgaggugaacaucagcugcaacaaccugcugcuguucuggcuggugagccaggagcccaaggaccagagaccccugggcaccuaccccgacgagcacuucaccgaggaggcccccagaagaagcaucgccgccuuccagagcagacuggcccagaucagcagagacauccaggagagaaaccagggccuggcccugcccuacaccuaccuggaccccccccugaucgagaacagcgugagcaucuaa

SEQ ID NO: 13528 - RNA, 1587 nt, Artificial Sequence
  ALPI__Homo_sapiens__NP_001622
augcagggccccugggugcugcugcugcugggccugagacugcagcugagccugggcgugauccccgccgaggaggagaaccccgccuucuggaacagacaggccgccgaggcccuggacgccgccaagaagcugcagcccauccagaagguggccaagaaccugauccuguuccugggcgacggccugggcgugcccaccgugaccgccaccagaauccugaagggccagaagaacggcaagcugggccccgagaccccccuggccauggacagauuccccuaccuggcccugagcaagaccuacaacguggacagacaggugcccgacagcgccgccaccgccaccgccuaccugugcggcgugaaggccaacuuccagaccaucggccugagcgccgccgccagauucaaccagugcaacaccaccagaggcaacgaggugaucagcgugaugaacagagccaagcaggccggcaagagcgugggcguggugaccaccaccagagugcagcacgccagccccgccggcaccuacgcccacaccgugaacagaaacugguacagcgacgccgacaugcccgccagcgccagacaggagggcugccaggacaucgccacccagcugaucagcaacauggacaucgacgugauccugggcggcggcagaaaguacauguuccccaugggcacccccgaccccgaguaccccgccgacgccagccagaacggcaucagacuggacggcaagaaccuggugcaggaguggcuggccaagcaccagggcgccugguacguguggaacagaaccgagcugaugcaggccagccuggaccagagcgugacccaccugaugggccuguucgagcccggcgacaccaaguacgagauccacagagaccccacccuggaccccagccugauggagaugaccgaggccgcccugagacugcugagcagaaaccccagaggcuucuaccuguucguggagggcggcagaaucgaccacggccaccacgagggcguggccuaccaggcccugaccgaggccgugauguucgacgacgccaucgagagagccggccagcugaccagcgaggaggacacccugacccuggugaccgccgaccacagccacguguucagcuucggcggcuacacccugagaggcagcagcaucuucggccuggcccccagcaaggcccaggacagcaaggccuacaccagcauccuguacggcaacggccccggcuacguguucaacagcggcgugagacccgacgugaacgagagcgagagcggcagccccgacuaccagcagcaggccgccgugccccugagcagcgagacccacggcggcgaggacguggccguguucgccagaggcccccaggcccaccuggugcacggcgugcaggagcagagcuucguggcccacgugauggccuucgccgccugccuggagcccuacaccgccugcgaccuggccccccccgccugcaccaccgacgccgcccaccccguggccgccagccugccccugcuggccggcacccugcugcugcugggcgccagcgccgcccccuaa

SEQ ID NO: 13529 - RNA, 3735 nt, Artificial Sequence
  ALPK1__Homo_sapiens__NP_001095876
augaacaaccagaaggugguggccgugcugcugcaggagugcaagcaggugcuggaccagcugcugcuggaggcccccgacgugagcgaggaggacaagagcgaggaccagagaugcagagcccugcugcccagcgagcugagaacccugauccaggaggccaaggagaugaaguggcccuucgugcccgagaaguggcaguacaagcaggccgugggccccgaggacaagaccaaccugaaggacgugaucggcgccggccugcagcagcugcuggccagccugagagccagcauccuggccagagacugcgccgccgccgccgccaucguguuccugguggacagauuccuguacggccuggacgugagcggcaagcugcugcagguggccaagggccugcacaagcugcagcccgccacccccaucgccccccagguggugaucagacaggccagaaucagcgugaacagcggcaagcugcugaaggccgaguacauccugagcagccugaucagcaacaacggcgccaccggcaccuggcuguacagaaacgagagcgacaaggugcuggugcagagcgugugcauccagaucagaggccagauccugcagaagcugggcaugugguacgaggccgccgagcugaucugggccagcaucgugggcuaccuggcccugccccagcccgacaagaagggccugagcaccagccugggcauccuggccgacaucuucgugagcaugagcaagaacgacuacgagaaguucaagaacaacccccagaucaaccugagccugcugaaggaguucgaccaccaccugcugagcgccgccgaggccugcaagcuggccgccgccuucagcgccuacaccccccuguucgugcugaccgccgugaacaucagaggcaccugccugcugagcuacagcagcagcaacgacugcccccccgagcugaagaaccugcaccugugcgaggccaaggaggccuucgagaucggccugcugaccaagagagacgacgagcccgugaccggcaagcaggagcugcacagcuucgugaaggccgccuucggccugaccaccgugcacagaagacugcacggcgagaccggcaccgugcacgccgccagccagcugugcaaggaggccaugggcaagcuguacaacuucagcaccagcagcagaagccaggacagagaggcccugagccaggaggugaugagcgugaucgcccaggugaaggagcaccugcaggugcagagcuucagcaacguggacgacagaagcuacgugcccgagagcuucgagugcagacuggacaagcugauccugcacggccagggcgacuuccagaagauccuggacaccuacagccagcaccacaccagcgugugcgagguguucgagagcgacugcggcaacaacaagaacgagcagaaggacgccaagaccggcgugugcaucaccgcccugaagaccgagaucaagaacaucgacaccgugagcaccacccaggagaagccccacugccagagagacaccggcaucagcagcagccugaugggcaagaacgugcagagagagcugagaagaggcggcagaagaaacuggacccacagcgacgccuucagagugagccuggaccaggacguggagaccgagaccgagcccagcgacuacagcaacggcgagggcgccguguucaacaagagccugagcggcagccagaccagcagcgccuggagcaaccugagcggcuucagcagcagcgccagcugggaggaggugaacuaccacguggacgacagaagcgccagaaaggagcccggcaaggagcaccugguggacacccagugcagcaccgcccugagcgaggagcuggagaacgacagagagggcagagccaugcacagccugcacagccagcugcacgaccugagccugcaggagcccaacaacgacaaccuggagcccagccagaaccagccccagcagcagaugccccugacccccuucagcccccacaacacccccggcaucuuccuggcccccggcgccggccugcuggagggcgcccccgagggcauccaggaggugagaaacaugggccccagaaacaccagcgcccacagcagacccagcuacagaagcgccagcuggagcagcgacagcggcagacccaagaacaugggcacccaccccagcgugcagaaggaggaggccuucgagaucaucguggaguuccccgagaccaacugcgacgugaaggacagacagggcaaggagcagggcgaggagaucagcgagagaggcgccggccccaccuucaaggccagccccagcuggguggaccccgagggcgagaccgccgagagcaccgaggacgccccccuggacuuccacagagugcugcacaacagccugggcaacaucagcaugcugcccugcagcagcuucacccccaacuggcccgugcagaaccccgacagcagaaagagcggcggccccguggccgagcagggcaucgaccccgacgccagcaccguggacgaggagggccagcugcuggacagcauggacgugcccugcaccaacggccacggcagccacagacugugcauccugagacagccccccggccagagagccgagacccccaacagcagcgugagcggcaacauccuguuccccgugcugagcgaggacugcaccaccaccgaggagggcaaccagcccggcaacaugcugaacugcagccagaacagcagcagcagcagcgugugguggcugaagagccccgccuucagcagcggcagcagcgagggcgacagccccuggagcuaccugaacagcagcggcagcagcugggugagccugcccggcaagaugagaaaggagauccuggaggccagaacccugcagcccgacgacuucgagaagcugcuggccggcgugagacacgacuggcuguuccagagacuggagaacaccggcguguucaagcccagccagcugcacagagcccacagcgcccugcugcugaaguacagcaagaagagcgagcuguggaccgcccaggagaccaucguguaccugggcgacuaccugaccgugaagaagaagggcagacagagaaacgccuucugggugcaccaccugcaccaggaggagauccugggcagauacgugggcaaggacuacaaggagcagaagggccuguggcaccacuucaccgacguggagagacagaugaccgcccagcacuacgugaccgaguucaacaagagacuguacgagcagaacauccccacccagaucuucuacauccccagcaccauccugcugauccuggaggacaagaccaucaagggcugcaucagcguggagcccuacauccugggcgaguucgugaagcugagcaacaacaccaagguggugaagaccgaguacaaggccaccgaguacggccuggccuacggccacuucagcuacgaguucagcaaccacagagacguggugguggaccugcagggcugggugaccggcaacggcaagggccugaucuaccugaccgacccccagauccacagcguggaccagaagguguucaccaccaacuucggcaagagaggcaucuucuacuucuucaacaaccagcacguggagugcaacgagaucugccacagacugagccugaccagacccagcauggagaagcccugcaccuaa

SEQ ID NO: 13530 - RNA, 6513 nt, Artificial Sequence
  ALPK2__Homo_sapiens__NP_443179
augaaggacagcgagggcccccagagacccccccugugcuuccugagcacccugcugagccagaaggugcccgagaagagcgacgccgugcugagaugcaucaucagcggccagcccaagcccgaggugaccugguacaagaacggccaggccaucgacggcagcggcaucaucagcaacuacgaguucuucgagaaccaguacauccacgugcugcaccugagcugcugcaccaagaacgacgccgccguguaccagaucagcgccaagaacagcuucggcaugaucugcugcagcgccagcguggagguggagugcagcagcgagaacccccagcugagccccaaccuggaggacgacagagacagaggcuggaagcacgagaccggcacccacgaggaggagagagccaaccagaucgacgagaaggagcaccccuacaaggaggaggagagcaucagccccggcacccccagaagcgccgacagcagccccagcaagagcaaccacagccugagccugcagagccugggcaaccuggacaucagcgugagcagcagcgagaacccccugggcgugaagggcaccagacacaccggcgaggccuacgaccccagcaacaccgaggagaucgccaacggccugcuguuccugaacagcagccacaucuacgagaagcaggacagaugcugccacaagaccgugcacagcauggccagcaaguucaccgacggcgaccugaacaacgacggcccccacgacgagggccugagaagcagccagcagaaccccaaggugcagaaguacaucagcuucagccugccccugagcgaggccaccgcccacaucuaccccggcgacagcgccguggccaacaagcagcccagcccccagcugagcagcgaggacagcgacagcgacuacgagcugugccccgagaucacccugaccuacaccgaggaguucagcgacgacgaccuggaguaccuggagugcagcgacgugaugaccgacuacagcaacgccguguggcagagaaaccugcugggcaccgagcacguguuccugcuggagagcgacgacgaggagauggaguucggcgagcacugccugggcggcugcgagcacuuccugagcggcaugggcugcggcagcagagugagcggcgacgccggccccaugguggccaccgccggcuucugcggccaccacagccagccccaggaggugggcgugagaagcagcagagugagcaagcacggccccagcagcccccagaccggcaugacccugauccugggcccccaccaggacggcaccagcagcgugaccgagcagggcagauacaagcugcccaccgcccccgaggccgccgagaacgacuaccccggcauccagggcgagaccagagacagccaccaggccagagaggaguucgccagcgacaaccugcugaacauggacgagagcgugagagagaccgagaugaagcugcugagcggcgagagcgagaacagcggcaugagccagugcugggagaccgccgccgacaagagagugggcggcaaggaccuguggagcaagagaggcagcagaaagagcgccagagugagacagcccggcaugaagggcaaccccaagaagcccaacgccaaccugagagagagcaccaccgagggcacccugcaccugugcagcgccaaggagagcgccgagcccccccugacccagagcgacaagagagagaccagccacaccaccgccgccgccaccggcagaagcagccacgccgacgccagagagugcgccaucagcacccaggccgagcaggaggccaagacccugcagaccagcaccgacagcgugagcaaggagggcaacaccaacugcaagggcgagggcaugcaggugaacacccuguucgagaccagccaggugcccgacuggagcgaccccccccaggugcaggugcaggagaccgugagagagaccaucagcugcagccagaugcccgccuucagcgagcccgccggcgaggagagccccuucaccggcaccaccaccaucagcuucagcaaccugggcggcgugcacaaggagaacgccagccuggcccagcacagcgaggugaagcccugcaccugcggcccccagcacgaggagaagcaggacagagacggcaacauccccgacaacuucagagaggaccugaaguacgagcagagcaucagcgaggccaacgacgagaccaugagccccggcguguucagcagacaccugcccaaggacgccagagccgacuucagagagcccguggccgugagcguggccagccccgagcccaccgacaccgcccugacccuggagaacgugugcgacgagcccagagacagagaggccgugugcgccauggagugcuucgaggccggcgaccagggcaccugcuucgacaccaucgacagccuggugggcagacccguggacaaguacagcccccaggagaucugcagcguggacaccgagcuggccgagggccagaacaaggugagcgaccugugcagcagcaacgacaagacccuggagguguucuuccagacccaggugagcgagaccagcgugagcaccugcaagagcagcaaggacggcaacagcgugaugagcccccuguucaccagcaccuucacccugaacaucagccacaccgccagcgagggcgccaccggcgagaaccuggccaagguggagaacagcaccuacccccuggccagcaccgugcacgccggccaggagcagcccagccccagcaacagcggcggccuggacgagacccagcugcugagcagcgagaacaacccccuggugcaguucaaggagggcggcgacaagagccccagccccagcgccgccgacaccaccgccacccccgccagcuacagcagcaucgugagcuuccccugggagaagcccaccacccugaccgccaacaacgagugcuuccaggccaccagagagaccgaggacaccagcaccgugaccaucgccaccgaggugcaccccgccaaguaccuggccgugagcauccccgaggacaagcacgccggcggcaccgaggagagauuccccagagccagccacgagaaggugagccaguuccccagccaggugcagcuggaccacauccugagcggcgccaccaucaagagcaccaaggagcugcugugcagagcccccagcgugcccggcgugccccaccacgugcugcagcugcccgagggcgagggcuucugcagcaacagcccccugcagguggacaaccugagcggcgacaagagccagaccguggacagagccgacuucagaagcuacgaggagaacuuccaggagagaggcagcgagaccaagcagggcgugcagcagcagagccugagccagcagggcagccugagcgcccccgacuuccagcagagccugcccaccaccagcgccgcccaggaggagagaaaccuggugcccaccgcccacagccccgccagcagcagagagggcgccggccagagaagcggcuggggcaccagagugagcgugguggccgagaccgccggcgaggaggacagccaggcccugagcaacgugcccagccugagcgacauccugcuggaggagagcaaggaguacagacccggcaacugggaggccggcaacaagcugaagaucaucacccuggaggccagcgccagcgagaucuggccccccagacagcugaccaacagcgagagcaaggccagcgacggcggccugaucauccccgacaaggugugggccgugcccgacagccugaaggccgacgccguggugcccgagcuggcccccagcgagaucgccgcccuggcccacagccccgaggacgccgagagcgcccuggccgacagcagagagagccacaagggcgaggagcccaccaucagcgugcacuggagaagccugagcagcagaggcuucagccagcccagacugcuggagagcagcguggaccccguggacgagaaggagcugagcgugaccgacagccugagcgccgccagcgagaccggcggcaaggagaacgugaacaacgugagccaggaccaggaggagaagcagcugaagauggaccacaccgccuucuucaagaaguuccugaccugccccaagauccuggagagcagcguggaccccaucgacgagaucagcgugaucgaguacaccagagccggcaagcccgagcccagcgagaccaccccccagggcgccagagagggcggccagagcaacgacggcaacaugggccacgaggccgagauccagcccgccauccugcaggugcccugccugcagggcaccauccugagcgagaacagaaucagcagaagccaggagggcagcaugaagcaggaggccgagcagauccagcccgaggaggccaagaccgccaucuggcaggugcugcagcccagcgagggcggcgagagaauccccagcggcugcagcaucggccagauccaggagagcagcgacggcagccugggcgaggccgagcagagcaagaaggacaaggccgagcugaucagccccaccagcccccugagcagcugccugcccaucaugacccacgccagccugggcguggacacccacaacagcaccggccagauccacgacgugcccgagaacgacaucguggagcccagaaagagacaguacguguuccccgugagccagaagagaggcaccaucgagaacgagagaggcaagccccugcccagcagccccgaccugaccagauuccccugcaccagcagccccgagggcaacgugaccgacuuccugaucagccacaagauggaggagcccaagaucgaggugcugcagaucggcgagaccaagccccccagcagcagcagcagcagcgccaagacccuggccuucaucagcggcgagagagagcuggagaaggcccccaagcugcugcaggaccccugccagaagggcacccugggcugcgccaagaagagcagagagagagagaagagccuggaggccagagccggcaagagccccggcacccugaccgccgugaccggcagcgaggaggugaagagaaagcccgaggcccccggcagcggccaccuggccgagggcgugaagaagaagauccugagcagaguggccgcccugagacugaagcuggaggagaaggagaacaucagaaagaacagcgccuuccugaagaagaugcccaagcuggagaccagccugagccacaccgaggagaagcaggaccccaagaagcccagcugcaagagagagggcagagcccccgugcugcugaagaagauccaggccgagauguuccccgagcacagcggcaacgugaagcugagcugccaguucgccgagauccacgaggacagcaccaucugcuggaccaaggacagcaagagcaucgcccaggugcagagaagcgccggcgacaacagcaccgugagcuucgccaucgugcaggccagccccaaggaccagggccuguacuacugcugcaucaagaacagcuacggcaaggugaccgccgaguucaaccugaccgccgaggugcugaagcagcugagcagcagacaggacaccaagggcugcgaggagaucgaguucagccagcugaucuucaaggaggacuuccugcacgacagcuacuucggcggcagacugagaggccagaucgccaccgaggagcugcacuucggcgagggcgugcacagaaaggccuucagaagcaccgugaugcacggccugaugcccguguucaagcccggccacgccugcgugcugaaggugcacaacgccaucgccuacggcaccagaaacaacgacgagcugauccagagaaacuacaagcuggccgcccaggagugcuacgugcagaacaccgccagauacuacgccaagaucuacgccgccgaggcccagccccuggagggcuucggcgaggugcccgagaucauccccaucuuccugauccacagacccgagaacaacauccccuacgccaccguggaggaggagcugaucggcgaguucgugaaguacagcaucagagacggcaaggagaucaacuuccugagaagagagagcgaggccggccagaagugcugcaccuuccagcacuggguguaccagaagaccagcggcugccugcuggugaccgacaugcagggcgugggcaugaagcugaccgacgugggcaucgccacccuggccaagggcuacaagggcuucaagggcaacugcagcaugaccuucaucgaccaguucaaggcccugcaccagugcaacaaguacugcaagaugcugggccugaagagccugcagaacaacaaccagaagcagaagcagcccagcaucggcaagagcaaggugcagaccaacagcaugaccaucaagaaggccggccccgagacccccggcgagaagaagaccuaa

SEQ ID NO: 13531 - RNA, 5724 nt, Artificial Sequence
  ALPK3__Homo_sapiens__NP_065829
auggagguggccuggcugguguacgugcugggccagcagccccuggccagacagggcgagggccagagcagacuggugcccggcagaggccuggugcuguggcugcccggccugcccagaagcagccccagcuggcccgccguggaccuggccccccuggcccccgccagacccagaggcccccugaucugccacaccggccacgagcaggccggcagagagcccggccccggcagcagcaccaagggccccgugcugcacgaccaggacaccagaugcgccuuccugcccagaccccccggcccccugcagaccagaagauacugcagacaccagggcagacagggcagcggccugggcgccggccccggcgccggcaccugggcccccgccccccccggcgugagcaagcccagaugccccggcagagccagacccggcgagggccagcagcaggugaccaccgccagaccccccgccaucaacagaggcgccagacagcccagagccggcgccgccgccgccggcagaggccccggcgccggcgccuggagaaccggcgaggccgccgccagcgccggccccgccgugggcgagggcggcgccaugggcagcagaagagcccccagcagaggcuggggcgccggcggcagaagcggcgccggcggcgacggcgaggacgacggccccguguggauccccagccccgccagcagaagcuaccugcugagcgugagacccgagaccagccugagcagcaacagacugagccaccccagcagcggcagaagcaccuucugcagcaucaucgcccagcugaccgaggagacccagccccuguucgagaccacccugaagagcagaagcgugagcgaggacagcgacgugagauucaccugcaucgugaccggcuaccccgagcccgaggugaccugguacaaggacgacaccgagcuggacagauacugcggccugcccaaguacgagaucacccaccagggcaacagacacacccugcagcuguacagaugcagagaggaggacgccgccaucuaccaggccagcgcccagaacagcaagggcaucgugagcugcagcggcgugcuggaggugggcaccaugaccgaguacaagauccaccagagaugguucgccaagcugaagagaaaggccgccgccaagcugagagagaucgagcagagcuggaagcacgagaaggccgugcccggcgagguggacacccugagaaagcugagccccgacagauuccagagaaagagaagacugagcggcgcccaggcccccggccccagcgugcccaccagagagcccgagggcggcacccuggccgccuggcaggagggcgagaccgagaccgcccagcacagcggccugggccugaucaacagcuucgccagcggcgaggugaccaccaacggcgaggccgcccccgagaacggcgaggacggcgagcacggccugcugaccuacaucugcgacgccauggagcugggcccccagagagcccugaaggaggagagcggcgccaagaagaagaagaaggacgaggagagcaagcagggccugagaaagcccgagcuggagaaggccgcccagagcagaagaagcagcgagaacugcauccccagcagcgacgagcccgacagcugcggcacccagggccccgugggcguggagcaggugcagacccagcccagaggcagagccgccagaggccccggcagcagcggcaccgacagcaccagaaagcccgccagcgccgugggcacccccgacaaggcccagaaggcccccggccccggccccggccaggagguguacuucagccugaaggacauguaccuggagaacacccaggccgugagaccccugggcgaggagggcccccagacccugagcgugagagcccccggcgagagccccaagggcaaggccccccugagagccagaagcgagggcgugcccggcgcccccggccagcccacccacagccugaccccccagcccaccagacccuucaacagaaagagauucgccccccccaagcccaagggcgaggccaccaccgacagcaagcccaucagcagccugagccaggcccccgagugcggcgcccagagccugggcaaggcccccccccaggccagcgugcaggugcccaccccccccgccagaagaagacacggcaccagagacagcacccugcagggccaggccggccacagaacccccggcgaggugcuggagugccagaccaccaccgcccccaccaugagcgccagcagcagcagcgacguggccagcaucggcgugagcaccagcggcagccagggcaucaucgagcccauggacauggagacccaggaggacggcagaaccagcgccaaccagagaaccggcagcaagaagaacgugcaggccgacggcaagauccagguggacggcagaaccagaggcgacggcacccagaccgcccagagaaccagagccgacagaaagacccagguggacgccggcacccaggagagcaagagaccccagagcgacagaagcgcccagaagggcaugaugacccagggcagagccgagacccagcuggagaccacccaggccggcgagaagauccaggaggacagaaaggcccaggccgacaagggcacccaggaggacagaagaaugcagggcgagaagggcaugcagggcgagaagggcacccagagcgagggcagcgcccccaccgccauggagggccagagcgagcaggagguggccaccagccugggcccccccagcagaacccccaagcugccccccaccgccggccccagagccccccugaacaucgagugcuucgugcagacccccgagggcagcugcuuccccaagaagcccggcugccugcccagaagcgaggaggccguggugaccgccagcagaaaccacgagcagaccgugcugggcccccugagcggcaaccugaugcugcccgcccagcccccccacgagggcagcguggagcaggugggcggcgagagaugcagaggcccccagagcagcggccccguggaggccaagcaggaggacagccccuuccagugccccaaggaggagagacccggcggcgugcccugcauggaccagggcggcugcccccuggccggccugagccaggaggugcccaccaugcccagccugcccggcaccggccugaccgccagccccaaggccggccccugcagcacccccaccagccagcacggcagcaccgccaccuuccugcccagcgaggaccaggugcugaugagcagcgcccccacccugcaccugggccugggcacccccacccagagccacccccccgagaccauggccaccagcagcgagggcgccugcgcccaggugcccgacguggagggcagaacccccggccccagaagcugcgaccccggccugaucgacagccugaagaacuaccugcugcugcugcugaagcugagcagcaccgagaccagcggcgccggcggcgagagccaggugggcgccgccaccggcggccuggugcccagcgccacccugacccccaccguggagguggccggccugagccccagaaccagcagaagaauccuggagagaguggagaacaaccaccuggugcagagcgcccagacccugcugcugagccccugcaccagcagaagacugaccggccugcuggacagagaggugcaggccggcagacaggcccuggccgccgccagaggcagcuggggccccggccccagcagccugaccgugcccgccaucgugguggacgaggaggaccccggccuggccagcgagggcgccagcgagggcgagggcgaggugagccccgagggccccggccugcugggcgccagccaggagagcagcauggccggcagacugggcgaggccggcggccaggccgcccccggccagggccccagcgccgagagcaucgcccaggagcccagccaggaggagaaguuccccggcgaggcccugaccggccugcccgccgccacccccgaggagcuggcccugggcgccagaagaaagagauuccugcccaaggugagagccgccggcgacggcgaggccaccacccccgaggagagagagagccccaccgugagccccagaggccccagaaagagccuggugcccggcagccccggcacccccggcagagagagaagaagccccacccagggcagaaaggccagcaugcuggaggugcccagagccgaggaggagcuggccgccggcgaccugggccccagccccaaggccggcggccuggacaccgagguggcccuggacgagggcaagcaggagacccuggccaagcccagaaaggccaaggaccugcugaaggccccccaggugaucagaaagaucagaguggagcaguuccccgacgccagcggcagccugaagcuguggugccaguucuucaacauccugagcgacagcgugcugaccugggccaaggaccagagacccgugggcgaggugggcagaagcgccggcgacgagggccccgccgcccuggccaucgugcaggccagccccguggacugcggcguguacagaugcaccauccacaacgagcacggcagcgccagcaccgacuucugccugagccccgaggugcugagcggcuucaucagcagagaggagggcgaggugggcgaggagaucgagaugacccccaugguguucgccaagggccuggccgacagcggcugcuggggcgacaagcuguucggcagacuggugagcgaggagcugagaggcggcggcuacggcugcggccugagaaaggccagccaggccaaggugaucuacggccuggagcccaucuucgagagcggcagaaccugcaucaucaaggugagcagccugcugguguucggccccagcagcgagaccagccuggugggcagaaacuacgacgugaccauccagggcugcaagauccagaacaugagcagagaguacugcaagaucuucgccgccgaggccagagccgcccccggcuucggcgaggugcccgagaucaucccccuguaccugaucuacagacccgccaacaacauccccuacgccacccuggaggaggaccugggcaagccccuggagagcuacugcagcagagaguggggcugcgccgaggcccccaccgccagcggcagcagcgaggccaugcagaagugccagaccuuccagcacuggcuguaccaguggaccaacggcagcuuccuggugaccgaccuggccggcguggacuggaagaugaccgacgugcagaucgccaccaagcugagaggcuaccagggccugaaggagagcugcuuccccgcccugcuggacagauucgccagcagccaccagugcaacgccuacugcgagcugcugggccugaccccccugaagggccccgaggccgcccacccccaggccaaggccaagggcagcaagagccccagcgccggcagaaagggcagccagcugagcccccagccccagaagaagggccugcccagcccccagggcaccagaaagagcgcccccagcagcaaggccaccccccaggccagcgagcccgugaccacccagcugcugggccagccccccacccaggaggagggcagcaaggcccagggcaugagauaa

SEQ ID NO: 13532 - RNA, 1608 nt, Artificial Sequence
  ALPP__Homo_sapiens__NP_001623
augcugggccccugcaugcugcugcugcugcugcugcugggccugagacugcagcugagccugggcaucauccccguggaggaggagaaccccgacuucuggaacagagaggccgccgaggcccugggcgccgccaagaagcugcagcccgcccagaccgccgccaagaaccugaucaucuuccugggcgacggcaugggcgugagcaccgugaccgccgccagaauccugaagggccagaagaaggacaagcugggccccgagaucccccuggccauggacagauuccccuacguggcccugagcaagaccuacaacguggacaagcacgugcccgacagcggcgccaccgccaccgccuaccugugcggcgugaagggcaacuuccagaccaucggccugagcgccgccgccagauucaaccagugcaacaccaccagaggcaacgaggugaucagcgugaugaacagagccaagaaggccggcaagagcgugggcguggugaccaccaccagagugcagcacgccagccccgccggcaccuacgcccacaccgugaacagaaacugguacagcgacgccgacgugcccgccagcgccagacaggagggcugccaggacaucgccacccagcugaucagcaacauggacaucgacgugauccugggcggcggcagaaaguacauguucagaaugggcacccccgaccccgaguaccccgacgacuacagccagggcggcaccagacuggacggcaagaaccuggugcaggaguggcuggccaagagacagggcgccagauacguguggaacagaaccgagcugaugcaggccagccuggaccccagcgugacccaccugaugggccuguucgagcccggcgacaugaaguacgagauccacagagacagcacccuggaccccagccugauggagaugaccgaggccgcccugagacugcugagcagaaaccccagaggcuucuuccuguucguggagggcggcagaaucgaccacggccaccacgagagcagagccuacagagcccugaccgagaccaucauguucgacgacgccaucgagagagccggccagcugaccagcgaggaggacacccugagccuggugaccgccgaccacagccacguguucagcuucggcggcuacccccugagaggcagcagcaucuucggccuggcccccggcaaggccagagacagaaaggccuacaccgugcugcuguacggcaacggccccggcuacgugcugaaggacggcgccagacccgacgugaccgagagcgagagcggcagccccgaguacagacagcagagcgccgugccccuggacgaggagacccacgccggcgaggacguggccguguucgccagaggcccccaggcccaccuggugcacggcgugcaggagcagaccuucaucgcccacgugauggccuucgccgccugccuggagcccuacaccgccugcgaccuggccccccccgccggcaccaccgacgccgcccaccccggcagaagcguggugcccgcccugcugccccugcuggccggcacccugcugcugcuggagaccgccaccgcccccuaa

SEQ ID NO: 13533 - RNA, 1599 nt, Artificial Sequence
  ALPPL2__Homo_sapiens__NP_112603
augcagggccccugggugcugcugcugcugggccugagacugcagcugagccugggcaucauccccguggaggaggagaaccccgacuucuggaacagacaggccgccgaggcccugggcgccgccaagaagcugcagcccgcccagaccgccgccaagaaccugaucaucuuccugggcgacggcaugggcgugagcaccgugaccgccgccagaauccugaagggccagaagaaggacaagcugggccccgagaccuuccuggccauggacagauuccccuacguggcccugagcaagaccuacagcguggacaagcacgugcccgacagcggcgccaccgccaccgccuaccugugcggcgugaagggcaacuuccagaccaucggccugagcgccgccgccagauucaaccagugcaacaccaccagaggcaacgaggugaucagcgugaugaacagagccaagaaggccggcaagagcgugggcguggugaccaccaccagagugcagcacgccagccccgccggcgccuacgcccacaccgugaacagaaacugguacagcgacgccgacgugcccgccagcgccagacaggagggcugccaggacaucgccacccagcugaucagcaacauggacaucgacgugauccugggcggcggcagaaaguacauguuccccaugggcacccccgaccccgaguaccccgacgacuacagccagggcggcaccagacuggacggcaagaaccuggugcaggaguggcuggccaagcaccagggcgccagauacguguggaacagaaccgagcugcugcaggccagccuggaccccagcgugacccaccugaugggccuguucgagcccggcgacaugaaguacgagauccacagagacagcacccuggaccccagccugauggagaugaccgaggccgcccugcugcugcugagcagaaaccccagaggcuucuuccuguucguggagggcggcagaaucgaccacggccaccacgagagcagagccuacagagcccugaccgagaccaucauguucgacgacgccaucgagagagccggccagcugaccagcgaggaggacacccugagccuggugaccgccgaccacagccacguguucagcuucggcggcuacccccugagaggcagcagcaucuucggccuggcccccggcaaggccagagacagaaaggccuacaccgugcugcuguacggcaacggccccggcuacgugcugaaggacggcgccagacccgacgugaccgagagcgagagcggcagccccgaguacagacagcagagcgccgugccccuggacggcgagacccacgccggcgaggacguggccguguucgccagaggcccccaggcccaccuggugcacggcgugcaggagcagaccuucaucgcccacgugauggccuucgccgccugccuggagcccuacaccgccugcgaccuggcccccagagccggcaccaccgacgccgcccaccccggccccagcguggugcccgcccugcugccccugcuggccggcacccugcugcugcugggcaccgccaccgcccccuaa

SEQ ID NO: 13534 - RNA, 2862 nt, Artificial Sequence
  ALS2CL__Homo_sapiens__NP_001177636
augugcaaccccgaggaggccgcccugcugagacuggaggagguguucagcgccacccuggcccacgugaacagccuggugcugcagccccugcugcccgccgcccccgaccccagcgaccccuggggcagagagugccugagacugcugcagcagcugcacaagagcagccagcagcugugggaggugaccgaggagagccugcacagccugcaggagagacugagauaccccgacagcaccggccuggagagccugcugcugcugagaggcgccgacagagugcugcaggcccacaucgaguacaucgagagcuacaccagcugcaugguggugcaggccuuccagaaggccgccaagagaagaagcgaguacuggagaggccagagaaaggcccugagacagcugcugagcggcgugagcagcgagggcagcgugggcgccagccugggccaggcccugcaccagccccuggcccaccacgugcagcaguacgugcugcugcugcugagccugggcgacaccaucggcgagcaccaccccaccagagagcugguggugaacgccgugacccuguucggcaaccugcagagcuucaugaagcaggagcuggaccaggccguggccacccaggcccuguggcacacccugagaggcagacugagagacgugcugugcacccccgcccacagacugcugcaggacagccaggacgugcccgugaccguggccccccugagagccgagagagugcugcuguucgacgacgcccuggugcugcugcagggccacaacgugcacaccuucgaccugaagcugguguggguggaccccggccaggacggcugcaccuuccaccugcugacccccgaggaggaguucagcuucugcgccaaggacagccagggccaggccguguggcaguggaaggugaccugggccgugcaccaggcccugcacggcaagaaggacuuccccgugcugggcgccggccuggagcccagccagccccccgacugcagaugcgccgaguacaccuuccaggccgagggcagacugugccaggccaccuacgagggcgaguggugcagaggcagaccccacggcaagggcacccugaaguggcccgacggcagaaaccacgugggcaacuucugccagggccuggagcacggcuucggcaucagacugcugccccaggccagcgaggacaaguucgacugcuacaagugccacuggagagagggcagcaugugcggcuacggcaucugcgaguacagcaccgacgagguguacaagggcuacuuccaggagggccugagacacggcuucggcgugcuggagagcggcccccaggccccccagcccuucagauacaccggccacugggagagaggccagagaagcggcuacggcaucgaggaggacggcgacagaggcgagagauacaucggcauguggcaggccggccagagacacggccccggcgugauggugacccaggccggcgugugcuaccagggcaccuuccaggccgacaagaccgugggccccggcauccugcugagcgaggacgacagccuguacgagggcaccuucaccagagaccugacccugaugggcaagggcaaggugaccuuccccaacggcuucacccuggagggcagcuucggcagcggcgccggcagaggccugcacacccagggcgugcuggacaccgccgcccugccccccgaccccagcagcaccugcaagagacagcugggcgugggcgccuuccccguggagagcagauggcagggcguguacagccccuucagagacuucgugugcgccggcugccccagagaccugcaggaggcccugcugggcuucgacgugcagagcagcagagagcugagaagaagccaggacuaccugagcugcgagagaacccaccccgaggacagcgugggcagcauggaggacauccuggaggagcugcugcagcacagagagcccaaggcccugcagcuguaccugagaaaggcccugagcaacagccugcacccccugggcaagcugcugagaacccugaugcugaccuuccaggccaccuacgccggcgugggcgccaacaagcaccugcaggagcuggcccaggaggaggugaagcagcacgcccaggagcugugggccgccuacagaggccugcugagaguggcccuggagagaaagggccaggcccuggaggaggacgaggacaccgagaccagagaccugcaggugcacggccuggugcugccccugaugcugcccagcuucuacagcgagcuguucacccuguaccugcugcugcacgagagagaggacagcuucuacagccagggcaucgccaaccugagccuguuccccgacacccagcugcuggaguuccuggacgugcagaagcaccuguggccccugaaggaccugacccugaccagcaaccagagauacagccuggugagagacaagugcuuccugagcgccaccgagugccugcagaagaucaugaccaccguggaccccagagagaagcuggaggugcuggagagaaccuacggcgagaucgagggcaccgugagcagagugcugggcagagaguacaagcugcccauggacgaccugcugccccugcugaucuacguggugagcagagccagaauccagcaccugggcgccgagauccaccugaucagagacaugauggaccccaaccacaccggcggccuguacgacuuccugcugaccgcccuggagagcugcuacgagcacauccagaaggaggacaugagacugcacagacugcccggccacuggcacagcagagagcugugguaa

SEQ ID NO: 13535 - RNA, 1269 nt, Artificial Sequence
  ALS2CR12__Homo_sapiens__NP_001120863
auguaccccaacccccugaucuacugcaccugcugggaccccuggaaccugggccccagaaagcugaucaagaccccccagcugcccagaaagaacagcaccggcagcagcaagcugaccccccuggugcccgcccccaagaaccacaacuaccugcagcccaccaagcccguggugagccccaagaugaagauccacagcgccagacaggaggagaccaacaagagcuucuacgaggugaucaacgugagccccggcuaccagcuggugagaaacagagagcagaucagcgugacccugggcgacgagauguucgacagaaagaagagaugggagagcgagauccccgacaagggcagauucagcagaaccaacaucaucagcgaccuggaggagcagaucagcgagcugaccgccaucaucgagcagaugaacagagaccaccagagcgcccagaagcugcugagcagcgagauggaccugagaugcgccgagaugaagcagaacuucgagaacaagaacagagagcugaaggaggcccacgaggccgagcugagcgagcuggagaacaacuacaaggccgcccugaaggccgagaagcuggccgcccaggagaagcuggaggagaugggcaaggaguacaaguaccugaagaacauguucagaaccuaccaggacagcaucuacgacgagauggaggagaaguggagcaagcagaaggccaaguggaagaaggacgagaaguucgagagagagaacauccugcugcagcagaagaagaagaugaccaagaaguucgagauggagagcggcgaggaggacaagaagaucaacgagagcugcagcgccguguucgagaacuucauccaggagaaggaggagcugcugaagcagcaccagagcgacacccugcagcuggaggagcugagaaagaccaaggaggugaugcaggaggagcugcacgcccaggcccugauccuggagagccugaacaccaaccuguacuacacccagcuggagcugcagaaggagaaggccaucgugggcaaccuggagaagaugcugcagaccaaguucgccgagaccgaggagaaguacaagcacaccauccagauccugaccgaggagaacauccaccugaagcagaagaucaucagcaagaacgaggagaucugcgagggcugcagcggcagacuggccagcaucaccgugagcaaggacgacagcgacaccgugcaggacggcagcaagaagggccaggagagcuaa

SEQ ID NO: 13536 - RNA, 1191 nt, Artificial Sequence
  ALS2__Homo_sapiens__NP_001129217
auggacagcaagaagagaagcagcaccgaggccgagggcagcaaggagagaggccuggugcacaucuggcaggccggcagcuuccccaucacccccgagagacugcccggcuggggcggcaagaccgugcugcaggccgcccugggcgugaagcacggcgugcugcugaccgaggacggcgagguguacagcuucggcacccugcccuggagaagcggccccguggagaucugccccagcagccccauccuggagaacgcccuggugggccaguacgugaucaccguggccaccggcagcuuccacagcggcgccgugaccgacaacggcguggccuacauguggggcgagaacagcgccggccagugcgccguggccaaccagcaguacgugcccgagcccaaccccgugagcaucgccgacagcgaggccagcccccugcuggccgugagaauccugcagcuggccugcggcgaggagcacacccuggcccugagcaucagcagagagaucugggccuggggcaccggcugccagcugggccugaucaccaccgccuuccccgugaccaagccccagaagguggagcaccuggccggcagaguggugcugcagguggccugcggcgccuuccacagccuggcccuggugcagugccugcccagccaggaccugaagcccgugcccgagagaugcaaccagugcagccagcugcugaucaccaugaccgacaaggaggaccacgugaucaucagcgacagccacugcugcccccugggcgugacccugaccgagagccaggccgagaaccacgccagcaccgcccugagccccagcaccgagacccuggacagacaggaggagguguucgagaacacccugguggccaacgaccagagcguggccaccgagcugaacgccgugagcgcccagaucaccagcagcgacgccaugagcagccagcagaacgugaugggcaccaccgagaucagcagcgccagaaacauccccagcuaccccgacacccaggccgugaacgaguaccugagaaagcugagcgaccacagcgugagagaggacagcgagcacggcgagaagcccgugcccagccaggugcccgcccaguucuacaagaucaaggugugccuggagcugaacugcaugggcuucagccuggagacccugaaguaa

SEQ ID NO: 13537 - RNA, 981 nt, Artificial Sequence
  ALX1__Homo_sapiens__XP_005269222
auggaguuccugagcgagaaguucgcccugaagagcccccccagcaagaacagcgacuucuacaugggcgccggcggcccccuggagcacgugauggagacccuggacaacgagagcuucuacagcaaggccagcgccggcaagugcgugcaggccuucggcccccugcccagagccgagcaccacgugagacuggagagaaccagccccugccaggacagcagcgugaacuacggcaucaccaagguggagggccagccccugcacaccgagcugaacagagccauggacaacugcaacagccugagaaugagccccgugaagggcaugcaggagaagggcgagcuggacgagcugggcgacaagugcgacagcaacgugagcagcagcaagaagagaagacacagaaccaccuucaccagccugcagcuggaggagcuggagaagguguuccagaagacccacuaccccgacguguacgugagagagcagcuggcccugagaaccgagcugaccgaggccagagugcaggugugguuccagaacagaagagccaaguggagaaagagagagagauacggccagauccagcaggccaagagccacuucgccgccaccuacgacaucagcgugcugcccagaaccgacagcuacccccagauccagaacaaccugugggccggcaacgccagcggcggcagcguggugaccagcugcaugcugcccagagacaccagcagcugcaugacccccuacagccacagccccagaaccgacagcagcuacaccggcuucagcaaccaccagaaccaguucagccacgugccccugaacaacuucuucaccgacagccugcugaccggcgccaccaacggccacgccuucgagaccaagcccgaguucgagagaagaagcagcagcaucgccgugcugagaaugaaggccaaggagcacaccgccaacaucagcugggccauguaa

SEQ ID NO: 13538 - RNA, 1236 nt, Artificial Sequence
  ALX4__Homo_sapiens__NP_068745
augaacgccgagaccugcgugagcuacugcgagagccccgccgccgccauggacgccuacuacagccccgugagccagagcagagagggcagcagccccuucagagccuuccccggcggcgacaaguucggcaccaccuuccugagcgccgccgccaaggcccagggcuucggcgacgccaagagcagagccagauacggcgccggccagcaggaccuggccaccccccuggagagcggcgccggcgccagaggcagcuucaacaaguuccagccccagcccagcaccccccagccccagccccccccccagccccagccccagcagcagcagccccagccccagccccccgcccagccccaccuguaccugcagagaggcgccugcaagaccccccccgacggcagccugaagcugcaggagggcagcagcggccacagcgccgcccugcaggugcccugcuacgccaaggagagcagccugggcgagcccgagcugccccccgacagcgacaccgugggcauggacagcagcuaccugagcgugaaggaggccggcgugaagggcccccaggacagagccagcagcgaccugcccagcccccuggagaaggccgacagcgagagcaacaagggcaagaagagaagaaacagaaccaccuucaccagcuaccagcuggaggagcuggagaagguguuccagaagacccacuaccccgacguguacgccagagagcagcuggccaugagaaccgaccugaccgaggccagagugcaggugugguuccagaacagaagagccaaguggagaaagagagagagauucggccagaugcagcaggugagaacccacuucagcaccgccuacgagcugccccugcugaccagagccgagaacuacgcccagauccagaaccccagcuggcugggcaacaacggcgccgccagccccgugcccgccugcguggugcccugcgaccccgugcccgccugcaugagcccccacgcccacccccccggcagcggcgccagcagcgugaccgacuuccugagcgugagcggcgccggcagccacgugggccagacccacaugggcagccuguucggcgccgccagccugagccccggccugaacggcuacgagcugaacggcgagcccgacagaaagaccagcagcaucgccgcccugagaaugaaggccaaggagcacagcgccgccaucagcugggccaccuaa

SEQ ID NO: 13539 - RNA, 795 nt, Artificial Sequence
  ALYREF__Homo_sapiens__NP_005773
augcccgacagcgcccccgccauggccgacaagauggacaugagccuggacgacaucaucaagcugaacagaagccagagaggcggcagaggcggcggcagaggcagaggcagagccggcagccagggcggcagaggcggcggcgcccaggccgccgccagagugaacagaggcggcggccccaucagaaacagacccgccaucgccagaggcgccgccggcggcggcggcagaaacagacccgcccccuacagcagacccaagcagcugcccgacaaguggcagcacgaccuguucgacagcggcuucggcggcggcgccggcguggagaccggcggcaagcugcuggugagcaaccuggacuucggcgugagcgacgccgacauccaggagcuguucgccgaguucggcacccugaagaaggccgccgugcacuacgacagaagcggcagaagccugggcaccgccgacgugcacuucgagagaaaggccgacgcccugaaggccaugaagcaguacaacggcgugccccuggacggcagacccaugaacauccagcuggugaccagccagaucgacgcccagagaagacccgcccagagcgugaacagaggcggcaugaccagaaacagaggcgccggcggcuucggcggcggcggcggcaccagaagaggcaccagaggcggcgccagaggcagaggcagaggcgccggcagaaacagcaagcagcagcugagcgccgaggagcuggacgcccagcuggacgccuacaacgccagaauggacaccagcuaa

SEQ ID NO: 13540 - RNA, 1185 nt, Artificial Sequence
  AMACR__Homo_sapiens__NP_001161067
auggcccugcagggcaucagcgugguggagcugagcggccuggcccccggccccuucugcgccauggugcuggccgacuucggcgccagaguggugagaguggacagacccggcagcagauacgacgugagcagacugggcagaggcaagagaagccuggugcuggaccugaagcagcccagaggcgccgccgugcugagaagacugugcaagagaagcgacgugcugcuggagcccuucagaagaggcgugauggagaagcugcagcugggccccgagauccugcagagagagaaccccagacugaucuacgccagacugagcggcuucggccagagcggcagcuucugcagacuggccggccacgacaucaacuaccuggcccugagcggcgugcugagcaagaucggcagaagcggcgagaaccccuacgccccccugaaccugcuggccgacuucgccggcggcggccugaugugcgcccugggcaucaucauggcccuguucgacagaaccagaaccggcaagggccaggugaucgacgccaacaugguggagggcaccgccuaccugagcagcuuccuguggaagacccagaagcugagccugugggaggcccccagaggccagaacaugcuggacggcggcgcccccuucuacaccaccuacagaaccgccgacggcgaguucauggccgugggcgccaucgagccccaguucuacgagcugcugaucaagggccugggccugaagagcgacgagcugcccaaccagaugagcauggacgacuggcccgagaugaagaagaaguucgccgacguguucgccgagaagaccaaggccgaguggugccagaucuucgacggcaccgacgccugcgugacccccgugcugaccuucgaggagguggugcaccacgaccacaacaaggagagaggcagcuucaucaccagcgaggagcaggacgugagccccagacccgccccccugcugcugaacacccccgccauccccagcuucaagagagaccccuucaucggcgagcacaccgaggagauccuggaggaguucggcuucagcagagaggagaucuaccagcugaacagcgacaagaucaucgagagcaacaaggccggcagcaaguucuggauccuguaccccacccacagcaacauccagaaguaa

SEQ ID NO: 13541 - RNA, 1344 nt, Artificial Sequence
  AMBN__Homo_sapiens__NP_057603
augagcgccagcaagaucccccuguucaagaugaaggaccugauccugauccugugccugcuggagaugagcuucgccgugcccuucuucccccagcagagcggcacccccggcauggccagccugagccuggagaccaugagacagcugggcagccugcagagacugaacacccugagccaguacagcagauacggcuucggcaagagcuucaacagccuguggaugcacggccugcugcccccccacagcagccugcccuggaugagacccagagagcacgagacccagcaguacgaguacagccugcccgugcacccccccccccugcccagccagcccagccugaagccccagcagcccggccugaagcccuuccugcagagcgccgccgccaccaccaaccaggccaccgcccugaaggaggcccugcagccccccauccaccugggccaccugccccugcaggagggcgagcugccccuggugcagcagcagguggcccccagcgacaagccccccaagcccgagcugcccggcguggacuucgccgacccccagggccccagccugcccggcauggacuuccccgacccccagggccccagccugcccggccuggacuucgccgacccccagggcagcaccaucuuccagaucgccagacugaucagccacggccccaugccccagaacaagcagagcccccuguaccccggcaugcuguacgugcccuucggcgccaaccagcugaacgcccccgccagacugggcaucaugagcagcgaggagguggccggcggcagagaggaccccauggccuacggcgccauguuccccggcuucggcggcaugagacccggcuucgagggcaugccccacaaccccgccaugggcggcgacuucacccuggaguucgacagccccguggccgccaccaagggccccgagaacgaggagggcggcgcccagggcagccccaugcccgaggccaaccccgacaaccuggagaaccccgccuuccugaccgagcuggagcccgccccccacgccggccugcuggcccugcccaaggacgacauccccggccugcccagaagccccagcggcaagaugaagggccugcccagcgugacccccgccgccgccgacccccugaugacccccgagcuggccgacguguacagaaccuacgacgccgacaugaccaccagcguggacuuccaggaggaggccaccauggacaccaccauggcccccaacagccugcagaccagcaugcccggcaacaaggcccaggagcccgagaugaugcacgacgccuggcacuuccaggagcccuaa

SEQ ID NO: 13542 - RNA, 1059 nt, Artificial Sequence
  AMBP__Homo_sapiens__NP_001624
augagaagccugggcgcccugcugcugcugcugagcgccugccuggccgugagcgccggccccgugcccaccccccccgacaacauccaggugcaggagaacuucaacaucagcagaaucuacggcaagugguacaaccuggccaucggcagcaccugccccuggcugaagaagaucauggacagaaugaccgugagcacccuggugcugggcgagggcgccaccgaggccgagaucagcaugaccagcaccagauggagaaagggcgugugcgaggagaccagcggcgccuacgagaagaccgacaccgacggcaaguuccuguaccacaagagcaaguggaacaucaccauggagagcuacguggugcacaccaacuacgacgaguacgccaucuuccugaccaagaaguucagcagacaccacggccccaccaucaccgccaagcuguacggcagagccccccagcugagagagacccugcugcaggacuucagagugguggcccagggcgugggcauccccgaggacagcaucuucaccauggccgacagaggcgagugcgugcccggcgagcaggagcccgagcccauccugauccccagagugagaagagccgugcugccccaggaggaggagggcagcggcggcggccagcuggugaccgaggugaccaagaaggaggacagcugccagcugggcuacagcgccggccccugcaugggcaugaccagcagauacuucuacaacggcaccagcauggccugcgagaccuuccaguacggcggcugcaugggcaacggcaacaacuucgugaccgagaaggagugccugcagaccugcagaaccguggccgccugcaaccugcccaucgugagaggccccugcagagccuucauccagcugugggccuucgacgccgugaagggcaagugcgugcuguuccccuacggcggcugccagggcaacggcaacaaguucuacagcgagaaggagugcagagaguacugcggcgugcccggcgacggcgacgaggagcugcugagauucagcaacuaa

SEQ ID NO: 13543 - RNA, 3906 nt, Artificial Sequence
  AMBRA1__Homo_sapiens__NP_001254711
augaagguggugcccgagaagaacgccgugagaauccuguggggcagagagagaggcgccagagccaugggcgcccagagacugcugcaggagcugguggaggacaagaccagauggaugaagugggagggcaagagaguggagcugcccgacagccccagaagcaccuuccugcuggccuucagccccgacagaacccugcuggccagcacccacgugaaccacaacaucuacaucaccgaggugaagaccggcaagugcgugcacagccugaucggccacagaagaacccccuggugcgugaccuuccaccccaccaucagcggccugaucgccagcggcugccuggacggcgaggugagaaucugggaccugcacggcggcagcgagagcugguucaccgacagcaacaacgccaucgccagccuggccuuccaccccaccgcccagcugcugcugaucgccaccgccaacgagauccacuucugggacuggagcagaagagagcccuucgccguggugaagaccgccagcgagauggagagagugagacuggugagauucgacccccugggccacuaccugcugaccgccaucgugaaccccagcaaccagcagggcgacgacgagcccgagauccccaucgacggcaccgagcugagccacuacagacagagagcccugcugcagagccagcccgugagaagaaccccccugcugcacaacuuccugcacaugcugagcagcagaagcagcggcauccagaccgagcccuuccacccccccgagcaggccagcagcacccagcaggaccagggccugcugaacagacccagcgccuucagcaccgugcagagcagcaccgccggcaacacccugagaaaccugagccugggccccaccagaagaagccugggcggcccccugagcagccaccccagcagauaccacagagagaucgcccccggccugaccggcagcgaguggaccagaaccgugcugagccugaacagcagaagcgaggccgagagcaugcccccccccagaaccagcgccagcagcgugagccugcugagcgugcugagacagcaggagggcggcagccaggccagcguguacaccagcgccaccgagggcagaggcuuccccgccagcggccuggccaccgagagcgacggcggcaacggcagcagccagaacaacagcggcagcaucagacacgagcugcagugcgaccugagaagauucuuccuggaguacgacagacugcaggagcuggaccagagccugagcggcgaggccccccagacccagcaggcccaggagaugcugaacaacaacaucgagagcgagagacccggccccagccaccagcccaccccccacagcagcgagaacaacagcaaccugagcagaggccaccugaacagaugcagagccugccacaaccugcugaccuucaacaacgacacccugagaugggagagaaccacccccaacuacagcagcggcgaggccagcagcagcuggcaggugcccagcagcuucgagagcgugcccagcagcggcagccagcugcccccccuggagagaaccgagggccagacccccagcagcagcagacuggagcugagcagcagcgccagcccccaggaggagagaaccgugggcguggccuucaaccaggagaccggccacugggagagaaucuacacccagagcagcagaagcggcaccgugagccaggaggcccugcaccaggacaugcccgaggagagcagcgaggaggacagccugagaagaagaagccuggcccugagccccagacuggaguacagcggcgccauccuggcccacugcaagcugagacugcccggcagcugccacagccccgccagcgccagccagguggccggcaccaccggcgcccaccaccacgccagacugaucuucgccuuccugguggagauggaguuccaccacgugagccaggccggccuggagcugcugaccagcggcgaccugcccaccagcgccagccagagcgccggcaucaccggcgugagccacagagccuggcccagacugcuggagagcagccugaucagccugagcagauacgacggcgccggcagcagagagcaccccaucuaccccgaccccgccagacugagccccgccgccuacuacgcccagagaaugauccaguaccugagcagaagagacagcaucagacagagaagcaugagauaccagcagaacagacugagaagcagcaccagcagcagcagcagcgacaaccagggccccagcguggagggcaccgaccuggaguucgaggacuucgaggacaacggcgacagaagcagacacagagcccccagaaacgccagaaugagcgcccccagccugggcagauucgugcccagaagauuccugcugcccgaguaccugcccuacgccggcaucuuccacgagagaggccagcccggccuggccacccacagcagcgugaacagagugcuggccggcgccgugaucggcgacggccagagcgccguggccagcaacaucgccaacaccaccuacagacugcaguggugggacuucaccaaguucgaccugcccgagaucagcaacgccagcgugaacgugcuggugcagaacugcaagaucuacaacgacgccagcugcgacaucagcgccgacggccagcugcuggccgccuucauccccagcagccagagaggcuuccccgacgagggcauccuggccguguacagccuggccccccacaaccugggcgagaugcuguacaccaagagauucggccccaacgccaucagcgugagccugagccccaugggcagauacgugauggugggccuggccagcagaagaauccugcugcaccccagcaccgagcacaugguggcccagguguucagacugcagcaggcccacggcggcgagaccagcaugagaagaguguucaacgugcuguaccccaugcccgccgaccagagaagacacgugagcaucaacagcgccagauggcugcccgagcccggccugggccuggccuacggcaccaacaagggcgaccuggugaucugcagacccgaggcccugaacagcggcguggaguacuacugggaccagcugaacgagaccguguucaccgugcacagcaacagcagaagcagcgagagacccggcaccagcagagccaccuggagaaccgacagagacaugggccugaugaacgccaucggccugcagcccagaaaccccgccaccagcgugaccagccagggcacccagacccuggcccugcagcugcagaacgccgagacccagaccgagagagaggugcccgagcccggcaccgccgccagcggccccggcgagggcgagggcagcgaguacggcgccagcggcgaggacgcccugagcagaauccagagacugauggccgagggcggcaugaccgccguggugcagagagagcagagcaccaccauggccagcaugggcggcuucggcaacaacaucaucgugagccacagaauccacagaagcagccagaccggcaccgagcccggcgccgcccacaccagcagcccccagcccagcaccagcagaggccugcugcccgaggccggccagcuggccgagagaggccugagccccagaaccgccagcugggaccagcccggcacccccggcagagagcccacccagcccacccugcccagcagcagccccgugcccauccccgugagccugcccagcgccgagggccccacccugcacugcgagcugaccaacaacaaccaccugcuggacggcggcagcagcagaggcgacgccgccggccccagaggcgagcccagaaacagauaa

SEQ ID NO: 13544 - RNA, 918 nt, Artificial Sequence
  AMD1__Homo_sapiens__NP_001274143
auggaggccgcccacuucuucgagggcaccgagaagcugcuggaggugugguucagcagacagcagcccgacgccaaccagggcagcggcgaccugagaaccauccccagcgagagcagcauguucgugagcaagagaagauucauccugaagaccugcggcaccacccugcugcugaaggcccuggugccccugcugaagcuggccagagacuacagcggcuucgacagcauccagagcuucuucuacagcagaaagaacuucaugaagcccagccaccagggcuacccccacagaaacuuccaggaggagaucgaguuccugaacgccaucuuccccaacggcgccgccuacugcaugggcagaaugaacagcgacugcugguaccuguacacccuggacuuccccgagagcagagugaucagccagcccgaccagacccuggagauccugaugagcgagcuggaccccgccgugauggaccaguucuacaugaaggacggcgugaccgccaaggacgugaccagagagagcggcaucagagaccugauccccggcagcgugaucgacgccaccauguucaaccccugcggcuacagcaugaacggcaugaagagcgacggcaccuacuggaccauccacaucacccccgagcccgaguucagcuacgugagcuucgagaccaaccugagccagaccagcuacgacgaccugaucagaaaggugguggagguguucaagcccggcaaguucgugaccacccuguucgugaaccagagcagcaagugcagaaccgugcuggccagcccccagaagaucgagggcuucaagagacuggacugccagagcgccauguucaacgacuacaacuucguguucaccagcuucgccaagaagcagcagcagcagcagagcuaa

SEQ ID NO: 13545 - RNA, 576 nt, Artificial Sequence
  AMELX__Homo_sapiens__NP_001133
augggcaccuggauccuguucgccugccugcugggcgccgccuucgccaugccccugcccccccaccccggccaccccggcuacaucaacuucagcuacgaggugcugaccccccugaagugguaccagagcaucagaccccccuaccccagcuacggcuacgagcccaugggcggcuggcugcaccaccagaucauccccgugcugagccagcagcacccccccacccacacccugcagccccaccaccacauccccguggugcccgcccagcagcccgugaucccccagcagcccaugaugcccgugcccggccagcacagcaugacccccauccagcaccaccagcccaaccugcccccccccgcccagcagcccuaccagccccagcccgugcagccccagccccaccagcccaugcagccccagccccccgugcaccccaugcagccccugcccccccagcccccccugccccccauguuccccaugcagccccugccccccaugcugcccgaccugacccuggaggccuggcccagcaccgacaagaccaagagagaggagguggacuaa

SEQ ID NO: 13546 - RNA, 579 nt, Artificial Sequence
  AMELY__Homo_sapiens__NP_001134
augggcaccuggauccuguucgccugccuggugggcgccgccuucgccaugccccugcccccccaccccggccaccccggcuacaucaacuucagcuacgaggugcugaccccccugaagugguaccagagcaugaucagaccccccuacagcagcuacggcuacgagcccaugggcggcuggcugcaccaccagaucauccccguggugagccagcagcacccccugacccacacccugcagagccaccaccacauccccguggugcccgcccagcagcccagagugagacagcaggcccugaugcccgugcccggccagcagagcaugacccccacccagcaccaccagcccaaccugccccugcccgcccagcagcccuuccagccccagcccgugcagccccagccccaccagcccaugcagccccagccccccgugcagcccaugcagccccugcugccccagcccccccugccccccauguucccccugagaccccugccccccauccugcccgaccugcaccuggaggccuggcccgccaccgacaagaccaagcaggaggagguggacuaa

SEQ ID NO: 13547 - RNA, 3408 nt, Artificial Sequence
  AMER1__Homo_sapiens__NP_689637
auggagacccagaaggacgaggccgcccaggccaagggcgccgccgccagcggcagcaccagagagcagaccgccgagaagggcgccaagaacaaggccgccgaggccaccgagggccccaccagcgagcccagcagcagcggccccggcagacugaagaagaccgccaugaagcuguucggcggcaagaagggcaucugcacccugcccagcuucuucggcggcggcagaagcaagggcagcggcaagggcagcagcaagaagggccugagcaagagcaagacccacgacggccugagcgaggccgcccacggccccgaggacguggugagcgagggcaccggcuucagccugccccugcccgagcugcccugccaguuccccagcagccagagcgcccacggcgcccuggagaccggcagcagaugcaagaccagcguggccggcgccaccgagaaggccguggccgagaaguuccccagcaugcccaagcccaagaagggccugaagggcuucuucagcagcaucagaagacacagaaagagcaaggugaccggcgccgagcagagcgagcccggcgccaagggccccgagagagugagagccagaccccacgagcacgugagcagcgccccccaggugcccugcuucgaggagaccuuccaggcccccagaaaggagaacgccaacccccaggacgcccccggccccaaggugagccccacccccgagcccagcccccccgccaccgagaagauggccugcaaggaccccgagaagcccauggaggccugcgccagcgcccacgugcagcccaagcccgcccccgaggccagcagccuggaggagccccacagccccgagaccggcgagaaggugguggccggcgaggugaacccccccaacggccccgugggcgacccccugagccugcuguucggcgacgugaccagccugaagagcuucgacagccugaccggcugcggcgacaucaucgccgagcaggacauggacagcaugaccgacagcauggccagcggcggccagagagccaacagagacggcaccaagagaagcagcugccuggugaccuaccagggcggcggcgaggagauggcccugcccgacgacgacgacgaggaggaggaggaggaggaggagguggagcuggaggaggaggaggaggaggugaaggaggaggaggaggacgacgaccuggaguaccugugggagaccgcccagauguaccccagacccaacaugaaccugggcuaccaccccaccaccagccccggccaccacggcuacaugcugcuggaccccgugagaagcuaccccggccuggcccccggcgagcugcugaccccccagagcgaccagcaggagagcgcccccaacagcgacgagggcuacuacgacagcaccacccccggcuucgaggacgacagcggcgaggcccugggccuggugagaagagacugccugcccagagacagcuacagcggcgacgcccuguacgaguucuacgagcccgacgacagccuggagaacagcccccccggcgacgacugccuguacgaccugcacggcagaagcagcgagauguucgaccccuuccugaacuucgagcccuuccugagcagcagaccccccggcgccauggagaccgaggaggagagacuggugaccauccagaagcagcugcuguacugggagcugagaagagagcagcuggaggcccaggaggccagagccagagaggcccacgccagagaggcccacgccagagaggccuacaccagagaggccuacggcagagaggccuacgccagagaggcccacaccugggaggcccacggcagagaggccagaaccagagaggcccaggccagagaggugagaugcagagagacccaggugagagagacccaggccagacaggagaagcccgugcuggaguaccagaugagaccccugggccccagcgugaugggccuggccgccggcgugagcggcaccagccagaucagccacagaggcaucaccagcgccuuccccaccaccgccagcagcgagcccgacuggagagacuucagaccccuggagaagagauacgagggcaccugcagcaagaaggaccagagcaccugccugaugcagcuguuccagagcgacgccauguucgagcccgacaugcaggaggccaacuucggcggcagccccagaagagccuaccccaccuacagcccccccgaggaccccgaggaggaggagguggagaaggagggcaacgccaccgugagcuucagccaggcccugguggaguucaccagcaacggcaaccuguucagcagcaugagcugcagcagcgacagcgacagcagcuucacccagaaccugcccgagcugccccccauggugaccuucgacaucgccgacguggagagagacggcgagggcaagugcgaggagaaccccgaguuccacaacgacgaggaccuggccgccagccuggaggccuucgagcugggcuacuaccacaagcacgccuucaacaacuaccacagcagauucuaccagggccugcccuggggcgugagcagccugcccagauaccugggccugcccggccugcaccccagacccccccccgccgccauggcccugaacagaagaagcagaagccuggacaccgccgagacccuggagauggagcugagcaacagccaccuggugcagggcuaccuggagagcgacgagcugcaggcccagcaggaggacagcgacgaggaggacgaggaggaggaggagggcgaguggagcagagacagcccccugagccuguacaccgagccccccggcgccuacgacuggcccgccugggcccccugcccccugcccgugggccccggccccgccuggaucagccccaaccagcuggacagacccagcagccagagccccuacagacaggccaccugcugcaucccccccaugaccaugagcaucagccugagcgugcccgagagcagagcccccggcgagagcggcccccagcuggccagacccagccaccugcaccugcccaugggccccugcuacaaccugcagccccaggccagccagagcaugagagccagacccagagacgugcugcugcccguggacgagcccagcugcagcagcagcagcggcggcuucagccccagcccccugccccaggccaagcccgugggcaucacccacggcaucccccagcugcccagagugagacccgagcacccccagccccagcccacccacuacggccccagcagccuggaccugagcaaggagagagccgagcagggcgccagccuggccaccagcuacagcagcaccgccaugaacggcaaccuggccaaguaa

SEQ ID NO: 13548 - RNA, 2016 nt, Artificial Sequence
  AMER2__Homo_sapiens__NP_689917
auggagaccagcagaagcagaggcggcggcggcgccgugagcgagagaggcggcgccggcgccagcgugggcgugugcagaagaaaggccgaggccggcgccggcaccggcacccuggccgccgacauggaccugcacugcgacugcgccgccgagacccccgccgccgagccccccagcggcaagaucaacaaggccgccuucaagcuguucaagaagagaaagagcggcggcaccaugcccagcaucuucggcgugaagaacaagggcgacggcaagagcagcggccccaccggccuggugagaagcagaacccacgacggccuggccgaggugcuggugcuggagagcggcagaaaggaggagcccagaggcggcggcgacagcggcggcggcggcggcggcagacccaaccccggcccccccagagccgccggccccggcggcggcagccuggccagcagcagcguggccaagagccacagcuucuucagccugcugaagaagaacggcagaagcgagaacggcaagggcgagcccguggacgccagcaaggccggcggcaagcagaagagaggccugagaggccuguucagcggcaugagauggcacagaaaggacaagagagccaaggccgaggccgccgagggcagagcccccggcggcggccugauccugcccggcagccugaccgccagccuggagugcgugaaggaggagacccccagagccgccagagagcccgaggagcccagccaggacgcccccagagaccccgccggcgagcccgccggcggcgaggaggugcccgcccccgccgacagagcccccgccagaagcugcagagaggccgagggccuggcccaccccggcgacaccggcgccagaggcgaggacgccgccggccacagaagagccgagcccggccccggcgaggugagaaccgccgaggacgccagcagaaccggcgccgugcccgugaagaccgugccccugguggacagcgagggcggcagcggcagagcccccgccgcccccgaccccgccagcguggacccccccagcgaccccagcgccgacagaaucugccugauguucagcgacgugaccagccugaagagcuucgacagccugaccggcugcggcgacaucaucgccgaccaggaggaggaggccggccccagcugcgacaagcacgugcccggccccggcaagcccgcccugagcaagaagaaccccggcgugguggccuaccagggcggcggcgaggagauggccagccccgacgagguggacgacaccuaccugcaggaguucugggacaugcugagccagaccgaggagcagggccccgagccccaggagggcgccgccaagguggccgccgcccuggagaccaagguggugcccgagacccccaaggacaccagaugcguggaggccgccaaggacgccagcagcgugaagagaagaagacugaacagaauccccaucgagccccaccccaaggaggagcccaagcaccccgagaaggagcagcaggagggcgugcccaacagcgacgagggcuacugggacagcaccacccccggccccgaggaggacagcagcagcagcggcaagaaggccggcauccccagagacagcuacagcggcgacgcccuguacgaccuguacgccgaccccgacggcagccccgccacccugcccggcggcaaggacaacgaggagaccagcagccugagcagacugaagcccgugagccccggcaccaucaccugcccccugagaacccccggcagccugcugaaggacagcaagauccccaucagcaucaagcaccugaccaaccugcccagcagccaccccguggugcaccagcagcccagcagaagcgagaugcccagaaccaagauccccgugagcaaggugcuggugagaagagugagcaacagaggccuggccggcaccaccaucagagccaccgccugccacgacagcgccaagaagcuguaa

SEQ ID NO: 13549 - RNA, 2586 nt, Artificial Sequence
  AMER3__Homo_sapiens__NP_001098663
auggagcugaagagaggcaagaccuucaucaagagcagccugcaggugagccacgagaagccccccgaccccgccgccguggccgccgccagagagggcaccggccccuggagcgugcugcccggcggccagcagagaccccacagcgagaagggcccccaggccagccccagcgcccaggaguacgacagaugccccaacaagggcgcccagcuggaccccaagggcggccccgccgcccugugcggcgccaccuucaagcccgugagaaagugcaagacccacgacagcaugagcggcgccggcagagccaccgccgccaccggccagcuggugggcagcgccagcuuccccggcagccccggcagcagaagaaugaucgacuacagacacuucgugccccagaugcccuucgugcccgccguggccaagagcauccccagaaagagaaucagccugaagagacccaagaagugcuucagaaaccuguuccacaucagaagaaacaagaccgaggaccuggccagccuggccgccgagggcaagagccugcccagccccggcgaccccagcgaccccggcggcagaagaagcaaggccuuccugccccccggcgagggccccggccuggacggccugugccaggaccugcuggacagcgagcugcuggccgacgccagcuucggccugugcagagcccugugcgaggacguggccagccugcagagcuucgacagccugaccggcugcggcgagguguucgccgacgagagcagcgugcccagccuggagcugaacgagggccccgagagccccacccaggccgcccagggccuggagagcaaggugcccagaggcccccugcagggcagcguggagcagcuggccagccccgcccagaacgaggccagcgacuucaccagauucugggacagcgugaacagaagcgugagacagcagcagagagcccugcugggccccuggcugagcggcccccagggcaccgacagagaccagagcagacuggacaccgccggccuggccgagcugccccugugccccugcagagaccccagaagcggcagcaaggccagcagcaucgacaccggcacccccaagagcgagcagcccgagagcgugagcaccagcgacgagggcuacuacgacagcuucagccccggccuggaggaggacaagaaggaggccgagagccccggcacccccgccgccaccuuccccagagacagcuacagcggcgacgcccuguacgagcuguuccacgaccccagcgagggcccccugggccccagccccgacgacgaccugugcgugagcgagagccugagcggccccgcccugggcaccccccugagcaucugcagcuucagagugggcgccgaggagaaccuggcccccgcccccggccccgaccugcugagccagggcuuccugcagagcagcuggaagggcaaggagugccugcugaagcugugcgacaccgagcuggccaucaccaugggcaucgugagcuggcugagaagaggccccacccccagagccccccccacccccggccagcccgccgccccccccggcagccagggcgcccccagagcccccaccgagaagcugggcggcagagagggccuggccagcgacgccggcggcgccaccgugugcagcgcccccagcagacaggagcugugggcccaccccggcaccaccggccugcuggccggcgagagcaaggcccugggcggcgccacccagggcaccggcacccugagcagagacgccagcagagaggaggagaccagaggccacagcgagggccuguucagcagcauggagagcgccgccaccagcaccaccgacaccagcggcaagaacaaggcccccgugcccagcaccuggcccugcagccagaaggagcccggcccccccggcgugcugggcugcuucagaggccccuggagacccggccacggcggcgacacccuggacgccgagcccaugcuggccggcugcguggccagaguggccgcccugaagaucagcagcaacgagcagccccccgccgccuggccccccagacaggacaugggcagcggccuguucggccagagaugggccagaggccccgacaugcuggagcagaagcagagcagcagcagccccagcaugaccaccauccacggccugcccuacagcgccagcacccaggaccagagaugcagagacagagugcaggaccugagcuggcugagaguggagcccaccggccugggcgugcaggccugggccagcguggaggaccagccccugcagcugagcaccgaggccguggagcagguggcccacggcagccagcuggacagcgagcccagaagcgcccccgccgccagauggagcagccagggccaccaccccgagagccugggccugacccugaacagccagcaggagggcggcgugagcgccagcgcccccgagugcagaugcagccugcuggccagagagggccugcugugcggccagcccgaggugggcgccagcggccccgccauggccgagccccaccuguaa

SEQ ID NO: 13550 - RNA, 1932 nt, Artificial Sequence
  AMFR__Homo_sapiens__NP_001135
augccccugcuguuccuggagagauuccccuggcccagccugagaaccuacaccggccugagcggccuggcccugcugggcaccaucaucagcgccuacagagcccugagccagcccgaggccggccccggcgagcccgaccagcugaccgccagccugcagcccgagccccccgcccccgccagacccagcgccggcggccccagagccagagacguggcccaguaccugcugagcgacagccuguucgugugggugcuggugaacaccgccugcugcgugcugaugcugguggccaagcugauccagugcaucguguucggcccccugagagugagcgagagacagcaccugaaggacaaguucuggaacuucaucuucuacaaguucaucuucaucuucggcgugcugaacgugcagaccguggaggagguggugauguggugccugugguucgccggccugguguuccugcaccugauggugcagcugugcaaggacagauucgaguaccugagcuucagccccaccacccccaugagcagccacggcagagugcugagccugcugguggccaugcugcugagcugcugcggccuggccgccgugugcagcaucaccggcuacacccacggcaugcacacccuggccuucauggccgccgagagccugcuggugaccgugagaaccgcccacgugauccugagauacgugauccaccugugggaccugaaccacgagggcaccugggagggcaagggcaccuacguguacuacaccgacuucgugauggagcugacccugcugagccuggaccugaugcaccacauccacaugcugcuguucggcaacaucuggcugagcauggccagccuggugaucuucaugcagcugagauaccuguuccacgaggugcagagaagaaucagaagacacaagaacuaccugagaguggugggcaacauggaggccagauucgccguggccacccccgaggagcuggccgugaacaacgacgacugcgccaucugcugggacagcaugcaggccgccagaaagcugcccugcggccaccuguuccacaacagcugccugagaagcuggcuggagcaggacaccagcugccccaccugcagaaugagccugaacaucgccgacaacaacagagugagagaggagcaccagggcgagaaccuggacgagaaccuggugcccguggccgccgccgagggcagacccagacugaaccagcacaaccacuucuuccacuucgacggcagcagaaucgccagcuggcugcccagcuucagcguggaggugaugcacaccaccaacauccugggcaucacccaggccagcaacagccagcugaacgccauggcccaccagauccaggagauguucccccaggugcccuaccaccuggugcugcaggaccugcagcugaccagaagcguggagaucaccaccgacaacauccuggagggcagaauccaggugcccuuccccacccagagaagcgacagcaucagacccgcccugaacagccccguggagagacccagcagcgaccaggaggagggcgagaccagcgcccagaccgagagagugccccuggaccugagccccagacuggaggagacccuggacuucggcgagguggagguggagcccagcgagguggaggacuucgaggccagaggcagcagauucagcaagagcgccgacgagagacagagaaugcuggugcagagaaaggacgagcugcugcagcaggccagaaagagauuccugaacaagagcagcgaggacgacgccgccagcgagagcuuccugcccagcgagggcgccagcagcgaccccgugacccugagaagaagaaugcuggccgccgccgccgagagaagacugcagaagcagcagaccagcuaa

SEQ ID NO: 13551 - RNA, 1683 nt, Artificial Sequence
  AMH__Homo_sapiens__NP_000470
augagagaccugccccugaccagccuggcccuggugcugagcgcccugggcgcccugcugggcaccgaggcccugagagccgaggagcccgccgugggcaccagcggccugaucuucagagaggaccuggacuggccccccggcagcccccaggagccccugugccugguggcccugggcggcgacagcaacggcagcagcagcccccugagaguggugggcgcccugagcgccuacgagcaggccuuccugggcgccgugcagagagccagauggggccccagagaccuggccaccuucggcgugugcaacaccggcgacagacaggccgcccugcccagccugagaagacugggcgccuggcugagagaccccggcggccagagacugguggugcugcaccuggaggaggugaccugggagcccacccccagccugagauuccaggagcccccccccggcggcgccggcccccccgagcuggcccugcuggugcuguaccccggccccggccccgaggugaccgugaccagagccggccugcccggcgcccagagccugugccccagcagagacaccagauaccuggugcuggccguggacagacccgccggcgccuggagaggcagcggccuggcccugacccugcagcccagaggcgaggacagcagacugagcaccgccagacugcaggcccugcuguucggcgacgaccacagaugcuucaccagaaugacccccgcccugcugcugcugcccagaagcgagcccgccccccugcccgcccacggccagcuggacaccgugcccuuccccccccccagacccagcgccgagcuggaggagagcccccccagcgccgaccccuuccuggagacccugaccagacuggugagagcccugagagugccccccgccagagccagcgcccccagacuggcccuggaccccgacgcccuggccggcuucccccagggccuggugaaccugagcgaccccgccgcccuggagagacugcuggacggcgaggagccccugcugcugcugcugagacccaccgccgccaccaccggcgaccccgccccccugcacgaccccaccagcgcccccugggccaccgcccuggccagaagaguggccgccgagcugcaggccgccgccgccgagcugagaagccugcccggccugccccccgccaccgccccccugcuggccagacugcuggcccugugccccggcggccccggcggccugggcgacccccugagagcccugcugcugcugaaggcccugcagggccugagaguggaguggagaggcagagaccccagaggccccggcagagcccagagaagcgccggcgccaccgccgccgacggccccugcgcccugagagagcugagcguggaccugagagccgagagaagcgugcugauccccgagaccuaccaggccaacaacugccagggcgugugcggcuggccccagagcgacagaaaccccagauacggcaaccacguggugcugcugcugaagaugcaggccagaggcgccgcccuggccagaccccccugcugcgugcccaccgccuacgccggcaagcugcugaucagccugagcgaggagagaaucagcgcccaccacgugcccaacaugguggccaccgagugcggcugcagauaa

SEQ ID NO: 13552 - RNA, 1437 nt, Artificial Sequence
  AMHR2__Homo_sapiens__NP_001158162
augcugggcagccugggccugugggcccugcugcccaccgccguggaggccccccccaacagaagaaccugcguguucuucgaggcccccggcgugagaggcagcaccaagacccugggcgagcugcuggacaccggcaccgagcugcccagagccaucagaugccuguacagcagaugcugcuucggcaucuggaaccugacccaggacagagcccagguggagaugcagggcugcagagacagcgacgagcccggcugcgagagccugcacugcgaccccagccccagagcccaccccagccccggcagcacccuguucaccugcagcugcggcaccgacuucugcaacgccaacuacagccaccugcccccccccggcagccccggcacccccggcagccagggcccccaggccgcccccggcgagagcaucuggauggcccuggugcugcugggccuguuccugcugcugcugcugcugcugggcagcaucauccuggcccugcugcagagaaagaacuacagagugagaggcgagcccgugcccgagcccagacccgacagcggcagagacuggagcguggagcugcaggagcugcccgagcugugcuucagccaggugaucagagagggcggccacgccguggugugggccggccagcugcagggcaagcugguggccaucaaggccuucccccccagaagcguggcccaguuccaggccgagagagcccuguacgagcugcccggccugcagcacgaccacaucgugagauucaucaccgccagcagaggcggccccggcagacugcugagcggcccccugcuggugcuggagcugcaccccaagggcagccugugccacuaccugacccaguacaccagcgacuggggcagcagccugagaauggcccugagccuggcccagggccuggccuuccugcacgaggagagauggcagaacggccaguacaagcccggcaucgcccacagagaccugagcagccagaacgugcugaucagagaggacggcagcugcgccaucggcgaccugggccuggcccuggugcugcccggccugacccagccccccgccuggacccccacccagccccagggccccgccgccaucauggaggccggcacccagagauacauggcccccgagcugcuggacaagacccuggaccugcaggacuggggcauggcccugagaagagccgacaucuacagccuggcccugcugcugugggagauccugagcagaugccccgaccugagacccgccgugcaccaccccagcaacuggcccaugagacagaacugggccaucccccugccccugaugagcuacggccccuggcagugcagaagaggcggcgugcccaccagccacccccccggcgccgcccugccccagacccugaugggcuaa

SEQ ID NO: 13553 - RNA, 1185 nt, Artificial Sequence
  AMICA1__Homo_sapiens__NP_001091996
auguucugcccccugaagcugauccugcugcccgugcugcuggacuacagccugggccugaacgaccugaacgugagcccccccgagcugaccgugcacgugggcgacagcgcccugaugggcugcguguuccagagcaccgaggacaagugcaucuucaagaucgacuggacccugagccccggcgagcacgccaaggacgaguacgugcuguacuacuacagcaaccugagcgugcccaucggcagauuccagaacagagugcaccugaugggcgacauccugugcaacgacggcagccugcugcugcaggacgugcaggaggccgaccagggcaccuacaucugcgagaucagacugaagggcgagagccagguguucaagaaggccguggugcugcacgugcugcccgaggagcccaaggagcugauggugcacgugggcggccugauccagaugggcugcguguuccagagcaccgaggugaagcacgugaccaagguggaguggaucuucagcggcagaagagccaaggaggagaucguguucagauacuaccacaagcugagaaugagcguggaguacagccagagcuggggccacuuccagaacagagugaaccuggugggcgacaucuucagaaacgacggcagcaucaugcugcagggcgugagagagagcgacggcggcaacuacaccugcagcauccaccugggcaaccugguguucaagaagaccaucgugcugcacgugagccccgaggagcccagaacccuggugacccccgccgcccugagaccccuggugcugggcggcaaccagcuggugaucaucgugggcaucgugugcgccaccauccugcugcugcccgugcugauccugaucgugaagaagaccugcggcaacaagagcagcgugaacagcaccgugcuggugaagaacaccaagaagaccaaccccgagaucaaggagaagcccugccacuucgagagaugcgagggcgagaagcacaucuacagccccaucaucgugagagaggugaucgaggaggaggagcccagcgagaagagcgaggccaccuacaugaccaugcaccccguguggcccagccugagaagcgacagaaacaacagccuggagaagaagagcggcggcggcaugcccaagacccagcaggccuucuaa

SEQ ID NO: 13554 - RNA, 1569 nt, Artificial Sequence
  AMIGO2__Homo_sapiens__NP_862830
augagccugagagugcacacccugcccacccugcugggcgccguggugagacccggcugcagagagcugcugugccugcugaugaucaccgugaccgugggccccggcgccagcggcgugugccccaccgccugcaucugcgccaccgacaucgugagcugcaccaacaagaaccugagcaaggugcccggcaaccuguucagacugaucaagagacuggaccugagcuacaacagaaucggccugcuggacagcgaguggauccccgugagcuucgccaagcugaacacccugauccugagacacaacaacaucaccagcaucagcaccggcagcuucagcaccacccccaaccugaagugccuggaccugagcagcaacaagcugaagaccgugaagaacgccguguuccaggagcugaaggugcuggaggugcugcugcuguacaacaaccacaucagcuaccuggaccccagcgccuucggcggccugagccagcugcagaagcuguaccugagcggcaacuuccugacccaguuccccauggaccuguacgugggcagauucaagcuggccgagcugauguuccuggacgugagcuacaacagaauccccagcaugcccaugcaccacaucaaccuggugcccggcaagcagcugagaggcaucuaccugcacggcaaccccuucgugugcgacugcagccuguacagccugcugguguucugguacagaagacacuucagcagcgugauggacuucaagaacgacuacaccugcagacuguggagcgacagcagacacagcagacaggugcugcugcugcaggacagcuucaugaacugcagcgacagcaucaucaacggcagcuucagagcccugggcuucauccacgaggcccaggugggcgagagacugauggugcacugcgacagcaagaccggcaacgccaacaccgacuucaucugggugggccccgacaacagacugcuggagcccgacaaggagauggagaacuucuacguguuccacaacggcagccuggugaucgagagccccagauucgaggacgccggcguguacagcugcaucgccaugaacaagcagagacugcugaacgagaccguggacgugaccaucaacgugagcaacuucaccgugagcagaagccacgcccacgaggccuucaacaccgccuucaccacccuggccgccugcguggccagcaucgugcuggugcugcuguaccuguaccugacccccugccccugcaagugcaagaccaagagacagaagaacaugcugcaccagagcaacgcccacagcagcauccugagccccggccccgccagcgacgccagcgccgacgagagaaaggccggcgccggcaagagagugguguuccuggagccccugaaggacaccgccgccggccagaacggcaaggugagacuguuccccagcgaggccgugaucgccgagggcauccugaagagcaccagaggcaagagcgacagcgacagcgugaacagcguguucagcgacacccccuucguggccagcaccuaa

SEQ ID NO: 13555 - RNA, 891 nt, Artificial Sequence
  AMMECR1__Homo_sapiens__NP_001020751
auggccgccggcugcugcggcgugaagaagcagaagcugagcagcagcccccccagcggcagcggcggcggcggcggcgccagcagcagcagccacugcagcggcgagagccagugcagagccggcgagcugggccugggcggcgccggcaccagacugaacggccugggcggccugaccggcggcggcagcggcagcggcugcacccugagccccccccagggcugcggcggcggcggcggcggcaucgcccugagccccccccccagcugcggcgugggcacccugcugagcacccccgccgccgccaccagcagcagccccagcagcagcagcgccgccagcagcagcagccccggcagcagaaagaugguggugagcgccgagaugugcugcuucugcuucgacgugcuguacugccaccuguacggcuaccagcagcccagaacccccagauucaccaacgagcccuacgcccugaaggacagcagauucccccccaugaccagagacgagcugcccagacuguucugcagcgugagccugcugaccaacuucgaggacgugugcgacuaccuggacugggaggugggcgugcacggcaucagaaucgaguucaucaacgagaagggcagcaagagaaccgccaccuaccugcccgagguggccaaggagcagggcugggaccacauccagaccaucgacagccugcugagaaagggcggcuacaaggcccccaucaccaacgaguucagaaagaccaucaagcugaccagauacagaagcgagaagaugacccugagcuacgccgaguaccuggcccacagacagcaccaccacuuccagaacggcaucggccacccccugccccccuacaaccacuacagcuaa

SEQ ID NO: 13556 - RNA, 1362 nt, Artificial Sequence
  AMN__Homo_sapiens__NP_112205
augggcgugcugggcagagugcugcuguggcugcagcugugcgcccugacccaggccgugagcaagcugugggugcccaacaccgacuucgacguggccgccaacuggagccagaacagaacccccugcgccggcggcgccguggaguuccccgccgacaagauggugagcgugcuggugcaggagggccacgccgugagcgacaugcugcugccccuggacggcgagcuggugcuggccagcggcgccggcuucggcgugagcgacgugggcagccaccuggacugcggcgccggcgagcccgccguguucagagacagcgacagauucagcuggcacgacccccaccuguggagaagcggcgacgaggcccccggccuguucuucguggacgccgagagagugcccugcagacacgacgacguguucuucccccccagcgccagcuucagagugggccugggccccggcgccagccccgugagagugagaagcaucagcgcccugggcagaaccuucaccagagacgaggaccuggccguguuccuggccagcagagccggcagacugagauuccacggccccggcgcccugagcgugggccccgaggacugcgccgaccccagcggcugcgugugcggcaacgccgaggcccagcccuggaucugcgccgcccugcugcagccccugggcggcagaugcccccaggccgccugccacagcgcccugagaccccagggccagugcugcgaccugugcggcgccguggugcugcugacccacggccccgccuucgaccuggagagauacagagccagaauccuggacaccuuccugggccugccccaguaccacggccugcagguggccgugagcaaggugcccagaagcagcagacugagagaggccgacaccgagauccagguggugcugguggagaacggccccgagaccggcggcgccggcagacuggccagagcccugcuggccgacguggccgagaacggcgaggcccugggcgugcuggaggccaccaugagagagagcggcgcccacguguggggcagcagcgccgccggccuggccggcggcguggccgccgccgugcugcuggcccugcuggugcugcugguggcccccccccugcugagaagagccggcagacugagauggagaagacacgaggccgccgcccccgccggcgccccccugggcuucagaaaccccguguucgacgugaccgccagcgaggagcugccccugcccagaagacugagccuggugcccaaggccgccgccgacagcaccagccacagcuacuucgugaacccccuguucgccggcgccgaggccgaggccuaa

SEQ ID NO: 13557 - RNA, 2028 nt, Artificial Sequence
  AMOT__Homo_sapiens__XP_005262147
augcccagagcccagcccagcagcgccagcuaccagcccgugcccgccgaccccuucgccaucgugagcagagcccagcagaugguggagauccugagcgacgagaacagaaaccugagacaggagcuggagggcugcuacgagaagguggccagacugcagaagguggagaccgagauccagagagugagcgaggccuacgagaaccuggugaagagcagcagcaagagagaggcccuggagaaggccaugagaaacaagcuggagggcgagaucagaagaaugcacgacuucaacagagaccugagagagagacuggagaccgccaacaagcagcuggccgagaaggaguacgagggcagcgaggacaccagaaagaccaucagccagcuguucgccaagaacaaggagagccagagagagaaggagaagcuggaggccgagcuggccaccgccagaagcaccaacgaggaccagagaagacacaucgagaucagagaccaggcccugagcaacgcccaggccaagguggugaagcuggaggaggagcugaagaagaagcagguguacguggacaagguggagaagaugcagcaggcccuggugcagcugcaggccgccugcgagaagagagagcagcuggagcacagacugagaaccagacuggagagagagcuggagagccugagaauccagcagagacagggcaacugccagcccaccaacgugagcgaguacaacgccgccgcccugauggagcugcugagagagaaggaggagagaauccuggcccuggaggccgacaugaccaagugggagcagaaguaccuggaggagaacgugaugagacacuucgcccuggacgccgccgccaccguggccgcccagagagacaccaccgugaucagccacagccccaacaccagcuacgacaccgcccuggaggccagaauccagaaggaggaggaggagauccugauggccaacaagagaugccuggacauggagggcagaaucaagacccugcacgcccagaucaucgagaaggacgccaugaucaaggugcugcagcagagaagcagaaaggagcccagcaagaccgagcagcugagcugcaugagacccgccaagagccugaugagcaucagcaacgccggcagcggccugcugagccacagcagcacccugaccggcagccccaucauggaggagaagagagacgacaagagcuggaagggcagccugggcauccugcugggcggcgacuacagagccgaguacgugcccagcacccccagccccgugccccccagcaccccccugcugagcgcccacagcaagaccggcagcagagacugcagcacccagaccgagagaggcaccgagagcaacaagaccgccgccguggcccccaucagcgugcccgcccccguggccgccgccgccaccgccgccgccaucaccgccaccgccgccaccaucaccaccaccaugguggccgccgcccccguggccguggccgccgccgccgcccccgccgccgccgccgcccccagccccgccaccgccgccgccaccgccgccgccgugagccccgccgccgccggccagauccccgccgccgccagcguggccagcgccgccgccguggcccccagcgccgccgccgccgccgccgugcagguggcccccgccgcccccgcccccgugcccgcccccgcccuggugcccgugcccgcccccgccgccgcccaggccagcgcccccgcccagacccaggcccccaccagcgcccccgccguggcccccacccccgcccccacccccacccccgccguggcccaggccgaggugcccgccagccccgccaccggccccggcccccacagacugagcauccccagccugaccugcaaccccgacaagaccgacggccccguguuccacagcaacacccuggagagaaagacccccauccagauccugggccaggagcccgacgccgagaugguggaguaccugaucuaa

SEQ ID NO: 13558 - RNA, 2721 nt, Artificial Sequence
  AMOTL1__Homo_sapiens__NP_001287936
auguggagagccaagcugagaagaggcaccugcgagcccgccgugaagguggaggacccccugugcaacuuccacagccccaacuuccugagaaucagcgagguggagaugagaggcagcgaggacgccgccgccggcaccgugcugcagagacugauccaggagcagcugagauacggcacccccaccgagaacaugaaccugcuggccauccagcaccaggccaccggcagcgccggccccgcccaccccaccaacaacuucagcagcaccgagaaccugacccaggaggacccccagaugguguaccagagcgccagacaggagccccagggccaggagcaccagguggacaacaccgugauggagaagcaggugagaagcacccagccccagcagaacaacgaggagcugcccaccuacgaggaggccaaggcccagagccaguucuucagaggccagcagcagcagcagcagcagcagggcgccgugggccacggcuacuacauggccggcggcaccagccagaagagcagaaccgagggcagacccaccgugaacagagccaacagcggccaggcccacaaggacgaggcccugaaggagcugaagcagggccacgugagaagccugagcgagagaaucaugcagcugagccuggagagaaacggcgccaagcagcaccugcccggcagcggcaacggcaagggcuucaaggugggcggcggccccagccccgcccagcccgccggcaaggugcuggaccccagaggccccccccccgaguaccccuucaagaccaagcagaugaugagccccgugagcaagacccaggagcacggccuguucuacggcgaccagcaccccggcaugcugcacgagauggugaagcccuaccccgccccccagcccgugagaaccgacguggccgugcugagauaccagcccccccccgaguacggcgugaccagcagacccugccagcugcccuuccccagcaccaugcagcagcacagccccaugagcagccagaccagcagcgccagcggcccccugcacagcgugagccugccccugccccugcccauggcccugggcgccccccagcccccccccgccgccagccccagccagcagcugggccccgacgccuucgccaucguggagagagcccagcagaugguggagauccugaccgaggagaacagagugcugcaccaggagcugcagggcuacuacgacaacgccgacaagcugcacaaguucgagaaggagcugcagagaaucagcgaggccuacgagagccuggugaagagcaccaccaagagagagagccuggacaaggccaugagaaacaagcuggagggcgagaucagaagacugcacgacuucaacagagaccugagagacagacuggagaccgccaacagacagcugagcagcagagaguacgagggccacgaggacaaggccgccgagggccacuacgccagccagaacaaggaguuccugaaggagaaggagaagcuggagauggagcuggccgccgugagaaccgccagcgaggaccacagaagacacaucgagauccuggaccaggcccugagcaacgcccaggccagagugaucaagcuggaggaggagcugagagagaagcaggccuacguggagaagguggagaagcugcagcaggcccugacccagcugcagagcgccugcgagaagagagagcagauggagagaagacugagaaccuggcuggagagagagcuggacgcccugagaacccagcagaagcacggcaacggccagcccgccaacaugcccgaguacaacgcccccgcccugcuggagcuggugagagagaaggaggagagaauccuggcccuggaggccgacaugaccaagugggagcagaaguaccuggaggagagcaccaucagacacuucgccaugaacgccgccgccaccgccgccgccgagagagacaccaccaucaucaaccacagcagaaacggcagcuacggcgagagcagccuggaggcccacaucuggcaggaggaggaggagguggugcaggccaacagaagaugccaggacauggaguacaccaucaagaaccugcacgccaagaucaucgagaaggacgccaugaucaaggugcugcagcagagaagcagaaaggacgccggcaagaccgacagcagcagccugagacccgccagaagcgugcccagcaucgccgccgccaccggcacccacagcagacagaccagccugaccagcagccagcuggccgaggagaagaaggaggagaagaccuggaagggcagcaucggccugcugcugggcaaggagcaccacgagcacgccagcgccccccugcugccccccccccccaccagcgcccugagcagcaucgccagcaccaccgccgccagcagcgcccacgccaagaccggcagcaaggacagcagcacccagaccgacaagagcgccgagcuguucuggcccagcauggccagccugcccagcagaggcagacugagcaccacccccgcccacagccccgugcugaagcaccccgccgccaagggcaccgccgagaagcuggagaacagccccggccacggcaagagccccgaccacagaggcagagugagcagccugcugcacaagcccgaguuccccgacggcgagaugauggaggugcugaucuaa

SEQ ID NO: 13559 - RNA, 1785 nt, Artificial Sequence
  AMPD2__Homo_sapiens__XP_011539550
augagaaagcugacccacggcaccggccccagacccagagugggcagcggccagcccuacagaggcgugguggccgcccacguggcccccagaaagagaaagaaguggagaggcggcgugggcagaagaagaagaggccaggccggcgccggccccagagccgccgagcccggcgccgagcccgccagauucugguggggccugaccugcugcgugacccccccccagagcggcagaggcagccccacccugaacgcccagggcgugcugagagagaucuggaccagcuucggcagcagaagccugggcagcaccuggcccaccagccugagcaucgccggccugggcggcagagacaccggcguggcccugagacccgugagacugcccagaagcgccggcgugcaccugagacccgccggcaacuucgagagacugcccuacuucccccaccugagcgccagagccggcgcccugggcgugaccuggcugggcagcguggccagaagccccugcagacccagcggccccggccugagcgccgugcagaccagcagaggccagcccccccugggcaccagagccagcuggccccaggagcuguucaccagaagccuggccgagagcgagcugagaagcgcccccuacgaguuccccgaggagagccccaucgagcagcuggaggagagaagacagagacuggagagacagaucagccaggacgugaagcuggagcccgacauccugcugagagccaagcaggacuuccugaagaccgacagcgacagcgaccugcagcuguacaaggagcagggcgagggccagggcgacagaagccugagagagagagacgugcuggagagagaguuccagagagugaccaucagcggcgaggagaagugcggcgugcccuucaccgaccugcuggacgccgccaagagcguggugagagcccuguucaucagagagaaguacauggcccugagccugcagagcuucugccccaccaccagaagauaccugcagcagcuggccgagaagccccuggagaccagaaccuacgagcagggccccgacacccccgugagcgccgacgcccccgugcacccccccgcccuggagcagcaccccuacgagcacugcgagcccagcaccaugcccggcgaccugggccugggccugagaauggugagaggcguggugcacguguacaccagaagagagcccgacgagcacugcagcgagguggagcugcccuaccccgaccugcaggaguucguggccgacgugaacgugcugauggcccugaucaucaacggccccaucaagagcuucugcuacagaagacugcaguaccugagcagcaaguuccagaugcacgugcugcugaacgagaugaaggagcuggccgcccagaagaaggugccccacagagacuucuacaacaucagaaagguggacacccacauccacgccagcagcugcaugaaccagaagcaccugcugagauucaucaagagagccaugaagagacaccuggaggagaucgugcacguggagcagggcagagagcagacccugagagagguguucgagagcaugaaccugaccgccuacgaccugagcguggacacccuggacgugcacgccgacagaaacaccuuccacagauucgacaaguucaacgccaaguacaaccccaucggcgagagcgugcugagagagaucuucaucaagaccgacaacagagugagcggcaaguacuucgcccacaucaucaaguaa

SEQ ID NO: 13560 - RNA, 2331 nt, Artificial Sequence
  AMPD3__Homo_sapiens__NP_000471
auggcccugagcagcgagcccgccgagaugcccagacaguuccccaagcugaacaucagcgagguggacgagcaggugagacugcuggccgagaagguguucgccaaggugcugagagaggaggacagcaaggacgcccugagccuguucaccgugcccgaggacugccccaucggccagaaggaggccaaggagagagagcugcagaaggagcuggccgagcagaagagcguggagaccgccaagagaaagaagagcuucaagaugaucagaagccagagccugagccugcagaugcccccccagcaggacuggaagggcccccccgccgccagccccgccaugagccccaccacccccguggugaccggcgccaccagccugcccacccccgcccccuacgccaugcccgaguuccagagagugaccaucagcggcgacuacugcgccggcaucacccuggaggacuacgagcaggccgccaagagccuggccaaggcccugaugaucagagagaaguacgccagacuggccuaccacagauuccccagaaucaccagccaguaccugggccaccccagagccgacaccgccccccccgaggagggccugcccgacuuccacccccccccccugccccaggaggaccccuacugccuggacgacgccccccccaaccuggacuaccuggugcacaugcagggcggcauccuguucguguacgacaacaagaagaugcuggagcaccaggagccccacagccugcccuaccccgaccuggagaccuacaccguggacaugagccacauccuggcccugaucaccgacggccccaccaagaccuacugccacagaagacugaacuuccuggagagcaaguucagccugcacgagaugcugaacgagaugagcgaguucaaggagcugaagagcaacccccacagagacuucuacaacgugagaaagguggacacccacauccacgccgccgccugcaugaaccagaagcaccugcugagauucaucaagcacaccuaccagaccgagcccgacagaaccguggccgagaagagaggcagaaagaucacccugagacagguguucgacggccugcacauggaccccuacgaccugaccguggacagccuggacgugcacgccggcagacagaccuuccacagauucgacaaguucaacagcaaguacaaccccgugggcgccagcgagcugagagaccuguaccugaagaccgagaacuaccugggcggcgaguacuucgccagaauggugaaggagguggccagagagcuggaggagagcaaguaccaguacagcgagcccagacugagcaucuacggcagaagccccgaggaguggcccaaccuggccuacugguucauccagcacaagguguacagccccaacaugagauggaucauccaggugcccagaaucuacgacaucuucagaagcaagaagcugcugcccaacuucggcaagaugcuggagaacaucuuccugccccuguucaaggccaccaucaacccccaggaccacagagagcugcaccuguuccugaaguacgugaccggcuucgacagcguggacgacgagagcaagcacagcgaccacauguucagcgacaagagccccaaccccgacguguggaccagcgagcagaacccccccuacagcuacuaccuguacuacauguacgccaacaucauggugcugaacaaccugagaagagagagaggccugagcaccuuccuguucagaccccacugcggcgaggccggcagcaucacccaccuggugagcgccuuccugaccgccgacaacaucagccacggccugcugcugaagaagagccccgugcugcaguaccuguacuaccuggcccagauccccaucgccaugagcccccugagcaacaacagccuguuccuggaguacagcaagaacccccugagagaguuccugcacaagggccugcacgugagccugagcaccgacgaccccaugcaguuccacuacaccaaggaggcccugauggaggaguacgccaucgccgcccagguguggaagcugagcaccugcgaccugugcgagaucgccagaaacagcgugcugcagagcggccugagccaccaggagaagcagaaguuccugggccagaacuacuacaaggagggccccgagggcaacgacaucagaaagaccaacguggcccagaucagaauggccuucagauacgagacccugugcaacgagcugagcuuccugagcgacgccaugaagagcgaggagaucaccgcccugaccaacuaa

SEQ ID NO: 13561 - RNA, 2088 nt, Artificial Sequence
  AMPH__Homo_sapiens__NP_001626
auggccgacaucaagaccggcaucuucgccaagaacgugcagaagagacugaacagagcccaggagaaggugcugcagaagcugggcaaggccgacgagaccaaggacgagcaguucgaggaguacgugcagaacuucaagagacaggaggccgagggcaccagacugcagagagagcugagaggcuaccuggccgccaucaagggcaugcaggaggccagcaugaagcugaccgagagccugcacgagguguacgagcccgacugguacggcagagaggacgugaagauggugggcgagaagugcgacgugcugugggaggacuuccaccagaagcugguggacggcagccugcugacccuggacaccuaccugggccaguuccccgacaucaagaacagaaucgccaagagaagcagaaagcugguggacuacgacagcgccagacaccaccuggaggcccugcagagcagcaagagaaaggacgagagcagaaucagcaaggccgaggaggaguuccagaaggcccagaagguguucgaggaguucaacguggaccugcaggaggagcugcccagccuguggagcagaagagugggcuucuacgugaacaccuucaagaacgugagcagccuggaggccaaguuccacaaggagaucgccgugcugugccacaagcuguacgaggugaugaccaagcugggcgaccagcacgccgacaaggccuucaccauccagggcgcccccagcgacagcggcccccugagaaucgccaagacccccagcccccccgaggagcccagcccccugcccagccccaccgccagccccaaccacacccuggcccccgccagccccgcccccgccagacccagaagccccagccagaccagaaagggcccccccgugcccccccugcccaaggugacccccaccaaggagcugcagcaggagaacaucaucagcuucuucgaggacaacuucgugcccgagaucagcgugaccacccccagccagaacgaggugcccgaggugaagaaggaggagacccugcuggaccuggacuucgaccccuucaagcccgaggugacccccgccggcagcgccggcgugacccacagccccaugagccagacccugcccugggaccuguggaccaccagcaccgaccuggugcagcccgccagcggcggcagcuucaacggcuucacccagccccaggacaccagccuguucaccaugcagaccgaccagagcaugaucugcaaccuggccgagagcgagcaggccccccccaccgagcccaaggccgaggagccccuggccgccgugacccccgccgugggccuggaccugggcauggacaccagagccgaggagcccguggaggaggccgugaucauccccggcgccgacgccgacgccgccgugggcacccuggugagcgccgccgagggcgcccccggcgaggaggccgaggccgagaaggccaccgugcccgccggcgagggcgugagccuggaggaggccaagaucggcaccgagaccaccgagggcgccgagagcgcccagcccgaggccgaggagcuggaggccaccgugccccaggagaaggugauccccagcguggugaucgagcccgccagcaaccacgaggaggagggcgagaacgagaucaccaucggcgccgagcccaaggagaccaccgaggacgccgccccccccggccccaccagcgagacccccgagcuggccaccgagcagaagcccauccaggacccccagcccacccccagcgcccccgccaugggcgccgccgaccagcuggccagcgccagagaggccagccaggagcugccccccggcuuccuguacaagguggagacccugcacgacuucgaggccgccaacagcgacgagcugacccugcagagaggcgacguggugcugguggugcccagcgacagcgaggccgaccaggacgccggcuggcuggugggcgugaaggagagcgacuggcugcaguacagagaccuggccaccuacaagggccuguuccccgagaacuucaccagaagacuggacuaa

SEQ ID NO: 13562 - RNA, 1212 nt, Artificial Sequence
  AMT__Homo_sapiens__NP_000472
augcagagagccgugagcgugguggccagacugggcuucagacugcaggccuucccccccgcccugugcagaccccugagcugcgcccaggaggugcugagaagaaccccccuguacgacuuccaccuggcccacggcggcaagaugguggccuucgccggcuggagccugcccgugcaguacagagacagccacaccgacagccaccugcacaccagacagcacugcagccuguucgacgugagccacaugcugcagaccaagauccugggcagcgacagagugaagcugauggagagccugguggugggcgacaucgccgagcugagacccaaccagggcacccugagccuguucaccaacgaggccggcggcauccuggacgaccugaucgugaccaacaccagcgagggccaccuguacguggugagcaacgccggcugcugggagaaggaccuggcccugaugcaggacaaggugagagagcugcagaaccagggcagagacgugggccuggaggugcuggacaacgcccugcuggcccugcagggccccaccgccgcccaggugcugcaggccggcguggccgacgaccugagaaagcugcccuucaugaccagcgccgugauggagguguucggcgugagcggcugcagagugaccagaugcggcuacaccggcgaggacggcguggagaucagcgugcccguggccggcgccgugcaccuggccaccgccauccugaagaaccccgaggugaagcuggccggccuggccgccagagacagccugagacuggaggccggccugugccuguacggcaacgacaucgacgagcacaccacccccguggagggcagccugagcuggacccugggcaagagaagaagagccgccauggacuuccccggcgccaaggugaucgugccccagcugaagggcagagugcagagaagaagagugggccugaugugcgagggcgcccccaugagagcccacagccccauccugaacauggagggcaccaagaucggcaccgugaccagcggcugccccagccccagccugaagaagaacguggccaugggcuacgugcccugcgaguacagcagacccggcaccaugcugcugguggaggugagaagaaagcagcagauggccguggugagcaagaugcccuucgugcccaccaacuacuacacccugaaguaa

SEQ ID NO: 13563 - RNA, 1497 nt, Artificial Sequence
  AMZ1__Homo_sapiens__XP_011513452
augcugcagugcagacccgcccaggaguucagcuucggccccagagcccugaaggacgcccuggugagcaccgacgccgcccugcagcagcuguacgugagcgccuucagccccgccgagagacuguuccuggccgaggccuacaacccccagagaacccuguucugcacccugcugaucagaaccggcuucgacuggcugcugagcagacccgaggcccccgaggacuuccagaccuuccacgccagccugcagcacagaaagcccagacuggccagaaagcacaucuaccugcagcccaucgaccugagcgaggagcccgugggcagcagccugcugcaccagcugugcagcugcaccgaggccuucuuccugggccugagagugaagugccugcccagcguggccgccgccagcaucagaugcagcagcagacccagcagagacagcgacagacugcagcugcacaccgacggcauccugagcuuccugaagaacaacaagcccggcgacgcccugugcgugcugggccugacccugagcgaccuguacccccacgaggccuggagcuucaccuucagcaaguuccugcccggccacgaggugggcgugugcagcuucgccagauucagcggcgaguuccccaagagcggccccagcgcccccgaccuggcccugguggaggccgccgccgacggccccgaggccccccugcaggacagaggcugggcccugugcuucagcgcccugggcauggugcagugcugcaaggugaccugccacgagcugugccaccugcugggccugggcaacugcagauggcugagaugccugaugcagggcgcccugagccuggacgaggcccugagaagaccccuggaccugugccccaucugccugagaaagcugcagcacgugcugggcuucagacugaucgagagauaccagagacuguacaccuggacccaggccguggugggcaccuggcccagccaggaggccggcgagcccagcgugugggaggacaccccccccgccagcgccgacagcggcaugugcugcgagagcgacagcgagcccggcaccagcgugagcgagccccugacccccgacgccggcagccacaccuucgccagcggccccgaggagggccugagcuaccuggccgccagcgaggccccccugccccccggcggccccgccgaggccaucaaggagcacgagagauggcuggccaugugcauccaggcccugcagagagagguggccgaggaggaccuggugcagguggacagagccguggacgcccuggacagaugggagauguucaccggccagcugcccgccaccagacaggacccccccagcagcagagacagcgugggccugagaaaggugcugggcgacaaguucagcagccugagaagaaagcugagcgccagaaagcuggccagagccgagagcgcccccagacccugggacggcgaggagagcuaa

SEQ ID NO: 13564 - RNA, 591 nt, Artificial Sequence
  ANAPC10__Homo_sapiens__NP_001243638
augggcggcgugaaggagaccaacauccugaagaugaccacccccaacaagaccccccccggcgccgaccccaagcagcuggagagaaccggcaccgugagagagaucggcagccaggccguguggagccugagcagcugcaagcccggcuucggcguggaccagcugagagacgacaaccuggagaccuacuggcagagcgacggcagccagccccaccuggugaacauccaguucagaagaaagaccaccgugaagacccugugcaucuacgccgacuacaagagcgacgagagcuacacccccagcaagaucagcgugagagugggcaacaacuuccacaaccugcaggagaucagacagcuggagcugguggagcccagcggcuggauccacgugccccugaccgacaaccacaagaagcccaccagaaccuucaugauccagaucgccgugcuggccaaccaccagaacggcagagacacccacaugagacagaucaagaucuacacccccguggaggagagcagcaucggcaaguuccccagaugcaccaccaucgacuucaugauguacagaagcaucagauaa

SEQ ID NO: 13565 - RNA, 591 nt, Artificial Sequence
  ANAPC11__Homo_sapiens__NP_001002244
augaaggugaagaucaagugcuggaacggcguggccaccuggcuguggguggccaacgacgagaacugcggcaucugcagaauggccuucaacggcugcugccccgacugcccccugcacggcgagagcaucagcagaugccugggcuggugcccccagcccgugcccgugcugggcggcagagcccacccccaggugcccaucaacaccgccagccccacccccggccagcacaccggcagccugaugagcagagaggagagcagcagaagccccgaccccaccccccccgcccuggaccaggagaccagcagccugcugagaugcaccagccccuggugccuggaccacagcugcgaccuguucggcaucaccgaccaggugagcgccgacggccccagagccugcagacagggcgccagaagaagacugcccgccggcgugggccccgugcugccccugcugccccacgcccugcacccccagguggccgccagaaccgccggcgccgccgcccugccccacgugccccccggcauggaggugcagggcgugagacccgaccuggcccuggccggcggcgccagcuaa

SEQ ID NO: 13566 - RNA, 225 nt, Artificial Sequence
  ANAPC13__Homo_sapiens__NP_001229304
auggacagcgaggugcagagagacggcagaauccuggaccugaucgacgacgccuggagagaggacaagcugcccuacgaggacguggccaucccccugaacgagcugcccgagcccgagcaggacaacggcggcaccaccgagagcgugaaggagcaggagaugaaguggaccgaccuggcccugcaguaccugcacgagaacgugccccccaucggcaacuaa

SEQ ID NO: 13567 - RNA, 5835 nt, Artificial Sequence
  ANAPC1__Homo_sapiens__NP_073153
augagcaacuucuacgaggagagaaccaccaugaucgccgccagagaccugcaggaguucgugcccuucggcagagaccacugcaagcaccaccccaacgcccugaaccugcagcugagacagcugcagcccgccagcgagcuguggagcagcgacggcgccgccggccuggugggcagccugcaggaggugaccauccacgagaagcagaaggagagcuggcagcugagaaagggcgugagcgagaucggcgaggacguggacuacgacgaggagcuguacguggccggcaacauggugaucuggagcaagggcagcaagagccaggcccuggccguguacaaggccuucaccguggacagccccgugcagcaggcccuguggugcgacuucaucaucagccaggacaagagcgagaaggccuacagcagcaacgagguggagaagugcaucugcauccugcagagcagcugcaucaacaugcacagcaucgagggcaaggacuacaucgccagccugcccuuccagguggccaacguguggcccaccaaguacggccugcuguucgagagaagcgccagcagccacgaggugccccccggcagccccagagagccccugcccaccauguucagcaugcugcacccccuggacgagaucaccccccuggugugcaagagcggcagccuguucggcagcagcagagugcaguacgugguggaccacgccaugaagaucguguuccugaacaccgaccccagcaucgugaugaccuacgacgccgugcagaacgugcacagcguguggacccugagaagagugaagagcgaggaggagaacguggugcugaaguucagcgagcagggcggcaccccccagaacguggccaccagcagcagccugaccgcccaccugagaagccugagcaagggcgacagccccgugaccagccccuuccagaacuacagcagcauccacagccagagcagaagcaccagcagccccagccugcacagcagaagccccagcaucagcaacauggccgcccugagcagagcccacagccccgcccugggcgugcacagcuucagcggcgugcagagauucaacaucagcagccacaaccagagccccaagagacacagcaucagccacagccccaacagcaacagcaacggcagcuuccuggcccccgagaccgagcccaucgugcccgagcugugcaucgaccaccuguggaccgagaccaucaccaacaucagagagaagaacagccaggccagcaagguguucaucaccagcgaccugugcggccagaaguuccugugcuuccugguggagagccagcugcagcugagaugcgugaaguuccaggagagcaacgacaagacccagcugaucuucggcagcgugaccaacauccccgccaaggacgccgcccccguggagaagaucgacaccaugcuggugcuggagggcagcggcaaccuggugcuguacaccggcguggugagagugggcaagguguucauccccggccugcccgcccccagccugaccaugagcaacaccaugcccagacccagcaccccccuggacggcgugagcacccccaagccccugagcaagcugcugggcagccuggacgagguggugcugcugagccccgugcccgagcugagagacagcagcaagcugcacgacagccuguacaacgaggacugcaccuuccagcagcugggcaccuacauccacagcaucagagaccccgugcacaacagagugacccuggagcugagcaacggcagcauggugagaaucaccauccccgagaucgccaccagcgagcuggugcagaccugccugcaggccaucaaguucauccugcccaaggagaucgccgugcagaugcuggugaagugguacaacgugcacagcgcccccggcggccccagcuaccacagcgaguggaaccuguucgugaccugccugaugaacaugaugggcuacaacaccgacagacuggccuggaccagaaacuucgacuucgagggcagccugagccccgugaucgcccccaagaaggccagacccagcgagaccggcagcgacgacgacugggaguaccugcugaacagcgacuaccaccagaacguggagagccaccugcugaacagaagccugugccugagccccagcgaggccagccagaugaaggacgaggacuucagccagaaccugagccuggacagcagcacccugcuguucacccacauccccgccaucuucuucgugcugcaccugguguacgaggagcugaagcugaacacccugaugggcgagggcaucugcagccugguggagcugcuggugcagcuggccagagaccugaagcugggccccuacguggaccacuacuacagagacuaccccacccuggugagaaccaccggccaggugugcaccaucgaccccggccagaccggcuucaugcaccaccccagcuucuucaccagcgagccccccagcaucuaccagugggugagcagcugccugaagggcgagggcaugccccccuaccccuaccugcccggcaucugcgagagaagcagacugguggugcugagcaucgcccuguacauccugggcgacgagagccuggugagcgacgagagcagccaguaccugaccagaaucaccaucgccccccagaagcugcagguggagcaggaggagaacagauucagcuucagacacagcaccagcgugagcagccuggccgagagacuggugguguggaugaccaacgugggcuucacccugagagaccuggagacccugcccuucggcaucgcccugcccaucagagacgccaucuaccacugcagagagcagcccgccagcgacuggcccgaggccgugugccugcugaucggcagacaggaccugagcaagcaggccugcgagggcaaccugcccaagggcaagagcgugcugagcagcgacgugcccagcggcaccgagaccgaggaggaggacgacggcaugaacgacaugaaccacgaggugaugagccugaucuggagcgaggaccugagagugcaggacgugagaagacugcugcagagcgcccaccccgugagagugaacguggugcaguaccccgagcugagcgaccacgaguucaucgaggagaaggagaacagacugcugcagcugugccagagaaccauggcccugcccgugggcagaggcauguucacccuguucagcuaccaccccgugcccaccgagccccugcccauccccaagcugaaccugaccggcagagccccccccagaaacaccaccguggaccugaacagcggcaacaucgacgugccccccaacaugaccagcugggccagcuuccacaacggcguggccgccggccugaagaucgcccccgccagccagaucgacagcgccuggaucguguacaacaagcccaagcacgccgagcuggccaacgaguacgccggcuuccugauggcccugggccugaacggccaccugaccaagcuggccacccugaacauccacgacuaccugaccaagggccacgagaugaccagcaucggccugcugcugggcgugagcgccgccaagcugggcaccauggacaugagcaucaccagacugcugagcauccacauccccgcccugcugccccccaccagcaccgagcuggacgugccccacaacgugcagguggccgccguggugggcaucggccugguguaccagggcaccgcccacagacacaccgccgaggugcugcuggccgagaucggcagaccccccggccccgagauggaguacugcaccgacagagagagcuacagccuggccgccggccuggcccugggcauggugugccugggccacggcagcaaccugaucggcaugagcgaccugaacgugcccgagcagcuguaccaguacauggugggcggccacagaagauuccagaccggcaugcacagagagaagcacaagagccccagcuaccagaucaaggagggcgacaccaucaacguggacgugaccugccccggcgccacccuggcccuggccaugaucuaccugaagaccaacaacagaagcaucgccgacuggcugagagcccccgacaccauguaccugcuggacuucgugaagcccgaguuccugcugcugagaacccuggccagaugccugauccugugggacgacauccugcccaacagcaaguggguggacagcaacgugccccagaucaucagagagaacagcaucagccugagcgagaucgagcugcccugcagcgaggaccugaaccuggagacccugagccaggcccacguguacaucaucgccggcgccugccugagccugggcuucagauucgccggcagcgagaaccugagcgccuucaacugccugcacaaguucgccaaggacuucaugaccuaccugagcgcccccaacgccagcgugaccggcccccacaaccuggagaccugccugagcguggugcugcugagccuggccauggugauggccggcagcggcaaccugaaggugcugcagcugugcagauuccugcacaugaagaccggcggcgagaugaacuacggcuuccaccuggcccaccacauggcccugggccugcuguuccugggcggcggcagauacagccugagcaccagcaacagcagcaucgccgcccugcugugcgcccuguacccccacuuccccgcccacagcaccgacaacagauaccaccugcaggcccugagacaccuguacgugcuggccgccgagcccagacugcuggugcccguggacguggacaccaacacccccugcuacgcccugcuggaggugaccuacaagggcacccagugguacgagcagaccaaggaggagcugauggcccccacccugcugcccgagcugcaccugcugaagcagaucaaggugaagggccccagauacugggagcugcugaucgaccugagcaagggcacccagcaccugaagagcauccugagcaaggacggcgugcuguacgugaagcugagagccggccagcugagcuacaaggaggaccccaugggcuggcagagccugcuggcccagaccguggccaacagaaacagcgaggccagagccuucaagcccgagaccaucagcgccuucaccagcgaccccgcccugcugagcuucgccgaguacuucugcaagcccaccgugaacaugggccagaagcaggagauccuggaccuguucagcagcgugcuguacgagugcgugacccaggagacccccgagaugcugcccgccuacaucgccauggaccaggccaucagaagacugggcagaagagagaugagcgagaccagcgagcuguggcagaucaagcuggugcuggaguucuucagcagcagaagccaccaggagagacugcagaaccaccccaagagaggccuguucaugaacagcgaguuccugcccguggugaagugcaccaucgacaacacccuggaccaguggcugcaggugggcggcgacaugugcgugcacgccuaccugagcggccagccccuggaggagagccagcugagcaugcuggccugcuuccugguguaccacagcgugcccgccccccagcaccugccccccaucggccuggagggcagcaccagcuucgccgagcugcuguucaaguucaagcagcugaagaugcccgugagagcccugcugagacuggccccccugcugcugggcaacccccagcccauggugauguaa

SEQ ID NO: 13568 - RNA, 2469 nt, Artificial Sequence
  ANAPC2__Homo_sapiens__NP_037498
auggccgccgccguggugguggccgagggcgacagcgacagcagacccggccaggagcugcugguggccuggaacaccgugagcaccggccuggugccccccgccgcccugggccuggugagcagcagaaccagcggcgccgugccccccaaggaggaggagcugagagccgccguggaggugcugagaggccacggccugcacagcgugcuggaggagugguucguggaggugcugcagaacgaccugcaggccaacaucagccccgaguucuggaacgccaucagccagugcgagaacagcgccgacgagccccagugccugcugcugcugcuggacgccuucggccugcuggagagcagacuggaccccuaccugagaagccuggagcugcuggagaaguggaccagacugggccugcugaugggcaccggcgcccagggccugagagaggaggugcacaccaugcugagaggcgugcuguucuucagcacccccagaaccuuccaggagaugauccagagacuguacggcugcuuccugagaguguacaugcagagcaagagaaagggcgagggcggcaccgaccccgagcuggagggcgagcuggacagcagauacgccagaagaagauacuacagacugcugcagagcccccugugcgccggcugcagcagcgacaagcagcagugcuggugcagacaggcccuggagcaguuccaccagcugagccaggugcugcacagacugagccugcuggagagagugagcgccgaggccgugaccaccacccugcaccaggugaccagagagagaauggaggacagaugcagaggcgaguacgagagaagcuuccugagagaguuccacaaguggaucgagagaguggugggcuggcugggcaagguguuccugcaggacggccccgccagacccgccagccccgaggccggcaacacccugagaagauggagaugccacgugcagagauucuucuacagaaucuacgccagccugagaaucgaggagcuguucagcaucgugagagacuuccccgacagcagacccgccaucgaggaccugaaguacugccuggagagaaccgaccagagacagcagcugcuggugagccugaaggccgcccuggagaccagacugcugcaccccggcgugaacaccugcgacaucaucacccuguacaucagcgccaucaaggcccugagagugcuggaccccagcauggugauccuggagguggccugcgagcccaucagaagauaccugagaaccagagaggacaccgugagacagaucguggccggccugaccggcgacagcgacggcaccggcgaccuggccguggagcugagcaagaccgaccccgccagccuggagaccggccaggacagcgaggacgacagcggcgagcccgaggacugggugcccgaccccguggacgccgaccccggcaagagcagcagcaagagaagaagcagcgacaucaucagccugcuggugagcaucuacggcagcaaggaccuguucaucaacgaguacagaagccugcuggccgacagacugcugcaccaguucagcuucagccccgagagagagaucagaaacguggagcugcugaagcugagauucggcgaggcccccaugcacuucugcgaggugaugcugaaggacauggccgacagcagaagaaucaacgccaacaucagagaggaggacgagaagagacccgccgaggagcagccccccuucggcguguacgccgugauccugagcagcgaguucuggccccccuucaaggacgagaagcuggaggugcccgaggacaucagagccgcccuggaggccuacugcaagaaguacgagcagcugaaggccaugagaacccugagcuggaagcacacccugggccuggugaccauggacguggagcuggccgacagaacccugagcguggccgugacccccgugcaggccgugauccugcuguacuuccaggaccaggccagcuggacccuggaggagcugagcaaggccgugaagaugcccguggcccugcugagaagaagaaugagcguguggcugcagcagggcgugcugagagaggagccccccggcaccuucagcgugaucgaggaggagagaccccaggacagagacaacauggugcugaucgacagcgacgacgagagcgacagcggcauggccagccaggccgaccagaaggaggaggagcugcugcuguucuggaccuacauccaggccaugcugaccaaccuggagagccugagccuggacagaaucuacaacaugcugagaauguucguggugaccggccccgcccuggccgagaucgaccugcaggagcugcagggcuaccugcagaagaaggugagagaccagcagcugguguacagcgccggcguguacagacugcccaagaacugcagcuaa

SEQ ID NO: 13569 - RNA, 2430 nt, Artificial Sequence
  ANAPC4__Homo_sapiens__NP_001273685
augcugagauuccccaccugcuuccccagcuucagaguggugggcgagaagcagcugccccaggagaucaucuuccugguguggagccccaagagagaccugaucgcccuggccaacaccgccggcgaggugcugcugcacagacuggccagcuuccacagaguguggagcuucccccccaacgagaacaccggcaaggaggugaccugccuggccuggagacccgacggcaagcugcuggccuucgcccuggccgacaccaagaagaucgugcugugcgacguggagaagcccgagagccugcacagcuucagcguggaggcccccgugagcugcaugcacuggauggaggugaccguggagagcagcgugcugaccagcuucuacaacgccgaggacgagagcaaccugcugcugcccaagcugcccacccugcccaagaacuacagcaacaccagcaagaucuucagcgaggagaacagcgacgagaucaucaagcugcugggcgacgugagacugaacauccuggugcugggcggcagcagcggcuucaucgagcuguacgccuacggcauguucaagaucgccagagugaccggcaucgccggcaccugccuggcccugugccugagcagcgaccugaagagccugagcguggugaccgaggugagcaccaacggcgccagcgaggugagcuacuuccagcuggagaccaaccugcuguacagcuuccugcccgaggugaccagaauggccagaaaguucacccacaucagcgcccugcugcaguacaucaaccugagccugaccugcaugugcgaggccugggaggagauccugaugcagauggacagcagacugaccaaguucgugcaggagaagaacaccaccaccagcgugcaggacgaguucaugcaccugcugcuguggggcaaggccagcgccgagcugcagacccugcugaugaaccagcugaccgugaagggccugaagaagcugggccagagcaucgagagcagcuacagcagcauccagaagcuggugaucagccaccugcagagcggcagcgagagccugcuguaccaccugagcgagcugaagggcauggccagcuggaagcagaaguacgagccccugggccuggacgccgccggcaucgaggaggccaucaccgccgugggcagcuucauccugaaggccaacgagcugcugcaggugaucgacagcagcaugaagaacuucaaggccuucuucagauggcuguacguggccaugcugagaaugaccgaggaccacgugcugcccgagcugaacaaggugaugacccagaaggacaucaccuucguggccgaguuccugaccgagcacuucaacgaggcccccgaccuguacaacagaaagggcaaguacuucaacguggagagagugggccaguaccugaaggacgaggacgacgaccuggugagcccccccaacaccgagggcaaccagugguacgacuuccugcagaacagcagccaccugaaggagagcccccugcuguuccccuacuaccccagaaagagccugcacuucgugaagagaagaauggagaacaucaucgaccagugccugcagaagcccgccgacgugaucggcaagagcaugaaccaggccaucugcaucccccuguacagagacaccagaagcgaggacagcaccagaagacuguucaaguuccccuuccuguggaacaacaagaccagcaaccugcacuaccugcuguucaccauccuggaggacagccuguacaagaugugcauccugagaagacacaccgacaucagccagagcgugagcaacggccugaucgccaucaaguucggcagcuucaccuacgccaccaccgagaaggugagaagaagcaucuacagcugccuggacgcccaguucuacgacgacgagaccgugaccguggugcugaaggacaccgugggcagagagggcagagacagacugcuggugcagcugccccugagccugguguacaacagcgaggacagcgccgaguaccaguucaccggcaccuacagcaccagacuggacgagcagugcagcgccauccccaccagaaccaugcacuucgagaagcacuggagacugcuggagagcaugaaggcccaguacguggccggcaacggcuucagaaaggugagcugcgugcugagcagcaaccugagacacgugagaguguucgagauggacaucgacgacgagugggagcuggacgagagcagcgacgaggaggaggaggccagcaacaagcccgugaagaucaaggaggaggugcugagcgagagcgaggccgagaaccagcaggccggcgccgccgcccuggcccccgagaucgugaucaagguggagaagcuggaccccgagcuggacagcuaa

SEQ ID NO: 13570 - RNA, 1932 nt, Artificial Sequence
  ANAPC5__Homo_sapiens__NP_001131031
auggccgagggcgagcugaaggacauggagcaguucuucgacgaccugagcgacagcuucagcggcaccgagcccgaggugcacaagaccagcguggugggccuguuccugagacacaugauccuggccuacagcaagcugagcuucagccagguguucaagcuguacaccgcccugcagcaguacuuccagaacggcgagaagaagaccguggaggacgccgacauggagcugaccagcagagacgagggcgagagaaagauggagaaggaggagcuggacgugagcgugagagaggaggaggugagcugcagcggcccccugagccagaagcaggccgaguucuuccugagccagcaggccagccugcugaagaacgacgagaccaaggcccugacccccgccagccugcagaaggagcugaacaaccugcugaaguucaaccccgacuucgccgaggcccacuaccugagcuaccugaacaaccugagagugcaggacguguucagcagcacccacagccugcugcacuacuucgacagacugauccugaccggcgccgagagcaagagcaacggcgaggagggcuacggcagaagccugagauacgccgcccugaaccuggccgcccugcacugcagauucggccacuaccagcaggccgagcuggcccugcaggaggccaucagaaucgcccaggagagcaacgaccacgugugccugcagcacugccugagcuggcuguacgugcugggccagaagagaagcgacagcuacgugcugcuggagcacagcgugaagaaggccgugcacuucggccugcccagagccuucgccggcaagaccgccaacaagcugauggacgcccugaaggacagcgaccugcugcacuggaagcacagccugagcgagcugaucgacaucagcaucgcccagaagaccgccaucuggagacuguacggcagaagcaccauggcccugcagcaggcccagaugcugcugagcaugaacagccuggaggccgugaacgccggcgugcagcagaacaacaccgagagcuucgccguggcccugugccaccuggccgagcugcacgccgagcagggcugcuucgccgccgccagcgaggugcugaagcaccugaaggagagauucccccccaacagccagcacgcccagcuguggaugcugugcgaccagaagauccaguucgacagagccaugaacgacggcaaguaccaccuggccgacagccuggugaccggcaucaccgcccugaacagcaucgagggcguguacagaaaggccguggugcugcaggcccagaaccagaugagcgaggcccacaagcugcugcagaagcugcuggugcacugccagaagcugaagaacaccgagauggugaucagcgugcugcugagcguggccgagcuguacuggagaagcagcagccccaccaucgcccugcccaugcugcugcaggcccuggcccugagcaaggaguacagacugcaguaccuggccagcgagaccgugcugaaccuggccuucgcccagcugauccugggcauccccgagcaggcccugagccugcugcacauggccaucgagcccauccuggccgacggcgccauccuggacaagggcagagccauguuccugguggccaagugccagguggccagcgccgccagcuacgaccagcccaagaaggccgaggcccuggaggccgccaucgagaaccugaacgaggccaagaacuacuucgccaagguggacugcaaggagagaaucagagacgugguguacuuccaggccagacuguaccacacccugggcaagacccaggagagaaacagaugcgccaugcuguucagacagcugcaccaggagcugcccagccacggcgugccccugaucaaccaccuguaa

SEQ ID NO: 13571 - RNA, 1614 nt, Artificial Sequence
  ANAPC7__Homo_sapiens__NP_001131136
auggaccccggcgacgccgccauccuggagagcagccugagaauccuguacagacuguucgagagcgugcugcccccccugcccgccgcccugcagagcagaaugaacgugaucgaccacgugagagacauggccgccgccggccugcacagcaacgugagacugcugagcagccugcugcugaccaugagcaacaacaaccccgagcuguucagccccccccagaaguaccagcugcugguguaccacgccgacagccuguuccacgacaaggaguacagaaacgccgugagcaaguacaccauggcccugcagcagaagaaggcccugagcaagaccagcaaggugagacccagcaccggcaacagcgccagcaccccccagagccagugccugcccagcgagaucgaggugaaguacaagauggccgagugcuacaccaugcugaagcaggacaaggacgccaucgccauccuggacggcauccccagcagacagagaacccccaagaucaacaugaugcuggccaaccuguacaagaaggccggccaggagagacccagcgugaccagcuacaaggaggugcugagacagugcccccuggcccuggacgccauccugggccugcugagccugagcgugaagggcgccgagguggccagcaugaccaugaacgugauccagaccgugcccaaccuggacuggcugagcguguggaucaaggccuacgccuucgugcacaccggcgacaacagcagagccaucagcaccaucugcagccuggagaagaagagccugcugagagacaacguggaccugcugggcagccuggccgaccuguacuucagagccggcgacaacaagaacagcgugcugaaguucgagcaggcccagaugcuggaccccuaccugaucaagggcauggacguguacggcuaccugcuggccagagagggcagacuggaggacguggagaaccugggcugcagacuguucaacaucagcgaccagcacgccgagcccuggguggugagcggcugccacagcuucuacagcaagagauacagcagagcccuguaccugggcgccaaggccauccagcugaacagcaacagcgugcaggcccugcugcugaagggcgccgcccugagaaacaugggcagagugcaggaggccaucauccacuucagagaggccaucagacuggcccccugcagacuggacugcuacgagggccugaucgagugcuaccuggccagcaacagcaucagagaggccauggugauggccaacaacguguacaagacccugggcgccaacgcccagacccugacccugcuggccaccgugugccuggaggaccccgugacccaggagaaggccaagacccugcuggacaaggcccugacccagagacccgacuacaucaaggccguggugaagaaggccgagcugcugagcagagagcagaaguacgaggacggcaucgcccugcugagaaacgcccuggccaaccagagcgacugcgugcugcacagaauccugggcgacuuccugguggccgugaacgaguaccaggaggccauggaccaguacagcaucgcccugagauaa

SEQ ID NO: 13572 - RNA, 444 nt, Artificial Sequence
  ANG__Homo_sapiens__NP_001091046
auggugaugggccugggcgugcugcugcugguguucgugcugggccugggccugaccccccccacccuggcccaggacaacagcagauacacccacuuccugacccagcacuacgacgccaagccccagggcagagacgacagauacugcgagagcaucaugagaagaagaggccugaccagccccugcaaggacaucaacaccuucauccacggcaacaagagaagcaucaaggccaucugcgagaacaagaacggcaacccccacagagagaaccugagaaucagcaagagcagcuuccaggugaccaccugcaagcugcacggcggcagccccuggccccccugccaguacagagccaccgccggcuucagaaacguggugguggccugcgagaacggccugcccgugcaccuggaccagagcaucuucagaagacccuaa

SEQ ID NO: 13573 - RNA, 1497 nt, Artificial Sequence
  ANGPT1__Homo_sapiens__NP_001137
augaccguguuccugagcuucgccuuccuggccgccauccugacccacaucggcugcagcaaccagagaagaagccccgagaacagcggcagaagauacaacagaauccagcacggccagugcgccuacaccuucauccugcccgagcacgacggcaacugcagagagagcaccaccgaccaguacaacaccaacgcccugcagagagacgccccccacguggagcccgacuucagcagccagaagcugcagcaccuggagcacgugauggagaacuacacccaguggcugcagaagcuggagaacuacaucguggagaacaugaagagcgagauggcccagauccagcagaacgccgugcagaaccacaccgccaccaugcuggagaucggcaccagccugcugagccagaccgccgagcagaccagaaagcugaccgacguggagacccaggugcugaaccagaccagcagacuggagauccagcugcuggagaacagccugagcaccuacaagcuggagaagcagcugcugcagcagaccaacgagauccugaagauccacgagaagaacagccugcuggagcacaagauccuggagauggagggcaagcacaaggaggagcuggacacccugaaggaggagaaggagaaccugcagggccuggugaccagacagaccuacaucauccaggagcuggagaagcagcugaacagagccaccaccaacaacagcgugcugcagaagcagcagcuggagcugauggacaccgugcacaaccuggugaaccugugcaccaaggagggcgugcugcugaagggcggcaagagagaggaggagaagcccuucagagacugcgccgacguguaccaggccggcuucaacaagagcggcaucuacaccaucuacaucaacaacaugcccgagcccaagaagguguucugcaacauggacgugaacggcggcggcuggaccgugauccagcacagagaggacggcagccuggacuuccagagaggcuggaaggaguacaagaugggcuucggcaaccccagcggcgaguacuggcugggcaacgaguucaucuucgccaucaccagccagagacaguacaugcugagaaucgagcugauggacugggagggcaacagagccuacagccaguacgacagauuccacaucggcaacgagaagcagaacuacagacuguaccugaagggccacaccggcaccgccggcaagcagagcagccugauccugcacggcgccgacuucagcaccaaggacgccgacaacgacaacugcaugugcaagugcgcccugaugcugaccggcggcuggugguucgacgccugcggccccagcaaccugaacggcauguucuacaccgccggccagaaccacggcaagcugaacggcaucaaguggcacuacuucaagggccccagcuacagccugagaagcaccaccaugaugaucagaccccuggacuucuaa

SEQ ID NO: 13574 - RNA, 1488 nt, Artificial Sequence
  ANGPT2__Homo_sapiens__NP_001112359
auguggcagaucguguucuucacccugagcugcgaccuggugcuggccgccgccuacaacaacuucagaaagagcauggacagcaucggcaagaagcaguaccaggugcagcacggcagcugcagcuacaccuuccugcugcccgagauggacaacugcagaagcagcagcagccccuacgugagcaacgccgugcagagagacgccccccuggaguacgacgacagcgugcagagacugcaggugcuggagaacaucauggagaacaacacccaguggcugaugaagcuggagaacuacauccaggacaacaugaagaaggagaugguggagauccagcagaacgccgugcagaaccagaccgccgugaugaucgagaucggcaccaaccugcugaaccagaccgccgagcagaccagaaagcugaccgacguggaggcccaggugcugaaccagaccaccagacuggagcugcagcugcuggagcacagccugagcaccaacaagcuggagaagcagauccuggaccagaccagcgagaucaacaagcugcaggacaagaacagcuuccuggagaagaaggugcuggccauggaggacaagcacaucauccagcugcagagcaucaaggaggagaaggaccagcugcaggugcuggugagcaagcagaacagcaucaucgaggagcuggagaagaagaucgugaccgccaccgugaacaacagcgugcugcagaagcagcagcacgaccugauggagaccgugaacaaccugcugaccaugaugagcaccagcaacagcaaggaccccaccguggccaaggaggagcagaucagcuucagagacugcgccgagguguucaagagcggccacaccaccaacggcaucuacacccugaccuuccccaacagcaccgaggagaucaaggccuacugcgacauggaggccggcggcggcggcuggaccaucauccagagaagagaggacggcagcguggacuuccagagaaccuggaaggaguacaaggugggcuucggcaaccccagcggcgaguacuggcugggcaacgaguucgugagccagcugaccaaccagcagagauacgugcugaagauccaccugaaggacugggagggcaacgaggccuacagccuguacgagcacuucuaccugagcagcgaggagcugaacuacagaauccaccugaagggccugaccggcaccgccggcaagaucagcagcaucagccagcccggcaacgacuucagcaccaaggacggcgacaacgacaagugcaucugcaagugcagccagaugcugaccggcggcuggugguucgacgccugcggccccagcaaccugaacggcauguacuacccccagagacagaacaccaacaaguucaacggcaucaagugguacuacuggaagggcagcggcuacagccugaaggccaccaccaugaugaucagacccgccgacuucuaa

SEQ ID NO: 13575 - RNA, 1512 nt, Artificial Sequence
  ANGPT4__Homo_sapiens__NP_057069
augcugagccagcuggccaugcugcagggcagccugcugcuggugguggccaccaugagcguggcccagcagaccagacaggaggccgacagaggcugcgagacccugguggugcagcacggccacugcagcuacaccuuccugcugcccaagagcgagcccugcccccccggccccgaggugagcagagacagcaacacccugcagagagagagccuggccaacccccugcaccugggcaagcugcccacccagcaggugaagcagcuggagcaggcccugcagaacaacacccaguggcugaagaagcuggagagagccaucaagaccauccugagaagcaagcuggagcaggugcagcagcagauggcccagaaccagaccgcccccaugcuggagcugggcaccagccugcugaaccagaccaccgcccagaucagaaagcugaccgacauggaggcccagcugcugaaccagaccagcagaauggacgcccagaugcccgagaccuuccugagcaccaacaagcuggagaaccagcugcugcugcagagacagaagcugcagcagcugcagggccagaacagcgcccuggagaagagacugcaggcccuggagaccaagcagcaggaggagcuggccagcauccugagcaagaaggccaagcugcugaacacccugagcagacagagcgccgcccugaccaacaucgagagaggccugagaggcgugagacacaacagcagccugcugcaggaccagcagcacagccugagacagcugcuggugcugcugagacaccuggugcaggagagagccaacgccagcgcccccgccuucaucauggccggcgagcagguguuccaggacugcgccgagauccagagaagcggcgccagcgccagcggcguguacaccauccaggugagcaacgccaccaagcccagaaagguguucugcgaccugcagagcagcggcggcagauggacccugauccagagaagagagaacggcaccgugaacuuccagagaaacuggaaggacuacaagcagggcuucggcgaccccgccggcgagcacuggcugggcaacgagguggugcaccagcugaccagaagagccgccuacagccugagaguggagcugcaggacugggagggccacgaggccuacgcccaguacgagcacuuccaccugggcagcgagaaccagcuguacagacugagcguggugggcuacagcggcagcgccggcagacagagcagccuggugcugcagaacaccagcuucagcacccuggacagcgacaacgaccacugccugugcaagugcgcccaggugaugagcggcggcuggugguucgacgccugcggccugagcaaccugaacggcguguacuaccacgcccccgacaacaaguacaagauggacggcaucagauggcacuacuucaagggccccagcuacagccugagagccagcagaaugaugaucagaccccuggacaucuaa

SEQ ID NO: 13576 - RNA, 1476 nt, Artificial Sequence
  ANGPTL1__Homo_sapiens__NP_004664
augaagaccuucaccuggacccugggcgugcuguucuuccugcugguggacaccggccacugcagaggcggccaguucaagaucaagaagaucaaccagagaagauaccccagagccaccgacggcaaggaggaggccaagaagugcgccuacaccuuccuggugcccgagcagagaaucaccggccccaucugcgugaacaccaagggccaggacgccagcaccaucaaggacaugaucaccagaauggaccuggagaaccugaaggacgugcugagcagacagaagagagagaucgacgugcugcagcuggugguggacguggacggcaacaucgugaacgaggugaagcugcugagaaaggagagcagaaacaugaacagcagagugacccagcuguacaugcagcugcugcacgagaucaucagaaagagagacaacagccuggagcugagccagcuggagaacaagauccugaacgugaccaccgagaugcugaagauggccaccagauacagagagcuggaggugaaguacgccagccugaccgaccuggugaacaaccagagcgugaugaucacccugcuggaggagcagugccugagaaucuucagcagacaggacacccacgugagccccccccuggugcagguggugccccagcacauccccaacagccagcaguacacccccggccugcugggcggcaacgagauccagagagaccccggcuaccccagagaccugaugcccccccccgaccuggccaccagccccaccaagagccccuucaagaucccccccgugaccuucaucaacgagggccccuucaaggacugccagcaggccaaggaggccggccacagcgugagcggcaucuacaugaucaagcccgagaacagcaacggccccaugcagcuguggugcgagaacagccuggaccccggcggcuggaccgugauccagaagagaaccgacggcagcgugaacuucuucagaaacugggagaacuacaagaagggcuucggcaacaucgacggcgaguacuggcugggccuggagaacaucuacaugcugagcaaccaggacaacuacaagcugcugaucgagcuggaggacuggagcgacaagaagguguacgccgaguacagcagcuucagacuggagcccgagagcgaguucuacagacugagacugggcaccuaccagggcaacgccggcgacagcaugauguggcacaacggcaagcaguucaccacccuggacagagacaaggacauguacgccggcaacugcgcccacuuccacaagggcggcuggugguacaacgccugcgcccacagcaaccugaacggcgugugguacagaggcggccacuacagaagcaagcaccaggacggcaucuucugggccgaguacagaggcggcagcuacagccugagagccgugcagaugaugaucaagcccaucgacuaa

SEQ ID NO: 13577 - RNA, 1482 nt, Artificial Sequence
  ANGPTL2__Homo_sapiens__NP_036230
augagaccccugugcgugaccugcugguggcugggccugcuggccgccaugggcgccguggccggccaggaggacggcuucgagggcaccgaggagggcagccccagagaguucaucuaccugaacagauacaagagagccggcgagagccaggacaagugcaccuacaccuucaucgugccccagcagagagugaccggcgccaucugcgugaacagcaaggagcccgaggugcugcuggagaacagagugcacaagcaggagcuggagcugcugaacaacgagcugcugaagcagaagagacagaucgagacccugcagcagcugguggagguggacggcggcaucgugagcgaggugaagcugcugagaaaggagagcagaaacaugaacagcagagugacccagcuguacaugcagcugcugcacgagaucaucagaaagagagacaacgcccuggagcugagccagcuggagaacagaauccugaaccagaccgccgacaugcugcagcuggccagcaaguacaaggaccuggagcacaaguaccagcaccuggccacccuggcccacaaccagagcgagaucaucgcccagcuggaggagcacugccagagagugcccagcgccagacccgugccccagcccccccccgccgccccccccagaguguaccagccccccaccuacaacagaaucaucaaccagaucagcaccaacgagauccagagcgaccagaaccugaaggugcugccccccccccugcccaccaugcccacccugaccagccugcccagcagcaccgacaagcccagcggccccuggagagacugccugcaggcccuggaggacggccacgacaccagcagcaucuaccuggugaagcccgagaacaccaacagacugaugcagguguggugcgaccagagacacgaccccggcggcuggaccgugauccagagaagacuggacggcagcgugaacuucuucagaaacugggagaccuacaagcagggcuucggcaacaucgacggcgaguacuggcugggccuggagaacaucuacuggcugaccaaccagggcaacuacaagcugcuggugaccauggaggacuggagcggcagaaagguguucgccgaguacgccagcuucagacuggagcccgagagcgaguacuacaagcugagacugggcagauaccacggcaacgccggcgacagcuucaccuggcacaacggcaagcaguucaccacccuggacagagaccacgacguguacaccggcaacugcgcccacuaccagaagggcggcuggugguacaacgccugcgcccacagcaaccugaacggcgugugguacagaggcggccacuacagaagcagauaccaggacggcguguacugggccgaguucagaggcggcagcuacagccugaagaagguggugaugaugaucagacccaaccccaacaccuuccacuaa

SEQ ID NO: 13578 - RNA, 1107 nt, Artificial Sequence
  ANGPTL4__Homo_sapiens__NP_001034756
augagcggcgcccccaccgccggcgccgcccugaugcugugcgccgccaccgccgugcugcugagcgcccagggcggccccgugcagagcaagagccccagauucgccagcugggacgagaugaacgugcuggcccacggccugcugcagcugggccagggccugagagagcacgccgagagaaccagaagccagcugagcgcccuggagagaagacugagcgccugcggcagcgccugccagggcaccgagggcagcaccgaccugccccuggcccccgagagcagaguggaccccgaggugcugcacagccugcagacccagcugaaggcccagaacagcagaauccagcagcuguuccacaagguggcccagcagcagagacaccuggagaagcagcaccugagaauccagcaccugcagagccaguucggccugcuggaccacaagcaccuggaccacgagguggccaagcccgccagaagaaagagacugcccgagauggcccagcccguggaccccgcccacaacgugagcagacugcaccacggcggcuggaccgugauccagagaagacacgacggcagcguggacuucaacagacccugggaggccuacaaggccggcuucggcgacccccacggcgaguucuggcugggccuggagaaggugcacagcaucaccggcgacagaaacagcagacuggccgugcagcugagagacugggacggcaacgccgagcugcugcaguucagcgugcaccugggcggcgaggacaccgccuacagccugcagcugaccgcccccguggccggccagcugggcgccaccaccgugccccccagcggccugagcgugcccuucagcaccugggaccaggaccacgaccugagaagagacaagaacugcgccaagagccugagcggcggcuggugguucggcaccugcagccacagcaaccugaacggccaguacuucagaagcaucccccagcagagacagaagcugaagaagggcaucuucuggaagaccuggagaggcagauacuacccccugcaggccaccaccaugcugauccagcccauggccgccgaggccgccagcuaa

SEQ ID NO: 13579 - RNA, 1413 nt, Artificial Sequence
  ANGPTL6__Homo_sapiens__NP_114123
augggcaagcccuggcugagagcccugcagcugcugcugcugcugggcgccagcugggccagagccggcgcccccagaugcaccuacaccuucgugcugcccccccagaaguucaccggcgccgugugcuggagcggccccgccagcaccagagccacccccgaggccgccaacgccagcgagcuggccgcccugagaaugagagugggcagacacgaggagcugcugagagagcugcagagacuggccgccgccgacggcgccguggccggcgaggugagagcccugagaaaggagagcagaggccugagcgccagacugggccagcugagagcccagcugcagcacgaggccggccccggcgccggccccggcgccgaccugggcgccgagcccgccgccgcccuggcccugcugggcgagagagugcugaacgccagcgccgaggcccagagagccgccgccagauuccaccagcuggacgugaaguucagagagcuggcccagcuggugacccagcagagcagccugaucgccagacuggagagacugugccccggcggcgccggcggccagcagcaggugcugcccccccccccccuggugcccguggugcccgugagacuggugggcagcaccagcgacaccagcagaaugcuggaccccgcccccgagccccagagagaccagacccagagacagcaggagcccauggccagccccaugcccgccggccaccccgccgugcccaccaagcccgugggccccuggcaggacugcgccgaggccagacaggccggccacgagcagagcggcguguacgagcugagagugggcagacacguggugagcguguggugcgagcagcagcuggagggcggcggcuggaccgugauccagagaagacaggacggcagcgugaacuucuucaccaccuggcagcacuacaaggccggcuucggcagacccgacggcgaguacuggcugggccuggagcccguguaccagcugaccagcagaggcgaccacgagcugcuggugcugcuggaggacuggggcggcagaggcgccagagcccacuacgacggcuucagccuggagcccgagagcgaccacuacagacugagacugggccaguaccacggcgacgccggcgacagccugagcuggcacaacgacaagcccuucagcaccguggacagagacagagacagcuacagcggcaacugcgcccuguaccagagaggcggcuggugguaccacgccugcgcccacagcaaccugaacggcguguggcaccacggcggccacuacagaagcagauaccaggacggcguguacugggccgaguucagaggcggcgccuacagccugagaaaggccgccaugcugaucagaccccugaagcuguaa

SEQ ID NO: 13580 - RNA, 5643 nt, Artificial Sequence
  ANK1__Homo_sapiens__NP_000028
augcccuacagcgugggcuucagagaggccgacgccgccaccagcuuccugagagccgccagaagcggcaaccuggacaaggcccuggaccaccugagaaacggcguggacaucaacaccugcaaccagaacggccugaacggccugcaccuggccagcaaggagggccacgugaagauggugguggagcugcugcacaaggagaucauccuggagaccaccaccaagaagggcaacaccgcccugcacaucgccgcccuggccggccaggacgagguggugagagagcuggugaacuacggcgccaacgugaacgcccagagccagaagggcuucaccccccuguacauggccgcccaggagaaccaccuggagguggugaaguuccugcuggagaacggcgccaaccagaacguggccaccgaggacggcuucaccccccuggccguggcccugcagcagggccacgagaacgugguggcccaccugaucaacuacggcaccaagggcaaggugagacugcccgcccugcacaucgccgccagaaacgacgacaccagaaccgccgccgugcugcugcagaacgaccccaaccccgacgugcugagcaagaccggcuucaccccccugcacaucgccgcccacuacgagaaccugaacguggcccagcugcugcugaacagaggcgccagcgugaacuucaccccccagaacggcaucaccccccugcacaucgccagcagaagaggcaacgugaucauggugagacugcugcuggacagaggcgcccagaucgagaccaagaccaaggacgagcugaccccccugcacugcgccgccagaaacggccacgugagaaucagcgagauccugcuggaccacggcgcccccauccaggccaagaccaagaacggccugagccccauccacauggccgcccagggcgaccaccuggacugcgugagacugcugcugcaguacgacgccgagaucgacgacaucacccuggaccaccugaccccccugcacguggccgcccacugcggccaccacagaguggccaaggugcugcuggacaagggcgccaagcccaacagcagagcccugaacggcuucaccccccugcacaucgccugcaagaagaaccacgugagagugauggagcugcugcugaagaccggcgccagcaucgacgccgugaccgagagcggccugaccccccugcacguggccagcuucaugggccaccugcccaucgugaagaaccugcugcagagaggcgccagccccaacgugagcaacgugaagguggagaccccccugcacauggccgccagagccggccacaccgagguggccaaguaccugcugcagaacaaggccaaggugaacgccaaggccaaggacgaccagaccccccugcacugcgccgccagaaucggccacaccaacauggugaagcugcugcuggagaacaacgccaaccccaaccuggccaccaccgccggccacaccccccugcacaucgccgccagagagggccacguggagaccgugcuggcccugcuggagaaggaggccagccaggccugcaugaccaagaagggcuucaccccccugcacguggccgccaaguacggcaaggugagaguggccgagcugcugcuggagagagacgcccaccccaacgccgccggcaagaacggccugaccccccugcacguggccgugcaccacaacaaccuggacaucgugaagcugcugcugcccagaggcggcagcccccacagccccgccuggaacggcuacaccccccugcacaucgccgccaagcagaaccagguggagguggccagaagccugcugcaguacggcggcagcgccaacgccgagagcgugcagggcgugaccccccugcaccuggccgcccaggagggccacgccgagaugguggcccugcugcugagcaagcaggccaacggcaaccugggcaacaagagcggccugaccccccugcaccugguggcccaggagggccacgugcccguggccgacgugcugaucaagcacggcgugaugguggacgccaccaccagaaugggcuacaccccccugcacguggccagccacuacggcaacaucaagcuggugaaguuccugcugcagcaccaggccgacgugaacgccaagaccaagcugggcuacagcccccugcaccaggccgcccagcagggccacaccgacaucgugacccugcugcugaagaacggcgccagccccaacgaggugagcagcgacggcaccaccccccuggccaucgccaagagacugggcuacaucagcgugaccgacgugcugaagguggugaccgacgagaccagcuucgugcuggugagcgacaagcacagaaugagcuuccccgagaccguggacgagauccuggacgugagcgaggacgagggcgaggagcugaucagcuucaaggccgagagaagagacagcagagacguggacgaggagaaggagcugcuggacuucgugcccaagcuggaccaggugguggagagccccgccauccccagaauccccugcgccaugcccgagaccguggugaucagaagcgaggagcaggagcaggccagcaaggaguacgacgaggacagccugauccccagcagccccgccaccgagaccagcgacaacaucagccccguggccagccccgugcacaccggcuuccuggugagcuucaugguggacgccagaggcggcagcaugagaggcagcagacacaacggccugagaguggugaucccccccagaaccugcgccgcccccaccagaaucaccugcagacuggugaagccccagaagcugagcaccccccccccccuggccgaggaggagggccuggccagcagaaucaucgcccugggccccaccggcgcccaguuccugagccccgugaucguggagaucccccacuucgccagccacggcagaggcgacagagagcugguggugcugagaagcgagaacggcagcguguggaaggagcacagaagcagauacggcgagagcuaccuggaccagauccugaacggcauggacgaggagcugggcagccuggaggagcuggagaagaagagagugugcagaaucaucaccaccgacuucccccuguacuucgugaucaugagcagacugugccaggacuacgacaccaucggccccgagggcggcagccugaagagcaagcuggugccccuggugcaggccaccuuccccgagaacgccgugaccaagagagugaagcuggcccugcaggcccagcccgugcccgacgagcuggugaccaagcugcugggcaaccaggccaccuucagccccaucgugaccguggagcccagaagaagaaaguuccacagacccaucggccugagaaucccccugccccccagcuggaccgacaaccccagagacagcggcgagggcgacaccaccagccugagacugcugugcagcgugaucggcggcaccgaccaggcccagugggaggacaucaccggcaccaccaagcugguguacgccaacgagugcgccaacuucaccaccaacgugagcgccagauucuggcugagcgacugccccagaaccgccgaggccgugaacuucgccacccugcuguacaaggagcugaccgccgugcccuacauggccaaguucgugaucuucgccaagaugaacgaccccagagagggcagacugagaugcuacugcaugaccgacgacaagguggacaagacccuggagcagcacgagaacuucguggagguggccagaagcagagacaucgaggugcuggagggcaugagccuguucgccgagcugagcggcaaccuggugcccgugaagaaggccgcccagcagagaagcuuccacuuccagagcuucagagagaacagacuggccaugcccgugaaggugagagacagcagcagagagcccggcggcagccugagcuuccugagaaaggccaugaaguacgaggacacccagcacauccugugccaccugaacaucaccaugccccccugcgccaagggcagcggcgccgaggacagaagaagaacccccaccccccuggcccugagauacagcauccugagcgagagcacccccggcagccugagcggcaccgagcaggccgagaugaagauggccgugaucagcgagcaccugggccugagcugggccgagcuggccagagagcugcaguucagcguggaggacaucaacagaaucagaguggagaaccccaacagccugcuggagcagagcguggcccugcugaaccugugggugaucagagagggccagaacgccaacauggagaaccuguacaccgcccugcagagcaucgacagaggcgagaucgugaacaugcuggagggcagcggcagacagagcagaaaccugaagcccgacagaagacacaccgacagagacuacagccugagccccagccagaugaacggcuacagcagccugcaggacgagcugcugagccccgccagccugggcugcgcccugagcagcccccugagagccgaccaguacuggaacgagguggccgugcuggacgccaucccccuggccgccaccgagcacgacaccaugcuggagaugagcgacaugcagguguggagcgccggccugacccccagccuggugaccgccgaggacagcagccuggagugcagcaaggccgaggacagcgacgccaccggccacgaguggaagcuggagggcgcccugagcgaggagcccagaggccccgagcugggcagccuggagcugguggaggacgacaccguggacagcgacgccaccaacggccugaucgaccugcuggagcaggaggagggccagagaagcgaggagaagcugcccggcagcaagagacaggacgacgccaccggcgccggccaggacagcgagaacgaggugagccuggugagcggccaccagagaggccaggccagaaucacccacagccccaccgugagccaggugaccgagagaagccaggacagacugcaggacugggacgccgacggcagcaucgugagcuaccugcaggacgccgcccagggcagcuggcaggaggaggugacccagggcccccacagcuuccagggcaccagcaccaugaccgagggccuggagcccggcggcagccaggaguacgagaaggugcuggugagcgugagcgagcacaccuggaccgagcagcccgaggccgagagcagccaggccgacagagacagaagacagcagggccaggaggagcaggugcaggaggccaagaacaccuucacccagguggugcagggcaacgaguuccagaacauccccggcgagcaggugaccgaggagcaguucaccgacgagcagggcaacaucgugaccaagaagaucaucagaaagguggugagacagaucgaccugagcagcgccgacgccgcccaggagcacgaggagguggagcugagaggcagcggccugcagcccgaccugaucgagggcagaaagggcgcccagaucgugaagagagccagccugaagagaggcaagcaguaa

SEQ ID NO: 13581 - RNA, 5592 nt, Artificial Sequence
  ANK2__Homo_sapiens__NP_001120965
augaccaccaugcugcagaagagcgacagcaacgccagcuuccugagagccgccagagccggcaaccuggacaaggugguggaguaccugaagggcggcaucgacaucaacaccugcaaccagaacggccugaacgcccugcaccuggccgccaaggagggccacgugggccuggugcaggagcugcugggcagaggcagcagcguggacagcgccaccaagaagggcaacaccgcccugcacaucgccagccuggccggccaggccgagguggugaaggugcuggugaaggagggcgccaacaucaacgcccagagccagaacggcuucaccccccuguacauggccgcccaggagaaccacaucgacguggugaaguaccugcuggagaacggcgccaaccagagcaccgccaccgaggacggcuucaccccccuggccguggcccugcagcagggccacaaccaggccguggccauccugcuggagaacgacaccaagggcaaggugagacugcccgcccugcacaucgccgccagaaaggacgacaccaagagcgccgcccugcugcugcagaacgaccacaacgccgacgugcagagcaagaugauggugaacagaaccaccgagagcggcuucaccccccugcacaucgccgcccacuacggcaacgugaacguggccacccugcugcugaacagaggcgccgccguggacuucaccgccagaaacggcaucaccccccugcacguggccagcaagagaggcaacaccaacauggugaagcugcugcuggacagaggcggccagaucgacgccaagaccagagacggccugaccccccugcacugcgccgccagaagcggccacgaccaggugguggagcugcugcuggagagaggcgccccccugcuggccagaaccaagaacggccugagcccccugcacauggccgcccagggcgaccacguggagugcgugaagcaccugcugcagcacaaggcccccguggacgacgugacccuggacuaccugaccgcccugcacguggccgcccacugcggccacuacagagugaccaagcugcugcuggacaagagagccaaccccaacgccagagcccugaacggcuucaccccccugcacaucgccugcaagaagaacagaaucaaggugauggagcugcuggugaaguacggcgccagcauccaggccaucaccgagagcggccugacccccauccacguggccgccuucaugggccaccugaacaucgugcugcugcugcugcagaacggcgccagccccgacgugaccaacaucagaggcgagaccgcccugcacauggccgccagagccggccagguggagguggugagaugccugcugagaaacggcgcccugguggacgccagagccagagaggagcagaccccccugcacaucgccagcagacugggcaagaccgagaucgugcagcugcugcugcagcacauggcccaccccgacgccgccaccaccaacggcuacaccccccugcacaucagcgccagagagggccagguggacguggccagcgugcugcuggaggccggcgccgcccacagccuggccaccaagaagggcuucaccccccugcacguggccgccaaguacggcagccuggacguggccaagcugcugcugcagagaagagccgccgccgacagcgccggcaagaacggccugaccccccugcacguggccgcccacuacgacaaccagaagguggcccugcugcugcuggagaagggcgccagcccccacgccaccgccaagaacggcuacaccccccugcacaucgccgccaagaagaaccagaugcagaucgccagcacccugcugaacuacggcgccgagaccaacaucgugaccaagcagggcgugaccccccugcaccuggccagccaggagggccacaccgacauggugacccugcugcuggacaagggcgccaacauccacaugagcaccaagagcggccugaccagccugcaccuggccgcccaggaggacaaggugaacguggccgacauccugaccaagcacggcgccgaccaggacgcccacaccaagcugggcuacaccccccugaucguggccugccacuacggcaacgugaagauggugaacuuccugcugaagcagggcgccaacgugaacgccaagaccaagaacggcuacaccccccugcaccaggccgcccagcagggccacacccacaucaucaacgugcugcugcagcacggcgccaagcccaacgccaccaccgccaacggcaacaccgcccuggccaucgccaagagacugggcuacaucagcgugguggacacccugaagguggugaccgaggaggugaccaccaccaccaccaccaucaccgagaagcacaagcugaacgugcccgagaccaugaccgaggugcuggacgugagcgacgaggagggcgacgacaccaugaccggcgacggcggcgaguaccugagacccgaggaccugaaggagcugggcgacgacagccugcccagcagccaguuccuggacggcaugaacuaccugagauacagccuggagggcggcagaagcgacagccugagaagcuucagcagcgacagaagccacacccugagccacgccagcuaccugagagacagcgccgugauggacgacagcguggugauccccagccaccaggugagcacccuggccaaggaggccgagagaaacagcuacagacugagcuggggcaccgagaaccuggacaacguggcccugagcagcagccccauccacagcggcagagccagccccugccuggagagagacaacagcagcuuccuggugagcuucaugguggacgccagaggcggcgccaugagaggcugcagacacaacggccugagaaucaucaucccccccagaaagugcaccgcccccaccagagugaccugcagacuggugaagagacacagacuggccaccaugccccccaugguggagggcgagggccuggccagcagacugaucgaggugggccccagcggcgcccaguuccugggcaagcugcaccugcccaccgccccccccccccugaacgagggcgagagccuggugagcagaauccugcagcugggcccccccggcaccaaguuccugggccccgugaucguggagaucccccacuucgccgcccugagaggcaaggagagagagcugguggugcugagaagcgagaacggcgacagcuggaaggagcacuucugcgacuacaccgaggacgagcugaacgagauccugaacggcauggacgaggugcuggacagccccgaggaccuggagaagaagagaaucugcagaaucaucaccagagacuucccccaguacuucgccguggugagcagaaucaagcaggacagcaaccugaucggccccgagggcggcgugcugagcagcaccguggugccccaggugcaggccguguuccccgagggcgcccugaccaagagaaucagagugggccugcaggcccagcccaugcacagcgagcuggugaagaagauccugggcaacaaggccaccuucagccccaucgugacccuggagcccagaagaagaaaguuccacaagcccaucaccaugaccauccccgugcccaaggccagcagcgacgugaugcugaacggcuucggcggcgacgcccccacccugagacugcugugcagcaucaccggcggcaccacccccgcccagugggaggacaucaccggcaccaccccccugaccuucgugaacgagugcgugagcuucaccaccaacgugagcgccagauucuggcugaucgacugcagacagauccaggagagcgugaccuucgccagccagguguacagagagaucaucugcgugcccuacauggccaaguucgugguguucgccaagagccacgaccccaucgaggccagacugagaugcuucugcaugaccgacgacaagguggacaagacccuggagcagcaggagaacuucgccgagguggccagaagcagagacguggaggugcuggagggcaagcccaucuacguggacugcuucggcaaccuggugccccugaccaagagcggccagcaccacaucuucagcuucuucgccuucaaggagaacagacugccccuguucgugaaggugagagacaccacccaggagcccugcggcagacugagcuucaugaaggagcccaagagcaccagaggccuggugcaccaggccaucugcaaccugaacaucacccugcccaucuacaccaaggagagcgagagcgaccaggagcaggaggaggagaucgacaugaccagcgagaagaacccccaggacgagcaggagagaaucgaggagagacuggccuacaucgccgaccaccugggcuucagcuggaccgagcuggccagagagcuggacuucaccgaggagcagauccaccagaucagaaucgagaaccccaacagccugcaggaccagagccacgcccugcugaaguacuggcuggagagagacggcaagcacgccaccgacaccaaccugguggagugccugaccaagaucaacagaauggacaucgugcaccugauggagaccaacaccgagccccugcaggagagaaucagccacagcuacgccgagaucgagcagaccaucacccuggaccacagcgagggcuucagcgugcugcaggaggagcugugcaccgcccagcacaagcagaaggaggagcaggccgugagcaaggagagcgagaccugcgaccacccccccaucgugagcgaggaggacaucagcgugggcuacagcaccuuccaggacggcgugcccaagaccgagggcgacagcagcgccaccgcccuguucccccagacccacaaggagcaggugcagcaggacuucagcggcaagaugcaggaccugcccgaggagagcagccuggaguaccagcaggaguacuucgugaccacccccggcaccgagaccagcgagacccagaaggccaugaucgugcccagcagccccagcaagacccccgaggaggugagcacccccgccgaggaggagaagcuguaccugcagacccccaccagcagcgagagaggcggcagccccaucauccaggagcccgaggagcccagcgagcacagagaggagagcagccccagaaagaccagccuggugaucguggagagcgccgacaaccagcccgagaccugcgagagacuggacgaggacgccgccuucgagaagggcgacgacaugcccgagaucccccccgagaccgugaccgaggaggaguacaucgacgagcacggccacaccguggugaagaaggugaccagaaagaucaucagaagauacgugagcagcgagggcaccgagaaggaggagaucauggugcagggcaugccccaggagcccgugaacaucgaggagggcgacggcuacagcaaggugaucaagagaguggugcugaagagcgacaccgagcagagcgaggacaacaacgaguaa

SEQ ID NO: 13582 - RNA, 5586 nt, Artificial Sequence
  ANK3__Homo_sapiens__NP_001191332
auggccagcagcgccagcagcagccccgccggcaccgaggacagcgcccccgcccagggcggcuucggcagcgacuacagcagaagcagcagaaagagcgacgccaacgccagcuaccugagagccgccagagccggccaccuggagaaggcccuggacuacaucaagaacggcguggacaucaacaucugcaaccagaacggccugaacgcccugcaccuggccagcaaggagggccacguggagguggugagcgagcugcugcagagagaggccaacguggacgccgccaccaagaagggcaacaccgcccugcacaucgccagccuggccggccaggccgagguggugaaggugcuggugaccaacggcgccaacgugaacgcccagagccagaacggcuucaccccccuguacauggccgcccaggagaaccaccuggagguggugaaguuccugcuggacaacggcgccagccagagccuggccaccgaggacggcuucaccccccuggccguggcccugcagcagggccacgaccagguggugagccugcugcuggagaacgacaccaagggcaaggugagacugcccgcccugcacaucgccgccagaaaggacgacaccaaggccgccgcccugcugcugcagaacgacaacaacgccgacguggagagcaagagcggcuucaccccccugcacaucgccgcccacuacggcaacaucaacguggccacccugcugcugaacagagccgccgccguggacuucaccgccagaaacgacaucaccccccugcacguggccagcaagagaggcaacgccaacauggugaagcugcugcuggacagaggcgccaagaucgacgccaagaccagagacggccugaccccccugcacugcggcgccagaagcggccacgagcaggugguggagaugcugcuggacagagccgcccccauccugagcaagaccaagaacggccugagcccccugcacauggccacccagggcgaccaccugaacugcgugcagcugcugcugcagcacaacgugcccguggacgacgugaccaacgacuaccugaccgcccugcacguggccgcccacugcggccacuacaagguggccaaggugcugcuggacaagaaggccaaccccaacgccaaggcccugaacggcuucaccccccugcacaucgccugcaagaagaacagaaucaaggugauggagcugcugcugaagcacggcgccagcauccaggccgugaccgagagcggccugacccccauccacguggccgccuucaugggccacgugaacaucgugagccagcugaugcaccacggcgccagccccaacaccaccaacgugagaggcgagaccgcccugcacauggccgccagaagcggccaggccgagguggugagauaccuggugcaggacggcgcccagguggaggccaaggccaaggacgaccagaccccccugcacaucagcgccagacugggcaaggccgacaucgugcagcagcugcugcagcagggcgccagccccaacgccgccaccaccagcggcuacaccccccugcaccugagcgccagagagggccacgaggacguggccgccuuccugcuggaccacggcgccagccugagcaucaccaccaagaagggcuucaccccccugcacguggccgccaaguacggcaagcuggagguggccaaccugcugcugcagaagagcgccagccccgacgccgccggcaagagcggccugaccccccugcacguggccgcccacuacgacaaccagaagguggcccugcugcugcuggaccagggcgccagcccccacgccgccgccaagaacggcuacaccccccugcacaucgccgccaagaagaaccagauggacaucgccaccacccugcuggaguacggcgccgacgccaacgccgugaccagacagggcaucgccagcgugcaccuggccgcccaggagggccacguggacauggugagccugcugcugggcagaaacgccaacgugaaccugagcaacaagagcggccugaccccccugcaccuggccgcccaggaggacagagugaacguggccgaggugcuggugaaccagggcgcccacguggacgcccagaccaagaugggcuacaccccccugcacgugggcugccacuacggcaacaucaagaucgugaacuuccugcugcagcacagcgccaaggugaacgccaagaccaagaacggcuacaccccccugcaccaggccgcccagcagggccacacccacaucaucaacgugcugcugcagaacaacgccagccccaacgagcugaccgugaacggcaacaccgcccugggcaucgccagaagacugggcuacaucagcgugguggacacccugaagaucgugaccgaggagaccaugaccaccaccaccgugaccgagaagcacaagaugaacgugcccgagaccaugaacgaggugcuggacaugagcgacgacgaggugagaaaggccaacgcccccgagaugcugagcgacggcgaguacaucagcgacguggaggagggcgaggacgccaugaccggcgacaccgacaaguaccugggcccccaggaccugaaggagcugggcgacgacagccugcccgccgagggcuacaugggcuucagccugggcgccagaagcgccagccugagaagcuucagcagcgacagaagcuacacccugaacagaagcagcuacgccagagacagcaugaugaucgaggagcugcuggugcccagcaaggagcagcaccugaccuucaccagagaguucgacagcgacagccugagacacuacagcugggccgccgacacccuggacaacgugaaccuggugagcagccccauccacagcggcuuccuggugagcuucaugguggacgccagaggcggcagcaugagaggcagcagacaccacggcaugagaaucaucaucccccccagaaagugcaccgcccccaccagaaucaccugcagacuggugaagagacacaagcuggccaaccccccccccaugguggagggcgagggccuggccagcagacugguggagaugggccccgccggcgcccaguuccugggccccgugaucguggagaucccccacuucggcagcaugagaggcaaggagagagagcugaucgugcugagaagcgagaacggcgagaccuggaaggagcaccaguucgacagcaagaacgaggaccugaccgagcugcugaacggcauggacgaggagcuggacagccccgaggagcugggcaagaagagaaucugcagaaucaucaccaaggacuucccccaguacuucgccguggugagcagaaucaagcaggagagcaaccagaucggccccgagggcggcauccugagcagcaccaccgugccccuggugcaggccagcuuccccgagggcgcccugaccaagagaaucagagugggccugcaggcccagcccgugcccgacgagaucgugaagaagauccugggcaacaaggccaccuucagccccaucgugaccguggagcccagaagaagaaaguuccacaagcccaucaccaugaccauccccgugcccccccccagcggcgagggcgugagcaacggcuacaagggcgacaccacccccaaccugagacugcugugcagcaucaccggcggcaccagccccgcccagugggaggacaucaccggcaccaccccccugaccuucaucaaggacugcgugagcuucaccaccaacgugagcgccagauucuggcuggccgacugccaccaggugcuggagaccgugggccuggccacccagcuguacagagagcugaucugcgugcccuacauggccaaguucgugguguucgccaagaugaacgaccccguggagagcagccugagaugcuucugcaugaccgacgacaagguggacaagacccuggagcagcaggagaacuucgaggagguggccagaagcaaggacaucgaggugcuggagggcaagcccaucuacguggacugcuacggcaaccuggccccccugaccaagggcggccagcagcugguguucaacuucuacagcuucaaggagaacagacugcccuucagcaucaagaucagagacaccagccaggagcccugcggcagacugagcuuccugaaggagcccaagaccaccaagggccugccccagaccgccgugugcaaccugaacaucacccugcccgcccacaagaagaucgagaagaccgacagaagacagagcuucgccagccuggcccugagaaagagauacagcuaccugaccgagcccggcaugagcccccagagccccugcgagagaaccgacaucagaauggccaucguggccgaccaccugggccugagcuggaccgagcuggccagagagcugaacuucagcguggacgagaucaaccagaucagaguggagaaccccaacagccugaucagccagagcuucaugcugcugaagaagugggugaccagagacggcaagaacgccaccaccgacgcccugaccagcgugcugaccaagaucaacagaaucgacaucgugacccugcuggagggccccaucuucgacuacggcaacaucagcggcaccagaagcuucgccgacgagaacaacguguuccacgaccccguggacggcuaccccagccugcagguggagcuggagacccccaccggccugcacuacaccccccccacccccuuccagcaggacgacuacuucagcgacaucagcagcaucgagagcccccugagaacccccagcagacugagcgacggccuggugcccagccagggcaacaucgagcacagcgccgacggcccccccguggugaccgccgaggacgccagccuggaggacagcaagcuggaggacagcgugccccugaccgagaugcccgaggccguggacguggacgagagccagcuggagaacgugugccugagcuggcagaacgagaccagcagcggcaaccuggagagcugcgcccaggccagaagagugaccggcggccugcuggacagacuggacgacagccccgaccagugcagagacagcaucaccagcuaccugaagggcgaggccggcaaguucgaggccaacggcagccacaccgagaucacccccgaggccaagaccaagagcuacuuccccgagagccagaacgacgugggcaagcagagcaccaaggagacccugaagcccaagauccacggcagcggccacguggaggagcccgccagcccccuggccgccuaccagaagagccuggaggagaccagcaagcugaucaucgaggagaccaagcccugcgugcccgugagcaugaagaagaugagcagaaccagccccgccgacggcaagcccagacugagccugcacgaggaggagggcagcagcggcagcgagcagaagcagggcgagggcuucaaggugaagaccaagaaggagaucagacacguggagaagaagagccacagcuaa

SEQ ID NO: 13583 - RNA, 2292 nt, Artificial Sequence
  ANKFN1__Homo_sapiens__NP_694960
auggaggccagccugaccagaagacugcuguucaaggacagacacuucaccugcagcaagaucaucggcagaagauucgccugcuucgcccagagacugagccacagaagaaagcagagccagugcgaccugcugaacgagagcaccggccagcugcccaccaccugcagcagcgccgccagcaacagcaucaacuggaacugcagagugaagaugacccagcagaugcagaaccugcaccugugccagagcaagaagcacagcgcccccagcagccccaacgccgccaagagacuguacagaaaccugagcgagaagcugaagggcagccacagcagcuucgacgaggccuacuucagaaccagaaccgacagacugagccugagaaagaccagcgugaacuuccagggcaacgaggccauguucgaggccguggagcagcaggacauggacgccgugcagauccugcuguaccaguacacccccgaggagcuggaccugaacacccccaacagcgagggccugaccccccuggacaucgccaucaugaccaacaacgugcccaucgccagaauccugcugagaaccggcgccagagagagcccccacuucgugagccuggagagcagagccaugcaccugaacacccuggugcaggaggcccaggagagagugagcgagcugagcgcccagguggagaacgagggcuucacccuggacaacaccgagaaggagaagcagcugaaggccugggaguggagauacagacuguacagaagaaugaagaccggcuucgagcacgccagagcccccgagaugcccaccaacgugugccugauggugaccagcagcaccagccugaccgugagcuuccaggagccccugagcgugaacgccgccguggugaccagauacaagguggaguggagcaugagcgaggacuucagcccccuggccggcgagaucaucauggacaaccugcagacccugagaugcaccaucaccggccugaccaugggccagcaguacuucgugcaggugagcgccuacaacaugaagggcuggggccccgcccagaccaccacccccgccugcgccagccccagcaacuggaaggacuacgacgacagagagcccagacacaagggccagagcgaggugcuggagggccugcugcagcaggugagagcccugcaccagcacuacagcugcagagagagcaccaagcugcagaccaccggcagaaagcagagcgugagcagaagccugaagcaccuguuccacagcagcaacaaguucgugaagacccugaagagaggccuguacaucgccgugaucuucuacuacaaggacaacauccuggugaccaacgaggaccaggugcccaucguggagaucgacgacagccacaccagcagcaucacccaggacuuccugugguucaccaagcugagcugcaugugggaggacaucagauggcugagacagagcauccccaucagcagcagcagcagcaccgugcugcagaccagacagaagaugcuggccgccaccgcccagcugcagaaccugcugggcacccacaaccugggcagaguguacuacgagcccaucaaggacagacacggcaacauccugaucgugaccaucagagagguggagaugcuguacagcuucuucaacggcaaguggaugcagaucagcaagcugcagagccagagaaagagccugagcacccccgaggagcccaccgcccuggacauccugcugaucaccauccaggacauccugagcuaccacaagagaagccaccagagacuguuccccggccuguaccugggcuaccugaagcugugcagcagcguggaccagaucaaggugcuggugacccagaagcugcccaacauccugugccacgugaagaucagagagaacaacaacaucagcagagaggagugggaguggauccagaagcugagcggcagcgagagcauggagagcguggaccacaccagcgacugccccaugcagcuguucuucuacgagcugcagauggccgugaaggcccugcugcagcagaucaacaucccccugcaccaggccagaaacuucagacuguacacccaggaggugcuggagaugggccacaacgugagcuuccugcugcugcugcccgccagcgacgacgugugcaccgcccccggccagaacaaccccuacaccccccacagcggcuuccugaaccugccccugcagauguucgagcugggcaucguggccugcuucaccuaa

SEQ ID NO: 13584 - RNA, 3513 nt, Artificial Sequence
  ANKFY1__Homo_sapiens__NP_057460
auggccgaggaggagguggccaagcuggagaagcaccugaugcugcugagacaggaguacgugaagcugcagaagaagcuggccgagaccgagaagagaugcgcccugcuggccgcccaggccaacaaggagagcagcagcgagagcuucaucagcagacugcuggccaucguggccgaccuguacgagcaggagcaguacagcgaccugaagaucaaggugggcgacagacacaucagcgcccacaaguucgugcuggccgccagaagcgacagcuggagccuggccaaccugagcagcaccaaggagcuggaccugagcgacgccaaccccgaggugaccaugaccaugcugagauggaucuacaccgacgagcuggaguucagagaggacgacguguuccugaccgagcugaugaagcuggccaacagauuccagcugcagcugcugagagagagaugcgagaagggcgugaugagccuggugaacgugagaaacugcaucagauucuaccagaccgccgaggagcugaacgccagcacccugaugaacuacugcgccgagaucaucgccagccacugggacgaccugagaaaggaggacuucagcagcaugagcgcccagcugcuguacaagaugaucaagagcaagaccgaguacccccugcacaaggccaucaagguggagagagaggacgugguguuccuguaccugaucgagauggacagccagcugcccggcaagcugaacgaggccgaccacaacggcgaccuggcccuggaccuggcccugagcagaagacuggagagcaucgccaccacccuggugagccacaaggccgacguggacaugguggacaagagcggcuggagccugcugcacaagggcauccagagaggcgaccuguucgccgccaccuuccugaucaagaacggcgccuucgugaacgccgccacccugggcgcccaggagaccccccugcaccugguggcccuguacagcagcaagaagcacagcgccgacgugaugagcgagauggcccagaucgccgaggcccugcugcaggccggcgccaaccccaacaugcaggacagcaagggcagaaccccccugcacgugagcaucauggccggcaacgaguacguguucagccagcugcugcagugcaagcagcuggaccuggagcugaaggaccacgagggcagcaccgcccuguggcuggccgugcagcacaucaccgugagcagcgaccagagcgugaaccccuucgaggacgugcccguggugaacggcaccagcuucgacgagaacagcuucgccgccagacugauccagagaggcagccacaccgacgcccccgacaccgccaccggcaacugccugcugcagagagccgccggcgccggcaacgaggccgccgcccuguuccuggccaccaacggcgcccacgugaaccacagaaacaaguggggcgagaccccccugcacaccgccugcagacacggccuggccaaccugaccgccgagcugcugcagcagggcgccaaccccaaccugcagaccgaggaggcccugccccugcccaaggaggccgccagccugaccagccuggccgacagcgugcaccugcagaccccccugcacauggccaucgccuacaaccaccccgacguggugagcgugauccuggagcagaaggccaacgcccugcacgccaccaacaaccugcagaucauccccgacuucagccugaaggacagcagagaccagaccgugcugggccuggcccuguggaccggcaugcacaccaucgccgcccagcugcugggcagcggcgccgccaucaacgacaccaugagcgacggccagacccugcugcacauggccauccagagacaggacagcaagagcgcccuguuccugcuggagcaccaggccgacaucaacgugagcagaacccaggacggcgagaccgcccugcagcuggccaucagaaaccagcugccccuggugguggacgccaucugcaccagaggcgccgacaugagcgugcccgacgagaagggcaaccccccccuguggcuggcccuggccaacaaccuggaggacaucgccagcacccuggugagacacggcugcgacgccaccugcuggggccccggccccggcggcugccugcagacccugcugcacagagccaucgacgagaacaacgagcccaccgccugcuuccugaucagaagcggcugcgacgugaacagccccagacagcccggcgccaacggcgagggcgaggaggaggccagagacggccagaccccccugcaccuggccgccagcuggggccuggaggagaccgugcagugccugcuggaguucggcgccaacgugaacgcccaggacgccgagggcagaacccccauccacguggccaucagcagccagcacggcgugaucauccagcugcuggugagccaccccgacauccaccugaacgugagagacagacagggccugacccccuucgccugcgccaugaccuucaagaacaacaagagcgccgaggccauccugaagagagagagcggcgccgccgagcagguggacaacaagggcagaaacuuccugcacguggccgugcagaacagcgacaucgagagcgugcuguuccugaucagcgugcacgccaacgugaacagcagagugcaggacgccagcaagcugaccccccugcaccuggccgugcaggccggcagcgagaucaucgugagaaaccugcugcuggccggcgccaaggugaacgagcugaccaagcacagacagaccgcccugcaccuggccgcccagcaggaccugcccaccaucugcagcgugcugcuggagaacggcguggacuucgccgccguggacgagaacggcaacaacgcccugcaccuggccgugaugcacggcagacugaacaacaucagagugcugcugaccgagugcaccguggacgccgaggccuucaaccugagaggccagagcccccugcacauccugggccaguacggcaaggagaacgccgccgccaucuucgaccuguuccuggagugcaugcccggcuacccccuggacaagcccgacgccgacggcagcaccgugcugcugcuggccuacaugaagggcaacgccaaccugugcagagccaucgugagaagcggcgccagacugggcgugaacaacaaccagggcgugaacaucuucaacuaccagguggccaccaagcagcugcuguucagacugcuggacaugcugagcaaggagccccccuggugcgacggcagcuacugcuacgagugcaccgccagauucggcgugaccaccagaaagcaccacugcagacacugcggcagacugcugugccacaagugcagcaccaaggagauccccaucaucaaguucgaccugaacaagcccgugagagugugcaacaucugcuucgacgugcugacccugggcggcgugagcuaa

SEQ ID NO: 13585 - RNA, 7854 nt, Artificial Sequence
  ANKHD1-EIF4EBP3__Homo_sapiens__NP_065741
augcugaccgacagcggcggcggcggcaccagcuucgaggaggaccuggacagcguggcccccagaagcgcccccgccggcgccagcgagccccccccccccggcggcgugggccugggcaucagaaccgugagacuguucggcgaggccggccccgccagcggcgugggcagcagcggcggcggcggcagcggcagcggcaccggcggcggcgacgccgcccuggacuucaagcuggccgccgccgugcugagaaccggcggcggcggcggcgccagcggcagcgacgaggacgaggugagcgagguggagagcuucauccuggaccaggaggaccuggacaaccccgugcugaagaccaccagcgagaucuuccugagcagcaccgccgagggcgccgaccugagaaccguggaccccgagacccaggccagacuggaggcccugcuggaggccgccggcaucggcaagcugagcaccgccgacggcaaggccuucgccgaccccgaggugcugagaagacugaccagcagcgugagcugcgcccuggacgaggccgccgccgcccugaccagaaugaaggccgagaacagccacaacgccggccagguggacaccagaagccuggccgaggccugcagcgacggcgacgugaacgccgugagaaagcugcuggacgagggcagaagcgugaacgagcacaccgaggagggcgagagccugcugugccuggccugcagcgccggcuacuacgagcuggcccaggugcugcuggccaugcacgccaacguggaggacagaggcaacaagggcgacaucaccccccugauggccgccagcagcggcggcuaccuggacaucgugaagcugcugcugcugcacgacgccgacgugaacagccagagcgccaccggcaacaccgcccugaccuacgccugcgccggcggcuucguggacaucgugaaggugcugcugaacgagggcgccaacaucgaggaccacaacgagaacggccacaccccccugauggaggccgccagcgccggccacguggagguggccagagugcugcuggaccacggcgccggcaucaacacccacagcaacgaguucaaggagagcgcccugacccuggccugcuacaagggccaccuggacauggugagauuccugcuggaggccggcgccgaccaggagcacaagaccgacgagaugcacaccgcccugauggaggccugcauggacggccacguggagguggccagacugcugcuggacagcggcgcccaggugaacaugcccgccgacagcuucgagagcccccugacccuggccgccugcggcggccacguggagcuggccgcccugcugaucgagagaggcgccaaccuggaggaggugaacgacgagggcuacaccccccugauggaggccgccagagagggccacgaggagaugguggcccugcugcuggcccagggcgccaacaucaacgcccagaccgaggagacccaggagaccgcccugacccuggccugcugcggcggcuucagcgagguggccgacuuccugaucaaggccggcgccgacaucgagcugggcugcagcaccccccugauggaggccagccaggagggccaccuggagcuggugaaguaccugcuggccagcggcgccaacgugcacgccaccaccgccaccggcgacaccgcccugaccuacgccugcgagaacggccacaccgacguggccgacgugcugcugcaggccggcgccgaccuggagcacgagagcgagggcggcagaaccccccugaugaaggccgccagagccggccaccugugcaccgugcaguuccugaucagcaagggcgccaacgugaacagagccaccgccaacaacgaccacaccguggugagccuggccugcgccggcggccaccuggccgugguggagcugcugcuggcccacggcgccgaccccacccacagacugaaggacggcagcaccaugcugaucgaggccgccaagggcggccacaccaacguggugagcuaccugcuggacuaccccaacaacgugcugagcgugcccaccaccgacgugagccagcugcccccccccagccaggaccagagccaggugcccagagugcccacccacacccuggccaugguggugcccccccaggagcccgacagaaccagccaggagaacagccccgcccugcugggcgugcagaagggcaccagcaagcagaagagcagcagccugcagguggccgaccaggaccugcugcccagcuuccaccccuaccagccccuggagugcaucguggaggagaccgagggcaagcugaacgagcugggccagagaaucagcgccaucgagaaggcccagcugaagagccuggagcugauccagggcgagccccugaacaaggacaagaucgaggagcugaagaagaacagagaggagcaggugcagaagaagaagaagauccugaaggagcugcagaagguggagagacagcugcagaugaagacccagcagcaguucaccaaggaguaccuggagaccaagggccagaaggacaccgugagccugcaccagcagugcagccacagaggcguguuccccgagggcgagggcgacggcagccugcccgaggaccacuucagcgagcugccccagguggacaccauccuguucaaggacaacgacguggacgacgagcagcagagcccccccagcgccgagcagaucgacuucgugcccgugcagccccugagcagcccccagugcaacuucagcagcgaccugggcagcaacggcaccaacagccuggagcugcagaaggugagcggcaaccagcagaucgugggccagccccagaucgccaucaccggccacgaccagggccugcuggugcaggagcccgacggccugaugguggccacccccgcccagacccugaccgacacccuggacgaccugaucgccgccgugagcaccagagugcccaccggcagcaacagcagcagccagaccaccgagugccugacccccgagagcugcagccagaccaccagcaacguggccagccagagcaugccccccguguaccccagcguggacaucgacgcccacaccgagagcaaccacgacaccgcccugacccuggccugcgccggcggccacgaggagcuggugagcgugcugaucgccagagacgccaagaucgagcacagagacaagaagggcuucaccccccugauccuggccgccaccgccggccacgugggcgugguggagauccugcuggacaagggcggcgacaucgaggcccagagcgagagaaccaaggacaccccccugagccuggccugcagcggcggcagacaggaggugguggaccugcugcuggccagaggcgccaacaaggagcacagaaacgugagcgacuacaccccccugagccuggccgccagcggcggcuacgugaacaucaucaagauccugcugaacgccggcgccgagaucaacagcagaaccggcagcaagcugggcaucagcccccugaugcuggccgccaugaacggccacgugcccgccgugaagcugcugcuggacaugggcagcgacaucaacgcccagaucgagaccaacagaaacaccgcccugacccuggccugcuuccagggcagagccgagguggugagccugcugcuggacagaaaggccaacguggagcacagagccaagaccggccugaccccccugauggaggccgccagcggcggcuacgccgaggugggcagagugcugcuggacaagggcgccgacgugaacgccccccccgugcccagcagcagagacaccgcccugaccaucgccgccgacaagggccacuacaaguucugcgagcugcugauccacagaggcgcccacaucgacgugagaaacaagaagggcaacaccccccuguggcuggccagcaacggcggccacuucgacguggugcagcugcuggugcaggccggcgccgacguggacgccgccgacaacagaaagaucaccccccugaugagcgccuucagaaagggccacgugaagguggugcaguaccuggugaaggaggugaaccaguuccccagcgacaucgagugcaugagauacaucgccaccaucaccgacaaggagcugcugaagaagugccaccagugcguggagaccaucgugaaggccaaggaccagcaggccgccgaggccaacaagaacgccagcauccugcugaaggagcuggaccuggagaagagcagagaggagagcagaaagcaggcccuggccgccaagagagagaagagaaaggagaagagaaagaagaagaaggaggagcagaagagaaagcaggaggaggacgaggagaacaagcccaaggagaacagcgagcugcccgaggacgaggacgaggaggagaacgacgaggacguggagcaggaggugcccaucgagccccccagcgccaccaccaccaccaccaucggcaucagcgccaccagcgccaccuucaccaacguguucggcaagaagagagccaacguggugaccacccccagcaccaacagaaagaacaagaagaacaagaccaaggagaccccccccaccgcccaccugauccugcccgagcagcacaugagccuggcccagcagaaggccgacaagaacaagaucaacggcgagcccagaggcggcggcgccggcggcaacagcgacagcgacaaccuggacagcaccgacugcaacagcgagagcagcagcggcggcaagagccaggagcugaacuucgugauggacgugaacagcagcaaguaccccagccugcugcugcacagccaggaggagaagaccagcaccgccaccagcaagacccagaccagacuggagggcgaggugacccccaacagccugagcaccagcuacaagaccgugagccugccccugagcagccccaacaucaagcugaaccugaccagccccaagagaggccagaagagagaggagggcuggaaggagguggugagaagaagcaagaagcugagcgugcccgccagcguggugagcagaaucaugggcagaggcggcugcaacaucaccgccauccaggacgugaccggcgcccacaucgacguggacaagcagaaggacaagaacggcgagagaaugaucaccaucagaggcggcaccgagagcaccagauacgccgugcagcugaucaacgcccugauccaggaccccgccaaggagcuggaggaccugauccccaagaaccacaucagaacccccgccagcaccaagagcauccacgccaacuucagcagcggcgugggcaccaccgccgccagcagcaagaacgccuucccccugggcgcccccacccuggugaccagccaggccaccacccugagcaccuuccagcccgccaacaagcugaacaagaacgugcccaccaacgugagaagcagcuuccccgugagccugccccuggccuacccccacccccacuucgcccugcuggccgcccagaccaugcagcagaucagacaccccagacugcccauggcccaguucggcggcaccuucagccccagccccaacaccuggggccccuuccccgugagacccgugaaccccggcaacaccaacagcagccccaagcacaacaacaccagcagacugcccaaccagaacggcaccgugcugcccagcgagagcgccggccuggccaccgccagcugccccaucaccgugagcagcgugguggccgccagccagcagcugugcgugaccaacaccagaacccccagcagcgugagaaagcagcuguucgccugcgugcccaagaccagcccccccgccaccgugaucagcagcgugaccagcaccugcagcagccugcccagcgugagcagcgcccccaucaccagcggccaggcccccaccaccuuccugcccgccagcaccagccaggcccagcugagcagccagaagauggagagcuucagcgccgugccccccaccaaggagaaggugagcacccaggaccagcccauggccaaccugugcacccccagcagcaccgccaacagcugcagcagcagcgccagcaacacccccggcgcccccgagacccaccccagcagcagccccacccccaccagcagcaacacccaggaggaggcccagcccagcagcgugagcgaccugagccccaugagcaugcccuucgccagcaacagcgagcccgccccccugacccugaccagccccagaaugguggccgccgacaaccaggacaccagcaaccugccccagcuggccgugcccgcccccagagugagccacagaaugcagcccagaggcagcuucuacagcauggugcccaacgccaccauccaccaggacccccagagcaucuucgugaccaaccccgugacccugacccccccccagggcccccccgccgccgugcagcugagcagcgccgugaacaucaugaacggcagccagaugcacaucaaccccgccaacaagagccugccccccaccuucggccccgccacccuguucaaccacuucagcagccuguucgacagcagccaggugcccgccaaccagggcuggggcgacggcccccugagcagcagaguggccaccgacgccagcuucaccgugcagagcgccuuccugggcaacagcgugcugggccaccuggagaacaugcaccccgacaacagcaaggcccccggcuucagaccccccagccagagagugagcaccagccccgugggccugcccagcaucgaccccagcggcagcagccccagcagcagcagcgccccccuggccagcuucagcggcauccccggcaccagaguguuccugcagggccccgcccccgugggcacccccagcuucaacagacagcacuucagcccccaccccuggaccagcgccagcaacagcagcaccagcgccccccccacccugggccagcccaagggcgugagcgccagccaggacagaaagauccccccccccaucggcaccgagagacuggccagaaucagacagggcggcagcguggcccaggcccccgccggcaccagcuucguggcccccgugggccacagcggcaucuggagcuucggcgugaacgccgugagcgagggccugagcggcuggagccagagcgugaugggcaaccaccccaugcaccagcagcugagcgaccccagcaccuucagccagcaccagcccauggagagagacgacagcggcaugguggcccccagcaacaucuuccaccagcccauggccagcggcuucguggacuucagcaagggccugcccaucagcauguacggcggcaccaucauccccagccacccccagcuggccgacgugcccggcggcccccuguucaacggccugcacaaccccgaccccgccuggaaccccaugaucaaggugauccagaacagcaccgagugcaccgacgcccagcaggccagccugcugcccagcgugcccgcccugaagggcgagauccccagcccccagcugaccagacccaagaagagaaucggcagacccaugguggccagccccaaccagagacaccaggaccaccugagacccaaggugcccgccggcgugcaggagcugacccacugccccgacaccccccugcugccccccagcgacagcagaggccacaacagcagcaacagccccagccugcaggccggcggcgccgagggcgccggcgacagaggcagagacaccagauaa

SEQ ID NO: 13586 - RNA, 7629 nt, Artificial Sequence
  ANKHD1__Homo_sapiens__NP_060217
augcugaccgacagcggcggcggcggcaccagcuucgaggaggaccuggacagcguggcccccagaagcgcccccgccggcgccagcgagccccccccccccggcggcgugggccugggcaucagaaccgugagacuguucggcgaggccggccccgccagcggcgugggcagcagcggcggcggcggcagcggcagcggcaccggcggcggcgacgccgcccuggacuucaagcuggccgccgccgugcugagaaccggcggcggcggcggcgccagcggcagcgacgaggacgaggugagcgagguggagagcuucauccuggaccaggaggaccuggacaaccccgugcugaagaccaccagcgagaucuuccugagcagcaccgccgagggcgccgaccugagaaccguggaccccgagacccaggccagacuggaggcccugcuggaggccgccggcaucggcaagcugagcaccgccgacggcaaggccuucgccgaccccgaggugcugagaagacugaccagcagcgugagcugcgcccuggacgaggccgccgccgcccugaccagaaugaaggccgagaacagccacaacgccggccagguggacaccagaagccuggccgaggccugcagcgacggcgacgugaacgccgugagaaagcugcuggacgagggcagaagcgugaacgagcacaccgaggagggcgagagccugcugugccuggccugcagcgccggcuacuacgagcuggcccaggugcugcuggccaugcacgccaacguggaggacagaggcaacaagggcgacaucaccccccugauggccgccagcagcggcggcuaccuggacaucgugaagcugcugcugcugcacgacgccgacgugaacagccagagcgccaccggcaacaccgcccugaccuacgccugcgccggcggcuucguggacaucgugaaggugcugcugaacgagggcgccaacaucgaggaccacaacgagaacggccacaccccccugauggaggccgccagcgccggccacguggagguggccagagugcugcuggaccacggcgccggcaucaacacccacagcaacgaguucaaggagagcgcccugacccuggccugcuacaagggccaccuggacauggugagauuccugcuggaggccggcgccgaccaggagcacaagaccgacgagaugcacaccgcccugauggaggccugcauggacggccacguggagguggccagacugcugcuggacagcggcgcccaggugaacaugcccgccgacagcuucgagagcccccugacccuggccgccugcggcggccacguggagcuggccgcccugcugaucgagagaggcgccaaccuggaggaggugaacgacgagggcuacaccccccugauggaggccgccagagagggccacgaggagaugguggcccugcugcuggcccagggcgccaacaucaacgcccagaccgaggagacccaggagaccgcccugacccuggccugcugcggcggcuucagcgagguggccgacuuccugaucaaggccggcgccgacaucgagcugggcugcagcaccccccugauggaggccagccaggagggccaccuggagcuggugaaguaccugcuggccagcggcgccaacgugcacgccaccaccgccaccggcgacaccgcccugaccuacgccugcgagaacggccacaccgacguggccgacgugcugcugcaggccggcgccgaccuggagcacgagagcgagggcggcagaaccccccugaugaaggccgccagagccggccaccugugcaccgugcaguuccugaucagcaagggcgccaacgugaacagagccaccgccaacaacgaccacaccguggugagccuggccugcgccggcggccaccuggccgugguggagcugcugcuggcccacggcgccgaccccacccacagacugaaggacggcagcaccaugcugaucgaggccgccaagggcggccacaccaacguggugagcuaccugcuggacuaccccaacaacgugcugagcgugcccaccaccgacgugagccagcugcccccccccagccaggaccagagccaggugcccagagugcccacccacacccuggccaugguggugcccccccaggagcccgacagaaccagccaggagaacagccccgcccugcugggcgugcagaagggcaccagcaagcagaagagcagcagccugcagguggccgaccaggaccugcugcccagcuuccaccccuaccagccccuggagugcaucguggaggagaccgagggcaagcugaacgagcugggccagagaaucagcgccaucgagaaggcccagcugaagagccuggagcugauccagggcgagccccugaacaaggacaagaucgaggagcugaagaagaacagagaggagcaggugcagaagaagaagaagauccugaaggagcugcagaagguggagagacagcugcagaugaagacccagcagcaguucaccaaggaguaccuggagaccaagggccagaaggacaccgugagccugcaccagcagugcagccacagaggcguguuccccgagggcgagggcgacggcagccugcccgaggaccacuucagcgagcugccccagguggacaccauccuguucaaggacaacgacguggacgacgagcagcagagcccccccagcgccgagcagaucgacuucgugcccgugcagccccugagcagcccccagugcaacuucagcagcgaccugggcagcaacggcaccaacagccuggagcugcagaaggugagcggcaaccagcagaucgugggccagccccagaucgccaucaccggccacgaccagggccugcuggugcaggagcccgacggccugaugguggccacccccgcccagacccugaccgacacccuggacgaccugaucgccgccgugagcaccagagugcccaccggcagcaacagcagcagccagaccaccgagugccugacccccgagagcugcagccagaccaccagcaacguggccagccagagcaugccccccguguaccccagcguggacaucgacgcccacaccgagagcaaccacgacaccgcccugacccuggccugcgccggcggccacgaggagcuggugagcgugcugaucgccagagacgccaagaucgagcacagagacaagaagggcuucaccccccugauccuggccgccaccgccggccacgugggcgugguggagauccugcuggacaagggcggcgacaucgaggcccagagcgagagaaccaaggacaccccccugagccuggccugcagcggcggcagacaggaggugguggaccugcugcuggccagaggcgccaacaaggagcacagaaacgugagcgacuacaccccccugagccuggccgccagcggcggcuacgugaacaucaucaagauccugcugaacgccggcgccgagaucaacagcagaaccggcagcaagcugggcaucagcccccugaugcuggccgccaugaacggccacgugcccgccgugaagcugcugcuggacaugggcagcgacaucaacgcccagaucgagaccaacagaaacaccgcccugacccuggccugcuuccagggcagagccgagguggugagccugcugcuggacagaaaggccaacguggagcacagagccaagaccggccugaccccccugauggaggccgccagcggcggcuacgccgaggugggcagagugcugcuggacaagggcgccgacgugaacgccccccccgugcccagcagcagagacaccgcccugaccaucgccgccgacaagggccacuacaaguucugcgagcugcugauccacagaggcgcccacaucgacgugagaaacaagaagggcaacaccccccuguggcuggccagcaacggcggccacuucgacguggugcagcugcuggugcaggccggcgccgacguggacgccgccgacaacagaaagaucaccccccugaugagcgccuucagaaagggccacgugaagguggugcaguaccuggugaaggaggugaaccaguuccccagcgacaucgagugcaugagauacaucgccaccaucaccgacaaggagcugcugaagaagugccaccagugcguggagaccaucgugaaggccaaggaccagcaggccgccgaggccaacaagaacgccagcauccugcugaaggagcuggaccuggagaagagcagagaggagagcagaaagcaggcccuggccgccaagagagagaagagaaaggagaagagaaagaagaagaaggaggagcagaagagaaagcaggaggaggacgaggagaacaagcccaaggagaacagcgagcugcccgaggacgaggacgaggaggagaacgacgaggacguggagcaggaggugcccaucgagccccccagcgccaccaccaccaccaccaucggcaucagcgccaccagcgccaccuucaccaacguguucggcaagaagagagccaacguggugaccacccccagcaccaacagaaagaacaagaagaacaagaccaaggagaccccccccaccgcccaccugauccugcccgagcagcacaugagccuggcccagcagaaggccgacaagaacaagaucaacggcgagcccagaggcggcggcgccggcggcaacagcgacagcgacaaccuggacagcaccgacugcaacagcgagagcagcagcggcggcaagagccaggagcugaacuucgugauggacgugaacagcagcaaguaccccagccugcugcugcacagccaggaggagaagaccagcaccgccaccagcaagacccagaccagacuggagggcgaggugacccccaacagccugagcaccagcuacaagaccgugagccugccccugagcagccccaacaucaagcugaaccugaccagccccaagagaggccagaagagagaggagggcuggaaggagguggugagaagaagcaagaagcugagcgugcccgccagcguggugagcagaaucaugggcagaggcggcugcaacaucaccgccauccaggacgugaccggcgcccacaucgacguggacaagcagaaggacaagaacggcgagagaaugaucaccaucagaggcggcaccgagagcaccagauacgccgugcagcugaucaacgcccugauccaggaccccgccaaggagcuggaggaccugauccccaagaaccacaucagaacccccgccagcaccaagagcauccacgccaacuucagcagcggcgugggcaccaccgccgccagcagcaagaacgccuucccccugggcgcccccacccuggugaccagccaggccaccacccugagcaccuuccagcccgccaacaagcugaacaagaacgugcccaccaacgugagaagcagcuuccccgugagccugccccuggccuacccccacccccacuucgcccugcuggccgcccagaccaugcagcagaucagacaccccagacugcccauggcccaguucggcggcaccuucagccccagccccaacaccuggggccccuuccccgugagacccgugaaccccggcaacaccaacagcagccccaagcacaacaacaccagcagacugcccaaccagaacggcaccgugcugcccagcgagagcgccggccuggccaccgccagcugccccaucaccgugagcagcgugguggccgccagccagcagcugugcgugaccaacaccagaacccccagcagcgugagaaagcagcuguucgccugcgugcccaagaccagcccccccgccaccgugaucagcagcgugaccagcaccugcagcagccugcccagcgugagcagcgcccccaucaccagcggccaggcccccaccaccuuccugcccgccagcaccagccaggcccagcugagcagccagaagauggagagcuucagcgccgugccccccaccaaggagaaggugagcacccaggaccagcccauggccaaccugugcacccccagcagcaccgccaacagcugcagcagcagcgccagcaacacccccggcgcccccgagacccaccccagcagcagccccacccccaccagcagcaacacccaggaggaggcccagcccagcagcgugagcgaccugagccccaugagcaugcccuucgccagcaacagcgagcccgccccccugacccugaccagccccagaaugguggccgccgacaaccaggacaccagcaaccugccccagcuggccgugcccgcccccagagugagccacagaaugcagcccagaggcagcuucuacagcauggugcccaacgccaccauccaccaggacccccagagcaucuucgugaccaaccccgugacccugacccccccccagggcccccccgccgccgugcagcugagcagcgccgugaacaucaugaacggcagccagaugcacaucaaccccgccaacaagagccugccccccaccuucggccccgccacccuguucaaccacuucagcagccuguucgacagcagccaggugcccgccaaccagggcuggggcgacggcccccugagcagcagaguggccaccgacgccagcuucaccgugcagagcgccuuccugggcaacagcgugcugggccaccuggagaacaugcaccccgacaacagcaaggcccccggcuucagaccccccagccagagagugagcaccagccccgugggccugcccagcaucgaccccagcggcagcagccccagcagcagcagcgccccccuggccagcuucagcggcauccccggcaccagaguguuccugcagggccccgcccccgugggcacccccagcuucaacagacagcacuucagcccccaccccuggaccagcgccagcaacagcagcaccagcgccccccccacccugggccagcccaagggcgugagcgccagccaggacagaaagauccccccccccaucggcaccgagagacuggccagaaucagacagggcggcagcguggcccaggcccccgccggcaccagcuucguggcccccgugggccacagcggcaucuggagcuucggcgugaacgccgugagcgagggccugagcggcuggagccagagcgugaugggcaaccaccccaugcaccagcagcugagcgaccccagcaccuucagccagcaccagcccauggagagagacgacagcggcaugguggcccccagcaacaucuuccaccagcccauggccagcggcuucguggacuucagcaagggccugcccaucagcauguacggcggcaccaucauccccagccacccccagcuggccgacgugcccggcggcccccuguucaacggccugcacaaccccgaccccgccuggaaccccaugaucaaggugauccagaacagcaccgagugcaccgacgcccagcagaucuggcccggcaccugggccccccacaucggcaacaugcaccugaaguacgugaacuaa

SEQ ID NO: 13587 - RNA, 1479 nt, Artificial Sequence
  ANKH__Homo_sapiens__NP_473368
auggugaaguuccccgcccugacccacuacuggccccugaucagauuccuggugccccugggcaucaccaacaucgccaucgacuucggcgagcaggcccugaacagaggcaucgccgccgugaaggaggacgccguggagaugcuggccagcuacggccuggccuacagccugaugaaguucuucaccggccccaugagcgacuucaagaacgugggccugguguucgugaacagcaagagagacagaaccaaggccgugcugugcauggugguggccggcgccaucgccgccguguuccacacccugaucgccuacagcgaccugggcuacuacaucaucaacaagcugcaccacguggacgagagcgugggcagcaagaccagaagagccuuccuguaccuggccgccuuccccuucauggacgccauggccuggacccacgccggcauccugcugaagcacaaguacagcuuccuggugggcugcgccagcaucagcgacgugaucgcccaggugguguucguggccauccugcugcacagccaccuggagugcagagagccccugcugauccccauccugagccuguacaugggcgcccuggugagaugcaccacccugugccugggcuacuacaagaacauccacgacaucauccccgacagaagcggccccgagcugggcggcgacgccaccaucagaaagaugcugagcuucugguggccccuggcccugauccuggccacccagagaaucagcagacccaucgugaaccuguucgugagcagagaccugggcggcagcagcgccgccaccgaggccguggccauccugaccgccaccuaccccgugggccacaugcccuacggcuggcugaccgagaucagagccguguaccccgccuucgacaagaacaaccccagcaacaagcuggugagcaccagcaacaccgugaccgccgcccacaucaagaaguucaccuucgugugcauggcccugagccugacccugugcuucgugauguucuggacccccaacgugagcgagaagauccugaucgacaucaucggcguggacuucgccuucgccgagcugugcguggugccccugagaaucuucagcuucuuccccgugcccgugaccgugagagcccaccugaccggcuggcugaugacccugaagaagaccuucgugcuggcccccagcagcgugcugagaaucaucgugcugaucgccagccugguggugcugcccuaccugggcgugcacggcgccacccugggcgugggcagccugcuggccggcuucgugggcgagagcaccaugguggccaucgccgccugcuacguguacagaaagcagaagaagaagauggagaacgagagcgccaccgagggcgaggacagcgccaugaccgacaugccccccaccgaggaggugaccgacaucguggagaugagagaggagaacgaguaa

SEQ ID NO: 13588 - RNA, 2298 nt, Artificial Sequence
  ANKK1__Homo_sapiens__NP_848605
auggccgccgaccccaccgagcugagacugggcagccugcccguguucaccagagacgacuucgagggcgacuggagacugguggccagcggcggcuucagccagguguuccaggccagacacagaagauggagaaccgaguacgccaucaagugcgcccccugccugccccccgacgccgccagcagcgacgugaacuaccugaucgaggaggccgccaagaugaagaagaucaaguuccagcacaucgugagcaucuacggcgugugcaagcagccccugggcaucgugauggaguucauggccaacggcagccuggagaaggugcugagcacccacagccugugcuggaagcugagauucagaaucauccacgagaccagccuggccaugaacuuccugcacagcaucaagcccccccugcugcaccuggaccugaagcccggcaacauccugcuggacagcaacaugcacgugaagaucagcgacuucggccugagcaaguggauggagcagagcaccagaaugcaguacaucgagagaagcgcccugagaggcaugcugagcuacaucccccccgagauguuccuggagagcaacaaggcccccggccccaaguacgacguguacagcuucgccaucgugaucugggagcugcugacccagaagaagcccuacagcggcuucaacaugaugaugaucaucaucagaguggccgccggcaugagacccagccugcagcccgugagcgaccaguggcccagcgaggcccagcagaugguggaccugaugaagagaugcugggaccaggaccccaagaagagacccugcuuccuggacaucaccaucgagaccgacauccugcugagccugcugcagagcagaguggccgugcccgagagcaaggcccuggccagaaaggugagcugcaagcugagccugagacagcccggcgaggugaacgaggacaucagccaggagcugauggacagcgacagcggcaacuaccugaagagagcccugcagcugagcgacagaaagaaccuggugcccagagacgaggagcugugcaucuacgagaacaaggugaccccccugcacuuccugguggcccagggcagcguggagcaggugagacugcugcuggcccacgagguggacguggacugccagaccgccagcggcuacaccccccugcugaucgccgcccaggaccagcagcccgaccugugcgcccugcugcuggcccacggcgccgacgccaacagaguggacgaggacggcugggccccccugcacuucgccgcccagaacggcgacgacggcaccgccagacugcugcuggaccacggcgccugcguggacgcccaggagagagagggcuggaccccccugcaccuggccgcccagaacaacuucgagaacguggccagacugcuggugagcagacaggccgaccccaaccugcacgaggccgagggcaagaccccccugcacguggccgccuacuucggccacgugagccuggugaagcugcugaccagccagggcgccgagcuggacgcccagcagagaaaccugagaaccccccugcaccuggccguggagagaggcaaggugagagccauccagcaccugcugaagagcggcgccgugcccgacgcccuggaccagagcggcuacggcccccugcacaccgccgccgccagaggcaaguaccugaucugcaagaugcugcugagauacggcgccagccuggagcugcccacccaccagggcuggaccccccugcaccuggccgccuacaagggccaccuggagaucauccaccugcuggccgagagccacgccaacaugggcgcccugggcgccgugaacuggaccccccugcaccuggccgccagacacggcgaggaggccguggugagcgcccugcugcagugcggcgccgaccccaacgccgccgagcagagcggcuggaccccccugcaccuggccgugcagagaagcaccuuccugagcgugaucaaccugcuggagcaccacgccaacgugcacgccagaaacaaggugggcuggacccccgcccaccuggccgcccugaagggcaacaccgccauccugaaggugcugguggaggccggcgcccagcuggacgugcaggacggcgugagcugcaccccccugcagcuggcccugagaagcagaaagcagggcaucaugagcuuccuggagggcaaggagcccagcguggccacccugggcggcagcaagcccggcgccgagauggagaucuaa

SEQ ID NO: 13589 - RNA, 1956 nt, Artificial Sequence
  ANKLE1__Homo_sapiens__NP_001265373
auguggacccccgugagaagaggcgccgccuggcugggcacccugcugggccccggcgagggcccccccgagcccagaggcggcgccgcccacgcccacaagccccccgccggcagcagaaagagcaccgaccaggccgugagauucggccccagccagggcaugugcagcgaggccagacuggccagaagacugagagacgcccugagagaggaggagcccugggccguggaggagcugcugagaugcggcgccgaccccaaccuggugcuggaggacggcgccgccgccgugcaccuggccgccggcgccagacaccccagaggccugagaugccugggcgcccugcugagacagggcggcgaccccaacgccagaagcguggaggcccugaccccccugcacguggccgccgccuggggcugcagaagaggccuggagcugcugcugagccagggcgccgaccccgcccugagagaccaggacggccugagaccccuggaccuggcccugcagcagggccaccuggagugcgccagagugcugcaggaccuggacaccagaaccagaaccagaaccagaaucggcgccgagacccaggagcccgagcccgcccccggcacccccggccugagcggccccaccgacgagacccuggacagcaucgcccugcagaagcagcccugcagaggcgacaacagagacaucggccuggaggccgaccccggcccccccagccugcccgugccccuggagaccguggacaagcacggcagcagcgccagcccccccggccacugggacuacagcagcgacgccagcuucgugaccgccguggaggugagcggcgccgaggaccccgccagcgacaccccccccugggccggcagccugccccccaccagacagggccugcugcacguggugcacgccaaccagagagugcccagaagccagggcaccgaggccgagcugaacgccagacugcaggcccugacccugaccccccccaacgccgccggcuuccagagcagccccagcagcaugccccugcuggacagaagccccgcccacagcccccccagaacccccacccccggcgccagcgacugccacugccugugggagcaccagaccagcaucgacagcgacauggccacccuguggcugaccgaggacgaggccagcagcaccggcggcagagagcccgugggccccugcagacaccugcccgugagcaccgugagcgaccuggagcugcugaagggccugagagcccugggccccgaguucagcggccacagccuggagcuggccgccgcccugagaaccggcugcauccccgacgugcaggccgacgaggacgcccuggcccagcaguucgagcagcccgaccccgccagaagauggagagagggcguggugaagagcagcuucaccuaccugcugcuggaccccagagagacccaggaccugcccgccagagccuucagccugacccccgccgagagacugcagaccuucaucagagccaucuucuacgugggcaagggcaccagagccagacccuacgugcaccugugggaggcccugggccaccacggcagaagcagaaagcagggcagcagaagaagccccaccagaagcaagggcaccgccauggagugguggcaggccggccaccugcugguggccggcgccuggggcugcaccugcugcaccgugcccagccugagcagcuggcugaaggccagcgacagcuucauccccagaaccagcagacccggcgccgagugcuggggcgugggccaccccgccuggggcgagauguucgagugcagcagcugccccaugcugaccgccgcccccaucagcggcuucagaagaggcgugugcgugugcgugugcgugugcgugugcgugugcgugugccugugcgugugcgugugcguguaa

SEQ ID NO: 13590 - RNA, 2817 nt, Artificial Sequence
  ANKLE2__Homo_sapiens__NP_055929
augcuguggcccagacuggccgccgccgagugggccgcccuggccugggagcugcugggcgccagcgugcugcugaucgccgugagauggcuggugagaagacugggccccagacccggcggccugggcagaagcggcacccccgugcccccccccagcgccgccgccgcccccgccagcggcgagaugaccauggacgcccugcuggccagacugaagcugcugaaccccgacgaccugagagaggagaucgugaaggccggccugaagugcggccccaucaccagcaccaccagauucaucuucgagaagaagcuggcccaggcccugcuggagcagggcggcagacugagcagcuucuaccaccacgaggccggcgugaccgcccugagccaggacccccagagaauccugaagcccgccgagggcaaccccaccgaccaggccggcuucagcgaggacagagacuucggcuacagcgugggccugaacccccccgaggaggaggccgugaccagcaagaccugcagcgugccccccagcgacaccgacaccuacagagccggcgccaccgccagcaaggagcccccccuguacuacggcgugugccccguguacgaggacgugcccgccagaaacgagagaaucuacguguacgagaacaagaaggaggcccugcaggccgugaagaugaucaagggcagcagauucaaggccuucagcaccagagaggacgccgagaaguucgccagaggcaucugcgacuacuuccccagccccagcaagaccagccugccccugagccccgugaagaccgccccccuguucagcaacgacagacugaaggacggccugugccugagcgagagcgagaccgugaacaaggagagagccaacagcuacaagaaccccagaacccaggaccugaccgccaagcugagaaaggccguggagaagggcgaggaggacaccuucagcgaccugaucuggagcaaccccagauaccugaucggcagcggcgacaaccccaccaucgugcaggagggcugcagauacaacgugaugcacguggccgccaaggagaaccaggccagcaucugccagcugacccuggacgugcuggagaaccccgacuucaugagacugauguaccccgacgacgacgaggccaugcugcagaagagaaucagauacgugguggaccuguaccugaacacccccgacaagaugggcuacgacaccccccugcacuucgccugcaaguucggcaacgccgacguggugaacgugcugagcagccaccaccugaucgugaagaacagcagaaacaaguacgacaagacccccgaggacgugaucugcgagagaagcaagaacaagagcguggagcugaaggagagaaucagagaguaccugaagggccacuacuacgugccccugcugagagccgaggagaccagcagccccgugaucggcgagcuguggagccccgaccagaccgccgaggccagccacgugagcagauacggcggcagccccagagaccccgugcugacccugagagccuucgccggcccccugagccccgccaaggccgaggacuucagaaagcuguggaagaccccccccagagagaaggccggcuuccugcaccacgugaagaagagcgaccccgagagaggcuucgagagagugggcagagagcuggcccacgagcugggcuaccccuggguggaguacugggaguuccugggcugcuucguggaccugagcagccaggagggccugcagagacuggaggaguaccugacccagcaggagaucggcaagaaggcccagcaggagaccggcgagagagaggccagcugcagagacaaggccaccaccagcggcagcaacagcaucagcgugagagccuuccuggacgaggacgacaugagccuggaggagaucaagaacagacagaacgccgccagaaacaacagcccccccaccgugggcgccuucggccacaccagaugcagcgccuucccccuggagcaggaggccgaccugaucgaggccgccgagcccggcggcccccacagcagcagaaacggccugugccacccccugaaccacagcagaacccuggccggcaagagacccaaggcccccagaggcgaggaggcccaccugccccccgugagcgaccugaccguggaguucgacaagcugaaccugcagaacaucggcagaagcgugagcaagacccccgacgagagcaccaagaccaaggaccagauccugaccagcagaaucaacgccguggagagagaccugcuggagcccagccccgccgaccagcugggcaacggccacagaagaaccgagagcgagaugagcgccagaaucgccaagaugagccugagccccagcagccccagacacgaggaccagcuggaggugaccagagagcccgccagaagacuguuccuguucggcgaggagcccagcaagcuggaccaggacgugcuggccgcccuggagugcgccgacguggacccccaccaguuccccgccgugcacagauggaagagcgccgugcugugcuacagccccagcgacagacagagcuggcccagccccgccgugaagggcagauucaagagccagcugcccgaccugagcggcccccacagcuacagccccggcagaaacagcguggccggcagcaaccccgccaagcccggccugggcagccccggcagauacagccccgugcacggcagccagcugagaagaauggccagacuggccgagcuggccgcccuguaa

SEQ ID NO: 13591 - RNA, 3093 nt, Artificial Sequence
  ANKMY1__Homo_sapiens__NP_001269700
auggagggcgcccacgccagccugagccuggaggacgaggugagcggcgccggcagcagacagagaccccuggagggcaagggcggcgagacccccgccgccgaggagcccggcagccugaagaacuacgccguguucgccaccagagacgugagcgccgcccccgagaaggaggaggaggaggccgagggcccccugagagcccaggaccugagagagagcuacauccagcuggugcagggcgugcaggaguggcaggacggcugcauguaccagggcgaguucggccugaacaugaagcugggcuacggcaaguucagcuggcccaccggcgagagcuaccacggccaguucuacagagaccacugccacggccugggcaccuacauguggcccgacggcagcagcuucaccggcaccuucuaccugagccacagagagggcuacggcaccauguacaugaagaccagacuguuccagggccuguacaaggccgaccagagauucggccccggcguggagaccuaccccgacggcagccaggacgugggccugugguucagagagcagcugaucaagcugugcacccagauccccagcggcuucagccugcugagauaccccgaguucagcagcuucaucacccacagccccgccagaaucagccugagcgaggaggagaagaccgaguggggccugcaggagggccaggaccccuucuucuacgacuacaagagauuccugcugaacgacaaccugacccugccccccgagauguacguguacagcaccaacagcgaccaccugcccaugaccagcagcuucagaaaggagcuggacgccagaaucuuccugaacgagaucccccccuucguggaggacggcgagcccugguucaucaucaacgagaccccccugcuggugaagauccagaagcagaccuacaaguucagaaacaagcccgcccacaccagcuggaacaugggcgccauccuggagggcaagagaagcggcuucgcccccugcggccccaaggagcagcugagcauggagaugauccugaaggccgaggagggcaaccacgaguggaucugcagaauccugaaggacaacuucgccagcgccgacguggccgacgccaagggcuacaccgugcuggccgccgccgccacccacugccacaacgacaucgugaaccugcugcuggacugcggcgccgacgugaacaagugcagcgacgagggccugaccgcccugagcaugugcuuccugcugcacuaccccgcccagagcuucaagcccaacguggccgagagaaccauccccgagccccaggagccccccaaguuccccguggugcccauccugagcagcagcuucauggacaccaaccuggagagccuguacuacgaggugaacgugcccagccagggcagcuacgagcugagacccccccccgccccccugcugcugcccagagugagcggcagccacgagggcggccacuuccaggacaccggccagugcggcggcagcaucgaccacagaagcagcagccugaagggcgacagcccccuggugaagggcagccugggccacguggagagcggccuggaggacgugcugggcaacaccgacagaggcagccugugcagcgccgagaccaaguucgagagcaacgugugcgugugcgacuucagcaucgagcugagccaggccaugcuggagagaagcgcccagagccacagccugcugaagauggccagccccagccccugcaccagcagcuucgacaagggcaccaugagaagaauggcccugagcaugaucgagagaagaaagagauggagaaccaucaagcugcugcugagaagaggcgccgaccccaaccugugcugcgugcccaugcaggugcuguuccuggccgugaaggccggcgacguggacggcgugagacugcugcuggagcacggcgccagaaccgacaucugcuuccccccccagcugagcacccugaccccccugcacaucgccgccgcccugcccggcgaggagggcgugcagaucguggagcugcugcugcacgccaucaccgacguggacgccaaggccagcgacgaggacgacaccuacaagcccggcaagcuggaccugcugcccagcagccugaagcugagcaacgagcccggccccccccaggccuacuacagcaccgacaccgcccugcccgaggagggcggcagaaccgcccugcacauggccugcgagagagaggacgacaacaagugcgccagagacaucgugagacugcugcugagccacggcgccaaccccaaccugcuguggagcggccacagcccccugagccugagcaucgccagcggcaacgagcugguggugaaggagcugcugacccagggcgccgaccccaaccugccccugaccaagggccugggcagcgcccugugcguggccugcgaccugaccuacgagcaccagagaaacauggacagcaagcuggcccugaucgacagacugaucagccacggcgccgacauccugaagcccgugaugcugagacagggcgagaaggaggccgugggcaccgccguggacuacggcuacuucagauucuuccaggacagaagaaucgccagaugccccuuccacacccugaugcccgccgagagagagaccuuccuggccagaaagagacugcuggaguacaugggccugcagcugagacaggccguguucgccaaggagagccagugggaccccaccuggcuguaccugugcaagagagccgagcugauccccagccacagaaugaagaagaagggccccagccugcccagaggccuggacgugaaggagcagggccagauccccuucuucaaguucugcuaccagugcggcagaagcaucggcgugagacugcugcccugccccagaugcuacggcauccugaccugcagcaaguacugcaagaccaaggccuggaccgaguuccacaagaaggacugcggcgaccugguggccaucgugacccagcuggagcaggugagcagaagaagagaggaguuccaguaa

SEQ ID NO: 13592 - RNA, 663 nt, Artificial Sequence
  ANKRD10__Homo_sapiens__NP_001273650
augagcgccgccggcgccggcgccggcguggaggccggcuucagcagcgaggagcugcugagccugagauucccccugcacagagccugcagagacggcgaccuggccacccugugcagccugcugcagcagaccccccacgcccaccuggccagcgaggacagcuucuacggcuggacccccgugcacugggccgcccacuucggcaagcuggagugccuggugcagcuggugagagccggcgccacccugaacgugagcaccaccagauacgcccagacccccgcccacaucgccgccuucggcggccacccccagugccugguguggcugauccaggccggcgccaacaucaacaagcccgacugcgagggcgagacccccauccacaaggccgccagaagcggcagccuggagugcaucagcgcccugguggccaacggcgcccacguggaguucaucagccagagcagcgugcacagcugccugcccggcgagcugcagcacggcgugaccuucgaccccagcgugcugauccagugccugaagcccgagaagugccaguggcccgacagcagcagacacugcaccaaccccggcuuccccagagugugccccgugagccuggagccccccgagcugagcagcgagcccuuccuguaa

SEQ ID NO: 13593 - RNA, 7992 nt, Artificial Sequence
  ANKRD11__Homo_sapiens__NP_037407
augcccaagggcggcugccccaaggccccccagcaggaggagcugccccugagcagcgacaugguggagaagcagaccggcaagaaggacaaggacaaggugagccugaccaagacccccaagcuggagagaggcgacggcggcaaggaggugagagagagagccagcaagagaaagcugcccuucaccgccggcgccaacggcgagcagaaggacagcgacaccgagaagcagggccccgagagaaagagaaucaagaaggagcccgugaccagaaaggccggccugcuguucggcaugggccugagcggcaucagagccggcuacccccugagcgagagacagcagguggcccugcugaugcagaugaccgccgaggagagcgccaacagccccguggacaccacccccaagcaccccagccagagcaccgugugccagaagggcacccccaacagcgccagcaagaccaaggacaaggugaacaagagaaacgagagaggcgagaccagacugcacagagccgccaucagaggcgacgccagaagaaucaaggagcugaucagcgagggcgccgacgugaacgugaaggacuucgccggcuggaccgcccugcacgaggccugcaacagaggcuacuacgacguggccaagcagcugcuggccgccggcgccgaggugaacaccaagggccuggacgacgacaccccccugcacgacgccgccaacaacggccacuacaagguggugaagcugcugcugagauacggcggcaacccccagcagagcaacagaaagggcgagaccccccugaagguggccaacagccccaccauggugaaccugcugcugggcaagggcaccuacaccagcagcgaggagagcagcaccgagagcagcgaggaggaggacgcccccagcuucgcccccagcagcagcguggacggcaacaacaccgacagcgaguucgagaagggccugaagcacaaggccaagaaccccgagccccagaaggccaccgcccccgugaaggacgaguacgaguucgacgaggacgacgagcaggacagagugccccccguggacgacaagcaccugcugaagaaggacuacagaaaggagaccaagagcaacagcuucaucagcauccccaagauggaggugaagagcuacaccaagaacaacaccaucgcccccaagaaggccagccacagaauccugagcgacaccagcgacgaggaggacgccagcgugaccgugggcaccggcgagaagcugagacugagcgcccacaccauccugcccggcagcaagaccagagagcccagcaacgccaagcagcagaaggagaagaacaaggugaagaagaagagaaagaaggagaccaagggcagagaggugagauucggcaagagaagcgacaaguucugcagcagcgagagcgagagcgagagcagcgagagcggcgaggacgacagagacagccugggcagcagcggcugccugaagggcagcccccuggugcugaaggaccccagccuguucagcagccugagcgccagcagcaccagcagccacggcagcagcgccgcccagaagcagaaccccagccacaccgaccagcacaccaagcacuggagaaccgacaacuggaagaccaucagcagccccgccuggagcgaggugagcagccugagcgacagcaccagaaccagacugaccagcgagagcgacuacagcagcgagggcagcagcguggagagccugaagcccgugagaaagagacaggagcacagaaagagagccagccugagcgagaagaagagccccuuccugagcagcgccgagggcgccgugcccaagcuggacaaggagggcaagguggugaagaagcacaagaccaagcacaagcacaagaacaaggagaagggccagugcagcaucagccaggagcugaagcugaagagcuucaccuacgaguacgaggacagcaagcagaagagcgacaaggccauccugcuggagaacgaccugagcaccgagaacaagcugaaggugcugaagcacgacagagaccacuucaagaaggaggagaagcugagcaagaugaagcuggaggagaaggaguggcuguucaaggacgagaagagccugaagagaaucaaggacaccaacaaggacaucagcagaagcuucagagaggagaaggacagaagcaacaaggccgagaaggagagaagccugaaggagaagagccccaaggaggagaagcugagacuguacaaggaggagagaaagaagaagagcaaggacagacccagcaagcuggagaagaagaacgaccugaaggaggacaagaucagcaaggagaaggagaagaucuucaaggaggacaaggagaagcugaagaaggagaagguguacagagaggacagcgccuucgacgaguacugcaacaagaaccaguuccuggagaacgaggacaccaaguucagccugagcgacgaccagagagacagaugguucagcgaccugagcgacagcagcuucgacuucaagggcgaggacagcugggacagccccgugaccgacuacagagacaugaagagcgacagcguggccaagcugauccuggagaccgugaaggaggacagcaaggagagaagaagagacagcagagccagagagaagagagacuacagagagcccuucuucagaaagaaggacagagacuaccuggacaagaacagcgagaagagaaaggagcagaccgagaagcacaagagcgugcccggcuaccugagcgagaaggacaagaagagaagagagagcgccgaggccggcagagacagaaaggacgcccuggagagcugcaaggagagaagagacggcagagccaagcccgaggaggcccacagagaggagcugaaggagugcggcugcgagagcggcuucaaggacaagagcgacggcgacuucggcaagggccuggagcccugggagagacaccaccccgccagagagaaggagaagaaggacggccccgacaaggagagaaaggagaagaccaagcccgagagauacaaggagaagagcagcgacaaggacaagagcgagaagagcauccuggagaagugccagaaggacaaggaguucgacaagugcuucaaggagaagaaggacaccaaggagaagcacaaggacacccacggcaaggacaaggagagaaaggccagccuggaccagggcaaggagaagaaggagaaggccuuccccggcaucaucagcgaggacuucagcgagaagaaggacgacaagaagggcaaggagaagagcugguacaucgccgacaucuucaccgacgagagcgaggacgacagagacagcugcaugggcagcggcuucaagaugggcgaggccagcgaccugcccagaaccgacggccugcaggagaaggaggagggcagagaggccuacgccagcgacagacacagaaagagcagcgacaagcagcaccccgagagacagaaggacaaggagcccagagacagaagaaaggacagaggcgccgccgacgccggcagagacaagaaggagaagguguucgagaagcacaaggagaagaaggacaaggagagcaccgagaaguacaaggacagaaaggacagagccagcguggacagcacccaggacaagaagaacaagcagaagcugcccgagaaggccgagaagaagcacgccgccgaggacaaggccaagagcaagcacaaggagaagagcgacaaggagcacagcaaggagagaaagagcagcagaagcgccgacgccgagaagagccugcuggagaagcuggaggaggaggcccugcacgaguacagagaggacagcaacgacaagaucagcgaggugagcagcgacagcuucaccgacagaggccaggagcccggccugaccgccuuccuggaggugagcuucaccgagccccccggcgacgacaagcccagagagagcgccugccugcccgagaagcugaaggagaaggagagacacagacacagcagcagcagcagcaagaagagccacgacagagagagagccaagaaggagaaggccgagaagaaggagaagggcgaggacuacaaggagggcggcagcagaaaggacagcggccaguacgagaaggacuuccuggaggccgacgccuacggcgugagcuacaacaugaaggccgacaucgaggacgagcuggacaagaccaucgagcuguucagcaccgagaagaaggacaagaacgacagcgagagagagcccagcaagaagaucgagaaggagcugaagcccuacggcagcagcgccaucaacauccugaaggagaagaagaagagagagaagcacagagagaaguggagagacgagaaggagagacacagagacagacacgccgacggccugcugagacaccacagagacgagcugcugagacaccacagagacgagcagaagcccgccaccagagacaaggacagcccccccagagugcugaaggacaagagcagagacgagggccccagacugggcgacgccaagcugaaggagaaguucaaggacggcgccgagaaggagaagggcgaccccgugaagaugagcaacggcaacgacaagguggcccccagcaaggaccccggcaagaaggacgccagacccagagagaagcugcugggcgacggcgaccugaugaugaccagcuucgagagaaugcugagccagaaggaccuggagaucgaggagagacacaagagacacaaggagagaaugaagcagauggagaagcugagacacagaagcggcgaccccaagcugaaggagaaggccaagcccgccgacgacggcagaaagaagggccuggacauccccgccaagaagccccccggccuggacccccccuucaaggacaagaagcugaaggagagcacccccaucccccccgccgccgagaacaagcugcaccccgccagcggcgccgacagcaaggacuggcuggccggcccccacaugaaggaggugcugcccgccagccccagacccgaccagagcagacccaccggcgugcccacccccaccagcgugcugagcugccccagcuacgaggaggugaugcacacccccagaacccccagcugcagcgccgacgacuacgccgaccugguguucgacugcgccgacagccagcacagcacccccgugcccaccgcccccaccagcgccugcagccccagcuucuucgacagauucagcguggccagcagcggccugagcgagaacgccagccaggcccccgccagaccccugagcaccaaccuguacagaagcgugagcguggacaucagaagaacccccgaggaggaguucagcgugggcgacaagcuguucagacagcagagcgugcccgccgccagcagcuacgacagccccaugccccccagcauggaggacagagccccccugccccccgugcccgccgagaaguucgccugccugagccccggcuacuacagccccgacuacggccugcccagccccaagguggacgcccugcacugcccccccgccgccguggugaccgugacccccagccccgagggcguguucagcagccugcaggccaagcccagccccagccccagagccgagcugcuggugcccagccuggagggcgcccugccccccgaccuggacaccagcgaggaccagcaggccaccgccgccaucaucccccccgagcccagcuaccuggagccccuggacgagggccccuucagcgccgugaucaccgaggagcccguggagugggcccaccccagcgagcaggcccuggccagcagccugaucggcggcaccagcgagaaccccgugagcuggcccgugggcagcgaccugcugcugaagagcccccagagauuccccgagagccccaagagauucugccccgccgacccccugcacagcgccgcccccggccccuucagcgccagcgaggcccccuaccccgccccccccgccagccccgcccccuacgcccugcccguggccgagcccggccuggaggacgugaaggacggcguggacgccgugcccgccgccaucagcaccagcgaggccgcccccuacgccccccccagcggccuggagagcuucuucagcaacugcaagagccugcccgaggccccccuggacguggcccccgagcccgccugcguggccgccguggcccagguggaggcccugggcccccuggagaacagcuuccuggacggcagcagaggccugagccaccugggccagguggagcccgugcccugggccgacgccuucgccggccccgaggacgaccuggaccugggccccuucagccugcccgagcugccccugcagaccaaggacgccgccgacggcgaggccgagcccguggaggagagccuggccccccccgaggagaugccccccggcgcccccggcgugaucaacggcggcgacgugagcaccgugguggccgaggagccccccgcccugccccccgaccaggccagcaccagacugcccgccgagcuggagcccgagcccagcggcgagcccaagcuggacguggcccuggaggccgccguggaggccgagaccgugcccgaggagagagccagaggcgaccccgacagcagcguggagcccgcccccgugccccccgagcagagaccccugggcagcggcgaccagggcgccgaggccgagggcccccccgccgccagccugugcgcccccgacggccccgcccccaacaccguggcccaggcccaggccgccgacggcgccggccccgaggacgacaccgaggccagcagagccgccgcccccgccgagggcccccccggcggcauccagcccgaggccgccgagcccaagcccaccgccgaggcccccaaggcccccagaguggaggagaucccccagagaaugaccagaaacagagcccagaugcuggccaaccagagcaagcagggccccccccccagcgagaaggagugcgcccccacccccgcccccgugaccagagccaaggccagaggcagcgaggacgacgacgcccaggcccagcaccccagaaagagaagauuccagagaagcacccagcagcugcagcagcagcugaacaccagcacccagcagaccagagaggugauccagcagacccuggccgccaucguggacgccaucaagcuggacgccaucgagcccuaccacagcgacagagccaaccccuacuucgaguaccugcagaucagaaagaagaucgaggagaagagaaagauccugugcugcaucaccccccaggccccccagugcuacgccgaguacgugaccuacaccggcagcuaccugcuggacggcaagccccugagcaagcugcacauccccgugaucgcccccccccccagccuggccgagccccugaaggagcuguucagacagcaggaggccgugagaggcaagcugagacugcagcacagcaucgagagagagaagcugaucgugagcugcgagcaggagauccugagagugcacugcagagccgccagaaccaucgccaaccaggccgugcccuucagcgccugcaccaugcugcuggacagcgagguguacaacaugccccuggagagccagggcgacgagaacaagagcgugagagacagauucaacgccagacaguucaucagcuggcugcaggacguggacgacaaguacgacagaaugaagaccugccugcugaugagacagcagcacgaggccgccgcccugaacgccgugcagagaauggaguggcagcugaaggugcaggagcuggaccccgccggccacaagagccugugcgugaacgaggugcccagcuucuacgugcccaugguggacgugaacgacgacuucgugcugcugcccgccuaa

SEQ ID NO: 13594 - RNA, 6120 nt, Artificial Sequence
  ANKRD12__Homo_sapiens__NP_001190985
augcccaagagcggcuucaccaagcccauccagagcgagaacagcgacagcgacagcaacaugguggagaagcccuacggcagaaagagcaaggacaagaucgccagcuacagcaagacccccaagaucgagagaagcgacgugagcaaggagaugaaggagaagagcagcaugaagagaaagcugcccuucaccaucagccccagcagaaacgaggagagagacagcgacaccgagaaggagggccccgagaagaagaagaccaagaaggaggccggcaacaagaagagcacccccgugagcauccuguucggcuacccccugagcgagagaaagcagauggcccugcugaugcagaugaccgccagagacaacagccccgacagcacccccaaccaccccagccagaccacccccgcccagaagaagacccccagcagcagcagcagacagaaggacaaggugaacaagagaaacgagagaggcgagaccccccugcacauggccgccaucagaggcgacgugaagcaggugaaggagcugaucagccugggcgccaacgugaacgugaaggacuucgccggcuggaccccccugcacgaggccugcaacgugggcuacuacgacguggccaagauccugaucgccgccggcgccgacgugaacacccagggccuggacgacgacaccccccugcacgacagcgccagcagcggccacagagacaucgugaagcugcugcugagacacggcggcaaccccuuccaggccaacaagcacggcgagagacccguggacguggccgagaccgaggagcuggagcugcugcugaagagagaggugccccugagcgacgacgacgagagcuacaccgacagcgaggaggcccagagcgugaaccccagcagcguggacgagaacaucgacagcgagaccgagaaggacagccugaucugcgagagcaagcagauccugcccagcaagaccccccugcccagcgcccuggacgaguacgaguucaaggacgacgacgacgaggagaucaacaagaugaucgacgacagacacauccugagaaaggagcagagaaaggagaacgagcccgaggccgagaagacccaccuguucgccaagcaggagaaggccuucuaccccaagagcuucaagagcaagaagcagaagcccagcagagugcuguacagcagcaccgagagcagcgacgaggaggcccugcagaacaagaagaucagcaccagcugcagcgugauccccgagaccagcaacagcgacaugcagaccaagaaggaguacguggugagcggcgagcacaagcagaagggcaaggugaagagaaagcugaagaaccagaacaagaacaaggagaaccaggagcugaagcaggagaaggagggcaaggagaacaccagaaucaccaaccugaccgugaacaccggccuggacugcagcgagaagaccagagaggagggcaacuucagaaagagcuucagccccaaggacgacaccagccugcaccuguuccacaucagcaccggcaagagccccaagcacagcugcggccugagcgagaagcagagcaccccccugaagcaggagcacaccaagaccugccugagccccggcagcagcgagaugagccugcagcccgaccuggugagauacgacaacaccgagagcgaguuccugcccgagagcagcagcgugaagagcugcaagcacaaggagaagagcaagcaccagaaggacuuccaccuggaguucggcgagaagagcaacgccaagaucaaggacgaggaccacagccccaccuucgagaacagcgacugcacccugaagaagauggacaaggagggcaagacccugaagaagcacaagcugaagcacaaggagagagagaaggagaagcacaagaaggagaucgagggcgagaaggagaaguacaagaccaaggacagcgccaaggagcugcagagaagcguggaguucgacagagaguucuggaaggagaacuucuucaagagcgacgagaccgaggaccuguuccugaacauggagcacgagagccugacccuggagaagaagagcaagcuggagaagaacaucaaggacgacaagagcaccaaggagaagcacgugagcaaggagagaaacuucaaggaggagagagacaagaucaagaaggagagcgagaagagcuucagagaggagaagaucaaggaccugaaggaggagagagagaacauccccaccgacaaggacagcgaguucaccagccugggcaugagcgccaucgaggagagcaucggccugcaccugguggagaaggagaucgacaucgagaagcaggagaagcacaucaaggagagcaaggagaagcccgagaagagaagccagaucaaggagaaggacaucgagaagauggagagaaagaccuucgagaaggagaagaagaucaagcacgagcacaagagcgagaaggacaagcuggaccugagcgagugcguggacaagaucaaggagaaggacaagcuguacagccaccacaccgagaagugccacaaggagggcgagaagagcaagaacaccgccgccaucaagaagaccgacgacagagagaagagcagagagaagauggacagaaagcacgacaaggagaagcccgagaaggagagacaccuggccgagagcaaggagaagcaccugauggagaagaagaacaagcagagcgacaacagcgaguacagcaagagcgagaagggcaagaacaaggagaaggacagagagcuggacaagaaggagaagagcagagacaaggagagcaucaacaucaccaacagcaagcacauccaggaggagaagaagagcagcaucguggacggcaacaaggcccagcacgagaagccccugagccugaaggagaagaccaaggacgagccccugaagacccccgacggcaaggagaaggacaagaaggacaaggacaucgacagauacaaggagagagacaagcacaaggacaagauccagaucaacagccugcugaagcugaagagcgaggccgacaagcccaagcccaagagcagccccgccagcaaggacaccagacccaaggagaagagacuggugaacgacgaccugaugcagaccagcuucgagagaaugcugagccugaaggaccuggagaucgagcaguggcacaagaagcacaaggagaagaucaagcagaaggagaaggagagacugagaaacagaaacugccuggagcugaagaucaaggacaaggagaagaccaagcacacccccaccgagagcaagaacaaggagcugaccagaagcaagagcagcgaggugaccgacgccuacaccaaggagaagcagcccaaggacgccgugagcaacagaagccagagcguggacaccaagaacgugaugacccugggcaagagcagcuucgugagcgacaacagccugaacagaagccccagaagcgagaacgagaagcccggccugagcagcagaagcgugagcaugaucagcguggccagcagcgaggacagcugccacaccaccgugaccacccccagaccccccguggaguacgacagcgacuucaugcuggagagcagcgagagccagaugagcuucagccagagccccuuccugagcaucgccaagagccccgcccugcacgagagagagcuggacagccuggccgaccugcccgagagaaucaagccccccuacgccaacagacugagcaccagccaccugagaagcagcagcguggaggacgugaagcugaucaucagcgagggcagacccaccaucgaggugagaagaugcagcaugcccagcgugaucugcgagcacaccaagcaguuccagaccaucagcgaggagagcaaccagggcagccugcugaccgugcccggcgacaccagccccagccccaagcccgagguguucagcaacgugcccgagagagaccugagcaacgugagcaacauccacagcagcuucgccaccagccccaccggcgccagcaacagcaaguacgugagcgccgacagaaaccugaucaagaacaccgcccccgugaacaccgugauggacagccccgugcaccuggagcccagcagccaggugggcgugauccagaacaagagcugggagaugcccguggacagacuggagacccugagcaccagagacuucaucugccccaacagcaacauccccgaccaggagagcagccugcagagcuucugcaacagcgagaacaaggugcugaaggagaacgccgacuuccugagccugagacagaccgagcugcccggcaacagcugcgcccaggaccccgccagcuucaugcccccccagcagcccugcagcuuccccagccagagccugagcgacgccgagagcaucagcaagcacaugagccugagcuacguggccaaccaggagcccggcauccugcagcagaagaacgccgugcagaucaucagcagcgcccuggacaccgacaacgagagcaccaaggacaccgagaacaccuucgugcugggcgacgugcagaagaccgacgccuucgugcccguguacagcgacagcaccauccaggaggccagccccaacuucgagaaggccuacacccugcccgugcugcccagcgagaaggacuucaacggcagcgacgccagcacccagcugaacacccacuacgccuucagcaagcugaccuacaagagcagcagcggccacgagguggagaacagcaccaccgacacccaggugaucagccacgagaaggagaacaagcuggagagccuggugcugacccaccugagcagaugcgacagcgaccugugcgagaugaacgccggcaugcccaagggcaaccugaacgagcaggaccccaagcacugccccgagagcgagaagugccugcugagcaucgaggacgaggagagccagcagagcauccugagcagccuggagaaccacagccagcagagcacccagcccgagaugcacaaguacggccagcuggugaagguggagcuggaggagaacgccgaggacgacaagaccgagaaccagaucccccagagaaugaccagaaacaaggccaacaccauggccaaccagagcaagcagauccuggccagcugcacccugcugagcgagaaggacagcgagagcagcagccccagaggcagaaucagacugaccgaggacgacgacccccagauccaccaccccagaaagagaaaggugagcagagugccccagcccgugcaggugagccccagccugcugcaggccaaggagaagacccagcagagccuggccgccaucguggacagccugaagcuggacgagauccagcccuacagcagcgagagagccaaccccuacuucgaguaccugcacaucagaaagaagaucgaggagaagagaaagcugcugugcagcgugaucccccaggccccccaguacuacgacgaguacgugaccuucaacggcagcuaccugcuggacggcaacccccugagcaagaucugcauccccaccaucacccccccccccagccugagcgacccccugaaggagcuguucagacagcaggagguggugagaaugaagcugagacugcagcacagcaucgagagagagaagcugaucgugagcaacgagcaggaggugcugagagugcacuacagagccgccagaacccuggccaaccagacccugcccuucagcgccugcaccgugcugcuggacgccgagguguacaacgugccccuggacagccagagcgacgacagcaagaccagcgugagagacagauucaacgccagacaguucaugagcuggcugcaggacguggacgacaaguucgacaagcugaagaccugccugcugaugagacagcagcacgaggccgccgcccugaacgccgugcagagacuggaguggcagcugaagcugcaggagcuggaccccgccaccuacaagagcaucagcaucuacgagauccaggaguucuacgugccccugguggacgugaacgacgacuucgagcugacccccaucuaa

SEQ ID NO: 13595 - RNA, 2979 nt, Artificial Sequence
  ANKRD18A__Homo_sapiens__NP_671728
augagaaagcuguucagcuucggcagaagacugggccaggcccugcugagcagcauggaccaggaguacgccggccccggcuacgacaucagagacugggagcugagaaagauccacagagccgccaucaagggcgacgccgccgagguggagagaugccugaccagaagauucagagaccuggacgccagagacagaaaggacagaaccgugcugcaccuggccugcgcccacggcagagugcagguggugacccugcugcugcacagaagaugccagaucgacaucugcgacagacugaacagaaccccccugaugaaggccgugcacagccaggaggaggccugcgccaucgugcugcuggagugcggcgccaaccccaacaucgaggacaucuacggcaacaccgcccugcacuacgccguguacaacaagggcaccagccuggccgagagacugcugagccaccacgccaacaucgaggcccugaacaaggagggcaacaccccccugcuguucgccaucaacagcagaagacagcacaugguggaguuccugcugaagaaccaggccaacauccacgccguggacaacuucaagagaaccgcccugauccuggccgugcagcacaaccugagcagcaucgugacccugcugcugcagcagaacaucagaaucagcagccaggacauguucggccagaccgccgaggacuacgcccugugcagcgaccugagaagcaucagacagcagauccuggagcacaagaacaagaugcugaagaaccaccugagaaacgacaaccaggagaccgccgccaugaagcccgccaaccugaagaagagaaaggagagagccaaggccgagcacaaccugaagguggccagcgaggagaagcaggagagacugcagagaagcgagaacaagcagccccaggacagccagagcuacggcaagaagaaggacgccauguacggcaacuucaugcugaagaaggacaucgccaugcugaaggaggagcuguacgccaucaagaacgacagccugagaaaggagaagaaguacauccaggagaucaagagcaucaccgagaucaacgccaacuucgagaagagcgugagacugaacgagaagaugaucaccaagaccguggccagauacagccagcagcugaacgaccugaaggccgagaacgccagacugaacagcgagcuggagaaggagaagcacaacaaggagagacuggaggccgagguggagagccugcacagcagccuggccaccgccaucaacgaguacaacgagaucguggagagaaaggaccuggagcuggugcuguggagagccgacgacgugagcagacacgagaagaugggcagcaacaucagccagcugaccgacaagaacgagcugcugaccgagcaggugcacaaggccagagugaaguucaacacccugaagggcaagcugagagagaccagagacgcccugagagagaagacccuggcccugggcagcgugcagcuggaccugagacaggcccagcacagaaucaaggagaugaagcagaugcaccccaacggcgaggccaaggagagccagagcaucggcaagcagaacagccuggaggagagaaucagacagcaggagcuggagaaccugcugcuggagagacagcuggaggacgccagaaaggagggcgacaacaaggagaucgugaucaacauccacagagacugccuggagaacggcaaggaggaccugcuggaggagagaaacaaggagcugaugaaggaguacaacuaccugaaggagaagcugcugcagugcgagaaggagaaggccgagagagaggugaucgugagagaguuccaggaggagcugguggaccaccugaagaccuucagcaucagcgagagcccccuggagggcaccagccacugccacaucaaccugaacgagaccuggaccagcaagaagaagcuguuccagguggagauccagcccgaggagaagcacgaggaguucagaaagcuguucgagcugaucagccugcugaacuacaccgccgaccagaucagaaagaagaacagagagcuggaggaggaggccaccggcuacaagaagugccuggagaugaccaucaacaugcugaacgccuucgccaacgaggacuucagcugccacggcgaccugaacaccgaccagcugaagauggacauccuguucaagaagcugaagcagaaguucaacgaccugguggccgagaaggaggccgugagcagcgagugcgugaaccuggccaaggacaacgaggugcugcaccaggagcugcugagcaugagaaacgugcaggagaagugcgagaagcuggagaaggacaagaagaugcuggaggaggaggugcugaaccugaagacccacauggagaaggacaugguggagcugggcaagcugcaggaguacaagagcgagcuggacgagagagccgugcaggagaucgagaagcuggaggagauccaccugcagaagcaggccgaguacgagaagcagcuggagcagcugaacaaggacaacaccgccagccugaagaagaaggagcugacccugaaggacguggagugcaaguucagcaagaugaagaccgccuacgaggaggugaccaccgagcuggaggaguucaaggaggccuucgccggcgccgugaaggccaacaacagcaugagcaagaagcugaugaagagcgacaagaagaucgccgugaucagcaccaagcuguucaccgagaagcagagaaugaaguacuuccugagcacccugcccaccagacccgagcccgagcugcccugcguggagaaccugaacagcaucgagcugaacagaaaguacauccccaagaccgccaucagaauccccaccagcaacccccagaccagcaacaacugcaagaacuuccugaccgaggugcugcugugcuaa

SEQ ID NO: 13596 - RNA, 960 nt, Artificial Sequence
  ANKRD1__Homo_sapiens__NP_055206
augauggugcugaagguggaggagcuggugaccggcaagaagaacggcaacggcgaggccggcgaguuccugcccgaggacuucagagacggcgaguacgaggccgccgugacccuggagaagcaggaggaccugaagacccugcuggcccaccccgugacccugggcgagcagcaguggaagagcgagaagcagagagaggccgagcugaagaagaagaagcuggagcagagaagcaagcuggagaaccuggaggaccuggagaucaucauccagcugaagaagagaaagaaguacagaaagaccaaggugcccguggugaaggagcccgagcccgagaucaucaccgagcccguggacgugcccaccuuccugaaggccgcccuggagaacaagcugcccgugguggagaaguuccugagcgacaagaacaaccccgacgugugcgacgaguacaagagaaccgcccugcacagagccugccuggagggccaccuggccaucguggagaagcugauggaggccggcgcccagaucgaguucagagacaugcuggagagcaccgccauccacugggccagcagaggcggcaaccuggacgugcugaagcugcugcugaacaagggcgccaagaucagcgccagagacaagcugcugagcaccgcccugcacguggccgugagaaccggccacuacgagugcgccgagcaccugaucgccugcgaggccgaccugaacgccaaggacagagagggcgacaccccccugcacgacgccgugagacugaacagauacaagaugaucagacugcugaucauguacggcgccgaccugaacaucaagaacugcgccggcaagacccccauggaccuggugcugcacuggcagaacggcaccaaggccaucuucgacagccugagagagaacagcuacaagaccagcagaaucgccaccuucuaa

SEQ ID NO: 13597 - RNA, 918 nt, Artificial Sequence
  ANKRD23__Homo_sapiens__NP_659431
auggacuucaucagcauccagcagcuggugagcggcgagagaguggagggcaaggugcugggcuucggccacggcgugcccgaccccggcgccuggcccagcgacuggagaagaggcccccaggaggccguggccagagagaagcugaagcuggaggaggagaagaagaagaagcuggagagauucaacagcaccagauucaaccuggacaaccuggccgaccuggagaaccuggugcagagaagaaagaagagacugagacacagagugccccccagaaagcccgagccccuggugaagccccagagccaggcccagguggagcccgugggccuggagauguuccugaaggccgccgccgagaaccaggaguaccugaucgacaaguaccugaccgacggcggcgaccccaacgcccacgacaagcugcacagaaccgcccugcacugggccugccugaagggccacagccagcuggugaacaagcugcugguggccggcgccaccguggacgccagagaccugcuggacagaacccccguguucugggccugcagaggcggccaccuggugauccugaagcagcugcugaaccagggcgccagagugaacgccagagacaagaucggcagcaccccccugcacguggccgugagaaccagacaccccgacugccuggagcaccugaucgagugcggcgcccaccugaacgcccaggacaaggagggcgacaccgcccugcacgaggccgugagacacggcagcuacaaggccaugaagcugcugcugcuguacggcgccgagcugggcgugagaaacgccgccagcgugacccccgugcagcuggccagagacuggcagagaggcaucagagaggcccugcaggcccacguggcccaccccagaaccagaugcuaa

SEQ ID NO: 13598 - RNA, 5133 nt, Artificial Sequence
  ANKRD26__Homo_sapiens__NP_055730
augaagaagaucuucagcaagaagggcgagagcccccugggcagcuucgccagaagacagagaagcagcgccggcggcggcggcgagcccggcgagggcgccuacagccagcccggcuaccacgugagagacagagaccugggcaagauccacaaggccgccagcgccggcaacguggccaaggugcagcagauccugcugcugagaaagaacggccugaacgacagagacaagaugaacagaaccgcccugcaccuggccugcgccaacggccaccccgagguggugacccugcugguggacagaaagugccagcugaacgugugcgacaacgagaacagaaccgcccugaugaaggccgugcagugccaggaggagaagugcgccaccauccugcuggagcacggcgccgaccccaaccuggccgacgugcacggcaacaccgcccugcacuacgccguguacaacgaggacaucagcguggccaccaagcugcugcuguacgacgccaacaucgaggccaagaacaaggacgaccugaccccccugcugcuggccgugagcggcaagaagcagcagaugguggaguuccugaucaagaagaaggccaacgugaacgccguggacaagcuggagagcagccaccagcugaucagcgaguacaaggaggagagaauccccaagcacagcagccagaacagcaacagcguggacgagagcagcgaggacagccugagcagacugagcggcaagcccggcguggacgacagcuggcccaccagcgacgacgaggaccugaacuucgacaccaagaacgugcccaagcccagccuggccaagcugaugaccgccagccagcagagcagaaagaaccuggaggccaccuacggcaccgugagaaccggcaacagaacccuguucgaggacagagacagcgacagccaggacgagguggugguggagagccugcccaccaccagcaucaaggugcagugcuucagccaccccaccuaccagagccccgaccugcugcccaagcccagccacaagagccuggccaaccccggccugaugaaggaggagcccaccaagcccggcaucgccaagaaggagaacggcaucgacaucaucgagagcgccccccuggagcagaccaacaacgacaaccugaccuacguggacgaggugcacaagaacaacagaagcgacaugaugagcgcccugggccugggccaggaggaggacaucgagagccccugggacagcgagagcaucagcgagaacuucccccagaaguacguggacccccuggccggcgccgccgacggcaaggagaagaacaucggcaacgagcaggccgaggacguguucuacauccccagcugcaugagcggcagcagaaacuucaagauggccaagcuggaggacaccagaaacgugggcaugcccguggcccacauggagagccccgagagauaccugcaccugaagcccaccaucgagaugaaggacagcgugcccaacaaggccggcggcaugaaggacgugcagaccagcaaggccgccgagcacgaccuggagguggccagcgaggaggagcaggagagagagggcagcgagaacaaccagccccagguggaggaggagagaaagaagcacagaaacaacgagauggaggugagcgccaacauccacgacggcgccaccgacgacgccgaggacgacgacgacgacgacggccugauccagaagagaaagagcggcgagaccgaccaccagcaguuccccagaaaggagaacaaggaguacgccagcagcggccccgcccugcagaugaaggaggugaagagcaccgagaaggagaagagaaccagcaaggagagcgugaacagccccguguucggcaaggccagccugcugaccggcggccugcugcagguggacgacgacagcagccugagcgagaucgacgaggacgagggcagacccaccaagaagaccagcaacgagaagaacaaggugaagaaccagauccagagcauggacgacguggacgaccugacccagagcagcgagaccgccagcgaggacugcgagcugccccacagcagcuacaagaacuucaugcugcugaucgagcagcugggcauggagugcaaggacagcgugagccugcugaagauccaggacgccgcccugagcugcgagagacugcuggagcugaagaagaaccacugcgagcugcugaccgugaagaucaagaagauggaggacaaggugaacgugcugcagagagagcugagcgagaccaaggagaucaagagccagcuggagcaccagaagguggagugggagagagagcugugcagccugagauucagccugaaccaggaggaggagaagagaagaaacgccgacacccuguacgagaagaucagagagcagcugagaagaaaggaggagcaguacagaaaggagguggaggugaagcagcagcuggagcugagccugcagacccuggagauggagcugagaaccgugaagagcaaccugaaccagguggugcaggagagaaacgacgcccagagacagcugagcagagagcagaacgccagaaugcugcaggacggcauccugaccaaccaccugagcaagcagaaggagaucgagauggcccagaagaagaugaacagcgagaacagccacagccacgaggaggagaaggaccugagccacaagaacagcaugcugcaggaggagaucgccaugcugagacuggagaucgacaccaucaagaaccagaaccaggagaaggagaagaagugcuucgaggaccugaagaucgugaaggagaagaacgaggaccugcagaagaccaucaagcagaacgaggagacccugacccagaccaucagccaguacaacggcagacugagcgugcugaccgccgagaacgccaugcugaacagcaagcuggagaacgagaagcagagcaaggagagacuggaggccgagguggagagcuaccacagcagacuggccgccgccauccacgacagagaccagagcgagaccagcaagagagagcuggagcuggccuuccagagagccagagacgagugcagcagacugcaggacaagaugaacuucgacgugagcaaccugaaggacaacaacgagauccugagccagcagcuguucaagaccgagagcaagcugaacagccuggagaucgaguuccaccacaccagagacgcccugagagagaagacccugggccuggagagagugcagaaggaccugagccagacccagugccagaugaaggagauggagcagaaguaccagaacgagcaggugaaggugaacaaguacaucggcaagcaggagagcguggaggagagacugagccagcugcagagcgagaacaugcugcugagacagcagcuggacgacgcccacaacaaggccgacaacaaggagaagaccgugaucaacauccaggaccaguuccacgccaucgugcagaagcugcaggccgagagcgagaagcagagccugcugcuggaggagagaaacaaggagcugaucagcgagugcaaccaccugaaggagagacaguaccaguacgagaacgagaaggccgagagagaggugguggugagacagcugcagcaggagcuggccgacacccugaagaagcagagcaugagcgaggccagccuggaggugaccagcagauacagaaucaaccuggaggacgagacccaggaccugaagaagaagcugggccagaucagaaaccagcugcaggaggcccaggacagacacaccgaggccgugagaugcgccgagaagaugcaggaccacaagcagaagcuggagaaggacaacgccaagcugaaggugaccgugaagaagcagauggacaagaucgaggagcugcagaagaaccugcugaacgccaaccugagcgaggacgagaaggagcagcugaagaagcugauggagcugaagcagagccuggagugcaaccuggaccaggagaugaagaagaacguggagcuggagagagagaucaccggcuucaagaaccugcugaagaugaccagaaagaagcugaacgaguacgagaacggcgaguucagcuuccacggcgaccugaagaccagccaguucgagauggacauccagaucaacaagcugaagcacaagaucgacgaccugaccgccgagcuggagaccgccggcagcaagugccugcaccuggacaccaagaaccagauccugcaggaggagcugcugagcaugaagaccgugcagaagaagugcgagaagcugcagaagaacaagaagaagcuggagcaggaggugaucaaccugagaagccacaucgagagaaacaugguggagcugggccaggugaagcaguacaagcaggagaucgaggagagagccagacaggagaucgccgagaagcugaaggaggugaaccuguuccugcaggcccaggccgccagccaggagaaccuggagcaguucagagagaacaacuucgccagcaugaagagccagauggagcugagaaucaaggaccuggagagcgagcugagcaagaucaagaccagccaggaggacuucaacaagaccgagcuggagaaguacaagcagcuguaccuggaggagcugaaggugagaaagagccugagcagcaagcugaccaagaccaacgagagacuggccgaggugaacaccaagcugcugguggagaagcagcagagcagaagccuguucaccacccugaccaccagacccgugauggagccccccugcgugggcaaccugaacaacagccuggaccugaacagaaagcugauccccagagagaaccuggugaucagcaccagcaaccccagagccagcaacaacagcauggagaacuaccugagcaagaugcagcaggagcuggagaagaacaucaccagagagcugaaggaggccgccgccgagcuggagagcggcagcaucgccagcccccugggcagcaccgacgagagcaaccugaaccaggaccugguguggaaggccagcagagaguacgugcaggugcugaagaagaacuacaugaucuaa

SEQ ID NO: 13599 - RNA, 3162 nt, Artificial Sequence
  ANKRD28__Homo_sapiens__NP_056014
auggccuuccugaagcugagagaccagcccagccuggugcaggccaucuucaacggcgaccccgacgaggugagagcccugaucuucaagaaggaggacgugaacuuccaggacaacgagaagagaaccccccugcacgccgccgccuaccugggcgacgccgagaucaucgagcugcugauccugagcggcgccagagugaacgccaaggacagcaaguggcugaccccccugcacagagccguggccagcugcagcgaggaggccgugcaggugcugcugaagcacagcgccgacgugaacgccagagacaagaacuggcagaccccccugcacaucgccgccgccaacaaggccgugaagugcgccgaggcccuggugccccugcugagcaacgugaacgugagcgacagagccggcagaaccgcccugcaccacgccgccuucagcggccacggcgagauggugaagcugcugcugagcagaggcgccaacaucaacgccuucgacaagaaggacagaagagccauccacugggccgccuacaugggccacaucgagguggugaagcugcuggugagccacggcgccgaggugaccugcaaggacaagaagagcuacaccccccugcacgccgccgccagcagcggcaugaucagcguggugaaguaccugcuggaccugggcguggacaugaacgagcccaacgccuacggcaacaccccccugcacguggccugcuacaacggccaggacgugguggugaacgagcugaucgacugcggcgccaucgugaaccagaagaacgagaagggcuucaccccccugcacuucgccgccgccagcacccacggcgcccugugccuggagcugcuggugggcaacggcgccgacgugaacaugaagagcaaggacggcaagaccccccugcacaugaccgcccugcacggcagauucagcagaagccagaccaucauccagagcggcgccgugaucgacugcgaggacaagaacggcaacaccccccugcacaucgccgccagauacggccacgagcugcugaucaacacccugaucaccagcggcgccgacaccgccaagagaggcauccacggcauguucccccugcaccuggccgcccugagcggcuucagcgacugcugcagaaagcugcugagcagcggcuucgacaucgacacccccgacgacuucggcagaaccugccugcacgccgccgccgccggcggcaaccuggagugccugaaccugcugcugaacaccggcgccgacuucaacaagaaggacaaguucggcagaagcccccugcacuacgccgccgccaacugcaacuaccagugccuguucgcccuggugggcagcggcgccagcgugaacgaccuggacgagagaggcugcaccccccugcacuacgccgccaccagcgacaccgacggcaagugccuggaguaccugcugagaaacgacgccaaccccggcaucagagacaagcagggcuacaacgccgugcacuacagcgccgccuacggccacagacugugccugcagcugaucgccagcgagaccccccuggacgugcugauggagaccagcggcaccgacaugcugagcgacagcgacaacagagccaccaucagcccccugcaccuggccgccuaccacggccaccaccaggcccuggaggugcuggugcagagccugcuggaccuggacgugagaaacagcagcggcagaaccccccuggaccuggccgccuucaagggccacguggagugcguggacgugcugaucaaccagggcgccagcauccuggugaaggacuacauccugaagagaacccccauccacgccgccgccaccaacggccacagcgagugccugagacugcugaucggcaacgccgagccccagaacgccguggacauccaggacggcaacggccagaccccccugaugcugagcgugcugaacggccacaccgacugcguguacagccugcugaacaagggcgccaacguggacgccaaggacaaguggggcagaaccgcccugcacagaggcgccgugaccggccacgaggagugcguggacgcccugcugcagcacggcgccaagugccugcugagagacagcagaggcagaacccccauccaccugagcgccgccugcggccacaucggcgugcugggcgcccugcugcagagcgccgccagcauggacgccaaccccgccaccgccgacaaccacggcuacaccgcccugcacugggccugcuacaacggccacgagaccugcguggagcugcugcuggagcaggagguguuccagaagaccgagggcaacgccuucagcccccugcacugcgccgugaucaacgacaacgagggcgccgccgagaugcugaucgacacccugggcgccagcaucgugaacgccaccgacagcaagggcagaaccccccugcacgccgccgccuucaccgaccacguggagugccugcagcugcugcugagccacaacgcccaggugaacagcguggacagcaccggcaagaccccccugaugauggccgccgagaacggccagaccaacaccguggagaugcuggugagcagcgccagcgccgagcugacccugcaggacaacagcaagaacaccgcccugcaccuggccugcagcaagggccacgagaccagcgcccugcugauccuggagaagaucaccgacagaaaccugaucaacgccaccaacgccgcccugcagaccccccugcacguggccgccagaaacggccugaccaugguggugcaggagcugcugggcaagggcgccagcgugcuggccguggacgagaacggcuacacccccgcccuggccugcgcccccaacaaggacguggccgacugccuggcccugauccuggccaccaugaugcccgugagcagcagcagcccccugagcagccugaccuucaacgccaucaacagauacaccaacaccagcaagaccgugagcuucgaggcccugcccaucaugagaaacgagcccagcagcuacugcagcuucaacaacaucggcggcgagcaggaguaccuguacaccgacguggacgagcugaacgacagcgacagcgagaccuacuaa

SEQ ID NO: 13600 - RNA, 984 nt, Artificial Sequence
  ANKRD2__Homo_sapiens__NP_001123453
auggccaaggcccccagcugggccggcgugggcgcccuggccuacaaggcccccgaggcccuguggcccgccgaggccgugauggacggcaccauggaggacagcgaggccgugcagagagccaccgcccugaucgagcagagacuggcccaggaggaggagaacgagaagcugagaggcgacgccagacagaagcugcccauggaccugcuggugcuggaggacgagaagcaccacggcgcccagagcgccgcccugcagaaggugaagggccaggagagagugagaaagaccagccuggaccugagaagagagaucaucgacgugggcggcauccagaaccugaucgagcugagaaagaagagaaagcagaagaagagagacgcccuggccgccagccacgagcccccccccgagcccgaggagaucaccggccccguggacgaggagaccuuccugaaggccgccguggagggcaagaugaaggugaucgagaaguuccuggccgacggcggcagcgccgacaccugcgaccaguucagaagaaccgcccugcacagagccagccuggagggccacauggagauccuggagaagcugcuggacaacggcgccaccguggacuuccaggacagacuggacugcaccgccaugcacugggccugcagaggcggccaccuggagguggugaagcugcugcagagccacggcgccgacaccaacgugagagacaaggagggcgacaccgcccugcacgacgccgugagacugaacagauacaagaucaucaagcugcugcugcugcacggcgccgacaugaugaccaagaaccuggccggcaagacccccaccgaccuggugcagcuguggcaggccgacaccagacacgcccuggagcaccccgagcccggcgccgagcacaacggccuggagggccccaacgacagcggcagagagaccccccagcccgugcccgcccaguaa

SEQ ID NO: 13601 - RNA, 4026 nt, Artificial Sequence
  ANKRD30A__Homo_sapiens__NP_443723
augaccaagagaaagaagaccaucaaccugaacauccaggacgcccagaagagaaccgcccugcacugggccugcgugaacggccacgaggagguggugaccuuccugguggacagaaagugccagcuggacgugcuggacggcgagcacagaaccccccugaugaaggcccugcagugccaccaggaggccugcgccaacauccugaucgacagcggcgccgacaucaaccugguggacguguacggcaacaccgcccugcacuacgccguguacagcgagauccugagcgugguggccaagcugcugagccacggcgccgugaucgaggugcacaacaaggccagccugaccccccugcugcugagcaucaccaagagaagcgagcagaucguggaguuccugcugaucaagaacgccaacgccaacgccgugaacaaguacaagugcaccgcccugaugcuggccgugugccacggcagcagcgagaucgugggcaugcugcugcagcagaacguggacguguucgccgccgacaucugcggcgugaccgccgagcacuacgccgugaccugcggcuuccaccacauccacgagcagaucauggaguacaucagaaagcugagcaagaaccaccagaacaccaaccccgagggcaccagcgccggcacccccgacgaggccgccccccuggccgagagaacccccgacaccgccgagagccugguggagaagacccccgacgaggccgccccccugguggagagaacccccgacaccgccgagagccugguggagaagacccccgacgaggccgccagccugguggagggcaccagcgacaagauccagugccuggagaaggccaccagcggcaaguucgagcagagcgccgaggagacccccagagagaucaccagccccgccaaggagaccagcgagaaguucaccuggcccgccaagggcagacccagaaagaucgccugggagaagaaggaggacacccccagagagaucaugagccccgccaaggagaccagcgagaaguucaccugggccgccaagggcagacccagaaagaucgccugggagaagaaggagacccccgugaagaccggcugcguggccagagugaccagcaacaagaccaaggugcuggagaagggcagaagcaagaugaucgccugccccaccaaggagagcagcaccaaggccagcgccaacgaccagagauuccccagcgagagcaagcaggaggaggacgaggaguacagcugcgacagcagaagccuguucgagagcagcgccaagauccaggugugcauccccgagagcaucuaccagaaggugauggagaucaacagagagguggaggagccccccaagaagcccagcgccuucaagcccgccaucgagaugcagaacagcgugcccaacaaggccuucgagcugaagaacgagcagacccugagagccgaccccauguucccccccgagagcaagcagaaggacuacgaggagaacagcugggacagcgagagccugugcgagaccgugagccagaaggacgugugccugcccaaggccacccaccagaaggagaucgacaagaucaacggcaagcuggaggagagccccaacaaggacggccugcugaaggccaccugcggcaugaaggugagcauccccaccaaggcccuggagcugaaggacaugcagaccuucaaggccgagccccccggcaagcccagcgccuucgagcccgccaccgagaugcagaagagcgugcccaacaaggcccuggagcugaagaacgagcagacccugagagccgacgagauccugcccagcgagagcaagcagaaggacuacgaggagaacagcugggacaccgagagccugugcgagaccgugagccagaaggacgugugccugcccaaggccgcccaccagaaggagaucgacaagaucaacggcaagcuggagggcagccccgugaaggacggccugcugaaggccaacugcggcaugaaggugagcauccccaccaaggcccuggagcugauggacaugcagaccuucaaggccgagccccccgagaagcccagcgccuucgagcccgccaucgagaugcagaagagcgugcccaacaaggcccuggagcugaagaacgagcagacccugagagccgacgagauccugcccagcgagagcaagcagaaggacuacgaggagagcagcugggacagcgagagccugugcgagaccgugagccagaaggacgugugccugcccaaggccacccaccagaaggagaucgacaagaucaacggcaagcuggaggagagccccgacaacgacggcuuccugaaggcccccugcagaaugaaggugagcauccccaccaaggcccuggagcugauggacaugcagaccuucaaggccgagccccccgagaagcccagcgccuucgagcccgccaucgagaugcagaagagcgugcccaacaaggcccuggagcugaagaacgagcagacccugagagccgaccagauguuccccagcgagagcaagcagaagaagguggaggagaacagcugggacagcgagagccugagagagaccgugagccagaaggacgugugcgugcccaaggccacccaccagaaggagauggacaagaucagcggcaagcuggaggacagcaccagccugagcaagauccuggacaccgugcacagcugcgagagagccagagagcugcagaaggaccacugcgagcagagaaccggcaagauggagcagaugaagaagaaguucugcgugcugaagaagaagcugagcgaggccaaggagaucaagagccagcuggagaaccagaaggugaagugggagcaggagcugugcagcgugagacugacccugaaccaggaggaggagaagagaagaaacgccgacauccugaacgagaagaucagagaggagcugggcagaaucgaggagcagcacagaaaggagcuggaggugaagcagcagcuggagcaggcccugagaauccaggacaucgagcugaagagcguggagagcaaccugaaccaggugagccacacccacgagaacgagaacuaccugcugcacgagaacugcaugcugaagaaggagaucgccaugcugaagcuggagaucgccacccugaagcaccaguaccaggagaaggagaacaaguacuucgaggacaucaagauccugaaggagaagaacgccgagcugcagaugacccugaagcugaaggaggagagccugaccaagagagccagccaguacagcggccagcugaaggugcugaucgccgagaacaccaugcugaccagcaagcugaaggagaagcaggacaaggagauccuggaggccgagaucgagagccaccaccccagacuggccagcgccgugcaggaccacgaccagaucgugaccagcagaaagagccaggagcccgccuuccacaucgccggcgacgccugccugcagagaaagaugaacguggacgugagcagcaccaucuacaacaacgaggugcugcaccagccccugagcgaggcccagagaaagagcaagagccugaagaucaaccugaacuacgccggcgacgcccugagagagaacacccuggugagcgagcacgcccagagagaccagagagagacccagugccagaugaaggaggccgagcacauguaccagaacgagcaggacaacgugaacaagcacaccgagcagcaggagagccuggaccagaagcuguuccagcugcagagcaagaacauguggcugcagcagcagcuggugcacgcccacaagaaggccgacaacaagagcaagaucaccaucgacauccacuuccuggagagaaagaugcagcaccaccugcugaaggagaagaacgaggagaucuucaacuacaacaaccaccugaagaacagaaucuaccaguacgagaaggagaaggccgagaccgagaacagcuaa

SEQ ID NO: 13602 - RNA, 4062 nt, Artificial Sequence
  ANKRD36B__Homo_sapiens__NP_079466
auggagagacugugcagcgacggcuucgccuucccccacuacuacaucaagcccuaccaccugaagagaauccacagagccgugcugagaggcaaccuggagaagcugaaguaccugcugcugaccuacuacgacgccaacaagagagacagaaaggagagaaccgcccugcaccuggccugcgccaccggccagcccgagauggugcaccugcuggugagcagaagaugcgagcugaaccugugcgacagagaggacagaaccccccugaucaaggccgugcagcugagacaggaggccugcgccacccugcugcugcagaacggcgccgaccccaacaucaccgacguguucggcagaaccgcccugcacuacgccguguacaacgaggacaccagcaugaucgagaagcugcugagccacggcaccaacaucgaggagugcagcaagaacgaguaccagccccugcugcuggccgugagcagaagaaaggugaagaugguggaguuccugcugaagaagaaggccaacgugaacgccaucgacuaccugggcagaagcgcccugauccuggccgugacccugggcgagaaggacaucgugauccugcugcugcagcacaacaucgacguguucagcagagacguguacggcaagcuggccgaggacuacgccagcgaggccgagaacagagugaucuucgaccugaucuacgaguacaagagaaagagauacgaggaccugcccaucaacagcaaccccgugagcccccagaagcagagagccgagaaggccaccagcgacgacaaggacagcgugagcaacaucgccaccgagaucaaggagggccccaucagcggcaccgugagcagccagaagcagcccgccgagaaggccaccagcgacgagaaggacagcgugagcaacaucgccaccgagaucaaggagggccagcagagcggcaccgugagcccccagaagcagagcgcccagaaggugaucuucaagaagaaggugagccugcugaacaucgccaccagaaucaugggcggcggcaagagcggcaccgugagcagccagaagcagcccgccagcaagaccgccagcgacaagaccgacagcgcccugaacaccgccaccgagaucaaggacggccugcagugcggcaccgugagcagccagaagcagcaggcccugaaggccaccaccgacgaggagggcagcgugagcaacaucgccaccgagaucaaggacggcgagaagagcggcaccgugagcagccagaagaagcccgcccugaaggccaccagcgacgagaaggacagcuucagcaacaucaccagagagaagaaggacggcgagaucagcagaaccgugagcagccagaagccccccgcccugaaggccaccagcgugaaggaggacagcgugcugaacaucgccagagagaagaaggacggcgagaagagcagaaccgugagcuucgagcagccccccggccugaaggccaccagagacgagaaggacagccugcugaacaucgccagaggcaagaaggacggcgagaagaccagaagagugagcagccacaagcagcccagccugaaggccaccagcgacaaggaggacagcgugcccaacauggccaccgagaccaaggacgagcagaucagcggcaccgugagcugccagaagcagcccgcccugaaggccaccagcgacaagaaggacagcgugagcaacauccccaccgagaucaaggacggccagcagagcggcaccgugagcagccagaagcagcccgccuggaaggccaccagcgugaagaaggacagcgugagcaacaucgccaccgagaucaaggacggccagaucagaggcaccgugagcagccagagaagacccgcccugaagaccaccggcgacgagaaggacagcgugagcaacaucgccagagagaucaaggacggcgagaagagcggcaccgugagcccccagaagcagagcgcccagaaggugaucuucaagaagaaggugagccugcugaacaucgccaccagaaucaccggcggcggcaagagcggcaccgaguaccccgagaaccugagaacccugaaggccaccaucgagaacaaggacagcgugcugaacaccgccaccaagaugaaggaggugcagaccagcacccccgccgagcaggaccuggagauggccagcgagggcgagcagaagagacuggaggaguacgagaacaaccagccccaggugaagaaccagauccacagcagagacgaccuggacgacaucauccagagcagccagaccgugagcgaggacggcgacagccugugcugcaacugcaagaacgugauccugcugaucgaccagcacgagaugaagugcaaggacugcgugcaccugcugaagaucaagaacaccuucugccuguggaagagacugaucaagcugaaggacaaccacugcgagcagcugagagugaagaucagaaagcugaagaacaaggccagcgugcugcagaagagaaucagcgagaaggaggagaucaagagccagcugaagcacgagauccuggagcuggagaaggagcugugcagccugagauucgccauccagcaggagaagaagaagagaagaaacguggaggagcugcaccagaaggugagagagaagcugagaaucaccgaggagcaguacagaaucgaggccgacgugaccaagcccaucaagcccgcccugaagagcgccgagguggagcugaagaccggcggcaacaacagcaaccaggugagcgagaccgacgagaaggaggaccugcugcacgagaacagacugaugcaggacgagaucgccagacugagacuggagaaggacaccaucaagaaccagaaccuggagaagaaguaccugaaggacuucgagaucgugaagagaaagcacgaggaccugcagaaggcccugaagagaaacggcgagacccuggccaagaccaucgccugcuacagcggccagcuggccgcccugaccgacgagaacaccacccugagaagcaagcuggagaagcagagagagagcagacagagacuggagaccgagaugcagagcuacagaugcagacugaacgccgccagaugcgaccacgaccagagccacagcagcaagagagaccaggagcuggccuuccagggcaccguggacaagugcagacaccugcaggagaaccugaacagccacgugcugauccugagccugcagcugagcaaggccgagagcaagagcagagugcugaagaccgagcugcacuacaccggcgaggcccugaaggagaaggcccugguguucgagcacgugcagagcgagcugaagcagaagcagagccagaugaaggacaucgagaagauguacaagagcggcuacaacaccauggagaagugcaucgagaagcaggagagauucugccagcugaagaagcagaacaugcugcugcagcagcagcuggacgacgccagaaacaaggccgacaaccaggagaaggccauccugaacauccaggccagaugcgacgccagagugcagaaccugcaggccgagugcagaaagcacagacugcugcuggaggaggacaacaagaugcuggugaacgagcugaaccacagcaaggagaaggagugccaguacgagaaggagaaggccgagagagagguggccgugagacagcugcagcagaagagagacgacgugcugaacaagggcagcgccaccaaggcccugcuggacgccagcagcagacacugcaccuaccuggagaacggcaugcaggacagcagaaagaagcuggaccagaugagaagccaguuccaggagauccaggaccagcugaccgccaccaucagaugcaccaaggagauggagggcgacacccagaagcuggagguggagcacgugaugaugagaaagaucaucaagaagcaggacgaccagaucgagagacuggagaagauccugcagcacagcagccugaugcugcagguguucgagagcuaa

SEQ ID NO: 13603 - RNA, 5826 nt, Artificial Sequence
  ANKRD36__Homo_sapiens__NP_001157787
auggaggacggcaagagagagagauggcccacccugauggagagacugugcagcgacggcuucgccuucccccaguaccccaucaagcccuaccaccugaagagaauccacagagccgugcugcacggcaaccuggagaagcugaaguaccugcugcugaccuacuacgacgccaacaagagagacagaaaggagagaaccgcccugcaccuggccugcgccaccggccagcccgagauggugcaccugcuggugagcagaagaugcgagcugaaccugugcgacagagaggacagaaccccccugaucaaggccgugcagcugagacaggaggccugcgccacccugcugcugcagaacggcgccaaccccaacaucaccgacuucuucggcagaaccgcccugcacuacgccguguacaacgaggacaccagcaugaucgagaagcugcugagccacggcaccaacaucgaggagugcagcaagugcgaguaccagccccugcuguucgccgugagcagaagaaaggugaagaugguggaguuccugcugaagaagaaggccaacgugaacgccaucgacuaccugggcagaagcgcccugauccacgccgugacccugggcgagaaggacaucgugauccugcugcugcagcacaacaucgacgugcugagcagagacgccuucagaaagaucgccggcgacuacgccaucgaggccaagaacagagugaucuucgaccugaucuacgaguacgagagaaagagauacgaggaccugcccaucaacagcaaccccgugagcagccagaagcagcccgcccugaaggccaccagcggcaaggaggacagcaucagcaacaucgccaccgagaucaaggacggccagaagagcggcaccgugagcagccagaagcagcccgcccugaaggacaccagcgacaaggacgacagcgugagcaacaccgccaccgagaucaaggacgagcagaagagcggcaccgugcugcccgccguggagcagugccugaacagaagccuguacagacccgacgccguggcccagcccgugaccgagaacgaguucagccuggagagcgagaucaucagcaagcuguacauccccaagagaaagaucaucagccccagaagcaucaaggacgugcugccccccguggaggaggccguggacagaugccuguaccugcuggacagauucgcccagcccgugaccaaggacaaguucgcccuggagagcgagaacaucagcgagcccuacuucaccaacagaagaaccaucagccagcagagcgccgagaaccuggacgccgccugcggcaucgacaagaccgagaacggcaacauguucgaggaccagaacguggacaaggagggcaaggcccugcccgccaccggccagaaggccaacgugagccccgagcagcccccccuguucacccacaccgugaaggacagagaccacaucagcaccagauuccugggcggcauggacagccugaccagcagcgaggagagcagcgagagacccccccugagcacccugacccugaaggaggccgaccccagcagcaaggccgccaugagaagaaaggacagccccccccccggcaaggugagcagccagaagcagcccgccgagaaggccaccagcgacgacaaggacagcgugagcaacaucgccaccgagaucaaggagggccccaucagcggcaccgugagcagccagaagcagcccgccgagaaggccaccagcgacgagaaggacagcgugagcaacaucgccaccgagaucaagaagggccagcagagcggcaccgugagcccccagaagcagagcgccuggaaggugaucuucaagaagaaggugagccugcugaacaucgccaccagaaucaugggcggcggcaagagcggcaccgugagcagccagaagcagcccgccagcaaggccaccagcgacaagaccgacagcgcccugaacaucgccaccgagaucaaggacggccugcagugcggcaccgugagcagccagaagcagcccgcccugaaggccaccaccgacgaggaggacagcgugagcaacaucgccaccgagaucaaggacggcgagaagagcggcaccgugagcagccagaagcagcccgcccugaaggccaccaccgacgaggaggacagcgugagcaacaucgccaccgagaucaaggacggcgagaagagcggcaccgugagcagccagaagcagcccgcccugaaggccaccaccgacgagaaggacagcgugagcaacaucgccaccgagaucaaggacggcgagaagagcggcaccgugagcagccagaagccccccgcccugaccgccaccagcgacgaggagggcagcgugcugagcaucgccagagagaacaaggacggcgagaagagcagaaccgugagcagcagaaagaagcccgcccugaaggccaccagcgacgagaaggacagcuucagcaacaucaccagaggcaagaaggacggcgagaucagcagaaaggugagcagccagaagccccccacccugaagggcaccagcgacgaggaggacagcgugcugggcaucgccagagagaacaaggacggcgagaagagcagaaccgugagcagcgagaagccccccggccugaaggccagcagcgccgagaaggacagcgugcugaacaucgccagaggcaagaaggacggcgagaagaccaagagagugagcagcagaaagaagcccagccuggaggccaccagcgacgagaaggacagcuucagcaacaucaccagagagaagaaggacggcgagaucagcagaaaggugagcagccagaagccccccgcccugaagggcaccagcgacgaggaggacagcgugcugggcaucgccagagagaacaaggacggcgagaagagcagaaccgugagcagcgagaagccccccggccugaaggccaccagcgacgagaaggacagcgugcugaacaucgccagaggcaagaaggacggcgagaagaccagaaccgugagcagccagaagccccccacccugaaggccaccagcgacgaggaggacagcgugcugagcaucgccagagagaacaaggacggcgagaagagcagaaccgugagcagcgagaagcccagcggccugaaggccaccagcgccgagaaggacagcgugcugaacaucgccagaggcaagaaguacggcgagaagaccaagagagugagcagcagaaagaagcccgcccugaaggccaccagcgacgagaaggacagcgugcuguacaucgccagagagaagaaggacggcgagaagagcagaaccgugagcagccccaagcagcccgcccugaaggccaucugcgacaaggaggacagcgugcccaacauggccaccgagaagaaggacgagcagaucagcggcaccgugagcugccagaagcagcccgcccugaaggccaccagcgacaagaaggacagcgugagcaacauccccaccgagaucaaggacggccagcagagcggcaccgugagcagccagaagcagcccgccuggaaggccaccagcgugaagaaggacagcgugagcaacaucgccaccgagaucaaggacggccagaucagaggcaccggcauccuggaguacaccuucaacgugauguucgaccagaucgaggagaaguucaccagccugaacaagagcgccggcgugagcccccagaagcagagcgcccagaaggugaucuucaagaagaaggugagccugcugaacaucgccaccagaaucaccggcggcuggaagagcggcaccgaguaccccgagaaccugcccacccugaaggccaccaucgagaacaagaacagcgugcugaacaccgccaccaagaugaaggacgugcagaccagcacccccgccgagcaggaccuggagauggccagcgagggcgagcagaagagacuggaggaguacgagaacaaccagccccaggugaagaaccagauccacagcagagacgaccuggacgacaucauccagagcagccagaccgugagcgaggacggcgacagccugugcugcaacugcaagaacgugauccugcugaucgaccagcacgagaugaagugcaaggacugcgugcaccugcugaagaucaagaacaccuucugccuguggaagagacugaucaagcugaaggacaaccacugcgagcagcugagagugaagaucagaaagcugaagaacaaggccagcgugcugcagaagagaaucagcgagaaggaggagaucaagagccagcugaagcacgagauccuggagcuggagaaggagcugugcagccugagauucgccauccagcaggagaagaagaagagaagaaacguggaggaggugcaccagaaggugagagagaagcugagaaucaccgaggagcaguacagaaucgaggccgacgugaccaagcccaucaagcccgcccugaagagcgccgagguggagcugaagaccggcggcaacaacagcaaccaggugagcgagaccgacgagaaggaggaccugcugcacgagaacagacugaugcaggacgagaucgccagacugagacuggagaaggacaccaucaagaaccagaaccuggagaagaaguaccugaaggacuucgagaucgugaagagaaagcacgaggaccugcagaaggcccugaagagaaacggcgagacccuggccaagaccaucgccugcuacagcggccagcuggccgcccugaccgacgagaacaccacccugagaagcaagcuggagaagcagagagagagcagacagagacuggagaccgagaugcagagcuaccacugcagacugaacgccgccagaugcgaccacgaccagagccacagcagcaagagagaccaggagcuggccuuccagggcaccguggacaagugcagacaccugcaggagaaccugaacagccacgugcugauccugagccugcagcugagcaaggccgagagcaagagcagagugcugaagaccgagcugcacuacaccggcgaggcccugaaggagaaggcccugguguucgagcacgugcagagcgagcugaagcagaagcagagccagaugaaggacaucgagaagauguacaagagcggcuacaacaccauggagaagugcaucgagaagcaggagagauucugccagcugaagaagcagaacaugcugcugcagcagcagcuggacgacgccagaaacaaggccgacaaccaggagaaggccauccugaacauccaggccagaugcgacgccagagugcagaaccugcaggccgagugcagaaagcacagacugcugcuggaggaggacaacaagaugcuggugaacgagcugaaccacagcaaggagaaggagugccaguacgagaaggagaaggccgagagagagguggccgugagacagcugcagcagaagagagacgacgugcugaacaagggcagcgccaccaaggcccugcuggacgccagcagcagacacugcaccuaccuggagaacggcaugcaggacagcagaaagaagcuggaccagaugagaagccaguuccaggagauccaggaccagcugaccgccaccaucagaugcaccaaggagauggagggcgacacccagaagcuggagguggagcacgugaugaugagaaagaucaucaagaagcaggacgaccagaucgagagacuggagaagauccugcagcacagcagccugaugcugcagguguucgagagcuaa

SEQ ID NO: 13604 - RNA, 477 nt, Artificial Sequence
  ANKRD37__Homo_sapiens__NP_859077
augcugcugcuggacugcaaccccgagguggacggccugaagcaccugcuggagaccggcgccagcgugaacgccccccccgaccccugcaagcagagccccgugcaccuggccgccggcagcggccuggccugcuuccugcuguggcagcugcagaccggcgccgaccugaaccagcaggacgugcugggcgaggccccccugcacaaggccgccaaggugggcagccuggagugccugagccugcugguggccagcgacgcccagaucgaccugugcaacaagaacggccagaccgccgaggaccuggccuggagcugcggcuuccccgacugcgccaaguuccugaccaccaucaagugcaugcagaccaucaaggccagcgagcaccccgacagaaacgacugcguggccgugcugagacagaagagaagccugggcagcguggagaacaccagcggcaagagaaagugcuaa

SEQ ID NO: 13605 - RNA, 2982 nt, Artificial Sequence
  ANKRD44__Homo_sapiens__NP_001182073
auggccgugcugaagcugaccgaccagcccccccuggugcaggccaucuucagcggcgaccccgaggagaucagaaugcugauccacaagaccgaggacgugaacacccuggacagcgagaagagaaccccccugcacguggccgccuuccugggcgacgccgagaucaucgagcugcugauccugagcggcgccagagugaacgccaaggacaacauguggcugaccccccugcacagagccguggccagcagaagcgaggaggccgugcaggugcugaucaagcacagcgccgacgugaacgccagagacaagaacuggcagaccccccugcacguggccgccgccaacaaggccgugaagugcgccgaggugaucaucccccugcugagcagcgugaacgugagcgacagaggcggcagaaccgcccugcaccacgccgcccugaacggccacguggagauggugaaccugcugcuggccaagggcgccaacaucaacgccuucgacaagaaggacagaagagcccugcacugggccgccuacaugggccaccuggacgugguggcccugcugaucaaccacggcgccgaggugaccugcaaggacaagaagggcuacaccccccugcacgccgccgccagcaacggccagaucaacguggugaagcaccugcugaaccugggcguggagaucgacgagaucaacguguacggcaacaccgcccugcacaucgccugcuacaacggccaggacgccguggugaacgagcugaucgacuacggcgccaacgugaaccagcccaacaacaacggcuucaccccccugcacuucgccgccgccagcacccacggcgcccugugccuggagcugcuggugaacaacggcgccgacgugaacauccagagcaaggacggcaagagcccccugcacaugaccgccgugcacggcagauucaccagaagccagacccugauccagaacggcggcgagaucgacugcguggacaaggacggcaacaccccccugcacguggccgccagauacggccacgagcugcugaucaacacccugaucaccagcggcgccgacaccgccaagugcggcauccacagcauguucccccugcaccuggccgcccugaacgcccacagcgacugcugcagaaagcugcugagcagcggcuucgagaucgacacccccgacaaguucggcagaaccugccugcacgccgccgccgccggcggcaacguggagugcaucaagcugcugcagagcagcggcgccgacuuccacaagaaggacaagugcggcagaaccccccugcacuacgccgccgccaacugccacuuccacugcaucgagacccuggugaccaccggcgccaacgugaacgagaccgacgacuggggcagaaccgcccugcacuacgccgccgccagcgacauggacagaaacaagaccauccugggcaacgcccacgacaacagcgaggagcuggagagagccagagagcugaaggagaaggaggccacccugugccuggaguuccugcugcagaacgacgccaaccccagcaucagagacaaggagggcuacaacagcauccacuacgccgccgccuacggccacagacagugccuggagcugcugcuggagagaaccaacagcggcuucgaggagagcgacagcggcgccaccaagagcccccugcaccuggccgccuacaacggccaccaccaggcccuggaggugcugcugcagagccugguggaccuggacaucagagacgagaagggcagaaccgcccuggaccuggccgccuucaagggccacaccgagugcguggaggcccugaucaaccagggcgccagcaucuucgugaaggacaacgugaccaagagaaccccccugcacgccagcgugaucaacggccacacccugugccugagacugcugcuggagaucgccgacaaccccgaggccguggacgugaaggacgccaagggccagaccccccugaugcuggccguggccuacggccacaucgacgccgugagccugcugcuggagaaggaggccaacguggacaccguggacauccugggcugcaccgcccugcacagaggcaucaugaccggccacgaggagugcgugcagaugcugcuggagcaggaggugagcauccugugcaaggacagcagaggcagaaccccccugcacuacgccgccgccagaggccacgccaccuggcugagcgagcugcugcagauggcccugagcgaggaggacugcugcuucaaggacaaccagggcuacaccccccugcacugggccugcuacaacggcaacgagaacugcaucgaggugcugcuggagcagaagugcuucagaaaguucaucggcaaccccuucaccccccugcacugcgccaucaucaacgaccacggcaacugcgccagccugcugcugggcgccaucgacagcagcaucgugagcugcagagacgacaagggcagaaccccccugcacgccgccgccuucgccgaccacguggagugccugcagcugcugcugagacacagcgcccccgugaacgccguggacaacagcggcaagaccgcccugaugauggccgccgagaacggccaggccggcgccguggacauccuggugaacagcgcccaggccgaccugaccgugaaggacaaggaccugaacaccccccugcaccuggccugcagcaagggccacgagaagugcgcccugcugauccuggacaagauccaggacgagagccugaucaacgagaagaacaacgcccugcagaccccccugcacguggccgccagaaacggccugaagguggugguggaggagcugcuggccaagggcgccugcgugcuggccguggacgagaacgccagcagaagcaacggccccagaagcacccccggcaccgccgugcagaaggaggaguaa

SEQ ID NO: 13606 - RNA, 801 nt, Artificial Sequence
  ANKRD45__Homo_sapiens__XP_011507772
auggagagcgagggcccccccgagagcgagagcagcgaguucuucagccagcaggaggaggagaacgaggaggaggaggcccaggagcccgaggagaccggccccaagaacccccugcugcagcccgcccugaccggcgacguggagggccugcagaagaucuucgaggaccccgagaacccccaccacgagcaggccaugcagcugcugcuggaggaggacaucgugggcagaaaccugcuguacgccgccugcauggccggccagagcgacgugaucagagcccuggccaaguacggcgugaaccugaacgagaagaccaccagaggcuacacccugcugcacugcgccgccgccuggggcagacuggagacccugaaggcccugguggagcuggacguggacaucgaggcccugaacuucagagaggagagagccagagacguggccgccagauacagccagaccgagugcguggaguuccuggacugggccgacgccagacugacccugaagaaguacaucgccaaggugagccuggccgugaccgacaccgagaagggcagcggcaagcugcugaaggaggacaagaacaccauccugagcgccugcagagccaagaacgaguggcuggagacccacaccgaggccagcaucaacgagcuguucgagcagagacagcagcuggaggacaucgugacccccaucuucaccaagaugaccacccccugccaggugaagagcgccaagagcgugaccagccacgaccagaagagaagccaggacgacaccagcaacuaa

SEQ ID NO: 13607 - RNA, 699 nt, Artificial Sequence
  ANKRD46__Homo_sapiens__NP_001257308
augagcuacguguucgugaacgacagcagccagaccaacgugccccugcugcaggccugcaucgacggcgacuucaacuacagcaagagacugcuggagagcggcuucgaccccaacaucagagacagcagaggcagaaccggccugcaccuggccgccgccagaggcaacguggacaucugccagcugcugcacaaguucggcgccgaccugcuggccaccgacuaccagggcaacaccgcccugcaccugugcggccacguggacaccauccaguuccuggugagcaacggccugaagaucgacaucugcaaccaccagggcgccaccccccuggugcuggccaagagaagaggcgugaacaaggacgugaucagacugcuggagagccuggaggagcaggaggugaagggcuucaacagaggcacccacagcaagcuggagaccaugcagaccgccgagagcgagagcgccauggagagccacagccugcugaaccccaaccugcagcagggcgagggcgugcugagcagcuucagaaccaccuggcaggaguucguggaggaccugggcuucuggagagugcugcugcugaucuucgugaucgcccugcugagccugggcaucgccuacuacagaagaacccugagacugggcagcuucgccagacaggacagaagcagaauccaggccaucuaa

SEQ ID NO: 13608 - RNA, 3753 nt, Artificial Sequence
  ANKRD50__Homo_sapiens__NP_001161354
augaagcccccccagcagagccuguaccugcugguggacagcguggacgagggcugcaacaucaccgagggcgagcagaccagcaccagccugagcggcaccguggccgcccugcuggccggccaccacgaguucuucccccccuggcugcugcugcugugcagcgccagaaagcagagcaaggccgugaccaagauguucaccggcuucagaaagaucagccuggacgaccugagaaaggccuacaucgugaaggacgugcagcaguacauccugcacagacuggaccaggaggaggcccugagacagcaccugaccaaggagaccgccgagaugcugaaccagcugcacaucaagagcagcggcugcuuccuguaccuggagagagugcuggacggcgugguggagaacuucaucaugcugagagagaucagagacauccccggcacccugaacggccuguaccuguggcugugccagagacuguucgugagaaagcaguucgccaaggugcagcccauccugaacgugauccuggccgccugcagaccccugaccaucaccgagcuguaccacgccguguggaccaagaacaugagccugacccuggaggacuuccagagaaagcuggacauccugagcaagcugcugguggacggccugggcaacaccaagauccuguuccacuacagcuucgccgaguggcugcuggacgugaagcacugcacccagaaguaccugugcaacgccgccgagggccacagaaugcuggccaugagcuacaccugccaggccaagaaccugaccccccuggaggcccaggaguucgcccugcaccugaucaacagcaaccugcagcuggagaccgccgagcuggcccuguggaugaucuggaacggcacccccgugagagacagccugagcacccugauccccaaggagcaggaggugcugcagcugcuggugaaggccggcgcccacgugaacagcgaggacgacagaaccagcugcaucgugagacaggcccuggagagagaggacagcaucagaacccugcuggacaacggcgccagcgugaaccagugcgacagcaacggcagaacccugcuggccaacgccgccuacagcggcagccuggacguggugaaccugcuggugagcagaggcgccgaccuggagaucgaggacgcccacggccacaccccccugacccuggccgccagacagggccacaccaagguggugaacugccugaucggcugcggcgccaacaucaaccacaccgaccaggacggcuggaccgcccugagaagcgccgccuggggcggccacaccgagguggugagcgcccugcuguacgccggcgugaagguggacugcgccgacgccgacagcagaaccgcccugagagccgccgccuggggcggccacgaggacaucgugcugaaccugcugcagcacggcgccgaggugaacaaggccgacaacgagggcagaaccgcccugaucgccgccgccuacaugggccacagagagaucguggagcaccugcuggaccacggcgccgaggugaaccacgaggacguggacggcagaaccgcccugagcguggccgcccugugcgugcccgccagcaagggccacgccagcguggugagccugcugaucgacagaggcgccgagguggaccacugcgacaaggacggcaugaccccccugcugguggccgccuacgagggccacguggacgugguggaccugcugcuggagggcggcgccgacguggaccacaccgacaacaacggcagaaccccccugcuggccgccgccagcaugggccacgccagcguggugaacacccugcuguucuggggcgccgccguggacagcaucgacagcgagggcagaaccgugcugagcaucgccagcgcccagggcaacguggagguggugagaacccugcuggacagaggccuggacgagaaccacagagacgacgccggcuggaccccccugcacauggccgccuucgagggccacagacugaucugcgaggcccugaucgagcagggcgccagaaccaacgagaucgacaacgacggcagaauccccuucauccuggccagccaggagggccacuacgacugcgugcagauccugcuggagaacaagagcaacaucgaccagagaggcuacgacggcagaaacgcccugagaguggccgcccuggagggccacagagacaucguggagcugcuguucagccacggcgccgacgugaacugcaaggacgccgacggcagacccacccuguacauccuggcccuggagaaccagcugaccauggccgaguacuuccuggagaacggcgccaacguggaggccagcgacgccgagggcagaaccgcccugcacgugagcugcuggcagggccacauggagauggugcaggugcugaucgccuaccacgccgacgugaacgccgccgacaacgagaagagaagcgcccugcagagcgccgccuggcagggccacgugaagguggugcagcugcugaucgagcacggcgccgugguggaccacaccugcaaccagggcgccaccgcccugugcaucgccgcccaggagggccacaucgacguggugcaggugcugcuggagcacggcgccgaccccaaccacgccgaccaguucggcagaaccgccaugagaguggccgccaagaacggccacagccagaucaucaagcugcuggagaaguacggcgccagcagccugaacggcugcagccccagccccgugcacaccauggagcagaagccccugcagagccugagcagcaaggugcagagccugaccaucaagagcaacagcagcggcagcaccggcggcggcgacaugcagcccagccugagaggccugcccaacggccccacccacgccuucagcagccccagcgagagccccgacagcaccguggacagacagaagagcagccugagcaacaacagccugaagagcagcaagaacagcagccugagaaccaccagcagcaccgccaccgcccagaccgugcccaucgacagcuuccacaaccugagcuucaccgagcagauccagcagcacagccugcccagaagcagaagcagacagagcaucgugagccccagcagcaccacccagagccugggccagagccacaacagccccagcagcgaguucgaguggagccaggugaagcccagccugaagagcaccaaggccagcaagggcggcaagagcgagaacagcgccaagagcggcagcgccggcaagaaggccaagcagagcaacagcagccagcccaaggugcuggaguacgagaugacccaguucgacagaagaggccccaucgccaagagcggcaccgccgccccccccaagcagaugcccgccgagagccagugcaagaucaugauccccagcgcccagcaggagaucggcagaagccagcagcaguuccugauccaccagcagagcggcgagcagaagaagagaaacggcaucaugaccaaccccaacuaccaccugcagagcaaccagguguuccugggcagagugagcgugcccagaaccaugcaggacagaggccaccaggaggugcuggagggcuaccccagcagcgagaccgagcugagccugaagcaggcccugaagcugcagaucgagggcagcgaccccagcuucaacuacaagaaggagaccccccuguaa

SEQ ID NO: 13609 - RNA, 1845 nt, Artificial Sequence
  ANKRD55__Homo_sapiens__NP_078945
augaugagacaggccaccauggacuucagcacccccagcguguucgaccagcagagaggcgacagcagcgaggagguggaccugaccaugguguaccaggccgccagcaacggcgacgugaacgcccugaccgccgugaucagagaggaccccagcauccuggagugcugcgacagcgagggcugcaccccccugaugcacgccgugagcggcagacaggccgacaccgugaagcugcugcugaagaugggcgccaacaucaacaugcaggacgccuacggcagaaccagccugugccuggccaccuaccugggcuggcuggagggcugcgugagccugcugagaaacggcgccaagcacaacauccccgacaagaacggcagacugccccugcacgccgccaccgccgagcccgacaugagacugcugaccgugcugcugcagcagagcaacaucagcgagaucaaccaccaggacaacgagggcaugaccccccugcacugggccgccuuccacaaccagccccagcacacccagaugcugcugaagaagggcgccgaccccacccugguggacaaggacuucaagaccgcccugcacugggccgugcagagcggcaacagaauccugugcagcaucauccugagccaccaccagggccccagcaucaucaacuacgacgacgagagcggcaagaccugcgugcacaucgccgccgccgccggcuucagcgacaucauccacgagcuggccagagugcccgagugcaaccugcaggcccuggacguggacgacagaaccccccugcacugggccgccgccgccggcaaggccgagugcgugcagagccugcuggagcugggcauggacagcaaccugagagacaucaacgagagcaccccccuggccuacgcccuguacugcggccacaccgccugcgugaagcugcugagccaggagagcagaaccgagcccaccagacccccccccagccagagcagcagaccccagaagaaggagagaagauucaacgugcugaaccagaucuucugcaagaacaagaaggaggagcagagagcccaccagaaggaccccagcagagacagauacagagaggaggacaccagcgaggugaacgacaucaucaccaccuucgacagcaucgugggcaccaacugccaggagcagcccggcgaccagguggccaugguggaguucaagaagaagaccagcgacaacagcaaguaccugcugcccgagaagaagccccuggccagaaagggccugccccccaucagaacccagagccugccccccaucacccugggcaacaacuuccugaccgccagccacagagccaccagccacgccggccugagcagcgccccccaccacauggcccagagaagccagaagagcagaagcgagcaggaccugcugaacaacagaaccggcugccagaugcugcuggacaaccccuggaagagcgacagcaaccagguguucagcuacaagguguggaccgugagcagcagcgacaagcugcuggacagacugcugagcgugagacccggccaccaggaggugagcgugcccccccaccugagacaccugcacaaccccagcagcggccagaacuuccagcaccugagccccaacagacacaagaucagagaccugcccuucaccagaaacaaccuggccccccugcccgaccagaaguuccugagcggcgagccccugagaaccaacagagugcugcccgccauccccagccagagaagacacagcaccgccgccgaggagagcgagcacagcgccaaccccaccagcgacgagaacuaa

SEQ ID NO: 13610 - RNA, 2184 nt, Artificial Sequence
  ANKRD6__Homo_sapiens__NP_001229738
augagccagcaggacgccguggccgcccugagcgagagacugcugguggccgccuacaagggccagaccgagaacguggugcagcugaucaacaagggcgccagaguggccgugaccaagcacggcagaaccccccugcaccuggccgccaacaagggccaccugcccguggugcagauccugcugaaggccggcugcgaccuggacgugcaggacgacggcgaccagaccgcccugcacagagccaccguggugggcaacaccgagaucaucgccgcccugauccacgagggcugcgcccuggacagacaggacaaggacggcaacaccgcccugcacgaggccagcuggcacggcuucagccagagcgccaagcugcugaucaaggccggcgccaacgugcuggccaagaacaaggccggcaacaccgcccugcaccuggccugccagaacagccacagccagagcaccagagugcugcugcuggccggcagcagagccgaccugaagaacaacgccggcgacaccugccugcacguggccgccagauacaaccaccugagcaucaucagacugcugcugaccgccuucugcagcgugcacgagaagaaccaggccggcgacaccgcccugcacguggccgccgcccugaaccacaagaagguggccaagauccugcuggaggccggcgccgacaccaccaucgugaacaacgccggccagaccccccuggagaccgccagauaccacaacaaccccgagguggcccugcugcugaccaaggccccccaggugcugagauucagcagaggcagaagccugagaaagaagagagagagacugaaggaggagagaagagcccagagcgugcccagagacgagguggcccagagcaagggcagcgugagcgccggcgacacccccagcagcgagcaggccguggccagaaaggaggaggccagagaggaguuccugagcgccagccccgagcccagagccaaggacgacagaagaagaaagagcagacccaaggugagcgccuucagcgaccccaccccccccgccgaccagcagcccggccaccagaagaaccugcacgcccacaaccaccccaagaagagaaacagacacagaugcagcagccccccccccccccacgaguucagagccuaccagcuguacacccuguacagaggcaaggacggcaaggugaugcaggcccccaucaacggcugcagaugcgagccccugaucaacaagcuggagaaccagcuggaggccaccguggaggagaucaaggccgagcugggcagcgugcaggacaagaugaacaccaagcugggccagauggagaacaagacccagcaccagaugagagugcuggacaagcugaugguggagagacugagcgccgagagaaccgagugccugaacagacugcagcagcacagcgacaccgagaagcacgagggcgagaagagacagaucagccugguggacgagcugaagaccuggugcaugcugaagauccagaaccuggagcagaagcugagcggcgacagcagagccugcagagccaagagcacccccagcaccugcgagagcagcaccggcguggaccagcugguggugaccgccggccccgccgccgccagcgacagcagcccccccguggugagacccaaggagaaggcccugaacagcaccgccacccagagacugcagcaggagcugagcagcagcgacugcaccggcagcagacugagaaacgugaaggugcagaccgcccugcugcccaugaacgaggccgccagaagcgaccagcaggccggccccugcgugaacagaggcacccagaccaagaagagcggcaagagcggccccaccagacacagagcccagcagcccgccgccagcagcaccugcggccagcccccccccgccaccggcagcgagcagaccggcccccacaucagagacaccagccaggcccuggagcugacccaguacuucuucgaggccgugagcacccagauggagaagugguacgagagaaagaucgaggaggccagaagccaggccaaccagaaggcccagcaggacaaggccacccugaaggagcacaucaagagccuggaggaggagcuggccaagcugagaaccagagugcagaaggagaacuaa

SEQ ID NO: 13611 - RNA, 765 nt, Artificial Sequence
  ANKRD7__Homo_sapiens__NP_062618
augaacaagcuguucagcuucuggaagagaaagaacgagaccagaagccagggcuacaaccugagagagaaggaccugaagaagcugcacagagccgccagcgugggcgaccugaagaagcugaaggaguaccugcagaucaagaaguacgacgugaacaugcaggacaagaaguacagaaccccccugcaccuggccugcgccaacggccacaccgacguggugcuguuccugaucgagcagcagugcaagaucaacgugagagacagcgagaacaagagcccccugaucaaggccgugcagugccagaacgaggacugcgccaccauccugcugaacuucggcgccgaccccgaccugagagacaucagauacaacaccgugcugcacuacgccgugugcggccagagccugagccugguggagaagcugcuggaguacgaggccgaccuggaggccaagaacaaggacggcuacaccccccugcugguggccgugaucaacaacaaccccaagauggugaaguuccugcuggagaagggcgccgacgugaacgccagcgacaacuaccagagaaccgcccugauccuggccgugagcggcgagccccccugccuggugaagcugcugcugcagcagggcguggagcugugcuacgagggcaucguggacagccagcugagaaacauguucaucagcauggugcugcugcacagauacccccaguucaccgccagccacggcaagaagaagcacgccaaguaa

SEQ ID NO: 13612 - RNA, 3405 nt, Artificial Sequence
  ANKS1A__Homo_sapiens__NP_056060
augggcaaggagcaggagcugcuggaggccgccagaaccggccaccugcccgccguggagaagcugcugagcggcaagagacugagcagcggcuucggcggcggcggcggcggcggcagcggcggcggcggcggcggcagcggcggcggcggcggcggccugggcagcagcagccacccccugagcagccugcugagcauguggagaggccccaacgugaacugcguggacagcaccggcuacaccccccugcaccacgccgcccugaacggccacaaggacgugguggaggugcugcugagaaacgacgcccugaccaacguggccgacagcaagggcugcuacccccugcaccuggccgccuggaagggcgacgcccagaucgugagacugcugauccaccagggccccagccacaccagagugaacgagcagaacaacgacaacgagaccgcccugcacugcgccgcccaguacggccacaccgagguggugaaggugcugcuggaggagcugaccgaccccaccaugagaaacaacaaguucgagaccccccuggaccuggccgcccuguacggcagacuggagguggugaagaugcugcugaacgcccaccccaaccugcugagcugcaacaccaagaagcacaccccccugcaccuggccgccagaaacggccacaaggccguggugcaggugcugcuggacgccggcauggacagcaacuaccagaccgagaugggcagcgcccugcacgaggccgcccuguucggcaagaccgacguggugcagauccugcuggccgccggcaccgacgugaacaucaaggacaaccacggccugaccgcccuggacaccgugagagagcugcccagccagaagagccagcagaucgccgcccugaucgaggaccacaugaccggcaagagaagcaccaaggagguggacaagaccccccccccccagcccccccugaucagcagcauggacagcaucagccagaagagccagggcgacguggagaaggccgugaccgagcugaucaucgacuucgacgccaacgccgaggaggagggccccuacgaggcccuguacaacgccaucagcugccacagccuggacagcauggccagcggcagaagcagcgaccaggacagcaccaacaaggaggccgaggccgccggcgugaagcccgccggcgugagacccagagagagaccccccccccccgccaagcccccccccgacgaggaggaggaggaccacaucgacaagaaguacuucccccugaccgccagcgaggugcugagcaugagacccagaauccacggcagcgccgccagagaggaggacgagcaccccuacgagcugcugcugaccgccgagaccaagaagguggugcugguggacggcaagaccaaggaccacagaagaagcagcagcagcagaagccaggacagcgccgagggccaggacggccaggugcccgagcaguucagcggccugcugcacggcagcagccccgugugcgaggugggccaggaccccuuccagcugcugugcaccgccggccagagccaccccgacggcagcccccagcagggcgccugccacaaggccagcaugcagcuggaggagaccggcgugcacgcccccggcgccagccagcccagcgcccuggaccagagcaagagagugggcuaccugaccggccugcccaccaccaacagcagaagccaccccgagacccugacccacaccgccagcccccaccccggcggcgccgaggagggcgacagaagcggcgccagaagcagagccccccccaccagcaagcccaaggccgagcugaagcugagcagaagccugagcaagagcgacagcgaccugcugaccugcagccccaccgaggacgccaccaugggcagcagaagcgagagccugagcaacugcagcaucggcaagaagagacuggagaagagccccagcuucgccagcgagugggacgagaucgagaagaucaugagcagcaucggcgagggcaucgacuucagccaggagagacagaagaucagcggccugagaacccuggagcagagcgugggcgaguggcuggagagcaucggccugcagcaguacgagagcaagcugcugcugaacggcuucgacgacgugcacuuccugggcagcaacgugauggaggagcaggaccugagagacaucggcaucagcgacccccagcacagaagaaagcugcugcaggccgccagaagccugcccaaggugaaggcccugggcuacgacggcaacagcccccccagcgugcccagcuggcuggacagccugggccugcaggacuacgugcacagcuuccugagcagcggcuacagcagcaucgacaccgugaagaaccugugggagcuggagcuggugaacgugcugaaggugcagcugcugggccacagaaagagaaucaucgccagccuggccgacagacccuacgaggagcccccccagaagccccccagauucagccagcugagaugccaggaccugcugagccagaccagcagcccccugagccagaacgacagcugcaccggcagaagcgccgaccugcugcugccccccggcgacaccggcagaagaagacacgacagccugcacgaccccgccgcccccagcagagccgagagauucagaauccaggaggagcacagagaggccaagcugacccugagaccccccagccuggccgcccccuacgcccccgugcagagcuggcagcaccagcccgagaagcugaucuucgagagcugcggcuacgaggccaacuaccugggcagcaugcugaucaaggaccugagaggcaccgagagcacccaggacgccugcgccaagaugagaaagagcaccgagcacaugaagaagauccccaccaucauccugagcaucaccuacaagggcgugaaguucaucgacgccagcaacaagaacgugaucgccgagcacgagaucagaaacaucagcugcgccgcccaggaccccgaggaccugugcaccuucgccuacaucaccaaggaccugcagaccagccaccacuacugccacguguucagcaccguggacgugaaccugaccuacgagaucauccugacccugggccaggccuucgagguggccuaccagcuggcccugcaggcccagaagagcagagccaccggcgccagcgccgccgagaugaucgagaccaagagcagcaagcccgugcccaagcccagagugggcgugagaaagagcgcccuggagccccccgacauggaccaggacgcccagagccacgccagcgugagcugggugguggaccccaagcccgacagcaagagaagccugagcaccaacuaa

SEQ ID NO: 13613 - RNA, 1074 nt, Artificial Sequence
  ANKS1B__Homo_sapiens__NP_001190995
auggccaacggcuucgacaacgugcaguucaugggcagcaacgugauggaggaccaggaccugcuggagaucggcauccugaacagcggccacagacagagaauccugcaggccauccagcugcugcccaagaugagacccaucggccacgacggcuaccaccccaccagcguggccgaguggcuggacagcaucgagcugggcgacuacaccaaggccuuccugaucaacggcuacaccagcauggaccugcugaagaagaucugggagguggagcugaucaaccagagcagcgugugcgagaucuggaccaaccagaacgccggcuuccccuucagcgccauccaccaggugcacaacaccggcgacuggggcgagcccagcaucacccugagaccccccaacgaggccaccgccagcacccccgugcaguacuggcagcaccaccccgagaagcugaucuuccagagcugcgacuacaaggccuucuaccugggcagcaugcugaucaaggagcugagaggcaccgagagcacccaggacgccugcgccaagaugagagccaacugccagaagagcaccgagcagaugaagaaggugcccaccaucauccugagcgugagcuacaagggcgugaaguucaucgacgccaccaacaagaacaucaucgccgagcacgagaucagaaacaucagcugcgccgcccaggaccccgaggaccugagcaccuucgccuacaucaccaaggaccugaagagcaaccaccacuacugccacguguucaccgccuucgacgugaaccuggccuacgagaucauccugacccugggccaggccuucgagguggccuaccagcuggcccugcaggccagaaagggcggccacagcagcacccugcccgagagcuucgagaacaagcccagcaagcccauccccaagcccagagugagcaucagaaagagcgugaucgaccccagcgagcagaagacccuggccaaccugcccuggaucguggagcccggccaggaggccaagagaggcaucaacaccaaguacgagaccaccaucuucuaa

SEQ ID NO: 13614 - RNA, 1254 nt, Artificial Sequence
  ANKS4B__Homo_sapiens__NP_665872
augagcaccagauaccaccaggccgccagcgacagcuaccuggagcugcugaaggaggccaccaagagagaccugaaccugagcgacgaggacggcaugacccccacccugcuggccgccuaccacggcaaccuggaggcccuggagaucaucugcagcagaggcggcgaccccgacagaugcgacaucuggggcaacaccccccugcacuucgccgccagcaacggccacgcccacugcgugagcuuccuggugaacuucggcgccaacaucuucgcccuggacaacgaccugcagaccccccuggacgccgccgccagcagagagcagaacgagugcguggcccugcuggacaaggccgccaccgcccagaacaucaugaaccccaagaaggugaccagacugaaggagcaggcccagaagaacgccagaagacagaucaaggagugcgagagacugcaggagaagcaccagaacaagauggcccacaccuacagcaaggaggagagcggcacccugagcagcagcaagggcaccuucagcagaagcagccccagcaacgccagcgcccccggcaccuucggcagccugagcaagggcaucaaggacaccuucaagaucaaguucaagaagaacaaggacaccgccgagcaggugggcaaggagggcagaagcggccagagaaacgugauggagguguucagagaggaggaggaggacagcuucagcggcgacuucaaggagaagcugcagcugagcgccgaggaggacggcagcgugcaccacgagagcauccugaacagacccggccugggcagcaucguguucagaagaaacagaaucagcagccccgaggacaucagcgacagcaagagagaguucggcuucaagcugcccagcgagcugcugcagagacagggcgccagcgaggccgacgagggcgccgccgacgaggagggcgaggagaacggccugaaggacgaccugcccugggacgacgacgagguggagugggaggaggacgugguggacgccaccccccuggagguguuccugcugagccagcaccuggaggaguuccugcccaucuucaagagagagcagaucgaccuggaggcccugcugcugugcagcgacgaggaccugcagagcauccagaugcagcugggccccagaaagaaggugcugaacgccaucaacagaagaaagcaggugcugcagcagcccggccagcugguggacaccagccuguaa

SEQ ID NO: 13615 - RNA, 2616 nt, Artificial Sequence
  ANKS6__Homo_sapiens__NP_775822
augggcgagggcggccugccccccgccuuccagcugcugcugagagccugcgaccagggcgacaccgagaccgccagaagacugcuggagcccggcgccgccgagcccgccgagagaggcgccgagcccgaggccggcgccgagcccgccggcgccgagguggccggccccggcgccgccgccgccggcgccgugggcgcccccgugcccguggacugcagcgacgaggccggcaacaccgcccugcaguucgccgccgccggcggccacgagccccuggugagauuccugcugagaagaggcgccagcgugaacagcagaaaccacuacggcuggagcgcccugaugcaggccgccagauucggccacgugagcguggcccaccugcugcuggaccacggcgccgacgugaacgcccagaacagacugggcgccagcgugcugaccguggccagcagaggcggccaccugggcguggugaagcugcugcuggaggccggcgccuucguggaccaccaccaccccagcggcgagcagcugggccugggcggcagcagagacgagccccuggacaucaccgcccugauggccgccauccagcacggccacgaggccguggugagacugcugauggaguggggcgccgaccccaaccacgccgccagaaccgugggcuggagcccccugaugcuggccgcccugaccggcagacugggcguggcccagcagcugguggagaagggcgccaaccccgaccaccugagcgugcuggagaagaccgccuucgagguggcccuggacugcaagcacagagaccugguggacuaccuggacccccugaccaccgugagacccaagaccgacgaggagaagagaagacccgacaucuuccacgcccugaagaugggcaacuuccagcuggugaaggagaucgccgacgaggaccccagccacgugaaccuggugaacggcgacggcgccaccccccugaugcuggccgccgugaccggccagcuggcccuggugcagcugcugguggagagacacgccgacguggacaagcaggacagcgugcacggcuggaccgcccugaugcaggccaccuaccacggcaacaaggagaucgugaaguaccugcugaaccagggcgccgacgugacccugagagccaagaacggcuacaccgccuucgaccuggugaugcugcugaacgaccccgacaccgagcuggugagacugcuggccagcgugugcaugcaggugaacaaggacaagggcagacccagccaccagcccccccugccccacagcaaggugagacagcccuggagcauccccgugcugcccgacgacaagggcggccugaagagcugguggaacagaaugagcaacagauucagaaagcugaagcugaugcagacccugcccagaggccugagcagcaaccagccccugcccuucagcgacgagcccgagcccgcccuggacagcaccaugagagccgccccccaggacaagaccagcagaagcgcccugcccgacgccgcccccgugaccaaggacaacggccccggcagcaccagaggcgagaaggaggacacccugcugaccaccaugcugagaaacggcgccccccugaccagacugcccagcgacaagcugaaggccgugaucccccccuuccugccccccagcagcuucgagcuguggagcagcgacagaagcagaaccagacacaacggcaaggccgaccccaugaagaccgcccugccccagagagccagcagaggccaccccgugggcggcggcggcaccgacaccacccccgugagacccgugaaguuccccagccugcccagaagccccgccagcagcgccaacagcggcaacuucaaccacagcccccacagcagcggcggcagcagcggcgugggcgugagcagacacggcggcgagcugcugaacagaagcggcggcagcaucgacaacgugcugagccagaucgccgcccagagaaagaaggccgccggccugcuggagcagaagcccagccacagaagcagccccgugggccccgcccccggcagcagccccagcgagcugcccgccagccccgccggcggcagcgcccccgugggcaagaagcuggagaccagcaagagaccccccagcggcaccagcaccaccagcaagagcaccagccccacccugacccccagccccagccccaagggccacaccgccgagagcagcgugagcagcagcagcagccacagacagagcaagagcagcggcggcagcagcagcggcaccaucaccgacgaggacgagcugaccggcauccugaagaagcugagccuggagaaguaccagcccaucuucgaggagcaggagguggacauggaggccuuccugacccugaccgacggcgaccugaaggagcugggcaucaagaccgacggcagcagacagcagauccuggccgccaucagcgagcugaacgccggcaagggcagagagagacagauccugcaggagaccauccacaacuuccacagcagcuucgagagcagcgccagcaacaccagagcccccggcaacagccccugcgccuaa

SEQ ID NO: 13616 - RNA, 3264 nt, Artificial Sequence
  ANLN__Homo_sapiens__NP_001271230
auggaccccuucaccgagaagcugcuggagagaaccagagccagaagagagaaccugcagagaaagauggccgagagacccaccgccgcccccagaagcaugacccacgccaagagagccagacagccccugagcgaggccagcaaccagcagccccugagcggcggcgaggagaagagcugcaccaagcccagccccagcaagaagagaugcagcgacaacaccgagguggaggugagcaaccuggagaacaagcagcccguggagagcaccagcgccaagagcugcagccccagccccgugagcccccaggugcagccccaggccgccgacaccaucagcgacagcguggccgugcccgccagccugcugggcaugagaagaggccugaacagcagacuggaggccaccgccgccagcagcgugaagaccagaaugcagaagcuggccgagcagagaagaagaugggacaacgacgacaugaccgacgacauccccgagagcagccuguucagccccaugcccagcgaggagaaggccgccagcccccccagaccccugcugagcaacgccagcgccacccccgugggcagaagaggcagacuggccaaccuggccgccaccaucugcagcugggaggacgacgugaaccacagcuucgccaagcagaacagcgugcaggagcagcccggcaccgccugccugagcaaguucagcagcgccagcggcgccagcgccagaaucaacagcagcagcgugaagcaggaggccaccuucugcagccagagagacggcgacgccagccugaacaaggcccugagcagcagcgccgacgacgccagccuggugaacgccagcaucagcagcagcgugaaggccaccagccccgugaagagcaccaccagcaucaccgacgccaagagcugcgagggccagaaccccgagcugcugcccaagacccccaucagcccccugaagaccggcgugagcaagcccaucgugaagagcacccugagccagaccgugcccagcaagggcgagcugagcagagagaucugccugcagagccagagcaaggacaagagcaccacccccggcggcaccggcaucaagcccuuccuggagagauucggcgagagaugccaggagcacagcaaggagagccccgccagaagcaccccccacagaacccccaucaucacccccaacaccaaggccauccaggagagacuguucaagcaggacaccagcagcagcaccacccaccuggcccagcagcugaagcaggagagacagaaggagcuggccugccugagaggcagauucgacaagggcaacaucuggagcgccgagaagggcggcaacagcaagagcaagcagcuggagaccaagcaggagacccacugccagagcaccccccugaagaagcaccagggcgugagcaagacccagagccugcccgugaccgagaaggugaccgagaaccagauccccgccaagaacagcagcaccgagcccaaggaggugaucagagagaucgagaugagcguggacgacgacgacaucaacagcagcaaggugaucaacgaccuguucagcgacgugcuggaggagggcgagcuggacauggagaagagccaggaggagauggaccaggcccuggccgagagcagcgaggagcaggaggacgcccugaacaucagcagcaugagccugcuggccccccuggcccagaccgugggcguggugagccccgagagccuggugagcacccccagacuggagcugaaggacaccagcagaagcgacgagagccccaagcccggcaaguuccagagaaccagagugcccagagccgagagcggcgacagccugggcagcgaggacagagaccugcuguacagcaucgacgccuacagaagccagagauucaaggagaccgagagacccagcaucaagcaggugaucgugagaaaggaggacgugaccagcaagcuggacgagaagaacaacgccuuccccugccaggugaacaucaagcagaagaugcaggagcugaacaacgagaucaacaugcagcagaccgugaucuaccaggccagccaggcccugaacugcugcguggacgaggagcacggcaagggcagccuggaggaggccgaggccgagagacugcugcugaucgccaccggcaagagaacccugcugaucgacgagcugaacaagcugaagaacgagggcccccagagaaagaacaaggccagcccccagagcgaguucaugcccagcaagggcagcgugacccugagcgagaucagacugccccugaaggccgacuucgugugcagcaccgugcagaagcccgacgccgccaacuacuacuaccugaucauccugaaggccggcgccgagaacaugguggccaccccccuggccagcaccagcaacagccugaacggcgacgcccugaccuucaccaccaccuucacccugcaggacgugagcaacgacuucgagaucaacaucgagguguacagccuggugcagaagaaggaccccagcggccuggacaagaagaagaagaccagcaagagcaaggccaucacccccaagagacugcugaccagcaucaccaccaagagcaacauccacagcagcgugauggccagccccggcggccugagcgccgugagaaccagcaacuucgcccuggugggcagcuacacccugagccugagcagcgugggcaacaccaaguucgugcuggacaaggugcccuuccugagcagccuggagggccacaucuaccugaagaucaagugccaggugaacagcagcguggaggagagaggcuuccugaccaucuucgaggacgugagcggcuucggcgccuggcacagaagauggugcgugcugagcggcaacugcaucagcuacuggaccuaccccgacgacgagaagagaaagaaccccaucggcagaaucaaccuggccaacugcaccagcagacagaucgagcccgccaacagagaguucugcgccagaagaaacaccuucgagcugaucaccgugagaccccagagagaggacgacagagagacccuggugagccagugcagagacacccugugcgugaccaagaacuggcugagcgccgacaccaaggaggagagagaccuguggaugcagaagcugaaccaggugcugguggacaucagacuguggcagcccgacgccugcuacaagcccaucggcaagcccuaa

SEQ ID NO: 13617 - RNA, 1884 nt, Artificial Sequence
  ANO10__Homo_sapiens__NP_001191760
augaaggugacccugagcgcccuggacaccagcgagagcagcuucaccccccugguggugaucgagcuggcccaggacgugaaggaggagaccaaggaguggcugaagaacagaaucaucgccaagaagaaggacggcggcgcccagcugcuguucagaccccugcugaacaaguacgagcaggagacccuggagaaccagaaccuguaccuggugggcgccagcaagaucagaaugcugcugggcgccgaggccgugggccuggugaaggagugcaacgacaacaccaugagagccuucaccuacagaaccagacagaacuucaagggcuucgacgacaacaacgacgacuuccugaccauggccgagugccaguucaucaucaagcacgagcuggagaaccugagagccaaggacgagaagaugauccccggcuacccccaggccaagcuguaccccggcaagagccugcugagaagacugcugaccagcggcaucgugauccagguguucccccugcacgacagcgaggcccugaagaagcuggaggacaccugguacaccagauucgcccugaaguaccagcccaucgacagcaucagaggcuacuucggcgagaccaucgcccuguacuucggcuuccuggaguacuucaccuucgcccugauccccauggccgugaucggccugcccuacuaccuguucgugugggaggacuacgacaaguacgugaucuucgccagcuucaaccugaucuggagcaccgugauccuggagcuguggaagagaggcugcgccaacaugaccuacagauggggcacccugcugaugaagagaaaguucgaggagcccagacccggcuuccacggcgugcugggcaucaacagcaucaccggcaaggaggagccccuguaccccagcuacaagagacagcugagaaucuaccuggugagccugcccuucgugugccugugccuguacuucagccuguacgugaugaugaucuacuucgacauggaggugugggcccugggccugcacgagaacagcggcagcgaguggaccagcgugcugcuguacgugcccagcaucaucuacgccaucgugaucgagaucaugaacagacuguacagauacgccgccgaguuccugaccagcugggagaaccacagacuggagagcgccuaccagaaccaccugauccugaaggugcugguguucaacuuccugaacugcuucgccagccuguucuacaucgccuucgugcugaaggacaugaagcugcugagacagagccuggccacccugcugaucaccagccagauccugaaccagaucauggagagcuuccugcccuacuggcugcagagaaagcacggcgugagagugaagagaaaggugcaggcccugaaggccgacaucgacgccacccuguacgagcaggugauccuggagaaggagaugggcaccuaccugggcaccuucgacgacuaccuggagcuguuccugcaguucggcuacgugagccuguucagcugcguguacccccuggccgccgccuucgccgugcugaacaacuucaccgaggugaacagcgacgcccugaagaugugcagaguguucaagagacccuucagcgagcccagcgccaacaucggcguguggcagcuggccuucgagaccaugagcgugaucagcguggugaccaacugcgcccugaucggcaugagcccccaggugaacgccguguuccccgagagcaaggccgaccugauccugaucgugguggccguggaggccgccagcugcaagcuggugagccugcccagauacagcuggagcaccaacagcgugcccggcaccgugaucggccccggcguguaa

SEQ ID NO: 13618 - RNA, 2961 nt, Artificial Sequence
  ANO1__Homo_sapiens__NP_060513
augagagugaacgagaaguacagcacccugcccgccgaggacagaagcgugcacaucaucaacaucugcgccaucgaggacaucggcuaccugcccagcgagggcacccugcugaacagccugagcguggaccccgacgccgagugcaaguacggccuguacuucagagacggcagaagaaagguggacuacauccugguguaccaccacaagagacccagcggcaacagaacccuggugagaagagugcagcacagcgacacccccagcggcgccagaagcgugaagcaggaccacccccugcccggcaagggcgccagccuggacgccggcagcggcgagccccccauggacuaccacgaggacgacaagagauucagaagagaggaguacgagggcaaccugcuggaggccggccuggagcuggagagagacgaggacaccaagauccacggcgugggcuucgugaagauccacgcccccuggaacgugcugugcagagaggccgaguuccugaagcugaagaugcccaccaagaagauguaccacaucaacgagaccagaggccugcugaagaagaucaacagcgugcugcagaagaucaccgaccccauccagcccaagguggccgagcacagaccccagaccaugaagagacugagcuaccccuucagcagagagaagcagcaccuguucgaccugagcgacaaggacagcuucuucgacagcaagaccagaagcaccaucguguacgagauccugaagagaaccaccugcaccaaggccaaguacagcaugggcaucaccagccugcuggccaacggcguguacgccgccgccuacccccugcacgacggcgacuacaacggcgagaacguggaguucaacgacagaaagcugcuguacgaggagugggccagauacggcguguucuacaaguaccagcccaucgaccuggugagaaaguacuucggcgagaagaucggccuguacuucgccuggcugggcguguacacccagaugcugauccccgccagcaucgugggcaucaucguguuccuguacggcugcgccaccauggacgagaacauccccagcauggagaugugcgaccagagacacaacaucaccaugugcccccugugcgacaagaccugcagcuacuggaagaugagcagcgccugcgccaccgccagagccagccaccuguucgacaaccccgccaccguguucuucagcguguucauggcccugugggccgccaccuucauggagcacuggaagagaaagcagaugagacugaacuacagaugggaccugaccggcuucgaggaggaggaggaggccgugaaggaccaccccagagccgaguacgaggccagagugcuggagaagagccugaagaaggagagcagaaacaaggagaagagaagacacauccccgaggagagcaccaacaaguggaagcagagagugaagaccgccauggccggcgugaagcugaccgacaaggugaagcugaccuggagagacagauuccccgccuaccugaccaaccuggugagcaucaucuucaugaucgccgugaccuucgccaucgugcugggcgugaucaucuacagaaucagcauggccgccgcccuggccaugaacagcagccccagcgugagaagcaacaucagagugaccgugaccgccaccgccgugaucaucaaccugguggugaucauccugcuggacgagguguacggcugcaucgccagauggcugaccaagaucgaggugcccaagaccgagaagagcuucgaggagagacugaucuucaaggccuuccugcugaaguucgugaacagcuacacccccaucuucuacguggccuucuucaagggcagauucgugggcagacccggcgacuacguguacaucuucagaagcuucagaauggaggagugcgcccccggcggcugccugauggagcugugcauccagcugagcaucaucaugcugggcaagcagcugauccagaacaaccuguucgagaucggcauccccaagaugaagaagcugaucagauaccugaagcugaagcagcagagcccccccgaccacgaggagugcgugaagagaaagcagagauacgagguggacuacaaccuggagcccuucgccggccugacccccgaguacauggagaugaucauccaguucggcuucgugacccuguucguggccagcuucccccuggccccccuguucgcccugcugaacaacaucaucgagaucagacuggacgccaagaaguucgugaccgagcugagaagacccguggccgugagagccaaggacaucggcaucugguacaacauccugagaggcaucggcaagcuggccgugaucaucaacgccuucgugaucagcuucaccagcgacuucauccccagacugguguaccuguacauguacagcaagaacggcaccaugcacggcuucgugaaccacacccugagcagcuucaacgugagcgacuuccagaacggcaccgcccccaacgacccccuggaccugggcuacgaggugcagaucugcagauacaaggacuacagagagccccccuggagcgagaacaaguacgacaucagcaaggacuucugggccgugcuggccgccagacuggccuucgugaucguguuccagaaccuggugauguucaugagcgacuucguggacugggugauccccgacauccccaaggacaucagccagcagauccacaaggagaaggugcugaugguggagcuguucaugagagaggagcaggacaagcagcagcugcuggagaccuggauggagaaggagagacagaaggacgagccccccugcaaccaccacaacaccaaggccugccccgacagccugggcagccccgcccccagccacgccuaccacggcggcgugcuguaa

SEQ ID NO: 13619 - RNA, 3012 nt, Artificial Sequence
  ANO2__Homo_sapiens__NP_001265525
auggccacccccggccccagagacaucccccugcugcccggcagccccagaagacugagcccccaggccggcagcagaggcggccagggccccaagcacggccagcagugccugaagaugcccggccccagagcccccggccugcagggcggcagcaacagagaccccggccagcccugcggcggcgagagcaccagaagcagcagcgugaucaacaacuaccuggacgccaacgagcccgugagccuggaggccagacugagcagaaugcacuuccacgacagccagagaaagguggacuacgugcuggccuaccacuacagaaagagaggcgugcaccuggcccagggcuuccccggccacagccuggccaucgugagcaacggcgagaccggcaaggagccccacgccggcggccccggcgacaucgagcugggcccccuggacgcccuggaggaggagagaaaggagcagagagaggaguucgagcacaaccugauggaggccggccuggagcuggagaaggaccuggagaacaagagccagggcagcaucuucgugagaauccacgcccccuggcaggugcuggccagagaggccgaguuccugaagaucaaggugcccaccaagaaggagauguacgagaucaaggccggcggcagcaucgccaagaaguucagcgccgcccugcagaagcugagcagccaccugcagcccagagugcccgagcacagcaacaacaagaugaagaaccugagcuaccccuucagcagagagaagauguaccuguacaacauccaggagaaggacaccuucuucgacaacgccaccagaagcagaaucgugcacgagauccugaagagaaccgccugcagcagagccaacaacaccaugggcaucaacagccugaucgccaacaacaucuacgaggccgccuacccccugcacgacggcgaguacgacagccccgaggacgacaugaacgacagaaagcugcuguaccaggagugggccagauacggcguguucuacaaguuccagcccaucgaccugaucagaaaguacuucggcgagaagaucggccuguacuucgccuggcugggccuguacaccagcuuccugauccccagcagcgugaucggcgugaucguguuccuguacggcugcgccaccaucgaggaggacauccccagcagagagaugugcgaccagcagaacgccuucaccaugugcccccugugcgacaagagcugcgacuacuggaaccugagcagcgccugcggcaccgcccaggccagccaccuguucgacaaccccgccaccguguucuucagcaucuucauggcccugugggccaccauguuccuggagaacuggaagagacugcagaugagacugggcuacuucugggaccugaccggcaucgaggaggaggaggagagagcccaggagcacagcagacccgaguacgagaccaaggugagagagaagaugcugaaggagagcaaccagagcgccgugcagaagcuggagaccaacaccaccgagugcggcgacgaggacgacgaggacaagcugaccuggaaggacagauuccccggcuaccugaugaacuucgccagcauccuguucaugaucgcccugaccuucagcaucguguucggcgugaucguguacagaaucaccaccgccgccgcccugagccugaacaaggccaccagaagcaacgugagagugaccgugaccgccaccgccgugaucaucaaccugguggugauccugauccuggacgagaucuacggcgccguggccaaguggcugaccaagaucgaggugcccaagaccgagcagaccuucgaggagagacugauccugaaggccuuccugcugaaguucgugaacgccuacagccccaucuucuacguggccuucuucaagggcagauucgugggcagacccggcagcuacguguacguguucgacggcuacagaauggaggagugcgcccccggcggcugccugauggagcugugcauccagcugagcaucaucaugcugggcaagcagcugauccagaacaacaucuucgagaucggcgugcccaagcugaagaagcuguucagaaagcugaaggacgagaccgaggccggcgagaccgacagcgcccacagcaagcaccccgagcagugggaccuggacuacagccuggagcccuacaccggccugacccccgaguacauggagaugaucauccaguucggcuucgugacccuguucguggccagcuucccccuggcccccguguucgcccugcugaacaacgugaucgaggugagacuggacgccaagaaguucgugaccgagcugagaagacccgacgccgugagaaccaaggacaucggcaucugguucgacauccugagcggcaucggcaaguucagcgugaucagcaacgccuucgugaucgccaucaccagcgacuucauccccagacugguguaccaguacagcuacagccacaacggcacccugcacggcuucgugaaccacacccugagcuucuucaacgugagccagcugaaggagggcacccagcccgagaacagccaguucgaccaggaggugcaguucugcagauucaaggacuacagagagccccccugggcccccaaccccuacgaguucagcaagcaguacugguucauccugagcgccagacuggccuucgugaucaucuuccagaaccuggugauguuccugagcgugcugguggacuggaugauccccgacauccccaccgacaucagcgaccagaucaagaaggagaagagccugcugguggacuucuuccugaaggaggagcacgagaagcugaagcugauggacgagcccgcccugagaagccccggcggcggcgacagaagcagaagcagagccgccagcagcgcccccagcggccagagccagcugggcagcaugaugagcagcggcagccagcacaccaacguguaa

SEQ ID NO: 13620 - RNA, 2946 nt, Artificial Sequence
  ANO3__Homo_sapiens__NP_113606
auggugcaccacagcggcagcauccagagcuucaagcagcagaagggcaugaacaucagcaagagcgagaucaccaaggagaccagccugaagcccagcagaagaagccugcccugccuggcccagagcuacgccuacagcaagagccugagccagagcaccagccuguuccagagcaccgagagcgagagccaggcccccaccagcaucacccugaucagcaccgacaaggccgagcaggugaacaccgaggagaacaagaacgacagcgugcugagaugcagcuucgccgaccugagcgacuucugccuggcccugggcaaggacaaggacuacaccgacgagagcgagcacgccaccuacgacagaagcagacugaucaacgacuucgugaucaaggacaagagcgaguucaagaccaagcugagcaagaacgacaugaacuacaucgccagcagcggcccccuguucaaggacggcaagaagagaaucgacuacauccugguguacagaaagaccaacauccaguacgacaagagaaacaccuucgagaagaaccugagagccgagggccugaugcuggagaaggagcccgccaucgccagccccgacaucauguucaucaagauccacauccccugggacacccugugcaaguacgccgagagacugaacaucagaaugcccuucagaaagaagugcuacuacaccgacggcagaagcaagagcaugggcagaaugcagaccuacuucagaagaaucaagaacuggauggcccagaaccccauggugcuggacaagagcgccuuccccgaccuggaggagagcgacugcuacaccggccccuucagcagagccagaauccaccacuucaucaucaacaacaaggacaccuucuucagcaacgccaccagaagcagaaucguguaccacaugcuggagagaaccaaguacgagaacggcaucagcaaggugggcaucagaaagcugaucaacaacggcagcuacaucgccgccuuccccccccacgagggcgccuacaagagcagccagcccaucaagacccacggcccccagaacaacagacaccugcuguacgagagaugggccagauggggcaugugguacaagcaccagccccuggaccugaucagacuguacuucggcgagaagaucggccuguacuucgccuggcugggcugguacaccggcaugcugauccccgccgccaucgugggccugugcguguucuucuacggccuguucaccaugaacaacagccaggugagccaggagaucugcaaggccaccgagguguucaugugcccccugugcgacaagaacugcagccugcagagacugaacgacagcugcaucuacgccaaggugaccuaccuguucgacaacggcggcaccguguucuucgccaucuucauggccaucugggccaccguguuccuggaguucuggaagagaagaagaagcauccugaccuacaccugggaccugaucgagugggaggaggaggaggagacccugagaccccaguucgaggccaaguacuacaagauggagaucgugaaccccaucaccggcaagcccgagccccaccagcccagcagcgacaaggugaccagacugcuggugagcgugagcggcaucuucuucaugaucagccuggugaucaccgccguguucggcguggugguguacagacugguggugauggagcaguucgccagcuucaaguggaacuucaucaagcaguacuggcaguucgccaccagcgccgccgccgugugcaucaacuucaucaucaucaugcugcugaaccuggccuacgagaagaucgccuaccugcugaccaaccuggaguaccccagaaccgagagcgagugggagaacagcuucgcccugaagauguuccuguuccaguucgugaaccugaacagcagcaucuucuacaucgccuucuuccugggcagauucgugggccaccccggcaaguacaacaagcuguucgacagauggagacuggaggagugccaccccagcggcugccugaucgaccugugccugcagaugggcgugaucauguuccugaagcagaucuggaacaacuucauggagcugggcuacccccugauccagaacugguggagcagacacaagaucaagagaggcauccacgacgccagcaucccccagugggagaacgacuggaaccugcagcccaugaaccugcacggccugauggacgaguaccuggagauggugcugcaguucggcuucaccaccaucuucguggccgccuucccccuggccccccugcuggcccugcugaacaacaucaucgagaucagacuggacgccuacaaguucgugacccaguggagaagaccccugcccgccagagccaccgacaucggcaucuggcugggcauccuggagggcaucggcauccuggccgugaucaccaacgccuucgugaucgccaucaccagcgacuacauccccagauucguguacgaguacaaguacggccccugcgccaaccacguggagcccagcgagaacugccugaagggcuacgugaacaacagccugagcuucuucgaccugagcgagcugggcaugggcaagagcggcuacugcagauacagagacuacagaggcccccccuggagcagcaagcccuacgaguucacccugcaguacuggcacauccuggccgccagacuggccuucaucaucguguucgagcaccugguguucggcaucaagagcuucaucgccuaccugauccccgacgugcccaagggccugcacgacagaaucagaagagagaaguaccuggugcaggagaugauguacgaggccgagcuggagcaccugcagcagcagagaagaaagagcggccagcccgugcaccacgaguggcccuaa

SEQ ID NO: 13621 - RNA, 2868 nt, Artificial Sequence
  ANO4__Homo_sapiens__NP_001273545
auggaggccagcagcagcggcaucaccaacggcaagaccaagguguuccaccccgagggcggcguggaccugcagggcuaccagcuggacaugcagauccugcccgacggccccaagagcgacguggacuucagcgagauccugaacgccauccaggagauggccaaggacgugaacauccuguucgacgagcuggaggccgugagcagccccugcaaggacgacgacagccugcugcaccccggcaaccugaccagcaccagcgacgacgccagcagacuggaggccggcggcgagaccgugcccgagagaaacaagagcaacggccuguacuucagagacggcaagugcagaaucgacuacauccugguguacagaaagagcaacccccagaccgagaagagagagguguucgagagaaacaucagagccgagggccugcagauggagaaggagagcagccugaucaacagcgacaucaucuucgugaagcugcacgcccccugggaggugcugggcagauacgccgagcagaugaacgugagaaugcccuucagaagaaagaucuacuaccugcccagaagauacaaguucaugagcagaaucgacaagcagaucagcagauucagaagauggcugcccaagaagcccaugagacuggacaaggagacccugcccgaccuggaggagaacgacugcuacaccgcccccuucagccagcagagaauccaccacuucaucauccacaacaaggagaccuucuucaacaacgccaccagaagcagaaucgugcaccacauccugcagagaaucaaguacgaggagggcaagaacaagaucggccugaacagacugcugaccaacggcagcuacgaggccgccuucccccugcacgagggcagcuacagaagcaagaacagcaucagaacccacggcgccgagaaccacagacaccugcuguacgagugcugggccagcuggggcgugugguacaaguaccagccccuggaccuggugagaagauacuucggcgagaagaucggccuguacuucgccuggcugggcugguacaccggcaugcuguuccccgccgccuucaucggccuguucguguuccuguacggcgugaccacccuggaccacagccaggugagcaaggaggugugccaggccaccgacaucaucaugugccccgugugcgacaaguacugccccuucaugagacugagcgacagcugcguguacgccaaggugacccaccuguucgacaacggcgccaccguguucuucgccguguucauggccgugugggccaccguguuccuggaguucuggaagagaagaagagccgugaucgccuacgacugggaccugaucgacugggaggaggaggaggaggagaucagaccccaguucgaggccaaguacagcaagaaggagagaaugaaccccaucagcggcaagcccgagcccuaccaggccuucaccgacaagugcagcagacugaucgugagcgccagcggcaucuucuucaugaucugcguggugaucgccgccguguucggcaucgugaucuacagaguggugaccgugagcaccuucgccgccuucaagugggcccugaucagaaacaacagccagguggccaccaccggcaccgccgugugcaucaacuucugcaucaucaugcugcugaacgugcuguacgagaagguggcccugcugcugaccaaccuggagcagcccagaaccgagagcgagugggagaacagcuucacccugaagauguuccuguuccaguucgugaaccugaacagcagcaccuucuacaucgccuucuuccugggcagauucaccggccaccccggcgccuaccugagacugaucaacagauggagacuggaggagugccaccccagcggcugccugaucgaccugugcaugcagaugggcaucaucauggugcugaagcagaccuggaacaacuucauggagcugggcuacccccugauccagaacugguggaccagaagaaaggugagacaggagcacggccccgagagaaagaucagcuucccccagugggagaaggacuacaaccugcagcccaugaacgccuacggccuguucgacgaguaccuggagaugauccugcaguucggcuucaccaccaucuucguggccgccuucccccuggccccccugcuggcccugcugaacaacaucaucgagaucagacuggacgccuacaaguucgugacccaguggagaagaccccuggccagcagagccaaggacaucggcaucugguacggcauccuggagggcaucggcauccugagcgugaucaccaacgccuucgugaucgccaucaccagcgacuucauccccagacugguguacgccuacaaguacggccccugcgccggccagggcgaggccggccagaagugcauggugggcuacgugaacgccagccugagcguguucagaaucagcgacuucgagaacagaagcgagcccgagagcgacggcagcgaguucagcggcaccccccugaaguacugcagauacagagacuacagagaccccccccacagccuggugcccuacggcuacacccugcaguucuggcacgugcuggccgccagacuggccuucaucaucguguucgagcaccugguguucugcaucaagcaccugaucagcuaccugauccccgaccugcccaaggaccugagagacagaaugagaagagagaaguaccugauccaggagaugauguacgaggccgagcuggagagacugcagaaggagagaaaggagagaaagaagaacggcaaggcccaccacaacgaguggcccuaa

SEQ ID NO: 13622 - RNA, 2742 nt, Artificial Sequence
  ANO5__Homo_sapiens__NP_998764
augggcgaccccgaccugcuggaggugcuggccgaggagggcgagaaggugaacaagcacaucgacuacagcuuccagaugagcgagcagagccugagcagcagagagaccagcuuccugaucaacgaggagaccaugcccgccaagagauucaaccuguuccugagaagaagacugauguuccagaagaaccagcagagcaaggacagcaucuucuucagagacggcaucagacagaucgacuucgugcugagcuacguggacgacgugaagaaggacgccgagcugaaggccgagagaagaaaggaguucgagaccaaccugagaaagaccggccuggagcuggagaucgaggacaagagagacagcgaggacggcagaaccuacuucgugaagauccacgcccccugggaggugcuggugaccuacgccgaggugcugggcaucaagaugcccaucaaggagagcgacauccccagacccaagcacacccccaucagcuacgugcugggccccgugagacugccccugagcgugaaguacccccaccccgaguacuucaccgcccaguucagcagacacagacaggagcuguuccugaucgaggaccaggccaccuucuuccccagcagcagcagaaacagaaucguguacuacauccugagcagaugccccuucggcaucgaggacggcaagaagagauucggcaucgagagacugcugaacagcaacaccuacagcagcgccuacccccugcacgacggccaguacuggaagcccagcgagccccccaaccccaccaacgagagauacacccugcaccagaacugggccagauucagcuacuucuacaaggagcagccccuggaccugaucaagaacuacuacggcgagaagaucggcaucuacuucguguuccugggcuucuacaccgagaugcuguucuucgccgccguggugggccuggccugcuucaucuacggccugcugagcauggagcacaacaccagcagcaccgagaucugcgaccccgagaucggcggccagaugaucaugugcccccugugcgaccaggugugcgacuacuggagacugaacagcaccugccuggccagcaaguucagccaccuguucgacaacgagagcaccguguucuucgccaucuucaugggcaucugggugacccuguuccuggaguucuggaagcagagacaggccagacuggaguacgagugggaccugguggacuucgaggaggagcagcagcagcugcagcugagacccgaguucgaggccaugugcaagcacagaaagcugaacgccgugaccaaggagauggagcccuacaugccccuguacaccagaauccccugguacuuccugagcggcgccaccgugacccuguggaugagccugguggugaccagcaugguggccgugaucguguacagacugagcguguucgccaccuucgccagcuucauggagagcgacgccagccugaagcaggugaagagcuuccugaccccccagaucaccaccagccugaccggcagcugccugaacuucaucgugauccugauccugaacuucuucuacgagaagaucagcgccuggaucaccaagauggagauccccagaaccuaccaggaguacgagagcagccugacccugaagauguuccuguuccaguucgugaacuucuacagcagcugcuucuacguggccuucuucaagggcaaguucgugggcuaccccggcaaguacaccuaccuguucaacgaguggagaagcgaggagugcgaccccggcggcugccugaucgagcugaccacccagcugaccaucaucaugaccggcaagcagaucuucggcaacaucaaggaggccaucuacccccuggcccugaacugguggagaagaagaaaggccagaaccaacagcgagaagcuguacagcagaugggagcaggaccacgaccuggagagcuucggcccccugggccuguucuacgaguaccuggagaccgugacccaguucggcuucgugacccuguucguggccagcuucccccuggccccccugcuggcccugaucaacaacaucguggagaucagaguggacgccuggaagcugaccacccaguacagaagaaccguggccagcaaggcccacagcaucggcguguggcaggacauccuguacggcauggccgugcugagcguggccaccaacgccuucaucguggccuucaccagcgacaucauccccagacugguguacuacuacgccuacagcaccaacgccacccagcccaugaccggcuacgugaacaacagccugagcguguuccugaucgccgacuuccccaaccacaccgcccccagcgagaagagagacuucaucaccugcagauacagagacuacagauacccccccgacgacgagaacaaguacuuccacaacaugcaguucuggcacgugcuggccgccaagaugaccuucaucaucgugauggagcacgugguguuccuggugaaguuccugcuggccuggaugauccccgacgugcccaaggacgugguggagagaaucaagagagagaagcugaugaccaucaagauccugcacgacuucgagcugaacaagcugaaggagaaccugggcaucaacagcaacgaguucgccaagcacgugaugaucgaggagaacaaggcccagcuggccaagagcacccuguaa

SEQ ID NO: 13623 - RNA, 2733 nt, Artificial Sequence
  ANO6__Homo_sapiens__NP_001020527
augaagaagaugagcagaaacgugcugcugcagauggaggaggaggaggacgacgacgacggcgacaucgugcuggagaaccugggccagaccaucgugcccgaccugggcagccuggagagccagcacgacuucagaacccccgaguucgaggaguucaacggcaagcccgacagccuguucuucaacgacggccagagaagaaucgacuucgugcugguguacgaggacgagagcagaaaggagaccaacaagaagggcaccaacgagaagcagagaagaaagagacaggccuacgagagcaaccugaucugccacggccugcagcuggaggccaccagaagcgugcuggacgacaagcugguguucgugaaggugcacgcccccugggaggugcugugcaccuacgccgagaucaugcacaucaagcugccccugaagcccaacgaccugaagaacagaagcagcgccuucggcacccugaacugguucaccaaggugcugagcguggacgagagcaucaucaagcccgagcaggaguucuucaccgcccccuucgagaagaacagaaugaacgacuucuacaucguggacagagacgccuucuucaaccccgccaccagaagcagaaucguguacuucauccugagcagagugaaguaccaggugaucaacaacgugagcaaguucggcaucaacagacuggugaacagcggcaucuacaaggccgccuucccccugcacgacugcaaguucagaagacagagcgaggaccccagcugccccaacgagagauaccugcuguacagagagugggcccaccccagaagcaucuacaagaagcagccccuggaccugaucagaaaguacuacggcgagaagaucggcaucuacuucgccuggcugggcuacuacacccagaugcugcugcuggccgccguggugggcguggccugcuuccuguacggcuaccugaaccaggacaacugcaccuggagcaaggaggugugccaccccgacaucggcggcaagaucaucaugugcccccagugcgacagacugugccccuucuggaagcugaacaucaccugcgagagcagcaagaagcugugcaucuucgacagcuucggcacccugguguucgccguguucaugggcgugugggugacccuguuccuggaguucuggaagagaagacaggccgagcuggaguacgagugggacaccguggagcugcagcaggaggagcaggccagacccgaguacgaggccagaugcacccacguggugaucaacgagaucacccaggaggaggagagaauccccuucaccgccuggggcaagugcaucagaaucacccugugcgccagcgccguguucuucuggauccugcugaucaucgccagcgugaucggcaucaucguguacagacugagcguguucaucguguucagcgccaagcugcccaagaacaucaacggcaccgaccccauccagaaguaccugaccccccagaccgccaccagcaucaccgccagcaucaucagcuucaucaucaucaugauccugaacaccaucuacgagaagguggccaucaugaucaccaacuucgagcugcccagaacccagaccgacuacgagaacagccugaccaugaagauguuccuguuccaguucgugaacuacuacagcagcugcuucuacaucgccuucuucaagggcaaguucgugggcuaccccggcgaccccguguacuggcugggcaaguacagaaacgaggagugcgaccccggcggcugccugcuggagcugaccacccagcugaccaucaucaugggcggcaaggccaucuggaacaacauccaggaggugcugcugcccuggaucaugaaccugaucggcagauuccacagagugagcggcagcgagaagaucacccccagaugggagcaggacuaccaccugcagcccaugggcaagcugggccuguucuacgaguaccuggagaugaucauccaguucggcuucgugacccuguucguggccagcuucccccuggccccccugcuggcccuggugaacaacauccuggagaucagaguggacgccuggaagcugaccacccaguucagaagacuggugcccgagaaggcccaggacaucggcgccuggcagcccaucaugcagggcaucgccauccuggccguggugaccaacgccaugaucaucgccuucaccagcgacaugauccccagacugguguacuacuggagcuucagcgugccccccuacggcgaccacaccagcuacaccauggagggcuacaucaacaacacccugagcaucuucaagguggccgacuucaagaacaagagcaagggcaaccccuacagcgaccugggcaaccacaccaccugcagauacagagacuucagauacccccccggccacccccaggaguacaagcacaacaucuacuacuggcacgugaucgccgccaagcuggccuucaucaucgugauggagcacgugaucuacagcgugaaguucuucaucagcuacgccauccccgacgugagcaagagaaccaagagcaagauccagagagagaaguaccugacccagaagcugcugcacgagaaccaccugaaggacaugaccaagaacaugggcgugaucgccgagagaaugaucgaggccguggacaacaaccugagacccaagagcgaguaa

SEQ ID NO: 13624 - RNA, 540 nt, Artificial Sequence
  ANO7__Homo_sapiens__NP_001001666
augagaauggccgccaccgccugggccggccugcagggccccccccugcccacccugugccccgccgugagaaccggccuguacugcagagaccaggcccacgccgagagaugggccaugaccagcgagaccagcagcggcagccacugcgccagaagcagaaugcugagaagaagagcccaggaggaggacagcaccgugcugaucgacgugagcccccccgaggccgagaagagaggcagcuacggcagcaccgcccacgccagcgagcccggcggccagcaggccgccgccugcagagccggcagccccgccaagcccagaaucgacuucgugcuggugugggaggaggaccugaagcuggacagacagcaggacagcgccgccagagacagaaccgacaugcacagaaccuggagagagaccuuccuggacaaccugagagccgccggccugugcguggaccaggugagaggcggcugccacggccagggccccagacccugcauccacagcgugacccacgaccuggccgccuaa

SEQ ID NO: 13625 - RNA, 750 nt, Artificial Sequence
  ANP32A__Homo_sapiens__NP_006296
auggagaugggcagaagaauccaccuggagcugagaaacagaacccccagcgacgugaaggagcuggugcuggacaacagcagaagcaacgagggcaagcuggagggccugaccgacgaguucgaggagcuggaguuccugagcaccaucaacgugggccugaccagcaucgccaaccugcccaagcugaacaagcugaagaagcuggagcugagcgacaacagagugagcggcggccuggaggugcuggccgagaagugccccaaccugacccaccugaaccugagcggcaacaagaucaaggaccugagcaccaucgagccccugaagaagcuggagaaccugaagagccuggaccuguucaacugcgaggugaccaaccugaacgacuacagagagaacguguucaagcugcugccccagcugaccuaccuggacggcuacgacagagacgacaaggaggcccccgacagcgacgccgagggcuacguggagggccuggacgacgaggaggaggacgaggacgaggaggaguacgacgaggacgcccaggugguggaggacgaggaggacgaggacgaggaggaggagggcgaggaggaggacgugagcggcgaggaggaggaggacgaggagggcuacaacgacggcgagguggacgacgaggaggacgaggaggagcugggcgaggaggagagaggccagaagagaaagagagagcccgaggacgagggcgaggacgacgacuaa

SEQ ID NO: 13626 - RNA, 756 nt, Artificial Sequence
  ANP32B__Homo_sapiens__NP_006392
auggacaugaagagaagaauccaccuggagcugagaaacagaacccccgccgccgugagagagcuggugcuggacaacugcaagagcaacgacggcaagaucgagggccugaccgccgaguucgugaaccuggaguuccugagccugaucaacgugggccugaucagcgugagcaaccugcccaagcugcccaagcugaagaagcuggagcugagcgagaacagaaucuucggcggccuggacaugcuggccgagaagcugcccaaccugacccaccugaaccugagcggcaacaagcugaaggacaucagcacccuggagccccugaagaagcuggagugccugaagagccuggaccuguucaacugcgaggugaccaaccugaacgacuacagagagagcguguucaagcugcugccccagcugaccuaccuggacggcuacgacagagaggaccaggaggcccccgacagcgacgccgagguggacggcguggacgaggaggaggaggacgaggagggcgaggacgaggaggacgaggacgacgaggacggcgaggaggaggaguucgacgaggaggacgacgaggacgaggacguggagggcgacgaggacgacgacgaggugagcgaggaggaggaggaguucggccuggacgaggaggacgaggacgaggacgaggacgaggaggaggaggagggcggcaagggcgagaagagaaagagagagaccgacgacgagggcgaggacgacuaa

SEQ ID NO: 13627 - RNA, 396 nt, Artificial Sequence
  ANP32D__Homo_sapiens__NP_036536
auggagaugggcaaguggauccaccuggagcugagaaacagaacccccagcgacgugaaggagcuguuccuggacaacagccagagcaacgagggcaagcuggagggccugaccgacgaguucgaggagcuggagcugcugaacaccaucaacaucggccugaccagcaucgccaaccugcccaagcugaacaagcugaagaagcuggagcugagcagcaacagagccagcgugggccuggaggugcuggccgagaagugccccaaccugauccaccugaaccugagcggcaacaagaucaaggaccugagcaccaucgagccccugaagaagcuggagaaccuggagagccuggaccuguucaccugcgaggugaccaaccugaacaacuacuaa

SEQ ID NO: 13628 - RNA, 2904 nt, Artificial Sequence
  ANPEP__Homo_sapiens__NP_001141
auggccaagggcuucuacaucagcaagagccugggcauccugggcauccugcugggcguggccgccgugugcaccaucaucgcccugagcgugguguacagccaggagaagaacaagaacgccaacagcagccccguggccagcaccacccccagcgccagcgccaccaccaaccccgccagcgccaccacccuggaccagagcaaggccuggaacagauacagacugcccaacacccugaagcccgacagcuacagagugacccugagacccuaccugacccccaacgacagaggccuguacguguucaagggcagcagcaccgugagauucaccugcaaggaggccaccgacgugaucaucauccacagcaagaagcugaacuacacccugagccagggccacagaguggugcugagaggcgugggcggcagccagccccccgacaucgacaagaccgagcugguggagcccaccgaguaccugguggugcaccugaagggcagccuggugaaggacagccaguacgagauggacagcgaguucgagggcgagcuggccgacgaccuggccggcuucuacagaagcgaguacauggagggcaacgugagaaaggugguggccaccacccagaugcaggccgccgacgccagaaagagcuuccccugcuucgacgagcccgccaugaaggccgaguucaacaucacccugauccaccccaaggaccugaccgcccugagcaacaugcugcccaagggccccagcaccccccugcccgaggaccccaacuggaacgugaccgaguuccacaccacccccaagaugagcaccuaccugcuggccuucaucgugagcgaguucgacuacguggagaagcaggccagcaacggcgugcugaucagaaucugggccagacccagcgccaucgccgccggccacggcgacuacgcccugaacgugaccggccccauccugaacuucuucgccggccacuacgacacccccuacccccugcccaagagcgaccagaucggccugcccgacuucaacgccggcgccauggagaacuggggccuggugaccuacagagagaacagccugcuguucgacccccugagcagcagcagcagcaacaaggagagaguggugaccgugaucgcccacgagcuggcccaccagugguucggcaaccuggugaccaucgagugguggaacgaccuguggcugaacgagggcuucgccagcuacguggaguaccugggcgccgacuacgccgagcccaccuggaaccugaaggaccugauggugcugaacgacguguacagagugauggccguggacgcccuggccagcagccacccccugagcacccccgccagcgagaucaacacccccgcccagaucagcgagcuguucgacgccaucagcuacagcaagggcgccagcgugcugagaaugcugagcagcuuccugagcgaggacguguucaagcagggccuggccagcuaccugcacaccuucgccuaccagaacaccaucuaccugaaccugugggaccaccugcaggaggccgugaacaacagaagcauccagcugcccaccaccgugagagacaucaugaacagauggacccugcagaugggcuuccccgugaucaccguggacaccagcaccggcacccugagccaggagcacuuccugcuggaccccgacagcaacgugaccagacccagcgaguucaacuacguguggaucgugcccaucaccagcaucagagacggcagacagcagcaggacuacuggcugaucgacgugagagcccagaacgaccuguucagcaccagcggcaacgagugggugcugcugaaccugaacgugaccggcuacuacagagugaacuacgacgaggagaacuggagaaagauccagacccagcugcagagagaccacagcgccauccccgugaucaacagagcccagaucaucaacgacgccuucaaccuggccagcgcccacaaggugcccgugacccuggcccugaacaacacccuguuccugaucgaggagagacaguacaugcccugggaggccgcccugagcagccugagcuacuucaagcugauguucgacagaagcgagguguacggccccaugaagaacuaccugaagaagcaggugaccccccuguucauccacuucagaaacaacaccaacaacuggagagagauccccgagaaccugauggaccaguacagcgaggugaacgccaucagcaccgccugcagcaacggcgugcccgagugcgaggagauggugagcggccuguucaagcaguggauggagaaccccaacaacaaccccauccaccccaaccugagaagcaccguguacugcaacgccaucgcccagggcggcgaggaggagugggacuucgccugggagcaguucagaaacgccacccuggugaacgaggccgacaagcugagagccgcccuggccugcagcaaggagcuguggauccugaacagauaccugagcuacacccugaaccccgaccugaucagaaagcaggacgccaccagcaccaucaucagcaucaccaacaacgugaucggccagggccuggugugggacuucgugcagagcaacuggaagaagcuguucaacgacuacggcggcggcagcuucagcuucagcaaccugauccaggccgugaccagaagauucagcaccgaguacgagcugcagcagcuggagcaguucaagaaggacaacgaggagaccggcuucggcagcggcaccagagcccuggagcaggcccuggagaagaccaaggccaacaucaagugggugaaggagaacaaggagguggugcugcagugguucaccgagaacagcaaguaa

SEQ ID NO: 13629 - RNA, 1002 nt, Artificial Sequence
  ANTXR1__Homo_sapiens__NP_060623
auggccaccgccgagagaagagcccugggcaucggcuuccaguggcugagccuggccacccuggugcugaucugcgccggccagggcggcagaagagaggacggcggccccgccugcuacggcggcuucgaccuguacuucauccuggacaagagcggcagcgugcugcaccacuggaacgagaucuacuacuucguggagcagcuggcccacaaguucaucagcccccagcugagaaugagcuucaucguguucagcaccagaggcaccacccugaugaagcugaccgaggacagagagcagaucagacagggccuggaggagcugcagaaggugcugcccggcggcgacaccuacaugcacgagggcuucgagagagccagcgagcagaucuacuacgagaacagacagggcuacagaaccgccagcgugaucaucgcccugaccgacggcgagcugcacgaggaccuguucuucuacagcgagagagaggccaacagaagcagagaccugggcgccaucguguacugcgugggcgugaaggacuucaacgagacccagcuggccagaaucgccgacagcaaggaccacguguuccccgugaacgacggcuuccaggcccugcagggcaucauccacagcauccugaagaagagcugcaucgagauccuggccgccgagcccagcaccaucugcgccggcgagagcuuccaggugguggugagaggcaacggcuucagacacgccagaaacguggacagagugcugugcagcuucaagaucaacgacagcgugacccugaacgagaagcccuucagcguggaggacaccuaccugcugugccccgcccccauccugaaggaggugggcaugaaggccgcccugcaggugagcaugaacgacggccugagcuucaucagcagcagcgugaucaucaccaccacccacugcagccugcacaagaucgccagcggccccaccaccgccgccugcauggaguaa

SEQ ID NO: 13630 - RNA, 1470 nt, Artificial Sequence
  ANTXR2__Homo_sapiens__NP_001139266
augguggccgagagaagccccgccagaagccccggcagcuggcuguuccccggccuguggcugcuggugcugagcggccccggcggccugcugagagcccaggagcagcccagcugcagaagagccuucgaccuguacuucgugcuggacaagagcggcagcguggccaacaacuggaucgagaucuacaacuucgugcagcagcuggccgagagauucgugagccccgagaugagacugagcuucaucguguucagcagccaggccaccaucauccugccccugaccggcgacagaggcaagaucagcaagggccuggaggaccugaagagagugagccccgugggcgagaccuacauccacgagggccugaagcuggccaacgagcagauccagaaggccggcggccugaagaccagcagcaucaucaucgcccugaccgacggcaagcuggacggccuggugcccagcuacgccgagaaggaggccaagaucagcagaagccugggcgccagcguguacugcgugggcgugcuggacuucgagcaggcccagcuggagagaaucgccgacagcaaggagcagguguuccccgugaagggcggcuuccaggcccugaagggcaucaucaacagcauccuggcccagagcugcaccgagauccuggagcugcagcccagcagcgugugcgugggcgaggaguuccagaucgugcugagcggcagaggcuucaugcugggcagcagaaacggcagcgugcugugcaccuacaccgugaacgagaccuacaccaccagcgugaagcccgugagcgugcagcugaacagcaugcugugccccgcccccauccugaacaaggccggcgagacccuggacgugagcgugagcuucaacggcggcaagagcgugaucagcggcagccugaucgugaccgccaccgagugcagcaacggcaucgccgccaucaucgugauccuggugcugcugcugcugcugggcaucggccugauguggugguucuggccccugugcugcaagguggugaucaaggaccccccccccccccccgcccccgcccccaaggaggaggaggaggagccccugcccaccaagaaguggcccaccguggacgccagcuacuacggcggcagaggcgugggcggcaucaagagaauggaggugagauggggcgacaagggcagcaccgaggagggcgccagacuggagaaggccaagaacgccguggugaagauccccgaggagaccgaggagcccaucagacccagaccccccagacccaagcccacccaccagcccccccagaccaagugguacacccccaucaagggcagacuggacgcccugugggcccugcugagaagacaguacgacagagugagccugaugagaccccaggagggcgacgaggugugcaucugggagugcaucgagaaggagcugaccgccuaa

SEQ ID NO: 13631 - RNA, 975 nt, Artificial Sequence
  ANXA10__Homo_sapiens__NP_009124
auguucugcggcgacuacgugcagggcaccaucuuccccgcccccaacuucaaccccaucauggacgcccagaugcugggcggcgcccugcagggcuucgacugcgacaaggacaugcugaucaacauccugacccagagaugcaacgcccagagaaugaugaucgccgaggccuaccagagcauguacggcagagaccugaucggcgacaugagagagcagcugagcgaccacuucaaggacgugauggccggccugauguacccccccccccuguacgacgcccacgagcuguggcacgccaugaagggcgugggcaccgacgagaacugccugaucgagauccuggccagcagaaccaacggcgagaucuuccagaugagagaggccuacugccugcaguacagcaacaaccugcaggaggacaucuacagcgagaccagcggccacuucagagacacccugaugaaccuggugcagggcaccagagaggagggcuacaccgaccccgccauggccgcccaggacgccauggugcugugggaggccugccagcagaagaccggcgagcacaagaccaugcugcagaugauccugugcaacaagagcuaccagcagcugagacugguguuccaggaguuccagaacaucagcggccaggacaugguggacgccaucaacgagugcuacgacggcuacuuccaggagcugcugguggccaucgugcugugcgugagagacaagcccgccuacuucgccuacagacuguacagcgccauccacgacuucggcuuccacaacaagaccgugaucagaauccugaucgccagaagcgagaucgaccugcugaccaucagaaagagauacaaggagagauacggcaagagccuguuccacgacaucagaaacuucgccagcggccacuacaagaaggcccugcuggccaucugcgccggcgacgccgaggacuacuaa

SEQ ID NO: 13632 - RNA, 1518 nt, Artificial Sequence
  ANXA11__Homo_sapiens__NP_001265336
augagcuaccccggcuacccccccccccccggcggcuacccccccgccgcccccggcggcggccccuggggcggcgccgccuacccccccccccccagcaugccccccaucggccuggacaacguggccaccuacgccggccaguucaaccaggacuaccugagcggcauggccgccaacaugagcggcaccuucggcggcgccaacaugcccaaccuguaccccggcgcccccggcgccggcuacccccccgugccccccggcggcuucggccagccccccagcgcccagcagcccgugccccccuacggcauguaccccccccccggcggcaacccccccagcagaaugcccagcuacccccccuaccccggcgcccccgugcccggccagcccaugcccccccccggccagcagccccccggcgccuaccccggccagccccccgugaccuaccccggccagccccccgugccccugcccggccagcagcagcccgugcccagcuaccccggcuaccccggcagcggcaccgugacccccgccgugccccccacccaguucggcagcagaggcaccaucaccgacgcccccggcuucgacccccugagagacgccgaggugcugagaaaggccaugaagggcuucggcaccgacgagcaggccaucaucgacugccugggcagcagaagcaacaagcagagacagcagauccugcugagcuucaagaccgccuacggcaaggaccugaucaaggaccugaagagcgagcugagcggcaacuucgagaagaccauccuggcccugaugaagacccccgugcuguucgacaucuacgagaucaaggaggccaucaagggcgugggcaccgacgaggccugccugaucgagauccuggccagcagaagcaacgagcacaucagagagcugaacagagccuacaaggccgaguucaagaagacccuggaggaggccaucagaagcgacaccagcggccacuuccagagacugcugaucagccugagccagggcaacagagacgagagcaccaacguggacaugagccuggcccagagagacgcccaggagcuguacgccgccggcgagaacagacugggcaccgacgagagcaaguucaacgccgugcugugcagcagaagcagagcccaccugguggccguguucaacgaguaccagagaaugaccggcagagacaucgagaagagcaucugcagagagaugagcggcgaccuggaggagggcaugcuggccguggugaagugccugaagaacacccccgccuucuucgccgagagacugaacaaggccaugagaggcgccggcaccaaggacagaacccugaucagaaucauggugagcagaagcgagaccgaccugcuggacaucagaagcgaguacaagagaauguacggcaagagccuguaccacgacaucagcggcgacaccagcggcgacuacagaaagauccugcugaagaucugcggcggcaacgacuaa

SEQ ID NO: 13633 - RNA, 1074 nt, Artificial Sequence
  ANXA13__Homo_sapiens__NP_001003954
augggcaacagacacagccagagcuacacccugagcgagggcagccagcagcugcccaagggcgacagccagcccagcaccguggugcagccccugagccaccccagcagaaacggcgagcccgaggccccccagcccgccaaggccagcagcccccagggcuucgacguggacagagacgccaagaagcugaacaaggccugcaagggcaugggcaccaacgaggccgccaucaucgagauccugagcggcagaaccagcgacgagagacagcagaucaagcagaaguacaaggccaccuacggcaaggagcuggaggaggugcugaagagcgagcugagcggcaacuucgagaagaccgcccuggcccugcuggacagacccagcgaguacgccgccagacagcugcagaaggccaugaagggccugggcaccgacgagagcgugcugaucgaggugcugugcaccagaaccaacaaggagaucaucgccaucaaggaggccuaccagagacuguucgacagaagccuggagagcgacgugaagggcgacaccagcggcaaccugaagaagauccuggugagccugcugcaggccaacagaaacgagggcgacgacguggacaaggaccuggccggccaggacgccaaggaccuguacgacgccggcgagggcagauggggcaccgacgagcuggccuucaacgaggugcuggccaagagaagcuacaagcagcugagagccaccuuccaggccuaccagauccugaucggcaaggacaucgaggaggccaucgaggaggagaccagcggcgaccugcagaaggccuaccugacccuggugagaugcgcccaggacugcgaggacuacuucgccgagagacuguacaagagcaugaagggcgccggcaccgacgaggagacccugaucagaaucguggugaccagagccgagguggaccugcagggcaucaaggccaaguuccaggagaaguaccagaagagccugagcgacauggugagaagcgacaccagcggcgacuucagaaagcugcugguggcccugcugcacuaa

SEQ ID NO: 13634 - RNA, 1074 nt, Artificial Sequence
  ANXA1__Homo_sapiens__XP_011516910
augaaccugauccugagauacaccuucagcaagauggccauggugagcgaguuccugaagcaggccugguucaucgagaacgaggagcaggaguacgugcagaccgugaagagcagcaagggcggccccggcagcgccgugagccccuaccccaccuucaaccccagcagcgacguggccgcccugcacaaggccaucauggugaagggcguggacgaggccaccaucaucgacauccugaccaagagaaacaacgcccagagacagcagaucaaggccgccuaccugcaggagaccggcaagccccuggacgagacccugaagaaggcccugaccggccaccuggaggagguggugcuggcccugcugaagacccccgcccaguucgacgccgacgagcugagagccgccaugaagggccugggcaccgacgaggacacccugaucgagauccuggccagcagaaccaacaaggagaucagagacaucaacagaguguacagagaggagcugaagagagaccuggccaaggacaucaccagcgacaccagcggcgacuucagaaacgcccugcugagccuggccaagggcgacagaagcgaggacuucggcgugaacgaggaccuggccgacagcgacgccagagcccuguacgaggccggcgagagaagaaagggcaccgacgugaacguguucaacaccauccugaccaccagaagcuacccccagcugagaagaguguuccagaaguacaccaaguacagcaagcacgacaugaacaaggugcuggaccuggagcugaagggcgacaucgagaagugccugaccgccaucgugaagugcgccaccagcaagcccgccuucuucgccgagaagcugcaccaggccaugaagggcgugggcaccagacacaaggcccugaucagaaucauggugagcagaagcgagaucgacaugaacgacaucaaggccuucuaccagaagauguacggcaucagccugugccaggccauccuggacgagaccaagggcgacuacgagaagauccugguggcccugugcggcggcaacuaa

SEQ ID NO: 13635 - RNA, 1074 nt, Artificial Sequence
  ANXA2__Homo_sapiens__NP_001002858
augggcagacagcuggccggcugcggcgacgccggcaagaaggccagcuucaagaugagcaccgugcacgagauccugugcaagcugagccuggagggcgaccacagcaccccccccagcgccuacggcagcgugaaggccuacaccaacuucgacgccgagagagacgcccugaacaucgagaccgccaucaagaccaagggcguggacgaggugaccaucgugaacauccugaccaacagaagcaacgcccagagacaggacaucgccuucgccuaccagagaagaaccaagaaggagcuggccagcgcccugaagagcgcccugagcggccaccuggagaccgugauccugggccugcugaagacccccgcccaguacgacgccagcgagcugaaggccagcaugaagggccugggcaccgacgaggacagccugaucgagaucaucugcagcagaaccaaccaggagcugcaggagaucaacagaguguacaaggagauguacaagaccgaccuggagaaggacaucaucagcgacaccagcggcgacuucagaaagcugaugguggcccuggccaagggcagaagagccgaggacggcagcgugaucgacuacgagcugaucgaccaggacgccagagaccuguacgacgccggcgugaagagaaagggcaccgacgugcccaaguggaucagcaucaugaccgagagaagcgugccccaccugcagaagguguucgacagauacaagagcuacagccccuacgacaugcuggagagcaucagaaaggaggugaagggcgaccuggagaacgccuuccugaaccuggugcagugcauccagaacaagccccuguacuucgccgacagacuguacgacagcaugaagggcaagggcaccagagacaaggugcugaucagaaucauggugagcagaagcgagguggacaugcugaagaucagaagcgaguucaagagaaaguacggcaagagccuguacuacuacauccagcaggacaccaagggcgacuaccagaaggcccugcuguaccugugcggcggcgacgacuaa

SEQ ID NO: 13636 - RNA, 582 nt, Artificial Sequence
  ANXA2R__Homo_sapiens__NP_001014301
auggagcagcacuuccugggcugcgugaagagagccugggacagcgccgagguggcccccgagccccagcccccccccaucgugagcagcgaggacagaggccccuggccccugccccuguaccccgugcugggcgaguacagccuggacagcugcgaccugggccugcugagcagccccugcuggagacugcccggcguguacuggcagaacggccugagccccggcgugcagagcacccuggagcccagcaccgccaagcccaccgaguucagcuggcccggcacccagaagcagcaggaggcccccguggaggaggugggccaggccgaggagcccgacagacugagacugcagcagcugcccuggagcagcccccugcaccccugggacagacagcaggacaccgaggugugcgacagcggcugccugcuggagagaagacacccccccgcccugcagcccuggagacaccugcccggcuucagcgacugccuggaguggauccugagagugggcuucgccgccuucagcgugcugugggccugcugcagcagaaucugcggcgccaagcagcccuaa

SEQ ID NO: 13637 - RNA, 972 nt, Artificial Sequence
  ANXA3__Homo_sapiens__NP_005130
auggccagcaucugggugggccacagaggcaccgugagagacuaccccgacuucagccccagcguggacgccgaggccauccagaaggccaucagaggcaucggcaccgacgagaagaugcugaucagcauccugaccgagagaagcaacgcccagagacagcugaucgugaaggaguaccaggccgccuacggcaaggagcugaaggacgaccugaagggcgaccugagcggccacuucgagcaccugaugguggcccuggugaccccccccgccguguucgacgccaagcagcugaagaagagcaugaagggcgccggcaccaacgaggacgcccugaucgagauccugaccaccagaaccagcagacagaugaaggacaucagccaggccuacuacaccguguacaagaagagccugggcgacgacaucagcagcgagaccagcggcgacuucagaaaggcccugcugacccuggccgacggcagaagagacgagagccugaagguggacgagcaccuggccaagcaggacgcccagauccuguacaaggccggcgagaacagauggggcaccgacgaggacaaguucaccgagauccugugccugagaagcuucccccagcugaagcugaccuucgacgaguacagaaacaucagccagaaggacaucguggacagcaucaagggcgagcugagcggccacuucgaggaccugcugcuggccaucgugaacugcgugagaaacacccccgccuuccuggccgagagacugcacagagcccugaagggcaucggcaccgacgaguucacccugaacagaaucauggugagcagaagcgagaucgaccugcuggacaucagaaccgaguucaagaagcacuacggcuacagccuguacagcgccaucaagagcgacaccagcggcgacuacgagaucacccugcugaagaucugcggcggcgacgacuaa

SEQ ID NO: 13638 - RNA, 966 nt, Artificial Sequence
  ANXA4__Homo_sapiens__NP_001307627
auggccauggccaccaagggcggcaccgugaaggccgccagcggcuucaacgccauggaggacgcccagacccugagaaaggccaugaagggccugggcaccgacgaggacgccaucaucagcgugcuggccuacagaaacaccgcccagagacaggagaucagaaccgccuacaagagcaccaucggcagagaccugaucgacgaccugaagagcgagcugagcggcaacuucgagcaggugaucgugggcaugaugacccccaccgugcuguacgacgugcaggagcugagaagagccaugaagggcgccggcaccgacgagggcugccugaucgagauccuggccagcagaacccccgaggagaucagaagaaucagccagaccuaccagcagcaguacggcagaagccuggaggacgacaucagaagcgacaccagcuucauguuccagagagugcuggugagccugagcgccggcggcagagacgagggcaacuaccuggacgacgcccuggugagacaggacgcccaggaccuguacgaggccggcgagaagaaguggggcaccgacgaggugaaguuccugaccgugcugugcagcagaaacagaaaccaccugcugcacguguucgacgaguacaagagaaucagccagaaggacaucgagcagagcaucaagagcgagaccagcggcagcuucgaggacgcccugcuggccaucgugaagugcaugagaaacaagagcgccuacuucgccgagaagcuguacaagagcaugaagggccugggcaccgacgacaacacccugaucagagugauggugagcagagccgagaucgacaugcuggacaucagagcccacuucaagagacuguacggcaagagccuguacagcuucaucaagggcgacaccagcggcgacuacagaaaggugcugcuggugcugugcggcggcgacgacuaa

SEQ ID NO: 13639 - RNA, 963 nt, Artificial Sequence
  ANXA5__Homo_sapiens__NP_001145
auggcccaggugcugagaggcaccgugaccgacuuccccggcuucgacgagagagccgacgccgagacccugagaaaggccaugaagggccugggcaccgacgaggagagcauccugacccugcugaccagcagaagcaacgcccagagacaggagaucagcgccgccuucaagacccuguucggcagagaccugcuggacgaccugaagagcgagcugaccggcaaguucgagaagcugaucguggcccugaugaagcccagcagacuguacgacgccuacgagcugaagcacgcccugaagggcgccggcaccaacgagaaggugcugaccgagaucaucgccagcagaacccccgaggagcugagagccaucaagcagguguacgaggaggaguacggcagcagccuggaggacgacguggugggcgacaccagcggcuacuaccagagaaugcugguggugcugcugcaggccaacagagaccccgacgccggcaucgacgaggcccagguggagcaggacgcccaggcccuguuccaggccggcgagcugaaguggggcaccgacgaggagaaguucaucaccaucuucggcaccagaagcgugagccaccugagaaagguguucgacaaguacaugaccaucagcggcuuccagaucgaggagaccaucgacagagagaccagcggcaaccuggagcagcugcugcuggccguggugaagagcaucagaagcauccccgccuaccuggccgagacccuguacuacgccaugaagggcgccggcaccgacgaccacacccugaucagagugauggugagcagaagcgagaucgaccuguucaacaucagaaaggaguucagaaagaacuucgccaccagccuguacagcaugaucaagggcgacaccagcggcgacuacaagaaggcccugcugcugcugugcggcgaggacgacuaa

SEQ ID NO: 13640 - RNA, 2022 nt, Artificial Sequence
  ANXA6__Homo_sapiens__NP_001146
auggccaagcccgcccagggcgccaaguacagaggcagcauccacgacuuccccggcuucgaccccaaccaggacgccgaggcccuguacaccgccaugaagggcuucggcagcgacaaggaggccauccuggacaucaucaccagcagaagcaacagacagagacaggaggugugccagagcuacaagagccuguacggcaaggaccugaucgccgaccugaaguacgagcugaccggcaaguucgagagacugaucgugggccugaugagaccccccgccuacugcgacgccaaggagaucaaggacgccaucagcggcaucggcaccgacgagaagugccugaucgagauccuggccagcagaaccaacgagcagaugcaccagcugguggccgccuacaaggacgccuacgagagagaccuggaggccgacaucaucggcgacaccagcggccacuuccagaagaugcugguggugcugcugcagggcaccagagaggaggacgacguggugagcgaggaccuggugcagcaggacgugcaggaccuguacgaggccggcgagcugaaguggggcaccgacgaggcccaguucaucuacauccugggcaacagaagcaagcagcaccugagacugguguucgacgaguaccugaagaccaccggcaagcccaucgaggccagcaucagaggcgagcugagcggcgacuucgagaagcugaugcuggccguggugaagugcaucagaagcacccccgaguacuucgccgagagacuguucaaggccaugaagggccugggcaccagagacaacacccugaucagaaucauggugagcagaagcgagcuggacaugcuggacaucagagagaucuucagaaccaaguacgagaagagccuguacagcaugaucaagaacgacaccagcggcgaguacaagaagacccugcugaagcugagcggcggcgacgacgacgccgccggccaguucuuccccgaggccgcccagguggccuaccagaugugggagcugagcgccguggccagaguggagcugaagggcaccgugagacccgccaacgacuucaaccccgacgccgacgccaaggcccugagaaaggccaugaagggccugggcaccgacgaggacaccaucaucgacaucaucacccacagaagcaacgugcagagacagcagaucagacagaccuucaagagccacuucggcagagaccugaugaccgaccugaagagcgagaucagcggcgaccuggccagacugauccugggccugaugaugccccccgcccacuacgacgccaagcagcugaagaaggccauggagggcgccggcaccgacgagaaggcccugaucgagauccuggccaccagaaccaacgccgagaucagagccaucaacgaggccuacaaggaggacuaccacaagagccuggaggacgcccugagcagcgacaccagcggccacuucagaagaauccugaucagccuggccaccggccacagagaggagggcggcgagaaccuggaccaggccagagaggacgcccagguggccgccgagauccuggagaucgccgacacccccagcggcgacaagaccagccuggagaccagauucaugaccauccugugcaccagaagcuacccccaccugagaagaguguuccaggaguucaucaagaugaccaacuacgacguggagcacaccaucaagaaggagaugagcggcgacgugagagacgccuucguggccaucgugcagagcgugaagaacaagccccuguucuucgccgacaagcuguacaagagcaugaagggcgccggcaccgacgagaagacccugaccagaaucauggugagcagaagcgagaucgaccugcugaacaucagaagagaguucaucgagaaguacgacaagagccugcaccaggccaucgagggcgacaccagcggcgacuuccugaaggcccugcuggcccugugcggcggcgaggacuaa

SEQ ID NO: 13641 - RNA, 1401 nt, Artificial Sequence
  ANXA7__Homo_sapiens__NP_001147
augagcuaccccggcuacccccccaccggcuacccccccuuccccggcuacccccccgccggccaggagagcagcuucccccccagcggccaguaccccuaccccagcggcuucccccccaugggcggcggcgccuacccccaggugcccagcagcggcuaccccggcgccggcggcuaccccgcccccggcggcuaccccgcccccggcggcuaccccggcgccccccagcccggcggcgcccccagcuaccccggcgugccccccggccagggcuucggcgugccccccggcggcgccggcuucagcggcuacccccagccccccagccagagcuacggcggcggccccgcccaggugccccugcccggcggcuuccccggcggccagaugcccagccaguaccccggcggccagcccaccuaccccagccagcccgccaccgugacccaggugacccagggcaccaucagacccgccgccaacuucgacgccaucagagacgccgagauccugagaaaggccaugaagggcuucggcaccgacgagcaggccaucguggacgugguggccaacagaagcaacgaccagagacagaagaucaaggccgccuucaagaccagcuacggcaaggaccugaucaaggaccugaagagcgagcugagcggcaacauggaggagcugauccuggcccuguucaugccccccaccuacuacgacgccuggagccugagaaaggccaugcagggcgccggcacccaggagagagugcugaucgagauccugugcaccagaaccaaccaggagaucagagagaucgugagaugcuaccagagcgaguucggcagagaccuggagaaggacaucagaagcgacaccagcggccacuucgagagacugcuggugagcaugugccagggcaacagagacgagaaccagagcaucaaccaccagauggcccaggaggacgcccagagacuguaccaggccggcgagggcagacugggcaccgacgagagcugcuucaacaugauccuggccaccagaagcuucccccagcugagagccaccauggaggccuacagcagaauggccaacagagaccugcugagcagcgugagcagagaguucagcggcuacguggagagcggccugaagaccauccugcagugcgcccugaacagacccgccuucuucgccgagagacuguacuacgccaugaagggcgccggcaccgacgacagcacccuggugagaaucguggugaccagaagcgagaucgaccuggugcagaucaagcagauguucgcccagauguaccagaagacccugggcaccaugaucgccggcgacaccagcggcgacuacagaagacugcugcuggccaucgugggccaguaa

SEQ ID NO: 13642 - RNA, 984 nt, Artificial Sequence
  ANXA8__Homo_sapiens__NP_001035173
auggccugguggaagagcuggaucgagcaggagggcgugaccgugaagagcagcagccacuucaaccccgaccccgacgccgagacccuguacaaggccaugaagggcaucggcaccaacgagcaggccaucaucgacgugcugaccaagagaagcaacacccagagacagcagaucgccaagagcuucaaggcccaguucggcaaggaccugaccgagacccugaagagcgagcugagcggcaaguucgagagacugaucguggcccugauguacccccccuacagauacgaggccaaggagcugcacgacgccaugaagggccugggcaccaaggagggcgugaucaucgagauccuggccagcagaaccaagaaccagcugagagagaucaugaaggccuacgaggaggacuacggcagcagccuggaggaggacauccaggccgacaccagcggcuaccuggagagaauccuggugugccugcugcagggcagcagagacgacgugagcagcuucguggaccccggccuggcccugcaggacgcccaggaccuguacgccgccggcgagaagaucagaggcaccgacgagaugaaguucaucaccauccugugcaccagaagcgccacccaccugcugagaguguucgaggaguacgagaagaucgccaacaagagcaucgaggacagcaucaagagcgagacccacggcagccuggaggaggccaugcugaccguggugaagugcacccagaaccugcacagcuacuucgccgagagacuguacuacgccaugaagggcgccggcaccagagacggcacccugaucagaaacaucgugagcagaagcgagaucgaccugaaccugaucaagugccacuucaagaagauguacggcaagacccugagcagcaugaucauggaggacaccagcggcgacuacaagaacgcccugcugagccuggugggcagcgaccccuaa

SEQ ID NO: 13643 - RNA, 984 nt, Artificial Sequence
  ANXA8L1__Homo_sapiens__NP_001092315
auggccugguggaaggccuggaucgagcaggagggcgugaccgugaagagcagcagccacuucaaccccgaccccgacgccgagacccuguacaaggccaugaagggcaucggcaccaacgagcaggccaucaucgacgugcugaccaagagaagcaacacccagagacagcagaucgccaagagcuucaaggcccaguucggcaaggaccugaccgagacccugaagagcgagcugagcggcaaguucgagagacugaucguggcccugauguacccccccuacagauacgaggccaaggagcugcacgacgccaugaagggccugggcaccaaggagggcgugaucaucgagauccuggccagcagaaccaagaaccagcugagagagaucaugaaggccuacgaggaggacuacggcagcagccuggaggaggacauccaggccgacaccagcggcuaccuggagagaauccuggugugccugcugcagggcagcagagacgacgugagcagcuucguggaccccgcccuggcccugcaggacgcccaggaccuguacgccgccggcgagaagaucagaggcaccgacgagaugaaguucaucaccauccugugcaccagaagcgccacccaccugcugagaguguucgaggaguacgagaagaucgccaacaagagcaucgaggacagcaucaagagcgagacccacggcagccuggaggaggccaugcugaccguggugaagugcacccagaaccugcacagcuacuucgccgagagacuguacuacgccaugaagggcgccggcaccagagacggcacccugaucagaaacaucgugagcagaagcgagaucgaccugaaccugaucaagugccacuucaagaagauguacggcaagacccugagcagcaugaucauggaggacaccagcggcgacuacaagaacgcccugcugagccuggugggcagcgaccccuaa

SEQ ID NO: 13644 - RNA, 2067 nt, Artificial Sequence
  AOAH__Homo_sapiens__NP_001170977
augcagagccccuggaagauccugaccguggccccccuguuccugcugcugagccugcagagcagcgccagccccgccaacgacgaccagagcagacccagccugagcaacggccacaccugcgugggcugcgugcugguggugagcgugaucgagcagcuggcccaggugcacaacagcaccgugcaggccagcauggagagacugugcagcuaccugcccgagaagcuguuccugaagaccaccugcuaccuggugaucgacaaguucggcagcgacaucaucaagcugcugagcgccgacaugaacgccgacguggugugccacacccuggaguucugcaagcagaacaccggccagccccugugccaccuguacccccugcccaaggagaccuggaaguucacccugcagaaggccagacagaucgugaagaagagccccauccugaaguacagcagaagcggcagcgacaucugcagccugcccgugcuggccaagaucugccagaagaucaagcuggccauggagcagagcgugcccuucaaggacguggacagcgacaaguacagcguguuccccacccugagaggcuaccacuggagaggcagagacugcaacgacagcgacgagagcguguaccccggcagaagacccaacaacugggacgugcaccaggacagcaacugcaacggcaucuggggcguggaccccaaggacggcgugcccuacgagaagaaguucugcgagggcagccagcccagaggcaucauccugcugggcgacagcgccggcgcccacuuccacaucagccccgaguggaucaccgccagccagaugagccugaacagcuucaucaaccugcccaccgcccugaccaacgagcuggacuggccccagcugagcggcgccaccggcuuccuggacagcaccgugggcaucaaggagaagagcaucuaccugagacuguggaagagaaaccacugcaaccacagagacuaccagaacaucagcagaaacggcgccagcagcagaaaccugaagaaguucaucgagagccugagcagaaacaaggugcuggacuaccccgccaucgugaucuacgccaugaucggcaacgacgugugcagcggcaagagcgaccccgugcccgccaugaccacccccgagaagcuguacagcaacgugaugcagacccugaagcaccugaacagccaccugcccaacggcagccacgugauccuguacggccugcccgacggcaccuuccugugggacaaccugcacaacagauaccacccccugggccagcugaacaaggacaugaccuacgcccagcuguacagcuuccugaacugccugcaggugagccccugccacggcuggaugagcagcaacaagacccugagaacccugaccagcgagagagccgagcagcugagcaacacccugaagaagaucgccgccagcgagaaguucaccaacuucaaccuguucuacauggacuucgccuuccacgagaucauccaggaguggcagaagagaggcggccagcccuggcagcugaucgagcccguggacggcuuccaccccaacgagagaaagagcauccugcugaagggcauccugaugaccagccagacccuggacaaccaggaguggacccagcugaccagcuggaucaagggcaaccugaccugcgacagcagaaccagagaguggcugugcugcugcuggagaaucaucagcggcaagagaugcagcagcagcggccccaagagcugggagagaagaaucagaagcacccccagacugaacagaugccuggagaccaaggccggcaccgagccccugagaagcaugcaccccuggggcgcccagggcggcagaggccugggcaagcugaucccccagacccuguggggccugcccagacacagacccaagggccuguucuucagcagcaucuucgccaagugccugagccugaacgaggagcacaucuggaccaccgugcagugcugcgugcugcccggcagcgugacccugccccuguuccugaaguaa

SEQ ID NO: 13645 - RNA, 2313 nt, Artificial Sequence
  AOC1__Homo_sapiens__XP_011514310
augcccgcccugggcugggccguggccgccauccugaugcugcagaccgccauggccgagcccagccccggcacccugcccagaaaggccggcguguucagcgaccugagcaaccaggagcugaaggccgugcacagcuuccuguggagcaagaaggagcugagacugcagcccagcagcaccaccaccauggccaagaacaccguguuccugaucgagaugcugcugcccaagaaguaccacgugcugagauuccuggacaagggcgagagacaccccgugagagaggccagagccgugaucuucuucggcgaccaggagcaccccaacgugaccgaguucgccgugggcccccugcccggccccugcuacaugagagcccugagccccagacccggcuaccagagcagcugggccagcagacccaucagcaccgccgaguacgcccugcuguaccacacccugcaggaggccaccaagccccugcaccaguucuuccugaacaccaccggcuucagcuuccaggacugccacgacagaugccuggccuucaccgacguggcccccagaggcguggccagcggccagagaagaagcuggcugaucauccagagauacguggagggcuacuuccugcaccccaccggccuggagcugcugguggaccacggcagcaccgacgccggccacugggccguggagcaggugugguacaacggcaaguucuacggcagccccgaggagcuggccagaaaguacgccgacggcgagguggacgugguggugcuggaggacccccugcccggcggcaagggccacgacagcaccgaggagcccccccuguucagcagccacaagcccagaggcgacuuccccagccccauccacgugagcggccccagacuggugcagccccacggccccagauucagacuggagggcaacgccgugcuguacggcggcuggagcuucgccuucagacugagaagcagcagcggccugcaggugcugaacgugcacuucggcggcgagagaaucgccuacgaggugagcgugcaggaggccguggcccuguacggcggccacacccccgccggcaugcagaccaaguaccuggacgugggcuggggccugggcagcgugacccacgagcuggcccccggcaucgacugccccgagaccgccaccuuccuggacaccuuccacuacuacgacgccgacgaccccgugcacuaccccagagcccugugccuguucgagaugcccaccggcgugccccugagaagacacuucaacagcaacuucaagggcggcuucaacuucuacgccggccugaagggccaggugcuggugcugagaaccaccagcaccguguacaacuacgacuacaucugggacuucaucuucuaccccaacggcgugauggaggccaagaugcacgccaccggcuacgugcacgccaccuucuacacccccgagggccugagacacggcaccagacugcacacccaccugaucggcaacauccacacccaccuggugcacuacagaguggaccuggacguggccggcaccaagaacagcuuccagacccugcagaugaagcuggagaacaucaccaaccccuggagccccagacacagaguggugcagcccacccuggagcagacccaguacagcugggagagacaggccgccuucagauucaagagaaagcugcccaaguaccugcuguucaccagcccccaggagaaccccuggggccacaagagaaccuacagacugcagauccacagcauggccgaccaggugcugccccccggcuggcaggaggagcaggccaucaccugggccagaaccgagggcggccagcccagagcccugagccaggccgccagccccgugcccggcagauacccccuggccgugaccaaguacagagagagcgagcugugcagcagcagcaucuaccaccagaacgaccccuggcacccccccgugguguucgagcaguuccugcacaacaacgagaacaucgagaacgaggaccugguggccugggugaccgugggcuuccugcacaucccccacagcgaggacauccccaacaccgccacccccggcaacagcgugggcuuccugcugagacccuucaacuucuuccccgaggaccccagccuggccagcagagacaccgugaucguguggcccagagacaacggccccaacuacgugcagagauggauccccgaggacagagacugcagcaugcccccccccuucagcuacaacggcaccuacagacccguguaa

SEQ ID NO: 13646 - RNA, 2190 nt, Artificial Sequence
  AOC2__Homo_sapiens__NP_001149
augcaccugaagaucgugcuggccuuccuggcccugagccugaucaccaucuucgcccuggccuacgugcugcugaccagccccggcggcagcagccagcccccccacugccccagcgugagccacagagcccagcccuggccccaccccggccagagccagcuguucgccgaccugagcagagaggagcugaccgccgugaugagauuccugacccagagacugggccccggccugguggacgccgcccaggcccagcccagcgacaacugcaucuucagcguggagcugcagcugccccccaaggccgccgcccuggcccaccuggacagaggcagccccccccccgccagagaggcccuggccaucgugcuguucggcggccagccccagcccaacgugagcgagcugguggugggcccccugccccaccccagcuacaugagagacgugaccguggagagacacggcggcccccugcccuaccacagaagacccgugcugagagccgaguucacccagauguggagacaccugaaggagguggagcugcccaaggcccccaucuuccugagcagcaccuucaacuacaacggcagcacccuggccgccgugcacgccacccccagaggccugagaagcggcgacagagccaccuggauggcccuguaccacaacaucagcggcgugggccuguuccugcaccccgugggccuggagcugcugcuggaccacagagcccuggaccccgcccacuggaccgugcagcagguguucuaccugggccacuacuacgccgaccugggccagcuggagagagaguucaagagcggcagacuggagguggugagagugccccugcccccccccaacggcgccagcagccugagaagcagaaacagccccggcccccugcccccccugcaguucagcccccagggcagccaguacagcgugcagggcaaccugguggugagcagccuguggagcuucaccuucggccacggcguguucagcggccugagaaucuucgacgugagauuccagggcgagagaaucgccuacgaggugagcgugcaggagugcgugagcaucuacggcgccgacagccccaagaccaugcugaccagauaccuggacagcagcuucggccugggcagaaacagcagaggccuggugagaggcguggacugccccuaccaggccaccaugguggacauccacauccuggugggcaagggcgccgugcagcugcugcccggcgccgugugcguguucgaggaggcccagggccugccccugagaagacaccacaacuaccugcagaaccacuucuacggcggccuggccagcagcgcccugguggugagaagcgugagcagcgugggcaacuacgacuacaucugggacuucgugcuguaccccaacggcgcccuggagggcagagugcacgccaccggcuacaucaacaccgccuuccugaagggcggcgaggagggccugcuguucggcaacagagugggcgagagagugcugggcaccgugcacacccacgccuuccacuucaagcuggaccuggacguggccggccugaagaacugggugguggccgaggacgugguguucaagcccguggccgcccccuggaaccccgagcacuggcugcagagaccccagcugaccagacaggugcugggcaaggaggaccugaccgccuucagccugggcagcccccugcccagauaccuguaccuggccagcaaccagaccaacgccuggggccaccagagaggcuaccagcugguggugacccagagaaaggaggaggagagccagagcagcagcaucuaccaccagaacgacaucuggacccccaccgugaccuucgccgacuucaucaacaacgagacccugcugggcgaggaccugguggccugggugaccgccagcuuccugcacaucccccacgccgaggacauccccaacaccgugacccugggcaacagagugggcuuccugcugagacccuacaacuucuucgacgaggaccccagcaucuucagccccggcagcguguacuucgagaagggccaggacgccggccugugcagcaucaaccccguggccugccugcccgaccuggccgccugcgugcccgaccugccccccuucagcuaccacggcuucuaa

SEQ ID NO: 13647 - RNA, 2292 nt, Artificial Sequence
  AOC3__Homo_sapiens__NP_003725
augaaccagaagaccauccuggugcugcugauccuggccgugaucaccaucuucgcccuggugugcgugcugcuggugggcagaggcggcgacggcggcgagcccagccagcugccccacugccccagcgugagccccagcgcccagcccuggacccaccccggccagagccagcuguucgccgaccugagcagagaggagcugaccgccgugaugagauuccugacccagagacugggccccggccugguggacgccgcccaggccagacccagcgacaacugcguguucagcguggagcugcagcugccccccaaggccgccgcccuggcccaccuggacagaggcagccccccccccgccagagaggcccuggccaucguguucuucggcagacagccccagcccaacgugagcgagcugguggugggcccccugccccaccccagcuacaugagagacgugaccguggagagacacggcggcccccugcccuaccacagaagacccgugcuguuccaggaguaccuggacaucgaccagaugaucuucaacagagagcugccccaggccagcggccugcugcaccacugcugcuucuacaagcacagaggcagaaaccuggugaccaugaccaccgcccccagaggccugcagagcggcgacagagccaccugguucggccuguacuacaacaucagcggcgccggcuucuuccugcaccacgugggccuggagcugcuggugaaccacaaggcccuggaccccgccagauggaccauccagaagguguucuaccagggcagauacuacgacagccuggcccagcuggaggcccaguucgaggccggccuggugaacguggugcugauccccgacaacggcaccggcggcagcuggagccugaagagccccgugccccccggccccgcccccccccugcaguucuacccccagggccccagauucagcgugcagggcagcagaguggccagcagccuguggaccuucagcuucggccugggcgccuucagcggccccagaaucuucgacgugagauuccagggcgagagacugguguacgagaucagccugcaggaggcccuggccaucuacggcggcaacagccccgccgccaugaccaccagauacguggacggcggcuucggcaugggcaaguacaccaccccccugaccagaggcguggacugccccuaccuggccaccuacguggacuggcacuuccugcuggagagccaggcccccaagaccaucagagacgccuucugcguguucgagcagaaccagggccugccccugagaagacaccacagcgaccuguacagccacuacuucggcggccuggccgagaccgugcugguggugagaagcaugagcacccugcugaacuacgacuacgugugggacaccguguuccaccccagcggcgccaucgagaucagauucuacgccaccggcuacaucagcagcgccuuccuguucggcgccaccggcaaguacggcaaccaggugagcgagcacacccugggcaccgugcacacccacagcgcccacuucaagguggaccuggacguggccggccuggagaacugggugugggccgaggacaugguguucgugcccauggccgugcccuggagccccgagcaccagcugcagagacugcaggugaccagaaagcugcuggagauggaggagcaggccgccuuccuggugggcagcgccacccccagauaccuguaccuggccagcaaccacagcaacaaguggggccaccccagaggcuacagaauccagaugcugagcuucgccggcgagccccugccccagaacagcagcauggccagaggcuucagcugggagagauaccagcuggccgugacccagagaaaggaggaggagcccagcagcagcagcguguucaaccagaacgaccccugggcccccaccguggacuucagcgacuucaucaacaacgagaccaucgccggcaaggaccugguggccugggugaccgccggcuuccugcacaucccccacgccgaggacauccccaacaccgugaccgugggcaacggcgugggcuucuuccugagacccuacaacuucuucgacgaggaccccagcuucuacagcgccgacagcaucuacuucagaggcgaccaggacgccggcgccugcgaggugaacccccuggccugccugccccaggccgccgccugcgcccccgaccugcccgccuucagccacggcggcuucagccacaacuaa

SEQ ID NO: 13648 - RNA, 4017 nt, Artificial Sequence
  AOX1__Homo_sapiens__NP_001150
auggacagagccagcgagcugcuguucuacgugaacggcagaaaggugaucgagaagaacguggaccccgagaccaugcugcugcccuaccugagaaagaagcugagacugaccggcaccaaguacggcugcggcggcggcggcugcggcgccugcaccgugaugaucagcagauacaaccccaucaccaagagaaucagacaccaccccgccaacgccugccugauccccaucugcagccuguacggcgccgccgugaccaccguggagggcaucggcagcacccacaccagaauccaccccgugcaggagagaaucgccaagugccacggcacccagugcggcuucugcacccccggcauggugaugagcaucuacacccugcugagaaaccaccccgagcccacccuggaccagcugaccgacgcccugggcggcaaccugugcagaugcaccggcuacagacccaucaucgacgccugcaagaccuucugcaagaccagcggcugcugccagagcaaggagaacggcgugugcugccuggaccagggcaucaacggccugcccgaguucgaggagggcagcaagaccagccccaagcuguucgccgaggaggaguuccugccccuggaccccacccaggagcugaucuucccccccgagcugaugaucauggccgagaagcagagccagagaaccagaguguucggcagcgagagaaugaugugguucagccccgugacccugaaggagcugcuggaguucaaguucaaguacccccaggcccccgugaucaugggcaacaccagcgugggccccgaggugaaguucaagggcguguuccaccccgugaucaucagccccgacagaaucgaggagcugagcguggugaaccacgccuacaacggccugacccugggcgccggccugagccuggcccaggugaaggacauccuggccgacguggugcagaagcugcccgaggagaagacccagauguaccacgcccugcugaagcaccugggcacccuggccggcagccagaucagaaacauggccagccugggcggccacaucaucagcagacaccccgacagcgaccugaaccccauccuggccgugggcaacugcacccugaaccugcugagcaaggagggcaagagacagaucccccugaacgagcaguuccugagcaagugccccaacgccgaccugaagccccaggagauccuggugagcgugaacauccccuacagcagaaagugggaguucgugagcgccuucagacaggcccagagacaggagaacgcccuggccaucgugaacagcggcaugagaguguucuucggcgagggcgacggcaucaucagagagcugugcaucagcuacggcggcgugggccccgccaccaucugcgccaagaacagcugccagaagcugaucggcagacacuggaacgagcagaugcuggacaucgccugcagacugauccugaacgaggugagccugcugggcagcgcccccggcggcaagguggaguucaagagaacccugaucaucagcuuccuguucaaguucuaccuggaggugagccagauccugaagaagauggaccccgugcacuaccccagccuggccgacaaguacgagagcgcccuggaggaccugcacagcaagcaccacugcagcacccugaaguaccagaacaucggccccaagcagcaccccgaggaccccaucggccaccccaucaugcaccugagcggcgugaagcacgccaccggcgaggccaucuacugcgacgacaugccccugguggaccaggagcuguuccugaccuucgugaccagcagcagagcccacgccaagaucgugagcaucgaccugagcgaggcccugagcaugcccggcgugguggacaucaugaccgccgagcaccugagcgacgugaacagcuucugcuucuucaccgaggccgagaaguuccuggccaccgacaagguguucugcgugggccagcuggugugcgccgugcuggccgacagcgaggugcaggccaagagagccgccaagagagugaagaucguguaccaggaccuggagccccugauccugaccaucgaggagagcauccagcacaacagcagcuucaagcccgagagaaagcuggaguacggcaacguggacgaggccuucaaggugguggaccagauccuggagggcgagauccacaugggcggccaggagcacuucuacauggagacccagagcaugcugguggugcccaagggcgaggaccaggagauggacguguacgugagcacccaguuccccaaguacauccaggacaucguggccagcacccugaagcugcccgccaacaaggugaugugccacgugagaagagugggcggcgccuucggcggcaaggugcugaagaccggcaucaucgccgccgugaccgccuucgccgccaacaagcacggcagagccgugagaugcgugcuggagagaggcgaggacaugcugaucaccggcggcagacaccccuaccugggcaaguacaaggccggcuucaugaacgacggcagaauccuggcccuggacauggagcacuacagcaacgccggcgccagccuggacgagagccuguucgugaucgagaugggccugcugaagauggacaacgccuacaaguuccccaaccugagaugcagaggcugggccugcagaaccaaccugcccagcaacaccgccuucagaggcuucggcuucccccaggccgcccugaucaccgagagcugcaucaccgagguggccgccaagugcggccugagccccgagaaggugagaaucaucaacauguacaaggagaucgaccagacccccuacaagcaggagaucaacgccaagaaccugauccagugcuggagagagugcauggccaugagcagcuacagccugagaaagguggccguggagaaguucaacgccgagaacuacuggaagaagaagggccuggccauggugccccugaaguuccccgugggccugggcagcagagccgccggccaggccgccgcccuggugcacaucuaccuggacggcagcgugcuggugacccacggcggcaucgagaugggccagggcgugcacaccaagaugauccagguggugagcagagagcugagaaugcccaugagcaacgugcaccugagaggcaccagcaccgagaccgugcccaacgccaacaucagcggcggcagcgugguggccgaccugaacggccuggccgugaaggacgccugccagacccugcugaagagacuggagcccaucaucagcaagaaccccaagggcaccuggaaggacugggcccagaccgccuucgacgagagcaucaaccugagcgccgugggcuacuucagaggcuacgagagcgacaugaacugggagaagggcgagggccagcccuucgaguacuucguguacggcgccgccugcagcgagguggagaucgacugccugaccggcgaccacaagaacaucagaaccgacaucgugauggacgugggcugcagcaucaaccccgccaucgacaucggccagaucgagggcgccuucauccagggcaugggccuguacaccaucgaggagcugaacuacagcccccagggcauccugcacaccagaggccccgaccaguacaagauccccgccaucugcgacaugcccaccgagcugcacaucgcccugcugccccccagccagaacagcaacacccuguacagcagcaagggccugggcgagagcggcguguuccugggcugcagcguguucuucgccauccacgacgccgugagcgccgccagacaggagagaggccugcacggcccccugacccugaacagcccccugacccccgagaagaucagaauggccugcgaggacaaguucaccaagaugauccccagagacgagcccggcagcuacgugcccuggaacgugcccaucuaa

SEQ ID NO: 13649 - RNA, 810 nt, Artificial Sequence
  AP1AR__Homo_sapiens__NP_001121898
augggcaacugcugcuggacccagugcuucggccugcugagaaaggaggccggcagacugcagagagugggcggcggcggcggcagcaaguacuucagaaccugcagcagaggcgagcaccugaccaucgaguucgagaaccugguggagagcgacgagggcgagagccccggcagcagccacagaccccugaccgaggaggagaucguggaccugagagagagacacuacgacagcaucgccgagaagcagaaggaccuggacaagaagauccagaaggagcaggagagacagagaaucgugcagcaguaccaccccagcaacaacggcgaguaccagagcagcggccccgaggacgacuucgagagcugccugagaaacaugaagagccaguacgagguguucagaagcagcagacugagcagcgacgccaccgugcugacccccaacaccgagagcagcugcgaccugaugaccaagaccaagagcaccagcggcaacgacgacagcaccagccuggaccuggagugggaggacgaggagggcaugaacagaaugcugcccaugagagagagaagcaagaccgaggaggacauccugagagccgcccugaaguacagcaacaagaagaccggcagcaaccccaccagcgccagcgacgacagcaacggccuggagugggagaacgacuucgugagcgccgagauggacgacaacggcaacagcgaguacagcggcuucgugaaccccgugcuggagcugagcgacagcggcaucagacacagcgacaccgaccagcagaccagauaa

SEQ ID NO: 13650 - RNA, 2760 nt, Artificial Sequence
  AP1B1__Homo_sapiens__NP_001159491
augaccgacagcaaguacuucaccaccaccaagaagggcgagaucuucgagcugaaggccgagcugaacagcgacaagaaggagaagaagaaggaggccgugaagaaggugaucgccagcaugaccgugggcaaggacgugagcgcccuguuccccgacguggugaacugcaugcagaccgacaaccuggagcugaagaagcugguguaccuguaccugaugaacuacgccaagagccagcccgacauggccaucauggccgugaacaccuucgugaaggacugcgaggaccccaacccccugaucagagcccuggccgugagaaccaugggcugcaucagaguggacaagaucaccgaguaccugugcgagccccugagaaagugccugaaggacgaggaccccuacgugagaaagaccgccgccgugugcguggccaagcugcacgacaucaacgcccagcugguggaggaccagggcuuccuggacacccugaaggaccugaucagcgacagcaaccccauggugguggccaacgccguggccgcccugagcgagaucgccgagagccaccccagcagcaaccugcuggaccugaacccccagagcaucaacaagcugcugaccgcccugaacgagugcaccgaguggggccagaucuucauccuggacugccuggccaacuacaugcccaaggacgacagagaggcccagagcaucugcgagagagugacccccagacugagccacgccaacagcgccguggugcugagcgccgugaaggugcugaugaaguucauggagaugcugagcaaggaccuggacuacuacggcacccugcugaagaagcuggcccccccccuggugacccugcugagcgccgagcccgagcugcaguacguggcccugagaaacaucaaccugaucgugcagaagagacccgagauccugaagcacgagaugaagguguucuucgugaaguacaacgaccccaucuacgugaagcuggagaagcuggacaucaugaucagacuggccagccaggccaacaucgcccaggugcuggccgagcugaaggaguacgccaccgagguggacguggacuucgugagaaaggccgugagagccaucggcagaugcgccaucaagguggagcagagcgccgagagaugcgugagcacccugcuggaccugauccagaccaaggugaacuacguggugcaggaggccaucguggugaucaaggacaucuucagaaaguaccccaacaaguacgagagcgugaucgccacccugugcgagaaccuggacagccuggacgagcccgaggccagagccgccaugaucuggaucgugggcgaguacgccgagagaaucgacaacgccgacgagcugcuggagagcuuccuggagggcuuccacgacgagagcacccaggugcagcugcagcugcugaccgccaucgugaagcuguuccugaagaagcccaccgagacccaggagcuggugcagcaggugcugagccuggccacccaggacagcgacaaccccgaccugagagacagaggcuacaucuacuggagacugcugagcaccgaccccguggccgccaaggagguggugcuggccgagaagccccugaucagcgaggagaccgaccugaucgagcccacccugcuggacgagcugaucugcuacaucggcacccuggccagcguguaccacaagccccccagcgccuucguggagggcggcagaggcguggugcacaagagccugccccccagaaccgccagcagcgagagcgccgagagccccgagaccgcccccaccggcgccccccccggcgagcagcccgacgugauccccgcccagggcgaccugcugggcgaccugcugaaccuggaccugggcccccccgugagcggccccccccuggccaccagcagcgugcagaugggcgccguggaccugcugggcggcggccuggacagccugaucggcggcaccaacuucguggccccccccaccgccgccgugcccgccaaccugggcgcccccaucggcagcggccugagcgaccuguucgaccugaccagcggcgugggcacccugagcggcagcuacguggcccccaaggccgugggcagcaucagcauggaccugcagcugaccaacaaggcccugcaggugaugaccgacuucgccauccaguucaacagaaacagcuucggccuggcccccgccgccccccugcaggugcacgccccccugagccccaaccagaccguggagaucagccugccccugagcaccgugggcagcgugaugaagauggagccccugaacaaccugcagguggccgugaagaacaacaucgacguguucuacuucagcacccuguacccccugcacauccuguucguggaggacggcaagauggacagacagauguuccuggccaccuggaaggacauccccaacgagaacgaggcccaguuccagaucagagacugcccccugaacgccgaggccgccagcagcaagcugcagagcagcaacaucuucaccguggccaagagaaacguggagggccaggacaugcuguaccagagccugaagcugaccaacggcaucugggugcuggccgagcugagaauccagcccggcaaccccagcugcacccugagccugaagugcagagcccccgaggugagccagcacguguaccaggccuacgagaccauccugaagaacuaa

SEQ ID NO: 13651 - RNA, 2478 nt, Artificial Sequence
  AP1G1__Homo_sapiens__NP_001025178
augcccgcccccaucagacugagagagcugaucagaaccaucagaaccgccagaacccaggccgaggagagagagaugauccagaaggagugcgccgccaucagaagcagcuucagagaggaggacaacaccuacagaugcagaaacguggccaagcugcuguacaugcacaugcugggcuaccccgcccacuucggccagcuggagugccugaagcugaucgccagccagaaguucaccgacaagagaaucggcuaccugggcgccaugcugcugcuggacgagagacaggacgugcaccugcugaugaccaacugcaucaagaacgaccugaaccacagcacccaguucgugcagggccuggcccugugcacccugggcugcaugggcagcagcgagaugugcagagaccuggccggcgagguggagaagcugcugaagaccagcaacagcuaccugagaaagaaggccgcccugugcgccgugcacgugaucagaaaggugcccgagcugauggagauguuccugcccgccaccaagaaccugcugaacgagaagaaccacggcgugcugcacaccagcguggugcugcugaccgagaugugcgagagaagccccgacaugcuggcccacuucagaaagaacgagaagcuggugccccagcuggugagaauccugaagaaccugaucaugagcggcuacagccccgagcacgacgugagcggcaucagcgaccccuuccugcaggugagaauccugagacugcugagaauccugggcagaaacgacgacgacagcagcgaggccaugaacgacauccuggcccagguggccaccaacaccgagaccagcaagaacgugggcaacgccauccuguacgagaccgugcugaccaucauggacaucaagagcgagagcggccugagagugcuggccaucaacauccugggcagauuccugcugaacaacgacaagaacaucagauacguggcccugaccagccugcugaagaccgugcagaccgaccacaacgccgugcagagacacagaagcaccaucguggacugccugaaggaccuggacgugagcaucaagagaagagccauggagcugagcuucgcccuggugaacggcaacaacaucagaggcaugaugaaggagcugcuguacuuccuggacagcugcgagcccgaguucaaggccgacugcgccagcggcaucuuccuggccgccgagaaguacgcccccagcaagagauggcacaucgacaccaucaugagagugcugaccaccgccggcagcuacgugagagacgacgccgugcccaaccugauccagcugaucaccaacagcguggagaugcacgccuacaccgugcagagacuguacaaggccauccugggcgacuacagccagcagccccuggugcagguggccgccuggugcaucggcgaguacggcgaccugcuggugagcggccagugcgaggaggaggagcccauccaggugaccgaggacgaggugcuggacauccuggagagcgugcugaucagcaacaugagcaccagcgugaccagaggcuacgcccugaccgccaucaugaagcugagcaccagauucaccugcaccgugaacagaaucaagaagguggugagcaucuacggcagcagcaucgacguggagcugcagcagagagccguggaguacaacgcccuguucaagaaguacgaccacaugagaagcgcccugcuggagagaaugcccgugauggagaaggugaccaccaacggccccaccgagaucgugcagaccaacggcgagaccgagcccgccccccuggagaccaagcccccccccagcggcccccagcccaccagccaggccaacgaccugcuggaccugcugggcggcaacgacaucacccccgugauccccaccgcccccaccagcaagcccagcagcgccggcggcgagcugcuggaccugcugggcgacaucaaccugaccggcgcccccgccgccgcccccgcccccgccagcgugccccagaucagccagccccccuuccugcuggacggccugagcagccagccccuguucaacgacaucgccgccggcauccccagcaucaccgccuacagcaagaacggccugaagaucgaguucaccuucgagagaagcaacaccaaccccagcgugaccgugaucaccauccaggccagcaacagcaccgagcuggacaugaccgacuucguguuccaggccgccgugcccaagaccuuccagcugcagcugcugagccccagcagcagcaucgugcccgccuucaacaccggcaccaucacccaggugaucaaggugcugaacccccagaagcagcagcugagaaugagaaucaagcugaccuacaaccacaagggcagcgccaugcaggaccuggccgaggugaacaacuuccccccccagagcuggcaguaa

SEQ ID NO: 13652 - RNA, 1308 nt, Artificial Sequence
  AP1M1__Homo_sapiens__NP_001123996
augagcgccagcgccguguacgugcuggaccugaagggcaaggugcugaucugcagaaacuacagaggcgacguggacaugagcgagguggagcacuucaugcccauccugauggagaaggaggaggagggcaugcugagccccauccuggcccacggcggcgugagauucauguggaucaagcacaacaaccuguaccugguggccaccagcaagaagaacgccugcgugagccugguguucagcuuccuguacaagguggugcagguguucagcgaguacuucaaggagcuggaggaggagagcaucagagacaacuucgugaucaucuacgagcugcuggacgagcugauggacuucggcuacccccagaccaccgacagcaagauccugcaggaguacaucacccaggagggccacaagcuggagaccggcgcccccagaccccccgccaccgugaccaacgccgugagcuggagaagcgagggcaucaaguacagaaagaacgagguguuccuggacgugaucgagagcgugaaccugcugggcaaguaccccggcgugggcuggcugggccacaccgugagcgccaacggcaacgugcugagaagcgagaucgugggcagcaucaagaugagaguguuccugagcggcaugcccgagcugagacugggccugaacgacaaggugcuguucgacaacaccggcagaggcaagagcaagagcguggagcuggaggacgugaaguuccaccagugcgugagacugagcagauucgagaacgacagaaccaucagcuucaucccccccgacggcgaguucgagcugaugagcuacagacugaacacccacgugaagccccugaucuggaucgagagcgugaucgagaagcacagccacagcagaaucgaguacaugaucaaggccaagagccaguucaagagaagaagcaccgccaacaacguggagauccacauccccgugcccaacgacgccgacagccccaaguucaagaccaccgugggcagcgugaagugggugcccgagaacagcgagaucguguggagcaucaagagcuuccccggcggcaaggaguaccugaugagagcccacuucggccugcccagcguggaggccgaggacaaggagggcaagccccccaucagcgugaaguucgagauccccuacuucaccaccagcggcauccaggugagauaccugaagaucaucgagaagagcggcuaccaggcccugcccugggugagauacaucacccagaacggcgacuaccagcugagaacccaguaa

SEQ ID NO: 13653 - RNA, 1272 nt, Artificial Sequence
  AP1M2__Homo_sapiens__NP_005489
augagcgccagcgccguguucauccuggacgugaagggcaagccccugaucagcagaaacuacaagggcgacguggccaugagcaagaucgagcacuucaugccccugcuggugcagagagaggaggagggcgcccuggccccccugcugagccacggccaggugcacuuccuguggaucaagcacagcaaccuguaccugguggccaccaccagcaagaacgccaacgccagccugguguacagcuuccuguacaagaccaucgagguguucugcgaguacuucaaggagcuggaggaggagagcaucagagacaacuucgugaucguguacgagcugcuggacgagcugauggacuucggcuucccccagaccaccgacagcaagauccugcaggaguacaucacccagcagagcaacaagcuggagaccggcaagagcagagugccccccaccgugaccaacgccgugagcuggagaagcgagggcaucaaguacaagaagaacgagguguucaucgacgugaucgagagcgugaaccugcuggugaacgccaacggcagcgugcugcugagcgagaucgugggcaccaucaagcugaagguguuccugagcggcaugcccgagcugagacugggccugaacgacagagugcuguucgagcugaccggcagaagcaagaacaagagcguggagcuggaggacgugaaguuccaccagugcgugagacugagcagauucgacaacgacagaaccaucagcuucaucccccccgacggcgacuucgagcugaugagcuacagacugagcacccaggugaagccccugaucuggaucgagagcgugaucgagaaguucagccacagcagaguggagaucauggugaaggccaagggccaguucaagaagcagagcguggccaacggcguggagaucagcgugcccgugcccagcgacgccgacagccccagauucaagaccagcgugggcagcgccaaguacgugcccgagagaaacguggugaucuggagcaucaagagcuuccccggcggcaaggaguaccugaugagagcccacuucggccugcccagcguggagaaggaggagguggagggcagaccccccaucggcgugaaguucgagauccccuacuucaccgugagcggcauccaggugagauacaugaagaucaucgagaagagcggcuaccaggcccugcccugggugagauacaucacccagagcggcgacuaccagcugagaaccagcuaa

SEQ ID NO: 13654 - RNA, 477 nt, Artificial Sequence
  AP1S1__Homo_sapiens__NP_001274
augaugagauucaugcugcuguucagcagacagggcaagcugagacugcagaagugguaccuggccaccagcgacaaggagagaaagaagauggugagagagcugaugcagguggugcuggccagaaagcccaagaugugcagcuuccuggaguggagagaccugaaggugguguacaagagauacgccagccuguacuucugcugcgccaucgagggccaggacaacgagcugaucacccuggagcugauccacagauacguggagcugcuggacaaguacuucggcagcgugugcgagcuggacaucaucuucaacuucgagaaggccuacuucauccuggacgaguuccugaugggcggcgacgugcaggacaccagcaagaagagcgugcugaaggccaucgagcaggccgaccugcugcaggaggaggacgagagccccagaagcgugcuggaggagaugggccuggccuaa

SEQ ID NO: 13655 - RNA, 483 nt, Artificial Sequence
  AP1S2__Homo_sapiens__NP_001259000
augcaguucaugcugcuguucagcagacagggcaagcugagacugcagaagugguacgugccccugagcgacaaggagaagaagaagaucaccagagagcuggugcagaccgugcuggccagaaagcccaagaugugcagcuuccuggaguggagagaccugaagaucguguacaagagauacgccagccuguacuucugcugcgccaucgaggaccaggacaacgagcugaucacccuggagaucauccacagauacguggagcugcuggacaaguacuucggcagcgugugcgagcuggacaucaucuucaacuucgagaaggccuacuucauccuggacgaguuccugcugggcggcgaggugcaggagaccagcaagaagaacgugcugaaggccaucgagcaggccgaccugcugcaggaggacgccaaggaggccgagacccccagaagcgugcuggaggagaucggccugaccuaa

SEQ ID NO: 13656 - RNA, 465 nt, Artificial Sequence
  AP1S3__Homo_sapiens__NP_001034658
augauccacuucauccugcuguucagcagacagggcaagcugagacugcagaagugguacaucacccugcccgacaaggagagaaagaagaucaccagagagaucgugcagaucauccugagcagaggccacagaaccagcagcuucguggacuggaaggagcugaagcugguguacaagagauacgccagccuguacuucugcugcgccaucgagaaccaggacaacgagcugcugacccuggagaucgugcacagauacguggagcugcuggacaaguacuucggcaacgugugcgagcuggacaucaucuucaacuucgagaaggccuacuucauccuggacgaguucaucaucggcggcgagauccaggagaccagcaagaagaucgccgugaaggccaucgaggacagcgacaugcugcaggagaccauggaggaguacaugaacaagcccaccuucuaa

SEQ ID NO: 13657 - RNA, 2934 nt, Artificial Sequence
  AP2A1__Homo_sapiens__NP_055018
augcccgccgugagcaagggcgacggcaugagaggccuggccguguucaucagcgacaucagaaacugcaagagcaaggaggccgagaucaagagaaucaacaaggagcuggccaacaucagaagcaaguucaagggcgacaaggcccuggacggcuacagcaagaagaaguacgugugcaagcugcuguucaucuuccugcugggccacgacaucgacuucggccacauggaggccgugaaccugcugagcagcaacaaguacaccgagaagcagaucggcuaccuguucaucagcgugcuggugaacagcaacagcgagcugaucagacugaucaacaacgccaucaagaacgaccuggccagcagaaaccccaccuucaugugccuggcccugcacugcaucgccaacgugggcagcagagagaugggcgaggccuucgccgccgacauccccagaauccugguggccggcgacagcauggacagcgugaagcagagcgccgcccugugccugcugagacuguacaaggccagccccgaccuggugcccaugggcgaguggaccgccagaguggugcaccugcugaacgaccagcacaugggcguggugaccgccgccgugagccugaucaccugccugugcaagaagaaccccgacgacuucaagaccugcgugagccuggccgugagcagacugagcagaaucgugagcagcgccagcaccgaccugcaggacuacaccuacuacuucgugcccgcccccuggcugagcgugaagcugcugagacugcugcagugcuaccccccccccgaggacgccgccgugaagggcagacugguggagugccuggagaccgugcugaacaaggcccaggagccccccaagagcaagaaggugcagcacagcaacgccaagaacgccauccuguucgagaccaucagccugaucauccacuacgacagcgagcccaaccugcuggugagagccugcaaccagcugggccaguuccugcagcacagagagaccaaccugagauaccuggcccuggagagcaugugcacccuggccagcagcgaguucagccacgaggccgugaagacccacaucgacaccgugaucaacgcccugaagaccgagagagacgugagcgugagacagagagccgccgaccugcuguacgccaugugcgacagaagcaacgccaagcagaucgugagcgagaugcugagauaccuggagaccgccgacuacgccaucagagaggagaucgugcugaagguggccauccuggccgagaaguacgccguggacuacagcugguacguggacaccauccugaaccugaucagaaucgccggcgacuacgugagcgaggaggugugguacagagugcugcagaucgugaccaacagagacgacgugcagggcuacgccgccaagaccguguucgaggcccugcaggcccccgccugccacgagaacauggugaaggugggcggcuacauccugggcgaguucggcaaccugaucgccggcgaccccagaagcagcccccccgugcaguucagccugcugcacagcaaguuccaccugugcagcguggccaccagagcccugcugcugagcaccuacaucaaguucaucaaccuguuccccgagaccaaggccaccauccagggcgugcugagagccggcagccagcugagaaacgccgacguggagcugcagcagagagccguggaguaccugacccugagcagcguggccagcaccgacgugcuggccaccgugcuggaggagaugccccccuuccccgagagagagagcagcauccuggccaagcugaagagaaagaagggccccggcgccggcagcgcccuggacgacggcagaagagaccccagcagcaacgacaucaacggcggcauggagcccacccccagcaccgugagcacccccagccccagcgccgaccugcugggccugagagccgcccccccccccgccgccccccccgccagcgccggcgccggcaaccugcugguggacguguucgacggccccgccgcccagcccagccugggccccacccccgaggaggccuuccugagcgagcuggagccccccgcccccgagagccccauggcccugcuggccgaccccgcccccgccgccgaccccggccccgaggacaucggcccccccauccccgaggccgacgagcugcugaacaaguucgugugcaagaacaacggcgugcuguucgagaaccagcugcugcagaucggcgugaagagcgaguucagacagaaccugggcagaauguaccuguucuacggcaacaagaccagcgugcaguuccagaacuucagccccaccguggugcaccccggcgaccugcagacccagcuggccgugcagaccaagagaguggccgcccagguggacggcggcgcccaggugcagcaggugcugaacaucgagugccugagagacuuccugacccccccccugcugagcgugagauucagauacggcggcgccccccaggcccugacccugaagcugcccgugaccaucaacaaguucuuccagcccaccgagauggccgcccaggacuucuuccagagauggaagcagcugagccugccccagcaggaggcccagaagaucuucaaggccaaccaccccauggacgccgaggugaccaaggccaagcugcugggcuucggcagcgcccugcuggacaacguggaccccaaccccgagaacuucgugggcgccggcaucauccagaccaaggcccugcaggugggcugccugcugagacuggagcccaacgcccaggcccagauguacagacugacccugagaaccagcaaggagcccgugagcagacaccugugcgagcugcuggcccagcaguucuaa

SEQ ID NO: 13658 - RNA, 2856 nt, Artificial Sequence
  AP2B1__Homo_sapiens__NP_001025177
augaccgacagcaaguacuucaccaccaacaagaagggcgagaucuucgagcugaaggccgagcugaacaacgagaagaaggagaagagaaaggaggccgugaagaaggugaucgccgccaugaccgugggcaaggacgugagcagccuguuccccgacguggugaacugcaugcagaccgacaaccuggagcugaagaagcugguguaccuguaccugaugaacuacgccaagagccagcccgacauggccaucauggccgugaacagcuucgugaaggacugcgaggaccccaacccccugaucagagcccuggccgugagaaccaugggcugcaucagaguggacaagaucaccgaguaccugugcgagccccugagaaagugccugaaggacgaggaccccuacgugagaaagaccgccgccgugugcguggccaagcugcacgacaucaacgcccagaugguggaggaccagggcuuccuggacagccugagagaccugaucgccgacagcaaccccauggugguggccaacgccguggccgcccugagcgagaucagcgagagccaccccaacagcaaccugcuggaccugaacccccagaacaucaacaagcugcugaccgcccugaacgagugcaccgaguggggccagaucuucauccuggacugccugagcaacuacaaccccaaggacgacagagaggcccagagcaucugcgagagagugacccccagacugagccacgccaacagcgccguggugcugagcgccgugaaggugcugaugaaguuccuggagcugcugcccaaggacagcgacuacuacaacaugcugcugaagaagcuggcccccccccuggugacccugcugagcggcgagcccgaggugcaguacguggcccugagaaacaucaaccugaucgugcagaagagacccgagauccugaagcaggagaucaagguguucuucgugaaguacaacgaccccaucuacgugaagcuggagaagcuggacaucaugaucagacuggccagccaggccaacaucgcccaggugcuggccgagcugaaggaguacgccaccgagguggacguggacuucgugagaaaggccgugagagccaucggcagaugcgccaucaagguggagcagagcgccgagagaugcgugagcacccugcuggaccugauccagaccaaggugaacuacguggugcaggaggccaucguggugaucagagacaucuucagaaaguaccccaacaaguacgagagcaucaucgccacccugugcgagaaccuggacagccuggacgagcccgacgccagagccgccaugaucuggaucgugggcgaguacgccgagagaaucgacaacgccgacgagcugcuggagagcuuccuggagggcuuccacgacgagagcacccaggugcagcugacccugcugaccgccaucgugaagcuguuccugaagaagcccagcgagacccaggagcuggugcagcaggugcugagccuggccacccaggacagcgacaaccccgaccugagagacagaggcuacaucuacuggagacugcugagcaccgaccccgugaccgccaaggagguggugcugagcgagaagccccugaucagcgaggagaccgaccugaucgagcccacccugcuggacgagcugaucugccacaucggcagccuggccagcguguaccacaagccccccaacgccuucguggagggcagccacggcauccacagaaagcaccugcccauccaccacggcagcaccgacgccggcgacagccccgugggcaccaccaccgccaccaaccuggagcagccccaggugauccccagccagggcgaccugcugggcgaccugcugaaccuggaccugggcccccccgugaacgugccccaggugagcagcaugcagaugggcgccguggaccugcugggcggcggccuggacagccugcugggcagcgaccugggcggcggcaucggcggcagccccgccgugggccagagcuucauccccagcagcgugcccgccaccuucgcccccagccccacccccgccguggugagcagcggccugaacgaccuguucgagcugagcaccggcaucggcauggcccccggcggcuacguggcccccaaggccguguggcugcccgccgugaaggccaagggccuggagaucagcggcaccuucacccacagacagggccacaucuacauggagaugaacuucaccaacaaggcccugcagcacaugaccgacuucgccauccaguucaacaagaacagcuucggcgugauccccagcaccccccuggccauccacaccccccugaugcccaaccagagcaucgacgugagccugccccugaacacccugggccccgugaugaagauggagccccugaacaaccugcagguggccgugaagaacaacaucgacguguucuacuucagcugccugaucccccugaacgugcuguucguggaggacggcaagauggagagacagguguuccuggccaccuggaaggacauccccaacgagaacgagcugcaguuccagaucaaggagugccaccugaacgccgacaccgugagcagcaagcugcagaacaacaacguguacaccaucgccaagagaaacguggagggccaggacaugcuguaccagagccugaagcugaccaacggcaucuggauccuggccgagcugagaauccagcccggcaaccccaacuacacccugagccugaagugcagagcccccgaggugagccaguacaucuaccagguguacgacagcauccugaagaacuaa

SEQ ID NO: 13659 - RNA, 1302 nt, Artificial Sequence
  AP2M1__Homo_sapiens__NP_001020376
augaucggcggccuguucaucuacaaccacaagggcgaggugcugaucagcagaguguacagagacgacaucggcagaaacgccguggacgccuucagagugaacgugauccacgccagacagcaggugagaagccccgugaccaacaucgccagaaccagcuucuuccacgugaagagaagcaacaucuggcuggccgccgugaccaagcagaacgugaacgccgccaugguguucgaguuccuguacaagaugugcgacgugauggccgccuacuucggcaagaucagcgaggagaacaucaagaacaacuucgugcugaucuacgagcugcuggacgagauccuggacuucggcuacccccagaacagcgagaccggcgcccugaagaccuucaucacccagcagggcaucaagagccagaccaaggaggagcagagccagaucaccagccaggugaccggccagaucggcuggagaagagagggcaucaaguacagaagaaacgagcuguuccuggacgugcuggagagcgugaaccugcugaugagcccccagggccaggugcugagcgcccacgugagcggcagaguggugaugaagagcuaccugagcggcaugcccgagugcaaguucggcaugaacgacaagaucgugaucgagaagcagggcaagggcaccgccgacgagaccagcaagagcggcaagcagagcaucgccaucgacgacugcaccuuccaccagugcgugagacugagcaaguucgacagcgagagaagcaucagcuucaucccccccgacggcgaguucgagcugaugagauacagaaccaccaaggacaucauccugcccuucagagugaucccccuggugagagaggugggcagaaccaagcuggaggugaagguggugaucaagagcaacuucaagcccagccugcuggcccagaagaucgaggugagaauccccaccccccugaacaccagcggcgugcaggugaucugcaugaagggcaaggccaaguacaaggccagcgagaacgccaucguguggaagaucaagagaauggccggcaugaaggagagccagaucagcgccgagaucgagcugcugcccaccaacgacaagaagaagugggccagaccccccaucagcaugaacuucgaggugcccuucgcccccagcggccugaaggugagauaccugaagguguucgagcccaagcugaacuacagcgaccacgacgugaucaagugggugagauacaucggcagaagcggcaucuacgagaccagaugcuaa

SEQ ID NO: 13660 - RNA, 429 nt, Artificial Sequence
  AP2S1__Homo_sapiens__NP_004060
augaucagauucauccugauccagaacagagccggcaagaccagacuggccaagugguacaugcaguucgacgacgacgagaagcagaagcugaucgaggaggugcacgccguggugaccgugagagacgccaagcacaccaacuucguggaguucagaaacuucaagaucaucuacagaagauacgccggccuguacuucugcaucugcguggacgugaacgacaacaaccuggccuaccuggaggccauccacaacuucguggaggugcugaacgaguacuuccacaacgugugcgagcuggaccugguguucaacuucuacaagguguacaccgugguggacgagauguuccuggccggcgagaucagagagaccagccagaccaaggugcugaagcagcugcugaugcugcagagccuggaguaa

SEQ ID NO: 13661 - RNA, 3138 nt, Artificial Sequence
  AP3B1__Homo_sapiens__NP_001258698
augcuggagagcaacaaggacagcgccaagcuggacgccaugaagagaaucgugggcaugaucgccaagggcaagaacgccagcgagcuguuccccgccguggugaagaacguggccagcaagaacaucgagaucaagaagcugguguacguguaccuggugagauacgccgaggagcagcaggaccuggcccugcugagcaucagcaccuuccagagagcccugaaggaccccaaccagcugaucagagccagcgcccugagagugcugagcagcaucagagugcccaucaucgugcccaucaugaugcuggccaucaaggaggccagcgccgaccugagccccuacgugagaaagaacgccgcccacgccauccagaagcuguacagccuggaccccgagcagaaggagaugcugaucgaggugaucgagaagcugcugaaggacaagagcacccugguggccggcagcguggugauggccuucgaggaggugugccccgacagaaucgaccugauccacaagaacuacagaaagcugugcaaccugcugguggacguggaggaguggggccagguggugaucauccacaugcugaccagauacgccagaacccaguucgugagccccuggaaggagggcgacgagcuggaggacaacggcaagaacuucuacgagagcgacgacgaccagaaggagaagaccgacaagaagaagaagcccuacaccauggaccccgaccacagacugcugaucagaaacaccaagccccugcugcagagcagaaacgccgccguggugauggccguggcccagcuguacuggcacaucagccccaagagcgaggccggcaucaucagcaagagccuggugagacugcugagaagcaacagagaggugcaguacaucgugcugcagaacaucgccaccaugagcauccagagaaagggcauguucgagcccuaccugaagagcuucuacgugagaagcaccgaccccaccaugaucaagacccugaagcuggagauccugaccaaccuggccaacgaggccaacaucagcacccugcugagagaguuccagaccuacgugaagagccaggacaagcaguucgccgccgccaccauccagaccaucggcagaugcgccaccaacauccuggaggugaccgacaccugccugaacggccuggugugccugcugagcaacagagacgagaucgugguggccgagagcgugguggugaucaagaagcugcugcagaugcagcccgcccagcacggcgagaucaucaagcacauggccaagcugcuggacagcaucaccgugcccguggccagagccagcauccuguggcugaucggcgagaacugcgagagagugcccaagaucgcccccgacgugcugagaaagauggccaagagcuucaccagcgaggacgaccuggugaagcugcagauccugaaccugggcgccaagcuguaccugaccaacagcaagcagaccaagcugcugacccaguacauccugaaccugggcaaguacgaccagaacuacgacaucagagacagaaccagauucaucagacagcugaucgugcccaacgugaagagcggcgcccugagcaaguacgccaagaagaucuuccuggcccagaagcccgccccccugcuggagagccccuucaaggacagagaccacuuccagcugggcacccugagccacacccugaacaucaaggccaccggcuaccuggagcugagcaacuggcccgagguggcccccgaccccagcgugagaaacguggaggugaucgagcuggccaaggaguggacccccgccggcaaggccaagcaggagaacagcgccaagaaguucuacagcgagagcgaggaggaggaggacagcagcgacagcagcagcgacagcgagagcgagagcggcagcgagagcggcgagcagggcgagagcggcgaggagggcgacagcaacgaggacagcagcgaggacagcagcagcgagcaggacagcgagagcggcagagagagcggccuggagaacaagagaaccgccaagagaaacagcaaggccaagggcaagagcgacagcgaggacggcgagaaggagaacgagaagagcaagaccagcgacagcagcaacgacgagagcagcagcaucgaggacagcagcagcgacagcgagagcgagagcgagcccgagagcgagagcgagagcagaagagugaccaaggagaaggagaagaagaccaagcaggacagaaccccccugaccaaggacgugagccugcuggaccuggacgacuucaaccccgugagcacccccguggcccugcccacccccgcccugagccccagccugauggccgaccuggagggccugcaccugagcaccagcagcagcgugaucagcgugagcacccccgccuucgugcccaccaagacccacgugcugcugcacagaaugagcggcaagggccuggccgcccacuacuucuuccccagacagcccugcaucuucggcgacaagauggugagcauccagaucacccugaacaacaccaccgacagaaagaucgagaacauccacaucggcgagaagaagcugcccaucggcaugaagaugcacguguucaaccccaucgacagccuggagcccgagggcagcaucaccgugagcaugggcaucgacuucugcgacagcacccagaccgccagcuuccagcugugcaccaaggacgacugcuucaacgugaacauccagccccccgugggcgagcugcugcugcccguggccaugagcgagaaggacuucaagaaggagcagggcgugcugaccggcaugaacgagaccagcgccgugaucaucgccgccccccagaacuucacccccagcgugaucuuccagaagguggugaacguggccaacgugggcgccgugcccagcggccaggacaacauccacagauucgccgccaagaccgugcacagcggcagccugaugcuggugaccguggagcugaaggagggcagcaccgcccagcugaucaucaacaccgagaagaccgugaucggcagcgugcugcugagagagcugaagcccgugcugagccagggcuaa

SEQ ID NO: 13662 - RNA, 3648 nt, Artificial Sequence
  AP3D1__Homo_sapiens__NP_001248755
auggcccugaagauggugaagggcagcaucgacagaauguucgacaagaaccugcaggaccuggugagaggcaucagaaaccacaaggaggacgaggccaaguacaucagccagugcaucgacgagaucaagcaggagcugaagcaggacaacaucgccgugaaggccaacgccgugugcaagcugaccuaccugcagaugcugggcuacgacaucagcugggccgccuucaacaucaucgaggugaugagcgccagcaaguucaccuucaagagaaucggcuaccuggccgccagccagagcuuccacgagggcaccgacgugaucaugcugaccaccaaccagaucagaaaggaccugagcagccccagccaguacgacaccggcguggcccugaccggccugagcugcuucgugacccccgaccuggccagagaccuggccaacgacaucaugacccugaugagccacaccaagcccuacaucagaaagaaggccgugcugaucauguacaagguguuccugaaguaccccgagagccugagacccgccuuccccagacugaaggagaagcuggaggaccccgaccccggcgugcagagcgccgccgugaacgugaucugcgagcuggccagaagaaaccccaagaacuaccugagccuggccccccuguucuucaagcugaugaccagcagcaccaacaacugggugcugaucaagaucaucaagcuguucggcgcccugaccccccuggagcccagacugggcaagaagcugaucgagccccugaccaaccugauccacagcaccagcgccaugagccugcuguacgagugcgugaacaccgugaucgccgugcugaucagccugagcagcggcaugcccaaccacagcgccagcauccagcugugcgugcagaagcugagaauccugaucgaggacagcgaccagaaccugaaguaccugggccugcuggccaugagcaagauccugaagacccaccccaagagcgugcagagccacaaggaccugauccugcagugccuggacgacaaggacgagagcaucagacugagagcccuggaccugcuguacggcauggugagcaagaagaaccugauggagaucgugaagaagcugaugacccacguggacaaggccgagggcaccaccuacagagacgagcugcugaccaagaucaucgacaucugcagccagagcaacuaccaguacaucaccaacuucgagugguacaucagcauccugguggagcugaccagacuggagggcaccagacacggccaccugaucgccgcccagaugcuggacguggccaucagagugaaggccaucagaaaguucgccgugagccagaugagcgcccugcuggacagcgcccaccugcuggccagcagcacccagagaaacggcaucugcgaggugcuguacgccgccgccuggaucugcggcgaguucagcgagcaccugcaggagccccaccacacccuggaggccaugcugagacccagagugaccacccugcccggccacauccaggccguguacgugcagaacguggugaagcuguacgccagcauccugcagcagaaggagcaggccggcgaggccgagggcgcccaggccgugacccagcugaugguggacagacugccccaguucgugcagagcgccgaccuggaggugcaggagagagccagcugcauccugcagcuggugaagcacauccagaagcugcaggccaaggacgugcccguggccgaggaggugagcgcccuguucgccggcgagcugaaccccguggcccccaaggcccagaagaaggugcccgugcccgagggccuggaccuggacgccuggaucaacgagccccugagcgacagcgagagcgaggacgagagacccagagccguguuccacgaggaggagcagagaagacccaagcacagacccagcgaggccgacgaggaggagcuggccagaagaagagaggccagaaagcaggagcaggccaacaaccccuucuacaucaagagcagccccagcccccagaagagauaccaggacacccccggcguggagcacauccccguggugcagaucgaccugagcgugccccugaaggugcccggccugcccaugagcgaccaguacgugaagcuggaggaggagagaagacacagacagaagcuggagaaggacaagagaagaaagaagagaaaggagaaggagaagaagggcaagagaagacacagcagccugcccaccgagagcgacgaggacaucgcccccgcccagcagguggacaucgugaccgaggagaugcccgagaacgcccugcccagcgacgaggacgacaaggaccccaacgaccccuacagagcccuggacaucgaccuggacaagccccuggccgacagcgagaagcugcccauccagaagcacagaaacaccgagaccagcaagagccccgagaaggacgugcccaugguggagaagaagagcaagaagcccaagaagaaggagaagaagcacaaggagaaggagagagacaaggagaagaagaaggagaaggagaagaaggccgaggaccuggacuucuggcugagcaccacccccccccccgcccccgcccccgcccccgcccccgugcccagcaccggcgagcugagcgugaacaccgugaccacccccaaggacgagugcgaggacgccaagaccgaggcccagggcgaggaggacgacgccgagggccaggaccaggacaagaagagccccaagcccaagaagaagaagcacagaaaggagaaggaggagagaaccaagggcaagaagaagagcaagaagcagccccccggcagcgaggaggccgccggcgagcccgugcagaacggcgcccccgaggaggagcagcugccccccgagagcagcuacagccugcuggccgagaacagcuacgugaagaugaccugcgacaucagaggcagccugcaggaggacagccaggugaccguggccaucgugcuggagaacagaagcagcagcauccugaagggcauggagcugagcgugcuggacagccugaacgccagaauggccagaccccagggcagcagcgugcacgacggcgugcccgugcccuuccagcugccccccggcgugagcaacgaggcccaguacguguucaccauccagagcaucgugauggcccagaagcugaagggcacccugagcuucaucgccaagaacgacgagggcgccacccacgagaagcuggacuucagacugcacuucagcugcagcagcuaccugaucaccacccccugcuacagcgacgccuucgccaagcugcuggagagcggcgaccugagcaugagcagcaucaagguggacggcaucagaaugagcuuccagaaccugcuggccaagaucugcuuccaccaccacuucagcgugguggagagaguggacagcugcgccagcauguacagcagaagcauccagggccaccacgugugccugcuggugaagaagggcgagaacagcgugagcguggacggcaagugcagcgacagcacccugcugagcaaccugcuggaggagaugaaggccacccuggccaagugcuaa

SEQ ID NO: 13663 - RNA, 1257 nt, Artificial Sequence
  AP3M2__Homo_sapiens__NP_006794
augauccacagccuguuccugaucaacagcagcggcgacaucuuccuggagaagcacuggaagagcguggugagcagaagcgugugcgacuacuucuucgaggcccaggagagagccaccgaggccgagaacgugccccccgugauccccaccccccaccacuaccugcugagcguguacagacacaagaucuucuucguggccgugauccagaccgaggugcccccccuguucgugaucgaguuccugcacagagugguggacaccuuccaggacuacuucggcgugugcagcgagcccgugaucaaggacaacgugguggugguguacgaggugcuggaggagaugcuggacaacggcuucccccuggccaccgagagcaacauccugaaggagcugaucaagccccccaccauccugagaaccguggugaacaccaucaccggcagcaccaacgugggcgaccagcugcccaccggccagcugagcguggugcccuggagaagaaccggcgugaaguacaccaacaacgaggccuacuucgacgugaucgaggagaucgacgccaucaucgacaagagcggcagcaccaucaccgccgagauccagggcgugaucgacgccugcgugaagcugaccggcaugcccgaccugacccugagcuucaugaaccccagacugcuggacgacgugagcuuccaccccugcgugagauucaagagaugggagagcgagagaauccugagcuucaucccccccgacggcaacuucagacugcugagcuaccacgugagcgcccagaaccugguggccauccccguguacgugaagcacaacaucagcuucagagacagcagcagccugggcagauucgagaucaccgugggccccaagcagaccaugggcaagaccaucgagggcgugaccgugaccagccagaugcccaagggcgugcugaacaugagccugacccccagccagggcacccacaccuucgaccccgugaccaagaugcugagcugggacgugggcaagaucaacccccagaagcugcccagccugaagggcaccaugagccugcaggccggcgccagcaagcccgacgagaaccccaccaucaaccugcaguucaagauccagcagcuggccaucagcggccugaaggugaacagacuggacauguacggcgagaaguacaagcccuucaagggcaucaaguacaugaccaaggccggcaaguuccaggugagaaccuaa

SEQ ID NO: 13664 - RNA, 582 nt, Artificial Sequence
  AP3S1__Homo_sapiens__NP_001275
augaucaaggccauccugaucuucaacaaccacggcaagcccagacugagcaaguucuaccagcccuacagcgaggacacccagcagcagaucaucagagagaccuuccaccuggugagcaagagagacgagaacgugugcaacuuccuggagggcggccugcugaucggcggcagcgacaacaagcugaucuacagacacuacgccacccuguacuucguguucugcguggacagcagcgagagcgagcugggcauccuggaccugauccagguguucguggagacccuggacaagugcuucgagaacgugugcgagcuggaccugaucuuccacguggacaaggugcacaacauccuggccgagauggugaugggcggcauggugcuggagaccaacaugaacgagaucgugacccagaucgacgcccagaacaagcuggagaagagcgaggccggccuggccggcgcccccgccagagccgugagcgccgugaagaacaugaaccugcccgagauccccagaaacaucaacaucggcgacaucagcaucaaggugcccaaccugcccagcuucaaguaa

SEQ ID NO: 13665 - RNA, 582 nt, Artificial Sequence
  AP3S2__Homo_sapiens__NP_005820
augauccaggccauccugguguucaacaaccacggcaagcccagacuggugagauucuaccagagauuccccgaggagauccagcagcagaucgugagagagaccuuccaccuggugcugaagagagacgacaacaucugcaacuuccuggagggcggcagccugaucggcggcagcgacuacaagcugaucuacagacacuacgccacccuguacuucguguucugcguggacagcagcgagagcgagcugggcauccuggaccugauccagguguucguggagacccuggacaagugcuucgagaacgugugcgagcuggaccugaucuuccacauggacaaggugcacuacauccugcaggagguggugaugggcggcauggugcuggagaccaacaugaacgagaucguggcccagaucgaggcccagaacagacuggagaagagcgagggcggccugagcgccgcccccgccagagccgugagcgccgugaagaacaucaaccugcccgagauccccagaaacaucaacaucggcgaccugaacaucaaggugcccaaccugagccaguucguguaa

SEQ ID NO: 13666 - RNA, 1995 nt, Artificial Sequence
  AP4B1__Homo_sapiens__XP_011538826
augcccuaccugggcagcgaggacguggugaaggagcugaagaaggcccugugcaacccccacauccaggccgacagacugagauacagaaacgugauccagagagugaucagaaugcccggcgugcaggaguacauccagcagcccauccugaacggccugagagacaaggccagcuacgugagaagaguggccgugcugggcugcgccaagaugcacaaccugcacggcgacagcgagguggacggcgcccuggugaacgagcuguacagccugcugagagaccaggaccccaucgugguggugaacugccugagaagccuggaggagauccugaagcaggagggcggcguggugaucaacaagcccaucgcccaccaccugcugaacagaaugagcaagcuggaccaguggggccaggccgaggugcugaacuuccugcugagauaccagcccagaagcgaggaggagcuguucgacauccugaaccugcuggacagcuuccugaagagcagcagccccggcguggugaugggcgccaccaagcuguuccugauccuggccaagauguucccccacgugcagaccgacgugcuggugagagugaagggcccccugcuggccgccugcagcagcgagagcagagagcugugcuucguggcccugugccacgugagacagauccugcacagccugcccggccacuucagcagccacuacaagaaguucuucugcagcuacagcgagccccacuacaucaagcugcagaagguggaggugcugugcgagcuggugaacgacgagaacgugcagcaggugcuggaggagcugagaggcuacugcaccgacgugagcgccgacuucgcccaggccgccaucuucgccaucggcggcaucgccagaaccuacaccgaccagugcgugcagauccugaccgagcugcugggccugagacaggagcacaucaccaccgugguggugcagaccuucagagaccugguguggcugugcccccagugcaccgaggccgugugccaggcccugcccggcugcgaggagaacauccaggacagcgagggcaagcaggcccugaucuggcugcugggcgugcacggcgagagaauccccaacgcccccuacgugcuggaggacuucguggagaacgugaagagcgagaccuuccccgccgugaagauggagcugcugaccgcccugcugagacuguuccugagcagacccgccgagugccaggacaugcugggcagacugcuguacuacugcaucgaggaggagaaggacauggccgugagagacagaggccuguucuacuacagacugcugcuggugggcaucgacgaggugaagagaauccugugcagccccaagagcgaccccacccugggccugcuggaggaccccgccgagagacccgugaacagcugggccagcgacuucaacacccuggugcccguguacggcaaggcccacugggccaccaucagcaagugccagggcgccgagagaugcgaccccgagcugcccaagaccagcagcuucgccgccagcggcccccugauccccgaggagaacaaggagagagugcaggagcugcccgacagcggcgcccugaugcuggugcccaacagacagcugaccgccgacuacuucgagaagaccuggcugagccugaagguggcccaccagcaggugcugcccuggagaggcgaguuccaccccgacacccugcagauggcccugcagguggugaacauccagaccaucgccaugagcagagccggcagcagacccuggaaggccuaccugagcgcccaggacgacaccggcugccuguuccugaccgagcugcugcuggagcccggcaacagcgagaugcagaucagcgugaagcagaacgaggccagaaccgagacccugaacagcuucaucagcgugcuggagaccgugaucggcaccaucgaggagaucaagagcuaa

SEQ ID NO: 13667 - RNA, 3414 nt, Artificial Sequence
  AP4E1__Homo_sapiens__NP_031373
augagcgacaucguggagaagacccugaccgcccugcccggccuguuccugcagaaccagcccggcggcggccccgccgccgccaaggccagcuucagcagcagacugggcagccuggugagaggcaucaccgcccugaccagcaagcacgaggaggagaagcugauccagcaggagcugagcagccugaaggccaccgugagcgcccccaccaccacccugaagaugaugaaggagugcauggugagacugaucuacugcgagaugcugggcuacgacgccagcuucggcuacauccacgccaucaagcuggcccagcagggcaaccugcuggagaagagagugggcuaccuggccgugagccuguuccugcacgagagccacgagcugcugcugcugcuggugaacaccguggugaaggaccugcagagcaccaaccugguggaggugugcauggcccugaccguggugagccagaucuuccccugcgagaugauccccgccgugcugccccugaucgaggacaagcugcagcacagcaaggagaucgugagaagaaaggccgugcuggcccuguacaaguuccaccugaucgcccccaaccaggugcagcacauccacaucaaguucagaaaggcccugugcgacagagacgugggcgugauggccgccagccugcacaucuaccugagaaugaucaaggagaacagcagcggcuacaaggaccugaccggcagcuucgugaccauccugaagcagguggugggcggcaagcugcccguggaguucaacuaccacagcgugcccgcccccuggcugcagauccagcugcugagaauccugggccugcugggcaaggacgaccagagaaccagcgagcugauguacgacgugcuggacgagagccugagaagagccgagcugaaccacaacgugaccuacgccauccuguucgagugcgugcacaccguguacagcaucuaccccaagagcgagcugcuggagaaggccgccaagugcaucggcaaguucgugcugagccccaagaucaaccugaaguaccugggccugaaggcccugaccuacgugauccagcaggaccccacccuggcccugcagcaccagaugaccaucaucgagugccuggaccaccccgaccccaucaucaagagagagacccuggagcugcuguacagaaucaccaacgcccagaacaucaccgugaucgugcagaagaugcuggaguaccugcaccagagcaaggaggaguacgugaucgugaaccuggugggcaagaucgccgagcuggccgagaaguacgcccccgacaacgccugguucauccagaccaugaacgccguguucagcgugggcggcgacgugaugcaccccgacauccccaacaacuuccugagacugcuggccgagggcuucgacgacgagaccgaggaccagcagcugagacuguacgccgugcagagcuaccugacccugcuggacauggagaacguguucuacccccagagauuccugcaggugaugagcugggugcugggcgaguacagcuaccugcuggacaaggagacccccgaggaggugaucgccaagcuguacaagcugcugaugaacgacagcgugagcagcgagaccaaggccuggcugaucgccgccgugaccaagcugaccagccaggcccacagcagcaacaccguggagagacugauccacgaguucaccaucagccuggacaccugcaugagacagcacgccuucgagcugaagcaccugcacgagaacguggagcugaugaagagccugcugcccguggacagaagcugcgaggaccuggugguggacgccagccugagcuuccuggacggcuucguggccgagggccugagccagggcgccgcccccuacaagcccccccaccagagacaggaggagaagcugagccaggagaaggugcugaacuucgagcccuacggccugagcuucagcagcagcggcuucaccggcagacagagccccgccggcaucagccugggcagcgacgugagcggcaacagcgccgagaccggccugaaggagaccaacagccugaagcuggagggcaucaagaagcuguggggcaaggagggcuaccugcccaagaaggagagcaagaccggcgacgagagcggcgcccugcccgugccccaggagagcaucauggagaacguggaccaggccaucaccaagaaggaccagagccaggugcugacccagagcaaggaggagaaggagaagcagcugcuggccagcagccuguucgugggccugggcagcgagagcaccaucaaccugcugggcaaggccgacaccgugagccacaaguucagaagaaagagcaaggugaaggaggccaagagcggcgagaccaccagcacccacaacaugaccugcagcagcuucagcagccugagcaacguggccuacgaggacgacuacuacagcaacacccugcacgacaccggcgacaaggagcugaagaaguucagccugaccagcgagcugcuggacagcgagagccugaccgagcugccccugguggagaaguucagcuacugcagccugagcacccccagccuguucgccaacaacaacauggagaucuuccaccccccccagagcaccgccgccagcguggccaaggagagcagccuggccagcagcuuccuggaggagaccaccgaguacauccacagcaacgccauggaggugugcaacaacgagaccaucagcgugagcagcuacaagaucuggaaggacgacugccugcugaugguguggagcgugaccaacaagagcggccuggagcugaagagcgccgaccuggagaucuuccccgccgagaacuucaaggugaccgagcagcccggcugcugccugcccgugauggaggccgagagcaccaagagcuuccaguacagcgugcagaucgagaagcccuucaccgagggcaaccugaccggcuucaucagcuaccacaugauggacacccacagcgcccagcuggaguucagcgugaaccugagccugcuggacuucaucagaccccugaagaucagcagcgacgacuucggcaagcuguggcugagcuucgccaacgacgugaagcagaacgugaagaugagcgagagccaggccgcccugcccagcgcccugaagacccugcagcagaagcugagacugcacaucaucgagaucaucggcaacgagggccugcuggccugccagcugcugcccagcauccccugccugcugcacugcagagugcacgccgacgugcuggcccugugguucagaagcagcugcagcacccugcccgacuaccugcuguaccagugccagaaggugauggagggcagcuaa

SEQ ID NO: 13668 - RNA, 1362 nt, Artificial Sequence
  AP4M1__Homo_sapiens__NP_004713
augaucagccaguucuucauccugagcagcaagggcgacccccugaucuacaaggacuucagaggcgacagcggcggcagagacguggccgagcuguucuacagaaagcugaccggccugcccggcgacgagagccccguggugaugcaccaccacggcagacacuucauccacaucagacacagcggccuguaccugguggugaccaccagcgagaacgugagccccuucagccugcuggagcugcugagcagacuggccacccugcugggcgacuacugcggcagccugggcgagggcaccaucagcagaaacguggcccugguguacgagcugcuggacgaggugcuggacuacggcuacgugcagaccaccagcaccgagaugcugagaaacuucauccagaccgaggccguggugagcaagcccuucagccuguucgaccugagcagcgugggccuguucggcgccgagacccagcagagcaagguggcccccagcagcgccgccagcagacccgugcugagcagcagaagcgaccagagccagaagaacgagguguuccuggacgugguggagagacugagcgugcugaucgccagcaacggcagccugcugaagguggacgugcagggcgagaucagacugaagagcuuccugcccagcggcagcgagaugagaaucggccugaccgaggaguucugcgugggcaagagcgagcugagaggcuacggccccggcaucagaguggacgaggugagcuuccacagcagcgugaaccuggacgaguucgagagccacagaauccugagacugcagcccccccagggcgagcugaccgugaugagauaccagcugagcgacgaccugcccagcccccugcccuucagacuguuccccagcgugcagugggacagaggcagcggcagacugcagguguaccugaagcugagaugcgaccugcugagcaagagccaggcccugaacgugagacugcaccugccccugcccagaggcguggugagccugagccaggagcugagcagccccgagcagaaggccgagcuggccgagggcgcccugagaugggaccugcccagagugcagggcggcagccagcugagcggccuguuccagauggacgugcccggcccccccggcccccccagccacggccugagcaccagcgccagcccccugggccugggccccgccagccugagcuucgagcugcccagacacaccugcagcggccugcaggugagauuccugagacuggccuucagacccugcggcaacgccaacccccacaagugggugagacaccugagccacagcgacgccuacgugaucagaaucuaa

SEQ ID NO: 13669 - RNA, 435 nt, Artificial Sequence
  AP4S1__Homo_sapiens__NP_001121598
augaucaaguucuuccugauggugaacaagcagggccagaccagacugagcaaguacuacgagcacguggacaucaacaagagaacccugcuggagaccgaggugaucaagagcugccugagcagaagcaacgagcagugcagcuucaucgaguacaaggacuucaagcugaucuacagacaguacgccgcccuguucaucguggugggcgugaacgacaccgagaacgagauggccaucuacgaguucauccacaacuucguggaggugcuggacgaguacuucagcagagugagcgagcuggacaucauguucaaccuggacaaggugcacaucauccuggacgagauggugcugaacggcugcaucguggagaccaacagagccagaauccuggccccccugcugauccuggacaagaugagcgagagcuaa

SEQ ID NO: 13670 - RNA, 1473 nt, Artificial Sequence
  AP5M1__Homo_sapiens__NP_060699
auggcccagagagccguguggcugaucagccacgagcccggcaccccccugugcggcaccgugagauucagcagaagauaccccaccguggagaagagagccagaguguucaacggcgccagcuacgugcccgugcccgaggacggccccuuccugaaggcccugcuguucgagcugagacugcuggacgacgacaaggacuucguggagagcagagacagcugcagcagaaucaacaagaccagcaucuacggccugcugaucggcggcgaggagcuguggcccgugguggccuuccugaagaacgacaugaucuacgccugcgugccccugguggagcagacccugagccccagacccccccugaucagcgugagcggcgugagccagggcuucgaguuccuguucggcauccaggacuuccuguacagcggccagaagaacgacagcgagcugaacaccaagcugagccagcugcccgaccugcugcugcaggccugccccuucggcacccugcuggacgccaaccugcagaacagccuggacaacaccaacuucgccagcgugacccagccccagaagcagcccgccuggaagaccggcaccuacaagggcaagccccaggugagcaucagcaucaccgagaaggugaagagcaugcaguacgacaagcagggcaucgccgacaccuggcagguggugggcaccgugaccugcaagugcgaccuggagggcaucaugcccaacgugaccaucagccugagccugcccaccaacggcagcccccugcaggacauccuggugcaccccugcgugaccagccuggacagcgccauccugaccagcagcagcaucgacgccauggacgacagcgccuucagcggccccuacaaguuccccuucacccccccccuggagagcuucaaccugugcuucuacaccagccaggugcccgugccccccauccugggcuucuaccagaugaaggaggaggaggugcagcugagaaucaccaucaaccugaagcugcacgagagcgugaagaacaacuucgaguucugcgaggcccacauccccuucuacaacagaggccccaucacccaccuggaguacaagaccagcuucggccagcuggagguguucagagagaagagccugcugaucuggaucaucggccagaaguuccccaagagcauggagaucagccugagcggcaccgugaccuucggcgccaagagccacgagaagcagcccuucgaccccaucugcaccggcgagaccgccuaccugaagcugcacuucagaauccuggacuacacccugaccggcugcuacgccgaccagcacagcgugcagguguucgccagcggcaagcccaagaucagcgcccacagaaagcugaucagcagcgacuacuacaucuggaacagcaaggcccccgcccccgugaccuacggcagccugcugcuguaa

SEQ ID NO: 13671 - RNA, 2424 nt, Artificial Sequence
  AP5Z1__Homo_sapiens__NP_055670
auguucagcgccggcgccgagagccugcugcaccaggccagagagauccaggacgaggagcugaagaaguucugcagcagaaucugcaagcugcugcaggccgaggaccugggccccgacacccuggacagccugcagagacuguuccugaucaucagcgccaccaaguacagcagaagacuggagaagaccugcguggaccugcugcaggccacccugggccugcccgccugccccgagcagcugcaggugcugugcgccgccauccugagagagaugagccccagcgacagccugagccuggccugggaccacacccagaacagcagacagcugagccugguggccagcgugcugcuggcccagggcgacagaaacgaggaggugagagccgugggccagggcgugcugagagcccuggagagcagacagcccgagggccccagccugagacaccugcugcccgugauggccaaggugguggugcugagccccggcacccugcaggaggaccaggccacccugcugagcaagagacugguggacuggcugagauacgccagccugcagcagggccugccccacagcggcggcuucuucagcacccccagagccagacagcccggccccgugaccgagguggacggcgccguggccaccgacuucuucaccgugcugagcagcggccacagauucaccgacgaccaguggcugaacgugcaggccuucagcaugcugagagccuggcugcugcacagcggccccgagggccccggcacccuggacaccgacgacagaagcgagcaggagggcagcacccugagcgugaucagcgccaccagcagcgccggcagacugcugccccccagagagagacugagagagguggccuucgaguacugccagagacugaucgagcagagcaacagaagagcccugagaaagggcgacagcgaccugcagaaggccugccugguggaggccgugcuggugcuggacgugcugugcagacaggaccccagcuuccuguacagaagccugagcugccugaaggcccugcacggcagagugagaggcgaccccgccagcgugagagugcugcugccccuggcccacuucuuccugagccacggcgaggccgccgccguggacagcgaggccguguaccagcaccuguucaccagaauccccguggagcaguuccacagccccaugcuggccuucgaguucauccaguucugcagagacaaccugcaccuguucagcggccaccugagcacccugagacugagcuuccccaaccuguucaaguuccuggccuggaacagccccccccugaccagcgaguucguggcccugcugcccgcccugguggacgccggcaccgcccuggagaugcugcacgcccugcuggaccugcccugccugaccgccgugcuggaccugcagcugagaagcgcccccgccgccagcgagagaccccugugggacaccagccugagagcccccagcugccuggaggccuucagagacccccaguuccagggccuguuccaguaccugcugagacccaaggccagcggcgccaccgagagacuggccccccugcaccagcugcugcagcccauggccggcugcgccagaguggcccagugcgcccaggccgugcccacccugcugcaggccuucuucagcgccgugacccagguggccgacggcagccugaucaaccagcuggcccugcugcugcugggcagaagcgacagccuguaccccgcccccggcuacgccgccggcgugcacagcgugcugagcagccaguuccuggcccugugcacccugaagcccagccuggugguggagcuggccagagaccugcuggaguuccugggcagcgugaacggccugugcagcagagccagccuggugaccagcguggugugggccaucggcgaguaccugagcgugaccuacgacagaagaugcaccguggagcagaucaacaaguucuucgaggcccuggaggcccugcuguucgaggugacccagugcagacccagcgccgcccugcccagaugccccccccagguggugaccgugcugaugaccacccugaccaagcuggccagcagaagccaggaccugauccccagagccagccugcugcugagcaagaugagaacccuggcccacagccccgccaccagcagcacccacagcgaggagggcgccgaggccaucagaaccagagccaccgagcugcugacccugcugaagaugcccagcguggcccaguucgugcugacccccagcaccgaggugugcagccccagauaccacagagacgccaacaccgcccugccccuggcccugagaaccgugagcagacugguggagagagaggccggccugaugcccggcuaa

SEQ ID NO: 13672 - RNA, 3585 nt, Artificial Sequence
  APAF1__Homo_sapiens__NP_001151
auggacgccaaggccagaaacugccugcugcagcacagagaggcccuggagaaggacaucaagaccagcuacaucauggaccacaugaucagcgacggcuuccugaccaucagcgaggaggagaaggugagaaacgagcccacccagcagcagagagccgccaugcugaucaagaugauccugaagaaggacaacgacagcuacgugagcuucuacaacgcccugcugcacgagggcuacaaggaccuggccgcccugcugcacgacggcauccccguggugagcagcagcagcgugagaaccgugcugugcgagggcggcgugccccagagacccgugguguucgugaccagaaagaagcuggugaacgccauccagcagaagcugagcaagcugaagggcgagcccggcugggugaccauccacggcauggccggcugcggcaagagcgugcuggccgccgaggccgugagagaccacagccugcuggagggcugcuuccccggcggcgugcacugggugagcgugggcaagcaggacaagagcggccugcugaugaagcugcagaaccugugcaccagacuggaccaggacgagagcuucagccagagacugccccugaacaucgaggaggccaaggacagacugagaauccugaugcugagaaagcaccccagaagccugcugauccuggacgacgugugggacagcugggugcugaaggccuucgacagccagugccagauccugcugaccaccagagacaagagcgugaccgacagcgugaugggccccaaguacguggugcccguggagagcagccugggcaaggagaagggccuggagauccugagccuguucgugaacaugaagaaggccgaccugcccgagcaggcccacagcaucaucaaggagugcaagggcagcccccugguggugagccugaucggcgcccugcugagagacuuccccaacagaugggaguacuaccugaagcagcugcagaacaagcaguucaagagaaucagaaagagcagcagcuacgacuacgaggcccuggacgaggccaugagcaucagcguggagaugcugagagaggacaucaaggacuacuacaccgaccugagcauccugcagaaggacgugaaggugcccaccaaggugcugugcauccugugggacauggagaccgaggagguggaggacauccugcaggaguucgugaacaagagccugcuguucugcgacagaaacggcaagagcuucagauacuaccugcacgaccugcagguggacuuccugaccgagaagaacugcagccagcugcaggaccugcacaagaagaucaucacccaguuccagagauaccaccagccccacacccugagccccgaccaggaggacugcauguacugguacaacuuccuggccuaccacauggccagcgccaagaugcacaaggagcugugcgcccugauguucagccuggacuggaucaaggccaagaccgagcuggugggccccgcccaccugauccacgaguucguggaguacagacacauccuggacgagaaggacugcgccgugagcgagaacuuccaggaguuccugagccugaacggccaccugcugggcagacagcccuuccccaacaucgugcagcugggccugugcgagcccgagaccagcgagguguaccagcaggccaagcugcaggccaagcaggagguggacaacggcaugcuguaccuggaguggaucaacaagaagaacaucaccaaccugagcagacugguggugagaccccacaccgacgccguguaccacgccugcuucagcgaggacggccagagaaucgccagcugcggcgccgacaagacccugcagguguucaaggccgagaccggcgagaagcugcuggagaucaaggcccacgaggacgaggugcugugcugcgccuucagcaccgacgacagauucaucgccaccugcagcguggacaagaaggugaagaucuggaacagcaugaccggcgagcuggugcacaccuacgacgagcacagcgagcaggugaacugcugccacuucaccaacagcagccaccaccugcugcuggccaccggcagcagcgacugcuuccugaagcugugggaccugaaccagaaggagugcagaaacaccauguucggccacaccaacagcgugaaccacugcagauucagccccgacgacaagcugcuggccagcugcagcgccgacggcacccugaagcugugggacgccaccagcgccaacgagagaaagagcaucaacgugaagcaguucuuccugaaccuggaggacccccaggaggacauggaggugaucgugaagugcugcagcuggagcgccgacggcgccagaaucaugguggccgccaagaacaagaucuuccuguggaacaccgacagcagaagcaagguggccgacugcagaggccaccugagcugggugcacggcgugauguucagccccgacggcagcagcuuccugaccagcagcgacgaccagaccaucagacugugggagaccaagaaggugugcaagaacagcgccgugaugcugaagcaggagguggacgugguguuccaggagaacgaggugauggugcuggccguggaccacaucagaagacugcagcugaucaacggcagaaccggccagaucgacuaccugaccgaggcccaggugagcugcugcugccugagcccccaccugcaguacaucgccuucggcgacgagaacggcgccaucgagauccuggagcuggugaacaacagaaucuuccagagcagauuccagcacaagaagaccguguggcacauccaguucaccgccgacgagaagacccugaucagcagcagcgacgacgccgagauccagguguggaacuggcagcuggacaagugcaucuuccugagaggccaccaggagaccgugaaggacuucagacugcugaagaacagcagacugcugagcuggagcuucgacggcaccgugaagguguggaacaucaucaccggcaacaaggagaaggacuucgugugccaccagggcaccgugcugagcugcgacaucagccacgacgccaccaaguucagcagcaccagcgccgacaagaccgccaagaucuggagcuucgaccugcugcugccccugcacgagcugagaggccacaacggcugcgugagaugcagcgccuucagcguggacagcacccugcuggccaccggcgacgacaacggcgagaucagaaucuggaacgugagcaacggcgagcugcugcaccugugcgccccccugagcgaggagggcgccgccacccacggcggcugggugaccgaccugugcuucagccccgacggcaagaugcugaucagcgccggcggcuacaucaagugguggaacguggugaccggcgagagcagccagaccuucuacaccaacggcaccaaccugaagaagauccacgugagccccgacuucaagaccuacgugaccguggacaaccugggcauccuguacauccugcagacccuggaguaa

SEQ ID NO: 13673 - RNA, 2514 nt, Artificial Sequence
  APBA1__Homo_sapiens__XP_011516919
augaaccaccuggagggcagcgccgagguggaggugaccgacgaggccgccggcggcgaggugaacgagagcguggaggccgaccuggagcaccccgagguggaggaggagcagcagcagcccccccagcagcagcacuacgugggcagacaccagagaggcagagcccuggaggaccugagagcccagcugggccaggaggaggaggagagaggcgagugccuggccagaagcgccagcaccgagagcggcuuccacaaccacaccgacaccgccgagggcgacgugaucgccgccgccagagacggcuacgacgccgagagagcccaggaccccgaggacgagagcgccuacgccgugcaguacagacccgaggccgaggaguacaccgagcaggccgaggccgagcacgccgaggccacccacagaagagcccugcccaaccaccugcacuuccacagccuggagcacgaggaggccaugaacgccgccuacagcggcuacguguacacccacagacuguuccacagaggcgaggacgagcccuacagcgagcccuacgccgacuacggcggccugcaggagcacguguacgaggagaucggcgacgcccccgagcuggacgccagagacggccugagacuguacgagcaggagagagacgaggccgccgccuacagacaggaggcccugggcgccagacugcaccacuacgacgagagaagcgacggcgagagcgacagccccgagaaggaggccgaguucgcccccuaccccagaauggacagcuacgagcaggaggaggacaucgaccagaucguggccgaggugaagcagagcaugagcagccagagccuggacaaggccgccgaggacaugcccgaggccgagcaggaccuggagagaccccccacccccgccggcggcagacccgacagccccggccugcaggcccccgccggccagcagagagccgugggccccgccggcggcggcgaggccggccagagauacagcaaggagaagagagacgccaucagccuggccaucaaggacaucaaggaggccaucgaggaggugaagaccagaaccaucagaagccccuacacccccgacgagcccaaggagcccaucugggugaugagacaggacaucagccccaccagagacugcgacgaccagagacccauggacggcgacagccccagccccggcagcagcagcccccugggcgccgagagcagcagcaccagccugcaccccagcgaccccguggaggccagcaccaacaaggagagcagaaagagccuggccagcuuccccaccuacguggaggugcccggccccugcgaccccgaggaccugaucgacggcaucaucuucgccgccaacuaccugggcagcacccagcugcugagcgacaagacccccagcaagaacgugagaaugaugcaggcccaggaggccgugagcagaaucaagauggcccagaagcuggccaagagcagaaagaaggcccccgagggcgagagccagcccaugaccgagguggaccuguucaucagcacccagagaaucaaggugcugaacgccgacacccaggagaccaugauggaccacccccugagaaccaucagcuacaucgccgacaucggcaacaucguggugcugauggccagaagaagaaugcccagaagcaacagccaggagaacguggaggccagccaccccagccaggacggcaagagacaguacaagaugaucugccacguguucgagagcgaggacgcccagcugaucgcccagagcaucggccaggccuucagcguggccuaccaggaguuccugagagccaacggcaucaaccccgaggaccugagccagaaggaguacagcgaccugcugaacacccaggacauguacaacgacgaccugauccacuucagcaagagcgagaacugcaaggacguguucaucgagaagcagaagggcgagauccugggcguggugaucguggagagcggcuggggcagcauccugcccaccgugaucaucgccaacaugaugcacggcggccccgccgagaagagcggcaagcugaacaucggcgaccagaucaugagcaucaacggcaccagccuggugggccugccccugagcaccugccagagcaucaucaagggccugaagaaccagagcagagugaagcugaacaucgugagaugcccccccgugaccaccgugcugaucagaagacccgaccugagauaccagcugggcuucagcgugcagaacggcaucaucugcagccugaugagaggcggcaucgccgagagaggcggcgugagagugggccacagaaucaucgagaucaacggccagagcgugguggccaccccccacgagaagaucgugcacauccugagcaacgccgugggcgagauccacaugaagaccaugcccgccgccauguacagacugcugaccgcccaggagcagcccguguacaucuaa

SEQ ID NO: 13674 - RNA, 2214 nt, Artificial Sequence
  APBA2__Homo_sapiens__XP_006725606
auggcccacagaaagcuggagagcgugggcagcggcaugcuggaccacagagugagacccggccccgugccccacagccaggagcccgagagcgaggacauggagcugccccuggagggcuacgugcccgagggccuggagcuggccgcccugagacccgagagccccgcccccgaggagcaggagugccacaaccacagccccgacggcgacagcagcagcgacuacgugaacaacaccagcgaggaggaggacuacgacgagggccugcccgaggaggaggagggcaucaccuacuacaucagauacugccccgaggacgacagcuaccuggagggcauggacugcaacggcgaggaguaccuggcccacagcgcccaccccguggacaccgacgagugccaggaggccguggaggaguggaccgacagcgccggcccccacccccacggccacgaggccgagggcagccaggacuaccccgacggccagcugcccauccccgaggacgagcccagcgugcuggaggcccacgaccaggaggaggacggccacuacugcgccagcaaggagggcuaccaggacuacuaccccgaggaggccaacggcaacaccggcgccagccccuacagacugagaagaggcgacggcgaccuggaggaccaggaggaggacaucgaccagaucguggccgagaucaagaugagccugagcaugaccagcaucaccagcgccagcgaggccagccccgagcacggccccgagcccggccccgaggacagcguggaggccugcccccccaucaaggccagcugcagccccagcagacacgaggccagacccaagagccugaaccugcugcccgaggccaagcaccccggcgacccccagagaggcuucaagcccaagaccagaacccccgaggagagacugaaguggccccacgagcaggugugcaacggccuggagcagcccagaaagcagcagagaagcgaccugaacggccccguggacaacaacaacauccccgagaccaagaagguggccagcuuccccagcuucguggccgugcccggccccugcgagcccgaggaccugaucgacggcaucaucuucgccgccaacuaccugggcagcacccagcugcugagcgagagaaaccccagcaagaacaucagaaugaugcaggcccaggaggccgugagcagagugaagaacagcgagggcgacgcccagacccugaccgagguggaccuguucaucagcacccagagaaucaaggugcugaacgccgacacccaggagaccaugauggaccacgcccugagaaccaucagcuacaucgccgacaucggcaacaucguggugcugauggccagaagaagaaugcccagaagcgccagccaggacugcaucgagaccacccccggcgcccaggagggcaagaagcaguacaagaugaucugccacguguucgagagcgaggacgcccagcugaucgcccagagcaucggccaggccuucagcguggccuaccaggaguuccugagagccaacggcaucaaccccgaggaccugagccagaaggaguacagcgacaucaucaacacccaggagauguacaacgacgaccugauccacuucagcaacagcgagaacugcaaggagcugcagcuggagaagcacaagggcgagauccugggcgugguggugguggagagcggcuggggcagcauccugcccaccgugauccuggccaacaugaugaacggcggccccgccgccagaagcggcaagcugagcaucggcgaccagaucaugagcaucaacggcaccagccuggugggccugccccuggccaccugccagggcaucaucaagggccugaagaaccagacccaggugaagcugaacaucgugagcugcccccccgugaccaccgugcugaucaagagacccgaccugaaguaccagcugggcuucagcgugcagaacggcaucaucugcagccugaugagaggcggcaucgccgagagaggcggcgugagagugggccacagaaucaucgagaucaacggccagagcgugguggccaccgcccacgagaagaucgugcaggcccugagcaacagcgugggcgagauccacaugaagaccaugcccgccgccauguucagacugcugaccggccaggagaccccccuguacaucuaa

SEQ ID NO: 13675 - RNA, 1728 nt, Artificial Sequence
  APBA3__Homo_sapiens__NP_004877
auggacuuccccaccaucagcagaagccccagcggcccccccgccauggaccuggagggccccagagacauccuggugcccagcgaggaccugacccccgacagccagugggaccccaugcccggcggccccggcagccugagcagaauggagcuggacgagagcagccugcaggagcuggugcagcaguucgaggcccugcccggcgaccuggugggccccagccccggcggcgcccccugcccccugcacaucgccaccggccacggccuggccagccaggagaucgccgacgcccacggccugcugagcgccgaggccggcagagacgaccugcugggccugcugcacugcgaggagugcccccccagccagaccggccccgaggagccccuggagcccgcccccagacugcugcagccccccgaggaccccgacgaggacagcgacagccccgaguggguggagggcgccagcgccgagcaggagggcagcagaagcagcagcagcagccccgagcccuggcuggagaccgugccccuggugacccccgaggagccccccgccggcgcccagagccccgagacccuggccagcuaccccgccccccaggaggugcccggccccugcgaccacgaggaccugcuggacggcgugaucuucggcgccagauaccugggcagcacccagcuggugagcgagagaaacccccccaccagcaccagaauggcccaggccagagaggccauggacagagugaaggcccccgacggcgagacccagcccaugaccgagguggaccuguucgugagcaccaagagaaucaaggugcugaccgccgacagccaggaggccaugauggaccacgcccugcacaccaucagcuacaccgccgacaucggcugcgugcuggugcugauggccagaagaagacuggccagaagacccgccccccaggaccacggcagaagacuguacaagaugcugugccacguguucuacgccgaggacgcccagcugaucgcccaggccaucggccaggccuucgccgccgccuacagccaguuccugagagagagcggcaucgaccccagccaggugggcgugcaccccagccccggcgccugccaccugcacaacggcgaccuggaccacuucagcaacagcgacaacugcagagaggugcaccuggagaagagaagaggcgagggccugggcguggcccugguggagagcggcuggggcagccugcugcccaccgccgugaucgccaaccugcugcacggcggccccgccgagagaagcggcgcccugagcaucggcgacagacugaccgccaucaacggcaccagccuggugggccugccccuggccgccugccaggccgccgugagagagaccaagagccagaccagcgugacccugagcaucgugcacugcccccccgugaccaccgccaucauccacagaccccacgccagagagcagcugggcuucugcguggaggacggcaucaucugcagccugcugagaggcggcaucgccgagagaggcggcaucagagugggccacagaaucaucgagaucaacggccagagcgugguggccaccccccacgccagaaucaucgagcugcugaccgaggccuacggcgaggugcacaucaagaccaugcccgccgccaccuacagacugcugaccggccaggagcagcccguguaccuguaa

SEQ ID NO: 13676 - RNA, 1473 nt, Artificial Sequence
  APBB1__Homo_sapiens__NP_001244248
augagcgccauguucagccaggacuucuuccuggccaucauccugcaggacagcagcgccgacagcuucuggaaccccaacgccuucgagaccgacagcgaccugcccgccggcuggaugagagugcaggacaccagcggcaccuacuacuggcacauccccaccggcaccacccagugggagccccccggcagagccagccccagccagggcagcagcccccaggaggagagccagcugaccuggaccggcuucgcccacggcgagggcuucgaggacggcgaguucuggaaggacgagcccagcgacgaggcccccauggagcugggccugaaggagcccgaggagggcacccugaccuuccccgcccagagccugagccccgagccccugccccaggaggaggagaagcugccccccagaaacaccaaccccggcaucaagugcuucgccgugagaagccugggcuggguggagaugaccgaggaggagcuggcccccggcagaagcagcguggccgugaacaacugcaucagacagcugagcuaccacaagaacaaccugcacgaccccaugagcggcggcuggggcgagggcaaggaccugcugcugcagcuggaggacgagacccugaagcugguggagccccagagccaggcccugcugcacgcccagcccaucaucagcaucagaguguggggcgugggcagagacagcggcagagagagagacuucgccuacguggccagagacaagcugacccagaugcugaagugccacguguucagaugcgaggcccccgccaagaacaucgccaccagccugcacgagaucugcagcaagaucauggccgagagaagaaacgccagaugccuggugaacggccugagccuggaccacagcaagcugguggacgugcccuuccagguggaguuccccgcccccaagaacgagcuggugcagaaguuccagguguacuaccugggcaacgugcccguggccaagcccgugggcguggacgugaucaacggcgcccuggagagcgugcugagcagcagcagcagagagcaguggacccccagccacgugagcguggcccccgccacccugaccauccugcaccagcagaccgaggccgugcugggcgagugcagagugagauuccugagcuuccuggccgugggcagagacgugcacaccuucgccuucaucauggccgccggccccgccagcuucugcugccacauguucuggugcgagcccaacgccgccagccugagcgaggccgugcaggccgccugcaugcugagauaccagaagugccuggacgccagaagccaggccagcaccagcugccugcccgccccccccgccgagagcguggccagaagagugggcuggaccgugagaagaggcgugcagagccuguggggcagccugaagcccaagagacugggcgcccacacccccuaa

SEQ ID NO: 13677 - RNA, 2001 nt, Artificial Sequence
  APBB1IP__Homo_sapiens__XP_006717514
augggcgagagcagcgaggacaucgaccagauguucagcacccugcugggcgagauggaccugcugacccagagccugggcguggacacccugcccccccccgaccccaacccccccagagccgaguucaacuacagcgugggcuucaaggaccugaacgagagccugaacgcccuggaggaccaggaccuggacgcccugauggccgaccugguggccgacaucagcgaggccgagcagagaaccauccaggcccagaaggagagccugcagaaccagcaccacagcgccagccugcaggccagcaucuucagcggcgccgccagccugggcuacggcaccaacguggccgccaccggcaucagccaguacgaggacgaccugccccccccccccgccgaccccgugcuggaccugccccugcccccccccccccccgagccccugagccaggaggaggaggaggcccaggccaaggccgacaagaucaagcuggcccuggagaagcugaaggaggccaaggugaagaagcugguggugaaggugcacaugaacgacaacagcaccaagagccugaugguggacgagagacagcuggccagagacgugcuggacaaccuguucgagaagacccacugcgacugcaacguggacuggugccuguacgagaucuaccccgagcugcagaucgagagauucuucgaggaccacgagaacgugguggaggugcugagcgacuggaccagagacaccgagaacaagauccuguuccuggagaaggaggagaaguacgccguguucaagaacccccagaacuucuaccuggacaacagaggcaagaaggagagcaaggagaccaacgagaagaugaacgccaagaacaaggagagccugcuggaggagagcuucugcggcaccagcaucaucgugcccgagcuggagggcgcccuguaccugaaggaggacggcaagaagagcuggaagagaagauacuuccugcugagagccagcggcaucuacuacgugcccaagggcaagaccaagaccagcagagaccuggccugcuucauccaguucgagaacgugaacaucuacuacggcacccagcacaagaugaaguacaaggcccccaccgacuacugcuucgugcugaagcacccccagauccagaaggagagccaguacaucaaguaccugugcugcgacgacaccagaacccugaaccagugggugaugggcaucagaaucgccaaguacggcaagacccuguacgacaacuaccagagagccguggccaaggccggccuggccagcagauggaccaaccugggcaccgugaacgccgccgcccccgcccagcccagcaccggccccaagaccggcaccacccagcccaacggccagaucccccaggccacccacagcgugagcgccgugcugcaggaggcccagagacacgccgagaccagcaaggacaagaagcccgcccugggcaaccaccacgaccccgccgugcccagagccccccacgcccccaagagcagccugcccccccccccccccgugagaagaagcagcgacaccagcggcagccccgccaccccccugaaggccaagggcaccggcggcggcggccugcccgccccccccgacgacuuccugcccccccccccccccccccccccccuggacgaccccgagcugcccccccccccccccgacuucauggagcccccccccgacuucgugcccccccccccccccagcuacgccggcaucgccggcagcgagcugccccccccccccccccccccccccgcccccgcccccgcccccgugcccgacagcgccagacccccccccgccguggccaagagaccccccgugccccccaagagacaggagaaccccggccaccccggcggcgccggcggcggcgagcaggacuucaugagcgaccugaugaaggcccugcagaagaagagaggcaacgugagcuaa

SEQ ID NO: 13678 - RNA, 2277 nt, Artificial Sequence
  APBB2__Homo_sapiens__NP_001159522
augagcgaggugcugcccgccgacagcggcguggacacccuggccguguucauggccagcagcggcaccaccgacgugaccaacagaaacagccccgccaccccccccaacacccugaaccugagaagcagccacaacgagcugcugaacgccgagaucaagcacaccgagaccaagaacagcaccccccccaagugcagaaagaaguacgcccugaccaacauccaggccgccaugggccugagcgaccccgccgcccagccccugcugggcaacggcagcgccaacaucaagcuggugaagaacggcgagaaccagcugagaaaggccgccgagcagggccagcaggaccccaacaagaaccugagccccaccgccgugaucaacaucaccagcgagaagcuggagggcaaggagccccacccccaggacagcagcagcugcgagauccugcccagccagcccagaagaaccaagagcuuccugaacuacuacgccgaccuggagaccagcgccagagagcuggagcagaacagaggcaaccaccacggcaccgccgaggagaagagccagcccgugcagggccaggccagcaccaucaucggcaacggcgaccugcugcugcagaagcccaacagaccccagagcagccccgaggacggccagguggccaccgugagcagcagccccgagaccaagaaggaccaccccaagaccggcgccaagaccgacugcgcccugcacagaauccagaaccuggcccccagcgacgaggagagcagcuggaccacccugagccaggacagcgccagccccagcagccccgacgagaccgacaucuggagcgaccacagcuuccagaccgaccccgaccugccccccggcuggaagagagugagcgacaucgccggcaccuacuacuggcacauccccaccggcaccacccagugggagagacccgugagcauccccgccgaccugcagggcagcagaaagggcagccugagcagcgugacccccagccccacccccgagaacgagaagcagcccuggagcgacuucgccgugcugaacggcggcaagaucaacagcgacaucuggaaggaccugcacgccgccaccgugaaccccgaccccagccugaaggaguucgagggcgccacccugagauacgccagccugaagcugagaaacgccccccaccccgacgacgacgacagcugcagcaucaacagcgaccccgaggccaagugcuucgccgugagaagccugggcuggguggagauggccgaggaggaccuggcccccggcaagagcagcguggccgugaacaacugcaucagacagcugagcuacugcaagaacgacaucagagacaccgugggcaucuggggcgagggcaaggacauguaccugauccuggagaacgacaugcugagccugguggaccccauggacagaagcgugcugcacagccagcccaucgugagcaucagaguguggggcgugggcagagacaacggcagagacuucgccuacguggccagagacaaggacaccagaauccugaagugccacguguucagaugcgacacccccgccaaggccaucgccaccagccugcacgagaucugcagcaagaucauggccgagagaaagaacgccaaggcccuggccugcagcagccugcaggagagagccaacgugaaccuggacgugccccugcagguggacuuccccacccccaagaccgagcuggugcagaaguuccacgugcaguaccugggcaugcugcccguggacaagcccgugggcauggacauccugaacagcgccaucgagaaccugaugaccagcagcaacaaggaggacuggcugagcgugaacaugaacguggccgacgccaccgugaccgugaucagcgagaagaacgaggaggaggugcugguggagugcagagugagauuccugagcuucaugggcgugggcaaggacgugcacaccuucgccuucaucauggacaccggcaaccagagauucgagugccacguguucuggugcgagcccaacgccggcaacgugagcgaggccgugcaggccgccugcaugcugagauaccagaagugccugguggccagaccccccagccagaaggugagacccccccccccccccgccgacagcgugaccagaagagugaccaccaacgugaagagaggcgugcugagccugaucgacacccugaagcagaagagacccgugaccgagaugcccuaa

SEQ ID NO: 13679 - RNA, 1482 nt, Artificial Sequence
  APBB3__Homo_sapiens__NP_006042
augcugggcaaggacuacaugcuggccaucauccuggugaacugcgacgacgaccuguggggcgaccacagccuggagguggaggccggccugccccccggcuggagaaagauccacgacgccgccggcaccuacuacuggcacgugcccagcggcagcacccaguggcagagacccaccugggagcugggcgacgccgaggaccccggcaccggcaccgagggcaucuggggccugagaccccccaagggcagaagcuucagcagccuggagagcagccuggacagaagcaacagccugagcugguacggcggcgagagcuacauccagagcauggagcccggcgccaagugcuucgccgugagaagccugggcuggguggaggugcccgaggaggaccuggcccccggcaagagcagcaucgccgugaacaacugcauccagcagcuggcccagaccagaagcagaagccagccccccgacggcgccuggggcgagggccagaacaugcugaugauccugaagaaggacgccaugagccuggugaacccccuggaccacagccugauccacugccagccccuggugcacaucagaguguggggcgugggcagcagcaagggcagagacagccccaucagcgcccccgccagagacuucgccuucguggccagcgacaaggacagcugcaugcugaagugccacguguucugcugcgacgugcccgccaaggccaucgccagcgcccugcacggccugugcgcccagauccugagcgagagaguggaggugagcggcgacgccagcugcugcagccccgaccccaucagccccgaggaccugcccagacagguggagcugcuggacgccgugagccaggccgcccagaaguacgaggcccuguacaugggcacccugcccgugaccaaggccaugggcauggacgugcugaacgaggccaucggcacccugaccgccagaggcgacagaaacgccugggugcccaccaugcugagcgugagcgacagccugaugaccgcccaccccauccaggccgaggccagcaccgaggaggagccccuguggcagugccccgugagacuggugaccuucaucggcgugggcagagacccccacaccuucggccugaucgccgaccugggcagacagagcuuccagugcgccgccuucuggugccagccccacgccggcggccugagcgaggccgugcaggccgccugcauggugcaguaccagaagugccugguggccagcgccgccagaggcaaggccuggggcgcccaggccagagccagacugagacugaagagaaccagcagcauggacagccccggcggcccccugccccugccccugcugaagggcggcgugggcggcgccggcgccacccccagaaagagaggcguguucagcuuccuggacgccuucagacugaagcccagccugcugcacaugcccuaa

SEQ ID NO: 13680 - RNA, 6984 nt, Artificial Sequence
  APC2__Homo_sapiens__XP_005259532
augggccugcugggccugcugagccugcugcacagcgccuucuucggcgaccagacccugcaggagcugaagauggccagcagcguggcccccuacgagcagcuggugagacagguggaggcccugaaggccgagaacagccaccugagacaggagcugagagacaacagcagccaccugagcaagcuggagaccgagaccagcggcaugaaggaggugcugaagcaccugcagggcaagcuggagcaggaggccagagugcuggugagcagcggccagaccgaggugcuggagcagcugaaggcccugcagauggacaucaccagccuguacaaccugaaguuccagccccccacccugggccccgagcccgccgccagaacccccgagggcagccccgugcacggcagcggccccagcaaggacagcuucggcgagcugagcagagccaccaucagacugcuggaggagcuggacagagagagaugcuuccugcugaacgagaucgagaaggaggagaaggagaagcugugguacuacagccagcugcagggccugagcaagagacuggacgagcugccccacguggagacccaguucagcaugcagauggaccugaucagacagcagcuggaguucgaggcccagcacaucagaagccugauggaggagagauucggcaccagcgacgagauggugcagagagcccagaucagagccagcagacuggagcagaucgacaaggagcugcuggaggcccaggacagagugcagcagaccgagccccaggcccugcuggccgugaagagcgugcccguggacgaggaccccgagaccgaggugcccacccaccccgaggacggcaccccccagcccggcaacagcaagguggaggugguguucuggcugcugagcaugcuggccaccagagaccaggaggacaccgccagaacccugcuggccaugagcagcagccccgagagcugcguggccaugagaagaagcggcugccugccccugcugcugcagauccugcacggcaccgaggccgccgccggcggcagagccggcgcccccggcgcccccggcgccaaggacgccagaaugagagccaacgccgcccugcacaacaucguguucagccagcccgaccagggccuggccagaaaggagaugagagugcugcacgugcuggagcagaucagagccuacugcgagaccugcugggacuggcugcaggccagagacggcggccccgagggcggcggcgccggcagcgcccccauccccaucgagccccagaucugccaggccaccugcgccgugaugaagcugagcuucgacgaggaguacagaagagccaugaacgagcugggcggccugcaggccguggccgagcugcugcagguggacuacgagaugcacaagaugaccagagacccccugaaccuggcccugagaagauacgccggcaugacccugaccaaccugaccuucggcgacguggccaacaaggccacccugugcgccagaagaggcugcauggaggccaucguggcccagcuggccagcgacagcgaggagcugcaccagguggugagcagcauccugagaaaccugagcuggagagccgacaucaacagcaagaaggugcugagagaggccggcagcgugaccgcccuggugcagugcgugcugagagccaccaaggagagcacccugaagagcgugcugagcgcccuguggaaccugagcgcccacagcaccgagaacaaggccgccaucugccagguggacggcgcccugggcuuccuggugagcacccugaccuacaagugccagagcaacagccuggccaucaucgagagcggcggcggcauccugagaaacgugagcagccugguggccaccagagaggacuacagacaggugcugagagaccacaacugccugcagacccugcugcagcaccugaccagccacagccugaccaucgugagcaacgccugcggcacccuguggaaccugagcgccagaagcgccagagaccaggagcugcugugggaccugggcgccgugggcaugcugagaaaccuggugcacagcaagcacaagaugaucgccaugggcagcgccgccgcccugagaaaccugcuggcccacagacccgccaagcaccaggccgccgccaccgccgugagccccggcagcugcgugcccagccuguacgugagaaagcagagagcccuggaggccgagcuggacgccagacaccuggcccaggcccuggagcaccuggagaagcagggcccccccgccgccgaggccgccaccaagaagccccugcccccccugagacaccuggacggccuggcccaggacuacgccagcgacagcggcugcuucgacgacgacgacgcccccagcagccuggccgccgccgccgccaccggcgagcccgccagccccgccgcccugagccuguuccugggcagccccuuccugcagggccaggcccuggccagaaccccccccaccagaagaggcggcaaggaggccgagaaggacaccagcggcgaggccgccguggccgccaaggccaaggccaagcuggcccuggccguggccagaaucgaccagcugguggaggacaucagcgcccugcacaccagcagcgacgacagcuucagccugagcagcggcgaccccggccaggaggcccccagagagggcagagcccagagcugcagccccugcagaggccccgagggcggcagaagagaggccggcagcagagcccacccccugcugagacugaaggccgcccacgccagccugagcaacgacagccugaacagcggcagcgccagcgacggcuacugccccagagagcacaugcugcccugcccccuggccgcccuggccagcagaagagaggaccccagaugcggccagcccagacccagcagacuggaccuggaccugcccggcugccaggccgagccccccgccagagaggccaccagcgccgacgccagagugagaaccaucaagcugagccccaccuaccagcacgugccccugcuggagggcgccagcagagccggcgccgagccccuggccggccccggcaucagccccggcgccagaaagcaggccuggcugcccgccgaccaccugagcaaggugcccgagaagcuggccgccgccccccugagcguggccagcaaggcccugcagaagcuggccgcccaggagggcccccugagccugagcagaugcagcagccugagcagccugagcagcgccggcagacccggccccagcgagggcggcgaccuggacgacagcgacagcagccuggagggccuggaggaggccggccccagcgaggccgagcuggacagcaccuggagagcccccggcgccaccagccugcccguggccauccccgcccccagaagaaacagaggcagaggccugggcguggaggacgccacccccagcagcagcagcgagaacuacgugcaggagaccccccuggugcugagcagaugcagcagcgugagcagccugggcagcuucgagagccccagcaucgccagcagcauccccagcgagcccugcagcggccagggcagcggcaccaucagccccagcgagcugcccgacagccccggccagaccaugccccccagcagaagcaagacccccccccuggcccccgccccccagggcccccccgaggccacccaguucagccugcagugggagagcuacgugaagagauuccuggacaucgccgacugcagagagagaugcagacugcccagcgagcuggacgccggcagcgugagauucaccguggagaagcccgacgagaacuucagcugcgccagcagccugagcgcccuggcccugcacgagcacuacgugcagcaggacguggagcugagacugcugcccagcgccugccccgagagaggcggcggcgccggcggcgccggccugcacuucgccggccacagaagaagagaggagggccccgcccccaccggcagcagacccagaggcgccgccgaccaggagcuggagcugcugagagagugccugggcgccgccgugcccgccagacugagaaagguggccagcgcccuggugcccggcagaagagcccugcccgugcccguguacaugcuggugcccgcccccgcccccgcccaggaggacgacagcugcaccgacagcgccgagggcacccccgugaacuucagcagcgccgccagccugagcgacgagacccugcagggcccccccagagaccagcccggcggccccgccggcagacagagacccaccggcagacccaccagcgccagacaggccaugggccacagacacaaggccggcggcgccggcagaagcgccgagcagagcagaggcgccggcaagaacagagccggccuggagcugccccugggcagaccccccagcgcccccgccgacaaggacggcagcaagcccggcagaaccagaggcgacggcgcccugcagagccugugccugaccacccccaccgaggaggccguguacugcuucuacggcaacgacagcgacgaggagccccccgccgccgcccccacccccacccacagaagaaccagcgccauccccagagccuucaccagagagagaccccagggcagaaaggaggcccccgcccccagcaaggccgcccccgccgcccccccccccgccagaacccagcccagccugaucgccgacgagaccccccccugcuacagccugagcagcagcgccagcagccugagcgagcccgagcccagcgagccccccgccgugcaccccagaggcagagagcccgccgugaccaaggaccccggccccggcggcggcagagacagcagccccagccccagagccgccgaggagcugcugcagagaugcaucagcagcgcccugcccagaagaagaccccccgugagcggccugagaagaagaaagcccagagccaccagacuggacgagagacccgccgagggcagcagagagagaggcgaggaggccgccggcagcgacagagccagcgaccuggacagcguggaguggagagccauccaggagggcgccaacagcaucgugaccuggcugcaccaggccgccgccgccaccagagaggccagcagcgagagcgacagcauccugagcuucgugagcggccugagcgugggcagcacccugcagccccccaagcacagaaagggcagacaggccgagggcgagaugggcagcgccagaagacccgagaagagaggcgccgccagcgugaagaccagcggcagccccagaagccccgccggccccgagaagcccagaggcacccagaagaccacccccggcgugcccgccgugcugagaggcagaaccgugaucuacgugcccagccccgcccccagagcccagcccaagggcacccccggccccagagccacccccagaaagguggccccccccugccuggcccagcccgccgcccccgccaaggugcccagccccggccagcagagaagcagaagccugcacagacccgccaagaccagcgagcuggccacccugagccagccccccagaagcgccaccccccccgccagacuggccaagacccccagcagcagcagcagccagaccagccccgccagccagccccugcccagaaagagaccccccgugacccaggccgccggcgcccugcccggccccggcgccagccccgugcccaagacccccgccagaacccugcuggccaagcagcacaagacccagagaagccccgugagaauccccuucaugcagagacccgccagaagaggcccccccccccuggccagagccgugcccgagcccggccccagaggcagagccggcaccgaggccggccccggcgccagaggcggcagacugggccuggugagaguggccagcgcccugagcagcggcagcgagagcagcgacagaagcggcuucagaagacagcugaccuucaucaaggagagccccggccugagaagaagaagaagcgagcugagcagcgccgagagcgccgccagcgccccccagggcgccagccccagaagaggcagacccgcccugcccgccguguuccugugcagcagcagaugcgaggagcugagagccgcccccagacagggccccgcccccgccagacagagaccccccgccgccagacccagccccggcgagagacccgccagaagaaccaccagcgagagccccagcagacugcccgugagagcccccgccgccagacccgagaccgugaagagauacgccagccugccccacaucagcguggccagaagacccgacggcgccgugcccgccgcccccgccagcgccgacgccgccagaagaagcagcgacggcgagcccagaccccugcccagaguggccgcccccggcaccaccuggagaagaaucagagacgaggacgugccccacauccugagaagcacccugcccgccaccgcccugccccugagaggcagcacccccgaggacgcccccgccggccccccccccagaaagaccagcgacgccguggugcagaccgaggagguggccgcccccaagaccaacagcagcaccagccccagccuggagaccagagagccccccggcgcccccgccggcggccagcugagccugcugggcagcgacguggacggccccagccuggccaaggcccccaucagcgcccccuucgugcacgagggccugggcguggccgugggcggcuuccccgccagcagacacggcagccccagcagaagcgccagagugccccccuucaacuacgugcccagccccauggugguggccgccaccaccgacagcgccgccgagaaggcccccgccaccgccagcgccacccugcuggaguaa

SEQ ID NO: 13681 - RNA, 1545 nt, Artificial Sequence
  APCDD1__Homo_sapiens__NP_694545
augagcuggcccagaagacugcugcugagauaccuguuccccgcccugcugcugcacggccugggcgagggcagcgcccugcugcaccccgacagcagaagccaccccagaagccuggagaagagcgccuggagagccuucaaggagagccagugccaccacaugcugaagcaccugcacaacggcgccagaaucaccgugcagaugccccccaccaucgagggccacugggugagcaccggcugcgaggugagaagcggccccgaguucaucaccagaagcuacagauucuaccacaacaacaccuucaaggccuaccaguucuacuacggcagcaacagaugcaccaaccccaccuacacccugaucaucagaggcaagaucagacugagacaggccagcuggaucaucagaggcggcaccgaggccgacuaccagcugcacaacgugcaggugaucugccacaccgaggccguggccgagaagcugggccagcaggugaacagaaccugccccggcuuccuggccgacggcggccccugggugcaggacguggccuacgaccuguggagagaggagaacggcugcgagugcaccaaggccgugaacuucgccaugcacgagcugcagcugaucagaguggagaagcaguaccugcaccacaaccuggaccaccugguggaggagcuguuccugggcgacauccacaccgacgccacccagagaauguucuacagacccagcagcuaccagcccccccugcagaacgccaagaaccacgaccacgccugcaucgccugcagaaucaucuacagaagcgacgagcaccacccccccauccugccccccaaggccgaccugaccaucggccugcacggcgagugggugagccagagaugcgaggugagacccgaggugcuguuccugaccagacacuucaucuuccacgacaacaacaacaccugggagggccacuacuaccacuacagcgaccccgugugcaagcaccccaccuucagcaucuacgccagaggcagauacagcagaggcgugcugagcagcagagugaugggcggcaccgaguucguguucaaggugaaccacaugaaggugacccccauggacgccgccaccgccagccugcugaacguguucaacggcaacgagugcggcgccgagggcagcuggcaggugggcauccagcaggacgugacccacaccaacggcugcguggcccugggcaucaagcugccccacaccgaguacgagaucuucaagauggagcaggacgccagaggcagauaccugcuguucaacggccagagacccagcgacggcagcagccccgacagacccgagaagagagccaccagcuaccagaugccccuggugcagugcgccagcagcagccccagagccgaggaccuggccgaggacagcggcagcagccuguacggcagagcccccggcagacacaccuggagccugcugcuggccgcccuggccugccuggugccccugcugcacuggaacaucagaagauaa

SEQ ID NO: 13682 - RNA, 1539 nt, Artificial Sequence
  APCDD1L__Homo_sapiens__NP_001291716
auggccgagaacagcggccccggcgugagaccccccggcugggaggcccagaucaacaucaucagcaccagacuggcccuggcccacaccgcccccgccgccggcgaggccggcggcagcugccugagaugggagccccacugccagcagccccugcccgacagagugcccagcaccgccauccugccccccagacugaacggccccuggaucagcaccggcugcgaggugagacccggccccgaguuccugaccagagccuacaccuucuaccccagcagacuguucagagcccaccaguucuacuacgaggaccccuucugcggcgagcccgcccacagccugcuggugaagggcaaggugagacugagaagagccagcugggugaccagaggcgccaccgaggccgacuaccaccugcacaaggugggcaucguguuccacagcagaagagcccugguggacgugaccggcagacugaaccagaccagagccggcagagacugcgccagaagacugccccccgccagagccuggcugcccggcgcccuguacgagcugagaagcgccagagcccagggcgacugccuggaggcccugggccugaccaugcacgagcugagccuggugagagugcagagaagacugcagccccagcccagagccagccccagacugguggaggagcuguaccugggcgacauccacaccgaccccgccgagagaagacacuacagacccaccggcuaccagagaccccugcagagcgcccugcaccacgugcagcccugccccgccugcggccugaucgccagaagcgacgugcaccacccccccgugcugccccccccccuggcccugccccugcaccugggcggcuggugggugagcagcggcugcgaggugagacccgccgugcuguuccugaccagacuguucaccuuccacggccacagcagaagcugggagggcuacuaccaccacuucagcgaccccgccugcagacagcccaccuucaccguguacgccgccggcagauacaccagaggcacccccagcaccagagugagaggcggcaccgagcugguguucgaggugaccagagcccacgugacccccauggaccaggugaccaccgccaugcugaacuucagcgagcccagcagcugcggcggcgccggcgccuggagcaugggcaccgagagagacgugaccgccaccaacggcugccugccccugggcaucagacugccccacguggaguacgagcuguucaagauggagcaggacccccugggccagagccugcuguucaucggccagagacccaccgacggcagcagccccgacacccccgagaagagacccaccagcuaccaggccccccuggugcugugccacggcgaggcccccgacuucagcagacccccccagcacagacccagccugcagaagcaccccagcaccggcggccugcacaucgcccccuucccccugcugccccuggugcugggccuggccuuccugcacuggcuguaa

SEQ ID NO: 13683 - RNA, 8532 nt, Artificial Sequence
  APC__Homo_sapiens__NP_001120982
auggccgccgccagcuacgaccagcugcugaagcagguggaggcccugaagauggagaacagcaaccugagacaggagcuggaggacaacagcaaccaccugaccaagcuggagaccgaggccagcaacaugaaggaggugcugaagcagcugcagggcagcaucgaggacgaggccauggccagcagcggccagaucgaccugcuggagagacugaaggagcugaaccuggacagcagcaacuuccccggcgugaagcugagaagcaagaugagccugagaagcuacggcagcagagagggcagcgugagcagcagaagcggcgagugcagccccgugcccaugggcagcuuccccagaagaggcuucgugaacggcagcagagagagcaccggcuaccuggaggagcuggagaaggagagaagccugcugcuggccgaccuggacaaggaggagaaggagaaggacugguacuacgcccagcugcagaaccugaccaagagaaucgacagccugccccugaccgagaacuucagccugcagaccgacaugaccagaagacagcuggaguacgaggccagacagaucagaguggccauggaggagcagcugggcaccugccaggacauggagaagagagcccagagaagaaucgccagaauccagcagaucgagaaggacauccugagaaucagacagcugcugcagagccaggccaccgaggccgagagaagcagccagaacaagcacgagaccggcagccacgacgccgagagacagaacgagggccagggcgugggcgagaucaacauggccaccagcggcaacggccagggcagcaccaccagaauggaccacgagaccgccagcgugcugagcagcagcagcacccacagcgcccccagaagacugaccagccaccugggcaccaagguggagaugguguacagccugcugagcaugcugggcacccacgacaaggacgacaugagcagaacccugcuggccaugagcagcagccaggacagcugcaucagcaugagacagagcggcugccugccccugcugauccagcugcugcacggcaacgacaaggacagcgugcugcugggcaacagcagaggcagcaaggaggccagagccagagccagcgccgcccugcacaacaucauccacagccagcccgacgacaagagaggcagaagagagaucagagugcugcaccugcuggagcagaucagagccuacugcgagaccugcugggaguggcaggaggcccacgagcccggcauggaccaggacaagaaccccaugcccgcccccguggagcaccagaucugccccgccgugugcgugcugaugaagcugagcuucgacgaggagcacagacacgccaugaacgagcugggcggccugcaggccaucgccgagcugcugcagguggacugcgagauguacggccugaccaacgaccacuacagcaucacccugagaagauacgccggcauggcccugaccaaccugaccuucggcgacguggccaacaaggccacccugugcagcaugaagggcugcaugagagcccugguggcccagcugaagagcgagagcgaggaccugcagcaggugaucgccagcgugcugagaaaccugagcuggagagccgacgugaacagcaagaagacccugagagaggugggcagcgugaaggcccugauggagugcgcccuggaggugaagaaggagagcacccugaagagcgugcugagcgcccuguggaaccugagcgcccacugcaccgagaacaaggccgacaucugcgccguggacggcgcccuggccuuccuggugggcacccugaccuacagaagccagaccaacacccuggccaucaucgagagcggcggcggcauccugagaaacgugagcagccugaucgccaccaacgaggaccacagacagauccugagagagaacaacugccugcagacccugcugcagcaccugaagagccacagccugaccaucgugagcaacgccugcggcacccuguggaaccugagcgccagaaaccccaaggaccaggaggcccugugggacaugggcgccgugagcaugcugaagaaccugauccacagcaagcacaagaugaucgccaugggcagcgccgccgcccugagaaaccugauggccaacagacccgccaaguacaaggacgccaacaucaugagccccggcagcagccugcccagccugcacgugagaaagcagaaggcccuggaggccgagcuggacgcccagcaccugagcgagaccuucgacaacaucgacaaccugagccccaaggccagccacagaagcaagcagagacacaagcagagccuguacggcgacuacguguucgacaccaacagacacgacgacaacagaagcgacaacuucaacaccggcaacaugaccgugcugagccccuaccugaacaccaccgugcugcccagcagcagcagcagcagaggcagccuggacagcagcagaagcgagaaggacagaagccuggagagagagagaggcaucggccugggcaacuaccaccccgccaccgagaaccccggcaccagcagcaagagaggccugcagaucagcaccaccgccgcccagaucgccaaggugauggaggaggugagcgccauccacaccagccaggaggacagaagcagcggcagcaccaccgagcugcacugcgugaccgacgagagaaacgcccugagaagaagcagcgccgcccacacccacagcaacaccuacaacuucaccaagagcgagaacagcaacagaaccugcagcaugcccuacgccaagcuggaguacaagagaagcagcaacgacagccugaacagcgugagcagcagcgacggcuacggcaagagaggccagaugaagcccagcaucgagagcuacagcgaggacgacgagagcaaguucugcagcuacggccaguaccccgccgaccuggcccacaagauccacagcgccaaccacauggacgacaacgacggcgagcuggacacccccaucaacuacagccugaaguacagcgacgagcagcugaacagcggcagacagagccccagccagaacgagagaugggccagacccaagcacaucaucgaggacgagaucaagcagagcgagcagagacagagcagaaaccagagcaccaccuaccccguguacaccgagagcaccgacgacaagcaccugaaguuccagccccacuucggccagcaggagugcgugagccccuacagaagcagaggcgccaacggcagcgagaccaacagagugggcagcaaccacggcaucaaccagaacgugagccagagccugugccaggaggacgacuacgaggacgacaagcccaccaacuacagcgagagauacagcgaggaggagcagcacgaggaggaggagagacccaccaacuacagcaucaaguacaacgaggagaagagacacguggaccagcccaucgacuacagccugaaguacgccaccgacauccccagcagccagaagcagagcuucagcuucagcaagagcagcagcggccagagcagcaagaccgagcacaugagcagcagcagcgagaacaccagcacccccagcagcaacgccaagagacagaaccagcugcaccccagcagcgcccagagcagaagcggccagccccagaaggccgccaccugcaaggugagcagcaucaaccaggagaccauccagaccuacugcguggaggacacccccaucugcuucagcagaugcagcagccugagcagccugagcagcgccgaggacgagaucggcugcaaccagaccacccaggaggccgacagcgccaacacccugcagaucgccgagaucaaggagaagaucggcaccagaagcgccgaggaccccgugagcgaggugcccgccgugagccagcaccccagaaccaagagcagcagacugcagggcagcagccugagcagcgagagcgccagacacaaggccguggaguucagcagcggcgccaagagccccagcaagagcggcgcccagacccccaagagcccccccgagcacuacgugcaggagaccccccugauguucagcagaugcaccagcgugagcagccuggacagcuucgagagcagaagcaucgccagcagcgugcagagcgagcccugcagcggcauggugagcggcaucaucagccccagcgaccugcccgacagccccggccagaccaugccccccagcagaagcaagaccccccccccccccccccagaccgcccagaccaagagagaggugcccaagaacaaggcccccaccgccgagaagagagagagcggccccaagcaggccgccgugaacgccgccgugcagagagugcaggugcugcccgacgccgacacccugcugcacuucgccaccgagagcacccccgacggcuucagcugcagcagcagccugagcgcccugagccuggacgagcccuucauccagaaggacguggagcugagaaucaugccccccgugcaggagaacgacaacggcaacgagaccgagagcgagcagcccaaggagagcaacgagaaccaggagaaggaggccgagaagaccaucgacagcgagaaggaccugcuggacgacagcgacgacgacgacaucgagauccuggaggagugcaucaucagcgccaugcccaccaagagcagcagaaaggccaagaagcccgcccagaccgccagcaagcugcccccccccguggccagaaagcccagccagcugcccguguacaagcugcugcccagccagaacagacugcagccccagaagcacgugagcuucacccccggcgacgacaugcccagaguguacugcguggagggcacccccaucaacuucagcaccgccaccagccugagcgaccugaccaucgagagcccccccaacgagcuggccgccggcgagggcgugagaggcggcgcccagagcggcgaguucgagaagagagacaccauccccaccgagggcagaagcaccgacgaggcccagggcggcaagaccagcagcgugaccauccccgagcuggacgacaacaaggccgaggagggcgacauccuggccgagugcaucaacagcgccaugcccaagggcaagagccacaagcccuucagagugaagaagaucauggaccaggugcagcaggccagcgccagcagcagcgcccccaacaagaaccagcuggacggcaagaagaagaagcccaccagccccgugaagcccaucccccagaacaccgaguacagaaccagagugagaaagaacgccgacagcaagaacaaccugaacgccgagagaguguucagcgacaacaaggacagcaagaagcagaaccugaagaacaacagcaagguguucaacgacaagcugcccaacaacgaggacagagugagaggcagcuucgccuucgacagcccccaccacuacacccccaucgagggcacccccuacugcuucagcagaaacgacagccugagcagccuggacuucgacgacgacgacguggaccugagcagagagaaggccgagcugagaaaggccaaggagaacaaggagagcgaggccaaggugaccagccacaccgagcugaccagcaaccagcagagcgccaacaagacccaggccaucgccaagcagcccaucaacagaggccagcccaagcccauccugcagaagcagagcaccuucccccagagcagcaaggacauccccgacagaggcgccgccaccgacgagaagcugcagaacuucgccaucgagaacacccccgugugcuucagccacaacagcagccugagcagccugagcgacaucgaccaggagaacaacaacaaggagaacgagcccaucaaggagaccgagccccccgacagccagggcgagcccagcaagccccaggccagcggcuacgcccccaagagcuuccacguggaggacacccccgugugcuucagcagaaacagcagccugagcagccugagcaucgacagcgaggacgaccugcugcaggagugcaucagcagcgccaugcccaagaagaagaagcccagcagacugaagggcgacaacgagaagcacagccccagaaacaugggcggcauccugggcgaggaccugacccuggaccugaaggacauccagagacccgacagcgagcacggccugagccccgacagcgagaacuucgacuggaaggccauccaggagggcgccaacagcaucgugagcagccugcaccaggccgccgccgccgccugccugagcagacaggccagcagcgacagcgacagcauccugagccugaagagcggcaucagccugggcagccccuuccaccugacccccgaccaggaggagaagcccuucaccagcaacaagggccccagaauccugaagcccggcgagaagagcacccuggagaccaagaagaucgagagcgagagcaagggcaucaagggcggcaagaagguguacaagagccugaucaccggcaaggugagaagcaacagcgagaucagcggccagaugaagcagccccugcaggccaacaugcccagcaucagcagaggcagaaccaugauccacauccccggcgugagaaacagcagcagcagcaccagccccgugagcaagaagggccccccccugaagacccccgccagcaagagccccagcgagggccagaccgccaccaccagccccagaggcgccaagcccagcgugaagagcgagcugagccccguggccagacagaccagccagaucggcggcagcagcaaggcccccagcagaagcggcagcagagacagcacccccagcagacccgcccagcagccccugagcagacccauccagagccccggcagaaacagcaucagccccggcagaaacggcaucagcccccccaacaagcugagccagcugcccagaaccagcagccccagcaccgccagcaccaagagcagcggcagcggcaagaugagcuacaccagccccggcagacagaugagccagcagaaccugaccaagcagaccggccugagcaagaacgccagcagcauccccagaagcgagagcgccagcaagggccugaaccagaugaacaacggcaacggcgccaacaagaagguggagcugagcagaaugagcagcaccaagagcagcggcagcgagagcgacagaagcgagagacccgugcuggugagacagagcaccuucaucaaggaggcccccagccccacccugagaagaaagcuggaggagagcgccagcuucgagagccugagccccagcagcagacccgccagccccaccagaagccaggcccagacccccgugcugagccccagccugcccgacaugagccugagcacccacagcagcgugcaggccggcggcuggagaaagcugccccccaaccugagccccaccaucgaguacaacgacggcagacccgccaagagacacgacaucgccagaagccacagcgagagccccagcagacugcccaucaacagaagcggcaccuggaagagagagcacagcaagcacagcagcagccugcccagagugagcaccuggagaagaaccggcagcagcagcagcauccugagcgccagcagcgagagcagcgagaaggccaagagcgaggacgagaagcacgugaacagcaucagcggcaccaagcagagcaaggagaaccaggugagcgccaagggcaccuggagaaagaucaaggagaacgaguucagccccaccaacagcaccagccagaccgugagcagcggcgccaccaacggcgccgagagcaagacccugaucuaccagauggcccccgccgugagcaagaccgaggacgugugggugagaaucgaggacugccccaucaacaaccccagaagcggcagaagccccaccggcaacaccccccccgugaucgacagcgugagcgagaaggccaaccccaacaucaaggacagcaaggacaaccaggccaagcagaacgugggcaacggcagcgugcccaugagaaccgugggccuggagaacagacugaacagcuucauccagguggacgcccccgaccagaagggcaccgagaucaagcccggccagaacaaccccgugcccgugagcgagaccaacgagagcagcaucguggagagaacccccuucagcagcagcagcagcagcaagcacagcagccccagcggcaccguggccgccagagugacccccuucaacuacaaccccagccccagaaagagcagcgccgacagcaccagcgccagacccagccagauccccacccccgugaacaacaacaccaagaagagagacagcaagaccgacagcaccgagagcagcggcacccagagccccaagagacacagcggcagcuaccuggugaccagcguguaa

SEQ ID NO: 13684 - RNA, 672 nt, Artificial Sequence
  APCS__Homo_sapiens__NP_001630
augaacaagccccugcuguggaucagcgugcugaccagccugcuggaggccuucgcccacaccgaccugagcggcaagguguucguguuccccagagagagcgugaccgaccacgugaaccugaucaccccccuggagaagccccugcagaacuucacccugugcuucagagccuacagcgaccugagcagagccuacagccuguucagcuacaacacccagggcagagacaacgagcugcugguguacaaggagagagugggcgaguacagccuguacaucggcagacacaaggugaccagcaaggugaucgagaaguuccccgcccccgugcacaucugcgugagcugggagagcagcagcggcaucgccgaguucuggaucaacggcaccccccuggugaagaagggccugagacagggcuacuucguggaggcccagcccaagaucgugcugggccaggagcaggacagcuacggcggcaaguucgacagaagccagagcuucgugggcgagaucggcgaccuguacaugugggacagcgugcugccccccgagaacauccugagcgccuaccagggcaccccccugcccgccaacauccuggacuggcaggcccugaacuacgagaucagaggcuacgugaucaucaagccccugguguggguguaa

SEQ ID NO: 13685 - RNA, 2199 nt, Artificial Sequence
  APEH__Homo_sapiens__NP_001631
auggagagacaggugcugcugagcgagcccgaggaggccgccgcccuguacagaggccugagcagacagcccgcccugagcgccgccugccugggccccgaggugaccacccaguacggcggccaguacagaaccgugcacaccgaguggacccagagagaccuggagagaauggagaacaucagauucugcagacaguaccugguguuccacgacggcgacagcgugguguucgccggccccgccggcaacagcguggagaccagaggcgagcugcugagcagagagagccccagcggcaccaugaaggccgugcugagaaaggccggcggcaccggccccggcgaggagaagcaguuccuggaggugugggagaagaacagaaagcugaagagcuucaaccugagcgcccuggagaagcacggccccguguacgaggacgacugcuucggcugccugagcuggagccacagcgagacccaccugcuguacguggccgagaagaagagacccaaggccgagagcuucuuccagaccaaggcccuggacgugagcgccagcgacgacgagaucgccagacugaagaagcccgaccaggccaucaagggcgaccaguucguguucuacgaggacuggggcgagaacauggugagcaagagcauccccgugcugugcgugcuggacguggagagcggcaacaucagcgugcuggagggcgugcccgagaacgugagccccggccaggccuucugggcccccggcgacgccggcgugguguucgugggcugguggcacgagcccuucagacugggcaucagauucugcaccaacagaagaagcgcccuguacuacguggaccugaucggcggcaagugcgagcugcugagcgacgacagccuggccgugagcagccccagacugagccccgaccagugcagaaucguguaccugcaguaccccagccugaucccccaccaccagugcagccagcugugccuguacgacugguacaccaaggugaccagcguggugguggacguggugcccagacagcugggcgagaacuucagcggcaucuacugcagccugcugccccugggcugcuggagcgccgacagccagagagugguguucgacagcgcccagagaagcagacaggaccuguucgccguggacacccaggugggcaccgugaccagccugaccgccggcggcagcggcggcagcuggaagcugcugaccaucgaccaggaccugaugguggcccaguucagcacccccagccugccccccacccugaaggugggcuuccugcccagcgccggcaaggagcagagcgugcugugggugagccuggaggaggccgagcccauccccgacauccacuggggcaucagagugcugcagcccccccccgagcaggagaacgugcaguacgccggccuggacuucgaggccauccugcugcagcccggcagcccccccgacaagacccaggugcccaugguggugaugccccacggcggcccccacagcagcuucgugaccgccuggaugcuguuccccgccaugcugugcaagaugggcuucgccgugcugcuggugaacuacagaggcagcaccggcuucggccaggacagcauccugagccugcccggcaacgugggccaccaggacgugaaggacgugcaguucgccguggagcaggugcugcaggaggagcacuucgacgccagccacguggcccugaugggcggcagccacggcggcuucaucagcugccaccugaucggccaguaccccgagaccuacagagccugcguggccagaaaccccgugaucaacaucgccagcaugcugggcagcaccgacauccccgacuggugcgugguggaggccggcuuccccuucagcagcgacugccugcccgaccugagcgugugggccgagaugcuggacaagagccccaucagauacaucccccaggugaagaccccccugcugcugaugcugggccaggaggacagaagagugcccuucaagcagggcauggaguacuacagagcccugaagaccagaaacgugcccgugagacugcugcuguaccccaagagcacccacgcccugagcgagguggagguggagagcgacagcuucaugaacgccgugcuguggcugagaacccaccugggcagcuaa

SEQ ID NO: 13686 - RNA, 957 nt, Artificial Sequence
  APEX1__Homo_sapiens__XP_005267638
augcccaagagaggcaagaagggcgccguggccgaggacggcgacgagcugagaaccgagcccgaggccaagaagagcaagaccgccgccaagaagaacgacaaggaggccgccggcgagggccccgcccuguacgaggacccccccgaccagaagaccagccccagcggcaagcccgccacccugaagaucugcagcuggaacguggacggccugagagccuggaucaagaagaagggccuggacugggugaaggaggaggcccccgacauccugugccugcaggagaccaagugcagcgagaacaagcugcccgccgagcugcaggagcugcccggccugagccaccaguacuggagcgcccccagcgacaaggagggcuacagcggcgugggccugcugagcagacagugcccccugaaggugagcuacggcaucggcgacgaggagcacgaccaggagggcagagugaucguggccgaguucgacagcuucgugcuggugaccgccuacgugcccaacgccggcagaggccuggugagacuggaguacagacagagaugggacgaggccuucagaaaguuccugaagggccuggccagcagaaagccccuggugcugugcggcgaccugaacguggcccacgaggagaucgaccugagaaaccccaagggcaacaagaagaacgccggcuucaccccccaggagagacagggcuucggcgagcugcugcaggccgugccccuggccgacagcuucagacaccuguaccccaacacccccuacgccuacaccuucuggaccuacaugaugaacgccagaagcaagaacgugggcuggagacuggacuacuuccugcugagccacagccugcugcccgcccugugcgacagcaagaucagaagcaaggcccugggcagcgaccacugccccaucacccuguaccuggcccuguaa

SEQ ID NO: 13687 - RNA, 1557 nt, Artificial Sequence
  APEX2__Homo_sapiens__NP_055296
augcugagaguggugagcuggaacaucaacggcaucagaagaccccugcagggcguggccaaccaggagcccagcaacugcgccgccguggccgugggcagaauccuggacgagcuggacgccgacaucgugugccugcaggagaccaaggugaccagagacgcccugaccgagccccuggccaucguggagggcuacaacagcuacuucagcuucagcagaaacagaagcggcuacagcggcguggccaccuucugcaaggacaacgccacccccguggccgccgaggagggccugagcggccuguucgccacccagaacggcgacgugggcugcuacggcaacauggacgaguucacccaggaggagcugagagcccuggacagcgagggcagagcccugcugacccagcacaagaucagaaccugggagggcaaggagaagacccugacccugaucaacguguacugcccccacgccgaccccggcagacccgagagacugguguucaagaugagauucuacagacugcugcagaucagagccgaggcccugcuggccgccggcagccacgugaucauccugggcgaccugaacaccgcccacagacccaucgaccacugggacgccgugaaccuggagugcuucgaggaggaccccggcagaaaguggauggacagccugcugagcaaccugggcugccagagcgccagccacgugggccccuucaucgacagcuacagaugcuuccagcccaagcaggagggcgccuucaccugcuggagcgccgugaccggcgccagacaccugaacuacggcagcagacuggacuacgugcugggcgacagaacccuggugaucgacaccuuccaggccagcuuccugcugcccgaggugaugggcagcgaccacugccccgugggcgccgugcugagcgugagcagcgugcccgccaagcagugccccccccugugcaccagauuccugcccgaguucgccggcacccagcugaagauccugagauuccuggugccccuggagcagagccccgugcuggagcagagcacccugcagcacaacaaccagaccagagugcagaccugccagaacaaggcccaggugagaagcaccagaccccagcccagccaggugggcagcagcagaggccagaagaaccugaagagcuacuuccagcccagccccagcugcccccaggccagccccgacaucgagcugcccagccugccccugaugagcgcccugaugacccccaagacccccgaggagaaggccguggccaagguggugaagggccaggccaagaccagcgaggccaaggacgagaaggagcugagaaccagcuucuggaagagcgugcuggccggcccccugagaaccccccugugcggcggccacagagagcccugcgugaugagaaccgugaagaagcccggccccaaccugggcagaagauucuacaugugcgccagacccagaggcccccccaccgaccccagcagcagaugcaacuucuuccuguggagcagacccagcuaa

SEQ ID NO: 13688 - RNA, 651 nt, Artificial Sequence
  APH1B__Homo_sapiens__NP_001139118
augaccgccgccguguucuucggcugcgccuucaucgccuucggccccgcccuggcccuguacguguucaccaucgccaccgagccccugagaaucaucuuccugaucgccggcgccuucuucuggcuggugagccugcugaucagcagccuggugugguucauggccagagugaucaucgacaacaaggacggccccacccagaaguaccugcugaucuucggcgccuucgugagcguguacauccaggagauguucagauucgccuacuacaagcugcugaagaaggccagcgagggccugaagagcaucaaccccggcgagaccgcccccagcaugagacugcuggccuacgccuucaugacccuggugaucauccugcugcacguguucuggggcaucguguucuucgacggcugcgagaagaagaaguggggcauccugcugaucgugcugcugacccaccugcuggugagcgcccagaccuucaucagcagcuacuacggcaucaaccuggccagcgccuucaucauccuggugcugaugggcaccugggccuuccuggccgccggcggcagcugcagaagccugaagcugugccugcugugccaggacaagaacuuccugcuguacaaccagagaagcagauaa

SEQ ID NO: 13689 - RNA, 1575 nt, Artificial Sequence
  API5__Homo_sapiens__NP_001136402
augcccaccguggaggagcuguacagaaacuacggcauccuggccgacgccaccgagcaggugggccagcacaaggacgccuaccaggugauccuggacggcgugaagggcggcaccaaggagaagagacuggccgcccaguucauccccaaguucuucaagcacuuccccgagcuggccgacagcgccaucaacgcccagcuggaccugugcgaggacgaggacgugagcaucagaagacaggccaucaaggagcugccccaguucgccaccggcgagaaccugcccagaguggccgacauccugacccagcugcugcagaccgacgacagcgccgaguucaaccuggugaacaacgcccugcugagcaucuucaagauggacgccaagggcacccugggcggccuguucagccagauccugcagggcgaggacaucgugagagagagagccaucaaguuccugagcaccaagcugaagacccugcccgacgaggugcugaccaaggagguggaggagcugauccugaccgagagcaagaaggugcuggaggacgugaccggcgaggaguucgugcuguucaugaagauccugagcggccugaagagccugcagaccgugagcggcagacagcagcugguggagcugguggccgagcaggccgaccuggagcagaccuucaaccccagcgaccccgacugcguggacagacugcugcagugcaccagacaggccgugccccuguucagcaagaacgugcacagcaccagauucgugaccuacuucugcgagcaggugcugcccaaccugggcacccugaccacccccguggagggccuggacauccagcuggaggugcugaagcugcuggccgagaugagcagcuucugcggcgacauggagaagcuggagaccaaccugagaaagcuguucgacaagcugcuggaguacaugccccugccccccgaggaggccgagaacggcgagaacgccggcaacgaggagcccaagcugcaguucagcuacguggagugccugcuguacagcuuccaccagcugggcagaaagcugcccgacuuccugaccgccaagcugaacgccgagaagcugaaggacuucaagaucagacugcaguacuucgccagaggccugcagguguacaucagacagcugagacuggcccugcagggcaagaccggcgaggcccugaagaccgaggagaacaagaucaaggugguggcccugaagaucaccaacaacaucaacgugcugaucaaggaccuguuccacaucccccccagcuacaagagcaccgugacccugagcuggaagcccgugcagaagguggagaucggccagaagagagccagcgaggacaccaccagcggcagcccccccaagaagagcagcgccggccccaagagagacgccagacagaucuacaacccccccagcggcaaguacagcagcaaccugggcaacuucaacuacgagcagagaggcgccuucagaggcagcagaggcggcagaggcuggggcaccagaggcaacagaagcagaggcagacuguacuaa

SEQ ID NO: 13690 - RNA, 729 nt, Artificial Sequence
  APIP__Homo_sapiens__NP_057041
augagcggcugcgacgccagagagggcgacugcugcagcagaagaugcggcgcccaggacaaggagcaccccagauaccugauccccgagcugugcaagcaguucuaccaccugggcugggugaccggcaccggcggcggcaucagccugaagcacggcgacgagaucuacaucgcccccagcggcgugcagaaggagagaauccagcccgaggacauguucgugugcgacaucaacgagaaggacaucagcggccccagccccagcaagaagcugaagaagagccagugcaccccccuguucaugaacgccuacaccaugagaggcgccggcgccgugauccacacccacagcaaggccgccgugauggccacccugcuguuccccggcagagaguucaagaucacccaccaggagaugaucaagggcaucaagaagugcaccagcggcggcuacuacagauacgacgacaugcugguggugcccaucaucgagaacacccccgaggagaaggaccugaaggacagaauggcccacgccaugaacgaguaccccgacagcugcgccgugcuggugagaagacacggcguguacguguggggcgagaccugggagaaggccaagaccaugugcgagugcuacgacuaccuguucgacaucgccgugagcaugaagaaggugggccuggaccccagccagcugcccgugggcgagaacggcaucguguaa

SEQ ID NO: 13691 - RNA, 234 nt, Artificial Sequence
  APLN__Homo_sapiens__NP_059109
augaaccugagacugugcgugcaggcccugcugcugcuguggcugagccugaccgccgugugcggcggcagccugaugccccugcccgacggcaacggccuggaggacggcaacgugagacaccuggugcagcccagaggcagcagaaacggccccggccccuggcagggcggcagaagaaaguucagaagacagagacccagacugagccacaagggccccaugcccuucuaa

SEQ ID NO: 13692 - RNA, 1143 nt, Artificial Sequence
  APLNR__Homo_sapiens__NP_005152
auggaggagggcggcgacuucgacaacuacuacggcgccgacaaccagagcgagugcgaguacaccgacuggaagagcagcggcgcccugauccccgccaucuacaugcugguguuccugcugggcaccaccggcaacggccuggugcuguggaccguguucagaagcagcagagagaagagaagaagcgccgacaucuucaucgccagccuggccguggccgaccugaccuucguggugacccugccccugugggccaccuacaccuacagagacuacgacuggcccuucggcaccuucuucugcaagcugagcagcuaccugaucuucgugaacauguacgccagcguguucugccugaccggccugagcuucgacagauaccuggccaucgugagacccguggccaacgccagacugagacugagagugagcggcgccguggccaccgccgugcugugggugcuggccgcccugcuggccaugcccgugauggugcugagaaccaccggcgaccuggagaacaccaccaaggugcagugcuacauggacuacagcaugguggccaccgugagcagcgagugggccugggaggugggccugggcgugagcagcaccaccgugggcuucguggugcccuucaccaucaugcugaccugcuacuucuucaucgcccagaccaucgccggccacuucagaaaggagagaaucgagggccugagaaagagaagaagacugcugagcaucaucguggugcugguggugaccuucgcccugugcuggaugcccuaccaccuggugaagacccuguacaugcugggcagccugcugcacuggcccugcgacuucgaccuguuccugaugaacaucuuccccuacugcaccugcaucagcuacgugaacagcugccugaaccccuuccuguacgccuucuucgaccccagauucagacaggccugcaccagcaugcugugcugcggccagagcagaugcgccggcaccagccacagcagcagcggcgagaagagcgccagcuacagcagcggccacagccagggccccggccccaacaugggcaagggcggcgagcagaugcacgagaagagcauccccuacagccaggagacccuggugguggacuaa

SEQ ID NO: 13693 - RNA, 1956 nt, Artificial Sequence
  APLP1__Homo_sapiens__NP_001019978
augggccccgccagccccgccgccagaggccugagcagaagacccggccagcccccccugccccugcugcugccccugcugcugcugcugcugagagcccagcccgccaucggcagccuggccggcggcagccccggcgccgccgaggcccccggcagcgcccagguggccggccugugcggcagacugacccugcacagagaccugagaaccggcagaugggagcccgacccccagagaagcagaagaugccugagagacccccagagagugcuggaguacugcagacagauguaccccgagcugcagaucgccagaguggagcaggccacccaggccauccccauggagagauggugcggcggcagcagaagcggcagcugcgcccacccccaccaccagguggugcccuucagaugccugcccggcgaguucgugagcgaggcccugcuggugcccgagggcugcagauuccugcaccaggagagaauggaccagugcgagagcagcaccagaagacaccaggaggcccaggaggccugcagcagccagggccugauccugcacggcagcggcaugcugcugcccugcggcagcgacagauucagaggcguggaguacgugugcugccccccccccggcacccccgaccccagcggcaccgccgugggcgaccccagcaccagaagcuggccccccggcagcagaguggagggcgccgaggacgaggaggaggaggagagcuucccccagcccguggacgacuacuucguggagcccccccaggccgaggaggaggaggagaccgugcccccccccagcagccacacccuggccguggugggcaaggugacccccacccccagacccaccgacggcguggacaucuacuucggcaugcccggcgagaucagcgagcacgagggcuuccugagagccaagauggaccuggaggagagaagaaugagacagaucaacgaggugaugagagagugggccauggccgacaaccagagcaagaaccugcccaaggccgacagacaggcccugaacgagcacuuccagagcauccugcagacccuggaggagcaggugagcggcgagagacagagacugguggagacccacgccaccagagugaucgcccugaucaacgaccagagaagagccgcccuggagggcuuccuggccgcccugcaggccgaccccccccaggccgagagagugcugcuggcccugagaagauaccugagagccgagcagaaggagcagagacacacccugagacacuaccagcacguggccgccguggaccccgagaaggcccagcagaugagauuccaggugcacacccaccugcaggugaucgaggagagagugaaccagagccugggccugcuggaccagaacccccaccuggcccaggagcugagaccccagauccaggagcugcugcacagcgagcaccugggccccagcgagcuggaggcccccgcccccggcggcagcagcgaggacaagggcggccugcagccccccgacagcaaggacgccgacacccccaugacccugcccaagggcagcaccgagcaggacgccgccagccccgagaaggagaagaugaacccccuggagcaguacgagagaaaggugaacgccagcgugcccagaggcuuccccuuccacagcagcgagauccagagagacgagcuggcccccgccggcaccggcgugagcagagaggccgugagcggccugcugaucaugggcgccggcggcggcagccugaucgugcugagcaugcugcugcugagaagaaagaagcccuacggcgccaucagccacggcgugguggagguggaccccaugcugacccuggaggagcagcagcugagagagcugcagagacacggcuacgagaaccccaccuacagauuccuggaggagagacccuaa

SEQ ID NO: 13694 - RNA, 2256 nt, Artificial Sequence
  APLP2__Homo_sapiens__NP_001135748
auggccgccaccggcaccgccgccgccgccgccaccggcagacugcugcugcugcugcuggugggccugaccgcccccgcccuggcccuggccggcuacaucgaggcccuggccgccaacgccggcaccggcuucgccguggccgagccccagaucgccauguucugcggcaagcugaacaugcacgugaacauccagaccggcaagugggagcccgaccccaccggcaccaagagcugcuucgagaccaaggaggaggugcugcaguacugccaggagauguaccccgagcugcagaucaccaacgugauggaggccaaccagagagugagcaucgacaacuggugcagaagagacaagaagcagugcaagagcagauucgugacccccuucaagugccuggugggcgaguucgugagcgacgugcugcuggugcccgagaagugccaguucuuccacaaggagagaauggaggugugcgagaaccaccagcacuggcacaccguggugaaggaggccugccugacccagggcaugacccuguacagcuacggcaugcugcugcccugcggcguggaccaguuccacggcaccgaguacgugugcugcccccagaccaagaucaucggcagcgugagcaaggaggaggaggaggaggacgaggaggaggaggaggaggaggacgaggaggaggacuacgacguguacaagagcgaguuccccaccgaggccgaccuggaggacuucaccgaggccgccguggacgaggacgacgaggacgaggaggagggcgaggaggugguggaggacagagacuacuacuacgacaccuucaagggcgacgacuacaacgaggagaaccccaccgagcccggcagcgacggcaccaugagcgacaaggagaucacccacgacgugaaggccgugugcagccaggaggccaugaccggccccugcagagccgugaugcccagaugguacuucgaccugagcaagggcaagugcgugagauucaucuacggcggcugcggcggcaacagaaacaacuucgagagcgaggacuacugcauggccgugugcaaggccaugaucccccccaccccccugcccaccaacgacguggacguguacuucgagaccagcgccgacgacaacgagcacgccagauuccagaaggccaaggagcagcuggagaucagacacagaaacagaauggacagagugaagaaggagugggaggaggccgagcugcaggccaagaaccugcccaaggccgagagacagacccugauccagcacuuccaggccauggugaaggcccuggagaaggaggccgccagcgagaagcagcagcugguggagacccaccuggccagaguggaggccaugcugaacgacagaagaagaauggcccuggagaacuaccuggccgcccugcagagcgacccccccagaccccacagaauccugcaggcccugagaagauacgugagagccgagaacaaggacagacugcacaccaucagacacuaccagcacgugcuggccguggaccccgagaaggccgcccagaugaagagccaggugaugacccaccugcacgugaucgaggagagaagaaaccagagccugagccugcuguacaaggugcccuacguggcccaggagauccaggaggagaucgacgagcugcugcaggagcagagagccgacauggaccaguucaccgccagcaucagcgagacccccguggacgugagagugagcagcgaggagagcgaggagaucccccccuuccaccccuuccaccccuuccccgcccugcccgagaacgagggcagcggcgugggcgagcaggacggcggccugaucggcgccgaggagaaggugaucaacagcaagaacaagguggacgagaacauggugaucgacgagacccuggacgugaaggagaugaucuucaacgccgagagagugggcggccuggaggaggagagagagagcgugggcccccugagagaggacuucagccugagcagcagcgcccugaucggccugcuggugaucgccguggccaucgccaccgugaucgugaucagccuggugaugcugagaaagagacaguacggcaccaucagccacggcaucguggagguggaccccaugcugacccccgaggagagacaccugaacaagaugcagaaccacggcuacgagaaccccaccuacaaguaccuggagcagaugcagaucuaa

SEQ ID NO: 13695 - RNA, 867 nt, Artificial Sequence
  APOA1BP__Homo_sapiens__NP_658985
augagcagacugagagcccugcugggccugggccugcugguggccggcagcagagugcccagaaucaagagccagaccaucgccugcagaagcggccccaccugguggggcccccagagacugaacagcggcggcagaugggacagcgaggugauggccagcaccguggugaaguaccugagccaggaggaggcccaggccguggaccaggagcuguucaacgaguaccaguucagcguggaccagcugauggagcuggccggccugagcugcgccaccgccaucgccaaggccuacccccccaccagcaugagcagaagcccccccaccgugcuggugaucugcggccccggcaacaacggcggcgacggccuggugugcgccagacaccugaagcuguucggcuacgagcccaccaucuacuaccccaagagacccaacaagccccuguucaccgcccuggugacccagugccagaagauggacauccccuuccugggcgagaugcccgccgagcccaugaccaucgacgagcuguacgagcuggugguggacgccaucuucggcuucagcuucaagggcgacgugagagagcccuuccacagcauccugagcgugcugaagggccugaccgugcccaucgccagcaucgacauccccagcggcugggacguggagaagggcaacgccggcggcauccagcccgaccugcugaucagccugaccgcccccaagaagagcgccacccaguucaccggcagauaccacuaccugggcggcagauucgugccccccgcccuggagaagaaguaccagcugaaccugccccccuaccccgacaccgagugcguguacagacugcaguaa

SEQ ID NO: 13696 - RNA, 303 nt, Artificial Sequence
  APOA2__Homo_sapiens__NP_001634
augaagcugcuggccgccaccgugcugcugcugaccaucugcagccuggagggcgcccuggugagaagacaggccaaggagcccugcguggagagccuggugagccaguacuuccagaccgugaccgacuacggcaaggaccugauggagaaggugaagagccccgagcugcaggccgaggccaagagcuacuucgagaagagcaaggagcagcugaccccccugaucaagaaggccggcaccgagcuggugaacuuccugagcuacuucguggagcugggcacccagcccgccacccaguaa

SEQ ID NO: 13697 - RNA, 1191 nt, Artificial Sequence
  APOA4__Homo_sapiens__NP_000473
auguuccugaaggccguggugcugacccuggcccugguggccguggccggcgccagagccgaggugagcgccgaccagguggccaccgugaugugggacuacuucagccagcugagcaacaacgccaaggaggccguggagcaccugcagaagagcgagcugacccagcagcugaacgcccuguuccaggacaagcugggcgaggugaacaccuacgccggcgaccugcagaagaagcuggugcccuucgccaccgagcugcacgagagacuggccaaggacagcgagaagcugaaggaggagaucggcaaggagcuggaggagcugagagccagacugcugccccacgccaacgaggugagccagaagaucggcgacaaccugagagagcugcagcagagacuggagcccuacgccgaccagcugagaacccaggugagcacccaggccgagcagcugagaagacagcugacccccuacgcccagagaauggagagagugcugagagagaacgccgacagccugcaggccagccugagaccccacgccgacgagcugaaggccaagaucgaccagaacguggaggagcugaagggcagacugacccccuacgccgacgaguucaaggugaagaucgaccagaccguggaggagcugagaagaagccuggcccccuacgcccaggacacccaggagaagcugaaccaccagcuggagggccugaccuuccagaugaagaagaacgccgaggagcugaaggccagaaucagcgccagcgccgaggagcugagacagagacuggccccccuggccgaggacgugagaggcaaccugagaggcaacaccgagggccugcagaagagccuggccgagcugggcggccaccuggaccagcagguggaggaguucagaagaagaguggagcccuacggcgagaacuucaacaaggcccuggugcagcagauggagcagcugagacagaagcugggcccccacgccggcgacguggagggccaccugagcuuccuggagaaggaccugagagacaaggugaacagcuucuucagcaccuucaaggagaaggagagccaggacaagacccugagccugcccgagcuggagcagcagcaggagcagcagcaggagcagcagcaggagcaggugcagaugcuggccccccuggagagcuaa

SEQ ID NO: 13698 - RNA, 1101 nt, Artificial Sequence
  APOA5__Homo_sapiens__NP_001160070
auggccagcauggccgccgugcugaccugggcccuggcccugcugagcgccuucagcgccacccaggccagaaagggcuucugggacuacuucagccagaccagcggcgacaagggcagaguggagcagauccaccagcagaagauggccagagagcccgccacccugaaggacagccuggagcaggaccugaacaacaugaacaaguuccuggagaagcugagaccccugagcggcagcgaggcccccagacugccccaggaccccgugggcaugagaagacagcugcaggaggagcuggaggaggugaaggccagacugcagcccuacauggccgaggcccacgagcuggugggcuggaaccuggagggccugagacagcagcugaagcccuacaccauggaccugauggagcagguggcccugagagugcaggagcugcaggagcagcugagaguggugggcgaggacaccaaggcccagcugcugggcggcguggacgaggccugggcccugcugcagggccugcagagcagaguggugcaccacaccggcagauucaaggagcuguuccaccccuacgccgagagccuggugagcggcaucggcagacacgugcaggagcugcacagaagcguggccccccacgcccccgccagccccgccagacugagcagaugcgugcaggugcugagcagaaagcugacccugaaggccaaggcccugcacgccagaauccagcagaaccuggaccagcugagagaggagcugagcagagccuucgccggcaccggcaccgaggagggcgccggccccgacccccagaugcugagcgaggaggugagacagagacugcaggccuucagacaggacaccuaccugcagaucgccgccuucaccagagccaucgaccaggagaccgaggaggugcagcagcagcuggccccccccccccccggccacagcgccuucgcccccgaguuccagcagaccgacagcggcaaggugcugagcaagcugcaggccagacuggacgaccugugggaggacaucacccacagccugcacgaccagggccacagccaccugggcgaccccuaa

SEQ ID NO: 13699 - RNA, 711 nt, Artificial Sequence
  APOBEC1__Homo_sapiens__NP_001291495
augaccagcgagaagggccccagcaccggcgaccccacccugagaagaagaaucgagcccugggaguucgacguguucuacgaccccagagagcugagaaaggaggccugccugcuguacgagaucaaguggggcaugagcagaaagaucuggagaagcagcggcaagaacaccaccaaccacguggaggugaacuucaucaagaaguucaccagcgagagagacuuccaccccagcaugagcugcagcaucaccugguuccugagcuggagccccugcugggagugcagccaggccaucagagaguuccugagcagacaccccggcgugacccuggugaucuacguggccagacuguucuggcacauggaccagcagaacagacagggccugagagaccuggugaacagcggcgugaccauccagaucaugagagccagcgaguacuaccacugcuggagaaacuucgugaacuacccccccggcgacgaggcccacuggccccaguaccccccccuguggaugaugcuguacgcccuggagcugcacugcaucauccugagccugccccccugccugaagaucagcagaagauggcagaaccaccugaccuucuucagacugcaccugcagaacugccacuaccagaccauccccccccacauccugcuggccaccggccugauccaccccagcguggccuggagauaa

SEQ ID NO: 13700 - RNA, 675 nt, Artificial Sequence
  APOBEC2__Homo_sapiens__NP_006780
auggcccagaaggaggaggccgccguggccaccgaggccgccagccagaacggcgaggaccuggagaaccuggacgaccccgagaagcugaaggagcugaucgagcugccccccuucgagaucgugaccggcgagagacugcccgccaacuucuucaaguuccaguucagaaacguggaguacagcagcggcagaaacaagaccuuccugugcuacgugguggaggcccagggcaagggcggccaggugcaggccagcagaggcuaccuggaggacgagcacgccgccgcccacgccgaggaggccuucuucaacaccauccugcccgccuucgaccccgcccugagauacaacgugaccugguacgugagcagcagccccugcgccgccugcgccgacagaaucaucaagacccugagcaagaccaagaaccugagacugcugauccuggugggcagacuguucaugugggaggagcccgagauccaggccgcccugaagaagcugaaggaggccggcugcaagcugagaaucaugaagccccaggacuucgaguacguguggcagaacuucguggagcaggaggagggcgagagcaaggccuuccagcccugggaggacauccaggagaacuuccuguacuacgaggagaagcuggccgacauccugaaguaa

SEQ ID NO: 13701 - RNA, 600 nt, Artificial Sequence
  APOBEC3A_B__Homo_sapiens__XP_011545347
auggaggccagccccgccagcggccccagacaccugauggacccccacaucuucaccagcaacuucaacaacggcaucggcagacacaagaccuaccugugcuacgagguggagagacuggacaacggcaccagcgugaagauggaccagcacagaggcuuccugcacaaccaggccaagaaccugcugugcggcuucuacggcagacacgccgagcugagauuccuggaccuggugcccagccugcagcuggaccccgcccagaucuacagagugaccugguucaucagcuggagccccugcuucagcuggggcugcgccggcgaggugagagccuuccugcaggagaacacccacgugagacugagaaucuucgccgccagaaucuacgacuacgacccccuguacaaggaggcccugcagaugcugagagacgccggcgcccaggugagcaucaugaccuacgacgaguucaagcacugcugggacaccuucguggaccaccagggcugccccuuccagcccugggacggccuggacgagcacagccaggcccugagcggcagacugagagccauccugcagaaccagggcaacuaa

SEQ ID NO: 13702 - RNA, 1074 nt, Artificial Sequence
  APOBEC3B__Homo_sapiens__NP_001257340
augaacccccagaucagaaaccccauggagagaauguacagagacaccuucuacgacaacuucgagaacgagcccauccuguacggcagaagcuacaccuggcugugcuacgaggugaagaucaagagaggcagaagcaaccugcugugggacaccggcguguucagaggccagguguacuucaagccccaguaccacgccgagaugugcuuccugagcugguucugcggcaaccagcugcccgccuacaagugcuuccagaucaccugguucgugagcuggacccccugccccgacugcguggccaagcuggccgaguuccugagcgagcaccccaacgugacccugaccaucagcgccgccagacuguacuacuacugggagagagacuacagaagagcccugugcagacugagccaggccggcgccagagugaagaucauggacuacgaggaguucgccuacugcugggagaacuucguguacaacgagggccagcaguucaugcccugguacaaguucgacgagaacuacgccuuccugcacagaacccugaaggagauccugagauaccugauggaccccgacaccuucaccuucaacuucaacaacgacccccuggugcugagaagaagacagaccuaccugugcuacgagguggagagacuggacaacggcaccugggugcugauggaccagcacaugggcuuccugugcaacgagcuggaccccgcccagaucuacagagugaccugguucaucagcuggagccccugcuucagcuggggcugcgccggcgaggugagagccuuccugcaggagaacacccacgugagacugagaaucuucgccgccagaaucuacgacuacgacccccuguacaaggaggcccugcagaugcugagagacgccggcgcccaggugagcaucaugaccuacgacgaguucgaguacugcugggacaccuucguguacagacagggcugccccuuccagcccugggacggccuggaggagcacagccaggcccugagcggcagacugagagccauccugcagaaccagggcaacuaa

SEQ ID NO: 13703 - RNA, 573 nt, Artificial Sequence
  APOBEC3C__Homo_sapiens__NP_055323
augaacccccagaucagaaaccccaugaaggccauguaccccggcaccuucuacuuccaguucaagaaccugugggaggccaacgacagaaacgagaccuggcugugcuucaccguggagggcaucaagagaagaagcguggugagcuggaagaccggcguguucagaaaccagguggacagcgagacccacugccacgccgagagaugcuuccugagcugguucugcgacgacauccugagccccaacaccaaguaccaggugaccugguacaccagcuggagccccugccccgacugcgccggcgagguggccgaguuccuggccagacacagcaacgugaaccugaccaucuucaccgccagacuguacuacuuccaguaccccugcuaccaggagggccugagaagccugagccaggagggcguggccguggagaucauggacuacgaggacuucaaguacugcugggagaacuucguguacaacgacaacgagcccuucaagcccuggaagggccugaagaccaacuucagacugcugaagagaagacugagagagagccugcaguaa

SEQ ID NO: 13704 - RNA, 306 nt, Artificial Sequence
  APOBEC3F__Homo_sapiens__NP_001006667
augaagccccacuucagaaacaccguggagagaauguacagagacaccuucagcuacaacuucuacaacagacccauccugagcagaagaaacaccguguggcugugcuacgaggugaagaccaagggccccagcagacccagacuggacgccaagaucuucagaggccaggugcccagaagcuucaucagagcccccuuccaggugcugagcagccccuucggccagugcgcccccccccacggcaccgcccaggugcaguggcccccccagcugaccgccggcagagagcagggcagacccuaa

SEQ ID NO: 13705 - RNA, 1155 nt, Artificial Sequence
  APOBEC3G__Homo_sapiens__NP_068594
augaagccccacuucagaaacaccguggagagaauguacagagacaccuucagcuacaacuucuacaacagacccauccugagcagaagaaacaccguguggcugugcuacgaggugaagaccaagggccccagcagacccccccuggacgccaagaucuucagaggccagguguacagcgagcugaaguaccaccccgagaugagauucuuccacugguucagcaaguggagaaagcugcacagagaccaggaguacgaggugaccugguacaucagcuggagccccugcaccaagugcaccagagacauggccaccuuccuggccgaggaccccaaggugacccugaccaucuucguggccagacuguacuacuucugggaccccgacuaccaggaggcccugagaagccugugccagaagagagacggccccagagccaccaugaagaucaugaacuacgacgaguuccagcacugcuggagcaaguucguguacagccagagagagcuguucgagcccuggaacaaccugcccaaguacuacauccugcugcacaucaugcugggcgagauccugagacacagcauggacccccccaccuucaccuucaacuucaacaacgagcccugggugagaggcagacacgagaccuaccugugcuacgagguggagagaaugcacaacgacaccugggugcugcugaaccagagaagaggcuuccugugcaaccaggccccccacaagcacggcuuccuggagggcagacacgccgagcugugcuuccuggacgugauccccuucuggaagcuggaccuggaccaggacuacagagugaccugcuucaccagcuggagccccugcuucagcugcgcccaggagauggccaaguucaucagcaagaacaagcacgugagccugugcaucuucaccgccagaaucuacgacgaccagggcagaugccaggagggccugagaacccuggccgaggccggcgccaagaucagcaucaugaccuacagcgaguucaagcacugcugggacaccuucguggaccaccagggcugccccuuccagcccugggacggccuggacgagcacagccaggaccugagcggcagacugagagccauccugcagaaccaggagaacuaa

SEQ ID NO: 13706 - RNA, 549 nt, Artificial Sequence
  APOBEC3H__Homo_sapiens__NP_001159474
auggcccugcugaccgccgagaccuucagacugcaguucaacaacaagagaagacugagaagacccuacuaccccagaaaggcccugcugugcuaccagcugaccccccagaacggcagcacccccaccagaggcuacuucgagaacaagaagaagugccacgccgagaucugcuucaucaacgagaucaagagcaugggccuggacgagacccagugcuaccaggugaccugcuaccugaccuggagccccugcagcagcugcgccugggagcugguggacuucaucaaggcccacgaccaccugaaccugggcaucuucgccagcagacuguacuaccacuggugcaagccccagcagaagggccugagacugcugugcggcagccaggugcccguggaggugaugggcuuccccgaguucgccgacugcugggagaacuucguggaccacgagaagccccugagcuucaaccccuacaagaugcuggaggagcuggacaagaacagcagagccaucaagagaagacuggagagaaucaagagcuaa

SEQ ID NO: 13707 - RNA, 13692 nt, Artificial Sequence
  APOB__Homo_sapiens__NP_000375
auggacccccccagacccgcccugcuggcccugcuggcccugcccgcccugcugcugcugcugcuggccggcgccagagccgaggaggagaugcuggagaacgugagccuggugugccccaaggacgccaccagauucaagcaccugagaaaguacaccuacaacuacgaggccgagagcagcagcggcgugcccggcaccgccgacagcagaagcgccaccagaaucaacugcaagguggagcuggaggugccccagcugugcagcuucauccugaagaccagccagugcacccugaaggagguguacggcuucaaccccgagggcaaggcccugcugaagaagaccaagaacagcgaggaguucgccgccgccaugagcagauacgagcugaagcuggccauccccgagggcaagcagguguuccuguaccccgagaaggacgagcccaccuacauccugaacaucaagagaggcaucaucagcgcccugcuggugccccccgagaccgaggaggccaagcaggugcuguuccuggacaccguguacggcaacugcagcacccacuucaccgugaagaccagaaagggcaacguggccaccgagaucagcaccgagagagaccugggccagugcgacagauucaagcccaucagaaccggcaucagcccccuggcccugaucaagggcaugaccagaccccugagcacccugaucagcagcagccagagcugccaguacacccuggacgccaagagaaagcacguggccgaggccaucugcaaggagcagcaccuguuccugcccuucagcuacaagaacaaguacggcaugguggcccaggugacccagacccugaagcuggaggacacccccaagaucaacagcagauucuucggcgagggcaccaagaagaugggccuggccuucgagagcaccaagagcaccagcccccccaagcaggccgaggccgugcugaagacccugcaggagcugaagaagcugaccaucagcgagcagaacauccagagagccaaccuguucaacaagcuggugaccgagcugagaggccugagcgacgaggccgugaccagccugcugccccagcugaucgaggugagcagccccaucacccugcaggcccuggugcagugcggccagccccagugcagcacccacauccugcaguggcugaagagagugcacgccaacccccugcugaucgacguggugaccuaccugguggcccugauccccgagcccagcgcccagcagcugagagagaucuucaacauggccagagaccagagaagcagagccacccuguacgcccugagccacgccgugaacaacuaccacaagaccaaccccaccggcacccaggagcugcuggacaucgccaacuaccugauggagcagauccaggacgacugcaccggcgacgaggacuacaccuaccugauccugagagugaucggcaacaugggccagaccauggagcagcugacccccgagcugaagagcagcauccugaagugcgugcagagcaccaagcccagccugaugauccagaaggccgccauccaggcccugagaaagauggagcccaaggacaaggaccaggaggugcugcugcagaccuuccuggacgacgccagccccggcgacaagagacuggccgccuaccugaugcugaugagaagccccagccaggccgacaucaacaagaucgugcagauccugcccugggagcagaacgagcaggugaagaacuucguggccagccacaucgccaacauccugaacagcgaggagcuggacauccaggaccugaagaagcuggugaaggaggcccugaaggagagccagcugcccaccgugauggacuucagaaaguucagcagaaacuaccagcuguacaagagcgugagccugcccagccuggaccccgccagcgccaagaucgagggcaaccugaucuucgaccccaacaacuaccugcccaaggagagcaugcugaagaccacccugaccgccuucggcuucgccagcgccgaccugaucgagaucggccuggagggcaagggcuucgagcccacccuggaggcccuguucggcaagcagggcuucuuccccgacagcgugaacaaggcccuguacugggugaacggccaggugcccgacggcgugagcaaggugcugguggaccacuucggcuacaccaaggacgacaagcacgagcaggacauggugaacggcaucaugcugagcguggagaagcugaucaaggaccugaagagcaaggaggugcccgaggccagagccuaccugagaauccugggcgaggagcugggcuucgccagccugcacgaccugcagcugcugggcaagcugcugcugaugggcgccagaacccugcagggcaucccccagaugaucggcgaggugaucagaaagggcagcaagaacgacuucuuccugcacuacaucuucauggagaacgccuucgagcugcccaccggcgccggccugcagcugcagaucagcagcagcggcgugaucgcccccggcgccaaggccggcgugaagcuggagguggccaacaugcaggccgagcugguggccaagcccagcgugagcguggaguucgugaccaacaugggcaucaucauccccgacuucgccagaagcggcgugcagaugaacaccaacuucuuccacgagagcggccuggaggcccacguggcccugaaggccggcaagcugaaguucaucauccccagccccaagagacccgugaagcugcugagcggcggcaacacccugcaccuggugagcaccaccaagaccgaggugauccccccccugaucgagaacagacagagcuggagcgugugcaagcagguguuccccggccugaacuacugcaccagcggcgccuacagcaacgccagcagcaccgacagcgccagcuacuacccccugaccggcgacaccagacuggagcuggagcugagacccaccggcgagaucgagcaguacagcgugagcgccaccuacgagcugcagagagaggacagagcccugguggacacccugaaguucgugacccaggccgagggcgccaagcagaccgaggccaccaugaccuucaaguacaacagacagagcaugacccugagcagcgaggugcagauccccgacuucgacguggaccugggcaccauccugagagugaacgacgagagcaccgagggcaagaccagcuacagacugacccuggacauccagaacaagaagaucaccgagguggcccugaugggccaccugagcugcgacaccaaggaggagagaaagaucaagggcgugaucagcauccccagacugcaggccgaggccagaagcgagauccuggcccacuggagccccgccaagcugcugcugcagauggacagcagcgccaccgccuacggcagcaccgugagcaagagaguggccuggcacuacgacgaggagaagaucgaguucgaguggaacaccggcaccaacguggacaccaagaagaugaccagcaacuuccccguggaccugagcgacuaccccaagagccugcacauguacgccaacagacugcuggaccacagagugccccagaccgacaugaccuucagacacgugggcagcaagcugaucguggccaugagcagcuggcugcagaaggccagcggcagccugcccuacacccagacccugcaggaccaccugaacagccugaaggaguucaaccugcagaacaugggccugcccgacuuccacauccccgagaaccuguuccugaagagcgacggcagagugaaguacacccugaacaagaacagccugaagaucgagaucccccugcccuucggcggcaagagcagcagagaccugaagaugcuggagaccgugagaacccccgcccugcacuucaagagcgugggcuuccaccugcccagcagagaguuccaggugcccaccuucaccauccccaagcuguaccagcugcaggugccccugcugggcgugcuggaccugagcaccaacguguacagcaaccuguacaacuggagcgccagcuacagcggcggcaacaccagcaccgaccacuucagccugagagccagauaccacaugaaggccgacagcgugguggaccugcugagcuacaacgugcagggcagcggcgagaccaccuacgaccacaagaacaccuucacccugagcugcgacggcagccugagacacaaguuccuggacagcaacaucaaguucagccacguggagaagcugggcaacaaccccgugagcaagggccugcugaucuucgacgccagcagcagcuggggcccccagaugagcgccagcgugcaccuggacagcaagaagaagcagcaccuguucgugaaggaggugaagaucgacggccaguucagagugagcagcuucuacgccaagggcaccuacggccugagcugccagagagaccccaacaccggcagacugaacggcgagagcaaccugagauucaacagcagcuaccugcagggcaccaaccagaucaccggcagauacgaggacggcacccugagccugaccagcaccagcgaccugcagagcggcaucaucaagaacaccgccagccugaaguacgagaacuacgagcugacccugaagagcgacaccaacggcaaguacaagaacuucgccaccagcaacaagauggacaugaccuucagcaagcagaacgcccugcugagaagcgaguaccaggccgacuacgagagccugagauucuucagccugcugagcggcagccugaacagccacggccuggagcugaacgccgacauccugggcaccgacaagaucaacagcggcgcccacaaggccacccugagaaucggccaggacggcaucagcaccagcgccaccaccaaccugaagugcagccugcuggugcuggagaacgagcugaacgccgagcugggccugagcggcgccagcaugaagcugaccaccaacggcagauucagagagcacaacgccaaguucagccuggacggcaaggccgcccugaccgagcugagccugggcagcgccuaccaggccaugauccugggcguggacagcaagaacaucuucaacuucaaggugagccaggagggccugaagcugagcaacgacaugaugggcagcuacgccgagaugaaguucgaccacaccaacagccugaacaucgccggccugagccuggacuucagcagcaagcuggacaacaucuacagcagcgacaaguucuacaagcagaccgugaaccugcagcugcagcccuacagccuggugaccacccugaacagcgaccugaaguacaacgcccuggaccugaccaacaacggcaagcugagacuggagccccugaagcugcacguggccggcaaccugaagggcgccuaccagaacaacgagaucaagcacaucuacgccaucagcagcgccgcccugagcgccagcuacaaggccgacaccguggccaaggugcagggcguggaguucagccacagacugaacaccgacaucgccggccuggccagcgccaucgacaugagcaccaacuacaacagcgacagccugcacuucagcaacguguucagaagcgugauggcccccuucaccaugaccaucgacgcccacaccaacggcaacggcaagcuggcccuguggggcgagcacaccggccagcuguacagcaaguuccugcugaaggccgagccccuggccuucaccuucagccacgacuacaagggcagcaccagccaccaccuggugagcagaaagagcaucagcgccgcccuggagcacaaggugagcgcccugcugacccccgccgagcagaccggcaccuggaagcugaagacccaguucaacaacaacgaguacagccaggaccuggacgccuacaacaccaaggacaagaucggcguggagcugaccggcagaacccuggccgaccugacccugcuggacagccccaucaaggugccccugcugcugagcgagcccaucaacaucaucgacgcccuggagaugagagacgccguggagaagccccaggaguucaccaucguggccuucgugaaguacgacaagaaccaggacgugcacagcaucaaccugcccuucuucgagacccugcaggaguacuucgagagaaacagacagaccaucaucguggugcuggagaacgugcagagaaaccugaagcacaucaacaucgaccaguucgugagaaaguacagagccgcccugggcaagcugccccagcaggccaacgacuaccugaacagcuucaacugggagagacaggugagccacgccaaggagaagcugaccgcccugaccaagaaguacagaaucaccgagaacgacauccagaucgcccuggacgacgccaagaucaacuucaacgagaagcugagccagcugcagaccuacaugauccaguucgaccaguacaucaaggacagcuacgaccugcacgaccugaagaucgccaucgccaacaucaucgacgagaucaucgagaagcugaagagccuggacgagcacuaccacaucagagugaaccuggugaagaccauccacgaccugcaccuguucaucgagaacaucgacuucaacaagagcggcagcagcaccgccagcuggauccagaacguggacaccaaguaccagaucagaauccagauccaggagaagcugcagcagcugaagagacacauccagaacaucgacauccagcaccuggccggcaagcugaagcagcacaucgaggccaucgacgugagagugcugcuggaccagcugggcaccaccaucagcuucgagagaaucaacgacgugcuggagcacgugaagcacuucgugaucaaccugaucggcgacuucgagguggccgagaagaucaacgccuucagagccaaggugcacgagcugaucgagagauacgagguggaccagcagauccaggugcugauggacaagcugguggagcuggcccaccaguacaagcugaaggagaccauccagaagcugagcaacgugcugcagcaggugaagaucaaggacuacuucgagaagcuggugggcuucaucgacgacgccgugaagaagcugaacgagcugagcuucaagaccuucaucgaggacgugaacaaguuccuggacaugcugaucaagaagcugaagagcuucgacuaccaccaguucguggacgagaccaacgacaagaucagagaggugacccagagacugaacggcgagauccaggcccuggagcugccccagaaggccgaggcccugaagcuguuccuggaggagaccaaggccaccguggccguguaccuggagagccugcaggacaccaagaucacccugaucaucaacuggcugcaggaggcccugagcagcgccagccuggcccacaugaaggccaaguucagagagacccuggaggacaccagagacagaauguaccagauggacauccagcaggagcugcagagauaccugagccuggugggccagguguacagcacccuggugaccuacaucagcgacugguggacccuggccgccaagaaccugaccgacuucgccgagcaguacagcauccaggacugggccaagagaaugaaggcccugguggagcagggcuucaccgugcccgagaucaagaccauccugggcaccaugcccgccuucgaggugagccugcaggcccugcagaaggccaccuuccagacccccgacuucaucgugccccugaccgaccugagaauccccagcgugcagaucaacuucaaggaccugaagaacaucaagauccccagcagauucagcacccccgaguucaccauccugaacaccuuccacauccccagcuucaccaucgacuucguggagaugaaggugaagaucaucagaaccaucgaccagaugcugaacagcgagcugcaguggcccgugcccgacaucuaccugagagaccugaagguggaggacaucccccuggccagaaucacccugcccgacuucagacugcccgagaucgccauccccgaguucaucauccccacccugaaccugaacgacuuccaggugcccgaccugcacauccccgaguuccagcugccccacaucagccacaccaucgaggugcccaccuucggcaagcuguacagcauccugaagauccagagcccccuguucacccuggacgccaacgccgacaucggcaacggcaccaccagcgccaacgaggccggcaucgccgccagcaucaccgccaagggcgagagcaagcuggaggugcugaacuucgacuuccaggccaacgcccagcugagcaaccccaagaucaacccccuggcccugaaggagagcgugaaguucagcagcaaguaccugagaaccgagcacggcagcgagaugcuguucuucggcaacgccaucgagggcaagagcaacaccguggccagccugcacaccgagaagaacacccuggagcugagcaacggcgugaucgugaagaucaacaaccagcugacccuggacagcaacaccaaguacuuccacaagcugaacauccccaagcuggacuucagcagccaggccgaccugagaaacgagaucaagacccugcugaaggccggccacaucgccuggaccagcagcggcaagggcagcuggaagugggccugccccagauucagcgacgagggcacccacgagagccagaucagcuucaccaucgagggcccccugaccagcuucggccugagcaacaagaucaacagcaagcaccugagagugaaccagaaccugguguacgagagcggcagccugaacuucagcaagcuggagauccagagccagguggacagccagcacgugggccacagcgugcugaccgccaagggcauggcccuguucggcgagggcaaggccgaguucaccggcagacacgacgcccaccugaacggcaaggugaucggcacccugaagaacagccuguucuucagcgcccagcccuucgagaucaccgccagcaccaacaacgagggcaaccugaaggugagauucccccugagacugaccggcaagaucgacuuccugaacaacuacgcccuguuccugagccccagcgcccagcaggccagcuggcaggugagcgccagauucaaccaguacaaguacaaccagaacuucagcgccggcaacaacgagaacaucauggaggcccacgugggcaucaacggcgaggccaaccuggacuuccugaacaucccccugaccauccccgagaugagacugcccuacaccaucaucaccacccccccccugaaggacuucagccugugggagaagaccggccugaaggaguuccugaagaccaccaagcagagcuucgaccugagcgugaaggcccaguacaagaagaacaagcacagacacagcaucaccaacccccuggccgugcugugcgaguucaucagccagagcaucaagagcuucgacagacacuucgagaagaacagaaacaacgcccuggacuucgugaccaagagcuacaacgagaccaagaucaaguucgacaaguacaaggccgagaagagccacgacgagcugcccagaaccuuccagauccccggcuacaccgugcccguggugaacguggaggugagccccuucaccaucgagaugagcgccuucggcuacguguuccccaaggccgugagcaugcccagcuucagcauccugggcagcgacgugagagugcccagcuacacccugauccugcccagccuggagcugcccgugcugcacgugcccagaaaccugaagcugagccugcccgacuucaaggagcugugcaccaucagccacaucuucauccccgccaugggcaacaucaccuacgacuucagcuucaagagcagcgugaucacccugaacaccaacgccgagcuguucaaccagagcgacaucguggcccaccugcugagcagcagcagcagcgugaucgacgcccugcaguacaagcuggagggcaccaccagacugaccagaaagagaggccugaagcuggccaccgcccugagccugagcaacaaguucguggagggcagccacaacagcaccgugagccugaccaccaagaacauggaggugagcguggccaccaccaccaaggcccagauccccauccugagaaugaacuucaagcaggagcugaacggcaacaccaagagcaagcccaccgugagcagcagcauggaguucaaguacgacuucaacagcagcaugcuguacagcaccgccaagggcgccguggaccacaagcugagccuggagagccugaccagcuacuucagcaucgagagcagcaccaagggcgacgugaagggcagcgugcugagcagagaguacagcggcaccaucgccagcgaggccaacaccuaccugaacagcaagagcaccagaagcagcgugaagcugcagggcaccagcaagaucgacgacaucuggaaccuggaggugaaggagaacuucgccggcgaggccacccugcagagaaucuacagccugugggagcacagcaccaagaaccaccugcagcuggagggccuguucuucaccaacggcgagcacaccagcaaggccacccuggagcugagccccuggcagaugagcgcccuggugcaggugcacgccagccagcccagcagcuuccacgacuuccccgaccugggccaggagguggcccugaacgccaacaccaagaaccagaagaucagauggaagaacgaggugagaauccacagcggcagcuuccagagccagguggagcugagcaacgaccaggagaaggcccaccuggacaucgccggcagccuggagggccaccugagauuccugaagaacaucauccugcccguguacgacaagagccugugggacuuccugaagcuggacgugaccaccagcaucggcagaagacagcaccugagagugagcaccgccuucguguacaccaagaaccccaacggcuacagcuucagcauccccgugaaggugcuggccgacaaguucaucauccccggccugaagcugaacgaccugaacagcgugcuggugaugcccaccuuccacgugcccuucaccgaccugcaggugcccagcugcaagcuggacuucagagagauccagaucuacaagaagcugagaaccagcagcuucgcccugaaccugcccacccugcccgaggugaaguuccccgagguggacgugcugaccaaguacagccagcccgaggacagccugauccccuucuucgagaucaccgugcccgagagccagcugaccgugagccaguucacccugcccaagagcgugagcgacggcaucgccgcccuggaccugaacgccguggccaacaagaucgccgacuucgagcugcccaccaucaucgugcccgagcagaccaucgagauccccagcaucaaguucagcgugcccgccggcaucgugauccccagcuuccaggcccugaccgccagauucgagguggacagccccguguacaacgccaccuggagcgccagccugaagaacaaggccgacuacguggagaccgugcuggacagcaccugcagcagcaccgugcaguuccuggaguacgagcugaacgugcugggcacccacaagaucgaggacggcacccuggccagcaagaccaagggcaccuucgcccacagagacuucagcgccgaguacgaggaggacggcaaguacgagggccugcaggagugggagggcaaggcccaccugaacaucaagagccccgccuucaccgaccugcaccugagauaccagaaggacaagaagggcaucagcaccagcgccgccagccccgccgugggcaccgugggcauggacauggacgaggacgacgacuucagcaaguggaacuucuacuacagcccccagagcagccccgacaagaagcugaccaucuucaagaccgagcugagagugagagagagcgacgaggagacccagaucaaggugaacugggaggaggaggccgccagcggccugcugaccagccugaaggacaacgugcccaaggccaccggcgugcuguacgacuacgugaacaaguaccacugggagcacaccggccugacccugagagaggugagcagcaagcugagaagaaaccugcagaacaacgccgaguggguguaccagggcgccaucagacagaucgacgacaucgacgugagauuccagaaggccgccagcggcaccaccggcaccuaccaggaguggaaggacaaggcccagaaccuguaccaggagcugcugacccaggagggccaggccagcuuccagggccugaaggacaacguguucgacggccuggugagagugacccaggaguuccacaugaaggugaagcaccugaucgacagccugaucgacuuccugaacuuccccagauuccaguuccccggcaagcccggcaucuacaccagagaggagcugugcaccauguucaucagagaggugggcaccgugcugagccagguguacagcaaggugcacaacggcagcgagauccuguucagcuacuuccaggaccuggugaucacccugcccuucgagcugagaaagcacaagcugaucgacgugaucagcauguacagagagcugcugaaggaccugagcaaggaggcccaggagguguucaaggccauccagagccugaagaccaccgaggugcugagaaaccugcaggaccugcugcaguucaucuuccagcugaucgaggacaacaucaagcagcugaaggagaugaaguucaccuaccugaucaacuacauccaggacgagaucaacaccaucuucagcgacuacauccccuacguguucaagcugcugaaggagaaccugugccugaaccugcacaaguucaacgaguucauccagaacgagcugcaggaggccagccaggagcugcagcagauccaccaguacaucauggcccugagagaggaguacuucgaccccagcaucgugggcuggaccgugaaguacuacgagcuggaggagaagaucgugagccugaucaagaaccugcugguggcccugaaggacuuccacagcgaguacaucgugagcgccagcaacuucaccagccagcugagcagccagguggagcaguuccugcacagaaacauccaggaguaccugagcauccugaccgaccccgacggcaagggcaaggagaagaucgccgagcugagcgccaccgcccaggagaucaucaagagccaggccaucgccaccaagaagaucaucagcgacuaccaccagcaguucagauacaagcugcaggacuucagcgaccagcugagcgacuacuacgagaaguucaucgccgagagcaagagacugaucgaccugagcauccagaacuaccacaccuuccugaucuacaucaccgagcugcugaagaagcugcagagcaccaccgugaugaaccccuacaugaagcuggcccccggcgagcugaccaucauccuguaa

SEQ ID NO: 13708 - RNA, 3294 nt, Artificial Sequence
  APOBR__Homo_sapiens__NP_061160
auggacuuccugagacuguaccugcccggccugcaccaggcccugagaggcgcccuggacagccugggcaccuucgugagcuaccugcugggcgacgccgugcccaccguggagagagaggcccaggccgccgaggagcugggcgugguggccgugggcaagaccggcaagaucguggaggaggaggcccaggaggaccuggagggccugagaggcagccagaacgagggcgccggcagacugagaggccccggcgacgacagaagacacgaggugggcagcagcgccguggagcagaccuggggcuggggcgacggcagcagccacggcagccaggccgagagacaggacagcggcgccggcgagaccgccaaggccgccagaugccaggagcccagcgcccaccuggaggccagaaagaagagcaaggccggcagcggcgccugccaggacagaagcggccaggcccaggagagacaggagagccacgagcaggaggugaacagagaggagagacugagaagcugggagcaggaggaggaggaggaggaggugagagccagagagcccggcauggccagaggcgccgagagcgaguggaccuggcacggcgagaccgagggcaaggccggcgccgugggccccaaggccgccggcgacaacagagagauggagcagggcgugagagaggccgacgccggcgagaccgaggagcccggcgccgagggcgccggcaagggcgaggaggugguggugguggagaaggccugcgagagcaccagagccuggggcaccuggggccccggcgccgagcccgaggacuggggcauccugggcagagaggaggccagaaccacccccggcagagaggaggccagagccauccuggacggcgaggaggccagaaccaucagcggcggcgaggaggccgagaccgccagcggcggcgaggaggccgagaccgccagcggcggcgaggaggccggcaccgccagcggcggcgaggaggccggcaucgccagcggcggcgaggccggcaccgccagcggcggcgaggaggccggcaccgccagcggcggcgaggaggccggcaccgccagcggcggcgacgaggccuggaccaccagcggcaaggaggaggccgaccugcugggcgugagacagaccgaguacggcgccgugcccggcgagagacugcuggaggccaccggcaaggugugggugcuggaggaggagggcgacgaggagagagaggccgaggugagccccuuccccaagcagccccaggugcugggcaccgagagaaccgaggaggccgccgagagccagaccgccggcagagaggccgugggcggccaggaggccggcgagagcuucgagggccagguggaccugagaggcaaggaggccgagaugagacaggaccugggcaucagagccgacagagccagaauggaggagcuggugcaggccgaggaggcccaggaggagagaggcagcagcagagaccccguggccgagcugcccagcgacggcgaggccgagggcaccgccgaccuggaggccacccccgaggccagacccgaggaggagcugaccggcgaggagagcgaggccgcccagaccagcugcggccugcugggcguggaguggggcggccugacccacagcgugaccaagggccagggccccgagcugaugggcggcgcccagacccccaccaagcagcccgaggagagagaggccggcgagguggagcugaugggcgugcuggcccugagcaaggaggagcaggagagaagccuggaggccggccccagacacgccggcagcgugaagcccgaggccagcgaggccuuccccggcgccugggagaacagaaccagaaaggacauggagagaggcaacacccaggaggacgccgccgacggcgagcagagagaggaggaggagaccgccggcggccagacccuggccgccgaggccgagggcgacagagagagcgagcugagcgaggugcccgaggccggcggcgagggccugaccacccaggacgccggcugcggcaccgaggagggcgaggccagcgugagcgagaaccaggagcuggacggcagcaccggcgccgacgccggccccugccccagccugggcgaggccuacgccagagagaccgaggacgaggaggccgaggccgacagaaccagcagaagaggcuggagacugcaggccguggccgugggccugcccgacagagaggacgcccagaccggcagcguggccgccggcaucaugggcggcgacguggugccccacaucagcgccgccggcgccggcgaggcccuggagggcgugcugggccagggcugggacagcaaggagaaggaggaggccgccgccggcgagcacgccggcggccaggaguucggccuggagggcagcgccgaggaggaggugaccggcagaggcagccagguggaggccuucgagagcagagagggcggccccuggggcggcagaguggaggccgaggagagcgccggcgccgaggacagcugcggccuggaccccgccggcagccagaccgccagagccgagggcaugggcgccaugguggaggccggcggccugcuggagaaguggacccugcuggaggaggaggccgugggcuggcaggagagagagcagagagaggacagcgagggcagaugcggcgacuaccaccccgagggcgaggcccccagacugcuggacgccgagggccugauggugaccggcggcagaagagccgaggccaaggagaccgagcccgagagccuggagcacgugagaggccaggaggagcagcccacccaccaggcccccgccgaggccgcccccgagagcgugggcgaggccgagaccgccgaggccaugggcagcgccagaggcggcgccgccaacagcuggagcgaggccccccugcccggcagccugcuggacgugagcgugcccagaagcagagugcaccugagcagaagcagcagccagagaagaagcagacccagcuucagaagaacccccgccugggagcagcaggaggagccccccgcccccaacccccccgaggaggagcugagcgcccccgagcagagaccccugcagcuggaggagccccuggagcccagcccccugagacacgacggcacccccgugcccgccagaagaagaccccugggccacggcuucggccuggcccaccccggcaugaugcaggagcugcaggccagacugggcagacccaagccccaguaa

SEQ ID NO: 13709 - RNA, 252 nt, Artificial Sequence
  APOC1__Homo_sapiens__NP_001636
augagacuguuccugagccugcccgugcuggugguggugcugagcaucgugcuggagggccccgcccccgcccagggcacccccgacgugagcagcgcccuggacaagcugaaggaguucggcaacacccuggaggacaaggccagagagcugaucagcagaaucaagcagagcgagcugagcgccaagaugagagagugguucagcgagaccuuccagaaggugaaggagaagcugaagaucgacagcuaa

SEQ ID NO: 13710 - RNA, 306 nt, Artificial Sequence
  APOC2__Homo_sapiens__NP_000474
augggcaccagacugcugcccgcccuguuccuggugcugcuggugcugggcuucgaggugcagggcacccagcagccccagcaggacgagaugcccagccccaccuuccugacccaggugaaggagagccugagcagcuacugggagagcgccaagaccgccgcccagaaccuguacgagaagaccuaccugcccgccguggacgagaagcugagagaccuguacagcaagagcaccgccgccaugagcaccuacaccggcaucuucaccgaccaggugcugagcgugcugaagggcgaggaguaa

SEQ ID NO: 13711 - RNA, 300 nt, Artificial Sequence
  APOC3__Homo_sapiens__NP_000031
augcagcccagagugcugcuggugguggcccugcuggcccugcuggccagcgccagagccagcgaggccgaggacgccagccugcugagcuucaugcagggcuacaugaagcacgccaccaagaccgccaaggacgcccugagcagcgugcaggagagccagguggcccagcaggccagaggcugggugaccgacggcuucagcagccugaaggacuacuggagcaccgugaaggacaaguucagcgaguucugggaccuggaccccgaggugagacccaccagcgccguggccgccuaa

SEQ ID NO: 13712 - RNA, 384 nt, Artificial Sequence
  APOC4__Homo_sapiens__NP_001637
augagccugcugagaaacagacugcaggcccugcccgcccugugccugugcgugcuggugcuggccugcaucggcgccugccagcccgaggcccaggagggcacccugagccccccccccaagcugaagaugagcagauggagccuggugagaggcagaaugaaggagcugcuggagaccguggugaacagaaccagagacggcuggcagugguucuggagccccagcaccuucagaggcuucaugcagaccuacuacgacgaccaccugagagaccugggcccccugaccaaggccugguuccuggagagcaaggacagccugcugaagaagacccacagccugugccccagacuggugugcggcgacaaggaccagggcuaa

SEQ ID NO: 13713 - RNA, 570 nt, Artificial Sequence
  APOD__Homo_sapiens__NP_001638
auggugaugcugcugcugcugcugagcgcccuggccggccuguucggcgccgccgagggccaggccuuccaccugggcaagugccccaacccccccgugcaggagaacuucgacgugaacaaguaccugggcagaugguacgagaucgagaagauccccaccaccuucgagaacggcagaugcauccaggccaacuacagccugauggagaacggcaagaucaaggugcugaaccaggagcugagagccgacggcaccgugaaccagaucgagggcgaggccacccccgugaaccugaccgagcccgccaagcuggaggugaaguucagcugguucaugcccagcgcccccuacuggauccuggccaccgacuacgagaacuacgcccugguguacagcugcaccugcaucauccagcuguuccacguggacuucgccuggauccuggccagaaaccccaaccugccccccgagaccguggacagccugaagaacauccugaccagcaacaacaucgacgugaagaagaugaccgugaccgaccaggugaacugccccaagcugagcuaa

SEQ ID NO: 13714 - RNA, 1032 nt, Artificial Sequence
  APOE__Homo_sapiens__NP_001289617
augagcagcggcgccagcagaaagagcugggaccccggcaaccccuggccccccgacuggcccaucaccggcagaaagaugaaggugcugugggccgcccugcuggugaccuuccuggccggcugccaggccaagguggagcaggccguggagaccgagcccgagcccgagcugagacagcagaccgaguggcagagcggccagagaugggagcuggcccugggcagauucugggacuaccugagaugggugcagacccugagcgagcaggugcaggaggagcugcugagcagccaggugacccaggagcugagagcccugauggacgagaccaugaaggagcugaaggccuacaagagcgagcuggaggagcagcugacccccguggccgaggagaccagagccagacugagcaaggagcugcaggccgcccaggccagacugggcgccgacauggaggacgugugcggcagacuggugcaguacagaggcgaggugcaggccaugcugggccagagcaccgaggagcugagagugagacuggccagccaccugagaaagcugagaaagagacugcugagagacgccgacgaccugcagaagagacuggccguguaccaggccggcgccagagagggcgccgagagaggccugagcgccaucagagagagacugggcccccugguggagcagggcagagugagagccgccaccgugggcagccuggccggccagccccugcaggagagagcccaggccuggggcgagagacugagagccagaauggaggagaugggcagcagaaccagagacagacuggacgaggugaaggagcagguggccgaggugagagccaagcuggaggagcaggcccagcagaucagacugcaggccgaggccuuccaggccagacugaagagcugguucgagccccugguggaggacaugcagagacagugggccggccugguggagaaggugcaggccgccgugggcaccagcgccgcccccgugcccagcgacaaccacuaa

SEQ ID NO: 13715 - RNA, 981 nt, Artificial Sequence
  APOF__Homo_sapiens__NP_001629
augaccggccugugcggcuacagcgcccccgacaugagaggccugagacugaucaugauccccguggagcugcugcugugcuaccugcugcugcaccccguggacgccaccagcuacggcaagcagaccaacgugcugaugcacuucccccugagccuggagagccagacccccagcagcgacccccugagcugccaguuccugcaccccaagagccugcccggcuucagccacauggccccccugcccaaguuccuggugagccuggcccugagaaacgcccuggaggaggccggcugccaggccgacgugugggcccugcagcugcagcuguacagacagggcggcgugaacgccacccaggugcugauccagcaccugagaggccugcagaagggcagaagcaccgagagaaacgugagcguggaggcccuggccagcgcccugcagcugcuggccagagagcagcagagcaccggcagagugggcagaagccugcccaccgaggacugcgagaacgagaaggagcaggccgugcacaacguggugcagcugcugcccggcgugggcaccuucuacaaccugggcaccgcccuguacuacgccacccagaacugccugggcaaggccagagagagaggcagagacggcgccaucgaccugggcuacgaccugcugaugaccauggccggcaugagcggcggccccaugggccuggccaucagcgccgcccugaagcccgcccugagaagcggcgugcagcagcugauccaguacuaccaggaccagaaggacgccaacaucagccagcccgagaccaccaaggagggccugagagccaucagcgacgugagcgaccuggaggagaccaccacccuggccagcuucaucagcgagguggugagcagcgcccccuacuggggcugggccaucaucaagagcuacgaccuggaccccggcgccggcagccuggagaucuaa

SEQ ID NO: 13716 - RNA, 1038 nt, Artificial Sequence
  APOH__Homo_sapiens__NP_000033
augaucagccccgugcugauccuguucagcagcuuccugugccacguggccaucgccggcagaaccugccccaagcccgacgaccugcccuucagcaccguggugccccugaagaccuucuacgagcccggcgaggagaucaccuacagcugcaagcccggcuacgugagcagaggcggcaugagaaaguucaucugcccccugaccggccuguggcccaucaacacccugaagugcacccccagagugugccccuucgccggcauccuggagaacggcgccgugagauacaccaccuucgaguaccccaacaccaucagcuucagcugcaacaccggcuucuaccugaacggcgccgacagcgccaagugcaccgaggagggcaaguggagccccgagcugcccgugugcgcccccaucaucugccccccccccagcauccccaccuucgccacccugagaguguacaagcccagcgccggcaacaacagccuguacagagacaccgccguguucgagugccugccccagcacgccauguucggcaacgacaccaucaccugcaccacccacggcaacuggaccaagcugcccgagugcagagaggugaagugccccuuccccagcagacccgacaacggcuucgugaacuaccccgccaagcccacccuguacuacaaggacaaggccaccuucggcugccacgacggcuacagccuggacggccccgaggagaucgagugcaccaagcugggcaacuggagcgccaugcccagcugcaaggccagcugcaaggugcccgugaagaaggccaccgugguguaccagggcgagagagugaagauccaggagaaguucaagaacggcaugcugcacggcgacaaggugagcuucuucugcaagaacaaggagaagaagugcagcuacaccgaggacgcccagugcaucgacggcaccaucgaggugcccaagugcuucaaggagcacagcagccuggccuucuggaagaccgacgccagcgacgugaagcccugcuaa

SEQ ID NO: 13717 - RNA, 1143 nt, Artificial Sequence
  APOL1__Homo_sapiens__NP_001130013
auggagggcgccgcccugcugagagugagcgugcugugcaucugggugcagcagaacgugcccagcggcaccgacaccggcgacccccagagcaagccccugggcgacugggccgccggcaccauggaccccgagagcagcaucuucaucgaggacgccaucaaguacuucaaggagaaggugagcacccagaaccugcugcugcugcugaccgacaacgaggccuggaacggcuucguggccgccgccgagcugcccagaaacgaggccgacgagcugagaaaggcccuggacaaccuggccagacagaugaucaugaaggacaagaacuggcacgacaagggccagcaguacagaaacugguuccugaaggaguuccccagacugaagagcgagcuggaggacaacaucagaagacugagagcccuggccgacggcgugcagaaggugcacaagggcaccaccaucgccaacguggugagcggcagccugagcaucagcagcggcauccugacccuggugggcaugggccuggcccccuucaccgagggcggcagccuggugcugcuggagcccggcauggagcugggcaucaccgccgcccugaccggcaucaccagcagcaccauggacuacggcaagaagugguggacccaggcccaggcccacgaccuggugaucaagagccuggacaagcugaaggaggugagagaguuccugggcgagaacaucagcaacuuccugagccuggccggcaacaccuaccagcugaccagaggcaucggcaaggacaucagagcccugagaagagccagagccaaccugcagagcgugccccacgccagcgccagcagacccagagugaccgagcccaucagcgccgagagcggcgagcagguggagagagugaacgagcccagcauccuggagaugagcagaggcgugaagcugaccgacguggcccccgugagcuucuuccuggugcuggacgugguguaccugguguacgagagcaagcaccugcacgagggcgccaagagcgagaccgccgaggagcugaagaagguggcccaggagcuggaggagaagcugaacauccugaacaacaacuacaagauccugcaggccgaccaggagcuguaa

SEQ ID NO: 13718 - RNA, 1014 nt, Artificial Sequence
  APOL2__Homo_sapiens__NP_663612
augaaccccgagagcagcaucuucaucgaggacuaccugaaguacuuccaggaccaggugagcagagagaaccugcugcagcugcugaccgacgacgaggccuggaacggcuucguggccgccgccgagcugcccagagacgaggccgacgagcugagaaaggcccugaacaagcuggccagccacauggugaugaaggacaagaacagacacgacaaggaccagcagcacagacagugguuccugaaggaguuccccagacugaagagagagcuggaggaccacaucagaaagcugagagcccuggccgaggagguggagcaggugcacagaggcaccaccaucgccaacguggugagcaacagcgugggcaccaccagcggcauccugacccugcugggccugggccuggcccccuucaccgagggcaucagcuucgugcugcuggacaccggcaugggccugggcgccgccgccgccguggccggcaucaccugcagcgugguggagcuggugaacaagcugagagccagagcccaggccagaaaccuggaccagagcggcaccaacguggccaaggugaugaaggaguucgugggcggcaacacccccaacgugcugacccugguggacaacugguaccaggugacccagggcaucggcagaaacaucagagccaucagaagagccagagccaacccccagcugggcgccuacgccccccccccccacgugaucggcagaaucagcgccgagggcggcgagcagguggagagagugguggagggccccgcccaggccaugagcagaggcaccaugaucgugggcgccgccaccggcggcauccugcugcugcuggacguggugagccuggccuacgagagcaagcaccugcuggagggcgccaagagcgagagcgccgaggagcugaagaagagagcccaggagcuggagggcaagcugaacuuccugaccaagauccacgagaugcugcagcccggccaggaccaguaa

SEQ ID NO: 13719 - RNA, 1209 nt, Artificial Sequence
  APOL3__Homo_sapiens__NP_663615
augggccugggccagggcuggggcugggaggccagcugcuucgccugccugaucagaagcugcugccagguggugaccuucaccuuccccuucggcuuccagggcaucagccagagccuggagaacgugagcggcuacuacgccgacgccagacuggaggugggcagcacccagcugagaaccgccggcagcugcagccacagcuucaagagaagcuuccuggagaagaagagauucaccgaggaggccaccaaguacuucagagagagagugagccccgugcaccugcagauccugcugaccaacaacgaggccuggaagagauucgugaccgccgccgagcugcccagagacgaggccgacgcccuguacgaggcccugaagaagcugagaaccuacgccgccaucgaggacgaguacgugcagcagaaggacgagcaguucagagagugguuccugaaggaguucccccaggugaagagaaagauccaggagagcaucgagaagcugagagcccuggccaacggcaucgaggaggugcacagaggcugcaccaucagcaacguggugagcagcagcaccggcgccgccagcggcaucaugagccuggccggccuggugcuggcccccuucaccgccggcaccagccuggcccugaccgccgccggcgugggccugggcgccgccagcgccgugaccggcaucaccaccagcaucguggagcacagcuacaccagcagcgccgaggccgaggccagcagacugaccgccaccagcaucgacagacugaagguguucaaggaggugaugagagacaucacccccaaccugcugagccugcugaacaacuacuacgaggccacccagaccaucggcagcgagaucagagccaucagacaggccagagccagagccagacugcccgugaccaccuggagaaucagcgccggcagcggcggccaggccgagagaaccaucgccggcaccaccagagccgugagcagaggcgccagaauccugagcgccaccaccagcggcaucuuccuggcccuggacguggugaaccugguguacgagagcaagcaccugcacgagggcgccaagagcgccagcgccgaggagcugagaagacaggcccaggagcuggaggagaaccugauggagcugacccagaucuaccagagacugaaccccugccacacccacuaa

SEQ ID NO: 13720 - RNA, 1047 nt, Artificial Sequence
  APOL4__Homo_sapiens__NP_085146
augggcagcugggugcagcugaucaccagcgugggcgugcagcagaaccaccccggcuggaccguggccggccaguuccaggagaagaagagauucaccgaggaggugaucgaguacuuccagaagaaggugagccccgugcaccugaagauccugcugaccagcgacgaggccuggaagagauucgugagaguggccgagcugcccagagaggaggccgacgcccuguacgaggcccugaagaaccugacccccuacguggccaucgaggacaaggacaugcagcagaaggagcagcaguucagagagugguuccugaaggaguucccccagaucagauggaagauccaggagagcaucgagagacugagagugaucgccaacgagaucgagaaggugcacagaggcugcgugaucgccaacguggugagcggcagcaccggcauccugagcgugaucggcgugaugcuggcccccuucaccgccggccugagccugagcaucaccgccgccggcgugggccugggcaucgccagcgccaccgccggcaucgccagcagcaucguggagaacaccuacaccagaagcgccgagcugaccgccagcagacugaccgccaccagcaccgaccagcuggaggcccugagagacauccugagagacaucacccccaacgugcugagcuucgcccuggacuucgacgaggccaccaagaugaucgccaacgacgugcacacccugagaagaagcaaggccaccgugggcagaccccugaucgccuggagauacgugcccaucaacgugguggagacccugagaaccagaggcgcccccaccagaaucgugagaaagguggccagaaaccugggcaaggccaccagcggcgugcugguggugcuggacguggugaaccuggugcaggacagccuggaccugcacaagggcgccaagagcgagagcgccgagagccugagacagugggcccaggagcuggaggagaaccugaacgagcugacccacauccaccagagccugaaggccggcuaa

SEQ ID NO: 13721 - RNA, 1032 nt, Artificial Sequence
  APOL6__Homo_sapiens__NP_085144
auggacaaccaggccgagagagagagcgaggccggcgugggccugcagagagacgaggacgacgccccccugugcgaggacguggagcugcaggacggcgaccugagccccgaggagaagaucuuccugagagaguuccccagacugaaggaggaccugaagggcaacaucgacaagcugagagcccuggccgacgacaucgacaagacccacaagaaguucaccaaggccaacaugguggccaccagcaccgccgugaucagcggcgugaugagccugcugggccuggcccuggcccccgccaccggcggcggcagccugcugcugagcaccgccggccagggccuggccaccgccgccggcgugaccagcaucgugagcggcacccuggagagaagcaagaacaaggaggcccaggccagagccgaggacauccugcccaccuacgaccaggaggacagagaggacgaggaggagaaggccgacuacgugaccgccgccggcaagaucaucuacaaccugagaaacacccugaaguacgccaagaagaacgugagagccuucuggaagcugagagccaaccccagacuggccaacgccaccaagagacugcugaccaccggccaggugagcagcagaagcagagugcaggugcagaaggccuucgccggcaccacccuggccaugaccaagaacgccagagugcugggcggcgugaugagcgccuucagccugggcuacgaccuggccacccugagcaaggaguggaagcaccugaaggagggcgccagaaccaaguucgccgaggagcugagagccaaggcccuggagcuggagagaaagcugaccgagcugacccagcuguacaagagccugcagcagaaggugagaagcagagccagaggcgugggcaaggaccugaccggcaccugcgagaccgaggccuacuggaaggagcugagagagcacguguggauguggcuguggcugugcgugugccugugcgugugcguguacgugcaguucaccuaa

SEQ ID NO: 13722 - RNA, 840 nt, Artificial Sequence
  APOLD1__Homo_sapiens__NP_001123887
auguucagagcccccugccacagacugagagccagaggcaccagaaaggccagagccggcgccuggagaggcugcaccuuccccugccugggcaagggcauggagagacccgccgccagagagccccacggccccgacgcccugagaagauuccagggccugcugcuggacagaagaggcagacugcacggccaggugcugagacugagagagguggccagaagacuggagagacugagaagaagaagccugguggccaacguggccggcagcagccugagcgccaccggcgcccuggccgccaucgugggccugagccugagccccgugacccugggcaccagccugcuggugagcgccgugggccugggcguggccaccgccggcggcgccgugaccaucaccagcgaccugagccugaucuucugcaacagcagagagcugagaagagugcaggagaucgccgccaccugccaggaccagaugagagagauccugagcugccuggaguucuucugcagauggcagggcugcggcgacagacagcugcugcagugcggcagaaacgccagcaucgcccuguacaacagcguguacuucaucguguucuucggcagcagaggcuuccugauccccagaagagccgagggcgacaccaaggugagccaggccgugcugaaggccaagauccagaagcuggccgagagccuggagagcugcaccggcgcccuggacgagcugagcgagcagcuggagagcagagugcagcugugcaccaagagcagcagaggccacgaccugaagaucagcgccgaccagagagccggccuguucuucuaa

SEQ ID NO: 13723 - RNA, 351 nt, Artificial Sequence
  APOM__Homo_sapiens__NP_001243098
auggccgccggcagcgcccccaugcagcugcaccugagagccaccaucagaaugaaggacggccugugcgugcccagaaaguggaucuaccaccugaccgagggcagcaccgaccugagaaccgagggcagacccgacaugaagaccgagcuguucagcagcagcugccccggcggcaucaugcugaacgagaccggccagggcuaccagagauuccugcuguacaacagaagcccccacccccccgagaagugcguggaggaguucaagagccugaccagcugccuggacagcaaggccuuccugcugacccccagaaaccaggaggccugcgagcugagcaacaacuaa

SEQ ID NO: 13724 - RNA, 597 nt, Artificial Sequence
  APOO__Homo_sapiens__NP_077027
auguucaaggugauccagagaagcgugggccccgccagccugagccugcugaccuucaagguguacgccgcccccaagaaggacagcccccccaagaacagcgugaagguggacgagcugagccuguacagcgugcccgagggccagagcaaguacguggaggaggccagaagccagcuggaggagagcaucagccagcugagacacuacugcgagcccuacaccaccuggugccaggagaccuacagccagaccaagcccaagaugcagagccuggugcaguggggccuggacagcuacgacuaccugcagaacgccccccccggcuucuuccccagacugggcgugaucggcuucgccggccugaucggccugcugcuggccagaggcagcaagaucaagaagcugguguacccccccggcuucaugggccuggccgccagccuguacuacccccagcaggccaucguguucgcccaggugagcggcgagagacuguacgacuggggccugagaggcuacaucgugaucgaggaccuguggaaggagaacuuccagaagcccggcaacgugaagaacagccccggcaccaaguaa

SEQ ID NO: 13725 - RNA, 621 nt, Artificial Sequence
  APOPT1__Homo_sapiens__NP_115750
augcugcccugcgccgccggcgccagaggcagaggcgccaugguggugcugagagccggcaagaagaccuuccugcccccccugugcagagccuucgccugcagaggcugccagcuggcccccgagagaggcgccgagagaagagacaccgcccccagcggcgugagcagauucugcccccccagaaagagcugccacgacuggaucggcccccccgacaaguacagcaaccugagacccgugcacuucuacauccccgagaacgagagcccccuggagcagaagcugagaaagcugagacaggagacccaggaguggaaccagcaguucugggccaaccagaaccugaccuucagcaaggagaaggaggaguucauccacagcagacugaagaccaagggccugggccugagaaccgagagcggccagaaggccacccugaacgccgaggagauggccgacuucuacaaggaguuccugagcaagaacuuccagaagcacauguacuacaacagagacugguacaagagaaacuucgccaucaccuucuucaugggcaagguggcccuggagagaaucuggaacaagcugaagcagaagcagaagaagagaagcaacuaa

SEQ ID NO: 13726 - RNA, 1758 nt, Artificial Sequence
  APPBP2__Homo_sapiens__NP_006371
auggccgccguggagcuggaguggauccccgagacccuguacaacaccgccaucagcgccgugguggacaacuacaucagaagcagaagagacaucagaagccugcccgagaacauccaguucgacguguacuacaagcuguaccagcagggcagacugugccagcugggcagcgaguucugcgagcuggagguguucgccaaggugcugagagcccuggacaagagacaccugcugcaccacugcuuccaggcccugauggaccacggcgugaagguggccagcgugcuggccuacagcuucagcagaagaugcagcuacaucgccgagagcgacgccgccgugaaggagaaggccauccaggugggcuucgugcugggcggcuuccugagcgacgccggcugguacagcgacgccgagaagguguuccugagcugccugcagcugugcacccugcacgacgagaugcugcacugguucagagccguggagugcugcgugagacugcugcacgugagaaacggcaacugcaaguaccaccugggcgaggagaccuucaagcuggcccagaccuacauggacaagcugagcaagcacggccagcaggccaacaaggccgcccuguacggcgagcugugcgcccugcuguucgccaagagccacuacgacgaggccuacaaguggugcaucgaggccaugaaggagaucaccgccggccugcccgugaagguggugguggacgugcugagacaggccagcaaggccugcguggugaagagagaguucaagaaggccgagcagcugaucaagcacgccguguaccuggccagagaccacuucggcagcaagcaccccaaguacagcgacacccugcuggacuacggcuucuaccugcugaacguggacaacaucugccagagcguggccaucuaccaggccgcccuggacaucagacagagcguguucggcggcaagaacauccacguggccaccgcccacgaggaccuggccuacagcagcuacgugcaccaguacagcagcggcaaguucgacaacgcccuguuccacgccgagagagccaucggcaucaucacccacauccugcccgaggaccaccugcugcuggccagcagcaagagagugaaggcccugauccuggaggagaucgccaucgacugccacaacaaggagaccgagcagagacugcugcaggaggcccacgaccugcaccugagcagccugcagcuggccaagaaggccuucggcgaguucaacgugcagaccgccaagcacuacggcaaccugggcagacuguaccagagcaugagaaaguucaaggaggccgaggagaugcacaucaaggccauccagaucaaggagcagcugcugggccaggaggacuacgagguggcccugagcgugggccaccuggccagccuguacaacuacgacaugaaccaguacgagaacgccgagaagcuguaccugagaagcaucgccaucggcaagaagcuguucggcgagggcuacagcggccuggaguacgacuacagaggccugaucaagcuguacaacagcaucggcaacuacgagaagguguucgaguaccacaacgugcugagcaacuggaacagacugagagacagacaguacagcgugaccgacgcccuggaggacgugagcaccagcccccagagcaccgaggagguggugcagagcuuccugaucagccagaacguggagggccccagcugcuaa

SEQ ID NO: 13727 - RNA, 2313 nt, Artificial Sequence
  APP__Homo_sapiens__NP_000475
augcugcccggccuggcccugcugcugcuggccgccuggaccgccagagcccuggaggugcccaccgacggcaacgccggccugcuggccgagccccagaucgccauguucugcggcagacugaacaugcacaugaacgugcagaacggcaagugggacagcgaccccagcggcaccaagaccugcaucgacaccaaggagggcauccugcaguacugccaggagguguaccccgagcugcagaucaccaacgugguggaggccaaccagcccgugaccauccagaacuggugcaagagaggcagaaagcagugcaagacccacccccacuucgugauccccuacagaugccuggugggcgaguucgugagcgacgcccugcuggugcccgacaagugcaaguuccugcaccaggagagaauggacgugugcgagacccaccugcacuggcacaccguggccaaggagaccugcagcgagaagagcaccaaccugcacgacuacggcaugcugcugcccugcggcaucgacaaguucagaggcguggaguucgugugcugcccccuggccgaggagagcgacaacguggacagcgccgacgccgaggaggacgacagcgacgugugguggggcggcgccgacaccgacuacgccgacggcagcgaggacaaggugguggagguggccgaggaggaggagguggccgagguggaggaggaggaggccgacgacgacgaggacgacgaggacggcgacgagguggaggaggaggccgaggagcccuacgaggaggccaccgagagaaccaccagcaucgccaccaccaccaccaccaccaccgagagcguggaggagguggugagagaggugugcagcgagcaggccgagaccggccccugcagagccaugaucagcagaugguacuucgacgugaccgagggcaagugcgcccccuucuucuacggcggcugcggcggcaacagaaacaacuucgacaccgaggaguacugcauggccgugugcggcagcgccaugagccagagccugcugaagaccacccaggagccccuggccagagaccccgugaagcugcccaccaccgccgccagcacccccgacgccguggacaaguaccuggagacccccggcgacgagaacgagcacgcccacuuccagaaggccaaggagagacuggaggccaagcacagagagagaaugagccaggugaugagagagugggaggaggccgagagacaggccaagaaccugcccaaggccgacaagaaggccgugauccagcacuuccaggagaagguggagagccuggagcaggaggccgccaacgagagacagcagcugguggagacccacauggccagaguggaggccaugcugaacgacagaagaagacuggcccuggagaacuacaucaccgcccugcaggccgugccccccagacccagacacguguucaacaugcugaagaaguacgugagagccgagcagaaggacagacagcacacccugaagcacuucgagcacgugagaaugguggaccccaagaaggccgcccagaucagaagccaggugaugacccaccugagagugaucuacgagagaaugaaccagagccugagccugcuguacaacgugcccgccguggccgaggagauccaggacgagguggacgagcugcugcagaaggagcagaacuacagcgacgacgugcuggccaacaugaucagcgagcccagaaucagcuacggcaacgacgcccugaugcccagccugaccgagaccaagaccaccguggagcugcugcccgugaacggcgaguucagccuggacgaccugcagcccuggcacagcuucggcgccgacagcgugcccgccaacaccgagaacgagguggagcccguggacgccagacccgccgccgacagaggccugaccaccagacccggcagcggccugaccaacaucaagaccgaggagaucagcgaggugaagauggacgccgaguucagacacgacagcggcuacgaggugcaccaccagaagcugguguucuucgccgaggacgugggcagcaacaagggcgccaucaucggccugauggugggcggcguggugaucgccaccgugaucgugaucacccuggugaugcugaagaagaagcaguacaccagcauccaccacggcgugguggagguggacgccgccgugacccccgaggagagacaccugagcaagaugcagcagaacggcuacgagaaccccaccuacaaguucuucgagcagaugcagaacuaa

SEQ ID NO: 13728 - RNA, 2130 nt, Artificial Sequence
  APPL1__Homo_sapiens__NP_036228
augcccggcaucgacaagcugcccaucgaggagacccuggaggacagcccccagaccagaagccugcugggcguguucgaggaggacgccaccgccaucagcaacuacaugaaccagcuguaccaggccaugcacagaaucuacgacgcccagaacgagcugagcgccgccacccaccugaccagcaagcugcugaaggaguacgagaagcagagauucccccugggcggcgacgacgaggugaugagcagcacccugcagcaguucagcaaggugaucgacgagcugagcagcugccacgccgugcugagcacccagcuggccgacgccaugauguuccccaucacccaguucaaggagagagaccugaaggagauccugacccugaaggagguguuccagaucgccagcaacgaccacgacgccgccaucaacagauacagcagacugagcaagaagagagagaacgacaaggugaaguacgaggugaccgaggacguguacaccagcagaaagaagcagcaccagaccaugaugcacuacuucugcgcccugaacacccugcaguacaagaagaagaucgcccugcuggagccccugcugggcuacaugcaggcccagaucagcuucuucaagaugggcagcgagaaccugaacgagcagcuggaggaguuccuggccaacaucggcaccagcgugcagaacgugagaagagagauggacagcgacaucgagaccaugcagcagaccaucgaggaccuggagguggccagcgacccccuguacgugcccgaccccgaccccaccaaguuccccgugaacagaaaccugaccagaaaggccggcuaccugaacgccagaaacaagaccggccuggugagcagcaccugggacagacaguucuacuucacccagggcggcaaccugaugagccaggccagaggcgacguggccggcggccuggccauggacaucgacaacugcagcgugauggccguggacugcgaggacagaagauacugcuuccagaucaccagcuucgacggcaagaagagcagcauccugcaggccgagagcaagaaggaccacgaggaguggaucugcaccaucaacaacaucagcaagcagaucuaccugagcgagaaccccgaggagaccgccgccagagugaaccagagcgcccuggaggccgugacccccagccccagcuuccagcagagacacgagagccugagacccgccgccggccagagcagaccccccaccgccagaaccagcagcagcggcagccugggcagcgagagcaccaaccuggccgcccugagccuggacagccugguggcccccgacacccccauccaguucgacaucaucagccccgugugcgaggaccagcccggccaggccaaggccuucggccagggcggcagaagaaccaaccccuucggcgagagcggcggcagcaccaagagcgagaccgaggacagcauccugcaccagcuguucaucgugagauuccugggcagcauggaggugaagagcgacgaccaccccgacgugguguacgagaccaugagacagauccuggccgccagagccauccacaacaucuucagaaugaccgagagccaccugcuggugaccugcgacugccugaagcugaucgacccccagacccaggugaccagacugaccuucccccugcccugcguggugcuguacgccacccaccaggagaacaagagacuguucggcuucgugcugagaaccagcagcggcagaagcgagagcaaccugagcagcgugugcuacaucuucgagagcaacaacgagggcgagaagaucugcgacagcgugggccuggccaagcagaucgcccugcacgccgagcuggacagaagagccagcgagaagcagaaggagaucgagagagugaaggagaagcagcagaaggagcugaacaagcagaagcagaucgagaaggaccuggaggagcagagcagacugaucgccgccagcagcagacccaaccaggccagcagcgagggccaguucguggugcugagcagcagccagagcgaggagagcgaccugggcgagggcggcaagaagagagagagcgaggccuaa

SEQ ID NO: 13729 - RNA, 2013 nt, Artificial Sequence
  APPL2__Homo_sapiens__NP_001238833
augcccgccguggacaagcugcugcuggaggaggcccugcaggacagcccccagaccagaagccugcugagcguguucgaggaggacgccggcacccugaccgacuacaccaaccagcugcugcaggccaugcagagaguguacggcgcccagaacgagaugugccuggccacccagcagcugagcaagcagcugcuggccuacgagaagcagaacuucgcccugggcaagggcgacgaggaggugaucagcacccugcacuacuucagcaaggugguggacgagcugaaccugcugcacaccgagcuggccaagcagcuggccgacaccauggugcugcccaucauccaguucagagagaaggaccugaccgaggugagcacccugaaggaccuguucggccuggccagcaacgacgugugccuguuccuggagcacgaccugagcauggccaaguacagcagacugcccaagaagaaggagaacgagaaggugaagaccgaggugggcaaggagguggccgccgccagaagaaagcagcaccugagcagccugcaguacuacugcgcccugaacgcccugcaguacagaaagcagauggccaugauggagcccaugaucggcuucgcccacggccagaucaacuucuucaagaagggcgccgagauguucagcaagagaauggacagcuuccugagcagcguggccgacauggugcagagcauccagguggagcuggaggccgaggccgagaagaugagagugagccagcaggagcugcugagcguggacgagagcguguacacccccgacagcgacguggccgccccccagaucaacagaaaccugauccagaaggccggcuaccugaaccugagaaacaagaccggccuggugaccaccaccugggagagacuguacuucuucacccagggcggcaaccugaugugccagcccagaggcgccguggccggcggccugauccaggaccuggacaacugcagcgugauggccguggacugcgaggacagaagauacugcuuccagaucaccacccccaacggcaagagcggcaucauccugcaggccgagagcagaaaggagaacgaggaguggaucugcgccaucaacaacaucagcagacagaucuaccugaccgacaaccccgaggccguggccaucaagcugaaccagaccgcccugcaggccgugacccccaucaccagcuucggcaagaagcaggagagcagcugccccagccagaaccugaagaacagcgagauggagaacgagaacgacaagaucgugcccaaggccaccgccagccugcccgaggccgaggagcugaucgcccccggcacccccauccaguucgacaucgugcugcccgccaccgaguuccuggaccagaacagaggcagcagaagaaccaaccccuucggcgagaccgaggacgagagcuuccccgaggccgaggacagccugcugcagcagauguucaucgugagauuccugggcagcauggccgugaagaccgacagcaccaccgaggugaucuacgaggccaugagacaggugcuggccgccagagccauccacaacaucuucagaaugaccgagagccaccugauggugaccagccagagccugagacugaucgacccccagacccaggugagcagagccaacuucgagcugaccagcgugacccaguucgccgcccaccaggagaacaagagacuggugggcuucgugaucagagugcccgagagcaccggcgaggagagccugagcaccuacaucuucgagagcaacagcgagggcgagaagaucugcuacgccaucaaccugggcaaggagaucaucgaggugcagaaggaccccgaggcccuggcccagcugaugcugagcaucccccugaccaacgacggcaaguacgugcugcugaacgaccagcccgacgacgacgacggcaaccccaacgagcacagaggcgccgagagcgaggccuaa

SEQ ID NO: 13730 - RNA, 543 nt, Artificial Sequence
  APRT__Homo_sapiens__NP_000476
auggccgacagcgagcugcagcugguggagcagagaaucagaagcuuccccgacuuccccacccccggcgugguguucagagacaucagccccgugcugaaggaccccgccagcuucagagccgccaucggccugcuggccagacaccugaaggccacccacggcggcagaaucgacuacaucgccggccuggacagcagaggcuuccuguucggccccagccuggcccaggagcugggccugggcugcgugcugaucagaaagagaggcaagcugcccggccccacccugugggccagcuacagccuggaguacggcaaggccgagcuggagauccagaaggacgcccuggagcccggccagagagugguggugguggacgaccugcuggccaccggcggcaccaugaacgccgccugcgagcugcugggcagacugcaggccgaggugcuggagugcgugagccugguggagcugaccagccugaagggcagagagaagcuggcccccgugcccuucuucagccugcugcaguacgaguaa

SEQ ID NO: 13731 - RNA, 1071 nt, Artificial Sequence
  APTX__Homo_sapiens__NP_001182177
augagcaacgugaaccugagcgugagcgacuucuggagagugaugaugagagugugcuggcuggugagacaggacagcagacaccagagaaucagacugccccaccuggaggccguggugaucggcagaggccccgagaccaagaucaccgacaagaagugcagcagacagcaggugcagcugaaggccgagugcaacaagggcuacgugaaggugaagcaggugggcgugaaccccaccagcaucgacagcguggugaucggcaaggaccaggaggugaagcugcagcccggccaggugcugcacauggugaacgagcuguaccccuacaucguggaguucgaggaggaggccaagaaccccggccuggagacccacagaaagagaaagagaagcggcaacagcgacagcaucgagagagacgccgcccaggaggccgaggccggcaccggccuggagcccggcagcaacagcggccagugcagcgugccccugaagaagggcaaggacgcccccaucaagaaggagagccugggccacuggagccagggccugaagaucagcaugcaggaccccaagaugcagguguacaaggacgagcaggugguggugaucaaggacaaguaccccaaggccagauaccacuggcuggugcugcccuggaccagcaucagcagccugaaggccguggccagagagcaccuggagcugcugaagcacaugcacaccgugggcgagaaggugaucguggacuucgccggcagcagcaagcugagauucagacugggcuaccacgccauccccagcaugagccacgugcaccugcacgugaucagccaggacuucgacagccccugccugaagaacaagaagcacuggaacagcuucaacaccgaguacuuccuggagagccaggccgugaucgagauggugcaggaggccggcagagugaccgugagagacggcaugcccgagcugcugaagcugccccugagaugccacgagugccagcagcugcugcccagcaucccccagcugaaggagcaccugagaaagcacuggacccaguaa

SEQ ID NO: 13732 - RNA, 906 nt, Artificial Sequence
  AQP10__Homo_sapiens__NP_536354
augguguucacccaggcccccgccgagaucaugggccaccugagaaucagaagccugcuggccagacagugccuggccgaguuccugggcguguucgugcugaugcugcugacccagggcgccguggcccaggccgugaccagcggcgagaccaagggcaacuucuucaccauguuccuggccggcagccuggccgugaccaucgccaucuacgugggcggcaacgugagcggcgcccaccugaaccccgccuucagccuggccaugugcaucgugggcagacugcccugggugaagcugcccaucuacauccuggugcagcugcugagcgccuucugcgccagcggcgccaccuacgugcuguaccacgacgcccugcagaacuacaccggcggcaaccugaccgugaccggccccaaggagaccgccagcaucuucgccaccuaccccgcccccuaccugagccugaacaacggcuuccuggaccaggugcugggcaccggcaugcugaucgugggccugcuggccauccuggacagaagaaacaagggcgugcccgccggccuggagcccgugguggugggcaugcugauccuggcccugggccugagcaugggcgccaacugcggcaucccccugaaccccgccagagaccugggccccagacuguucaccuacguggccggcuggggccccgagguguucagcgccggcaacggcugguggugggugcccgugguggccccccuggugggcgccaccgugggcaccgccaccuaccagcugcugguggcccugcaccaccccgagggccccgagcccgcccaggaccuggugagcgcccagcacaaggccagcgagcuggagacccccgccagcgcccagaugcuggagugcaagcuguaa

SEQ ID NO: 13733 - RNA, 561 nt, Artificial Sequence
  AQP1__Homo_sapiens__NP_001171989
augcccggcgccagaccccugccccuggugcuggugccccagaacacccuggccuggaugcagcuggacgccaaggcccccgcccaccccagaccccugcagcugcugggcagagugggccccggcagcagacagcuggccgacggcgugaacagcggccagggccugggcaucgagaucaucggcacccugcagcuggugcugugcgugcuggccaccaccgacagaagaagaagagaccugggcggcagcgccccccuggccaucggccugagcguggcccugggccaccugcuggccaucgacuacaccggcugcggcaucaaccccgccagaagcuucggcagcgccgugaucacccacaacuucagcaaccacuggaucuucugggugggccccuucaucggcggcgcccuggccgugcugaucuacgacuucauccuggcccccagaagcagcgaccugaccgacagagugaagguguggaccagcggccagguggaggaguacgaccuggacgccgacgacaucaacagcagaguggagaugaagcccaaguaa

SEQ ID NO: 13734 - RNA, 816 nt, Artificial Sequence
  AQP2__Homo_sapiens__NP_000477
augugggagcugagaagcaucgccuucagcagagccguguucgccgaguuccuggccacccugcuguucguguucuucggccugggcagcgcccugaacuggccccaggcccugcccagcgugcugcagaucgccauggccuucggccugggcaucggcacccuggugcaggcccugggccacaucagcggcgcccacaucaaccccgccgugaccguggccugccuggugggcugccacgugagcgugcugagagccgccuucuacguggccgcccagcugcugggcgccguggccggcgccgcccugcugcacgagaucacccccgccgacaucagaggcgaccuggccgugaacgcccugagcaacagcaccaccgccggccaggccgugaccguggagcuguuccugacccugcagcuggugcugugcaucuucgccagcaccgacgagagaagaggcgagaaccccggcacccccgcccugagcaucggcuucagcguggcccugggccaccugcugggcauccacuacaccggcugcagcaugaaccccgccagaagccuggcccccgccguggugaccggcaaguucgacgaccacuggguguucuggaucggcccccuggugggcgccauccugggcagccugcuguacaacuacgugcuguucccccccgccaagagccugagcgagagacuggccgugcugaagggccuggagcccgacaccgacugggaggagagagaggugagaagaagacagagcguggagcugcacagcccccagagccugcccagaggcaccaaggccuaa

SEQ ID NO: 13735 - RNA, 879 nt, Artificial Sequence
  AQP3__Homo_sapiens__NP_004916
augggcagacagaaggagcuggugagcagaugcggcgagaugcugcacaucagauacagacugcugagacaggcccuggccgagugccugggcacccugauccuggugauguucggcugcggcagcguggcccagguggugcugagcagaggcacccacggcggcuuccugaccaucaaccuggccuucggcuucgccgugacccugggcauccugaucgccggccaggugagcggcgcccaccugaaccccgccgugaccuucgccaugugcuuccuggccagagagcccuggaucaagcugcccaucuacacccuggcccagacccugggcgccuuccugggcgccggcaucguguucggccuguacuacgacgccaucuggcacuucgccgacaaccagcuguucgugagcggccccaacggcaccgccggcaucuucgccaccuaccccagcggccaccuggacaugaucaacggcuucuucgaccaguucaucggcaccgccagccugaucgugugcgugcuggccaucguggaccccuacaacaaccccgugcccagaggccuggaggccuucaccgugggccugguggugcuggugaucggcaccagcaugggcuucaacagcggcuacgccgugaaccccgccagagacuucggccccagacuguucaccgcccuggccggcuggggcagcgccguguucaccaccggccagcacugguggugggugcccaucgugagcccccugcugggcagcaucgccggcguguucguguaccagcugaugaucggcugccaccuggagcagcccccccccagcaacgaggaggagaacgugaagcuggcccacgugaagcacaaggagcagaucuaa

SEQ ID NO: 13736 - RNA, 972 nt, Artificial Sequence
  AQP4__Homo_sapiens__NP_001641
augagcgacagacccaccgccagaagauggggcaagugcggcccccugugcaccagagagaacaucaugguggccuucaagggcguguggacccaggccuucuggaaggccgugaccgccgaguuccuggccaugcugaucuucgugcugcugagccugggcagcaccaucaacuggggcggcaccgagaagccccugcccguggacauggugcugaucagccugugcuucggccugagcaucgccaccauggugcagugcuucggccacaucagcggcggccacaucaaccccgccgugaccguggccauggugugcaccagaaagaucagcaucgccaagagcguguucuacaucgccgcccagugccugggcgccaucaucggcgccggcauccuguaccuggugaccccccccagcguggugggcggccugggcgugaccauggugcacggcaaccugaccgccggccacggccugcugguggagcugaucaucaccuuccagcugguguucaccaucuucgccagcugcgacagcaagagaaccgacgugaccggcagcaucgcccuggccaucggcuucagcguggccaucggccaccuguucgccaucaacuacaccggcgccagcaugaaccccgccagaagcuucggccccgccgugaucaugggcaacugggagaaccacuggaucuacugggugggccccaucaucggcgccgugcuggccggcggccuguacgaguacguguucugccccgacguggaguucaagagaagauucaaggaggccuucagcaaggccgcccagcagaccaagggcagcuacauggagguggaggacaacagaagccagguggagaccgacgaccugauccugaagcccggcguggugcacgugaucgacguggacagaggcgaggagaagaagggcaaggaccagagcggcgaggugcugagcagcguguaa

SEQ ID NO: 13737 - RNA, 798 nt, Artificial Sequence
  AQP5__Homo_sapiens__NP_001642
augaagaaggaggugugcagcguggccuuccugaaggccguguucgccgaguuccuggccacccugaucuucguguucuucggccugggcagcgcccugaaguggcccagcgcccugcccaccauccugcagaucgcccuggccuucggccuggccaucggcacccuggcccaggcccugggccccgugagcggcggccacaucaaccccgccaucacccuggcccugcuggugggcaaccagaucagccugcugagagccuucuucuacguggccgcccagcuggugggcgccaucgccggcgccggcauccuguacggcguggccccccugaacgccagaggcaaccuggccgugaacgcccugaacaacaacaccacccagggccaggccauggugguggagcugauccugaccuuccagcuggcccugugcaucuucgccagcaccgacagcagaagaaccagccccgugggcagccccgcccugagcaucggccugagcgugacccugggccaccuggugggcaucuacuucaccggcugcagcaugaaccccgccagaagcuucggccccgccguggugaugaacagauucagccccgcccacuggguguucugggugggccccaucgugggcgccgugcuggccgccauccuguacuucuaccugcuguuccccaacagccugagccugagcgagagaguggccaucaucaagggcaccuacgagcccgacgaggacugggaggagcagagagaggagagaaagaagaccauggagcugaccaccagauaa

SEQ ID NO: 13738 - RNA, 849 nt, Artificial Sequence
  AQP6__Homo_sapiens__NP_001643
auggacgccguggagcccggcggcagaggcugggccagcaugcuggccugcagacuguggaaggccaucagcagagcccuguucgccgaguuccuggccaccggccuguacguguucuucggcgugggcagcgugaugagauggcccaccgcccugcccagcgugcugcagaucgccaucaccuucaaccuggugaccgccauggccgugcaggugaccuggaaggccagcggcgcccacgccaaccccgccgugacccuggccuuccuggugggcagccacaucagccugcccagagccguggccuacguggccgcccagcuggugggcgccaccgugggcgccgcccugcuguacggcgugaugcccggcgacaucagagagacccugggcaucaacguggugagaaacagcgugagcaccggccaggccguggccguggagcugcugcugacccugcagcuggugcugugcguguucgccagcaccgacagcagacagaccagcggcagccccgccaccaugaucggcaucagcguggcccugggccaccugaucggcauccacuucaccggcugcagcaugaaccccgccagaagcuucggccccgccaucaucaucggcaaguucaccgugcacuggguguucugggugggcccccugaugggcgcccugcuggccagccugaucuacaacuucgugcuguuccccgacaccaagacccuggcccagagacuggccauccugaccggcaccguggaggugggcaccggcgccggcgccggcgccgagccccugaagaaggagagccagcccggcagcggcgccguggagauggagagcguguaa

SEQ ID NO: 13739 - RNA, 1029 nt, Artificial Sequence
  AQP7__Homo_sapiens__NP_001161
auggugcaggccagcggccacagaagaagcaccagaggcagcaagauggugagcuggagcgugaucgccaagauccaggagauccugcagagaaagauggugagagaguuccuggccgaguucaugagcaccuacgugaugaugguguucggccugggcagcguggcccacauggugcugaacaagaaguacggcagcuaccugggcgugaaccugggcuucggcuucggcgugaccaugggcgugcacguggccggcagaaucagcggcgcccacaugaacgccgccgugaccuucgccaacugcgcccugggcagagugcccuggagaaaguuccccguguacgugcugggccaguuccugggcagcuuccuggccgccgccaccaucuacagccuguucuacaccgccauccugcacuucagcggcggccagcugauggugaccggccccguggccaccgccggcaucuucgccaccuaccugcccgaccacaugacccuguggagaggcuuccugaacgaggccuggcugaccggcaugcugcagcugugccuguucgccaucaccgaccaggagaacaaccccgcccugcccggcaccgaggcccuggugaucggcauccugguggugaucaucggcgugagccugggcaugaacaccggcuacgccaucaaccccagcagagaccugccccccagaaucuucaccuucaucgccggcuggggcaagcagguguucagcaacggcgagaacugguggugggugcccgugguggccccccugcugggcgccuaccugggcggcaucaucuaccugguguucaucggcagcaccauccccagagagccccugaagcuggaggacagcguggccuacgaggaccacggcaucaccgugcugcccaagaugggcagccacgagcccaccaucagcccccugacccccgugagcgugagccccgccaacagaagcagcgugcaccccgcccccccccugcacgagagcauggcccuggagcacuucuaa

SEQ ID NO: 13740 - RNA, 786 nt, Artificial Sequence
  AQP8__Homo_sapiens__NP_001160
augagcggcgagaucgccaugugcgagcccgaguucggcaacgacaaggccagagagcccagcgugggcggcagauggagagugagcugguacgagagauucgugcagcccugccugguggagcugcugggcagcgcccuguucaucuucaucggcugccugagcgugaucgagaacggcaccgacaccggccugcugcagcccgcccuggcccacggccuggcccugggccuggugaucgccacccugggcaacaucagcggcggccacuucaaccccgccgugagccuggccgccaugcugaucggcggccugaaccuggugaugcugcugcccuacugggugagccagcugcugggcggcaugcugggcgccgcccuggccaaggccgugagccccgaggagagauucuggaacgccagcggcgccgccuucgugaccgugcaggagcagggccagguggccggcgcccugguggccgagaucauccugaccacccugcuggcccuggccgugugcaugggcgccaucaacgagaagaccaagggcccccuggcccccuucagcaucggcuucgccgugaccguggacauccuggccggcggccccgugagcggcggcugcaugaaccccgccagagccuucggccccgccgugguggccaaccacuggaacuuccacuggaucuacuggcugggcccccugcuggccggccugcuggugggccugcugaucagaugcuucaucggcgacggcaagaccagacugauccugaaggccagauaa

SEQ ID NO: 13741 - RNA, 888 nt, Artificial Sequence
  AQP9__Homo_sapiens__NP_066190
augcagcccgagggcgccgagaagggcaagagcuucaagcagagacuggugcugaagagcagccuggccaaggagacccugagcgaguuccugggcaccuucauccugaucgugcugggcugcggcugcguggcccaggccauccugagcagaggcagauucggcggcgugaucaccaucaacgugggcuucagcauggccguggccauggccaucuacguggccggcggcgugagcggcggccacaucaaccccgccgugagccuggccaugugccuguucggcagaaugaagugguucaagcugcccuucuacgugggcgcccaguuccugggcgccuucgugggcgccgccaccguguucggcaucuacuacgacggccugaugagcuucgccggcggcaagcugcugaucgugggcgagaacgccaccgcccacaucuucgccaccuaccccgcccccuaccugagccuggccaacgccuucgccgaccaggugguggccaccaugauccugcugaucaucguguucgccaucuucgacagcagaaaccugggcgcccccagaggccuggagcccaucgccaucggccugcugaucaucgugaucgccagcagccugggccugaacagcggcugcgccaugaaccccgccagagaccugagccccagacuguucaccgcccuggccggcuggggcuucgagguguucagagccggcaacaacuucugguggauccccguggugggcccccuggugggcgccgugaucggcggccugaucuacgugcuggugaucgagauccaccaccccgagcccgacagcguguucaagaccgagcagagcgaggacaagcccgagaaguacgagcugagcgugaucauguaa

SEQ ID NO: 13742 - RNA, 561 nt, Artificial Sequence
  ARAF__Homo_sapiens__NP_001243126
auggagccccccagaggcccccccgccaacggcgccgagcccagcagagccgugggcaccgugaagguguaccugcccaacaagcagagaaccguggugaccgugagagacggcaugagcguguacgacagccuggacaaggcccugaaggugagaggccugaaccaggacugcugcgugguguacagacugaucaagggcagaaagaccgugaccgccugggacaccgccaucgccccccuggacggcgaggagcugaucguggaggugcuggaggacgugccccugaccaugcacaacuucgugagaaagaccuucuucagccuggccuucugcgacuucugccugaaguuccuguuccacggcuucagaugccagaccugcggcuacaaguuccaccagcacugcagcagcaaggugcccaccgugugcguggacaugagcaccaacagacagcaguucuaccacagcgugcaggaccugagcggcggcagcagacagcacgaggcccccagcaacagaccccugaacgagcugcugaccccccagggccccagauaa

SEQ ID NO: 13743 - RNA, 4353 nt, Artificial Sequence
  ARAP1__Homo_sapiens__NP_001035207
auggccgaggccggcgacgccgcccugagcguggccgaguggcugagagcccugcaccuggagcaguacaccggccuguucgagcagcacggccuggugugggccaccgagugccagggccugagcgacaccagacugauggacaugggcaugcugcugcccggccacagaagaagaauccuggccggccugcugagagcccacaccagccccgcccccgcccccagacccacccccagacccgugcccaugaagagacacaucuucagaagcccccccgugcccgccaccccccccgagccccugcccaccaccaccgaggacgagggccugcccgccgccccccccaucccccccagaagaagcugccugccccccaccugcuucaccacccccagcaccgccgcccccgaccccgugcugcccccccugcccgccaagagacaccuggccgagcugagcgugccccccgugccccccagaaccggcccccccagacugcuggugagccugcccaccaaggaggaggagagccugcugcccagccugagcagccccccccagccccagagcgaggagccccugagcacccugccccagggccccccccagccccccagccccccccccugcccccccgagaucccccccaagcccgugagacuguuccccgaguucgacgacagcgacuacgacgaggugcccgaggagggccccggcgcccccgccagagugaugaccaagaaggaggagcccccccccagcagagugcccagagccgugagaguggccagccugcugagcgagggcgaggagcugagcggcgacgaccagggcgacgaggaggaggacgaccacgccuacgagggcgugcccaacggcggcuggcacaccagcagccugagccugagccugcccagcaccaucgccgccccccaccccauggacggcccccccggcggcagcacccccgugacccccgugaucaaggccggcuggcuggacaagaaccccccccagggcagcuacaucuaccagaagagaugggugagacuggacaccgaccaccugagauacuucgacagcaacaaggacgccuacagcaagagauucaucagcguggccugcaucagccacguggccgccaucggcgaccagaaguucgaggugaucaccaacaacagaaccuucgccuucagagccgagagcgacguggagagaaaggaguggaugcaggcccugcagcaggccauggccgagcagagagccagagccagacugagcagcgccuaccugcugggcgugcccggcagcgagcagcccgacagagccggcagccuggagcugagaggcuucaagaacaagcuguacguggccguggugggcgacaaggugcagcuguacaagaaccuggaggaguaccaccugggcaucggcaucaccuucaucgacaugagcgugggcaacgugaaggagguggacagaagaagcuucgaccugaccacccccuacagaaucuucagcuucagcgccgacagcgagcuggagaaggagcaguggcuggaggccaugcagggcgccaucgccgaggcccugagcaccagcgagguggccgagagaaucugggccgccgcccccaacagauucugcgccgacugcggcgccccccagcccgacugggccagcaucaaccugugcguggugaucugcaagagaugcgccggcgagcacagaggccugggcgccggcgugagcaaggugagaagccugaagauggacagaaagguguggaccgagacccugaucgagcuguuccugcagcugggcaacggcgccggcaacagauucugggccgccaacgugccccccagcgaggcccugcagcccagcagcagccccagcaccagaagaugccaccuggaggccaaguacagagagggcaaguacagaagauaccacccccuguucggcaaccaggaggagcuggacaaggcccugugcgccgccgugaccaccaccgaccuggccgagacccaggcccugcugggcugcggcgccggcaucaacugcuucagcggcgaccccgaggcccccaccccccuggcccuggccgagcaggccggccagacccugcagauggaguuccugagaaacaacagaaccaccgaggugcccagacuggacagcaugaagccccuggagaagcacuacagcguggugcugcccaccgugagccacagcggcuuccuguacaagaccgccagcgccggcaagcugcugcaggacagaagagccagagaggaguucagcagaagauggugcgugcugggcgacggcgugcugagcuacuucgagaacgagagagccgugacccccaacggcgagaucagagccagcgagaucgugugccuggccgugcccccccccgacacccacggcuucgagcacaccuucgagguguacaccgagggcgagagacuguaccuguucggccuggagagcgccgagcaggcccacgagugggugaagugcaucgccaaggccuucgugcccccccuggccgaggaccugcuggccagagacuucgagagacugggcagacugcccuacaaggccggccugagccugcagagagcccaggagggcugguucagccugagcggcagcgagcugagagccguguuccccgagggccccugcgaggagccccugcagcugagaaagcugcaggagcugagcauccagggcgacagcgagaaccaggugcuggugcugguggagagaagaagaacccuguacauccagggcgagagaagacuggacuucaugggcuggcugggcgccauccagaaggccgccgccagcaugggcgacacccugagcgagcagcagcugggcgacagcgacauccccgugaucguguacagaugcguggacuacaucacccagugcggccugaccagcgagggcaucuacagaaagugcggccagaccagcaagacccagagacugcuggagagccugagacaggacgccagaagcgugcaccugaaggagggcgagcagcacguggacgacgugagcagcgcccugaagagauuccugagagaccugcccgacggccuguucaccagagcccagagacugaccuggcuggaggccagcgagaucgaggacgaggaggagaaggugagcagauacagagagcugcuggugagacugccccccgugaacagagccaccgugaaggcccugaucagccaccuguacugcgugcagugcuucagcgacaccaaccagaugaacgugcacaaccuggccaucguguucggccccacccuguuccagaccgacggccaggacuacaaggccggcagagugguggaggaccugaucaaccacuacguggugguguucagcguggacgaggaggagcugagaaagcagagagaggagaucaccgccaucgugaagaugagaguggccggcaccgccagcggcacccagcacgccggcgacuucaucugcaccguguaccuggaggagaagaaggccgagaccgagcagcacaucaaggugcccgccagcaugaccgccgaggagcugacccuggagauccuggacagaagaaacgugggcaucagagagaaggacuacuggaccugcuucgaggugaacgagagagaggaggccgagagaccccugcacuucgccgagaaggugcugcccauccugcacggccugggcaccgacagccaccugguggugaagaagcaccaggccauggaggccaugcugcuguaccuggccagcagagugggcgacaccaagcacggcaugaugaaguucagagaggacagaagccugcugggccugggccugcccagcggcggcuuccacgacagauacuucauccugaacagcagcugccugagacuguacaaggaggugagaagccagagacccuggagcggcgcccccgagaccagccacagacccgagaaggaguggcccaucaagagccugaagguguaccugggcgugaagaagaagcugagaccccccaccugcuggggcuucaccguggugcacgagaccgagaagcacgagaagcagcagugguaccugugcugcgacacccagauggagcugagagagugguucgccaccuuccuguucgugcagcacgacggccugguguggcccagcgagcccagcagagugagcagagccgugcccgaggugagacugggcagcgugagccugaucccccugagaggcagcgagaacgagaugagaagaagcguggccgccuucaccgccgacccccugagccugcugagaaacguguaa

SEQ ID NO: 13744 - RNA, 4635 nt, Artificial Sequence
  ARAP3__Homo_sapiens__NP_071926
auggccgccccccaggaccuggacaucgccguguggcuggccaccgugcaccuggagcaguacgccgacaccuucagaagacacggccuggccaccgccggcgccgccagaggccugggccacgaggagcugaagcagcugggcaucagcgccaccggccacagaaagagaauccugagacugcugcagaccggcaccgaggagggcagccuggaccccaagagcgacagcgccauggagcccagccccagccccgccccccaggcccagccccccaagcccgugcccaagcccagaaccguguucggcggccugagcggccccgccaccacccagagacccggccugagccccgcccugggcggccccggcgugagcagaagccccgagcccagccccagaccccccccccugcccaccagcagcagcgagcagagcagcgcccugaacaccguggagaugaugcccaacagcaucuacuucggccuggacagcagaggcagagcccaggccgcccaggacaaggcccccgacagcagccagaucagcgcccccacccccgcccugagacccaccaccggcaccgugcacaucauggaccccggcugccuguacuacggcgugcagcccgugggcacccccggcgcccccgacagaagagagagcagaggcgugugccagggcagagccgagcacagacugagcagacaggaccuggaggccagagaggacgccggcuacgccagccuggagcugcccggcgacagcacccugcugagccccacccuggagaccgaggagaccagcgacgaccugaucagccccuacgccagcuucagcuucaccgccgacagacugaccccccugcugagcggcuggcuggacaagcugagcccccagggcaacuacguguuccagagaagauucgugcaguucaacggcagaagccugauguacuucggcagcgacaaggaccccuuccccaagggcgugaucccccugaccgccaucgagaugaccagaagcagcaaggacaacaaguuccaggugaucaccggccagagaguguucguguucagaaccgagagcgaggcccagagagacauguggugcagcacccugcagagcugccugaaggagcagagacugcugggccaccccagacccccccagccccccagaccccugagaaccggcaugcuggagcugagaggccacaaggccaagguguucgccgcccugagccccggcgagcuggcccuguacaagagcgagcaggccuucagccugggcaucggcaucugcuucaucgagcugcagggcugcagcgugagagagaccaagagcagaagcuucgaccugcugaccccccacagaugcuucagcuucaccgccgagagcggcggcgccagacagagcugggccgccgcccugcaggaggccgugaccgagacccugagcgacuacgagguggccgagaagaucuggagcaacagagccaacagacagugcgccgacugcggcagcagcagacccgacugggccgccgugaaccugggcguggugaucugcaagcagugcgccggccagcacagagcccugggcagcggcaucagcaaggugcagagccugaagcuggacaccagcguguggagcaacgagaucgugcagcuguucaucgugcugggcaacgacagagccaacagauucugggccggcacccugccccccggcgagggccugcaccccgacgccacccccggccccagaggcgaguucaucagcagaaaguacagacugggccuguucagaaagccccacccccaguaccccgaccacagccagcugcugcaggcccugugcgccgccguggccagacccaaccugcugaagaacaugacccagcugcugugcguggaggccuucgagggcgaggagcccugguucccccccgcccccgacggcagcugccccggccugcugcccagcgaccccagccccggcguguacaacgaggugguggugagagccaccuacagcggcuuccuguacugcagccccgugagcaacaaggccggccccagcccccccagaagaggcagagacgccccccccagacuguggugcgugcugggcgccgcccuggagauguucgccagcgagaacagccccgagccccugagccugauccagccccaggacaucgugugccugggcgugagccccccccccaccgaccccggcgacagauuccccuucagcuucgagcugauccuggccggcggcagaauccagcacuucggcaccgacggcgccgacagccuggaggccuggaccagcgccgugggcaagugguucagcccccugagcugccaccagcugcugggccccggccugcugagacugggcagacuguggcugagaagccccagccacaccgcccccgcccccggccuguggcugagcggcuucggccugcugagaggcgaccaccuguuccugugcagcgcccccggccccggcccccccgcccccgaggacauggugcaccugagaagacugcaggagaucagcguggugagcgccgccgacacccccgacaagaaggagcaccuggugcugguggagaccggcagaacccuguaccugcagggcgagggcagacuggacuucaccgccuggaacgccgccaucggcggcgccgccggcggcggcggcaccggccugcaggagcagcagaugagcagaggcgacauccccaucaucguggacgccugcaucagcuucgugacccagcacggccugagacuggagggcguguacagaaagggcggcgccagagccagaagccugagacugcuggccgaguucagaagagacgccagaagcgugaagcugagacccggcgagcacuucguggaggacgugaccgacacccugaagagauucuucagagagcuggacgaccccgugaccagcgccagacugcugcccagauggagagaggccgccgagcugccccagaagaaccagagacuggagaaguacaaggacgugaucggcugccugcccagagugaacagaagaacccuggccacccugaucggccaccuguacagagugcagaagugcgccgcccugaaccagaugugcaccagaaaccuggcccugcuguucgcccccagcguguuccagaccgacggcagaggcgagcacgaggugagagugcugcaggagcugaucgacggcuacaucagcguguucgacaucgacagcgaccagguggcccagaucgaccuggaggugagccugaucaccaccuggaaggacgugcagcugagccaggccggcgaccugaucauggagguguacaucgagcagcagcugcccgacaacugcgugacccugaaggugagccccacccugaccgccgaggagcugaccaaccaggugcuggagaugagaggcaccgccgccggcauggaccugugggugaccuucgagaucagagagcacggcgagcuggagagaccccugcaccccaaggagaaggugcuggagcaggcccugcaguggugccagcugcccgagcccugcagcgccagccugcugcugaagaaggugccccuggcccaggccggcugccuguucaccggcaucagaagagagagccccagagugggccugcugagaugcagagaggagccccccagacugcugggcagcagauuccaggagagauucuuccugcugagaggcagaugccugcugcugcugaaggagaagaagagcagcaagcccgagagagaguggccccuggagggcgccaagguguaccugggcaucagaaagaagcugaagccccccacccccuggggcuucacccugauccuggagaagaugcaccuguaccugagcugcaccgacgaggacgagaugugggacuggaccaccagcauccugaaggcccagcacgacgaccagcagcccguggugcugagaagacacagcagcagcgaccuggccagacagaaguucggcaccaugccccugcugcccaucagaggcgacgacagcggcgccacccugcugagcgccaaccagacccugagaagacugcacaacagaagaacccugagcauguucuuccccaugaagagcagccagggcagcguggaggagcaggaggagcuggaggagcccguguacgaggagcccguguacgaggaggugggcgccuuccccgagcugauccaggacaccagcaccagcuucagcaccaccagagaguggaccgugaagcccgagaacccccugaccagccagaagagccuggaccagcccuuccugagcaagagcagcacccugggccaggaggagagaccccccgagcccccccccggcccccccagcaagagcagcccccaggccagaggcagccuggaggagcagcugcugcaggagcugagcagccugauccugagaaagggcgagaccaccgccggccugggcagccccagccagcccagcagcccccagagccccagccccaccggccugcccacccagacccccggcuuccccacccagccccccugcaccagcagcccccccagcagccagccccugaccuaa

SEQ ID NO: 13745 - RNA, 1191 nt, Artificial Sequence
  ARC__Homo_sapiens__NP_056008
auggagcuggaccacagaaccagcggcggccugcacgccuaccccggccccagaggcggccagguggccaagcccaacgugauccugcagaucggcaagugcagagccgagaugcuggagcacgugagaagaacccacagacaccugcuggccgaggugagcaagcagguggagagagagcugaagggccugcacagaagcgugggcaagcuggagagcaaccuggacggcuacgugcccaccagcgacagccagagauggaagaagagcaucaaggccugccugugcagaugccaggagaccaucgccaaccuggagagaugggugaagagagagaugcacguguggagagagguguucuacagacuggagagaugggccgacagacuggagagcaccggcggcaaguaccccgugggcagcgagagcgccagacacaccgugagcgugggcgugggcggccccgagagcuacugccacgaggccgacggcuacgacuacaccgugagccccuacgccaucacccccccccccgccgccggcgagcugcccggccaggagcccgccgaggcccagcaguaccagcccugggugcccggcgaggacggccagcccagccccggcguggacacccagaucuucgaggaccccagagaguuccugagccaccuggaggaguaccugagacaggugggcggcagcgaggaguacuggcugagccagauccagaaccacaugaacggccccgccaagaaguggugggaguucaagcagggcagcgugaagaacuggguggaguucaagaaggaguuccugcaguacagcgagggcacccugagcagagaggccauccagagagagcuggaccugccccagaagcagggcgagccccuggaccaguuccuguggagaaagagagaccuguaccagacccuguacguggacgccgacgaggaggagaucauccaguacguggugggcacccugcagcccaagcugaagagauuccugagacacccccugcccaagacccuggagcagcugauccagagaggcauggaggugcaggacgaccuggagcaggccgccgagcccgccggcccccaccugcccguggaggacgaggccgagacccugacccccgcccccaacagcgagagcguggccagcgacagaacccagcccgaguaa

SEQ ID NO: 13746 - RNA, 1272 nt, Artificial Sequence
  ARCN1__Homo_sapiens__NP_001135753
augauccccgaguacugcagagcccuggaggagaacgagaucagcgagcacugcuucgaccugaucuucgccuucgacgagaucguggcccugggcuacagagagaacgugaaccuggcccagaucagaaccuucaccgagauggacagccacgaggagaagguguucagagccgugagagagacccaggagagagaggccaaggccgagaugagaagaaaggccaaggagcugcagcaggccagaagagacgccgagagacagggcaagaaggcccccggcuucggcggcuucggcagcagcgccgugagcggcggcagcaccgccgccaugaucaccgagaccaucaucgagaccgacaagcccaagguggcccccgcccccgccagacccagcggccccagcaaggcccugaagcugggcgccaagggcaaggagguggacaacuucguggacaagcugaagagcgagggcgagaccaucaugagcagcagcaugggcaagagaaccagcgaggccaccaagaugcacgccccccccaucaacauggagagcgugcacaugaagaucgaggagaagaucacccugaccugcggcagagacggcggccugcagaacauggagcugcacggcaugaucaugcugagaaucagcgacgacaaguacggcagaaucagacugcacguggagaacgaggacaagaagggcgugcagcugcagacccaccccaacguggacaagaagcuguucaccgccgagagccugaucggccugaagaaccccgagaagagcuuccccgugaacagcgacgugggcgugcugaaguggagacugcagaccaccgaggagagcuucaucccccugaccaucaacugcuggcccagcgagagcggcaacggcugcgacgugaacaucgaguacgagcugcaggaggacaaccuggagcugaacgacguggugaucaccaucccccugcccagcggcgugggcgcccccgugaucggcgagaucgacggcgaguacagacacgacagcagaagaaacacccuggaguggugccugcccgugaucgacgccaagaacaagagcggcagccuggaguucagcaucgccggccagcccaacgacuucuuccccgugcaggugagcuucgugagcaagaagaacuacugcaacauccaggugaccaaggugacccagguggacggcaacagccccgugagauucagcaccgagaccaccuuccugguggacaaguacgagauccuguaa

SEQ ID NO: 13747 - RNA, 759 nt, Artificial Sequence
  AREG__Homo_sapiens__NP_001648
augagagccccccugcugccccccgcccccguggugcugagccugcugauccugggcagcggccacuacgccgccggccuggaccugaacgacaccuacagcggcaagagagagcccuucagcggcgaccacagcgccgacggcuucgaggugaccagcagaagcgagaugagcagcggcagcgagaucagccccgugagcgagaugcccagcagcagcgagcccagcagcggcgccgacuacgacuacagcgaggaguacgacaacgagccccagauccccggcuacaucguggacgacagcgugagaguggagcagguggugaagcccccccagaacaagaccgagagcgagaacaccagcgacaagcccaagagaaagaagaagggcggcaagaacggcaagaacagaagaaacagaaagaagaagaaccccugcaacgccgaguuccagaacuucugcauccacggcgagugcaaguacaucgagcaccuggaggccgugaccugcaagugccagcaggaguacuucggcgagagaugcggcgagaagagcaugaagacccacagcaugaucgacagcagccugagcaagaucgcccuggccgccaucgccgccuucaugagcgccgugauccugaccgccguggccgugaucaccgugcagcugagaagacaguacgugagaaaguacgagggcgaggccgaggagagaaagaagcugagacaggagaacggcaacgugcacgccaucgccuaa

SEQ ID NO: 13748 - RNA, 546 nt, Artificial Sequence
  ARF1__Homo_sapiens__NP_001019398
augggcaacaucuucgccaaccuguucaagggccuguucggcaagaaggagaugagaauccugauggugggccuggacgccgccggcaagaccaccauccuguacaagcugaagcugggcgagaucgugaccaccauccccaccaucggcuucaacguggagaccguggaguacaagaacaucagcuucaccgugugggacgugggcggccaggacaagaucagaccccuguggagacacuacuuccagaacacccagggccugaucuucgugguggacagcaacgacagagagagagugaacgaggccagagaggagcugaugagaaugcuggccgaggacgagcugagagacgccgugcugcugguguucgccaacaagcaggaccugcccaacgccaugaacgccgccgagaucaccgacaagcugggccugcacagccugagacacagaaacugguacauccaggccaccugcgccaccagcggcgacggccuguacgagggccuggacuggcugagcaaccagcugagaaaccagaaguaa

SEQ ID NO: 13749 - RNA, 546 nt, Artificial Sequence
  ARF3__Homo_sapiens__NP_001650
augggcaacaucuucggcaaccugcugaagagccugaucggcaagaaggagaugagaauccugauggugggccuggacgccgccggcaagaccaccauccuguacaagcugaagcugggcgagaucgugaccaccauccccaccaucggcuucaacguggagaccguggaguacaagaacaucagcuucaccgugugggacgugggcggccaggacaagaucagaccccuguggagacacuacuuccagaacacccagggccugaucuucgugguggacagcaacgacagagagagagugaacgaggccagagaggagcugaugagaaugcuggccgaggacgagcugagagacgccgugcugcugguguucgccaacaagcaggaccugcccaacgccaugaacgccgccgagaucaccgacaagcugggccugcacagccugagacacagaaacugguacauccaggccaccugcgccaccagcggcgacggccuguacgagggccuggacuggcuggccaaccagcugaagaacaagaaguaa

SEQ ID NO: 13750 - RNA, 543 nt, Artificial Sequence
  ARF4__Homo_sapiens__NP_001651
augggccugaccaucagcagccuguucagcagacuguucggcaagaagcagaugagaauccugauggugggccuggacgccgccggcaagaccaccauccuguacaagcugaagcugggcgagaucgugaccaccauccccaccaucggcuucaacguggagaccguggaguacaagaacaucugcuucaccgugugggacgugggcggccaggacagaaucagaccccuguggaagcacuacuuccagaacacccagggccugaucuucgugguggacagcaacgacagagagagaauccaggagguggccgacgagcugcagaagaugcugcugguggacgagcugagagacgccgugcugcugcuguucgccaacaagcaggaccugcccaacgccauggccaucagcgagaugaccgacaagcugggccugcagagccugagaaacagaaccugguacgugcaggccaccugcgccacccagggcaccggccuguacgagggccuggacuggcugagcaacgagcugagcaagagauaa

SEQ ID NO: 13751 - RNA, 528 nt, Artificial Sequence
  ARF6__Homo_sapiens__NP_001654
augggcaaggugcugagcaagaucuucggcaacaaggagaugagaauccugaugcugggccuggacgccgccggcaagaccaccauccuguacaagcugaagcugggccagagcgugaccaccauccccaccgugggcuucaacguggagaccgugaccuacaagaacgugaaguucaacgugugggacgugggcggccaggacaagaucagaccccuguggagacacuacuacaccggcacccagggccugaucuucgugguggacugcgccgacagagacagaaucgacgaggccagacaggagcugcacagaaucaucaacgacagagagaugagagacgccaucauccugaucuucgccaacaagcaggaccugcccgacgccaugaagccccacgagauccaggagaagcugggccugaccagaaucagagacagaaacugguacgugcagcccagcugcgccaccagcggcgacggccuguacgagggccugaccuggcugaccagcaacuacaagagcuaa

SEQ ID NO: 13752 - RNA, 1212 nt, Artificial Sequence
  ARFGAP1__Homo_sapiens__NP_001268411
auggccagccccagaaccagaaaggugcugaaggaggugagagugcaggacgagaacaacgugugcuucgagugcggcgccuucaacccccagugggugagcgugaccuacggcaucuggaucugccuggagugcagcggcagacacagaggccugggcgugcaccugagcuucgugagaagcgugaccauggacaaguggaaggacaucgagcuggagaagaugaaggccggcggcaacgccaaguucagagaguuccuggagagccaggaggacuacgaccccugcuggagccugcaggagaaguacaacagcagagccgccgcccuguucagagacaaggugguggcccuggccgagggcagagaguggagccuggagagcagccccgcccagaacuggacccccccccagcccagaacccugcccagcauggugcacagagugagcggccagccccagagcgugaccgccagcagcgacaaggccuucgaggacuggcugaacgacgaccugggcagcuaccagggcgcccagggcaacagauacgugggcuucggcaacaccccccccccccagaagaaggaggacgacuuccugaacaacgccaugagcagccuguacagcggcuggagcagcuucaccaccggcgccagcagauucgccagcgccgccaaggagggcgccaccaaguucggcagccaggccagccagaaggccagcgagcugggccacagccugaacgagaacgugcugaagcccgcccaggagaaggugaaggagggcaagaucuucgacgacgugagcagcggcgugagccagcuggccagcaagugccagagaagacugugcugccaccagagccacugcagcgccggccaccugggcagagccuucugccccgugagcuggcacgaggcccugugcggccagaccggcagagaggagcaggccagccugcugccccccaagcacguggugggcgcccuggaggugugcgccagaggcugccccagaugccacgugccccacacccccggcaccgccgccgaguggcccggcagacugugccugagcagagagagcguggugagagacggcggcaccagcccccccuucuucagaggcaagcagagagcccccuggaccgcccccagaagagccaccgugaucagaaccgccguguggaccaccagcaagaccgccaccuaa

SEQ ID NO: 13753 - RNA, 1482 nt, Artificial Sequence
  ARFGAP2__Homo_sapiens__NP_001229761
auggccgccgagcccaacaagaccgagauccagacccuguucaagagacugagagccgugcccaccaacaaggccugcuucgacugcggcgccaagaaccccagcugggccagcaucaccuacggcguguuccugugcaucgacugcagcggcgugcacagaagccugggcgugcaccugagcuucaucagaagcaccgagcuggacagcaacuggaacugguuccagcugagaugcaugcaggugggcggcaacgccaacgccaccgccuucuucagacagcacggcugcaccgccaacgacgccaacaccaaguacaacagcagagccgcccagauguacagagagaagaucagacagcugggcagcgccgcccuggccagacacggcaccgacccccccgccugggacgcccccgccaccgagcccagcggcacccagcagcccgcccccagcaccgagagcagcggccuggcccagcccgagcacggccccaacaccgaccugcugggcaccagccccaaggccagccuggagcugaagagcagcaucaucggcaagaagaagcccgccgccgccaagaagggccugggcgccaagaagggccugggcgcccagaaggugagcagccagagcuucagcgagaucgagagacaggcccagguggccgagaagcugagagagcagcaggccgccgacgccaagaagcaggccgaggagagcaugguggccagcaugagacuggccuaccaggagcugcagaucgacagaaagaaggaggagaagaagcugcagaaccuggagggcaagaagagagagcaggccgagagacugggcaugggccuggugagcagaagcagcgugagccacagcgugcugagcgagaugcaggugaucgagcaggagacccccgugagcgccaagagcagcagaagccagcuggaccuguucgacgacgugggcaccuucgccagcggcccccccaaguacaaggacaaccccuucagccugggcgagagcuucggcagcagaugggacaccgacgccgccuggggcauggacagaguggaggagaaggagcccgaggugaccaucagcagcaucagacccaucagcgagagagccaccaacagaagagagguggagagcagaagcagcggccuggagagcagcgaggccagacagaaguucgccggcgccaaggccaucagcagcgacauguucuucggcagagagguggacgccgaguacgaggccagaagcagacugcagcagcugagcggcagcagcgccaucagcagcagcgaccuguucggcgacauggacggcgcccacggcgccggcagcgugagccugggcaacgugcugcccaccgccgacaucgcccaguucaagcagggcgugaagagcguggccggcaagauggccgugcuggccaacggcgugaugaacagccugcaggacagauacggcagcuacuaa

SEQ ID NO: 13754 - RNA, 1419 nt, Artificial Sequence
  ARFGAP3__Homo_sapiens__NP_001135765
augggcgaccccagcaagcaggacauccugaccaucuucaagagacugagaagcgugcccaccaacaaggugugcuucgacugcggcgccaagaaccccagcugggccagcaucaccuacggcguguuccugugcaucgacugcagcggcagccacagaagccugggcgugcaccugagcuucaucagaagcaccgagcuggacagcaacuggagcugguuccagcugagaugcaugcaggugggcggcaacgccagcgcccuguggcuggacagcugcguggugcccccccugagccccccccccaaggaggaggacuucuucgccagccacgugagccccgaggugagcgacaccgccugggccagcgccaucgccgagcccagcagccugaccagcagacccguggagaccacccuggagaacaacgagggcggccaggagcagggccccagcguggagggccugaacgugcccaccaaggccacccuggaggugagcagcaucaucaagaagaagcccaaccaggccaagaagggccugggcgccaagaagggcagccugggcgcccagaagcuggccaacaccugcuucaacgagaucgagaagcaggcccaggccgccgacaagaugaaggagcaggaggaccuggccaagguggugagcaaggaggagagcaucgugagcagccugagacuggccuacaaggaccuggagauccagaugaagaaggacgagaagaugaacaucagcggcaagaagaacguggacagcgacagacugggcaugggcuucggcaacugcagaagcgugaucagccacagcgugaccagcgacaugcagaccaucgagcaggagagccccaucauggccaagcccagaaagaaguacaacgacgacagcgacgacagcuacuucaccagcagcagcagcuacuucgacgagcccguggagcugagaagcagcagcuucagcagcugggacgacagcagcgacagcuacuggaagaaggagaccagcaaggacaccgagaccgugcugaagaccaccggcuacagcgacagacccaccgccagaagaaagcccgacuacgagcccguggagaacaccgacgaggcccagaagaaguucggcaacgugaaggccaucagcagcgacauguacuucggcagacagagccaggccgacuacgagaccagagccagacuggagagacugagcgccagcagcagcaucagcagcgccgaccuguucgaggagcccagaaagcagcccgccggcaacuacagccugagcagcgugcugcccaacgcccccgacauggcccaguucaagcagggcgugagaagcguggccggcaagcugagcguguucgccaacggcguggugaccagcauccaggacagauacggcagcuaa

SEQ ID NO: 13755 - RNA, 5550 nt, Artificial Sequence
  ARFGEF1__Homo_sapiens__NP_006412
auguacgagggcaagaagaccaagaacauguuccugaccagagcccuggagaagauccuggccgacaaggaggugaagaaggcccaccacagccagcugagaaaggccugcgagguggcccuggaggagaucaaggccgagaccgagaagcagagccccccccacggcgaggccaaggccggcagcagcacccugccccccgugaagagcaagaccaacuucaucgaggccgacaaguacuuccugcccuucgagcuggccugccagagcaagugccccagaaucgugagcaccagccuggacugccugcagaagcugaucgccuacggccaccugaccggcaacgcccccgacagcaccacccccggcaagaagcugaucgacagaaucaucgagaccaucugcggcugcuuccagggcccccagaccgacgagggcgugcagcugcagaucaucaaggcccugcugaccgccgugaccagccagcacaucgagauccacgagggcaccgugcugcaggccgugagaaccugcuacaacaucuaccuggccagcaagaaccugaucaaccagaccaccgccaaggccacccugacccagaugcugaacgugaucuucgccagaauggagaaccaggcccugcaggaggccaagcagauggagaaggagagacacagacagcaccaccaccugcugcagagccccgugagccaccacgagcccgagagcccccagcugagauaccugcccccccagaccguggaccacaucagccaggagcacgagggcgaccuggaccugcacaccaacgacguggacaagagccugcaggacgacaccgagcccgagaacggcagcgacaucagcagcgccgagaacgagcagaccgaggccgaccaggccaccgccgccgagacccugagcaagaacgaggugcuguacgacggcgagaaccacgacugcgaggagaagccccaggacaucgugcagaacaucguggaggagauggugaacaucguggugggcgacaugggcgagggcaccaccaucaacgccagcgccgacggcaacaucggcaccaucgaggacggcagcgacagcgagaacauccaggccaacggcauccccggcacccccaucagcguggccuacacccccagccugcccgacgacagacugagcgugagcagcaacgacacccaggagagcggcaacagcagcggccccagccccggcgccaaguucagccacauccugcagaaggacgccuuccugguguucagaagccugugcaagcugagcaugaagccccugagcgacggcccccccgaccccaagagccacgagcugagaagcaagauccugagccugcagcugcugcugagcauccugcagaacgccggccccaucuucagaaccaacgagauguucaucaacgccaucaagcaguaccugugcguggcccugagcaagaacggcgugagcagcgugcccgagguguucgagcugagccugagcaucuuccugacccugcugagcaacuucaagacccaccugaagaugcagaucgagguguucuucaaggagaucuuccuguacauccuggagaccagcaccagcagcuucgaccacaaguggauggugauccagacccugaccagaaucugcgccgacgcccagagcgugguggacaucuacgugaacuacgacugcgaccugaacgccgccaacaucuucgagagacuggugaacgaccugagcaagaucgcccagggcagaggcagccaggagcugggcaugagcaacgugcaggagcugagccugagaaagaagggccuggagugccuggugagcauccugaagugcaugguggaguggagcaaggaccaguacgugaaccccaacagccagaccacccugggccaggagaagcccagcgagcaggagaugagcgagaucaagcaccccgagaccaucaacagauacggcagccugaacagccuggagagcaccagcagcagcggcaucggcagcuacagcacccagaugagcggcaccgacaaccccgagcaguucgaggugcugaagcagcagaaggagaucaucgagcagggcaucgaccuguucaacaagaagcccaagagaggcauccaguaccugcaggagcagggcaugcugggcaccacccccgaggacaucgcccaguuccugcaccaggaggagagacuggacagcacccaggugggcgaguuccugggcgacaacgacaaguucaacaaggaggugauguacgccuacguggaccagcacgacuucagcggcaaggacuucgugagcgcccugagaauguuccuggagggcuucagacugcccggcgaggcccagaagaucgacagacugauggagaaguucgccgccagauaccuggagugcaaccagggccagacccuguucgccagcgccgacaccgccuacgugcuggccuacagcaucaucaugcugaccaccgaccugcacagcccccaggugaagaacaagaugaccaaggagcaguacaucaagaugaacagaggcaucaacgacagcaaggaccugcccgaggaguaccugagcgccaucuacaacgagaucgccggcaagaagaucagcaugaaggagaccaaggagcugaccauccccaccaagagcagcaagcagaacguggccagcgagaagcagagaagacugcuguacaaccuggagauggagcagauggccaagaccgccaaggcccugauggaggccgugagccacgugcaggcccccuucaccagcgccacccaccuggagcacgugagacccauguucaagcuggccuggacccccuuccuggccgccuucagcgugggccugcaggacugcgacgacaccgagguggccagccugugccuggagggcaucagaugcgccaucagaaucgccugcaucuucagcauccagcuggagagagacgccuacgugcaggcccuggccagauucacccugcugaccgugagcagcggcaucaccgagaugaagcagaagaacaucgacaccaucaagacccugaucaccguggcccacaccgacggcaacuaccugggcaacagcuggcacgagauccugaagugcaucagccagcuggagcuggcccagcugaucggcaccggcgugaagcccagauacaucagcggcaccgugagaggcagagagggcagccugaccggcaccaaggaccaggcccccgacgaguucgugggccugggccuggugggcggcaacguggacuggaagcagaucgccagcauccaggagagcaucggcgagaccagcagccagagcguggugguggccguggacagaaucuucaccggcagcaccagacuggacggcaacgccaucguggacuucgugagauggcugugcgccgugagcauggacgagcugcugagcaccacccaccccagaauguucagccugcagaagaucguggagaucagcuacuacaacaugggcagaaucagacugcaguggagcagaaucugggaggugaucggcgaccacuucaacaaggugggcugcaaccccaacgaggacguggccaucuucgccguggacagccugagacagcugagcaugaaguuccuggagaagggcgagcuggccaacuucagauuccagaaggacuuccugagacccuucgagcacaucaugaagagaaacagaagccccaccaucagagacaugguggugagaugcaucgcccagauggugaacagccaggccgccaacaucagaagcggcuggaagaacaucuucagcguguuccaccuggccgccagcgaccaggacgagagcaucguggagcuggccuuccagaccaccggccacaucgugacccugguguucgagaagcacuuccccgccaccaucgacagcuuccaggacgccgugaagugccugagcgaguucgccugcaacgccgccuuccccgacaccagcauggaggccaucagacugaucagacacugcgccaaguacgugagcgacagaccccaggccuucaaggaguacaccagcgacgacaugaacguggcccccgaggacagagugugggugagaggcugguuccccauccuguucgagcugagcugcaucaucaacagaugcaagcuggacgugagaaccagaggccugaccgugauguucgagaucaugaagaccuacggccacaccuacgagaagcacugguggcaggaccuguucagaaucguguucagaaucuucgacaacaugaagcugcccgagcagcagaccgagaaggccgaguggaugaccaccaccugcaaccacgcccuguacgccaucugcgacguguucacccaguaccuggaggugcugagcgacgugcugcuggacgacaucuucgcccagcuguacuggugcgugcagcaggacaacgagcagcuggccagaagcggcaccaacugccuggagaacguggugauccugaacggcgagaaguucacccuggagaucugggacaagaccugcaacugcacccuggacaucuucaagaccaccaucccccacgcccugcugaccuggagacccaacagcggcgagaccgccccccccccccccagccccgugagcgagaagccccuggacaccaucagccagaagagcguggacauccacgacagcauccagcccagaagcguggacaacagaccccaggccccccuggugagcgccagcgccgugaacgaggaggugagcaagaucaagagcaccgccaaguuccccgagcagaagcuguucgccgcccugcugaucaagugcguggugcagcuggagcugauccagaccaucgacaacaucguguucuuccccgccaccagcaagaaggaggacgccgagaaccuggccgccgcccagagagacgccguggacuucgacgugagaguggacacccaggaccagggcauguacagauuccugaccagccagcagcuguucaagcugcuggacugccugcuggagagccacagauucgccaaggccuucaacagcaacaacgagcagagaaccgcccuguggaaggccggcuucaagggcaagagcaagcccaaccugcugaagcaggagaccagcagccuggccugcggccugagaauccuguucagaauguacauggacgagagcagagugagcgccugggaggaggugcagcagagacugcugaacgugugcagcgaggcccugagcuacuuccugacccugaccagcgagagccacagagaggccuggaccaaccugcugcugcuguuccugaccaaggugcugaagaucagcgacaacagauucaaggcccacgccagcuucuacuacccccugcugugcgagaucaugcaguucgaccugauccccgagcugagagccgugcugagaagauucuuccugagaaucggcgugguguuccagaucagccagccccccgagcaggagcugggcaucaacaagcaguaa

SEQ ID NO: 13756 - RNA, 5358 nt, Artificial Sequence
  ARFGEF2__Homo_sapiens__NP_006411
augcaggagagccagaccaagagcauguucgugagcagagcccuggagaagauccuggccgacaaggaggugaagagaccccagcacagccagcugagaagagccugccagguggcccuggacgagaucaaggccgagaucgagaagcagagacugggcaccgccgccccccccaaggccaacuucaucgaggccgacaaguacuuccugcccuucgagcuggccugccagagcaagagccccagaguggugagcaccagccuggacugccugcagaagcugaucgccuacggccacaucaccggcaacgcccccgacagcggcgcccccggcaagagacugaucgacagaaucguggagaccaucugcagcugcuuccagggcccccagaccgacgagggcgugcagcugcagaucaucaaggcccugcugaccgccgugaccagcccccacaucgagauccacgagggcaccauccugcagaccgugagaaccugcuacaacaucuaccuggccagcaagaaccugaucaaccagaccaccgccaaggccacccugacccagaugcugaacgugaucuucaccagaauggagaaccaggugcugcaggaggccagagagcuggagaagcccauccagagcaagccccagagccccgugauccaggccgccgccgugagccccaaguucgugagacugaagcacagccaggcccagagcaagcccaccacccccgagaagaccgaccugaccaacggcgagcacgccagaagcgacagcggcaaggugagcaccgagaacggcgacgcccccagagagagaggcagcagccugagcggcaccgacgacggcgcccaggagguggugaaggacauccuggaggacguggugaccagcgccaucaaggaggccgccgagaagcacggccugaccgagcccgagagagugcugggcgagcuggagugccaggagugcgccaucccccccggcguggacgagaacagccagaccaacggcaucgccgacgacagacagagccugagcagcgccgacaaccuggagagcgacgcccagggccaccagguggccgccagauucagccacgugcugcagaaggacgccuuccugguguucagaagccugugcaagcugagcaugaagccccugggcgagggcccccccgaccccaagagccacgagcugagaagcaagguggugagccugcagcugcugcugagcgugcugcagaacgccggccccguguucagaacccacgagauguucaucaacgccaucaagcaguaccugugcguggcccugagcaagaacggcgugagcagcgugcccgacguguucgagcugagccuggccaucuuccugacccugcugagcaacuucaagaugcaccugaagaugcagaucgagguguucuucaaggagaucuuccugaacauccuggagaccagcaccagcagcuucgagcacagauggauggugauccagacccugaccagaaucugcgccgacgcccagugcgugguggacaucuacgugaacuacgacugcgaccugaacgccgccaacaucuucgagagacuggugaacgaccugagcaagaucgcccagggcagaagcggccacgagcugggcaugaccccccugcaggagcugagccugagaaagaagggccuggagugccuggugagcauccugaagugcaugguggaguggagcaaggaccuguacgugaaccccaaccaccagaccagccugggccaggagagacugaccgaccaggagaucggcgacggcaagggccuggacauggccagaagaugcagcgugaccagcauggagagcaccgugagcagcggcacccagaccaccgugcaggacgaccccgagcaguucgaggugaucaagcagcagaaggagaucaucgagcacggcaucgagcuguucaacaagaagcccaagagaggcauccaguuccugcaggagcagggcaugcugggcaccagcguggaggacaucgcccaguuccugcaccaggaggagagacuggacagcacccaggugggcgacuuccugggcgacagcgccagauucaacaaggaggugauguacgccuacguggaccagcuggacuucugcgagaaggaguucgugagcgcccugagaaccuuccuggagggcuucagacugcccggcgaggcccagaagaucgacagacugauggagaaguucgccgccagauacaucgagugcaaccagggccagacccuguucgccagcgccgacaccgccuacgugcuggccuacagcaucaucaugcugaccaccgaccugcacagcccccaggugaagaacaagaugaccaaggagcaguacaucaagaugaacagaggcaucaacgacagcaaggaccugcccgaggaguaccugagcagcaucuacgaggagaucgagggcaagaagaucgccaugaaggagaccaaggagcugaccaucgccaccaagagcaccaagcagaacguggccagcgagaagcagagaagacugcuguacaaccuggagauggagcagauggccaagaccgccaaggcccugauggaggccgugagccacgccaaggcccccuucaccagcgccacccaccuggaccacgugagacccauguucaagcugguguggaccccccugcuggccgccuacagcaucggccugcagaacugcgacgacaccgagguggccagccugugccuggagggcaucagaugcgccaucagaaucgccugcaucuucggcaugcagcuggagagagacgccuacgugcaggcccuggccagauucagccugcugaccgccagcagcagcaucaccgagaugaagcagaagaacaucgacaccaucaagacccugaucaccguggcccacaccgacggcaacuaccugggcaacagcuggcacgagauccugaagugcaucagccagcuggagcuggcccagcugaucggcaccggcgugaagaccagauaccugagcggcagcggcagagagagagagggcagccugaagggccacacccuggccggcgaggaguucaugggccugggccugggcaaccuggugagcggcggcguggacaagagacagauggccagcuuccaggagagcgugggcgagaccagcagccagagcguggugguggccguggacagaaucuucaccggcagcaccagacuggacggcaacgccaucguggacuucgugagauggcugugcgccgugagcauggacgagcuggccagcccccaccaccccagaauguucagccugcagaagaucguggagaucagcuacuacaacaugaacagaaucagacugcaguggagcagaaucuggcacgugaucggcgaccacuucaacaaggugggcugcaaccccaacgaggacguggccaucuucgccguggacagccugagacagcugagcaugaaguuccuggagaagggcgagcuggccaacuucagauuccagaaggacuuccugagacccuucgagcacaucaugaagaagaacagaagccccaccaucagagacauggccaucagaugcaucgcccagauggugaacagccaggccgccaacaucagaagcggcuggaagaacaucuucgccguguuccaccaggccgccagcgaccacgacggcaacaucguggagcuggccuuccagaccaccugccacaucgugaccaccaucuuccagcaccacuuccccgccgccaucgacagcuuccaggacgccgugaagugccugagcgaguucgccugcaacgccgccuuccccgacaccagcauggaggccaucagacugaucagauucugcggcaaguacgugagcgagagacccagagugcugcaggaguacaccagcgacgacaugaacguggcccccggcgacagagugugggugagaggcugguuccccauccuguucgagcugagcugcaucaucaacagaugcaagcuggacgugagaaccagaggccugaccgugauguucgagaucaugaagagcuacggccacaccuucgagaagcacugguggcaggaccuguucagaaucguguucagaaucuucgacaacaugaagcugcccgagcagcugagcgagaagagcgaguggaugaccaccaccugcaaccacgcccuguacgccaucugcgacguguucacccaguucuacgaggcccugaacgaggugcugcugagcgacguguucgcccagcugcaguggugcgugaagcaggacaacgagcagcuggccagaagcggcaccaacugccuggagaaccuggugaucagcaacggcgagaaguucagccccgaggugugggacgagaccugcaacugcaugcuggacaucuucaagaccaccaucccccacgugcugcugaccuggagacccgugggcauggaggaggacagcagcgagaagcaccuggacguggaccuggacagacagagccugagcagcaucgacaagaaccccagcgagagaggccagagccagcugagcaaccccaccgacgacagcuggaagggcagacccuacgccaaccagaagcuguucgccagccugcugaucaagugcguggugcagcuggagcugauccagaccaucgacaacaucguguucuaccccgccaccagcaagaaggaggacgccgagcacaugguggccgcccagcaggacacccuggacgccgacauccacaucgagaccgaggaccagggcauguacaaguacaugagcagccagcaccuguucaagcugcuggacugccugcaggagagccacagcuucagcaaggccuucaacagcaacuacgagcagagaaccgugcuguggagagccggcuucaagggcaagagcaagcccaaccugcugaagcaggagaccagcagccuggccugcugccugagaauccuguucagaauguacguggacgagaacagaagagacagcugggaggagauccagcagagacugcugaccgugugcagcgaggcccuggccuacuucaucaccgugaacagcgagagccacagagaggccuggaccagccugcugcugcugcugcugaccaagacccugaagaucaacgacgagaaguucaaggcccacgccagcauguacuaccccuaccugugcgagaucaugcaguucgaccugauccccgagcugagagccgugcugagaaaguucuuccugagaaucggcgugguguacaagaucuggauccccgaggagcccagccaggugcccgccgcccugagccccgugugguaa

SEQ ID NO: 13757 - RNA, 6534 nt, Artificial Sequence
  ARFGEF3__Homo_sapiens__NP_065073
auggaggagauccugagaaagcugcagaaggaggccagcggcagcaaguacaaggccaucaaggagagcugcaccugggcccuggagacccugggcggccuggacaccaucgugaagauccccccccacgugcugagagagaagugccugcugccccugcagcuggcccuggagagcaagaacgugaagcuggcccagcacgcccuggccggcaugcagaagcugcugagcgaggagagauucgugagcauggagaccgacagcgacgagaagcagcugcugaaccagauccugaacgccgugaaggugacccccagccugaacgaggaccugcagguggaggugaugaaggugcugcugugcaucaccuacacccccaccuucgaccugaacggcagcgccgugcugaagaucgccgaggugugcaucgagaccuacaucagcagcugccaccagagaagcaucaacaccgccgugagagccacccugagccagaugcugagcgaccugacccugcagcugagacagagacaggagaacaccaucaucgagaaccccgacgugccccaggacuucggcaaccagggcagcaccguggagagccugugcgacgacguggugagcgugcugaccgugcugugcgagaagcugcaggccgccaucaacgacagccagcagcugcagcugcuguaccuggagugcauccugagcgugcugagcagcagcagcagcagcaugcaccugcacagaagauucaccgaccugaucuggaagaaccugugccccgcccugaucgugauccugggcaaccccauccacgacaagaccaucaccagcgcccacaccagcagcaccagcaccagccuggagagcgacagcgccagccccggcgugagcgaccacggcagaggcagcggcugcagcugcaccgcccccgcccugagcggccccguggccagaaccaucuacuacaucgccgccgagcuggugagacuggugggcagcguggacagcaugaagcccgugcugcagagccuguaccacagagugcugcuguacccccccccccagcacagaguggaggccaucaagaucaugaaggagauccugggcagcccccagagacugugcgaccuggccggccccagcagcaccgagagcgagagcagaaagagaagcaucagcaagagaaagagccaccuggaccugcugaagcugaucauggacggcaugaccgaggccugcaucaagggcggcaucgaggccugcuacgccgccgugagcugcgugugcacccugcugggcgcccuggacgagcugagccagggcaagggccugagcgagggccaggugcagcugcugcugcugagacuggaggagcugaaggacggcgccgaguggagcagagacagcauggagaucaacgaggccgacuucagauggcagagaagagugcugagcagcgagcacacccccugggagagcggcaacgagagaagccuggacaucagcaucagcgugaccaccgacaccggccagaccacccuggagggcgagcugggccagaccacccccgaggaccacagcggcaaccacaagaacagccugaagagccccgccauccccgagggcaaggagacccugagcaaggugcuggagaccgaggccguggaccagcccgacguggugcagagaagccacaccgugcccuaccccgacaucaccaacuuccugagcguggacugcagaaccagaagcuacggcagcagauacagcgagagcaacuucagcguggacgaccaggaccugagcagaaccgaguucgacagcugcgaccaguacagcauggccgccgagaaggacagcggcagaagcgacgugagcgacaucggcagcgacaacugcagccuggccgacgaggagcagacccccagagacugccugggccacagaagccugagaaccgccgcccugagccugaagcugcugaagaaccaggaggccgaccagcacagcgccagacuguucauccagagccuggagggccugcugcccagacugcugagccugagcaacguggaggagguggacaccgcccugcagaacuucgccagcaccuucugcagcggcaugaugcacagccccggcuucgacggcaacagcagccugagcuuccagaugcugaugaacgccgacagccuguacaccgccgcccacugcgcccugcugcugaaccugaagcugagccacggcgacuacuacagaaagagacccacccuggcccccggcgugaugaaggacuucaugaagcaggugcagaccagcggcgugcugaugguguucagccaggccuggaucgaggagcuguaccaccaggugcuggacagaaacaugcugggcgaggccggcuacuggggcagccccgaggacaacagccugccccugaucaccaugcugaccgacaucgacggccuggagagcagcgccaucggcggccagcugauggccagcgccgccaccgagagccccuucgcccagagcagaagaaucgacgacagcaccguggccggcguggccuucgccagauacauccuggugggcugcuggaagaaccugaucgacacccugagcaccccccugaccggcagaauggccggcagcagcaagggccuggccuucauccugggcgccgagggcaucaaggagcagaaccagaaggagagagacgccaucugcaugagccuggacggccugagaaaggccgccagacugagcugcgcccugggcguggccgccaacugcgccagcgcccuggcccagauggccgccgccagcugcgugcaggaggagaaggaggagagagaggcccaggagcccagcgacgccaucacccaggugaagcugaagguggagcagaagcuggagcagaucggcaaggugcagggcguguggcugcacaccgcccacgugcugugcauggaggccauccugagcgugggccuggagaugggcagccacaaccccgacugcuggccccacguguucagagugugcgaguacgugggcacccuggagcacaaccacuucagcgacggcgccagccagcccccccugaccaucagccagccccagaaggccaccggcagcgccggccugcugggcgaccccgagugcgagggcagcccccccgagcacagccccgagcagggcagaagccugagcaccgcccccguggugcagccccugagcauccaggaccuggugagagagggcagcagaggcagagccagcgacuucagaggcggcagccugaugagcggcagcagcgccgccaagguggugcugacccugagcacccaggccgacagacuguucgaggacgccaccgacaagcugaaccugauggcccugggcggcuuccuguaccagcugaagaaggccagccagagccagcuguuccacagcgugaccgacaccguggacuacagccuggccaugcccggcgaggugaagagcacccaggacagaaagagcgcccugcaccuguucagacugggcaacgccaugcugagaaucgugagaagcaaggccagaccccugcugcacgugaugagaugcuggagccugguggccccccaccugguggaggccgccugccacaaggagagacacgugagccagaaggccgugagcuucauccacgacauccugaccgaggugcugaccgacuggaacgagcccccccacuuccacuucaacgaggcccuguucagacccuucgagagaaucaugcagcuggagcugugcgacgaggacgugcaggaccagguggugaccagcaucggcgagcugguggaggugugcagcacccagauccagagcggcuggagaccccuguucagcgcccuggagaccgugcacggcggcaacaagagcgagaugaaggaguaccuggugggcgacuacagcaugggcaagggccaggcccccguguucgacguguucgaggccuuccugaacaccgacaacauccagguguucgccaacgccgccaccagcuacaucaugugccugaugaaguucgugaagggccugggcgagguggacugcaaggagaucggcgacugcgcccccgcccccggcgcccccagcaccgaccugugccugcccgcccuggacuaccugagaagaugcagccagcugcuggccaagaucuacaagaugccccugaagcccaucuuccugagcggcagacuggccggccugcccagaagacugcaggagcagagcgccagcagcgaggacggcaucgagagcgugcugagcgacuucgacgacgacaccggccugaucgagguguggaucauccugcuggagcagcugaccgccgccgugagcaacugccccagacagcaccagccccccacccuggaccugcuguucgagcugcugagagacgugaccaagacccccggccccggcuucggcaucuacgccguggugcaccugcugcugcccgugaugagcguguggcugagaagaagccacaaggaccacagcuacugggacauggccagcgccaacuucaagcacgccaucggccugagcugcgagcuggugguggagcacauccagagcuuccugcacagcgacaucagauacgagagcaugaucaacaccaugcugaaggaccuguucgagcugcugguggccugcguggccaagcccaccgagaccaucagcagagugggcugcagcugcaucagauacgugcuggugaccgccggccccguguucaccgaggagauguggagacuggccugcugcgcccugcaggacgccuucagcgccacccugaagcccgugaaggaccugcugggcugcuuccacagcggcaccgagagcuucagcggcgagggcugccaggugagaguggccgcccccagcagcagccccagcgccgaggccgaguacuggagaaucagagccauggcccagcagguguucaugcuggacacccagugcagccccaagacccccaacaacuucgaccacgcccagagcugccagcugaucaucgagcugccccccgacgagaagcccaacggccacaccaagaagagcgugagcuucagagagaucguggugagccugcugagccaccaggugcugcugcagaaccuguacgacauccugcuggaggaguucgugaagggccccagccccggcgaggagaagaccauccaggugcccgaggccaagcuggccggcuuccugagauacaucagcaugcagaaccuggccgugaucuucgaccugcugcuggacagcuacagaaccgccagagaguucgacaccagccccggccugaagugccugcugaagaaggugagcggcaucggcggcgccgccaaccuguacagacagagcgccaugagcuucaacaucuacuuccacgcccuggugugcgccgugcugaccaaccaggagaccaucaccgccgagcaggugaagaaggugcuguucgaggacgacgagagaagcaccgacagcagccagcagugcagcagcgaggacgaggacaucuucgaggagaccgcccaggugagcccccccagaggcaaggagaagagacaguggagagccagaaugccccugcugagcgugcagcccgugagcaacgccgacuggguguggcuggugaagagacugcacaagcugugcauggagcugugcaacaacuacauccagaugcaccuggaccuggagaacugcauggaggagccccccaucuucaagggcgaccccuucuucauccugcccagcuuccagagcgagagcagcacccccagcaccggcggcuucagcggcaaggagacccccagcgaggacgacagaagccagagcagagagcacaugggcgagagccugagccugaaggccggcggcggcgaccugcugcugccccccagccccaagguggagaagaaggaccccagcagaaagaaggaguggugggagaacgccggcaacaagaucuacaccauggccgccgacaagaccaucagcaagcugaugaccgaguacaagaagagaaagcagcagcacaaccugagcgccuuccccaaggaggugaagguggagaagaagggcgagccccugggccccagaggccaggacagcccccugcugcagagaccccagcaccugauggaccagggccagaugagacacagcuucagcgccggccccgagcugcugagacaggacaagagacccagaagcggcagcaccggcagcagccugagcgugagcgugagagacgccgaggcccagauccaggccuggaccaacauggugcugaccgugcugaaccagauccagauccugcccgaccagaccuucaccgcccugcagcccgccguguuccccugcaucagccagcugaccugccacgugaccgacaucagagugagacaggccgugagagaguggcugggcagagugggcagaguguacgacaucaucguguaa

SEQ ID NO: 13758 - RNA, 1122 nt, Artificial Sequence
  ARFIP1__Homo_sapiens__NP_001020766
auggcccaggagagccccaagaacagcgccgccgagauccccgugaccagcaacggcgagguggacgacagcagagagcacagcuucaacagagaccugaagcacagccugcccagcggccugggccugagcgagacccagaucaccagccacggcuucgacaacaccaaggagggcgugaucgaggccggcgccuuccagggcagccccgcccccccccugcccagcgugaugagccccagcagaguggccgccagcagacuggcccagcagggcagcgaccugaucgugcccgccggcggccagagaacccagaccaagagcggccccgugauccuggccgacgagaucaagaaccccgccauggagaagcuggagcuggugagaaaguggagccugaacaccuacaagugcaccagacagaucaucagcgagaagcugggcagaggcagcagaaccguggaccuggagcuggaggcccagaucgacauccugagagacaacaagaagaaguacgagaacauccugaagcuggcccagacccugagcacccagcuguuccagauggugcacacccagagacagcugggcgacgccuucgccgaccugagccugaagagccuggagcugcacgaggaguucggcuacaacgccgacacccagaagcugcuggccaagaacggcgagacccugcugggcgccaucaacuucuucaucgccagcgugaacacccuggugaacaagaccaucgaggacacccugaugaccgugaagcaguacgagagcgccagaaucgaguacgacgccuacagaaccgaccuggaggagcugaaccugggccccagagacgccaacacccugcccaagaucgagcagagccagcaccuguuccaggcccacaaggagaaguacgacaagaugagaaacgacgugagcgugaagcugaaguuccuggaggagaacaaggugaaggugcugcacaaccagcuggugcuguuccacaacgccaucgccgccuacuucgccggcaaccagaagcagcuggagcagacccugaagcaguuccacaucaagcugaagacccccggcguggacgcccccagcuggcuggaggagcaguaa

SEQ ID NO: 13759 - RNA, 522 nt, Artificial Sequence
  ARFRP1__Homo_sapiens__NP_001128230
auguacacccugcugagcggccuguacaaguacauguuccagaaggacgaguacugcauccugauccugggccuggacaacgccggcaagaccaccuuccuggagcagagcaagaccagauucaacaagaacuacaagggcaugagccugagcaagaucaccaccaccgugggccugaacaucggcaccguggacgugggcaaggccagacugauguucugggaccugggcggccaggaggagcugcagagccugugggacaaguacuacgccgagugccacggcgugaucuacgugaucgacagcaccgacgaggagagacuggccgagagcaagcaggccuucgagaagguggugaccagcgaggcccugugcggcgugcccgugcuggugcuggccaacaagcaggacguggagaccugccugagcauccccgacaucaagaccgccuucagcgacugcaccagcaagaucggcagaagagacugccugacccaggccugcagcgcccugaccggcuaa

SEQ ID NO: 13760 - RNA, 969 nt, Artificial Sequence
  ARG1__Homo_sapiens__NP_000036
augagcgccaagagcagaaccaucggcaucaucggcgcccccuucagcaagggccagcccagaggcggcguggaggagggccccaccgugcugagaaaggccggccugcuggagaagcugaaggagcaggagugcgacgugaaggacuacggcgaccugcccuucgccgacauccccaacgacagccccuuccagaucgugaagaaccccagaagcgugggcaaggccagcgagcagcuggccggcaagguggccgaggugaagaagaacggcagaaucagccuggugcugggcggcgaccacagccuggccaucggcagcaucagcggccacgccagagugcaccccgaccugggcgugaucuggguggacgcccacaccgacaucaacaccccccugaccaccaccagcggcaaccugcacggccagcccgugagcuuccugcugaaggagcugaagggcaagauccccgacgugcccggcuucagcugggugacccccugcaucagcgccaaggacaucguguacaucggccugagagacguggaccccggcgagcacuacauccugaagacccugggcaucaaguacuucagcaugaccgagguggacagacugggcaucggcaaggugauggaggagacccugagcuaccugcugggcagaaagaagagacccauccaccugagcuucgacguggacggccuggaccccagcuucacccccgccaccggcacccccguggugggcggccugaccuacagagagggccuguacaucaccgaggagaucuacaagaccggccugcugagcggccuggacaucauggaggugaaccccagccugggcaagacccccgaggaggugaccagaaccgugaacaccgccguggccaucacccuggccugcuucggccuggccagagagggcaaccacaagcccaucgacuaccugaacccccccaaguaa

SEQ ID NO: 13761 - RNA, 822 nt, Artificial Sequence
  ARGLU1__Homo_sapiens__NP_060481
augggcagaagcagaagcagaagcagcagcagaagcaagcacaccaagagcagcaagcacaacaagaagagaagcagaagcagaagcagaagcagagacaaggagagagugagaaagagaagcaagagcagagagagcaagagaaacagaagaagagagagcagaagcagaagcagaagcaccaacaccgccgugagcagaagagagagagacagagagagagccagcagcccccccgacagaaucgacaucuucggcagaaccgugagcaagagaagcagccuggacgagaagcagaagagagaggaggaggagaagaaggccgaguucgagagacagagaaagaucagacagcaggagaucgaggagaagcugaucgaggaggagaccgccagaagaguggaggagcugguggccaagagaguggaggaggagcuggagaagagaaaggacgagaucgagagagaggugcugagaagaguggaggaggccaagagaaucauggagaagcagcugcuggaggagcuggagagacagagacaggccgagcuggccgcccagaaggccagagaggaggaggagagagccaagagagaggagcuggagagaauccuggaggagaacaacagaaagaucgccgaggcccaggccaagcuggccgaggagcagcugagaaucguggaggagcagagaaagauccacgaggagagaaugaagcuggagcaggagagacagagacagcagaaggaggagcagaagaucauccugggcaagggcaagagcagacccaagcugagcuucagccugaagacccaggacuaa

SEQ ID NO: 13762 - RNA, 2361 nt, Artificial Sequence
  ARHGAP10__Homo_sapiens__NP_078881
augggccugcagccccuggaguucagcgacugcuaccuggacagccccugguucagagagagaaucagagcccacgaggccgagcuggagagaaccaacaaguucaucaaggagcugaucaaggacggcaagaaccugaucgccgccaccaagagccugagcguggcccagagaaaguucgcccacagccugagagacuucaaguucgaguucaucggcgacgccgugaccgacgacgagagaugcaucgacgccagccugagagaguucagcaacuuccugaagaaccuggaggagcagagagagaucauggcccugagcgugaccgagacccugaucaagccccuggagaaguucagaaaggagcagcugggcgccgugaaggaggagaagaagaaguucgacaaggagaccgagaagaacuacagccugaucgacaagcaccugaaccugagcgccaagaagaaggacagccaccugcaggaggccgacauccagguggagcagaacagacagcacuucuacgagcugagccuggaguacgugugcaagcugcaggagauccaggagagaaagaaguucgaguucguggagcccaugcugagcuucuuccagggcauguucaccuucuaccaccagggccacgagcuggccaaggacuucaaccacuacaagauggagcugcagaucaacauccagaacaccagaaacagauucgagggcaccagaagcgagguggaggagcugaugaacaagaucagacagaaccccaaggaccacaagagagccagccaguucaccgccgagggcuaccuguacgugcaggagaagagacccgcccccuucggcagcagcugggugaagcacuacugcauguacagaaaggccgccaagaaguucaacaugauccccuucgagcacagaagcggcggcaagcugggcgacggcgagguguucuuccugaaggagugcaccaagagacacaccgacagcaucgacagaagauucugcuucgacaucgaggccgccgacagacccggcgugagccugaccaugcaggccuucagcgaggaggagagaaagcaguggcuggaggcccugggcggcaaggaggcccugagccacagcuucaacaccgccaucauccccagacccgagggcaacgcccagcuggacaagaugggcuucaccaucaucagaaagugcaucagcgccguggagaccagaggcaucaacgaccagggccuguacagaguggugggcgugagcagcaaggugcagagacugcugagcaugcugauggacgugaagaccugcaacgagguggaccuggagaacagcgccgacugggaggugaagaccaucaccagcgcccugaagcaguaccugagaagccugcccgagccccugaugaccuacgagcugcacggcgacuucaucgugcccgccaagagcggcagccccgagagcagagugaacgccauccacuuccuggugcacaagcugcccgagaagaacaaggagaugcuggacauccuggugaagcaccugaccaacgugagcaaccacagcaagcagaaccugaugaccguggccaaccugggcgugguguucggccccacccugaugagaccccaggaggagaccguggccgcccugauggaccugaaguuccagaacaucgugguggagauccugaucgagaaccacgagaagaucuucagaaccccccccgacaccaccuuccccgagcccaccugccugagcgccagcccccccaacgccccccccagacagagcaagagacagggccagagaaccaagagacccguggccguguacaaccugugccuggagcuggaggacggcgacaaccccuaccccagcaaggaggacacccccaccagcagccuggacagccugagcagccccagccccgugaccaccgccgugcccggcccccccggccccgacaagaaccaccugcuggccgacggcggcagcuucggcgacugggccagcaccauccccggccagaccagaagcagcauggugcaguggcugaacccccagagccccaccaccaccagcagcaacagcgccgugaccccccugagccccggcagcagccccuuccccuucagcccccccgccaccguggccgacaagccccccgagagcaucagaagcagaaaggccagagccguguaccccugcgaggccgagcacagcagcgagcugagcuucgagaucggcgccaucuucgaggacgugcagaccagcagagagcccggcuggcuggagggcacccugaacggcaagagaggccugaucccccagaacuacgugaagcugcuguaa

SEQ ID NO: 13763 - RNA, 2505 nt, Artificial Sequence
  ARHGAP11A__Homo_sapiens__NP_001273408
auggacagcagcaaccuggccgugaucuucgcccccaaccugcugcagaccagcgagggccacgagaagaugagcagcaacaccgagaagaagcugagacugcaggccgccguggugcagacccugaucgacuacgccagcgacaucggcagagugcccgacuucauccuggagaagauccccgccaugcugggcaucgacggccugugcgccacccccagccuggagggcuucgaggagggcgaguacgagacccccggcgaguacaagagaaagagaagacagagcgugggcgacuucgugagcggcgcccugaacaaguucaagcccaacagaacccccagcaucaccccccaggaggagagaaucgcccagcugagcgagagccccgugauccugacccccaacgccaagagaacccugcccguggacagcagccacggcuucagcagcaagaagagaaagagcaucaagcacaacuucaacuucgagcugcugcccagcaaccuguucaacagcagcagcacccccgugagcgugcacaucgacaccagcagcgagggcagcagccagagcagccugagccccgugcugaucggcggcaaccaccugaucaccgccggcgugcccagaagaagcaagagaaucgccggcaagaaggugugcagaguggagagcggcaaggccggcugcuucagccccaagaucagccacaaggagaaggugagaagaagccugagacugaaguucaaccugggcaagaacggcagagaggugaacggcugcagcggcgugaacagauacgagagcgugggcuggagacuggccaaccagcagagccugaagaacagaaucgagagcgugaagaccggccugcuguucagccccgacguggacgagaagcugcccaagaagggcagcgagaagaucagcaagagcgaggagacccugcugacccccgagagacuggugggcaccaacuacagaaugagcuggaccggccccaacaacagcagcuuccaggagguggacgccaacgaggccagcagcaugguggagaaccuggagguggagaacagccuggagcccgacaucaugguggagaagagccccgccaccagcugcgagcugacccccagcaaccugaacaacaagcacaacagcaacaucaccagcagcccccugagcggcgacgagaacaacaugaccaaggagacccuggugaaggugcagaaggccuucagcgagagcggcagcaaccugcacgcccugaugaaccagagacagagcagcgugaccaacgugggcaaggugaagcugaccgagcccagcuaccuggaggacagccccgaggagaaccuguucgagaccaacgaccugaccaucguggagagcaaggagaaguacgagcaccacaccggcaagggcgagaagugcuucagcgagagagacuucagcccccugcagacccagaccuucaacagagagaccaccaucaagugcuacagcacccagaugaagauggagcacgagaaggacauccacagcaacaugcccaaggacuaccugagcaagcaggaguucagcagcgacgaggagaucaagaagcagcagagccccaaggacaagcugaacaacaagcugaaggagaacgagaacaugauggagggcaaccugcccaagugcgccgcccacagcaaggacgaggccagaagcagcuucagccagcagagcaccugcguggugaccaaccugagcaagcccagacccaugagaaucgccaagcagcagagccuggagaccugcgagaagaccgugagcgagagcagccagaugaccgagcacagaaaggugagcgaccacauccagugguucaacaagcugagccugaacgagcccaacagaaucaaggugaagagcccccugaaguuccagagaacccccgugagacagagcgugagaagaaucaacagccugcuggaguacagcagacagcccaccggccacaagcuggccagccugggcgacaccgccagcccccuggugaagagcgugagcugcgacggcgcccugagcagcugcaucgagagcgccagcaaggacagcagcgugagcugcaucaagagcggccccaaggagcagaagagcaugagcugcgaggagagcaacaucggcgccaucagcaagagcagcauggagcugcccagcaagagcuuccugaagaugagaaagcaccccgacagcgugaacgccagccugagaagcaccaccguguacaagcagaagauccugagcgacggccaggugaaggugccccuggacgaccugaccaaccacgacaucgugaagcccguggugaacaacaacaugggcaucagcagcggcaucaacaacagagugcugagaagacccagcgagagaggcagagccugguacaagggcagccccaagcaccccaucggcaagacccagcugcugcccaccagcaagcccguggaccuguaa

SEQ ID NO: 13764 - RNA, 804 nt, Artificial Sequence
  ARHGAP11B__Homo_sapiens__NP_001034930
augugggaccagagacuggugaagcuggcccugcugcagcaccugagagccuucuacggcaucaaggugaagggcgugagaggccagugcgacagaagaagacacgagaccgccgccaccgagaucggcggcaagaucuucggcgugcccuucaacgcccugccccacagcgccgugcccgaguacggccacauccccagcuuccugguggacgccugcaccagccuggaggagcacauccacaccgagggccuguucagaaagagcggcagcgugaucagacugaaggcccugaagaacaagguggaccacggcgagggcugccugagcagcgccccccccugcgacaucgccggccugcugaagcaguucuucagagagcugcccgagcccauccugcccgccgaccugcacgaggcccugcugaaggcccagcagcugggcaccgaggagaagaacaaggccauccugcugcugagcugccugcuggccgaccacaccgugcacgugcugagauacuucuucaacuuccugagaaacgugagccugagaagcagcgagaacaagauggacagcagcaaccuggccgugaucuucgcccccaaccugcugcagaccagcgagggccacgagaagaugagcagcaacgccgagaagaagggcguguaccagacccugagcuggaagagauaccagcccugcugggugcugauggugagcgugcugcugcaccacuggaaggcccugaagaaggugaacaugaagcugcuggugaacaucagagagagagaggacaacguguaa

SEQ ID NO: 13765 - RNA, 1428 nt, Artificial Sequence
  ARHGAP15__Homo_sapiens__NP_060930
augcagaagagcaccaacagcgacaccagcguggagacccugaacagcaccagacagggcaccggcgccgugcagaugagaaucaagaacgccaacagccaccacgacagacugagccagagcaagagcaugauccugaccgacgugggcaaggugaccgagcccaucagcagacacagaagaaaccacagccagcacauccugaaggacgugauccccccccuggagcagcugaugguggagaaggagggcuaccugcagaaggccaagaucgccgacggcggcaagaagcugagaaagaacuggagcaccagcuggaucgugcugagcagcagaagaaucgaguucuacaaggagagcaagcagcaggcccugagcaacaugaagaccggccacaagcccgagagcguggaccugugcggcgcccacaucgagugggccaaggagaagagcagcagaaagaacguguuccagaucaccaccgugagcggcaacgaguuccugcugcagagcgacaucgacuucaucauccuggacugguuccacgccaucaagaacgccaucgacagacugcccaaggacagcagcugccccagcagaaaccuggagcuguucaagauccagagaagcagcagcaccgagcugcugagccacuacgacagcgacaucaaggagcagaagcccgagcacagaaagagccugauguucagacugcaccacagcgccagcgacaccagcgacaagaacagagugaagagcagacugaagaaguucaucaccagaagacccagccugaagacccugcaggagaagggccugaucaaggaccagaucuucggcagccaccugcacaaggugugcgagagagagaacagcaccgugcccugguucgugaagcagugcaucgaggccguggagaagagaggccuggacguggacggcaucuacagagugagcggcaaccuggccaccauccagaagcugagauucaucgugaaccaggaggagaagcugaaccuggacgacagccagugggaggacauccacguggugaccggcgcccugaagauguucuucagagagcugcccgagccccuguuccccuacagcuucuucgagcaguucguggaggccaucaagaagcaggacaacaacaccagaaucgaggccgugaagagccuggugcagaagcugcccccccccaacagagacaccaugaaggugcuguucggccaccugaccaagaucguggccaaggccagcaagaaccugaugagcacccagagccugggcaucguguucggccccacccugcugagagccgagaacgagaccggcaacauggccauccacaugguguaccagaaccagaucgccgagcugaugcugagcgaguacagcaagaucuucggcagcgaggaggacuaa

SEQ ID NO: 13766 - RNA, 1992 nt, Artificial Sequence
  ARHGAP18__Homo_sapiens__NP_277050
augagcuggcugagcagcagccagggcguggugcugaccgccuaccaccccagcggcaaggaccagaccgugggcaacagccacgccaaggccggcgaggaggccaccagcagcagaagauacggccaguacaccaugaaccaggagagcaccaccaucaaggugauggagaagccccccuucgacagaagcaucagccaggacagccuggacgagcugagcauggaggacuacuggaucgagcuggagaacaucaagaagagcagcgagaacagccaggaggaccaggagguggugguggugaaggagcccgacgagggcgagcuggaggaggaguggcugaaggaggccggccugagcaaccuguucggcgagagcgccggcgacccccaggagagcaucguguuccugagcacccugaccagaacccaggccgccgccgugcagaagagaguggagaccgugagccagacccugagaaagaagaacaagcaguaccagauccccgacgugagagacaucuucgcccagcagagagagagcaaggagaccgcccccggcggcaccgagagccagagccugagaaccaacgagaacaaguaccagggcagagacgacgaggccagcaaccuggugggcgaggagaagcugaucccccccgaggagacccccgcccccgagaccgacaucaaccuggaggugagcuucgccgagcaggcccugaaccagaaggagagcagcaaggagaagauccagaagagcaagggcgacgacgccacccugcccagcuucagacugcccaaggacaagaccggcaccaccagaaucggcgaccuggccccccaggacaugaagaaggugugccaccuggcccugaucgagcugaccgcccuguacgacgugcugggcaucgagcugaagcagcagaaggccgugaagaucaagaccaaggacagcggccuguucugcgugccccugaccgcccugcuggagcaggaccagagaaaggugcccggcaugagaaucccccugaucuuccagaagcugaucagcagaaucgaggagagaggccuggagaccgagggccugcugagaauccccggcgccgccaucagaaucaagaaccugugccaggagcuggaggccaaguucuacgagggcaccuucaacugggagagcgugaagcagcacgacgccgccagccugcugaagcuguucaucagagagcugccccagccccugcugagcguggaguaccugaaggccuuccaggccgugcagaaccugcccaccaagaagcagcagcugcaggcccugaaccugcuggugauccugcugcccgacgccaacagagacacccugaaggcccugcuggaguuccugcagagagugaucgacaacaaggagaagaacaagaugaccgugaugaacguggccauggugauggcccccaaccuguucaugugccacgcccugggccugaagagcagcgagcagagagaguucgugauggccgccggcaccgccaacaccaugcaccugcugaucaaguaccagaagcugcuguggaccauccccaaguucaucgugaaccaggugagaaagcagaacaccgagaaccacaagaaggacaagagagccaugaagaagcugcugaagaagauggccuacgacagagagaaguacgagaagcaggacaagagcaccaacgacgccgacgugccccagggcgugaucagagugcaggccccccaccugagcaaggugagcauggccauccagcugaccgaggagcugaaggccagcgacgugcuggccagauuccugagccaggagagcggcguggcccagacccugaagaagggcgagguguuccuguacgagaucggcggcaacaucggcgagagaugccuggacgacgacaccuacaugaaggaccuguaccagcugaaccccaacgccgagugggugaucaagagcaagccccuguaa

SEQ ID NO: 13767 - RNA, 1320 nt, Artificial Sequence
  ARHGAP1__Homo_sapiens__XP_011518397
auggacccccugagcgagcugcaggacgaccugacccuggacgacaccagcgaggcccugaaccagcugaagcuggccagcaucgacgagaagaacuggcccagcgacgagaugcccgacuuccccaagagcgacgacagcaagagcagcagccccgagcuggugacccaccugaagugggacgaccccuacuacgacaucgccagacaccagaucguggagguggccggcgacgacaaguacggcagaaagaucaucguguucagcgccugcagaaugccccccagccaccagcuggaccacagcaagcugcugggcuaccugaagcacacccuggaccaguacguggagagcgacuacacccugcuguaccugcaccacggccugaccagcgacaacaagcccagccugagcuggcugagagacgccuacagagaguucgacagaaaguacaagaagaacaucaaggcccuguacaucgugcaccccaccauguucaucaagacccugcugauccuguucaagccccugaucagcuucaaguucggccagaagaucuucuacgugaacuaccugagcgagcugagcgagcacgugaagcuggagcagcugggcauccccagacaggugcugaaguacgacgacuuccugaagagcacccagaagagccccgccaccgcccccaagcccaugccccccagacccccccugcccaaccagcaguucggcgugagccugcagcaccugcaggagaagaaccccgagcaggagcccauccccaucgugcugagagagaccguggccuaccugcaggcccacgcccugaccaccgagggcaucuucagaagaagcgccaacacccagguggugagagaggugcagcagaaguacaacaugggccugcccguggacuucgaccaguacaacgagcugcaccugcccgccgugauccugaagaccuuccugagagagcugcccgagccccugcugaccuucgaccuguacccccacguggugggcuuccugaacaucgacgagagccagagagugcccgccacccugcaggugcugcagacccugcccgaggagaacuaccaggugcugagauuccugaccgccuuccuggugcagaucagcgcccacagcgaccagaacaagaugaccaacaccaaccuggccgugguguucggccccaaccugcugugggccaaggacgccgccaucacccugaaggccaucaaccccaucaacaccuucaccaaguuccugcuggaccaccagggcgagcuguuccccagccccgaccccagcggccuguaa

SEQ ID NO: 13768 - RNA, 3507 nt, Artificial Sequence
  ARHGAP20__Homo_sapiens__NP_001245344
augagcgccagagagagacagcccgcccugaagaagaagaugaagacccuggccgagagaagaagaagcgcccccagccugauccuggacaaggcccugcagaagagacccaccaccagagacagccccagcgccagcguggacaccugcaccuuccugagcagccuggugugcagcaacagaacccugcugaucgacggcagagccgagcugaagagaggccugcagagacaggagagacaccuguuccuguucaacgaccuguucgugguggccaagaucaaguacaacaacaacuucaagaucaagaacaagaucaagcugaccgacauguggaccgccagcugcguggacgaggugggcgagggcaacaccaacgccaugaagagcuucgugcugggcuggcccaccgugaacuucguggccaccuucagcagccccgagcagaaggacaaguggcugagccugcugcagagauacaucaaccuggagaaggagaaggacuaccccaagagcaucccccugaagaucuucgccaaggacaucggcaacugcgccuacagcaagaccaucaccgugaugaacagcgacaccgccaacgaggugaucaacaugagccugcccaugcugggcaucaccggcagcgagagagacuaccagcugugggugaacagcggcaaggaggaggcccccuacccccugaucggccacgaguaccccuacggcaucaagaugagccaccugagagacagcgcccugcugacccccggcagcaaggacagcaccacccccuucaaccugcaggagcccuuccugauggagcagcugcccagagagaugcagugccaguucauccugaagcccagcagacuggccgccgcccagcagcugagcgacagcggccacaagaccuucaagagaagaagaagcaucaucaacugggccuucuggagaggcagcagcacccaccuggacaaccugcccagcagccccaccagccccaugcccggccagcuguucggcaucagccugcccaacaucugcgagaacgacaaccugcccaagcccgugcuggacaugcuguucuuccugaaccagaagggcccccugaccaagggcaucuucagacagagcgccaacgugaagagcugcagagagcugaaggagaagcugaacagcggcguggaggugcaccuggacugcgagagcaucuucgugaucgccagcgugcugaaggacuuccugagaaacauccccggcagcaucuucagcagcgaccuguacgaccacugggugagcgugauggaccagggcaacgacgaggagaagaucaacaccgugcagagacugcuggaccagcugcccagagccaacguggugcugcugagauaccuguucggcgugcugcacaacaucgagcagcacagcagcagcaaccagaugaccgccuucaaccuggccgugugcguggcccccagcauccuguggccccccgccagcagcagccccgagcuggagaacgaguucaccaagaaggugagccugcugauccaguuccugaucgagaacugccugagaaucuucggcgaggagaucaccagccuguucagagaggugagcgugagaugcgacaccagagagaacgccagcgacaucagcugcuuccagcugaacgacagcagcuacgacagccuggagaacgagcugaacgaggacguggacgcccccugcagcgaccuggugaagaagcugggccagggcagcagaagcauggacagcgugcugacccugagcgacuacgaccuggaccagcccgagguggagggccugcugacccugagcgacuucgaccuggcccacagcaaggacgaggacgugcagaugaagagaccccuggagagcaagcccgugaacauccugguguacaccaagaucccccugagagaccacgccagagcccccagcgccaugugcacccccagcuaccugagcaccgccgccgccaacgccgccaagagccugagaagacacagaagaugcagcgagcccagcaucgacuaccuggacagcaagcugagcuaccugagagaguucuaccagaagaagcugagaaagagcagcugcgacgccauccugagccagaaggacgaggacuaccugaagcagaaccagccccugcaggaggagggcaagaccugcuucaagcagagccuggugaccggcaccgacgugagcaagaagaacgccaccacccagaacaccaagaagaagagccugagcggcagcgagggcaaccacgugaagcuguuccccaagagcaagcccguggccaucagcguggccagcuacagccccaugagcagccaggaccacagcaagaaccagcccuucgacgugaacaccagcggcuacagccccccccacaccgccgacgcccugaagggccccagaacccacagaagaugcagcgagcccaacaucgaggaccagaacagaaagcugaccuaccugagaggcaucuacagcaagaagcagcacaagaccagcugcgaggccggccugcugcacggcgaggaggacuaccugaagagacacaagagccugcagauggagggccagaagcugaucaaccagagccuggugaugggcaucgaggugggcaagagcagcgccaccaaccagaacaccgagaaggugcugccccccagacugaaccugugccccagaaccagcuacagcagccugagcagccccggcaccagccccagcggcagcagcgugagcagccaggacagcgccuucagccagaucagcgagcacagcguguucacccccaccgagaccagcagccccaucgacugcaccuuccaggcccagagaaagagagaggaccugagccccgacuucagcaacgccagccacgugagcggcaugcccggccccagcagcggccaggccugcagcagacccgccuacaccaagaaggacaccauggaguggcacagccagaugcacagcgugacccugcaccccagcaccuggcugagaaacggcguggccagccugaagaacuggagccugaagaagaaggccaaggccgccagacccgaggaggagaagaucgccagccccaagggcccccuggagccccccccccacgccagcggcgugcccgaggccaacagccugcaggaggagcagaaggaccugccccugagagccgccgagggccugagccccgugcagagcgcccagagaugcagcagcagccccuuccaggacagcgagagacacugcagcagccccuucagccugguggagagcagacugaagcugugcaugaagagccacgaggagaucgagcccggcagccagagcagcagcggcagccugcccugggagagagccagcgccagcagcuggacccuggaggacgccaccagccccgacagcggccccaccguggugugcgacaucgaggacagauaccugaccaaggacaucuaa

SEQ ID NO: 13769 - RNA, 5877 nt, Artificial Sequence
  ARHGAP21__Homo_sapiens__XP_005252599
augauggccaccagaagaaccggccugagcgagggcgacggcgacaagcugaaggccugcgaggugagcaagaacaaggacggcaaggagcagagcgagaccgugagccugagcgaggacgagaccuucagcuggcccggccccaagaccgugacccugaagagaaccagccagggcuucggcuucacccugagacacuucaucguguacccccccgagagcgccauccaguucagcuacaaggacgaggagaacggcaacagaggcggcaagcagagaaacagacuggagcccauggacaccaucuucgugaagcaggugaaggagggcggccccgccuucgaggccggccugugcaccggcgacagaaucaucaaggugaacggcgagagcgugaucggcaagaccuacagccaggugaucgcccugauccagaacagcgacaccacccuggagcugagcgugaugcccaaggacgaggacauccugcaggugcugcaguucaccaaggacgugaccgcccuggccuacagccaggacgccuaccugaagggcaacgaggccuacagcggcaacgccagaaacauccccgagcccccccccaucugcuaccccuggcugcccagcgcccccagcgccauggcccagcccguggagaucagcccccccgacagcagccugagcaagcagcagaccagcacccccgugcugacccagcccggcagagccuacagaauggagauccaggugccccccagccccaccgacguggccaagagcaacaccgccgugugcgugugcaacgagagcgugagaaccgugaucgugcccagcgagaaggugguggaccugcugagcaacagaaacaaccacaccggccccagccacagaaccgaggaggugagauacggcgugagcgagcagaccagccugaagaccgugagcagaaccaccagccccccccugagcauccccaccacccaccugauccaccagcccgccggcagcagaagccuggagcccagcggcauccugcugaagagcggcaacuacagcggccacagcgacggcaucagcagcagcagaagccaggccguggaggcccccagcgugagcgugaaccacuacagccccaacagccaccagcacaucgacuggaagaacuacaagaccuacaaggaguacaucgacaacagaagacugcacaucggcugcagaaccauccaggagagacuggacagccugagagccgccagccagagcaccaccgacuacaaccagguggugcccaacagaaccacccugcagggcagaagaagaagcaccagccacgacagagugccccagagcgugcagaucagacagagaagcgugagccaggagagacuggaggacagcgugcugaugaaguacugccccagaagcgccagccagggcgcccugaccagccccagcgugagcuucagcaaccacagaaccagaagcugggacuacaucgagggccaggacgagacccuggagaacgugaacagcggcacccccauccccgacagcaacggcgagaagaagcagaccuacaaguggagcggcuucaccgagcaggacgacagaagaggcaucugcgagagacccagacagcaggagauccacaagagcuucagaggcagcaacuucaccguggcccccagcguggugaacagcgacaacagaagaaugagcggcagaggcgugggcagcgugagccaguucaagaagaucccccccgaccugaagacccugcagagcaacagaaacuuccagaccaccugcggcaugagccugcccagaggcaucagccaggacagaagcccccuggugaaggugagaagcaacagccugaaggcccccagcacccacgugaccaagcccagcuucagccagaagagcuucgugagcaucaaggaccagagacccgugaaccaccugcaccagaacagccugcugaaccagcagaccugggugagaaccgacagcgcccccgaccagcagguggagaccggcaagagccccagccugagcggcgccagcgccaagcccgccccccagagcagcgagaacgccggcaccagcgaccuggagcugcccgugagccagagaaaccaggaccugagccugcaggaggccgagaccgagcagagcgacacccuggacaacaaggaggccgugauccugagagagaagccccccagcggcagacagaccccccagccccugagacaccagagcuacauccuggccgugaacgaccaggagaccggcagcgacaccaccugcuggcugcccaacgacgccagaagagaggugcacaucaagagaauggaggagagaaaggccagcagcaccagcccccccggcgacagccuggccagcauccccuucaucgacgagcccaccagccccagcaucgaccacgacaucgcccacauccccgccagcgccgugaucagcgccagcaccagccaggugcccagcaucgccaccgugccccccugccugaccaccagcgccccccugaucagaagacagcugagccacgaccacgagagcgugggcccccccagccuggacgcccagcccaacagcaagaccgagagaagcaagagcuacgacgagggccuggacgacuacagagaggacgccaagcugagcuucaagcacgugagcagccugaagggcaucaagaucgccgacagccagaagagcagcgaggacagcggcagcagaaaggacagcagcagcgagguguucagcgacgccgccaaggagggcuggcugcacuucagaccccuggugaccgacaagggcaagagagugggcggcagcaucagacccuggaagcagauguacguggugcugagaggccacagccuguaccuguacaaggacaagagagagcagaccacccccagcgaggaggagcagcccaucagcgugaacgccugccugaucgacaucagcuacagcgagaccaagagaaagaacguguucagacugaccaccagcgacugcgagugccuguuccaggccgaggacagagacgacaugcuggccuggaucaagaccauccaggagagcagcaaccugaacgaggaggacaccggcgugaccaacagagaccugaucagcagaagaaucaaggaguacaacaaccugaugagcaaggccgagcagcugcccaagacccccagacagagccugagcaucagacagacccugcugggcgccaagagcgagcccaagacccagagcccccacagccccaaggaggagagcgagagaaagcugcugagcaaggacgacaccagcccccccaaggacaagggcaccuggagaaagggcauccccagcaucaugagaaagaccuucgagaagaagcccaccgccaccggcaccuucggcgugagacuggacgacugcccccccgcccacaccaacagauacaucccccugaucguggacaucugcugcaagcugguggaggagagaggccuggaguacaccggcaucuacagagugcccggcaacaacgccgccaucagcagcaugcaggaggagcugaacaagggcauggccgacaucgacauccaggacgacaaguggagagaccugaacgugaucagcagccugcugaagagcuucuucagaaagcugcccgagccccuguucaccaacgacaaguacgccgacuucaucgaggccaacagaaaggaggacccccuggacagacugaagacccugaagagacugauccacgaccugcccgagcaccacuacgagacccugaaguuccugagcgcccaccugaagaccguggccgagaacagcgagaagaacaagauggagcccagaaaccuggccaucguguucggccccacccuggugagaaccagcgaggacaacaugacccacauggugacccacaugcccgaccaguacaagaucguggagacccugauccagcaccacgacugguucuucaccgaggagggcgccgaggagccccugaccaccgugcaggaggagagcaccguggacagccagcccgugcccaacaucgaccaccugcugaccaacaucggcagaaccggcgugagccccggcgacgugagcgacagcgccaccagcgacagcaccaagagcaagggcagcuggggcagcggcaaggaccaguacagcagagagcugcuggugagcagcaucuucgccgccgccagcagaaagagaaagaagcccaaggagaaggcccagcccagcagcagcgaggacgagcuggacaacguguucuucaagaaggagaacguggagcagugccacaacgacaccaaggaggagagcaagaaggagagcgagacccugggcagaaagcagaagaucaucaucgccaaggagaacagcaccagaaaggaccccagcaccaccaaggacgagaagaucagccugggcaaggagagcacccccagcgaggagcccagccccccccacaacagcaagcacaacaagagccccacccugagcugcagauucgccauccugaaggagagccccagaagccugcuggcccagaagagcagccaccuggaggagaccggcagcgacagcggcacccugcugagcaccagcagccaggccagccuggccagauucagcaugaagaagagcaccagccccgagaccaagcacagcgaguuccuggccaacgugagcaccaucaccagcgacuacagcaccaccagcagcgccaccuaccugaccagccuggacagcagcagacugagccccgaggugcagagcguggccgagagcaagggcgacgaggccgacgacgagagaagcgagcugaucagcgagggcagacccguggagaccgacagcgagagcgaguuccccguguuccccaccgcccugaccagcgagagacuguucagaggcaagcugcaggaggugaccaagagcagcagaagaaacagcgagggcagcgagcugagcugcaccgagggcagccugaccagcagccuggacagcagaagacagcuguucagcagccacaagcugaucgagugcgacacccugagcagaaagaagagcgccagauucaagagcgacagcggcagccugggcgacgccaagaacgagaaggaggcccccagccugaccaagguguucgacgugaugaagaagggcaagagcaccggcagccugcugacccccaccagaggcgagagcgagaagcaggagcccaccuggaagaccaagaucgccgacagacugaagcugagacccagagcccccgccgacgacauguucggcgugggcaaccacaaggugaacgccgagaccgccaagagaaagagcaucagaagaagacacacccugggcggccacagagacgccaccgagaucagcgugcugaacuucuggaaggugcacgagcagagcggcgagagagagagcgagcugagcgccgugaacagacugaagcccaagugcagcgcccaggaccugagcaucagcgacuggcuggccagagagagacugagaaccagcaccagcgaccugagcagaggcgagaucggcgacccccagaccgagaaccccagcaccagagagaucgccaccaccgacaccccccugagccugcacugcaacaccggcagcagcagcagcacccuggccagcaccaacagaccccugcugagcauccccccccagagccccgaccagaucaacggcgagagcuuccagaacgugagcaagaacgccagcagcgccgccaacgcccagccccacaagcugagcgagacccccggcagcaaggccgaguuccaccccugccuguaa

SEQ ID NO: 13770 - RNA, 2145 nt, Artificial Sequence
  ARHGAP22__Homo_sapiens__NP_001242953
augcugagccccaagaucagacaggccagaagagccagaagcaagagccuggugaugggcgagcagagcagaagccccggcagaaugcccugcccccacagacugggccccgugcugaaggccggcuggcugaagaagcagagaagcaucaugaagaacuggcagcagagaugguucgugcugagaggcgaccagcuguucuacuacaaggacaaggacgagaucaagccccagggcuucaucagccugcagggcacccaggugaccgagcugccccccggccccgaggaccccggcaagcaccuguucgagaucagccccggcggcgccggcgagagagagaaggugcccgccaaccccgaggcccugcugcugauggccagcagccagagagacauggaggacugggugcaggccaucagaagagugaucugggccccccugggcggcggcaccgccagaagaagccacgcccacccccuggagccccugccccccggcaucuucggccagagacuggaggagaccgugcaccacgagagaaaguacggccccagacuggccccccugcugguggagcagugcguggacuucaucagagagagaggccugaccgaggagggccuguucagaaugcccggccaggccaaccuggugagagaccugcaggacagcuucgacugcggcgagaagccccuguucgacagcaccaccgacgugcacaccguggccagccugcugaagcuguaccugagagagcugcccgagcccguggugcccuucgccagauacgaggacuuccugagcugcgcccagcugcugaccaaggacgagggcgagggcacccuggagcuggccaagcaggugagcaaccugccccaggccaacuacaaccugcugagauacaucugcaaguuccuggacgaggugcaggccuacagcaacgugaacaagaugagcgugcagaaccuggccaccguguucggccccaacauccugagaccccagguggaggaccccgugaccaucauggagggcaccagccuggugcagcaccugaugaccgugcugaucagaaagcacagccagcuguucaccgcccccgugcccgagggccccaccagccccagaggcggccugcagugcgccgugggcuggggcagcgaggaggugaccagagacagccagggcgagcccggcggccccggccugcccgcccacagaaccagcagccuggacggcgccgccguggccgugcugagcagaaccgcccccaccggccccggcagcagaugcagccccggcaagaaggugcagacccugcccagcuggaagagcagcuucagacagcccagaagccugagcggcagccccaagggcggcggcagcagccuggaggugcccaucaucagcagcggcggcaacuggcugaugaacggccugagcagccugagaggccacagaagagccagcagcggcgacagacugaaggacagcggcagcgugcagagacugagcaccuacgacaacgugcccgcccccggccuggugcccggcauccccagcguggccagcauggccuggagcggcgccagcagcagcgagagcagcgugggcggcagccugagcagcugcaccgccugcagagccagcgacagcagcgccagaagcagccugcacaccgacugggcccuggagcccagcccccugcccagcagcagcgaggaccccaagagccuggaccuggaccacagcauggacgaggccggcgccggcgccagcaacagcgagcccagcgagcccgacagccccaccagagagcacgccagaagaagcgaggcccugcagggccuggugaccgagcugagagccgagcugugcagacagagaaccgaguacgagagaagcgugaagagaaucgaggagggcagcgccgaccugagaaagagaaugagcagacuggaggaggagcuggaccaggagaagaagaaguacaucaugcuggagaucaagcugagaaacagcgagagagccagagaggacgccgagagaagaaaccagcugcugcagagagagauggaggaguucuucagcacccugggcagccugaccgugggcgccaagggcgccagagcccccaaguaa

SEQ ID NO: 13771 - RNA, 4476 nt, Artificial Sequence
  ARHGAP23__Homo_sapiens__NP_001186346
augaacggcguggccuucugccuggugggcaucccccccagacccgagcccagacccccccagcugccccugggccccagagacggcugcagccccagaagacccuuccccuggcagggccccagaacccugcugcuguacaagagcccccaggacggcuucggcuucacccugagacacuucaucguguacccccccgagagcgccgugcacugcagccugaaggaggaggagaacggcggcagaggcggcggccccagccccagauacagacuggagcccauggacaccaucuucgugaagaacgugaaggaggacggccccgcccacagagccggccugagaaccggcgacagacuggugaaggugaacggcgagagcgugaucggcaagaccuacagccaggugaucgcccugauccagaacagcgacgacacccuggagcugagcaucaugcccaaggacgaggacauccugcagcuggccuacagccaggacgccuaccugaagggcaacgagcccuacagcggcgaggccagaagcauccccgagcccccccccaucugcuaccccagaaagaccuacgccccccccgccagagccagcaccagagccaccauggugcccgagcccaccagcgcccugcccagcgaccccagaagccccgccgccuggagcgaccccggccugagagugccccccgccgccagagcccaccuggacaacagcagccugggcaugagccagcccagacccagccccggcgccuucccccaccugagcagcgagcccagaacccccagagccuuccccgagcccggcagcagagugccccccagcagacuggagugccagcaggcccugagccacuggcugagcaaccaggugcccagaagagccggcgagagaagaugccccgccauggcccccagagccagaagcgccagccaggacagacuggaggagguggccgcccccagacccuggcccugcagcaccagccaggacgcccugagccagcugggccaggagggcuggcacagagccagaagcgacgacuaccugagcagagccaccagaagcgccgaggcccugggccccggcgcccuggugagccccagauucgagagaugcggcugggccagccagagaagcagcgccagaacccccgccugccccaccagagaccugcccggcccccaggcccccccccccagcggccugcagggccuggacgaccugggcuacaucggcuacagaagcuacagccccagcuuccagagaagaaccggccugcugcacgcccugagcuucagagacagccccuucggcggccugcccaccuucaaccuggcccagagccccgccagcuucccccccgaggccagcgagccccccagaguggugagacccgagcccagcaccagagcccuggagccccccgccgaggacagaggcgacgagguggugcugagacagaagccccccaccggcagaaaggugcagcugacccccgccagacagaugaaccugggcuucggcgacgagagccccgagcccgaggccagcggcagaggcgagagacugggcagaaagguggccccccuggccaccaccgaggacagccuggccagcauccccuucaucgacgagcccaccagccccagcaucgaccugcaggccaagcacgugcccgccagcgccguggugagcagcgccaugaacagcgcccccgugcugggcaccagccccagcagccccaccuucaccuucacccugggcagacacuacagccaggacugcagcagcaucaaggccggcagaagaagcagcuaccugcuggccaucaccaccgagagaagcaagagcugcgacgacggccugaacaccuucagagacgagggcagagugcugagaagacugcccaacagaauccccagccugagaaugcugagaagcuucuucaccgacggcagccuggacagcuggggcaccagcgaggacgccgacgcccccagcaagagacacagcaccagcgaccugagcgacgccaccuucagcgacaucagaagagagggcuggcuguacuacaagcagauccugaccaagaagggcaagaaggccggcagcggccugagacaguggaagagaguguacgccgcccugagagccagaagccugagccugagcaaggagagaagagagcccggccccgccgccgccggcgccgccgccgccggcgccggcgaggacgaggccgcccccgugugcaucggcagcugccugguggacaucagcuacagcgagaccaagagaagacacguguucagacugaccaccgccgacuucugcgaguaccuguuccaggccgaggacagagacgacaugcugggcuggaucagagccaucagagagaacagcagagccgagggcgaggaccccggcugcgccaaccaggcccugaucagcaagaagcugaacgacuacagaaaggugagccacagcagcggccccaaggccgacagcagccccaagggcagcagaggccugggcggccugaagagcgaguuccugaagcagagcgccgccagaggccugagaacccaggaccugcccgccggcagcaaggacgacagcgccgccgcccccaagacccccuggggcaucaacaucaucaagaagaacaagaaggccgcccccagagccuucggcgugagacuggaggagugccagcccgccaccgagaaccagagagugccccugaucguggccgccugcugcagaaucguggaggccagaggccuggagagcaccggcaucuacagagugcccggcaacaacgccguggugagcagccugcaggagcagcugaacagaggccccggcgacaucaaccugcaggacgagagauggcaggaccugaacgugaucagcagccugcugaagagcuucuucagaaagcugcccgagccccuguucaccgacgacaaguacaacgacuucaucgaggccaacagaaucgaggacgccagagagagaaugagaacccugagaaagcugaucagagaccugcccggccacuacuacgagacccugaaguuccuggugggccaccugaagaccaucgccgaccacagcgagaagaacaagauggagcccagaaaccuggcccugguguucggccccacccuggugagaaccagcgaggacaacaugaccgacauggugacccacaugcccgacagauacaagaucguggagacccugauccagcacagcgacugguucuucagcgacgaggaggacaagggcgagagaacccccgugggcgacaaggagccccaggccgugcccaacaucgaguaccugcugcccaacaucggcagaaccgugccccccggcgaccccggcagcgacagcaccaccugcagcagcgccaagagcaagggcagcugggcccccaagaaggagcccuacgccagagagaugcuggccaucagcuucaucagcgccgugaacagaaagagaaagaagagaagagaggccagaggccugggcagcagcaccgacgacgacagcgagcaggaggcccacaagcccggcgccggcgccaccgcccccggcacccaggagagaccccagggcccccugcccggcgccguggcccccgaggcccccggcagacugagcccccccgccgcccccgaggagagacccgccgccgacaccagaagcaucgugagcggcuacagcacccugagcaccauggacagaagcgugugcagcggcgccagcggcagaagagccggcgccggcgacgaggccgacgacgagagaagcgagcugagccacguggagaccgacaccgagggcgccgccggcgccggccccggcggcagacugaccagaagacccagcuucagcagccaccaccugaugcccugcgacacccuggccagaagaagacuggccagaggcagacccgacggcgagggcgccggcagaggcggccccagagcccccgagccccccggcagcgccagcagcagcagccaggagagccugagaccccccgccgccgcccuggccagcagacccagcagaauggaggcccugagacugagacugagaggcaccgccgacgacaugcuggccgugagacugagaagaccccugagccccgagaccagaagaagaagaagcagcuggagaagacacaccgugguggugcagagcccccugaccgaccugaacuucaacgaguggaaggagcugggcggcggcggcccccccgagcccgccggcgccagagcccacagcgacaacaaggacagcggccugagcagccuggagagcaccaaggccagagcccccagcagcgccgccagccagccccccgcccccggcgacaccggcagccugcagagccagccccccagaagaagcgccgccagcagacugcaccagugccuguaa

SEQ ID NO: 13772 - RNA, 1968 nt, Artificial Sequence
  ARHGAP24__Homo_sapiens__NP_112595
augcccgaggacagaaacagcggcggcugccccgccggcgcccuggccagcacccccuucauccccaagaccaccuacagaagaaucaagagaugcuucagcuucagaaagggcaucuucggccagaagcuggaggacaccgugagauacgagaagagauacggcaacagacuggcccccaugcugguggagcagugcguggacuucaucagacagagaggccugaaggaggagggccuguucagacugcccggccaggccaaccuggugaaggagcugcaggacgccuucgacugcggcgagaagcccagcuucgacagcaacaccgacgugcacaccguggccagccugcugaagcuguaccugagagagcugcccgagcccgugauccccuacgccaaguacgaggacuuccugagcugcgccaagcugcugagcaaggaggaggaggccggcgugaaggagcuggccaagcaggugaagagccugcccguggugaacuacaaccugcugaaguacaucugcagauuccuggacgaggugcagagcuacagcggcgugaacaagaugagcgugcagaaccuggccaccguguucggccccaacauccugagacccaagguggaggacccccugaccaucauggagggcaccgugguggugcagcagcugaugagcgugaugaucagcaagcacgacugccuguuccccaaggacgccgagcugcagagcaagccccaggacggcgugagcaacaacaacgagauccagaagaaggccaccaugggccagcugcagaacaaggagaacaacaacaccaaggacagccccagcagacagugcagcugggacaagagcgagagcccccagagaagcagcaugaacaacggcagccccaccgcccugagcggcagcaagaccaacagccccaagaacagcgugcacaagcuggacgugagcagaagccccccccugauggugaagaagaaccccgccuucaacaagggcagcggcaucgugaccaacggcagcuucagcagcagcaacgccgagggccuggagaagacccagaccacccccaacggcagccugcaggccagaagaagcagcagccugaaggugagcggcaccaagaugggcacccacagcgugcagaacggcaccgugagaaugggcauccugaacagcgacacccugggcaaccccaccaacgugagaaacaugagcuggcugcccaacggcuacgugacccugagagacaacaagcagaaggagcaggccggcgagcugggccagcacaacagacugagcaccuacgacaacgugcaccagcaguucagcaugaugaaccuggacgacaagcagagcaucgacagcgccaccuggagcaccagcagcugcgagaucagccugcccgagaacagcaacagcugcagaagcagcaccaccaccugccccgagcaggacuucuucggcggcaacuucgaggaccccgugcuggacggccccccccaggacgaccugagccaccccagagacuacgagagcaagagcgaccacagaagcgugggcggcagaagcagcagagccaccagcagcagcgacaacagcgagaccuucgugggcaacagcagcagcaaccacagcgcccugcacagccuggugagcagccugaagcaggagaugaccaagcagaagaucgaguacgagagcagaaucaagagccuggagcagagaaaccugacccuggagaccgagaugaugagccugcacgacgagcuggaccaggagagaaagaaguucaccaugaucgagaucaagaugagaaacgccgagagagccaaggaggacgccgagaagagaaacgacaugcugcagaaggagauggagcaguucuucagcaccuucggcgagcugaccguggagcccagaagaaccgagagaggcaacaccaucuggauccaguaa

SEQ ID NO: 13773 - RNA, 1941 nt, Artificial Sequence
  ARHGAP25__Homo_sapiens__NP_001007232
augagccugaagcugcccagaaacugggacuucaaccugaagguggaggccgccaagaucgccagaagcagaagcgugaugaccggcgagcagauggccgccuuccaccccagcagcacccccaacccccuggagagacccaucaagaugggcuggcugaagaagcagagaagcaucgugaagaacuggcagcagagauacuucgugcugagagcccagcagcuguacuacuacaaggacgaggaggacaccaagccccagggcugcauguaccugcccggcugcaccaucaaggagaucgccaccaaccccgaggaggccggcaaguucguguucgagaucauccccgccagcugggaccagaacagaaugggccaggacagcuacgugcugauggccagcagccaggccgagauggaggagugggugaaguuccugagaagaguggccggcacccccugcggcgccguguucggccagagacuggacgagaccguggccuacgagcagaaguucggcccccaccuggugcccauccugguggagaagugcgccgaguucauccuggagcacggcagaaacgaggagggcaucuucagacugcccggccaggacaaccuggugaagcagcugagagacgccuucgacgccggcgagagacccagcuucgacagagacaccgacgugcacaccguggccagccugcugaagcuguaccugagagaccugcccgagcccguggugcccuggagccaguacgagggcuuccugcugugcggccagcugaccaacgccgacgaggccaaggcccagcaggagcugaugaagcagcugagcauccugcccagagacaacuacagccugcugagcuacaucugcagauuccugcacgagauccagcugaacugcgccgugaacaagaugagcguggacaaccuggccaccgugaucggcgugaaccugaucagaagcaagguggaggaccccgccgugaucaugagaggcaccccccagauccagagagugaugaccaugaugaucagagaccacgaggugcuguuccccaagagcaaggacaucccccugagcccccccgcccagaagaacgaccccaagaaggcccccguggccagaagcagcgugggcugggacgccaccgaggaccugagaaucagcagaaccgacagcuucagcagcaugaccagcgacagcgacaccaccagccccaccggccagcagcccagcgacgccuuccccgaggacagcagcaaggugcccagagagaagcccggcgacuggaagaugcagagcagaaagagaacccagacccugcccaacagaaagugcuuccugaccagcgccuuccagggcgccaacagcagcaagauggagaucuucaagaacgaguucuggagccccagcagcgaggccaaggccggcgagggccacagaagaaccaugagccaggaccugagacagcugagcgacagccagagaaccagcaccuacgacaacgugcccagccugcccggcagccccggcgaggaggccagcgcccugagcagccaggccugcgacagcaagggcgacacccuggccagccccaacagcgagaccggccccggcaagaagaacagcggcgaggaggagaucgacagccugcagagaauggugcaggagcugagaaaggagaucgagacccagaagcagauguacgaggagcagaucaagaaccuggagaaggagaacuacgacgugugggccaagguggugagacugaacgaggagcuggagaaggagaagaagaagagcgccgcccuggagaucagccugagaaacauggagagaagcagagaggacguggagaagagaaacaaggcccuggaggaggaggugaaggaguucgugaagagcaugaaggagcccaagaccgaggccuaa

SEQ ID NO: 13774 - RNA, 2280 nt, Artificial Sequence
  ARHGAP26__Homo_sapiens__NP_001129080
augggccugcccgcccuggaguucagcgacugcugccuggacagcccccacuucagagagacccugaagagccacgaggccgagcuggacaagaccaacaaguucaucaaggagcugaucaaggacggcaagagccugaucagcgcccugaagaaccugagcagcgccaagagaaaguucgccgacagccugaacgaguucaaguuccagugcaucggcgacgccgagaccgacgacgagaugugcaucgccagaagccugcaggaguucgccaccgugcugagaaaccuggaggacgagagaaucagaaugaucgagaacgccagcgaggugcugaucaccccccuggagaaguucagaaaggagcagaucggcgccgccaaggaggccaagaagaaguacgacaaggagaccgagaaguacugcggcauccuggagaagcaccugaaccugagcagcaagaagaaggagagccagcugcaggaggccgacagccagguggaccuggugagacagcacuucuacgaggugagccuggaguacguguucaaggugcaggaggugcaggagagaaagauguucgaguucguggagccccugcuggccuuccugcagggccuguucaccuucuaccaccacggcuacgagcuggccaaggacuucggcgacuucaagacccagcugaccaucagcauccagaacaccagaaacagauucgagggcaccagaagcgagguggagagccugaugaagaagaugaaggagaacccccuggagcacaagaccaucagccccuacaccauggagggcuaccuguacgugcaggagaagagacacuucggcaccagcugggugaagcacuacugcaccuaccagagagacagcaagcagaucaccauggugcccuucgaccagaagagcggcggcaagggcggcgaggacgagagcgugauccugaagagcugcaccagaagaaagaccgacagcaucgagaagagauucugcuucgacguggaggccguggacagacccggcgugaucaccaugcaggcccugagcgaggaggacagaagacuguggauggaggccauggacggcagagagcccguguacaacagcaacaaggacagccagagcgagggcaccgcccagcuggacagcaucggcuucagcaucaucagaaagugcauccacgccguggagaccagaggcaucaacgagcagggccuguacagaaucgugggcgugaacagcagagugcagaagcugcugagcgugcugauggaccccaagaccgccagcgagaccgagaccgacaucugcgccgagugggagaucaagaccaucaccagcgcccugaagaccuaccugagaaugcugcccggcccccugaugauguaccaguuccagagaagcuucaucaaggccgccaagcuggagaaccaggagagcagagugagcgagauccacagccuggugcacagacugcccgagaagaacagacagaugcugcagcugcugaugaaccaccuggccaacguggccaacaaccacaagcagaaccugaugaccguggccaaccugggcgugguguucggccccacccugcugagaccccaggaggagaccguggccgccaucauggacaucaaguuccagaacaucgugaucgagauccugaucgagaaccacgagaagaucuucaacaccgugcccgacaugccccugaccaacgcccagcugcaccugagcagaaagaagagcagcgacagcaagccccccagcugcagcgagagaccccugacccuguuccacaccgugcagagcaccgagaagcaggagcagagaaacagcaucaucaacagcagccuggagagcgugagcagcaaccccaacagcauccugaacagcagcagcagccugcagcccaacaugaacagcagcgaccccgaccuggccguggugaagcccaccagacccaacagccugccccccaaccccagccccaccagcccccugagccccagcuggcccauguucagcgcccccagcagccccaugcccaccagcagcaccagcagcgacagcagccccgugagcacccccuucagaaaggccaaggcccuguacgccugcaaggccgagcacgacagcgagcugagcuucaccgccggcaccguguucgacaacgugcaccccagccaggagcccggcuggcuggagggcacccugaacggcaagaccggccugauccccgagaacuacguggaguuccuguaa

SEQ ID NO: 13775 - RNA, 792 nt, Artificial Sequence
  ARHGAP27__Homo_sapiens__NP_777579
auggccgccgacguggugggcgacguguacgugcugguggagcaccccuucgaguacaccggcaaggacggcagaagaguggccaucagacccaacgagagauacagacugcugagaagaagcaccgagcacugguggcacgugagaagagagcccggcggcagacccuucuaccugcccgcccaguacgugagagagcugcccgcccugggcaaccccgccgccgccgccccccccggcccccaccccagccccgccgcccccgagccccuggccuacgacuacagauucgugagcgccgccgccaccgccggccccgacggcgcccccgaggagagcggcggcagagccagcagccugugcggccccgcccagagaggcgccgccacccagagaagcagccuggcccccggccugcccgccugccuguaccugagacccgccgcccccgugagacccgcccagagccugaacgaccuggccugcgccgccgugagcccccccgccggccugcugggcagcagcggcagcuucaaggccugcagcguggccggcagcugggugugccccagaccccuggccagaagcgacagcgagaacguguacgaggugauccaggaccugcacgugcccccccccgaggagagcgccgagcaggugccccccagagcccugggcagaggcggcggcuggagagccagagacagagccagaaccgagcccggcagaaaggagaccagaagcgcccagagaagagccagaagacccccccugagcgaggacuucggcuaa

SEQ ID NO: 13776 - RNA, 1713 nt, Artificial Sequence
  ARHGAP28__Homo_sapiens__NP_001010000
augagaaagaaggacaagcagagcaucagagacgugagagacaucuucggcgugagcgagagcccccccagagacaccugcggcaaccacaccaaccagcuggacggcaccaaggaggagagagagcugcccagagugaucaagaccagcggcagcaugcccgacgacgccagccugaacagcaccacccugagcgacgccagccaggacaaggagggcagcuucgccgugcccagaagcgacagcguggccauccuggagaccauccccgugcugcccgugcacagcaacggcagccccgagcccggccagcccgugcagaacgccaucagcgacgacgacuuccuggagaagaacaucccccccgaggccgaggagcugagcuucgaggugagcuacagcgagauggugaccgaggcccugaagagaaacaagcugaagaagagcgagaucaagaaggaggacuacgugcugaccaaguucaacgugcagaagaccagauucggccugaccgaggccggcgaccugagcgccgaggacaugaagaagaucagacaccugagccugaucgagcugaccgccuucuucgacgccuucggcauccagcugaagagaaacaagaccgagaaggugaagggcagagacaacggcaucuucggcgugccccugaccgugcugcuggacggcgacagaaagaaggaccccggcgugaaggugccccuggugcugcagaaguucuucgagaagguggaggagagcggccuggagagcgagggcaucuucagacugagcggcugcaccgccaaggugaagcaguacagagaggagcuggacgccaaguucaacgccgacaaguucaagugggacaagaugugccacagagaggccgccgugaugcugaaggccuucuucagagagcugcccaccagccuguuccccguggaguacauccccgccuucaucagccugauggagagaggcccccacgugaaggugcaguuccaggcccugcaccugauggugauggcccugcccgacgccaacagagacgccgcccaggcccugaugaccuucuucaacaaggugaucgccaacgagagcaagaacagaaugagccuguggaacaucagcaccgugauggcccccaaccuguucuucagcagaagcaagcacagcgacuacgaggagcugcugcuggccaacaccgccgcccacaucaucagacugaugcugaaguaccagaagauccuguggaaggugcccagcuuccugaucacccaggugagaagaaugaacgaggccaccaugcugcugaagaagcagcugcccagcgugagaaagcugcugagaagaaagacccuggagagagagaccgccagccccaagaccagcaaggugcugcagaagagccccagcgccagaagaaugagcgacgugcccgagggcgugaucagagugcacgccccccugcugagcaaggugagcauggccauccagcugaacaaccagaccaaggccaaggacauccuggccaaguuccaguacgagaacagccacggcagcagcgagugcaucaagauccagaaccagagacuguacgagaucggcggcaacaucggcgagcacugccuggaccccgacgccuacauccuggacguguacagaaucaacccccaggccgagugggugaucaagccccagcagagcagcuaa

SEQ ID NO: 13777 - RNA, 3306 nt, Artificial Sequence
  ARHGAP30__Homo_sapiens__NP_001020769
augaagagcagacagaagggcaagaagaagggcagcgccaaggagagaguguucggcugcgaccugcaggagcaccugcagcacagcggccaggaggugccccaggugcugaagagcugcgccgaguucguggaggaguacggcgugguggacggcaucuacagacugagcggcgugagcagcaacauccagaagcugagacaggaguucgagagcgagagaaagcccgaccugagaagagacguguaccugcaggacauccacugcgugagcagccugugcaaggccuacuucagagagcugcccgacccccugcugaccuacagacuguacgacaaguucgccgaggccgugggcgugcagcuggagcccgagagacuggugaagauccuggaggugcugagagagcugcccgugcccaacuacagaacccuggaguuccugaugagacaccuggugcacauggccagcuucagcgcccagaccaacaugcacgccagaaaccuggccaucgugugggcccccaaccugcugagaagcaaggacaucgaggccagcggcuucaacggcaccgccgccuucauggaggugagagugcagagcaucgugguggaguucauccugacccacguggaccagcuguucggcggcgccgcccugagcggcggcgagguggagagcggcuggagaagccugcccggcaccagagccagcggcagccccgaggaccugaugcccagaccccugcccuaccaccugcccagcauccugcaggccggcgacggccccccccagaugagacccuaccacaccaucaucgagaucgccgagcacaagagaaagggcagccugaaggugagaaaguggagaagcaucuucaaccugggcagaagcggccacgagaccaagagaaagcugcccagaggcgccgaggacagagaggacaagagcaacaagggcacccugagacccgccaagagcauggacagccugagcgccgccgccggcgccagcgacgagcccgagggccuggugggccccagcagccccagacccagcccccugcugcccgagagccuggagaacgacagcaucgaggccgccgagggcgagcaggagcccgaggccgaggcccugggcggcaccaacagcgagcccggcacccccagagccggcagaagcgccaucagagccggcggcagcagcagagccgagagaugcgccggcgugcacaucagcgaccccuacaacgugaaccugccccugcacaucaccagcauccugagcgugccccccaacaucaucagcaacgugagccuggccagacugaccagaggccuggagugccccgcccugcagcacagacccagccccgccagcggccccggccccggccccggccugggccccggcccccccgacgagaagcuggaggccagccccgccagcagcccccuggccgacagcggccccgacgaccuggcccccgcccuggaggacagccugagccaggaggugcaggacagcuucagcuuccuggaggacagcagcagcagcgagcccgagugggugggcgccgaggacggcgagguggcccaggccgaggccgccggcgccgccuucagccccggcgaggacgaccccggcaugggcuaccuggaggagcugcugggcgugggcccccagguggaggaguucagcguggagcccccccuggacgaccugagccuggacgaggcccaguucgugcuggcccccagcugcugcagccuggacagcgccggccccagacccgagguggaggaggagaacggcgaggagguguuccugagcgccuacgacgaccugagcccccugcugggccccaagccccccaucuggaagggcagcggcagccuggagggcgaggccgccggcugcggcagacaggcccugggccagggcggcgaggagcaggccugcugggaggugggcgaggacaagcaggccgagcccggcggcagacuggacaucagagaggaggccgagggcagccccgagaccaagguggaggccggcaaggccagcgaggacagaggcgaggccggcggcagccaggagaccaaggugagacugagagagggcagcagagaggagaccgaggccaaggaggagaagagcaagggccagaagaaggccgacagcauggaggccaagggcguggaggagcccggcggcgacgaguacaccgacgagaaggagaaggagaucgagagagaggaggacgagcagagagaggaggcccagguggaggccggcagagaccuggagcagggcgcccaggaggaccagguggccgaggagaagugggagguggugcagaagcaggaggccgagggcgugagagaggacgaggacaagggccagagagagaagggcuaccacgaggccagaaaggaccagggcgacggcgaggacagcagaagccccgaggccgccaccgagggcggcgccggcgaggugagcaaggagagagagagcggcgacggcgaggccgagggcgaccagagagccggcggcuacuaccuggaggaggacacccugagcgagggcagcggcguggccagccuggagguggacugcgccaaggagggcaacccccacagcagcgagauggaggagguggccccccagcccccccagcccgaggagauggagcccgagggccagcccagccccgacggcugccugugccccugcagccugggccugggcggcgugggcaugagacuggccagcacccuggugcaggugcagcaggugagaagcgugcccguggugccccccaagccccaguucgccaagaugcccagcgccaugugcagcaagauccacguggcccccgccaaccccugccccagacccggcagacuggacggcacccccggcgagagagccuggggcagcagagccagcagaagcagcuggagaaacggcggcagccugagcuucgacgccgccguggcccuggccagagacagacagagaaccgaggcccagggcgugagaagaacccagaccugcaccgagggcggcgacuacugccugauccccagaaccagccccugcagcaugaucagcgcccacagccccagaccccugagcugccuggagcugcccagcgagggcgccgagggcagcggcagcagaagcagacugagccugccccccagagagccccaggugcccgacccccugcugagcagccagagaagaagcuacgccuucgagacccaggccaaccccggcaagggcgagggccuguaa

SEQ ID NO: 13778 - RNA, 4335 nt, Artificial Sequence
  ARHGAP31__Homo_sapiens__NP_065805
augaagaacaagggcgccaagcagaagcugaagagaaagggcgccgccagcgccuucggcugcgaccugaccgaguaccuggagagcagcggccaggacgugcccuacgugcugaagagcugcgccgaguucaucgagacccacggcaucguggacggcaucuacagacugagcggcgugaccagcaacauccagagacugagacaggaguucggcagcgaccagugccccgaccugaccagagagguguaccugcaggacauccacugcgugggcagccugugcaagcuguacuucagagagcugcccaacccccugcugaccuacgagcuguacgagaaguucaccgaggccgugagccacugccccgaggagggccagcuggccagaauccagaacgugauccaggagcugccccccagccacuacagaacccuggaguaccugaucagacaccuggcccacaucgccagcuucagcagcaagaccaacaugcacgccagaaaccuggcccuggugugggcccccaaccugcugagaagcaaggagaucgaggccaccggcugcaacggcgacgccgccuuccuggccgugagagugcagcagguggugaucgaguucauccugaaccacguggaccagaucuucaacaacggcgcccccggcagccuggagaacgacgagaacagacccaucaugaagagccugacccugcccgcccugagccugcccaugaagcuggugagccuggaggaggcccaggccagaagccuggccaccaaccaccccgccagaaaggagagaagagagaacagccugcccgagaucgugccccccaugggcacccuguuccacaccgugcuggagcugcccgacaacaagagaaagcugagcagcaagagcaagaaguggaagagcaucuucaaccugggcagaagcggcagcgacagcaagagcaagcugagcagaaacggcagcguguucgugagaggccagagacugagcguggagaaggccaccaucagacccgccaagagcauggacagccugugcagcgugcccguggagggcaaggagaccaagggcaacuucaacagaaccgugaccaccggcggcuucuucauccccgccaccaagaugcacagcaccggcaccggcagcagcugcgaccugaccaagcaggagggcgaguggggccaggagggcaugccccccggcgccgagggcggcuucgacgugagcagcgacagaagccaccugcagggcgcccaggccagacccccccccgagcagcugaagguguucagacccguggaggaccccgagagcgagcagaccgcccccaagaugcugggcauguucuacaccagcaacgacagccccagcaagagcguguucaccagcagccuguuccagauggagcccagccccagaaaccagagaaaggcccugaacaucagcgagcccuucgccgugagcgugccccugagagugagcgccgugaucagcaccaacagcacccccugcagaaccccccccaaggagcugcagagccugagcagccuggaggaguucagcuuccacggcagcgagagcggcggcuggcccgaggaggagaagccccugggcgccgagaccagcgccgccagcgugcccaagaaggccggccuggaggacgccaaggccgugcccgaggcccccggcaccguggagugcagcaagggccugagccaggagcccggcgcccaccuggaggagaagaagacccccgagagcagccugagcagccagcaccugaacgagcuggagaagagacccaaccccgagaaggugguggaggagggcagagaggccggcgagauggagagcagcacccugcaggagagccccagagccagagccgaggccgugcugcugcacgagauggacgaggacgaccuggccaacgcccugaucuggcccgagauccagcaggagcugaagaucaucgagagcgaggaggagcugagcagccugcccccccccgcccugaagaccagccccauccagcccauccuggagagcagccugggccccuucauccccagcgagccccccggcagccugcccugcggcagcuuccccgcccccgugagcaccccccuggagguguggaccagagaccccgccaaccagagcacccagggcgccagcaccgccgccagcagagagaagcccgagcccgagcagggccugcaccccgaccuggccagccuggccccccuggagaucgugcccuucgagaaggccagcccccaggccaccguggaggugggcggccccggcaaccugagccccccccugccccccgccccccccccccccaccccccuggaggagagcacccccgugcugcugagcaagggcggccccgagagagaggacagcagcagaaagcugagaaccgaccuguacaucgaccagcugaagagccaggacagccccgagaucagcagccugugccagggcgaggaggccacccccagacacagcgacaagcagaacagcaagaacgccgccagcgagggcaagggcugcggcuuccccagccccaccagagagguggagaucgugagccaggaggaggaggacgugacccacagcgugcaggagcccagcgacugcgacgaggacgacaccgugaccgacaucgcccagcacggccuggagaugguggagcccugggaggagccccagugggugaccagcccccugcacagccccacccugaaggacgcccacaaggcccaggugcagggccugcagggccaccagcuggagaagagacugagccacagacccagccugagacagagccacagccuggacagcaagcccaccgugaagagccaguggacccuggaggugcccagcagcagcagcugcgccaaccuggagaccgagagaaacagcgacccccugcagccccaggcccccagaagagagaucaccggcugggacgagaaggcccugagaagcuucagagaguucagcggccugaagggcgccgaggccccccccaaccagaagggccccagcggcgugcagcccaaccccgccgagaccagccccaucagccuggccgagggcaaggagcugggcacccaccugggccacagcagcccccagaucagacagggcggcgugcccggccccgagagcagcaaggagagcagccccagcgugcaggacagcaccagccccggcgagcaccccgccaagcugcagcugaagagcaccgagugcggcccccccaagggcaagaacagacccagcagccugaaccuggaccccgccauccccaucgccgaccuguucugguucgagaacguggccagcuucagcagccccggcaugcaggugagcgagcccggcgaccccaaggugaccuggaugaccagcagcuacugcaaggccgaccccuggagaguguacagccaggacccccaggaccuggacaucguggcccacgcccugaccggcagaagaaacagcgcccccgugagcgugagcgccgugagaaccagcuucauggugaagaugugccaggccagagccgugcccgugaucccccccaagauccaguacacccagaucccccagccccugcccagccagagcagcggcgagaacggcgugcagccccuggagagaagccaggagggccccagcagcaccagcggcaccacccagaagcccgccaaggacgacagccccagcagccuggagagcagcaaggaggagaagcccaagcaggaccccggcgccaucaagagcagccccguggacgccaccgcccccugcaugugcgagggccccacccugagccccgagcccggcagcagcaaccugcugagcacccaggacgccguggugcagugcagaaagagaaugagcgagaccgagcccagcggcgacaaccugcugagcagcaagcuggagagacccagcggcggcagcaagcccuuccacagaagcagacccggcagaccccagagccugauccuguucagcccccccuuccccaucauggaccaccugccccccagcagcaccgugaccgacagcaaggugcugcugagccccaucagaagccccacccagaccgugagccccggccugcugugcggcgagcuggccgagaacaccugggugacccccgagggcgugacccugagaaacaagaugaccauccccaagaacggccagagacuggagaccagcaccagcugcuucuaccagccccagagaagaagcgugauccuggacggcagaagcggcagacagaucgaguaa

SEQ ID NO: 13779 - RNA, 6264 nt, Artificial Sequence
  ARHGAP32__Homo_sapiens__NP_001136157
auggagaccgagagcgagagcagcacccugggcgacgacagcguguucuggcuggagagcgaggugaucauccaggugaccgacugcgaggaggaggagagagaggagaaguucagaaagaugaagagcagcgugcacagcgaggaggacgacuucgugcccgagcugcacagaaacgugcaccccagagagagacccgacugggaggagacccugagcgccauggccagaggcgccgacgugcccgagauccccggcgaccugacccugaagaccugcggcagcaccgccagcaugaaggugaagcacgugaagaagcugcccuucaccaagggccacuuccccaagauggccgagugcgcccacuuccacuacgagaacguggaguucggcagcauccagcugagccugagcgaggagcagaacgaggugaugaagaacggcugcgagagcaaggagcugguguaccuggugcagaucgccugccagggcaagagcuggaucgugaagagaagcuacgaggacuucagagugcuggacaagcaccugcaccugugcaucuacgacagaagauucagccagcugagcgagcugcccagaagcgacacccugaaggacagccccgagagcgugacccagaugcugauggccuaccugagcagacugagcgccaucgccggcaacaagaucaacugcggccccgcccugaccuggauggagaucgacaacaagggcaaccaccugcuggugcacgaggagagcagcaucaacacccccgccgugggcgccgcccacgugaucaagagauacaccgccagagcccccgacgagcugacccuggaggugggcgacaucgugagcgugaucgacaugccccccaaggugcugagcaccugguggagaggcaagcacggcuuccaggugggccuguuccccggccacugcguggagcugaucaaccagaaggugccccagagcgugaccaacagcgugcccaagcccgugagcaagaagcacggcaagcugaucaccuuccugagaaccuucaugaagagcagacccaccaagcagaagcugaagcagagaggcauccugaaggagagaguguucggcugcgaccugggcgagcaccugcugaacagcggcuucgaggugccccaggugcugcagagcugcaccgccuucaucgagagauacggcaucguggacggcaucuacagacugagcggcguggccagcaacauccagagacugagacacgaguucgacagcgagcacgugcccgaccugaccaaggagcccuacgugcaggacauccacagcgugggcagccugugcaagcuguacuucagagagcugcccaacccccugcugaccuaccagcuguacgagaaguucagcgacgccgugagcgccgccaccgacgaggagagacugaucaagauccacgacgugauccagcagcugccccccccccacuacagaacccuggaguuccugaugagacaccugagccugcuggccgacuacugcagcaucaccaacaugcacgccaagaaccuggccaucgugugggcccccaaccugcugagaagcaagcagaucgagagcgccugcuucagcggcaccgccgccuucauggaggugagaauccagagcguggugguggaguucauccugaaccacguggacgugcuguucagcggcagaaucagcauggccaugcaggagggcgccgccagccugagcagacccaagagccugcuggugagcagccccagcaccaagcugcugacccuggaggaggcccaggccagaacccaggcccaggugaacagccccaucgugaccgagaacaaguacaucgaggugggcgagggccccgccgcccugcagggcaaguuccacaccaucaucgaguucccccuggagagaaagagaccccagaacaagaugaagaagagccccgugggcagcuggagaagcuucuucaaccugggcaagagcagcagcgugagcaagagaaagcugcagagaaacgagagcgagcccagcgagaugaaggccauggcccugaagggcggcagagccgagggcacccugagaagcgccaagagcgaggagagccugaccagccugcacgccguggacggcgacagcaagcuguucagacccagaagacccagaagcagcagcgacgcccugagcgccagcuucaacggcgagaugcugggcaacagaugcaacagcuacgacaaccugccccacgacaacgagagcgaggaggagggcggccugcugcacauccccgcccugaugagcccccacagcgccgaggacguggaccugagcccccccgacaucggcguggccagccuggacuucgaccccaugagcuuccagugcagcccccccaaggccgagagcgagugccuggagagcggcgccagcuuccuggacagccccggcuacagcaaggacaagcccagcgccaacaagaaggacgccgagaccggcagcagccagugccagacccccggcagcaccgccagcagcgagcccgugagcccccugcaggagaagcugagccccuucuucacccuggaccugagccccaccgaggacaagagcagcaagcccagcagcuucaccgagaaggugguguacgccuucagccccaagaucggcagaaagcugagcaagagccccagcaugagcaucagcgagcccaucagcgugacccugccccccagagugagcgaggugaucggcaccgugagcaacaccaccgcccagaacgccagcagcagcaccugggacaagugcguggaggagagagacgccaccaacagaagccccacccagaucgugaagaugaagaccaacgagaccguggcccaggaggccuacgagagcgaggugcagccccuggaccagguggccgccgaggagguggagcugcccggcaaggaggaccagagcgugagcagcagccagagcaaggccguggccagcggccagacccagaccggcgccgugacccacgaccccccccaggacagcgugcccgugagcagcgugagccugaucccccccccccccccccccaagaacguggccagaaugcuggcccuggcccuggccgagagcgcccagcaggccagcacccagagccugaagagacccggcaccagccaggccggcuacaccaacuacggcgacaucgccguggccaccaccgaggacaaccugagcagcagcuacagcgccguggcccuggacaaggccuacuuccagaccgacagacccgccgagcaguuccaccugcagaacaacgcccccggcaacugcgaccacccccugcccgagaccaccgccaccggcgaccccacccacagcaacaccaccgagagcggcgagcagcaccaccagguggaccugaccggcaaccagccccaccaggccuaccugagcggcgaccccgagaaggccagaaucaccagcgugccccuggacagcgagaagagcgacgaccacgugagcuuccccgaggaccagagcggcaagaacagcaugcccaccgugagcuuccuggaccaggaccagagcccccccagauucuacagcggcgaccagccccccagcuaccugggcgccagcguggacaagcugcaccacccccuggaguucgccgacaagagccccaccccccccaaccugcccagcgacaagaucuacccccccagcggcagccccgaggagaacaccagcaccgccaccaugaccuacaugaccaccacccccgccaccgcccagaugagcaccaaggaggccagcugggacguggccgagcagcccaccaccgccgacuucgccgccgccacccugcagagaacccacagaaccaacagaccccugccccccccccccagccagagaagcgccgagcagccccccguggugggccaggugcaggccgccaccaacaucggccugaacaacagccacaaggugcagggcguggugcccgugcccgagagaccccccgagcccagagccauggacgaccccgccagcgccuucaucagcgacagcggcgccgccgccgcccagugccccauggccaccgccgugcagcccggccugcccgagaaggugagagacggcgccagagugccccugcugcaccugagagccgagagcgugcccgcccaccccugcggcuuccccgccccccugccccccaccagaaugauggagagcaagaugaucgccgccauccacagcagcagcgccgacgccaccagcagcagcaacuaccacagcuucgugaccgccagcagcaccagcguggacgacgcccugccccugccccugcccgugccccagcccaagcacgccagccagaagaccguguacagcagcuucgccagacccgacgugaccaccgagcccuucggccccgacaacugccugcacuucaacaugacccccaacugccaguacagaccccagagcgugcccccccaccacaacaagcuggagcagcaccagguguacggcgccagaagcgagccccccgccagcaugggccugagauacaacaccuacguggcccccggcagaaacgccagcggccaccacagcaagcccugcagcagaguggaguacgugagcagccugagcagcagcgugagaaacaccugcuaccccgaggacaucccccccuaccccaccaucagaagagugcagagccugcacgccccccccagcagcaugaucagaagcgugcccaucagcagaaccgaggugccccccgacgacgagcccgccuacugccccagaccccuguaccaguacaagcccuaccagagcagccaggccagaagcgacuaccacgugacccagcugcagcccuacuucgagaacggcagagugcacuacagauacagccccuacagcagcagcagcagcagcuacuacagccccgacggcgcccugugcgacguggacgccuacggcaccgugcagcugagaccccugcacagacugcccaacagagacuucgccuucuacaaccccagacugcagggcaagagccuguacagcuacgccggccuggcccccagacccagagccaacgugaccggcuacuucagccccaacgaccacaacguggugagcaugccccccgccgccgacgugaagcacaccuacaccagcugggaccuggaggacauggagaaguacagaaugcagagcaucagaagagagagcagagccagacagaaggugaagggccccgugaugagccaguacgacaacaugacccccgccgugcaggacgaccugggcggcaucuacgugauccaccugagaagcaagagcgaccccggcaagaccggccugcugagcguggccgagggcaaggagagcagacacgccgccaaggccaucagccccgagggcgaggacagauucuacagaagacaccccgaggccgagauggacagagcccaccaccacggcggccacggcagcacccagcccgagaagcccagccugccccagaagcagagcagccugagaagcagaaagcugcccgacaugggcugcagccugcccgagcacagagcccaccaggaggccagccacagacaguucugcgagagcaagaacggcccccccuacccccagggcgccggccagcuggacuacggcagcaagggcauccccgacaccagcgagcccgugagcuaccacaacagcggcgugaaguacgccgccagcggccaggagagccugagacugaaccacaaggaggugagacugagcaaggagauggagagacccugggugagacagcccagcgcccccgagaagcacagcagagacugcuacaaggaggaggagcaccugacccagagcaucgugcccccccccaagcccgagagaagccacagccugaagcugcaccacacccagaacguggagagagaccccagcgugcuguaccaguaccagccccacggcaagagacagagcagcgugaccguggugagccaguacgacaaccuggaggacuaccacagccugccccagcaccagagaggcguguucggcggcggcggcaugggcaccuacgugccccccggcuucccccacccccagagcagaaccuacgccaccgcccugggccagggcgccuuccugcccgccgagcugagccugcagcaccccgagacccagauccacgccgaguaa

SEQ ID NO: 13780 - RNA, 4500 nt, Artificial Sequence
  ARHGAP35__Homo_sapiens__NP_004482
augaugauggccagaaagcaggacgugagaauccccaccuacaacaucagcguggugggccugagcggcaccgagaaggagaagggccagugcggcaucggcaagagcugccugugcaacagauucgugagacccagcgccgacgaguuccaccuggaccacaccagcgugcugagcaccagcgacuucggcggcagaguggugaacaacgaccacuuccuguacuggggcgaggugagcagaagccuggaggacugcguggagugcaagaugcacaucguggagcagaccgaguucaucgacgaccagaccuuccagccccacagaagcaccgcccugcagcccuacaucaagagagccgccgccaccaagcuggccagcgccgagaagcugauguacuucugcaccgaccagcugggccuggagcaggacuucgagcagaagcagaugcccgacggcaagcugcugguggacggcuuccugcugggcaucgacgugagcagaggcaugaacagaaacuucgacgaccagcugaaguucgugagcaaccuguacaaccagcuggccaagaccaagaagcccaucgugguggugcugaccaagugcgacgagggcguggagagauacaucagagacgcccacaccuucgcccugagcaagaagaaccugcaggugguggagaccagcgccagaagcaacgugaacguggaccuggccuucagcacccuggugcagcugaucgacaagagcagaggcaagaccaagaucauccccuacuucgaggcccugaagcagcagagccagcagaucgccaccgccaaggacaaguacgaguggcuggugagcagaaucgugaagaaccacaacgagaacuggcugagcgugagcagaaagaugcaggccagccccgaguaccaggacuacguguaccuggagggcacccagaaggccaagaagcuguuccugcagcacauccacagacugaagcacgagcacaucgagagaagaagaaagcuguaccuggccgcccugccccuggccuucgaggcccugauccccaaccuggacgagaucgaccaccugagcugcaucaaggccaagaagcugcuggagaccaagcccgaguuccugaagugguucguggugcuggaggagacccccugggacgccaccagccacaucgacaacauggagaacgagagaauccccuucgaccugauggacaccgugcccgccgagcagcuguacgaggcccaccuggagaagcugagaaacgagagaaagagaguggagaugagaagagccuucaaggagaaccuggagaccagccccuucaucacccccggcaagcccugggaggaggccagaagcuucaucaugaacgaggacuucuaccaguggcuggaggagagcguguacauggacaucuacggcaagcaccagaagcagaucaucgacaaggccaaggaggaguuccaggagcugcugcuggaguacagcgagcuguucuacgagcuggagcuggacgccaagcccagcaaggagaagaugggcgugauccaggacgugcugggcgaggagcagagauucaaggcccugcagaagcugcaggccgagagagacgcccugauccugaagcacauccacuucguguaccaccccaccaaggagaccugccccagcugccccgccugcguggacgccaagaucgagcaccugaucagcagcagauucaucagacccagcgacagaaaccagaagaacagccugagcgaccccaacaucgacagaaucaaccuggugauccugggcaaggacggccuggccagagagcuggccaacgagaucagagcccugugcaccaacgacgacaaguacgugaucgacggcaagauguacgagcugagccugagacccaucgagggcaacgugagacugcccgugaacagcuuccagacccccaccuuccagccccacggcugccugugccuguacaacagcaaggagagccugagcuacgugguggagagcaucgagaagagcagagagagcacccugggcagaagagacaaccaccuggugcaccugccccugacccugauccuggugaacaagagaggcgacaccagcggcgagacccugcacagccugauccagcagggccagcagaucgccagcaagcugcagugcguguuccuggaccccgccagcgccggcaucggcuacggcagaaacaucaacgagaagcagaucagccaggugcugaagggccugcuggacagcaagagaaaccugaaccuggugagcagcaccgccagcaucaaggaccuggccgacguggaccugagaaucgugaugugccugaugugcggcgaccccuucagcgccgacgacauccuguuccccgugcugcagagccagaccugcaagagcagccacugcggcagcaacaacagcgugcugcuggagcugcccaucggccugcacaagaagagaaucgagcugagcgugcugagcuaccacagcagcuucagcaucagaaagagcagacuggugcacggcuacaucguguucuacagcgccaagagaaaggccagccuggccaugcugagagccuuccugugcgaggugcaggacaucauccccauccagcugguggcccugaccgacggcgccguggacgugcuggacaacgaccugagcagagagcagcugaccgagggcgaggagaucgcccaggagaucgacggcagauucaccagcauccccugcagccagccccagcacaagcuggagaucuuccaccccuucuucaaggacgugguggagaagaagaacaucaucgaggccacccacauguacgacaacgccgccgaggccugcagcaccaccgaggagguguucaacagccccagagccggcagcccccugugcaacagcaaccugcaggacagcgaggaggacaucgagcccagcuacagccuguucagagaggacaccagccugcccagccugagcaaggaccacagcaagcugagcauggagcuggagggcaacgacggccugagcuucaucaugagcaacuucgagagcaagcugaacaacaaggugcccccccccgugaagcccaagccccccgugcacuucgagaucaccaagggcgaccugagcuaccuggaccagggccacagagacggccagagaaagagcgugagcagcagccccuggcugccccaggacggcuucgaccccagcgacuacgccgagcccauggacgccguggugaagcccagaaacgaggaggagaacaucuacagcgugccccacgacagcacccagggcaagaucaucaccaucagaaacaucaacaaggcccagagcaacggcagcggcaacggcagcgacagcgagauggacaccagcagccuggagagaggcagaaaggugagcaucgugagcaagcccgugcuguacagaaccagaugcaccagacugggcagauucgccagcuacagaaccagcuucagcgugggcagcgacgacgagcugggccccaucagaaagaaggaggaggaccaggccagccagggcuacaagggcgacaacgccgugauccccuacgagaccgacgaggaccccagaagaagaaacauccugagaagccugagaagaaacaccaagaagcccaagcccaagcccagacccagcaucaccaaggccaccugggagagcaacuacuucggcgugccccugaccaccguggugacccccgagaagcccauccccaucuucaucgagagaugcaucgaguacaucgaggccaccggccugagcaccgagggcaucuacagagugagcggcaacaagagcgagauggagagccugcagagacaguucgaccaggaccacaaccuggaccuggccgagaaggacuucaccgugaacaccguggccggcgccaugaagagcuucuucagcgagcugcccgacccccuggugcccuacaacaugcagaucgaccugguggaggcccacaagaucaacgacagagagcagaagcugcacgcccugaaggaggugcugaagaaguuccccaaggagaaccacgagguguucaaguacgugaucagccaccugaacaaggugagccacaacaacaaggugaaccugaugaccagcgagaaccugagcaucugcuucuggcccacccugaugagacccgacuucagcaccauggacgcccugaccgccaccagaaccuaccagaccaucaucgagcuguucauccagcagugccccuucuucuucuacaacagacccaucaccgagccccccggcgccagacccagcagccccagcgccguggccagcaccgugcccuuccugaccagcacccccgugaccagccagcccagccccccccagagccccccccccaccccccagagccccaugcagccccugcugcccagccagcugcaggccgagcacacccuguaa

SEQ ID NO: 13781 - RNA, 2625 nt, Artificial Sequence
  ARHGAP42__Homo_sapiens__NP_689645
augggccugcccacccuggaguucagcgacagcuaccuggacagccccgacuucagagagagacugcagugccacgagaucgagcuggagagaaccaacaaguucaucaaggagcugaucaaggacggcagccugcugaucggcgcccugagaaaccugagcauggccgugcagaaguucagccagagccugcaggacuuccaguucgagugcaucggcgacgccgagaccgacgacgagaucagcaucgcccagagccugaaggaguucgccagacugcugaucgccguggaggaggagagaagaagacugauccagaacgccaacgacgugcugaucgccccccuggagaaguucagaaaggagcagaucggcgccgccaaggacggcaagaagaaguucgacaaggagagcgagaaguacuacagcauccuggagaagcaccugaaccugagcgccaagaagaaggagagccaccugcaggaggccgacacccagaucgacagagagcaccagaacuucuacgaggccagccuggaguacguguucaagauccaggaggugcaggagaagaagaaguucgaguucguggagccccugcugagcuuccugcagggccuguucaccuucuaccacgagggcuacgagcuggcccaggaguucgcccccuacaagcagcagcugcaguucaaccugcagaacaccagaaacaacuucgagagcaccagacaggagguggagagacugaugcagagaaugaagagcgccaaccaggacuacagaccccccagccaguggaccauggagggcuaccuguacgugcaggagaagagaccccugggcuucaccuggaucaagcacuacugcaccuacgacaagggcagcaagaccuucaccaugagcgugagcgagaugaagagcagcggcaagaugaacggccuggugaccagcagccccgagauguucaagcugaagagcugcaucagaagaaagaccgacagcaucgacaagagauucugcuucgacaucgaggugguggagagacacggcaucaucacccugcaggccuucagcgaggccaacagaaagcuguggcuggaggccauggacggcaaggagcccaucuacacccugcccgccaucaucagcaagaaggaggagauguaccugaacgaggccggcuucaacuucgugagaaagugcauccaggccguggagaccagaggcaucaccauccugggccuguacagaaucggcggcgugaacagcaaggugcagaagcugaugaacaccaccuucagccccaagagcccccccgacaucgacaucgacaucgagcugugggacaacaagaccaucaccagcggccugaagaacuaccugagaugccuggccgagccccugaugaccuacaagcugcacaaggacuucaucaucgccgugaagagcgacgaccagaacuacagaguggaggccgugcacgcccuggugcacaagcugcccgagaagaacagagagaugcuggacauccugaucaagcaccuggugaaggugagccugcacagccagcagaaccugaugaccgugagcaaccugggcgugaucuucggccccacccugaugagagcccaggaggagaccguggccgccaugaugaacaucaaguuccagaacaucgugguggagauccugaucgagcacuacgagaagaucuuccacaccgcccccgaccccagcaucccccugccccagccccagagcagaagcggcagcagaagaaccagagccaucugccugagcaccggcagcagaaagcccagaggcagauacacccccugccuggccgagcccgacagcgacagcuacagcagcagccccgacagcacccccaugggcagcaucgagagccugagcagccacagcagcgagcagaacagcaccaccaagagcgccagcugccagcccagagagaagagcggcggcauccccuggaucgccacccccagcagcagcaacggccagaagagccugggccuguggaccaccagccccgagagcagcagcagagaggacgccaccaagaccgacgccgagagcgacugccagagcguggccagcgugaccagccccggcgacgugagcccccccaucgaccuggugaagaaggagcccuacggccugagcggccugaagagagccagcgccagcagccugagaagcaucagcgccgccgagggcaacaagagcuacagcggcagcauccagagccugaccagcgugggcagcaaggagacccccaaggccagccccaaccccgaccugccccccaagaugugcagaagacugagacuggacaccgccagcagcaacggcuaccagagacccggcagcgugguggccgccaaggcccagcuguucgagaacgugggcagccccaagcccgugagcagcggcagacaggccaaggccauguacagcugcaaggccgagcacagccacgagcugagcuucccccagggcgccaucuucagcaacguguaccccagcguggagcccggcuggcugaaggccaccuacgagggcaagaccggccuggugcccgagaacuacgugguguuccuguaa

SEQ ID NO: 13782 - RNA, 2961 nt, Artificial Sequence
  ARHGAP4__Homo_sapiens__NP_001158213
auggccgcccacggcaagcugagaagagagagaggccugcaggccgaguacgagacccaggugaaggagaugagauggcagcugagcgagcagcugagaugccuggagcugcagggcgagcugagaagagagcugcugcaggagcuggccgaguucaugagaagaagagccgagguggagcuggaguacagcagaggccuggagaagcuggccgagagauucagcagcagaggcggcagacugggcagcagcagagagcaccagagcuucagaaaggagcccagccugcugagcccccugcacugcugggccgugcugcugcagcacaccagacagcagagcagagagagcgccgcccugagcgaggugcuggccggcccccuggcccagagacugagccacaucgccgaggacgugggcagacuggugaagaagagcagagaccuggagcagcagcugcaggacgagcugcuggagguggugagcgagcugcagaccgccaagaagaccuaccaggccuaccacauggagagcgugaacgccgaggccaagcugagagaggccgagagacaggaggagaagagagccggcagaagcgugcccaccaccaccgccggcgccaccgaggccggcccccugagaaagagcagccugaagaagggcggcagacugguggagaagcuguggcccccccagagacccguggccgccagcagcugcgcccccgugugcuggcugcaggccggcuuccuggugcacccccccugguggggcgccaugugcgcccccagcacccaccagagacaggccaaguucauggagcacaagcugaagugcaccaaggccagaaacgaguaccugcugagccuggccagcgugaacgccgccgugagcaacuacuaccugcacgacgugcuggaccugauggacugcugcgacaccggcuuccaccuggcccugggccaggugcugagaagcuacaccgccgccgagagcagaacccaggccagccaggugcagggccugggcagccuggaggaggccguggaggcccuggacccccccggcgacaaggccaaggugcuggaggugcacgccaccguguucugccccccccugagauucgacuaccacccccacgacggcgacgagguggccgagaucugcguggagauggagcugagagacgagauccugcccagagcccagaacauccagagcagacuggacagacagaccaucgagaccgaggaggugaacaagacccugaaggccacccugcaggcccugcuggaggugguggccagcgacgacggcgacgugcuggacagcuuccagaccagccccagcaccgagagccugaagagcaccagcagcgaccccggcagcagacaggccggcagaagaagaggccagcagcaggagaccgagaccuucuaccugaccaagcugcaggaguaccugagcggcagaagcauccuggccaagcugcaggccaagcacgagaagcugcaggaggcccugcagagaggcgacaaggaggagcaggaggugagcuggacccaguacacccagagaaaguuccagaagagcagacagcccagacccagcagccaguacaaccagagacuguucggcggcgacauggagaaguucauccagagcagcggccagcccgugccccuggugguggagagcugcaucagauucaucaaccugaacggccugcagcacgagggcaucuucagagugagcggcgcccagcugagagugagcgagaucagagacgccuucgagagaggcgaggacccccugguggagggcugcaccgcccacgaccuggacagcguggccggcgugcugaagcuguacuucagaagccuggagcccccccuguucccccccgaccuguucggcgagcugcuggccagcagcgagcuggaggccaccgccgagagaguggagcacgugagcagacugcuguggagacugcccgcccccgugcugguggugcugagauaccuguucaccuuccugaaccaccuggcccaguacagcgacgagaacaugauggaccccuacaaccuggccgugugcuucggccccacccugcugcccgugcccgccggccaggaccccguggcccugcagggcagagugaaccagcuggugcagacccugaucgugcagcccgacagaguguuccccccccugaccagccugcccggccccguguacgagaagugcauggccccccccagcgccagcugccugggcgacgcccagcuggagagccugggcgccgacaacgagcccgagcuggaggccgagaugcccgcccaggaggacgaccuggagggcgugguggaggccguggccugcuucgccuacaccggcagaaccgcccaggagcugagcuucagaagaggcgacgugcugagacugcacgagagagccagcagcgacugguggagaggcgagcacaacggcaugagaggccugaucccccacaaguacaucacccugcccgccggcaccgagaagcagguggugggcgccggccugcagaccgccggcgagagcggcagcagccccgagggccugcuggccagcgagcuggugcacagacccgagcccugcaccagccccgaggccaugggccccagcggccacagaagaagaugccuggugcccgccagccccgagcagcacguggagguggacaaggccguggcccagaacauggacagcguguucaaggagcugcugggcaagaccagcgugagacagggccugggccccgccagcaccaccagccccagccccggccccagaagccccaaggccccccccagcagcagacugggcagaaacaagggcuucagcagaggccccggcgcccccgccagccccagcgccagccacccccagggccuggacaccacccccaagccccacuaa

SEQ ID NO: 13783 - RNA, 4506 nt, Artificial Sequence
  ARHGAP5__Homo_sapiens__NP_001164
augauggccaagaacaaggagcccagaccccccagcuacaccaucagcaucgugggccugagcggcaccgagaaggacaagggcaacugcggcgugggcaagagcugccugugcaacagauucgugagaagcaaggccgacgaguacuaccccgagcacaccagcgugcugagcaccaucgacuucggcggcagaguggugaacaacgaccacuuccuguacuggggcgacaucauccagaacagcgaggacggcguggagugcaagauccacgugaucgagcagaccgaguucaucgacgaccagaccuuccugccccacagaagcaccaaccugcagcccuacaucaagagagccgccgccagcaagcugcagagcgccgagaagcugauguacaucugcaccgaccagcugggccuggagcaggacuucgagcagaagcagaugcccgagggcaagcugaacguggacggcuuccugcugugcaucgacgugagccagggcugcaacagaaaguucgacgaccagcugaaguucgugaacaaccuguucgugcagcugagcaagagcaagaagcccgugaucaucgccgccaccaagugcgacgagugcguggaccacuaccugagagaggugcaggccuucgccagcaacaagaagaaccugcuggugguggagaccagcgccagauucaacgugaacaucgagaccugcuucaccgcccuggugcagaugcuggacaagaccagaagcaagcccaagaucauccccuaccuggacgccuacaagacccagagacagcugguggugaccgccaccgacaaguucgagaagcuggugcagaccgugagagacuaccacgccaccuggaagaccgugagcaacaagcugaagaaccaccccgacuacgaggaguacaucaaccuggagggcaccagaaaggccagaaacaccuucagcaagcacaucgagcagcugaagcaggagcacaucagaaagagaagagaggaguacaucaacacccugcccagagccuucaacacccugcugcccaaccuggaggagaucgagcaccugaacuggagcgaggcccugaagcugauggagaagagagccgacuuccagcugugcuucguggugcuggagaagacccccugggacgagaccgaccacaucgacaagaucaacgacagaagaauccccuucgaccugcugagcacccuggaggccgagaagguguaccagaaccacgugcagcaccugaucagcgagaagagaagaguggagaugaaggagaaguucaagaagacccuggagaagauccaguucaucagccccggccagcccugggaggaggugaugugcuucgugauggaggacgaggccuacaaguacaucaccgaggccgacagcaaggagguguacggcagacaccagagagagaucguggagaaggccaaggaggaguuccaggagaugcuguucgagcacagcgagcuguucuacgaccuggaccugaacgccacccccagcagcgacaagaugagcgagauccacaccgugcugagcgaggagcccagauacaaggcccugcagaagcuggcccccgacagagagagccugcugcugaagcacaucggcuucguguaccaccccaccaaggagaccugccugagcggccagaacugcaccgacaucaagguggagcagcugcuggccagcagccugcugcagcuggaccacggcagacugagacuguaccacgacagcaccaacaucgacaaggugaaccuguucauccugggcaaggacggccuggcccaggagcuggccaacgagaucagaacccagagcaccgacgacgaguacgcccuggacggcaagaucuacgagcuggaccugagacccguggacgccaagagccccuacuuccugagccagcuguggaccgccgccuucaagccccacggcugcuucugcguguucaacagcaucgagagccugagcuucaucggcgaguucaucggcaagaucagaaccgaggccagccagaucagaaaggacaaguacauggccaaccugcccuucacccugauccuggccaaccagagagacagcaucagcaagaaccugcccauccugagacaccagggccagcagcuggccaacaagcugcagugccccuucguggacgugcccgccggcaccuaccccagaaaguucaacgagacccagaucaagcaggcccugagaggcgugcuggagagcgugaagcacaaccuggacguggugagccccauccccgccaacaaggaccugagcgaggccgaccugagaaucgugaugugcgccaugugcggcgaccccuucagcguggaccugauccugagccccuuccuggacagccacagcugcagcgccgcccaggccggccagaacaacagccugaugcuggacaagaucaucggcgagaagagaagaagaauccagaucaccauccugagcuaccacagcagcaucggcgugagaaaggacgagcuggugcacggcuacauccugguguacagcgccaagagaaaggccagcaugggcaugcugagagccuuccugagcgaggugcaggacaccauccccgugcagcugguggccgugaccgacagccaggccgacuucuucgagaacgaggccaucaaggagcugaugaccgagggcgagcacaucgccaccgagaucaccgccaaguucaccgcccuguacagccugagccaguaccacagacagaccgagguguucacccuguucuucagcgacgugcuggagaagaagaacaugaucgagaacagcuaccugagcgacaacaccagagagagcacccaccagagcgaggacguguuccugcccagccccagagacugcuuccccuacaacaacuaccccgacagcgacgacgacaccgaggcccccccccccuacagccccaucggcgacgacgugcagcugcugcccacccccagcgacagaagcagauacagacuggaccuggagggcaacgaguaccccauccacagcacccccaacugccacgaccacgagagaaaccacaaggugcccccccccaucaagcccaagcccguggugcccaagaccaacgugaagaagcuggaccccaaccugcugaagaccaucgaggccggcaucggcaagaaccccagaaagcagaccagcagagugccccuggcccaccccgaggacauggaccccagcgacaacuacgccgagcccaucgacaccaucuucaagcagaagggcuacagcgacgagaucuacguggugcccgacgacagccagaacagaaucaagaucagaaacagcuucgugaacaacacccagggcgacgaggagaacggcuucagcgacagaaccagcaagagccacggcgagagaagacccagcaaguacaaguacaagagcaagacccuguucagcaaggccaagagcuacuacagaagaacccacagcgacgccagcgacgacgaggccuucaccaccagcaagaccaagagaaagggcagacacagaggcagcgaggaggacccccugcugagccccguggagaccuggaagggcggcaucgacaaccccgccaucaccagcgaccaggagcuggacgacaagaagaugaagaagaagacccacaaggugaaggaggacaagaagaagaagaagaccaagaacuucaacccccccaccagaagaaacugggagagcaacuacuucggcaugccccugcaggaccuggugaccgccgagaagcccaucccccuguucguggagaagugcguggaguucaucgaggacaccggccugugcaccgagggccuguacagagugagcggcaacaagaccgaccaggacaacauccagaagcaguucgaccaggaccacaacaucaaccuggugagcauggaggugaccgugaacgccguggccggcgcccugaaggccuucuucgccgaccugcccgacccccugauccccuacagccugcaccccgagcugcuggaggccgccaagauccccgacaagaccgagagacugcacgcccugaaggagaucgugaagaaguuccaccccgugaacuacgacguguucagauacgugaucacccaccugaacagagugagccagcagcacaagaucaaccugaugaccgccgacaaccugagcaucugcuucuggcccacccugaugagacccgacuucgagaacagagaguuccugagcaccaccaagauccaccagagcgugguggagaccuucauccagcagugccaguucuucuucuacaacggcgagaucguggagaccaccaacaucguggccccccccccccccagcaaccccggccagcugguggagcccauggugccccugcagcugccccccccccugcagccccagcugauccagccccagcugcagaccgacccccugggcaucaucuaa

SEQ ID NO: 13784 - RNA, 2385 nt, Artificial Sequence
  ARHGAP6__Homo_sapiens__NP_001274171
augggccaccccguguacagaggcgagaagccccagcugcacuacgccggcgacuucaccuggaacagcaugagcggcagaagcgugagacugagaagcgugcccauccagagccugagcgagcuggagagagccagacugcaggagguggccuucuaccagcugcagcaggacugcgaccugagcugccagaucaccauccccaaggacggccagaagagaaagaagagccugagaaagaagcuggacagccugggcaaggagaagaacaaggacaaggaguucaucccccaggccuucggcaugccccugagccaggugaucgccaacgacagagccuacaagcugaagcaggaccugcagagagacgagcagaaggacgccagcgacuucguggccagccugcugcccuucggcaacaagagacagaacaaggagcugagcagcagcaacagcagccugagcagcaccagcgagacccccaacgagagcaccagccccaacacccccgagcccgcccccagagccagaagaagaggcgccaugagcguggacagcaucaccgaccuggacgacaaccagagcagacugcuggaggcccugcagcugagccugcccgccgaggcccagagcaagaaggagaaggccagagacaagaagcugagccugaaccccaucuacagacaggugcccagacugguggacagcugcugccagcaccuggagaagcacggccugcagaccgugggcaucuucagagugggcagcagcaagaagagagugagacagcugagagaggaguucgacagaggcaucgacgugagccuggaggaggagcacagcgugcacgacguggccgcccugcugaaggaguuccugagagacaugcccgacccccugcugaccagagagcuguacaccgccuucaucaacacccugcugcuggagcccgaggagcagcugggcacccugcagcugcugaucuaccugcugccccccugcaacugcgacacccugcacagacugcugcaguuccugagcaucguggccagacacgccgacgacaacaucagcaaggacggccaggaggugaccggcaacaagaugaccagccugaaccuggccaccaucuucggccccaaccugcugcacaagcagaagagcagcgacaaggaguucagcgugcagagcagcgccagagccgaggagagcaccgccaucaucgccguggugcagaagaugaucgagaacuacgaggcccuguucauggugccccccgaccugcagaacgaggugcugaucagccugcuggagaccgaccccgacgugguggacuaccugcugagaagaaaggccagccagagcagcagccccgacaugcugcagagcgaggugagcuucagcgugggcggcagacacagcagcaccgacagcaacaaggccagcagcggcgacaucagccccuacgacaacaacagccccgugcugagcgagagaagccugcuggccaugcaggaggacgccgcccccggcggcagcgagaagcuguacagagugcccggccaguucaugcuggugggccaccugagcagcagcaagagcagagagagcagccccggccccagacugggcaaggaccugagcgaggagcccuucgacaucuggggcaccuggcacagcacccugaagagcggcagcaaggaccccggcaugaccggcagcagcggcgacaucuucgagagcagcagccugagagccggccccugcagccugagccagggcaaccugagccccaacuggcccagauggcagggcagccccgccgagcuggacagcgacacccagggcgccagaagaacccaggccgccgcccccgccaccgagggcagagcccaccccgccgugagcagagccugcagcaccccccacgugcagguggccggcaaggccgagagacccaccgccagaagcgagcaguaccugacccugagcggcgcccacgaccugagcgagagcgagcuggacguggccggccugcagagcagagccaccccccagugccagagaccccacggcagcggcagagacgacaagagaccccccccccccuaccccggccccggcaagcccgccgccgccgccgccuggauccagggcccccccgagggcguggagacccccaccgaccagggcggccaggccgccgagagagagcagcaggugacccagaagaagcugagcagcgccaacagccugcccgccggcgagcaggacagccccagacugggcgacgccggcuggcuggacuggcagagagagagauggcagaucugggagcugcugagcaccgacaaccccgacgcccugcccgagacccugguguaa

SEQ ID NO: 13785 - RNA, 1644 nt, Artificial Sequence
  ARHGAP9__Homo_sapiens__NP_001073625
augagcgagccccccguguacugcaaccugguggaccugagaagaugccccagaagccccccccccggccccgccugcccccugcugcagagacuggacgccugggagcagcaccuggaccccaacagcggcagaugcuucuacaucaacagccugaccggcugcaagagcuggaagccccccagaagaagcagaagcgagaccaaccccggcagcauggagggcacccagacccugaagagaaacaacgacgugcugcagccccaggccaagggcuucagaagcgacaccggcacccccgagccccuggacccccagggcagccugagccugagccagagaaccagccagcuggacccccccgcccugcaggcccccagaccccugccccagcugcuggacgacccccacgagguggagaagagcggccugcugaacaugaccaagaucgcccagggcggcagaaagcugagaaagaacuggggccccagcuggguggugcugaccggcaacagccugguguucuacagagagcccccccccaccgcccccagcagcggcuggggccccgccggcagcagacccgagagcagcguggaccugagaggcgccgcccuggcccacggcagacaccugagcagcagaagaaacgugcugcacaucagaaccauccccggccacgaguuccugcugcagagcgaccacgagaccgagcugagagccuggcacagagcccugagaaccgugaucgagagacuggacagagagaacccccuggagcugagacugagcggcagcggccccgccgagcugagcgccggcgaggacgaggaggaggagagcgagcuggugagcaagccccugcugagacugagcagcagaagaagcagcaucagaggccccgagggcaccgagcagaacagagugagaaacaagcugaagagacugaucgccaagagacccccccugcagagccugcaggagagaggccugcugagagaccagguguucggcugccagcuggagagccugugccagagagagggcgacaccgugcccagcuuccugagacugugcaucgccgccguggacaagagaggccuggacguggacggcaucuacagagugagcggcaaccuggccguggugcagaagcugagauuccugguggacagagagagagccgugaccagcgacggcagauacguguuccccgagcagcccggccaggagggcagacuggaccuggacagcaccgagugggacgacauccacguggugaccggcgcccugaagcuguuccugagagagcugccccagccccuggugcccccccugcugcugccccacuucagagccgcccuggcccugagcgagagcgagcagugccugagccagauccaggagcugaucggcagcaugcccaagcccaaccacgacacccugagauaccugcuggagcaccugugcagagugaucgcccacagcgacaagaacagaaugaccccccacaaccugggcaucguguucggccccacccuguucagacccgagcaggagaccagcgaccccgccgcccacgcccuguaccccggccagcuggugcagcugaugcugaccaacuucaccagccuguuccccuaa

SEQ ID NO: 13786 - RNA, 1014 nt, Artificial Sequence
  ARHGDIA__Homo_sapiens__NP_001288171
auggccgagcaggagcccaccgccgagcagcuggcccagaucgccgccgagaacgaggaggacgagcacagcgugaacuacaagccccccgcccagaagagcauccaggagauccaggagcuggacaaggacgacgagagccugagaaaguacaaggaggcccugcugggcagaguggccgugagcgccgaccccaacgugcccaacgugguggugaccggccugacccuggugugcagcagcgcccccggcccccuggagcuggaccugaccggcgaccuggagagcuucaagaagcagagcuucgugcugaaggagggcguggaguacagaaucaagaucagcuucagagugaacagagagaucgugagcggcaugaaguacauccagcacaccuacagaaagggcgugaagaucgacaagaccgacuacaugaccaccaccagacccaccaccugccccggcagcggcaucagccccagcagaagaaccggcagaaccgagcccagccagagaagagccggccagaccgacggcagaaccaccgacagaagaaugugccccccccagccccugcccagccccuaccagagcgccgacagacccagcgugccccugccccccuggagcgccagccuggccuggcugaacagagugccccccaccccccugcugagcccccccccccccaccggccccgccagcagcgugagcugccugguggccgccagcgccugcgccgugggcgagagaggcagaagccaggccagcgccgcccugagcgugccccccagauucuaccugcccgugacccccgaggccuggcugcaggagggcgccgagcagcccuucagcagacccagaggcugccccuggaccugcgccagcgccgcccccggcuggagcuggggcgugggcugcaccgccagcuggggccccggcagaccccccgccccccugcugcccggccagccccccugcagaugcagaagcagacugaccaugaugcccuaa

SEQ ID NO: 13787 - RNA, 606 nt, Artificial Sequence
  ARHGDIB__Homo_sapiens__XP_011518968
augaccgagaaggcccccgagccccacguggaggaggacgacgacgacgagcuggacagcaagcugaacuacaagccccccccccagaagagccugaaggagcugcaggagauggacaaggacgacgagagccugaucaaguacaagaagacccugcugggcgacggccccguggugaccgaccccaaggcccccaacgugguggugaccagacugacccuggugugcgagagcgcccccggccccaucaccauggaccugaccggcgaccuggaggcccugaagaaggagaccaucgugcugaaggagggcagcgaguacagagugaagauccacuucaaggugaacagagacaucgugagcggccugaaguacgugcagcacaccuacagaaccggcgugaagguggacaaggccaccuucauggugggcagcuacggccccagacccgaggaguacgaguuccugacccccguggaggaggcccccaagggcaugcuggccagaggcaccuaccacaacaagagcuucuucaccgacgacgacaagcaggaccaccugagcugggaguggaaccugagcaucaagaaggaguggaccgaguaa

SEQ ID NO: 13788 - RNA, 4035 nt, Artificial Sequence
  ARHGEF10__Homo_sapiens__NP_055444
auggaccagagagagccccugccccccgcccccgccgagaacgagaugaaguacgacaccaacaacaacgaggaggaggagggcgagcaguucgacuucgacagcggcgacgagauccccgaggccgacagacaggcccccagcgcccccgagaccggcggcgccggcgccagcgaggcccccgcccccaccggcggcgaggacggcgccggcgccgagaccacccccguggccgagcccaccaagcuggugcugcccaugaaggugaaccccuacagcgugaucgacaucacccccuuccaggaggaccagccccccacccccgugcccagcgccgaggaggagaacgugggccugcacgugcccugcggcuaccuggugcccgugcccugcggcuacgccgugcccagcaaccugccccugcugcugcccgccuacagcagccccgugaucaucugcgccaccagccuggacgaggaggagacccccgaggugaccgaggacagacagcccaacagccugagcagcgaggagccccccaccagcgaggaccaggugggcagagaggacagcgcccuggccagaugggccgccgaccccgccaacaccgccuggauggagaaccccgaggaggccaucuacgacgacgugcccagagagaacagcgacagcgagcccgacgagaugaucuacgacgacguggagaacggcgacgagggcggcaacagcagccuggaguacggcuggagcagcagcgaguucgagagcuacgaggagcagagcgacagcgagugcaagaacggcauccccagaagcuuccugagaagcaaccacaagaagcagcugagccacgaccugaccagacugaaggagcacuacgagaagaagaugagagaccugauggccagcaccgugggcgugguggagauccagcagcugagacagaagcacgagcugaagaugcagaagcuggugaaggccgccaaggacggcaccaaggacggccuggagagaaccagagccgccgugaagagaggcagaagcuucaucagaaccaagagccugaucgcccaggaccacagaagcagccuggaggaggagcagaaccuguucaucgacguggacugcaagcaccccgaggccauccugacccccaugcccgagggccugagccagcagcagguggugagaagauacauccugggcagcgugguggacagcgagaagaacuacguggacgcccugaagagaauccuggagcaguacgagaagccccugagcgagauggagcccaaggugcugagcgagagaaagcugaagaccguguucuacagagugaaggagauccugcagugccacagccuguuccagaucgcccuggccagcagagugagcgagugggacagcguggagaugaucggcgacguguucguggccagcuucagcaagagcauggugcuggacgccuacagcgaguacgugaacaacuucagcaccgccguggccgugcugaagaagaccugcgccaccaagcccgccuuccuggaguuccugaagcaggagcaggaggccagccccgacagaaccacccuguacagccugaugaugaagcccauccagagauucccccaguucauccugcugcugcaggacaugcugaagaacaccagcaagggccaccccgacagacugccccugcagauggcccugaccgagcuggagacccuggccgagaagcugaacgagagaaagagagacgccgaccagagaugcgaggugaagcagaucgccaaggccaucaacgagagauaccugaacaagcugcugagcagcggcagcagauaccugaucagaagcgacgacaugaucgagaccguguacaacgacagaggcgagaucgugaagaccaaggagagaagaguguucaugcugaacgacgugcugaugugcgccaccgugagcagcagacccagccacgacagcagagugaugagcagccagagauaccugcugaaguggagcgugccccugggccacguggacgccaucgaguacggcagcagcgccggcaccggcgagcacagcagacaccuggccgugcacccccccgagagccuggccgugguggccaacgccaagcccaacaagguguacaugggccccggccagcuguaccaggaccugcagaaccugcugcacgaccugaacgugaucggccagaucacccagcugaucggcaaccugaagggcaacuaccagaaccugaaccagagcguggcccacgacuggaccagcggccugcagagacugauccugaagaaggaggacgagaucagagccgccgacugcugcagaauccagcugcagcugcccggcaagcaggacaagagcggcagacccaccuucuucaccgccguguucaacaccuucacccccgccaucaaggagagcugggugaacagccugcagauggccaagcuggcccuggaggaggagaaccacaugggcugguucugcguggaggacgacggcaaccacaucaagaaggagaagcacccccugcuggugggccacaugcccgugaugguggccaagcagcaggaguucaagaucgagugcgccgccuacaaccccgagcccuaccugaacaacgagagccagcccgacagcuucagcaccgcccacggcuuccuguggaucggcagcugcacccaccagaugggccagaucgccaucgugagcuuccagaacagcacccccaaggugaucgagugcuucaacguggagagcagaauccugugcaugcuguacgugcccguggaggagaagagaagagagcccggcgccccccccgaccccgagacccccgccgugagagccagcgacgugcccaccaucugcgugggcaccgaggagggcagcaucagcaucuacaagagcagccagggcagcaagaaggugagacugcagcacuucuucacccccgagaagagcaccgugaugagccuggccugcaccagccagagccuguacgccggccuggugaacggcgccguggccagcuacgccagagcccccgacggcagcugggacagcgagccccagaaggugaucaagcugggcgugcugcccgugagaagccugcugaugauggaggacacccugugggccgccagcggcggccagguguucaucaucagcguggagacccacgccguggagggccagcuggaggcccaccaggaggagggcauggugaucagccacauggccgugagcggcgugggcaucuggaucgccuucaccagcggcagcacccugagacuguuccacaccgagacccugaagcaccugcaggacaucaacaucgccacccccgugcacaacaugcugcccggccaccagagacugagcgugaccagccugcuggugugccacggccugcugauggugggcaccagccugggcgugcugguggcccugcccgugcccagacugcagggcauccccaaggugaccggcagaggcauggugagcuaccacgcccacaacagccccgugaaguucaucgugcuggccaccgcccugcacgagaaggacaaggacaagagcagagacagccuggcccccggccccgagccccaggacgaggaccagaaggacgcccugcccagcggcggcgccggcagcagccugagccagggcgaccccgacgccgccaucuggcugggcgacagccugggcagcaugacccagaagagcgaccugagcagcagcagcggcagccugagccugagccacggcagcagcagccuggagcacagaagcgaggacagcaccaucuacgaccugcugaaggaccccgugagccugagaagcaaggccagaagagccaagaaggccaaggccagcagcgcccugguggugugcggcggccagggccacagaagagugcacagaaaggccagacagccccaccaggaggagcuggcccccaccgugaugguguggcagaucccccugcugaacaucuaa

SEQ ID NO: 13789 - RNA, 3726 nt, Artificial Sequence
  ARHGEF10L__Homo_sapiens__XP_011539993
auggccagcagcaacccccccccccagcccgccaucggcgaccagcuggugcccggcgugcccggccccagcagcgaggccgaggacgaccccggcgaggccuucgaguucgacgacagcgacgacgaggaggacaccagcgccgcccugggcgugcccagccuggcccccgagagagacaccgaccccccccugauccaccuggacagcauccccgugaccgaccccgaccccgccgccgccccccccggcaccggcgugcccgccugggugagcaacggcgacgccgccgacgccgccuucagcggcgccagacacagcagcuggaagagaaagagcagcagaagaaucgacagauucaccuuccccgcccuggaggaggacgugaucuacgacgacgugcccugcgagagccccgacgcccaccagcccgccggcgccgagagaaaccugcuguacgaggacgcccacagagccggcgcccccagacaggccgaggaccugggcuggagcagcagcgaguucgagagcuacagcgaggacagcggcgaggaggccaagcccgagguggagguggagcccgccaagcacagagugagcuuccagcccaagaugacccagcugaugaaggccgccaagagcggcaccaaggacggccuggagaagaccagaauggccgugaugagaaaggugagcuuccugcacagaaaggacgugcugggcgacagcgaggaggaggacaugggccugcuggaggugagcgugagcgacaucaagccccccgcccccgagcugggccccaugcccgagggccugagcccccagcagguggugagaagacacauccugggcagcaucgugcagagcgagggcagcuacguggagagccugaagagaauccugcaggacuacagaaacccccugauggagauggagcccaaggcccugagcgccagaaagugccaggugguguucuucagagugaaggagauccugcacugccacagcauguuccagaucgcccugagcagcagaguggccgagugggacagcaccgagaagaucggcgaccuguucguggccagcuucagcaagagcauggugcuggacguguacagcgacuacgugaacaacuucaccagcgccaugagcaucaucaagaaggccugccugaccaagcccgccuuccuggaguuccugaagagaagacaggugugcagccccgacagagugacccuguacggccugauggugaagcccauccagagauucccccaguucauccugcugcugcaggacaugcugaagaacacccccagaggccaccccgacagacugagccugcagcuggcccugaccgagcuggagacccuggccgagaagcugaacgagcagaagagacuggccgaccagguggccgagauccagcagcugaccaagagcgugagcgacagaagcagccugaacaagcugcugaccagcggccagagacagcugcugcugugcgagacccugaccgagaccguguacggcgacagaggccagcugaucaagagcaaggagagaagaguguuccugcugaacgacaugcuggugugcgccaacaucaacuucaagcccgccaaccacagaggccagcuggagaucagcagccuggugccccugggccccaaguacguggugaaguggaacaccgcccugccccaggugcaggugguggaggugggccaggacggcggcaccuacgacaaggacaacgugcugauccagcacagcggcgccaagaaggccagcgccagcggccaggcccagaacaagguguaccugggcccccccagacuguuccaggagcugcaggaccugcagaaggaccuggccgugguggagcagaucacccugcugaucagcacccugcacggcaccuaccagaaccugaacaugaccguggcccaggacuggugccuggcccugcagagacugaugagagugaaggaggaggagauccacagcgccaacaagugcagacugagacugcugcugcccggcaagcccgacaagagcggcagacccaucagcuucauggugguguucaucacccccaacccccugagcaagaucagcugggugaacagacugcaccuggccaagaucggccugagagaggagaaccagcccggcuggcugugccccgacgaggacaagaagagcaaggcccccuucuggugccccauccuggccugcugcauccccgccuucagcagcagagcccugagccugcagcugggcgcccuggugcacagccccgugaacugcccccugcugggcuucagcgccgugagcaccagccugccccagggcuaccugugggugggcggcggccaggagggcgccggcggccagguggagaucuucagccugaacagacccagccccagaaccgugaagagcuucccccuggccgcccccgugcugugcauggaguacauccccgagcuggaggaggaggccgagagcagagacgagagccccaccguggccgaccccagcgccaccgugcaccccaccaucugccugggccugcaggacggcagcauccugcuguacagcagcguggacaccggcacccagugccuggugagcugcagaagccccggccugcagcccgugcugugccugagacacagccccuuccaccugcuggccggccugcaggacggcacccuggccgccuaccccagaaccagcggcggcgugcugugggaccuggagagcccccccgugugccugaccgugggccccggccccgugagaacccugcugagccuggaggacgccgugugggccagcugcggccccagagugaccgugcuggaggccaccacccugcagccccagcagagcuucgaggcccaccaggacgaggccgugagcgugacccacauggugaaggccggcagcggcguguggauggccuucagcagcggcaccagcaucagacuguuccacaccgagacccuggagcaccugcaggagaucaacaucgccaccagaaccaccuuccugcugcccggccagaagcaccugugcgugaccagccugcugaucugccagggccugcugugggugggcaccgaccagggcgugaucgugcugcugcccgugcccagacuggagggcauccccaagaucaccggcaagggcauggugagccugaacggccacugcggccccguggccuuccuggccguggccaccagcauccuggcccccgacauccugagaagcgaccaggaggaggccgagggccccagagccgaggaggacaagcccgacggccaggcccacgagcccaugcccgacagccacgugggcagagagcugaccagaaagaagggcauccugcugcaguacagacugagaagcaccgcccaccugcccggcccccugcugagcaugagagagcccgcccccgccgacggcgccgcccuggagcacagcgaggaggacggcagcaucuacgagauggccgacgaccccgacaucugggugagaagcagacccugcgccagagacgcccacagaaaggagaucugcagcguggccaucaucagcggcggccagggcuacagaaacuucggcagcgcccugggcagcagcggcagacaggcccccugcggcgagaccgacagcacccugcugaucuggcaggugccccugaugcuguaa

SEQ ID NO: 13790 - RNA, 4569 nt, Artificial Sequence
  ARHGEF11__Homo_sapiens__NP_055599
augagcgugagacugccccagagcaucgacagacugagcagccugagcagccugggcgacagcgcccccgagagaaagagccccagccaccacagacagcccagcgacgccagcgagaccaccggccuggugcagagaugcgugaucauccagaaggaccagcacggcuucggcuucaccgugagcggcgacagaaucgugcuggugcagagcgugagacccggcggcgccgccaugaaggccggcgugaaggagggcgacagaaucaucaaggugaacggcaccauggugaccaacagcagccaccuggagguggugaagcugaucaagagcggcgccuacguggcccugacccugcugggcagcagccccagcagcaugggcaucagcggccugcagcaggaccccagccccgccggcgcccccagaaucaccagcgugauccccagccccccccccccccccccccugccccccccccagagaaucaccggccccaagccccugcaggaccccgaggugcagaagcacgccacccagauccugagaaacaugcugagacaggaggagaaggagcugcaggacauccugccccuguacggcgacaccagccagagacccagcgagggcagacugagccuggacagccaggagggcgacagcggccuggacagcggcaccgagagauuccccagccugagcgagagccugaugaacagaaacagcgugcugagcgaccccggccuggacagccccagaaccagccccgugaucauggccagaguggcccagcaccacagaagacagggcagcgacgccgccgugcccagcaccggcgaccagggcguggaccagagccccaagccccugaucaucggccccgaggaggacuacgaccccggcuacuucaacaacgagagcgacaucaucuuccaggaccuggagaagcugaagagcagacccgcccaccugggcguguuccugagauacaucuucagccaggccgaccccagcccccugcuguucuaccugugcgccgagguguaccagcaggccagccccaaggacagcagaagccugggcaaggacaucuggaacaucuuccuggagaagaacgccccccugagagugaagauccccgagaugcugcaggccgagaucgacagcagacugagaaacagcgaggacgccagaggcgugcugugcgaggcccaggaggccgccaugcccgagauccaggagcagauccacgacuacagaaccaagagaacccugggccugggcagccuguacggcgagaacgaccugcuggaccuggacggcgacccccugagagagagacagguggccgagaagcagcuggccgcccugggcgacauccugagcaaguacgaggaggacagaagcgcccccauggacuucgcccugaacaccuacaugagccacgccggcaucagacugagagaggccagacccagcaacaccgccgagaaggcccagagcgcccccgacaaggacaaguggcugcccuucuuccccaagaccaagaagagcagcaacagcaagaaggagaaggacgcccuggaggacaagaagagaaaccccauccugaaguacaucggcaagcccaagagcagcagccagagcaccuuccacaucccccugagccccguggaggugaagcccggcaacgugagaaacaucauccagcacuucgagaacaaccagcaguacgacgcccccgagcccggcacccagagacugagcaccggcagcuuccccgaggaccugcuggagagcgacagcagcagaagcgagaucagacugggcagaagcgagagccugaagggcagagaggagaugaagagaagcagaaaggccgagaacgugcccagaagcagaagcgacguggacauggacgccgccgccgaggccaccagacugcaccagagcgccagcagcagcaccagcagccugagcaccagaagccuggagaaccccaccccccccuucacccccaagaugggcagaagaagcaucgagagccccagccugggcuucugcaccgacacccugcugccccaccugcuggaggacgaccugggccagcugagcgaccuggagcccgagcccgacgcccagaacuggcagcacaccgugggcaaggacgugguggccggccugacccagagagagaucgacagacaggaggugaucaacgagcuguucgugaccgaggccagccaccugagaacccugagagugcuggaccugaucuucuaccagagaaugaagaaggagaaccugaugcccagagaggagcuggccagacuguuccccaaccugcccgagcugaucgagauccacaacagcuggugcgaggccaugaagaagcugagagaggagggccccaucaucaaggagaucagcgaccugaugcuggccagauucgacggccccgccagagaggagcugcagcagguggccgcccaguucugcagcuaccagagcaucgcccuggagcugaucaagaccaagcagagaaaggagagcagauuccagcuguucaugcaggaggccgagagccacccccagugcagaagacugcagcugagagaccugaucaucagcgagaugcagagacugaccaaguacccccugcugcuggagagcaucaucaagcacaccgagggcggcaccagcgagcacgagaagcugugcagagccagagaccagugcagagagauccugaaguacgugaacgaggccgugaagcagaccgagaacagacacagacuggagggcuaccagaagagacuggacgccaccgcccuggagagagccagcaacccccuggccgccgaguucaagagccuggaccugaccaccagaaagaugauccacgagggcccccugaccuggagaaucagcaaggacaagacccuggaccugcacgugcugcugcuggaggaccugcuggugcugcugcagaagcaggacgagaagcugcugcugaagugccacagcaagaccgccgugggcagcagcgacagcaagcagaccuucagccccgugcugaagcugaacgccgugcugaucagaagcguggccaccgacaagagagccuucuucaucaucugcaccagcaagcugggccccccccagaucuacgagcugguggcccugaccagcagcgacaagaacaccuggauggagcugcuggaggaggccgugagaaacgccaccagacaccccggcgccgcccccaugcccgugcacccccccccccccggccccagagagcccgcccagcagggccccacccccagcagaguggagcuggacgacagcgacguguuccacggcgagcccgagcccgaggagcugcccggcggcaccggcagccagcagagagugcagggcaagcaccaggugcugcuggaggaccccgagcaggagggcagcgccgaggaggaggagcugggcgugcugcccugccccagcaccagccuggacggcgagaacagaggcaucagaaccagaaaccccauccaccuggccuuccccggcccccuguucauggagggccuggccgacagcgcccuggaggacguggagaaccugagacaccugauccuguggagccugcugcccggccacaccauggagacccaggccgcccaggagcccgaggacgaccugacccccacccccagcgugaucagcgugaccagccaccccugggaccccggcagccccggccaggccccccccggcggcgagggcgacaacacccagcuggccggccuggagggcgagagacccgagcaggaggacaugggccugugcagccuggagcaccugccccccagaaccagaaacagcggcaucugggagagccccgagcuggacagaaaccuggccgaggacgccagcagcaccgaggccgccggcggcuacaagguggugagaaaggccgagguggccggcagcaagguggugcccgcccugcccgagagcggccagagcgagcccggcccccccgagguggagggcggcaccaaggccaccggcaacugcuucuacgugagcaugcccagcggcccccccgacagcagcaccgaccacagcgaggcccccaugagccccccccagcccgacagccugcccgccggccagaccgagccccagccccagcugcagggcggcaacgacgaccccagaagacccagcagaagcccccccagccuggcccugagagacgugggcaugaucuuccacaccaucgagcagcugacccugaagcugaacagacugaaggacauggagcuggcccacagagagcugcugaagagccugggcggcgagagcagcggcggcaccacccccgugggcagcuuccacaccgaggccgccagauggaccgacggcagccugagcccccccgccaaggagccccuggccagcgacagcagaaacagccacgagcugggccccugccccgaggacggcagcgacgccccccuggaggacagcaccgccgacgccgccgccagccccggccccuaa

SEQ ID NO: 13791 - RNA, 4578 nt, Artificial Sequence
  ARHGEF12__Homo_sapiens__NP_001185594
augagcggcacccagagcaccaucaccgacagauucccccugaagaagcccaucagacacggcagcauccugaacagagagagccccaccgacaagaagcagaagguggagagaaucgccagccacgacuucgaccccaccggccuggugcagagaugcgugaucauccagaaggacgacaacggcuucggccugaccgugagcggcgacaaccccguguucgugcagagcgugaaggaggacggcgccgccaugagagccggcgugcagaccggcgacagaaucaucaaggugaacggcacccuggugacccacagcaaccaccuggagguggugaagcugaucaagagcggcagcuacguggcccugaccgugcagggcagaccccccggcagcccccagaucccccuggccgacagcgagguggagcccagcgugaucggccacaugagccccaucaugaccagcccccacagccccggcgccagcggcaacauggagagaaucaccagccccgugcugaugggcgaggagaacaacguggugcacaaccagaagguggagauccugagaaagaugcugcagaaggagcaggagagacugcagcugcugcaggaggacuacaacagaacccccgcccagagacugcugaaggagauccaggaggccaagaagcacaucccccagcugcaggagcagcugagcaaggccaccggcagcgcccaggacggcgccguggugacccccagcagaccccugggcgacacccugaccgugagcgaggccgagaccgaccccggcgacgugcugggcagaaccgacugcagcagcggcgacgccagcagacccagcagcgacaacgccgacagccccaagagcggccccaaggagagaaucuaccuggaggagaaccccgagaagagcgagaccauccaggacaccgacacccagagccuggugggcagccccagcaccagaaucgccccccacaucaucggcgccgaggacgacgacuucggcaccgagcacgagcagaucaacggccagugcagcugcuuccagagcaucgagcugcugaagagcagacccgcccaccuggccguguuccugcaccacguggugagccaguucgaccccgccacccugcugugcuaccuguacagcgaccuguacaagcacaccaacagcaaggagaccagaagaaucuuccuggaguuccaccaguucuuccuggacagaagcgcccaccugaaggugagcgugcccgacgagaugagcgccgaccuggagaagagaagacccgagcugauccccgaggaccugcacagacacuacauccagaccaugcaggagagagugcaccccgaggugcagagacaccuggaggacuucagacagaagagaagcaugggccugacccuggccgagagcgagcugaccaagcuggacgccgagagagacaaggacagacugacccuggagaaggagagaaccugcgccgagcagaucguggccaagaucgaggaggugcugaugaccgcccaggccguggaggaggacaagagcagcaccaugcaguacgugauccugauguacaugaagcaccugggcgugaaggugaaggagcccagaaaccuggagcacaagagaggcagaaucggcuuccugcccaagaucaagcagagcaugaagaaggacaaggagggcgaggagaagggcaagagaagaggcuuccccagcauccugggcccccccagaagacccagcagacacgacaacagcgccaucggcagagccauggagcugcagaaggccagacaccccaagcaccugagcacccccagcagcgugagccccgagccccaggacagcgccaagcugagacagagcggccuggccaacgagggcaccgacgccggcuaccugcccgccaacagcaugagcagcguggccagcggcgccagcuucagccaggagggcggcaaggagaacgacaccggcagcaagcaggugggcgagaccagcgcccccggcgacacccuggacggcacccccagaacccugaacaccguguucgacuuccccccccccccccuggaccaggugcaggaggaggagugcgagguggagagagugaccgagcacggcacccccaagcccuucagaaaguucgacagcguggccuucggcgagagccagagcgaggacgagcaguucgagaacgaccuggagaccgacccccccaacuggcagcagcuggugagcagagaggugcugcugggccugaagcccugcgagaucaagagacaggaggugaucaacgagcuguucuacaccgagagagcccacgugagaacccugaaggugcuggaccagguguucuaccagagagugagcagagagggcauccugagccccagcgagcugagaaagaucuucagcaaccuggaggacauccugcagcugcacaucggccugaacgagcagaugaaggccgugagaaagagaaacgagaccagcgugaucgaccagaucggcgaggaccugcugaccugguucagcggccccggcgaggagaagcugaagcacgccgccgccaccuucugcagcaaccagcccuucgcccuggagaugaucaagagcagacagaagaaggacagcagauuccagaccuucgugcaggacgccgagagcaacccccugugcagaagacugcagcugaaggacaucauccccacccagaugcagagacugaccaaguacccccugcugcuggacaacaucgccaaguacaccgaguggcccaccgagagagagaaggugaagaaggccgccgaccacugcagacagauccugaacuacgugaaccaggccgugaaggaggccgagaacaagcagagacuggaggacuaccagagaagacuggacaccagcagccugaagcugagcgaguaccccaacguggaggagcugagaaaccuggaccugaccaagagaaagaugauccacgagggcccccugguguggaaggugaacagagacaagaccaucgaccuguacacccugcugcuggaggacauccuggugcugcugcagaagcaggacgacagacuggugcugagaugccacagcaagauccuggccagcaccgccgacagcaagcacaccuucagccccgugaucaagcugagcaccgugcuggugagacagguggccaccgacaacaaggcccuguucgugaucagcaugagcgacaacggcgcccagaucuacgagcugguggcccagaccgugagcgagaagaccguguggcaggaccugaucugcagaauggccgccagcgugaaggagcagagcaccaagcccaucccccugccccagagcacccccggcgagggcgacaacgacgaggaggaccccagcaagcugaaggaggagcagcacggcaucagcgugaccggccugcagagccccgacagagaccugggccuggagagcacccugaucagcagcaagccccagagccacagccugagcaccagcggcaagagcgaggugagagaccuguucguggccgagagacaguucgccaaggagcagcacaccgacggcacccugaaggaggugggcgaggacuaccagaucgccauccccgacagccaccugcccgugagcgaggagagaugggcccuggacgcccugagaaaccugggccugcugaagcagcugcuggugcagcagcugggccugaccgagaagagcgugcaggaggacuggcagcacuuccccagauacagaaccgccagccagggcccccagaccgacagcgugauccagaacagcgagaacaucaaggccuaccacagcggcgagggccacaugcccuucagaaccggcaccggcgacaucgccaccugcuacagccccagaaccagcaccgagagcuucgcccccagagacagcgugggccuggccccccaggacagccaggccagcaacauccuggugauggaccacaugaucaugacccccgagaugcccaccauggagcccgagggcggccuggacgacagcggcgagcacuucuucgacgccagagaggcccacagcgacgagaaccccagcgagggcgacggcgccgugaacaaggaggagaaggacgugaaccugagaaucagcggcaacuaccugauccuggacggcuacgaccccgugcaggagagcagcaccgacgaggagguggccagcagccugacccugcagcccaugaccggcauccccgccguggagagcacccaccagcagcagcacagcccccagaacacccacagcgacggcgccaucagccccuucacccccgaguuccuggugcagcagagauggggcgccauggaguacagcugcuucgagauccagagccccagcagcugcgccgacagccagagccagaucauggaguacauccacaagaucgaggccgaccuggagcaccugaagaagguggaggagagcuacaccauccugugccagagacuggccggcagcgcccugaccgacaagcacagcgacaagagcuaa

SEQ ID NO: 13792 - RNA, 2526 nt, Artificial Sequence
  ARHGEF15__Homo_sapiens__NP_776089
augagcgcccagagccugcccgccgccaccccccccacccagaagccccccagaaucaucagacccagaccccccagcagaagcagagccgcccagagccccggccccccccacaacggcagcagcccccaggagcugcccagaaacagcaacgacgcccccacccccaugugcacccccaucuucugggagccccccgccgccagccugaagccccccgcccugcugccccccagcgccagcagagccagccuggacagccagaccagccccgacagccccagcagcacccccacccccagccccgugagcagaagaagcgccagccccgagcccgcccccagaagccccgugcccccccccaagcccagcggcagccccugcaccccccugcugcccauggccggcgugcuggcccagaacggcagcgccagcgcccccggcaccgugagaagacuggccggcagauucgagggcggcgccgagggcagagcccaggacgccgacgcccccgagcccggccugcaggccagagccgacgugaacggcgagagagaggccccccugaccggcagcggcagccaggagaacggcgcccccgacgccggccuggccugcccccccugcugccccugcgugugccacaccaccagacccggccuggagcugagaugggugcccgugggcggcuacgaggaggugcccagagugcccagaagagccagcccccugagaaccagcagaagcagaccccacccccccagcaucggccaccccgccguggugcugaccagcuacagaagcaccgccgagagaaagcugcugccccugcugaagccccccaagcccaccagagugagacaggacgccaccaucuucggcgaccccccccagcccgaccuggaccugcugagcgaggacggcauccagaccggcgacagccccgacgaggccccccagaacaccccccccgccaccguggagggcagagaggaggagggccuggaggugcugaaggagcagaacugggagcugccccugcaggacgagccccuguaccagaccuacagagccgccgugcugagcgaggagcuguggggcgugggcgaggacggcagccccagccccgccaacgccggcgacgcccccaccuuccccagaccccccggccccagaaacacccuguggcaggagcugcccgccgugcaggccagcggccugcuggacacccugagcccccaggagagaagaaugcaggagagccuguucgagguggugaccagcgaggccagcuaccugagaagccugagacugcugaccgacaccuucgugcugagccaggcccugagagacacccugacccccagagaccaccacacccuguucagcaacgugcagagagugcagggcgugagcgagagauuccuggccacccugcugagcagagugagaagcagcccccacaucagcgaccugugcgacguggugcacgcccacgccgugggccccuucagcguguacguggacuacgugagaaaccagcaguaccaggaggagaccuacagcagacugauggacaccaacgugagauucagcgccgagcugagaagacugcagagccugcccaagugcgagagacugccccugcccagcuuccugcugcugcccuuccagagaaucaccagacugagaaugcugcugcagaacauccugagacagaccgaggagggcagcagcagacaggagaacgcccagaaggcccugggcgccgugagcaagaucaucgagagaugcagcgccgaggugggcagaaugaagcagaccgaggagcugaucagacugacccagagacugagauuccacaaggugaaggcccugccccuggugagcuggagcagaagacuggaguuccagggcgagcugaccgagcugggcugcagaagaggcggcgugcuguucgccagcagacccagauucaccccccugugccugcugcuguucagcgaccugcugcugaucacccagcccaagagcggccagagacugcaggugcuggacuacgcccacagaagccuggugcaggcccagcaggugcccgaccccagcggcccccccaccuucagacugagccugcugagcaaccaccagggcagacccacccacagacugcugcaggccagcagccugagcgacaugcagagauggcugggcgccuuccccacccccggcccccugcccugcagccccgacaccaucuacgaggacugcgacugcagccaggagcugugcagcgagagcagcgcccccgccaagaccgagggcagaagccuggagagcagagccgcccccaagcaccugcacaagacccccgagggcuggcugaagggccugcccggcgccuuccccgcccagcuggugugcgaggugaccggcgagcacgagagaagaagacaccugagacagaaccagagacugcuggaggccgugggcagcagcagcggcacccccaacgcccccccccccuaa

SEQ ID NO: 13793 - RNA, 2295 nt, Artificial Sequence
  ARHGEF16__Homo_sapiens__XP_011539555
auggcccagagacacagcgacagcagccuggaggagaagcugcugggccacagauuccacagcgagcugagacuggacgccggcggcaaccccgccagcggccugcccauggugagaggcagccccagagugagagacgacgccgccuuccagccccaggugcccgcccccccccagcccagaccccccggccacgaggagcccuggcccaucgugcugagcaccgagagccccgccgcccugaagcugggcacccagcagcugauccccaagagccuggccguggccagcaaggccaagacccccgccagacaccagagcuucggcgccgccgugcugagcagagaggccgccagaagagaccccaagcugcugcccgcccccagcuucagccuggacgacauggacguggacaaggaccccggcggcaugcugagaagaaaccugagaaaccagagcuacagagccgccaugaagggccugggcaagcccggcggccagggcgacgccauccagcugagccccaagcugcaggcccuggccgaggagcccagccagccccacaccagaagccccgccaagaacaagaagacccugggcagaaagagaggccacaagggcagcuucaaggacgacccccagcuguaccaggagauccaggagagaggccugaacaccagccaggagagcgacgacgacauccuggacgagagcagcagccccgagggcacccagaagguggacgccaccaucguggugaagagcuacagacccgcccaggugaccuggagccagcugcccgaggugguggagcugggcauccuggaccagcugagcaccgaggagagaaagagacaggaggccauguucgagauccugaccagcgaguucagcuaccagcacagccugagcauccugguggaggaguuccugcagagcaaggagcugagagccaccgugacccagauggagcaccaccaccuguucagcaacauccuggacgugcugggcgccagccagagaugccugguggccggccccgagcuguggcugcagggccuggagguggagagacuggacaugcagcugcagcccugcaccggcgaggccuggcugcugagaggcuggcaggcccagagcggccccgugagcagaggcggcggcacccccgcccaccugcacgccggcuucuucgaggaccuggagcagagacacaaggcccaggugcugguggaggacaucagcgacauccuggaggagcacgccgagaagcacuuccaccccuacaucgccuacugcagcaacgagguguaccagcagagaacccugcagaagcugaucagcagcaacgccgccuucagagaggcccugagagagaucgagagaagacccgccugcggcggccugcccaugcugagcuuccugauccugcccaugcagagagugaccagacugccccugcugauggacacccugugccugaagacccagggccacagcgagagauacaaggccgccagcagagcccugaaggccaucagcaagcuggugagacagugcaacgagggcgcccacagaauggagagaauggagcagauguacacccugcacacccagcuggacuucagcaaggugaagagccugccccugaucagcgccagcagauggcugcugaagagaggcgagcuguuccugguggaggagaccggccuguucagaaagaucgccagcagacccaccugcuaccuguuccuguucaacgacgugcugguggugaccaagaagaagagcgaggagagcuacauggugcaggacuacgcccagaugaaccacauccagguggagaagaucgagcccagcgagcugccccugcccggcggcggcaacagaagcagcagcgugccccaccccuuccaggugacccugcugagaaacagcgagggcagacaggagcagcugcugcugagcagcgacagcgccagcgacagagccagauggaucguggcccugacccacagcgagagacaguggcagggccugagcagcaagggcgaccugccccagguggagaucaccaaggccuucuucgccaagcaggccgacgaggugacccugcagcaggccgacguggugcuggugcugcagcaggaggacggcuggcuguacggcgagagacugagagacggcgagaccggcugguuccccgaggacuucgccagauucaucaccagcagaguggccguggagggcaacgugagaagaauggagagacugagaguggagaccgacguguaa

SEQ ID NO: 13794 - RNA, 6192 nt, Artificial Sequence
  ARHGEF17__Homo_sapiens__NP_055601
auggccgacggcgcccccagaccccagcuguacagaagcgugagcuucaagcugcuggagagauggagcggcggccccggccugagagaggaggacaccgacacccccggccugagaagaagagccagcugcagacccaccaccgccgccagaggccagcccagcagaagagugagcaagcuggccagcggcccccuggccgcccccgcccagcccagaccccugagaagccugagccccagcgugagacagcugagcagaagauucgacgcccccagacuggacgacggcagcgccggcaccagagacggcggcgugcugcccgccgccgccgaggaggccgccgagggccccgccagaggcgccuggcccagcgugaccgagaugagaaagcuguucggcggccccggcagcagaagacccagcgccgacagcgagagccccggcacccccagccccgacggcgccgccugggagccccccgccagagagagcagacagccccccacccccccccccagaaccugcuucccccuggccggccugagaagcgccagaccccugaccggccccgagaccgagggcagacugagaagaccccagcagcagcaggagagagcccagagacccgccgacggccugcacagcuggcacaucuucagccagccccaggccggcgccagagccagcugcagcagcagcagcaucgccgccagcuaccccgugagcagaagcagagccgccagcagcagcgaggaggaggaggagggccccccccagcugcccggcgcccagagccccgccuaccacggcggccacagcagcggcagcgacgacgacagagacggcgagggcggccacagauggggcggcagacccggccugagacccggcagcagccugcuggaccaggacugcagacccgacagcgacggccugaaccugagcagcaugaacagcgccggcgugagcggcagccccgagccccccaccagccccagagcccccagagaggagggccugagagaguggggcagcggcagcccccccugcgugcccggcccccaggagggccugagacccaugagcgacagcgugggcggcgccuucagaguggccaaggugagcuuccccagcuaccuggccagccccgccggcagcagaggcagcagcagauacagcagcaccgagacccugaaggacgacgaccuguggagcagcagaggcagcggcggcuggggcguguacagaagccccagcuucggcgccggcgagggccugcugagaagccaggccagaaccagagccaagggccccggcggcaccagcagagcccugagagacggcggcuucgagcccgagaagagcagacagagaaagagccugagcaaccccgacaucgccagcgagacccugacccugcugagcuuccugagaagcgaccugagcgagcugagagugagaaagcccggcggcagcagcggcgacagaggcagcaacccccuggacggcagagacagccccagcgccggcggccccgugggccagcuggagcccauccccauccccgcccccgccagccccggcaccagacccacccugaaggaccugaccgccacccugagaagagccaagagcuucaccugcagcgagaagcccauggccagaagacugcccagaaccagcgcccugaagagcagcagcagcgagcugcugcugaccggccccggcgccgaggaggacccccugccccugaucgugcaggaccaguacgugcaggaggccagacagguguucgagaagauccagagaaugggcgcccagcaggacgacggcagcgacgccccccccggcagccccgacugggccggcgacgugaccagaggccagagaagccaggaggagcugagcggccccgagagcagccugaccgacgagggcaucggcgccgaccccgagccccccguggccgccuucugcggccugggcaccaccggcauguggagaccccugagcagcagcagcgcccagaccaaccaccacggccccggcaccgaggacagccugggcggcugggcccuggugagccccgagaccccccccacccccggcgcccugagaagaagaagaaaggugccccccagcggcagcggcggcagcgagcugagcaacggcgaggccggcgaggccuacagaagccugagcgaccccaucccccagagacacagagccgccaccagcgaggagcccaccggcuucagcguggacagcaaccugcugggcagccugagccccaagaccggccugcccgccaccagcgccauggacgagggccugaccagcggccacagcgacuggagcgugggcagcgaggagagcaagggcuaccaggaggugauccagagcaucgugcagggccccggcacccugggcagagugguggacgacagaaucgccggcaaggcccccaagaagaagagccugagcgaccccagcagaagaggcgagcuggccggccccggcuucgagggccccggcggcgagcccaucagagagguggagcccaugcugccccccagcagcagcgagcccauccugguggagcagagagccgagcccgaggagcccggcgccaccagaagcagagcccagagcgagagagcccugcccgaggcccugcccccccccgccaccgcccacagaaacuuccaccuggaccccaagcuggccgacauccugagccccagacugaucagaagaggcagcaagaagagacccgccagaagcagccaccaggagcugagaagagacgagggcagccaggaccagaccggcagccugagcagagccagacccagcagcagacacgugagacacgccagcgugcccgccaccuucaugcccaucguggugcccgagccccccaccagcgugggcccccccguggccgugcccgagcccaucggcuuccccaccagagcccaccccacccugcaggcccccagccuggaggacgugaccaagcaguacaugcugaaccugcacagcggcgaggugcccgcccccgugcccguggacaugcccugccugccccuggccgccccccccagcgccgaggccaagccccccgaggccgccagacccgccgacgagcccacccccgccagcaagugcugcagcaagccccagguggacaugagaaagcacguggccaugacccugcuggacaccgagcagagcuacguggagagccugagaacccugaugcagggcuacaugcagccccugaagcagcccgagaacagcgugcugugcgaccccagccugguggacgagaucuucgaccagauccccgagcugcuggagcaccacgagcaguuccuggagcaggugagacacugcaugcagaccuggcacgcccagcagaaggugggcgcccugcuggugcagagcuucagcaaggacgugcuggugaacaucuacagcgccuacaucgacaacuuccugaacgccaaggacgccgugagaguggccaaggaggccagacccgccuuccugaaguuccuggagcagagcaugagagagaacaaggagaagcaggcccugagcgaccugaugaucaagcccgugcagagaauccccagauacgagcugcuggugaaggaccugcugaagcacacccccgaggaccaccccgaccacccccugcugcuggaggcccagagaaacaucaagcagguggccgagagaaucaacaagggcgugagaagcgccgaggaggccgagagacacgccagagugcugcaggagaucgaggcccacaucgagggcauggaggaccugcaggccccccugagaagauuccugagacaggagauggugaucgaggugaaggccaucggcggcaagaaggacagaagccuguuccuguucaccgaccugaucgugugcaccacccugaagagaaagagcggcagccugagaagaagcagcaugagccuguacaccgccgccagcgugaucgacaccgccagcaaguacaagaugcuguggaagcugccccuggaggacgccgacaucaucaagggcgccagccaggccaccaacagagagaacauccagaaggccaucagcagacuggacgaggaccugaccacccugggccagaugagcaagcugagcgagagccugggcuucccccaccagagccuggacgacgcccugagagaccugagcgccgccaugcacagagaccugagcgagaagcaggcccugugcuacgcccugagcuucccccccaccaagcuggagcugugcgccaccagacccgagggcaccgacagcuacaucuucgaguucccccaccccgacgccagacugggcuucgagcaggccuucgacgaggccaagagaaagcuggccagcagcaagagcugccuggaccccgaguuccugaaggccauccccaucaugaagaccagaagcggcaugcaguucagcugcgccgcccccacccugaacagcugccccgagcccagccccgaggugugggugugcaacagcgacggcuacgugggccaggugugccugcugagccugagagccgagcccgacguggaggccugcaucgccgugugcagcgccagaauccugugcaucggcgccgugcccggccugcagcccagaugccacagagagcccccccccagccugagaagcccccccgagaccgcccccgagcccgccggccccgagcuggacguggaggccgccgccgacgaggaggccgccacccuggccgagcccggcccccagcccugccugcacaucagcaucgccggcagcggccuggagaugacccccggccugggcgagggcgaccccagacccgagcuggugcccuucgacagcgacagcgacgacgagagcagccccagccccagcggcacccugcagagccaggccagcagaagcaccaucagcagcagcuucggcaacgaggagacccccagcagcaaggaggccaccgccgagaccaccagcagcgaggaggagcaggagcccggcuuccugccccugagcggcagcuucggccccggcggccccugcggcaccagccccauggacggcagagcccugagaagaagcagccacggcagcuucaccagaggcagccuggaggaccugcugagcguggaccccgaggccuaccagagcagcguguggcugggcaccgaggacggcugcgugcacguguaccagagcagcgacagcaucagagacagaagaaacagcaugaagcugcagcacgccgccagcgugaccugcauccuguaccugaacaaccagguguucgugagccuggccaacggcgagcuggugguguaccagagagaggccggccacuucugggacccccagaacuucaagagcgugacccugggcacccagggcagccccaucaccaagauggugagcgugggcggcagacuguggugcggcugccagaacagagugcuggugcugagccccgacacccugcagcuggagcacauguucuacgugggccaggacagcagcagaugcguggccugcaugguggacagcagccugggcgugugggugacccugaagggcagcgcccacgugugccuguaccaccccgacaccuucgagcagcuggccgagguggacgugaccccccccgugcacagaaugcuggccggcagcgacgccaucaucagacagcacaaggccgccugccugagaaucaccgcccugcuggugugcgaggagcugcugugggugggcaccagcgccggcguggugcugaccaugcccaccagccccggcaccgugagcugccccagagccccccugagccccaccggccugggccagggccacaccggccacgugagauuccuggccgccgugcagcugcccgacggcuucaaccugcugugccccacccccccccccccccccgacaccggccccgagaagcugcccagccuggagcacagagacagccccuggcacagaggccccgcccccgccagacccaagaugcuggugaucagcggcggcgacggcuacgaggacuucagacugagcagcggcggcggcagcagcagcgagaccgugggcagagacgacagcaccaaccaccugcugcuguggagaguguaa

SEQ ID NO: 13795 - RNA, 2640 nt, Artificial Sequence
  ARHGEF1__Homo_sapiens__NP_945328
auggaggacuucgccagaggcgccgccagccccggccccagcagacccggccuggugcccgugagcaucaucggcgccgaggacgaggacuucgagaacgagcuggagaccaacagcgaggagcagaacagccaguuccagagccuggagcaggugaagagaagacccgcccaccugauggcccugcugcagcacguggcccugcaguucgagcccggcccccuggugcugagagugcccgugccccccaacguggccuucgagcuggacagaaccagagccgaccugaucagcgaggacgugcagagaagauucgugcaggagguggugcagagccagcagguggccgugggcagacagcuggaggacuucagaagcaagagacugaugggcaugacccccugggagcaggagcuggcccagcuggaggccugggugggcagagacagagccagcuacgaggccagagagagacacguggccgagagacugcugaugcaccuggaggagaugcagcacaccaucagcaccgacgaggagaagagcgccgccguggugaacgccaucggccuguacaugagacaccugggcgugagaaccaagagcggcgacaagaagagcggcagaaacuucuucagaaagaaggugaugggcaacagaagaagcgacgagcccgccaagaccaagaagggccugagcagcauccuggacgccgccagauggaacagaggcgagccccaggugcccgacuucagacaccugaaggccgagguggacgccgagaagcccggcgccaccgacagaaagggcggcgugggcaugcccagcagagacagaaacaucggcgcccccggccaggacacccccggcgugagccugcacccccugagccuggacagccccgacagagagcccggcgccgacgccccccuggagcugggcgacagcagcccccagggccccaugagccuggagagccuggccccccccgagagcaccgacgagggcgccgagaccgagagccccgagcccggcgacgagggcgagcccggcagaagcggccuggagcuggagcccgaggagccccccggcuggagagagcuggugccccccgacacccugcacagccugcccaagagccaggugaagagacaggaggugaucagcgagcugcuggugaccgaggccgcccacgugagaaugcugagagugcugcacgaccuguucuuccagcccauggccgagugccuguucuucccccuggaggagcugcagaacaucuuccccagccuggacgagcugaucgaggugcacagccuguuccuggacagacugaugaagagaagacaggagagcggcuaccugaucgaggagaucggcgacgugcugcuggccagauucgacggcgccgagggcagcugguuccagaagaucagcagcagauucugcagcagacagagcuucgcccuggagcagcugaaggccaagcagagaaaggaccccagauucugcgccuucgugcaggaggccgagagcagacccagaugcagaagacugcagcugaaggacaugauccccaccgagaugcagagacugaccaaguacccccugcugcugcagagcaucggccagaacaccgaggagcccaccgagagagagaagguggagcuggccgccgagugcugcagagagauccugcaccacgugaaccaggccgugagagacauggaggaccugcugagacugaaggacuaccagagaagacuggaccugagccaccugagacagagcagcgaccccaugcugagcgaguucaagaaccuggacaucaccaagaagaagcuggugcacgagggcccccugaccuggagagugaccaaggacaaggccguggaggugcacgugcugcugcuggacgaccugcugcugcugcugcagagacaggacgagagacugcugcugaagagccacagcagaacccugacccccacccccgacggcaagaccaugcugagacccgugcugagacugaccagcgccaugaccagagagguggccaccgaccacaaggccuucuacgugcuguucaccugggaccaggaggcccagaucuacgagcugguggcccagaccgugagcgagagaaagaacuggugcgcccugaucaccgagaccgccggcagccugaaggugcccgcccccgccagcagacccaagcccagacccagccccagcagcaccagagagccccugcugagcagcagcgagaacggcaacggcggcagagagaccagccccgccgacgccagaaccgagagaauccugagcgaccugcugcccuucugcagacccggccccgagggccagcuggccgccaccgcccugagaaaggugcugagccugaagcagcugcuguuccccgccgaggaggacaacggcgccggcccccccagagacggcgacggcgugcccggcggcggcccccugagccccgccagaacccaggagauccaggagaaccugcugagccuggaggagaccaugaagcagcuggaggagcuggaggaggaguucugcagacugagaccccugcugagccagcugggcggcaacagcgugccccagcccggcugcaccuaa

SEQ ID NO: 13796 - RNA, 1860 nt, Artificial Sequence
  ARHGEF25__Homo_sapiens__NP_001104740
augaagccccccgacagacccgcccccggcagaaccgacagaauccugggcgugaugggcggcaugcugagagccugcgcccugcccggccaggagggcccccccagaagaagcccccugggccuggugggcaccgagcccgagagcgagagaaccgagggcgaccacagaagagacagagagcacgaggugcuggccggcgcccugcagcccgagagcuacagcaucgccggcagcgagggcagcaucagcgccagcgccgccagcggccuggccgcccccagcggccccagcagcggccugagcagcggccccugcagccccggcccccccggccccgugagcggccugagaagauggcuggaccacagcaagcacugccugagcguggagaccgaggccgacagcggccaggccggccccuacgagaacuggaugcuggagcccgcccuggccaccggcgaggagcugcccgagcugacccugcugaccacccugcuggagggccccggcgacaagacccagccccccgaggaggagacccugagccaggcccccgagagcgaggaggagcagaagaagaaggcccuggagagaagcauguacgugcugagcgagcugguggagaccgagaagauguacguggacgaccugggccagaucguggagggcuacauggccaccauggccgcccagggcgugcccgagagccugagaggcagagacagaaucguguucggcaacauccagcagaucuacgaguggcacagagacuacuuccugcaggagcugcagagaugccugaaggaccccgacuggcuggcccagcuguucaucaagcacgagagaagacugcacauguacgugguguacugccagaacaagcccaagagcgagcacguggugagcgaguucggcgacagcuacuucgaggagcugagacagcagcugggccacagacugcagcugaacgaccugcugaucaagcccgugcagagaaucaugaaguaccagcugcugcugaaggacuuccugaaguacuacaacagagccggcauggacaccgccgaccuggagcaggccguggaggugaugugcuucgugcccaagagaugcaacgacaugaugacccugggcagacugagaggcuucgagggcaagcugaccgcccagggcaagcugcugggccaggacaccuucugggugaccgagcccgaggccggcggccugcugagcagcagaggcagagagagaagaguguuccuguucgagcagaucaucaucuucagcgaggcccugggcggcggcgugagaggcggcacccagcccggcuacguguacaagaacagcaucaaggugagcugccugggccuggagggcaaccugcagggcgaccccugcagauucgcccugaccagcagaggccccgagggcggcauccagagauacgugcugcaggccgccgaccccgccaucagccaggccuggaucaagcacguggcccagauccuggagagccagagagacuuccugaacgcccugcagagccccaucgaguaccagagaagagagagccagaccaacagccugggcagacccagaggccccggcgugggcagccccggcagaaucagacugggcgaccaggcccagggcagcacccacacccccaucaacggcagccugcccagccugcugcugagccccaagggcgagguggccagagcccugcugccccuggacaagcaggcccugggcgacaucccccaggccccccacgacagcccccccgugagccccacccccaagaccccccccugccaggccagacuggccaagcuggacgaggacgagcuguaa

SEQ ID NO: 13797 - RNA, 2376 nt, Artificial Sequence
  ARHGEF26__Homo_sapiens__NP_001238892
auggacggcgagagcgagguggacuucagcagcaacagcaucaccccccuguggagaagaagaagcaucccccagccccaccaggugcugggcagaagcaagcccagaccccagagcuaccagagccccaacggccugcugaucaccgacuuccccguggaggacggcggcacccugcuggccgcccagauccccgcccaggugcccaccgccagcgacagcagaaccgugcacagaagcccccugcugcugggcgcccagagaagagccguggccaacggcggcaccgccagccccgaguacagagccgccagccccagacugagaagacccaagagccccaagcugcccaaggccgugcccggcggcagccccaagagccccgccaacggcgccgugacccugcccgcccccccccccccccccgugcugagaccccccagaacccccaacgcccccgcccccugcacccccgaggaggaccugaccggccugaccgccagccccgugcccagccccaccgccaacggccuggccgccaacaacgacagccccggcagcggcagccagagcggcagaaaggccaaggaccccgagagaggccuguuccccggcccccagaagagcagcagcgagcagaagcugccccugcagagacugcccagccaggagaacgagcugcuggagaaccccagcguggugcugagcaccaacagccccgccgcccugaaggugggcaagcagcagaucauccccaagagccuggccagcgagaucaagaucagcaagagcaacaaccagaacguggagccccacaagagacugcugaaggugagaagcaugguggagggccugggcggcccccugggccacgccggcgaggagagcgagguggacaacgacguggacagccccggcagccugagaagaggccugagaagcaccagcuacagaagagccguggugagcggcuucgacuucgacagccccaccagcagcaagaagaagaacagaaugagccagcccgugcugaagguggugauggaggacaaggagaaguucagcagccugggcagaaucaagaagaagaugcugaagggccagggcaccuucgacggcgaggagaacgccgugcuguaccagaacuacaaggagaaggcccuggacaucgacagcgacgaggagagcgagcccaaggagcagaagagcgacgagaagaucgugauccaccacaagccccugagaagcaccuggagccagcugagcgccgugaagagaaagggccugagccagaccgugagccaggaggagagaaagagacaggaggccaucuucgaggugaucagcagcgagcacagcuaccugcugagccuggagauccugaucagaauguucaagaacagcaaggagcugagcgacaccaugaccaagaccgagagacaccaccuguucagcaacaucaccgacgugugcgaggccagcaagaaguucuucaucgagcuggaggccagacaccagaacaacaucuucaucgacgacaucagcgacaucguggagaagcacaccgccagcaccuucgaccccuacgugaaguacugcaccaacgagguguaccagcagagaacccugcagaagcugcuggccaccaaccccagcuucaaggaggugcugagcagaaucgagagccacgaggacugcagaaaccugcccaugaucagcuuccugauccugcccaugcagagagugaccagacugccccugcugauggacaccaucugccagaagacccccaaggacagccccaaguacgaggugugcaagagagcccugaaggaggugagcaagcuggugagacugugcaacgagggcgccagaaagauggagagaaccgagaugauguacaccaucaacagccagcuggaguucaagaucaagcccuucccccuggugagcagcagcagauggcuggugaagagaggcgagcugaccgccuacguggaggacaccgugcuguucagcagaagaaccagcaagcagcagguguacuucuuccuguucaacgacgugcugaucaucaccaagaagaagagcgaggagagcuacaacgugaacgacuacagccugagagaccagcugcugguggagagcugcgacaacgaggagcugaacagcagccccggcaagaacagcagcaccaugcuguacagcagacagagcagcgccagccaccuguucacccugaccgugcugagcaaccacgccaacgagaagguggagaugcugcugggcgccgagacccagagcgagagagccagauggaucaccgcccugggccacagcagcggcaagccccccgccgacagaaccugcggcuaa

SEQ ID NO: 13798 - RNA, 5196 nt, Artificial Sequence
  ARHGEF28__Homo_sapiens__NP_001073948
auggagcugagcugcagcgaggccccccuguacggccagaugaugaucuacgccaaguucgacaagaacguguaccugcccgaggacgccgaguucuacuucaccuacgacggcagccaccagagacacgugaugaucgccgagagaaucgaggacaacgugcugcagagcagcgugcccggccacggccugcaggagaccgugaccgugagcgugugccugugcagcgagggcuacagccccgugaccaugggcagcggcagcgugaccuacguggacaacauggccugcagacuggccagacugcuggugacccaggccaacagacugaccgccugcagccaccagacccugcugacccccuucgcccugaccgccggcgcccugcccgcccuggacgaggagcuggugcuggcccugacccaccuggagcugccccuggaguggaccgugcugggcagcagcagccuggaggugagcagccacagagagagccugcugcaccuggccaugagauggggccuggccaagcugagccaguucuuccugugccugcccggcggcgugcaggcccuggcccugcccaacgaggagggcgccaccccccuggaccuggcccugagagagggccacagcaagcugguggaggacgugaccaacuuccagggcagauggagccccagcuucagcagagugcagcugagcgaggaggccagccugcacuacauccacagcagcgagacccugacccugacccugaaccacaccgccgagcaccugcuggaggccgacaucaagcuguucagaaaguacuucugggacagagccuuccuggugaaggccuucgagcccgaggccagacccgaggagagaaccgccaugcccagcagcggcgccgagaccgaggaggagaucaagaacagcgugagcagcagaagcgccgccgagaaggaggacaucaagagagugaagagccugguggugcagcacaacgagcacgaggaccagcacagccuggaccuggacagaagcuucgacauccugaagaagagcaagccccccagcacccugcuggccgccggcagacugagcgacaugcugaacggcggcgacgagguguacgccaacugcauggugaucgaccaggugggcgaccuggacaucagcuacaucaacaucgagggcaucaccgccaccaccagccccgagagcagaggcugcacccuguggccccagagcagcaagcacacccugcccaccgagaccagccccagcguguacccccugagcgagaacguggagggcaccgcccacaccgaggcccagcagagcuucaugagccccagcagcagcugcgccagcaaccugaaccugagcuucggcuggcacggcuucgagaaggagcagagccaccugaagaagagaagcagcagccuggacgcccuggacgccgacagcgagggcgagggccacagcgagcccagccacaucugcuacacccccggcagccagagcagcagcagaaccggcauccccagcggcgacgagcuggacagcuucgagaccaacaccgagcccgacuucaacaucagcagagccgagagccugccccugagcagcaaccugcagagcaaggagagccugcugagcggcgugagaagcagaagcuacagcugcagcagccccaagaucagccugggcaagaccagacuggugagagagcugaccgugugcagcagcagcgaggagcagagagccuacagccugagcgagccccccagagagaacagaauccaggaggaggagugggacaaguacaucauccccgccaagagcgagagcgagaaguacaaggugagcagaaccuucagcuuccugaugaacagaaugaccagccccagaaacaagagcaagaccaagagcaaggacgccaaggacaaggagaagcugaacagacaccaguucgcccccggcaccuucagcggcgugcugcagugccuggugugcgacaagacccugcugggcaaggagagccugcagugcagcaacugcaacgccaacgugcacaagggcugcaaggacgccgcccccgccugcaccaagaaguuccaggagaaguacaacaagaacaagccccagaccauccugggcaacagcagcuucagagacaucccccagcccggccugagccugcaccccagcagcagcgugcccgugggccugcccaccggcagaagagagaccgugggccaggugcacccccugagcagaagcgugcccggcaccacccuggagagcuucagaagaagcgccaccagccuggagagcgagagcgaccacaacagcugcagaagcagaagccacagcgacgagcugcugcagagcaugggcagcagccccagcaccgagagcuucaucauggaggacgugguggacagcagccuguggagcgaccugagcagcgacgcccaggaguucgaggccgagagcuggagccuggugguggaccccagcuucugcaacagacaggagaaggacgugaucaagagacaggacgugaucuucgagcugaugcagaccgagaugcaccacauccagacccuguucaucaugagcgagaucuucagaaagggcaugaaggaggagcugcagcuggaccacagcaccguggacaagaucuuccccugccuggacgagcugcuggagauccacagacacuucuucuacagcaugaaggagagaagacaggagagcugcgccggcagcgacagaaacuucgugaucgacagaaucggcgacauccuggugcagcaguucagcgaggagaacgccagcaagaugaagaagaucuacggcgaguucugcugccaccacaaggaggccgugaaccuguucaaggagcugcagcagaacaagaaguuccagaacuucaucaagcugagaaacagcaaccugcuggccagaagaagaggcauccccgagugcauccugcuggugacccagagaaucaccaaguaccccgugcugguggagagaauccugcaguacaccaaggagagaaccgaggagcacaaggaccugagaaaggcccugugccugaucaaggacaugaucgccaccguggaccugaaggugaacgaguacgagaagaaccagaaguggcuggagauccugaacaagaucgagaacaagaccuacaccaagcugaagaacggccacguguucagaaagcaggcccugaugagcgaggagagaacccugcuguacgacggccugguguacuggaagaccgccaccggcagauucaaggacauccuggcccugcugcugaccgacgugcugcuguuccugcaggagaaggaccagaaguacaucuucgccgccguggaccagaagcccagcgugaucagccugcagaagcugaucgccagagagguggccaacgaggagagaggcauguuccugaucagcgccagcagcgccggccccgagauguacgagauccacaccaacagcaaggaggagagaaacaacuggaugagaagaauccagcaggccguggagagcugccccgaggagaagggcggcagaaccagcgagagcgacgaggacaagagaaaggccgaggccagaguggccaagauccagcagugccaggagauccugaccaaccaggaccagcagaucugcgccuaccuggaggagaagcugcacaucuacgccgagcugggcgagcugagcggcuucgaggacgugcaccuggagccccaccugcugaucaagcccgaccccggcgagcccccccaggccgccagccugcuggccgccgcccugaaggaggccgagagccugcagguggccgugaaggccagccagaugggcgccgugagccagagcugcgaggacagcugcggcgacagcgugcuggccgacacccugagcagccacgacgugcccggcagccccaccgccagccuggugaccggcggcagagagggcagaggcugcagcgacguggaccccggcauccagggcguggugaccgaccuggccgugagcgacgccggcgagaagguggagugcagaaacuuccccggcagcagccagagcgagaucauccaggccauccagaaccugaccagacugcuguacagccugcaggccgcccugaccauccaggacagccacaucgagauccacagacuggugcugcagcagcaggagggccugagccugggccacagcauccugagaggcggcccccugcaggaccagaagagcagagacgccgacagacagcacgaggagcuggccaacgugcaccagcugcagcaccagcugcagcaggagcagagaagauggcugagaagaugcgagcagcagcagagagcccaggccaccagagagagcuggcugcaggagagagagagagagugccagagccaggaggagcugcugcugagaagcagaggcgagcuggaccugcagcugcaggaguaccagcacagccuggagagacugagagagggccagagacugguggagagagagcaggccagaaugagagcccagcagagccugcugggccacuggaagcacggcagacagagaagccugcccgccgugcugcugcccggcggccccgaggugauggagcugaacagaagcgagagccugugccacgagaacagcuucuucaucaacgaggcccuggugcagaugagcuucaacaccuucaacaagcugaaccccagcgugauccaccaggacgccaccuaccccaccacccagagccacagcgaccuggugagaaccagcgagcaccagguggaccugaagguggaccccagccagcccagcaacgugagccacaagcuguggaccgccgccggcagcggccaccagauccugcccuuccacgagagcagcaaggacagcugcaagaacggcagcagcaugaccaagugcagcugcacccugaccagcccccccggccuguggaccggcaccaccagcacccugaaggaccuggacaccagccacaccgagagccccaccccccacgacagcaacagccacagaccccagcugcaggccuucaucaccgaggccaagcugaaccugcccaccagaaccaugaccagacaggacggcgagaccggcgacggcgccaaggagaacaucguguaccuguaa

SEQ ID NO: 13799 - RNA, 2961 nt, Artificial Sequence
  ARHGEF2__Homo_sapiens__NP_001155855
augagcagaaucgagagccugaccagagccagaaucgacagaagcagagagcuggccagcaagaccagagagaaggagaagaugaaggaggccaaggacgccagauacaccaacggccaccuguucaccaccaucagcgugagcggcaugaccaugugcuacgccugcaacaagagcaucaccgccaaggaggcccugaucugccccaccugcaacgugaccauccacaacagaugcaaggacacccuggccaacugcaccaaggugaagcagaagcagcagaaggccgcccugcugaagaacaacaccgcccugcagagcgugagccugagaagcaagaccaccaucagagagagacccagcagcgccaucuaccccagcgacagcuucagacagagccugcugggcagcagaagaggcagaagcagccugagccuggccaagagcgugagcaccaccaacaucgccggccacuucaacgacgagagcccccugggccugagaagaauccugagccagagcaccgacagccugaacaugagaaacagaacccugagcguggagagccugaucgacgaggccgaggugaucuacagcgagcugaugagcgacuucgagauggacgagaaggacuucgccgccgacagcuggagccuggccguggacagcagcuuccugcagcagcacaagaaggaggugaugaagcagcaggacgugaucuacgagcugauccagaccgagcugcaccacgugagaacccugaagaucaugaccagacuguucagaaccggcaugcuggaggagcugcaccuggagcccggcguggugcagggccuguuccccugcguggacgagcugagcgacauccacaccagauuccugagccagcugcuggagagaagaagacaggcccugugccccggcagcaccagaaacuucgugauccacagacugggcgaccugcugaucagccaguucagcggccccagcgccgagcagaugugcaagaccuacagcgaguucugcagcagacacagcaaggcccugaagcuguacaaggagcuguacgccagagacaagagauuccagcaguucaucagaaaggugaccagacccgccgugcugaagagacacggcgugcaggagugcauccugcuggugacccagagaaucaccaaguacccccugcugaucagcagaauccugcagcacagccacggcaucgaggaggagagacaggaccugaccaccgcccugggccuggugaaggagcugcugagcaacguggacgagggcaucuaccagcuggagaagggcgccagacugcaggagaucuacaacagaauggaccccagagcccagacccccgugcccggcaagggccccuucggcagagaggagcugcugagaagaaagcugauccacgacggcugccugcuguggaagaccgccaccggcagauucaaggacgugcuggugcugcugaugaccgacgugcugguguuccugcaggagaaggaccagaaguacaucuuccccacccuggacaagcccagcguggugagccugcagaaccugaucgugagagacaucgccaaccaggagaagggcauguuccugaucagcgccgccccccccgagauguacgaggugcacaccgccagcagagacgacagaagcaccuggaucagagugauccagcagagcgugagaaccugccccagcagagaggacuucccccugaucgagaccgaggacgaggccuaccugagaagaaucaagauggagcugcagcagaaggacagagcccugguggagcugcugagagagaaggugggccuguucgccgagaugacccacuuccaggccgaggaggacggcggcagcggcauggcccugcccacccugcccagaggccuguucagaagcgagagccuggagagccccagaggcgagagacugcugcaggacgccaucagagagguggagggccugaaggaccugcuggugggccccggcguggagcugcugcugacccccagagagcccgcccugccccuggagcccgacagcggcggcaacaccagccccggcgugaccgccaacggcgaggccagaaccuucaacggcagcaucgagcugugcagagccgacagcgacagcagccagagagacagaaacggcaaccagcugagaagcccccaggaggaggcccugcagagacuggugaaccuguacggccugcugcacggccugcaggccgccguggcccagcaggacacccugauggaggccagauuccccgagggccccgagagaagagagaagcugugcagagccaacagcagagacggcgaggccggcagagccggcgccgcccccguggcccccgagaagcaggccaccgagcuggcccugcugcagagacagcacgcccugcugcaggaggagcugagaagaugcagaagacugggcgaggagagagccaccgaggccggcagccuggaggccagacugagagagagcgagcaggccagagcccugcuggagagagaggccgaggaggccagaagacagcuggccgcccugggccagaccgagccccugcccgccgaggcccccugggccagaagacccguggaccccagaagaagaagccugcccgccggcgacgcccuguaccugagcuucaaccccccccagcccagcagaggcaccgacagacuggaccugcccgugaccaccagaagcgugcacagaaacuucgaggacagagagagacaggagcugggcagccccgaggagagacugcaggacagcagcgaccccgacaccggcagcgaggaggagggcagcagcagacugagccccccccacagccccagagacuucaccagaaugcaggacauccccgaggagaccgagagcagagacggcgaggccguggccagcgagagcuaa

SEQ ID NO: 13800 - RNA, 2334 nt, Artificial Sequence
  ARHGEF38__Homo_sapiens__NP_001229658
auggagcccaaggaggccaccggcaaggagaacauggugaccaagaagaagaaccuggccuuccugagaagcagacuguacaugcuggagagaagaaagaccgacaccgugguggagagcagcgugagcggcgaccacagcggcacccugagaagaagccagagcgacagaaccgaguacaaccagaagcugcaggagaagaugaccccccagggcgagugcagcguggccgagacccugacccccgaggaggagcaccacaugaagagaaugauggccaagagagagaagaucaucaaggagcugauccagaccgagaaggacuaccugaacgaccuggagcugugcgugagagagguggugcagccccugagaaacaagaagaccgacagacuggacguggacagccuguucagcaacaucgagagcgugcaccagaucagcgccaagcugcugagccugcuggaggaggccaccaccgacguggagcccgccaugcaggugaucggcgagguguuccugcagaucaagggcccccuggaggacaucuacaagaucuacugcuaccaccacgacgaggcccacagcauccuggagagcuacgagaaggaggaggagcugaaggagcaccugagccacugcauccagagccugaagaagaucuacaugcaggagggcaagcccaaccugcuggacaugggcagccugaugaucaagcccauccagagagugaugaaguacccccugcugcugugcgagcugagaaacagcaccccccccagccaccccgacuacagagcccuggacgacgccuucgccgccgugaaggacaucaacgugaacaucaacgagcugaagagaagaaaggaccuggugcugaaguacaagaagaacgacgaggacgagagccugaaggacaagcugagcaagcugaacauccacagcaucagcaagaagagcaagagagugaccaaccaccugaagauccugaccagaggcgagagccaggugaaggacaacaccuucaacagagaggagaagcuguucagagcccuggagaagaccgugagacugugcgugaagaacaucagccugugccugcagcacauccaggacgccaugccccuggcccugcagagcgugauggaccugcaggagaucagcuacaacaaggacgacgagauggacuacagcgagacccugagcaacgcccugaacagcugccacgacuucgccagccaccugcagagacugauccugaccccccugagcgcccugcugagccuguuccccggcccccacaagcugauccagaagagauacgacaagcugcuggacugcaacagcuaccugcagagaagcaccggcgaggagagcgaccuggccaagaaggaguacgaggcccugaacgcccagcugguggaggagcugcaggccuucaaccaggccgccagaaagauccugcugaacugccugugcagcuucaucacccugcugagagaccugaugcugguggcccagcaggccuacagcacccuggugcccaugccccugcuggugagcagcaucagcgagauccagaaccaggugcuggaggagauccagaaccugaacugcgugaaggagaacagcgccaccuucaucgagagaaagcugagcuucgagaagaagaagcccgugcagauccugcccgagaugccccaccagaccgacauccacagaagcaagcugcugagcaccuacagcgccgaggagcuguaccaggccaagagaaagugcaacgccacccaggaguacgacaucaaccugcuggagggcgaccugguggccgugaucgagcagaaggacccccugggcagcaccagcagauggcugguggacaccggcaacgugaagggcuacguguacagcagcuuccugaagcccuacaaccccgccaagaugcagaagguggacgccgagaacagauucugcgacgacgacuucgagaacaucagccuguucgugagcagcagacccgccagcgacagcgugaccggcaccagcgagagcagcaucggcgacagcagcagcagccugagcggcaccugcggcaaguucgagaccaacggcaccgacguggacagcuuccaggagguggacgagcagaucuucuacgccgugcacgccuuccaggccagaagcgaccacgagcugagccugcaggaguaccagagagugcacauccugagauucugcgaccugagcggcaacaaggagugguggcuggccgaggcccagggccagaagggcuacgugcccgccaacuaccugggcaagaugaccuacgccuaa

SEQ ID NO: 13801 - RNA, 1677 nt, Artificial Sequence
  ARHGEF3__Homo_sapiens__NP_001122087
auggacagcagcaccgccaugaaccagugcagcugcagaggcauggaggagaacaaggagagacccaagagacagagacagaacaacuuccccauguuccccagccccaaggccuggaacuucagaggcagaaagagaaagcagagcacccaggacgaggacgccgugagccugugcagccuggacaucagcgagcccagcaacaagagagugaagccccugagcagagugaccagccuggccaaccugaucccccccgugaaggccaccccccugaagagauucagccagacccugcagagaagcaucagcuucagaagcgagagcagacccgacauccuggcccccagacccuggagcagaaacgccgcccccagcagcaccaagagaagagacagcaagcuguggagcgagaccuucgacgugugcgugaaccagaugcugaccagcaaggagaucaagagacaggaggccaucuucgagcugagccagggcgaggaggaccugaucgaggaccugaagcuggccaagaaggccuaccacgaccccaugcugaagcugagcaucaugaccgagcaggagcugaaccagaucuucggcacccuggacagccugaucccccugcacgaggagcugcugagccagcugagagacgugagaaagcccgacggcagcaccgagcacgugggccccauccuggugggcuggcugcccugccugagcagcuacgacagcuacugcagcaaccagguggccgccaaggcccugcuggaccacaagaagcaggaccacagagugcaggacuuccugcagagaugccuggagagccccuucagcagaaagcuggaccuguggaacuuccuggacauccccagaagcagacuggugaaguacccccugcugcugagagagauccugagacacacccccaacgacaaccccgaccagcagcaccuggaggaggccaucaacaucauccagggcaucguggccgagaucaacaccaagaccggcgagagcgagugcagauacuacaaggagagacugcuguaccuggaggagggccagaaggacagccugaucgacagcagcagagugcugugcugccacggcgagcugaagaacaacagaggcgugaagcugcacguguuccuguuccaggaggugcuggugaucaccagagccgugacccacaacgagcagcugugcuaccagcuguacagacagcccauccccgugaaggaccugcugcuggaggaccugcaggacggcgaggugagacugggcggcagccugagaggcgccuucagcaacaacgagagaaucaagaacuucuucagagugagcuucaagaacggcagccagagccagacccacagccugcaggccaacgacaccuucaacaagcagcaguggcugaacugcaucagacaggccaaggagaccgugcugugcgccgccggccaggccggcgugcuggacagcgagggcagcuuccugaaccccaccaccggcagcagagagcugcagggcgagaccaagcuggagcagauggaccagagcgacagcgagagcgacugcagcauggacaccagcgaggugagccuggacugcgagagaauggagcagaccgacagcagcugcggcaacagcagacacggcgagagcaacguguaa

SEQ ID NO: 13802 - RNA, 2073 nt, Artificial Sequence
  ARHGEF4__Homo_sapiens__NP_056135
augcccugggaggagcccgccggcgagaagcccagcugcagccacagccagaaggccuuccacauggagcccgcccagaagcccugcuucaccaccgacauggugaccugggcccugcugugcaucagcgccgagaccgugagaggcgaggcccccagccagcccagaggcaucccccacagaagccccgugagcguggacgaccuguggcuggagaagacccagagaaagaagcugcagaagcaggcccacguggagagaagacugcacaucggcgccgugcacaaggacggcgugaagugcuggagaaagaccaucaucaccagccccgagagccugaaccugcccagaagaagccacccccugagccagagcgcccccaccggccugaaccacaugggcuggcccgagcacacccccggcaccgccaugcccgacggcgcccuggacaccgccgugugcgccgacgaggugggcagcgaggaggaccuguacgacgaccugcacagcagcagccaccacuacagccaccccggcggcggcggcgagcagcuggccaucaacgagcugaucagcgacggcagcguggugugcgccgaggcccugugggaccacgugaccauggacgaccaggagcugggcuucaaggccggcgacgugaucgaggugauggacgccaccaacagagaguggugguggggcagaguggccgacggcgagggcugguuccccgccagcuucgugagacugagagugaaccaggacgagcccgccgacgacgacgccccccuggccggcaacagcggcgccgaggacggcggcgccgaggcccagagcagcaaggaccagaugagaaccaacgugaucaacgagauccugagcaccgagagagacuacaucaagcaccugagagacaucugcgagggcuacgugagacagugcagaaagagagccgacauguucagcgaggagcagcugagaaccaucuucggcaacaucgaggacaucuacagaugccagaaggccuucgugaaggcccuggagcagagauucaacagagagagaccccaccugagcgagcugggcgccugcuuccuggagcaccaggccgacuuccagaucuacagcgaguacugcaacaaccaccccaacgccugcguggagcugagcagacugaccaagcugagcaaguacguguacuucuucgaggccugcagacugcugcagaagaugaucgacaucagccuggacggcuuccugcugacccccgugcagaagaucugcaaguacccccugcagcuggccgagcugcugaaguacacccacccccagcacagagacuucaaggacguggaggccgcccugcacgccaugaagaacguggcccagcugaucaacgagagaaagagaagacuggagaacaucgacaagaucgcccaguggcagagcagcaucgaggacugggagggcgaggaccugcuggugagaagcagcgagcugaucuacagcggcgagcugaccagagugacccagccccaggccaagagccagcagagaauguucuuccuguucgaccaccagcugaucuacugcaagaaggaccugcugagaagagacgugcuguacuacaagggcagacuggacauggacggccuggaggugguggaccuggaggacggcaaggacagagaccugcacgugagcaucaagaacgccuucagacugcacagaggcgccaccggcgacagccaccugcugugcaccagaaagcccgagcagaagcagagauggcugaaggccuucgccagagagagagagcaggugcagcuggaccaggagaccggcuucagcaucaccgagcugcagagaaagcaggccaugcugaacgccagcaagcagcaggugaccggcaagcccaaggccgugggcagacccugcuaccugaccagacagaagcaccccgcccugcccagcaacagaccccagcagcaggugcuggugcuggccgagcccagaagaaagcccagcaccuucuggcacagcaucagcagacuggcccccuucagaaaguaa

SEQ ID NO: 13803 - RNA, 4794 nt, Artificial Sequence
  ARHGEF5__Homo_sapiens__NP_005426
auggaggccgaggaggcccagagaggcgccagcccccccaucagcgccaucgaggaguucagcaucauccccgaggcccccaugagaagcagccaggugagcgcccugggccuggaggcccaggaggacgaggaccccagcuacaaguggagagaggagcacagacugagcgccacccagcagagcgagcugagagacgugugcgacuacgccaucgagaccaugcccagcuuccccaaggagggcagcgccgacguggagcccaaccaggagagccugguggccgaggccugcgacacccccgagcacugggaggccgugccccagagccuggccggcagacaggccagaacccuggccccccccgagcugugggccugccccauccagagcgagcaccuggacauggcccccuucagcagcgaccugggcagcgaggaggaggagguggaguucuggcccggccugaccagccugacccugggcagcggccaggccgaggaggaggaggagaccagcagcgacaacagcggccagaccagauacuacagccccugcgaggagcaccccgccgagaccaaccagaacgagggcagcgagagcggcaccaucagacagggcgaggagcugccccccgaggagcugcaggagagccagggccugcugcacccccaggaggugcaggugcuggaggagcagggccagcaggaggccggcuucagaggcgagggcacccugagagaggacgugugcgccgacggccugcugggcgaggagcagaugaucgagcaggugaacgacgagaagggcgagcagaagcagaagcaggagcaggugcaggacgugaugcugggcagacagggcgagagaaugggccugaccggcgagcccgagggccugaacgacggcgagugggagcaggaggacauggagagaaaggcccagggccagggcggccccgagcagggcgaggagagaaagagagagcugcaggugcccgaggagaacagagccgacagccaggacgagaagagccagaccuuccugggcaagagcgaggaggugaccggcaagcaggaggaccacggcaucaaggagaagggcgugcccgugagcggccaggaggccaaggagcccgagagcugggacggcggcagacugggcgccgugggcagagccagaagcagagaggaggagaacgagcaccacggccccagcaugcccgcccugaucgcccccgaggacagcccccacugcgaccuguuccccggcgccagcuaccugaugacccagauccccggcacccagaccgagagcagagccgaggagcugagccccgccgcccugagccccagccuggagcccaucagaugcagccaccagcccaucagccugcugggcagcuuccugaccgaggagagccccgacaaggagaucgaccagaacagccagcaggaggagagcagacugagaaagggcaccgugagcagccagggcaccgaggugguguucgccagcgccagcgugaccccccccagaacccccgacagcgccccccccagccccgccgaggccuaccccaucacccccgccagcgugagcgccagaccccccguggccuuccccagaagagagaccagcugcgccgccagagcccccgagaccgccagcgccccccugagcauggacgaccccagccccugcggcaccagcgagaugugccccgccgcccuguacggcuuccccagcaccggcaccagcccccccagaccccccgccaacagcaccggcaccgugcagcaccugagaagcgacagcuuccccggcagccacagaaccgagcagacccccgaccuggugggcaugcugcugagcuacagccacagcgagcugccccagagaccccccaagcccgccaucuacagcagcgugacccccagaagagacagaagaagcggcagagacuacagcaccgugagcgccagccccaccgcccugagcacccugaagcaggacagccaggagagcaucagcaaccuggagagacccagcagcccccccagcauccagcccugggugagcccccacaaccccgccuucgccaccgagagccccgccuacggcagcagccccagcuucgugagcauggaggacgugagaauccacgagccccugccccccccccccccccagagaagagacacccaccccagcgugguggagaccgacggccacgccagagugguggugcccacccugaagcagcacagccacccccccccccuggcccugggcagcggccugcacgccccccacaagggcccccugccccaggccagcgaccccgccguggccagacagcacagaccccugcccagcacccccgacagcagccaccacgcccaggccacccccagauggagauacaacaagccccugccccccacccccgaccugccccagccccaccugccccccaucagcgcccccggcagcagcagaaucuacagaccccugcccccccugcccaucaucgacccccccaccgagccccccccccugccccccaagagcagaggcagaagcagaagcaccagaggcggccacaugaacagcggcggccacgccaagaccagacccgccugccaggacuggaccgugccccugcccgccagcgccggcagaaccagcuggccccccgccaccgccagaagcaccgagagcuucaccagcaccagcagaagcaagagcgaggugagccccggcauggccuucagcaacaugaccaacuuccugugccccagcagccccaccacccccuggacccccgagcugcagggccccaccagcaaggacgaggccggcgugagcgagcaccccgaggcccccgccagagagccccugagaagaaccaccccccagcagggcgccagcggccccggcagaagccccgugggccaggccagacagcccgagaagcccagccaccugcaccuggagaaggccagcagcuggccccacagaagagacagcggcagaccccccggcgacagcagcggccaggccguggcccccagcgagggcgccaacaagcacaagggcuggagcagacagggccugagaagacccagcauccugcccgagggcagcagcgacagcagaggccccgccguggagaagcaccccggccccagcgacaccgugguguucagagagaagaagcccaaggaggugaugggcggcuucagcagaagaugcagcaagcugaucaacagcagccagcugcuguaccaggaguacagcgacguggugcugaacaaggagauccagagccagcagagacuggagagccugagcgagacccccggccccagcagccccagacagcccagaaaggcccuggugagcagcgagagcuaccugcagagacugagcauggccagcagcggcagccuguggcaggagauccccguggugagaaacagcaccgugcugcugagcaugacccacgaggaccagaagcugcaggaggugaaguucgagcugaucgugagcgaggccagcuaccugagaagccugaacaucgccguggaccacuuccagcugagcaccagccugagagccacccugagcaaccaggagcaccaguggcuguucagcagacugcaggacgugagagacgugagcgccaccuuccugagcgaccuggaggagaacuucgagaacaacaucuucagcuuccaggugugcgacguggugcugaaccacgcccccgacuucagaagaguguaccugcccuacgugaccaaccagaccuaccaggagagaaccuuccagagccugaugaacagcaacagcaacuucagagaggugcuggagaagcuggagagcgaccccgugugccagagacugagccugaagagcuuccugauccugcccuuccagagaaucaccagacugaagcugcugcugcagaacauccugaagagaacccagcccggcagcagcgaggaggccgaggccaccaaggcccaccacgcccuggagcagcugaucagagacugcaacaacaacgugcagagcaugagaagaaccgaggagcugaucuaccugagccagaagaucgaguucgagugcaagaucuucccccugaucagccagagcagauggcuggugaagagcggcgagcugaccgcccuggaguucagcgccagccccggccugagaagaaagcugaacaccagacccgugcaccugcaccuguucaacgacugccugcugcugagcagacccagagagggcagcagauuccugguguucgaccacgcccccuucagcagcaucagaggcgagaagugcgagaugaagcugcacggcccccacaagaaccuguucagacuguuccugagacagaacacccagggcgcccaggccgaguuccuguucagaaccgagacccagagcgagaagcugagauggaucagcgcccuggccaugcccagagaggagcuggaccugcuggagugcuacaacagcccccaggugcagugccugagagccuacaagcccagagagaacgacgagcuggcccuggagaaggccgacguggugauggugacccagcagagcagcgacggcuggcuggagggcgugagacugagcgacggcgagagaggcugguuccccgugcagcagguggaguucaucagcaaccccgaggugagagcccagaaccugaaggaggcccacagagugaagaccgccaagcugcagcugguggagcagcaggccuaa

SEQ ID NO: 13804 - RNA, 2331 nt, Artificial Sequence
  ARHGEF6__Homo_sapiens__NP_004831
augaaccccgaggagcagaucgugaccuggcugaucagccugggcgugcuggagagccccaagaagaccaucugcgaccccgaggaguuccugaagagcagccugaagaacggcguggugcugugcaagcugaucaacagacugaugcccggcagcguggagaaguucugccuggacccccagaccgaggccgacugcaucaacaacaucaacgacuuccugaagggcugcgccacccugcagguggagaucuucgaccccgacgaccuguacagcggcgugaacuucagcaaggugcugagcacccugcuggccgugaacaaggccaccgaggaccagcugagcgagagacccugcggcagaagcagcagccugagcgccgccaacaccagccagaccaacccccagggcgccgugagcagcaccgugagcggccugcagagacagagcaagaccguggagaugaccgagaacggcagccaccagcugaucgugaaggccagauucaacuucaagcagaccaacgaggacgagcugagcgugugcaagggcgacaucaucuacgugaccagaguggaggagggcggcuggugggagggcacccugaacggcagaaccggcugguuccccagcaacuacgugagagagaucaagagcagcgagagaccccugagccccaaggccgugaagggcuucgagaccgccccccugaccaagaacuacuacaccguggugcugcagaacauccuggacaccgagaaggaguacgccaaggagcugcagagccugcuggugaccuaccugagaccccugcagagcaacaacaaccugagcaccguggaggugaccagccugcugggcaacuucgaggaggugugcaccuuccagcagacccugugccaggcccuggaggagugcagcaaguuccccgagaaccagcacaaggugggcggcugccugcugagccugaugccccacuucaagagcauguaccuggccuacugcgccaaccaccccagcgccgugaacgugcugacccagcacagcgacgagcuggagcaguucauggagaaccagggcgccagcagccccggcauccugauccugaccaccaaccugagcaagcccuucaugagacuggagaaguacgugacccugcugcaggagcuggagagacacauggaggacacccaccccgaccaccaggacauccugaaggccaucguggccuucaagacccugaugggccagugccaggaccugagaaagagaaagcagcuggagcugcagauccugagcgagcccauccaggccugggagggcgaggacaucaagaaccugggcaacgugaucuucaugagccaggugauggugcaguacggcgccugcgaggagaaggaggagagauaccugaugcuguucagcaacgugcugaucaugcugagcgccagccccagaaugagcggcuucaucuaccagggcaagauccccaucgccggcaccguggugaccagacuggacgagaucgagggcaacgacugcaccuucgagaucaccggcaacaccguggagagaaucguggugcacugcaacaacaaccaggacuuccaggaguggcuggagcagcugaacagacugaucagaggccccgccagcugcagcagccugagcaagaccagcagcagcagcugcagcgcccacagcagcuucagcagcaccggccagcccagaggcccccuggagcccccccagaucaucaagcccuggagccugagcugccugagacccgcccccccccugagacccagcgccgcccugggcuacaaggagagaaugagcuacauccugaaggagagcagcaagagccccaagaccaugaagaaguuccugcacaagagaaagaccgagagaaagcccagcgaggaggaguacgugaucagaaagagcaccgccgcccuggaggaggacgcccagauccugaaggugaucgaggccuacugcaccagcgccaacuuccagcagggccacggcagcagcaccagaaaggacagcaucccccaggugcugcugcccgaggaggagaagcugaucaucgaggagaccagaagcaacggccagaccaucauggaggagaagagccugguggacaccguguacgcccugaaggacgaggugagagagcugaagcaggagaacaagagaaugaagcagugccuggaggaggagcugaagagcagaagagaccuggagaagcuggugagaagacugcugaagcagaccgacgagugcaucagaggcgagagcagcagcaagaccagcauccugcccuaa

SEQ ID NO: 13805 - RNA, 2412 nt, Artificial Sequence
  ARHGEF7__Homo_sapiens__NP_001106983
augaacagcgccgagcagaccgugaccuggcugaucacccugggcgugcuggagagccccaagaagaccaucagcgaccccgagggcuuccugcaggccagccugaaggacggcguggugcugugcagacugcuggagagacugcugcccggcaccaucgagaagguguaccccgagcccagaagcgagagcgagugccugagcaacaucagagaguuccugagaggcugcggcgccagccugagacuggagcugcuguucccccccagccagcccccccagcaccuggugaccaccauccugcugagcgccagcaccuucgacgccaacgaccuguaccagggccagaacuucaacaaggugcugagcagccuggugacccugaacaaggugaccgccgacaucggccugggcagcgacagcgugugcgccagacccagcagccacagaaucaagagcuucgacagccugggcagccagagccugcacaccagaaccagcaagcuguuccagggccaguacagaagccuggacaugaccgacaacagcaacaaccagcugguggugagagccaaguucaacuuccagcagaccaacgaggacgagcugagcuucagcaagggcgacgugauccacgugaccagaguggaggagggcggcuggugggagggcacccugaacggcagaaccggcugguuccccagcaacuacgugagagaggugaaggccagcgagaagcccgugagccccaagagcggcacccugaagagcccccccaagggcuucgacaccaccgccaucaacaagagcuacuacaacguggugcugcagaacauccuggagaccgagaacgaguacagcaaggagcugcagaccgugcugagcaccuaccugagaccccugcagaccagcgagaagcugagcagcgccaacaucagcuaccugaugggcaaccuggaggagaucugcagcuuccagcagaugcuggugcagagccuggaggagugcaccaagcugcccgaggcccagcagagagugggcggcugcuuccugaaccugaugccccagaugaagacccuguaccugaccuacugcgccaaccaccccagcgccgugaacgugcugaccgagcacagcgaggagcugggcgaguucauggagaccaagggcgccagcagccccggcauccuggugcugaccaccggccugagcaagcccuucaugagacuggacaaguaccccacccugcugaaggagcuggagagacacauggaggacuaccacaccgacagacaggacauccagaagagcauggccgccuucaagaaccugagcgcccagugccaggaggugagaaagagaaaggagcuggagcugcagauccugaccgaggccaucagaaacugggagggcgacgacaucaagacccugggcaacgugaccuacaugagccaggugcugauccagugcgccggcagcgaggagaagaacgagagauaccugcugcuguuccccaacgugcugcugaugcugagcgccagccccagaaugagcggcuucaucuaccagggcaagcugcccaccaccggcaugaccaucaccaagcuggaggacagcgagaaccacagaaacgccuucgagaucagcggcagcaugaucgagagaauccuggugagcugcaacaaccagcaggaccugcaggaguggguggagcaccugcagaagcagaccaaggugaccagcgugggcaaccccaccaucaagccccacagcgugcccagccacacccugcccagccaccccgugacccccagcagcaagcacgccgacagcaagcccgccccccugacccccgccuaccacacccugccccaccccagccaccacggcaccccccacaccaccaucaacuggggcccccuggagccccccaagacccccaagcccuggagccugagcugccugagacccgcccccccccugagacccagcgccgcccugugcuacaaggaggaccugagcaagagccccaagaccaugaagaagcugcugcccaagagaaagcccgagagaaagcccagcgacgaggaguucgccagcagaaagagcaccgccgcccuggaggaggacgcccagauccugaaggugaucgaggccuacugcaccagcgccaagaccagacagacccugaacagcaccuggcagggcaccgaccugaugcacaaccacgugcuggccgacgacgaccagcccagccuggacagccugggcagaagaagcagccugagcagacuggagcccagcgaccugagcgaggacagcgacuacgacagcaucuggaccgcccacagcuacagaaugggcagcaccagcagaaagagcugcugcagcuacaucagccaccagaacuaa

SEQ ID NO: 13806 - RNA, 1392 nt, Artificial Sequence
  ARHGEF9__Homo_sapiens__NP_001166950
augcaguggaucagaggcggcagcggcaugcugugggugaaccaggaggacgagguggaggagggccccagcgacgugcagaacggccaccuggaccccaacagcgacugccugugccugggcagaccccugcagaacagagaccagaugagagccaacgugaucaacgagaucaugagcaccgagagacacuacaucaagcaccugaaggacaucugcgagggcuaccugaagcagugcagaaagagaagagacauguucagcgacgagcagcugaaggugaucuucggcaacaucgaggacaucuacagauuccagaugggcuucgugagagaccuggagaagcaguacaacaacgacgacccccaccugagcgagaucggccccugcuuccuggagcaccaggacggcuucuggaucuacagcgaguacugcaacaaccaccuggacgccugcauggagcugagcaagcugaugaaggacagcagauaccagcacuucuucgaggccugcagacugcugcagcagaugaucgacaucgccaucgacggcuuccugcugacccccgugcagaagaucugcaaguacccccugcagcuggccgagcugcugaaguacaccgcccaggaccacagcgacuacagauacguggccgccgcccuggccgugaugagaaacgugacccagcagaucaacgagagaaagagaagacuggagaacaucgacaagaucgcccaguggcaggccagcgugcuggacugggagggcgaggacauccuggacagaagcagcgagcugaucuacaccggcgagauggccuggaucuaccagcccuacggcagaaaccagcagagaguguucuuccuguucgaccaccagauggugcugugcaagaaggaccugaucagaagagacauccuguacuacaagggcagaaucgacauggacaaguacgaggugguggacaucgaggacggcagagacgacgacuucaacgugagcaugaagaacgccuucaagcugcacaacaaggagaccgaggagauccaccuguucuucgccaagaagcuggaggagaagaucagauggcugagagccuucagagaggagagaaagauggugcaggaggacgagaagaucggcuucgagaucagcgagaaccagaagagacaggccgccaugaccgugagaaaggugcccaagcagaagggcgugaacagcgccagaagcgugccccccagcuacccccccccccaggacccccugaaccacggccaguaccuggugcccgacggcaucgcccagagccagguguucgaguucaccgagcccaagagaagccagagccccuucuggcagaacuucagcagacugacccccuucaagaaguaa

SEQ ID NO: 13807 - RNA, 2763 nt, Artificial Sequence
  AR__Homo_sapiens__NP_000035
auggaggugcagcugggccugggcagaguguaccccagaccccccagcaagaccuacagaggcgccuuccagaaccuguuccagagcgugagagaggugauccagaaccccggccccagacaccccgaggccgccagcgccgccccccccggcgccagccugcugcugcugcagcagcagcagcagcagcagcagcagcagcagcagcagcagcagcagcagcagcagcagcagcagcaggagaccagccccagacagcagcagcagcagcagggcgaggacggcagcccccaggcccacagaagaggccccaccggcuaccuggugcuggacgaggagcagcagcccagccagccccagagcgcccuggagugccaccccgagagaggcugcgugcccgagcccggcgccgccguggccgccagcaagggccugccccagcagcugcccgccccccccgacgaggacgacagcgccgcccccagcacccugagccugcugggccccaccuuccccggccugagcagcugcagcgccgaccugaaggacauccugagcgaggccagcaccaugcagcugcugcagcagcagcagcaggaggccgugagcgagggcagcagcagcggcagagccagagaggccagcggcgcccccaccagcagcaaggacaacuaccugggcggcaccagcaccaucagcgacaacgccaaggagcugugcaaggccgugagcgugagcaugggccugggcguggaggcccuggagcaccugagccccggcgagcagcugagaggcgacugcauguacgccccccugcugggcgugccccccgccgugagacccacccccugcgccccccuggccgagugcaagggcagccugcuggacgacagcgccggcaagagcaccgaggacaccgccgaguacagccccuucaagggcggcuacaccaagggccuggagggcgagagccugggcugcagcggcagcgccgccgccggcagcagcggcacccuggagcugcccagcacccugagccuguacaagagcggcgcccuggacgaggccgccgccuaccagagcagagacuacuacaacuucccccuggcccuggccggccccccccccccccccccccccccccacccccacgccagaaucaagcuggagaacccccuggacuacggcagcgccugggccgccgccgccgcccagugcagauacggcgaccuggccagccugcacggcgccggcgccgccggccccggcagcggcagccccagcgccgccgccagcagcagcuggcacacccuguucaccgccgaggagggccagcuguacggccccugcggcggcggcggcggcggcggcggcggcggcggcggcggcggcggcggcggcggcggcggcggcggcggcgaggccggcgccguggcccccuacggcuacaccagacccccccagggccuggccggccaggagagcgacuucaccgcccccgacgugugguaccccggcggcauggugagcagagugcccuaccccagccccaccugcgugaagagcgagaugggccccuggauggacagcuacagcggccccuacggcgacaugagacuggagaccgccagagaccacgugcugcccaucgacuacuacuuccccccccagaagaccugccugaucugcggcgacgaggccagcggcugccacuacggcgcccugaccugcggcagcugcaagguguucuucaagagagccgccgagggcaagcagaaguaccugugcgccagcagaaacgacugcaccaucgacaaguucagaagaaagaacugccccagcugcagacugagaaagugcuacgaggccggcaugacccugggcgccagaaagcugaagaagcugggcaaccugaagcugcaggaggagggcgaggccagcagcaccaccagccccaccgaggagaccacccagaagcugaccgugagccacaucgagggcuacgagugccagcccaucuuccugaacgugcuggaggccaucgagcccggcguggugugcgccggccacgacaacaaccagcccgacagcuucgccgcccugcugagcagccugaacgagcugggcgagagacagcuggugcacguggugaagugggccaaggcccugcccggcuucagaaaccugcacguggacgaccagauggccgugauccaguacagcuggaugggccugaugguguucgccaugggcuggagaagcuucaccaacgugaacagcagaaugcuguacuucgcccccgaccugguguucaacgaguacagaaugcacaagagcagaauguacagccagugcgugagaaugagacaccugagccaggaguucggcuggcugcagaucaccccccaggaguuccugugcaugaaggcccugcugcuguucagcaucauccccguggacggccugaagaaccagaaguucuucgacgagcugagaaugaacuacaucaaggagcuggacagaaucaucgccugcaagagaaagaaccccaccagcugcagcagaagauucuaccagcugaccaagcugcuggacagcgugcagcccaucgccagagagcugcaccaguucaccuucgaccugcugaucaagagccacauggugagcguggacuuccccgagaugauggccgagaucaucagcgugcaggugcccaagauccugagcggcaaggugaagcccaucuacuuccacacccaguaa

SEQ ID NO: 13808 - RNA, 6711 nt, Artificial Sequence
  ARID1B__Homo_sapiens__NP_059989
auggcccacaacgccggcgccgccgccgccgccggcacccacagcgccaagagcggcggcagcgaggccgcccugaaggagggcggcagcgccgccgcccugagcagcagcagcagcagcagcgccgccgccgccgccgccagcagcagcagcagcagcggccccggcagcgccauggagaccggccugcugcccaaccacaagcugaagaccgugggcgaggcccccgccgcccccccccaccagcagcaccaccaccaccaccacgcccaccaccaccaccaccacgcccaccaccugcaccaccaccacgcccugcagcagcagcugaaccaguuccagcagcagcagcagcagcagcagcagcagcagcagcagcagcagcagcagcagcaccccaucagcaacaacaacagccugggcggcgccggcggcggcgccccccagcccggccccgacauggagcagccccagcacggcggcgccaaggacagcgccgccggcggccaggccgacccccccggccccccccugcugagcaagcccggcgacgaggacgacgccccccccaagaugggcgagcccgccggcggcagauacgagcaccccggccugggcgcccugggcacccagcagccccccguggccgugcccggcggcggcggcggccccgccgccgugcccgaguucaacaacuacuacggcagcgccgcccccgccagcggcggccccggcggcagagccggccccugcuucgaccagcacggcggccagcagagccccggcaugggcaugaugcacagcgccagcgccgccgccgccggcgcccccggcagcauggacccccugcagaacagccacgagggcuaccccaacagccagugcaaccacuaccccggcuacagcagacccggcgccggcggcggcggcggcggcggcggcggcggcggcggcggcagcggcggcggcggcggcggcggcggcgccggcgccggcggcgccggcgccggcgccguggccgccgccgccgccgccgccgccgccgccgccggcggcggcggcggcggcggcuacggcggcagcagcgccggcuacggcgugcugagcagccccagacagcagggcggcggcaugaugaugggccccggcggcggcggcgccgccagccugagcaaggccgccgccggcagcgccgccggcggcuuccagagauucgccggccagaaccagcaccccagcggcgccacccccacccugaaccagcugcugaccagccccagccccaugaugagaagcuacggcggcagcuaccccgaguacagcagccccagcgcccccccccccccccccagccagccccagagccaggccgccgccgccggcgccgccgccggcggccagcaggccgccgccggcaugggccugggcaaggacaugggcgcccaguacgccgccgccagccccgccugggccgccgcccagcagagaagccaccccgccaugagccccggcacccccggccccaccaugggcagaagccagggcagccccauggaccccauggugaugaagagaccccagcuguacggcaugggcagcaacccccacagccagccccagcagagcagccccuaccccggcggcagcuacggcccccccggcccccagagauaccccaucggcauccagggcagaacccccggcgccauggccggcaugcaguacccccagcagcagaugcccccccaguacggccagcagggcgugagcggcuacugccagcagggccagcagcccuacuacagccagcagccccagcccccccaccugcccccccaggcccaguaccugcccagccagagccagcagagauaccagccccagcaggacaugagccaggagggcuacggcaccagaagccagcccccccuggcccccggcaagcccaaccacgaggaccugaaccugauccagcaggagagacccagcagccugcccgaccugagcggcagcaucgacgaccugcccaccggcaccgaggccacccugagcagcgccgugagcgccagcggcagcaccagcagccagggcgaccagagcaaccccgcccagagccccuucagcccccacgccagcccccaccugagcagcauccccggcggccccagccccagccccgugggcagccccgugggcagcaaccagagcagaagcggccccaucagccccgccagcauccccggcagccagaugcccccccagccccccggcagccagagcgagagcagcagccaccccgcccugagccagagccccaugccccaggagagaggcuucauggccggcacccagagaaacccccagauggcccaguacggcccccagcagaccggccccagcaugagcccccaccccagccccggcggccagaugcacgccggcaucagcagcuuccagcagagcaacagcagcggcaccuacggcccccagaugagccaguacggcccccagggcaacuacagcagaccccccgccuacagcggcgugcccagcgccagcuacagcggccccggccccggcaugggcaucagcgccaacaaccagaugcacggccagggccccagccagcccugcggcgccgugccccugggcagaaugcccagcgccggcaugcagaacagacccuuccccggcaacaugagcagcaugacccccagcagccccggcaugagccagcagggcggccccggcaugggcccccccaugcccaccgugaacagaaaggcccaggaggccgccgccgccgugaugcaggccgccgccaacagcgcccagagcagacagggcagcuuccccggcaugaaccagagcggccugauggccagcagcagccccuacagccagcccaugaacaacagcagcagccugaugaacacccaggccccccccuacagcauggcccccgccauggugaacagcagcgccgccagcgugggccuggccgacaugaugagccccggcgagagcaagcugccccugccccugaaggccgacggcaaggaggagggcaccccccagcccgagagcaagagcaagaagagcagcagcagcaccaccaccggcgagaagaucaccaagguguacgagcugggcaacgagcccgagagaaagcuguggguggacagauaccugaccuucauggaggagagaggcagccccgugagcagccugcccgccgugggcaagaagccccuggaccuguucagacuguacgugugcgugaaggagaucggcggccuggcccaggugaacaagaacaagaaguggagagagcuggccaccaaccugaacgugggcaccagcagcagcgccgccagcagccugaagaagcaguacauccaguaccuguucgccuucgagugcaagaucgagagaggcgaggagcccccccccgagguguucagcaccggcgacaccaagaagcagcccaagcugcagccccccagccccgccaacagcggcagccugcagggcccccagaccccccagagcaccggcagcaacagcauggccgaggugcccggcgaccugaagccccccacccccgccagcaccccccacggccagaugacccccaugcagggcggcagaagcagcaccaucagcgugcacgaccccuucagcgacgugagcgacagcagcuuccccaagagaaacagcaugacccccaacgcccccuaccagcagggcaugagcaugcccgacgugaugggcagaaugcccuacgagcccaacaaggaccccuucggcggcaugagaaaggugcccggcagcagcgagcccuucaugacccagggccagaugcccaacagcagcaugcaggacauguacaaccagagccccagcggcgccaugagcaaccugggcaugggccagagacagcaguuccccuacggcgccagcuacgacagaagacacgagcccuacggccagcaguaccccggccagggcccccccagcggccagccccccuacggcggccaccagcccggccuguacccccagcagcccaacuacaagagacacauggacggcauguacggcccccccgccaagagacacgagggcgacauguacaacaugcaguacagcagccagcagcaggagauguacaaccaguacggcggcagcuacagcggccccgacagaagacccauccagggccaguaccccuaccccuacagcagagagagaaugcagggccccggccagauccagacccacggcauccccccccagaugaugggcggcccccugcagagcagcagcagcgagggcccccagcagaacaugugggccgccagaaacgacaugcccuaccccuaccagaacagacagggccccggcggccccacccaggccccccccuaccccggcaugaacagaaccgacgacaugauggugcccgaccagagaaucaaccacgagagccaguggcccagccacgugagccagagacagcccuacaugagcagcagcgccagcaugcagcccaucaccagacccccccagcccagcuaccagaccccccccagccugcccaaccacaucagcagagcccccagccccgccagcuuccagagaagccuggagaacagaaugagccccagcaagagccccuuccugcccagcaugaagaugcagaaggugaugcccaccgugcccaccagccaggugaccggcccccccccccagcccccccccaucagaagagagaucaccuucccccccggcagcguggaggccagccagcccgugcugaagcagagaagaaagaucaccagcaaggacaucgugacccccgaggccuggagagugaugaugagccugaagagcggccugcuggccgagagcaccugggcccuggacaccaucaacauccugcuguacgacgacagcaccguggccaccuucaaccugagccagcugagcggcuuccuggagcugcugguggaguacuucagaaagugccugaucgacaucuucggcauccugauggaguacgaggugggcgaccccagccagaaggcccuggaccacaacgccgccagaaaggacgacagccagagccuggccgacgacagcggcaaggaggaggaggacgccgagugcaucgacgacgacgaggaggacgaggaggacgaggaggaggacagcgagaagaccgagagcgacgagaagagcagcaucgcccugaccgcccccgacgccgccgccgaccccaaggagaagcccaagcaggccagcaaguucgacaagcugcccaucaagaucgugaagaagaacaaccuguucgugguggacagaagcgacaagcugggcagagugcaggaguucaacagcggccugcugcacuggcagcugggcggcggcgacaccaccgagcacauccagacccacuucgagagcaagauggagaucccccccagaagaagacccccccccccccugagcagcgccggcagaaagaaggagcaggagggcaagggcgacagcgaggagcagcaggagaagagcaucaucgccaccaucgacgacgugcugagcgccagacccggcgcccugcccgaggacgccaaccccggcccccagaccgagagcagcaaguuccccuucggcauccagcaggccaagagccacagaaacaucaagcugcuggaggacgagcccagaagcagagacgagaccccccugugcaccaucgcccacuggcaggacagccuggccaagagaugcaucugcgugagcaacaucgugagaagccugagcuucgugcccggcaacgacgccgagaugagcaagcaccccggccuggugcugauccugggcaagcugauccugcugcaccacgagcaccccgagagaaagagagccccccagaccuacgagaaggaggaggacgaggacaagggcguggccugcagcaaggacgagugguggugggacugccuggaggugcugagagacaacacccuggugacccuggccaacaucagcggccagcuggaccugagcgccuacaccgagagcaucugccugcccauccuggacggccugcugcacuggauggugugccccagcgccgaggcccaggaccccuuccccaccgugggccccaacagcgugcugagcccccagagacuggugcuggagacccugugcaagcugagcauccaggacaacaacguggaccugauccuggccaccccccccuucagcagacaggagaaguucuacgccacccuggugagauacgugggcgacagaaagaaccccgugugcagagagaugagcauggcccugcugagcaaccuggcccagggcgacgcccuggccgccagagccaucgccgugcagaagggcagcaucggcaaccugaucagcuuccuggaggacggcgugaccauggcccaguaccagcagagccagcacaaccugaugcacaugcagccccccccccuggagccccccagcguggacaugaugugcagagccgccaaggcccugcuggccauggccagaguggacgagaacagaagcgaguuccugcugcacgagggcagacugcuggacaucagcaucagcgccgugcugaacagccugguggccagcgugaucugcgacgugcuguuccagaucggccagcuguaa

SEQ ID NO: 13809 - RNA, 5508 nt, Artificial Sequence
  ARID2__Homo_sapiens__NP_689854
auggccaacagcaccggcaaggccccccccgacgagagaagaaagggccuggccuuccuggacgagcugagacaguuccaccacagcagaggcagccccuucaagaagauccccgccgugggcggcaaggagcuggaccugcacggccuguacaccagagugaccacccugggcggcuucgccaaggugagcgagaagaaccaguggggcgagaucguggaggaguucaacuuccccagaagcugcagcaacgccgccuucgcccugaagcaguacuaccugagauaccuggagaaguacgagaaggugcaccacuucggcgaggacgacgacgaggugccccccggcaaccccaagccccagcugcccaucggcgccauccccagcagcuacaacuaccagcagcacagcgugagcgacuaccugagacagagcuacggccugagcauggacuucaacagccccaacgacuacaacaagcuggugcugagccugcugagcggccugcccaacgagguggacuucgccaucaacgugugcacccugcugagcaacgagagcaagcacgugaugcagcuggagaaggaccccaagaucaucacccugcugcuggccaacgccggcguguucgacgacacccugggcagcuucagcaccguguucggcgaggaguggaaggagaagaccgacagagacuucgugaaguucuggaaggacaucguggacgacaacgaggugagagaccugaucagcgacagaaacaagagccacgagggcaccagcggcgaguggaucugggagagccuguuccacccccccagaaagcugggcaucaacgacaucgagggccagagagugcugcagaucgccgugauccugagaaaccugagcuucgaggagggcaacgugaagcugcuggccgccaacagaaccugccugagauuccugcugcugagcgcccacagccacuucaucagccugagacagcugggccuggacacccugggcaacaucgccgccgagcugcugcuggaccccguggacuucaagaccacccaccugauguuccacaccgugaccaagugccugaugagcagagacagauuccugaagaugagaggcauggagauccugggcaaccugugcaaggccgaggacaacggcgugcugaucugcgaguacguggaccaggacagcuacagagagaucaucugccaccugacccugcccgacgugcugcuggugaucagcacccuggaggugcuguacaugcugaccgagaugggcgacguggccugcaccaagaucgccaagguggagaagagcaucgacaugcuggugugccuggugagcauggacauccagauguucggccccgacgcccuggccgccgugaagcugaucgagcaccccagcagcagccaccagaugcugagcgagaucagaccccaggccaucgagcaggugcagacccagacccacguggccagcgcccccgccagcagagccgugguggcccagcacguggcccccccccccggcaucguggagaucgacagcgagaaguucgccugccaguggcugaacgcccacuucgaggugaaccccgacugcagcgugagcagagccgagauguacagcgaguaccugagcaccugcagcaagcuggccagaggcggcauccugaccagcaccggcuucuacaagugccugagaaccguguuccccaaccacaccgugaagagaguggaggacagcagcagcaacggccaggcccacauccacguggugggcgugaagagaagagccaucccccugcccauccagauguacuaccagcagcagcccgugagcaccagcguggugagaguggacagcgugcccgacgugagccccgcccccagccccgccggcaucccccacggcagccagaccaucggcaaccacuuccagagaacccccguggccaaccagagcagcaaccugaccgccacccagaugagcuuccccgugcagggcgugcacaccguggcccagaccgugagcagaaucccccagaaccccagcccccacacccaccagcagcagaacgcccccgugaccgugauccagagcaaggcccccauccccugcgagguggugaaggccaccgugauccagaacagcaucccccagaccggcgugcccgugagcaucgccgugggcggcggccccccccagagcagcguggugcagaaccacagcaccggcccccagcccgugaccguggugaacagccagacccugcugcaccaccccagcgugaucccccagcagagcccccugcacaccguggugcccggccagauccccagcggcacccccgugaccgugauccagcaggccgugccccagagccacauguucggcagagugcagaacauccccgccugcaccagcaccgugagccagggccagcagcugaucaccaccagcccccagcccgugcagaccagcagccagcagaccagcgccggcagccagagccaggacaccgugaucaucgcccccccccaguacgugaccaccagcgccagcaacaucgugagcgccaccagcgugcagaacuuccagguggccaccggccagauggugaccaucgccggcgugcccagcccccaggccagcagagugggcuuccagaacaucgcccccaagccccugcccagccagcaggugagcagcaccguggugcagcagcccauccagcagccccagcagcccacccagcagagcguggugaucgugagccagcccgcccagcagggccagaccuacgcccccgccauccaccagaucgugcuggccaaccccgccgcccugcccgccggccagaccgugcagcugaccggccagcccaacaucacccccagcagcagccccagccccgugcccgccaccaacaaccaggugcccaccgccaugagcagcagcagcaccccccagagccagggccccccccccaccgugagccagaugcugagcgugaagagacagcagcagcagcagcacagccccgccccccccccccagcaggugcaggugcaggugcagcagccccagcaggugcagaugcaggugcagccccagcagagcaacgccggcgugggccagcccgccagcggcgagagcagccugaucaagcagcugcugcugcccaagagaggccccagcacccccggcggcaagcugauccugcccgccccccagauccccccccccaacaacgccagagcccccagcccccaggugguguaccagguggccagcaaccaggccgccggcuucggcgugcagggccagacccccgcccagcagcugcuggugggccagcagaacgugcagcuggugcccagcgccaugccccccagcggcggcgugcagaccgugcccaucagcaaccugcagauccugcccggcccccugaucagcaacagccccgccaccaucuuccagggcaccagcggcaaccaggugaccaucaccguggugcccaacaccagcuucgcccccgccaccgugagccagggcaacgccacccagcugaucgcccccgccggcaucaccaugagcggcacccagaccggcgugggccugcccgugcagacccugcccgccacccaggccagccccgccggccagagcagcugcaccaccgccaccccccccuucaagggcgacaagaucaucugccagaaggaggaggaggccaaggaggccaccggccugcacgugcacgagagaaagaucgaggugauggagaaccccagcugcagaagaggcgccaccaacaccagcaacggcgacaccaaggagaacgagaugcacgugggcagccugcugaacggcagaaaguacagcgacagcagccugccccccagcaacagcggcaagauccagagcgagaccaaccagugcagccugaucagcaacggccccagccuggagcugggcgagaacggcgccagcggcaagcagaacagcgagcagaucgacaugcaggacaucaagagcgaccugagaaagccccuggugaacggcaucugcgacuucgacaagggcgacggcagccaccugagcaagaacauccccaaccacaagaccagcaaccacgugggcaacggcgagaucagccccauggagccccagggcacccuggacaucacccagcaggacaccgccaagggcgaccagcuggagagaaucagcaacggccccgugcugacccugggcggcagcagcgugagcagcauccaggaggccagcaacgccgccacccagcaguucagcggcaccgaccugcugaacggcccccuggccagcagccugaacagcgacgugccccagcagagacccagcgugguggugagcccccacagcaccaccagcgugauccagggccaccagaucaucgccgugcccgacagcggcagcaaggugagccacagccccgcccugagcagcgacgugagaagcaccaacggcaccgccgagugcaagaccgugaagagacccgccgaggacaccgacagagagaccguggccggcauccccaacaaggugggcgugagaaucgugaccaucagcgaccccaacaacgccggcugcagcgccaccaugguggccgugcccgccggcgccgaccccagcaccguggccaagguggccaucgagagcgccgugcagcagaagcagcagcacccccccaccuacgugcagaacguggugccccagaacacccccaugccccccagccccgccgugcaggugcagggccagcccaacagcagccagcccagccccuucagcggcagcagccagcccggcgaccccaugagaaagcccggccagaacuucaugugccuguggcagagcugcaagaagugguuccagacccccagccagguguucuaccacgccgccaccgagcacggcggcaaggacguguaccccggccagugccugugggagggcugcgagcccuuccagagacagagauucagcuucaucacccaccugcaggacaagcacugcagcaaggacgcccugcuggccggccugaagcaggacgagcccggccaggccggcagccagaagagcagcaccaagcagcccaccgugggcggcaccagcagcacccccagagcccagaaggccaucgugaaccaccccagcgccgcccugauggcccugagaagaggcagcagaaaccugguguucagagacuucaccgacgagaaggagggccccaucaccaagcacaucagacugaccgccgcccugauccugaagaacaucggcaaguacagcgagugcggcagaagacugcugaagagacacgagaacaaccugagcgugcuggccaucagcaacauggaggccagcagcacccuggccaagugccuguacgagcugaacuucaccgugcagagcaaggagcaggagaaggacagcgagaugcugcaguaa

SEQ ID NO: 13810 - RNA, 1782 nt, Artificial Sequence
  ARID3A__Homo_sapiens__NP_005215
augaagcugcaggccgugauggagacccugcugcagagacagcagagagccagacaggagcuggaggccagacagcagcugccccccgacccccccgccgccccccccggcagagccagagccgcccccgacgaggacagagagcccgagagcgccagaaugcagagagcccagauggccgcccuggccgccaugagagccgccgccgccggccugggccaccccgccagccccggcggcagcgaggacggcccccccggcagcgaggaggaggacgccgccagagagggcacccccggcagccccggcagaggcagagagggccccggcgaggagcacuucgaggacauggccagcgacgaggacaugaagcccaagugggaggaggaggagauggaggaggaccugggcgaggacgaggaggaggaggaggaggacuacgaggacgaggaggaggaggaggacgaggagggccugggcccccccggccccgccagccugggcaccaccgcccuguuccccagaaaggcccagcccccccaggccuucagaggcgacggcgugcccagagugcugggcggccaggagagacccggccccggccccgcccaccccggcggcgccgcccacguggccccccagcugcagccccccgaccacggcgacuggaccuacgaggagcaguucaagcagcuguacgagcuggacggcgaccccaagagaaaggaguuccuggacgaccuguucagcuucaugcagaagagaggcacccccgugaacagaauccccaucauggccaagcaggugcuggaccuguucaugcuguacgugcuggugaccgagaagggcggccugguggaggugaucaacaagaagcuguggagagagaucaccaagggccugaaccugcccaccagcaucaccagcgccgccuucacccugagaacccaguacaugaaguaccuguaccccuacgagugcgagaagagaggccugagcaaccccaacgagcugcaggccgccaucgacagcaacagaagagagggcagaagacagagcuucggcggcagccuguucgccuacagccccggcggcgcccacggcaugcugagcagccccaagcugcccgugagcagccugggccuggccgccagcaccaacggcagcagcaucacccccgcccccaagaucaagaaggaggaggacagcgccauccccaucaccgugcccggcagacugcccgugagccuggccggccaccccgugguggccgcccaggccgccgccgugcaggccgccgccgcccaggccgccguggccgcccaggccgccgcccuggagcagcugagagagaagcuggagagcgccgagccccccgagaagaagauggcccugguggccgacgagcagcagagacugaugcagagagcccugcagcagaacuuccuggccauggccgcccagcugcccaugagcaucagaaucaacagccaggccagcgagagcagacaggacagcgccgugaaccugaccggcaccaacggcagcaacagcaucagcaugagcguggagaucaacggcaucauguacaccggcgugcuguucgcccagccccccgcccccacccccaccagcgcccccaacaagggcggcggcggcggcggcggcagcagcagcaacgccggcggcagaggcggcaacaccggcaccagcggcggccaggccggccccgccggccugagcacccccagcaccagcaccagcaacaacagccugcccuaa

SEQ ID NO: 13811 - RNA, 1683 nt, Artificial Sequence
  ARID3B__Homo_sapiens__NP_006456
auggagccccugcagcagcagcagcagcagcagcagcagcagcagaagcagccccaccuggccccccugcagauggacgccagagagaagcagggccagcagaugagagaggcccaguuccuguacgcccagaagcuggugacccagcccacccugcugagcgccaccgccggcagacccagcggcagcaccccccugggcccccuggccagagugccccccaccgccgccguggcccagguguucgagagaggcaacaugaacagcgagcccgaggaggaggacggcggccuggaggacgaggacggcgacgacgagguggccgagguggccgagaaggagacccaggccgccagcaaguacuuccacgugcagaagguggccagacaggaccccagaguggcccccaugagcaaccugcugcccgcccccggccugcccccccacggccagcaggccaaggaggaccacaccaaggacgccagcaaggccagccccagcgugagcaccgccggccagcccaacuggaaccuggacgagcagcugaagcagaacggcggccuggccuggagcgacgacgccgacggcggcagaggcagagagaucagcagagacuucgccaagcuguacgagcuggacggcgaccccgagagaaaggaguuccuggacgaccuguucguguucaugcagaagagaggcacccccaucaacagaauccccaucauggccaagcagauccuggaccuguacaugcuguacaagcuggugaccgagaagggcggccugguggagaucaucaacaagaagaucuggagagagaucaccaagggccugaaccugcccaccagcaucaccagcgccgccuucacccugagaacccaguacaugaaguaccuguacgccuacgagugcgagaagaaggcccugagcagccccgccgagcugcaggccgccaucgacggcaacagaagagagggcagaagacccagcuacagcagcagccuguucggcuacagccccgccgccgccaccgccgccgccgccgccggcgcccccgcccugcugagcccccccaagaucagauuccccauccugggccugggcagcagcagcggcaccaacaccagcagccccagaaucagccccgccaccacccugagaaagggcgacggcgcccccgugaccaccgugcccgugcccaacagacuggccgugcccgugacccuggccagccagcaggccggcaccagaaccgccgcccuggagcagcugagagagagacuggagagcggcgagcccgccgagaagaaggccagcagacugagcgaggaggagcagagacuggugcagcaggccuuccagagaaacuucuucagcauggccagacagcugcccaugaagaucagaaucaacggcagagaggacagagccgaggccagcgccgccgcccugaaccugaccaccagcagcaucggcagcaucaacaugagcguggacaucgacggcaccaccuacgccggcgugcuguucgcccagaagcccguggugcaccugaucaccggcagcgccccccagagccugggcagcagcgccagcagcagcagcagcagccacugcagccccagccccaccagcagcagaggcacccccagcgccgagcccagcaccagcuggagccuguaa

SEQ ID NO: 13812 - RNA, 3774 nt, Artificial Sequence
  ARID4A__Homo_sapiens__NP_002883
augaaggccgccgacgagcccgccuaccugaccgugggcaccgacgugagcgccaaguacagaggcgccuucugcgaggccaagaucaagaccgugaagagacuggugaaggugaaggugcugcugaagcaggacaacaccacccagcuggugcaggacgaccaggugaagggcccccugagagugggcgccaucguggagaccagaaccagcgacggcagcuuccaggaggccaucaucagcaagcugaccgacgccagcugguacaccgugguguucgacgacggcgacgagagaacccugagaagaaccagccugugccugaagggcgagagacacuucgccgagagcgagacccuggaccagcugccccugaccaaccccgagcacuucggcacccccgugaucgccaagaagaccaacagaggcagaagaagcagccugcccgugaccgaggacgagaaggaggaggagagcagcgaggaggaggacgaggacaagagaagacugaacgacgagcugcugggcaagguggugagcguggugagcgccaccgagagaaccgagugguaccccgcccuggugaucagccccagcugcaacgacgacaucaccgugaagaaggaccagugccuggugagaagcuucaucgacagcaaguucuacagcaucgccagaaaggacaucaaggagguggacauccugaaccugcccgagagcgagcugagcaccaagcccggccugcagaaggccagcaucuuccugaagaccagaguggugcccgacaacuggaagauggacaucagcgagauccuggagagcagcagcagcgacgacgaggacggccccgccgaggagaacgacgaggagaaggagaaggaggccaagaagaccgaggaggaggugcccgaggaggagcuggaccccgaggagagagacaacuuccugcagcagcuguacaaguucauggaggacagaggcacccccaucaacaagccccccgugcugggcuacaaggaccugaaccuguucaagcuguucagacugguguaccaccagggcggcugcgacaacaucgacagcggcgccguguggaagcagaucuacauggaccugggcauccccauccugaacagcgccgccagcuacaacgugaagaccgccuacagaaaguaccuguacggcuucgaggaguacugcagaagcgccaacauccaguucagaaccgugcaccaccacgagcccaaggugaaggaggagaagaaggaccuggaggagagcauggaggaggcccugaagcuggaccaggagaugccccugaccgaggugaagagcgagcccgaggagaacaucgacagcaacagcgagagcgagagagaggagaucgagcugaagagccccagaggcagaagaagaaucgccagagacgugaacagcaucaagaaggagaucgaggaggagaagaccgaggacaagcugaaggacaacgacaccgagaacaaggacguggacgacgacuacgagaccgccgagaagaaggagaacgagcugcugcugggcagaaagaacacccccaagcagaaggagaagaagaucaagaagcaggaggacagcgacaaggacagcgacgaggaggaggagaagagccaggagagagaggagaccgagagcaagugcgacagcgagggcgaggaggacgaggaggacauggagcccugccugaccggcaccaaggugaaggugaaguacggcagaggcaagacccagaagaucuacgaggccagcaucaagagcaccgagaucgacgacggcgaggugcuguaccuggugcacuacuacggcuggaacgugagauacgacgagugggugaaggccgacagaaucaucuggccccuggacaagggcggccccaagaagaagcagaagaagaaggccaagaacaaggaggacagcgagaaggacgagaagagagacgaggagagacagaagagcaagagaggcagacccccccugaagagcacccugagcagcaacaugcccuacggccugagcaagaccgccaacagcgagggcaagagcgacagcugcagcagcgacagcgagaccgaggacgcccuggagaagaaccugaucaacgaggagcugagccugaaggacgagcuggagaagaacgagaaccugaacgacgacaagcuggacgaggagaaccccaagaucagcgcccacauccugaaggagaacgacagaacccagaugcagccccuggagacccugaagcuggaggugggcgagaacgagcagaucgugcagaucuucggcaacaagauggagaagaccgaggaggugaagaaggaggccgagaagagccccaagggcaagggcagaagaagcaagaccaaggaccugagccuggagaucaucaagaucagcagcuucggccagaacgaggccggcagcgagccccacaucgaggcccacagccuggagcugagcagccuggacaacaagaacuucagcagcgccaccgaggacgagaucgaccagugcgugaaggagaagaagcugaagagaaagauccugggccagagcagccccgagaagaagaucagaaucgagaacggcauggagaugaccaacaccgugagccaggagagaaccagcgacugcaucggcagcgagggcaugaagaaccugaacuucgagcagcacuucgagagagagaacgagggcaugcccagccugaucgccgagagcaaccagugcauccagcagcugaccagcgagagauucgacagccccgccgaggagaccgugaacaucccccugaaggaggacgaggacgccaugccccugaucggccccgagacccuggugugccacgagguggaccuggacgaccuggacgagaaggacaagaccagcaucgaggacguggccguggagagcagcgagagcaacagccuggugagcaucccccccgcccugccccccguggugcagcacaacuucagcguggccagcccccugacccugagccaggacgagagcagaagcgugaagagcgagagcgacaucaccaucgagguggacagcaucgccgaggagagccaggagggccugugcgagagagagagcgccaacggcuucgagaccaacguggccagcggcaccugcagcaucaucgugcaggagagagagagcagagagaagggccagaagagacccagcgacggcaacagcggccugauggccaagaagcagaagagaacccccaagagaaccagcgccgccgccaagaacgagaagaacggcaccggccagagcagcgacagcgaggaccugcccgugcuggacaacagcagcaagugcacccccgugaagcaccugaacgugagcaagccccagaagcuggccagaagccccgccagaaucagcccccacaucaaggacggcgagaaggacaagcacagagagaagcaccccaacagcagccccagaaccuacaaguggagcuuccagcugaacgagcuggacaacaugaacagcaccgagagaaucagcuuccugcaggagaagcugcaggagaucagaaaguacuacaugagccugaagagcgagguggccaccaucgacagaagaagaaagagacugaagaagaaggacagagaggugagccacgccggcgccagcaugagcagcgccagcagcgacaccggcaugagccccagcagcagcagccccccccagaacgugcuggccguggagugcagauaa

SEQ ID NO: 13813 - RNA, 3939 nt, Artificial Sequence
  ARID4B__Homo_sapiens__NP_057458
augaaggcccuggacgagccccccuaccugaccgugggcaccgacgugagcgccaaguacagaggcgccuucugcgaggccaagaucaagaccgccaagagacuggugaaggugaaggugaccuucagacacgacagcagcaccguggaggugcaggacgaccacaucaagggcccccugaaggugggcgccaucguggaggugaagaaccuggacggcgccuaccaggaggccgugaucaacaagcugaccgacgccagcugguacaccgugguguucgacgacggcgacgagaagacccugagaagaagcagccugugccugaagggcgagagacacuucgccgagagcgagacccuggaccagcugccccugaccaaccccgagcacuucggcacccccgugaucggcaagaagaccaacagaggcagaagaagcaaccacauccccgaggaggagagcagcagcagcagcagcgacgaggacgaggacgacagaaagcagaucgacgagcugcugggcaagguggugugcguggacuacaucagccuggacaagaagaaggcccugugguuccccgcccugguggugugccccgacugcagcgacgagaucgccgugaagaaggacaacauccuggugagaagcuucaaggacggcaaguucaccagcgugcccagaaaggacgugcacgagaucaccagcgacaccgcccccaagcccgacgccgugcugaagcaggccuucgagcaggcccuggaguuccacaagagcagaaccauccccgccaacuggaagaccgagcugaaggaggacagcagcagcagcgaggccgaggaggaggaggaggaggaggacgacgagaaggagaaggaggacaacagcagcgaggaggaggaggagaucgagcccuuccccgaggagagagagaacuuccugcagcagcuguacaaguucauggaggacagaggcacccccaucaacaagagacccgugcugggcuacagaaaccugaaccuguucaagcuguucagacuggugcacaagcugggcggcuucgacaacaucgagagcggcgccguguggaagcagguguaccaggaccugggcauccccgugcugaacagcgccgccggcuacaacgugaagugcgccuacaagaaguaccuguacggcuucgaggaguacugcagaagcgccaacaucgaguuccagauggcccugcccgagaagguggugaacaagcagugcaaggagugcgagaacgugaaggagaucaaggugaaggaggagaacgagaccgagaucaaggagaucaagauggaggaggagagaaacaucauccccagagaggagaagcccaucgaggacgagaucgagagaaaggagaacaucaagcccagccugggcagcaagaagaaccugcuggagagcauccccacccacagcgaccaggagaaggaggugaacaucaagaagcccgaggacaacgagaaccuggacgacaaggacgacgacaccaccagaguggacgagagccugaacaucaagguggaggccgaggaggagaaggccaagagcggcgacgagaccaacaaggaggaggacgaggacgacgaggaggccgaggaggaggaggaggaggaggaggaggaggaggacgaggacgacgacgacaacaacgaggaggaggaguucgagugcuacccccccggcaugaaggugcaggugagauacggcagaggcaagaaccagaagauguacgaggccagcaucaaggacagcgacguggagggcggcgaggugcuguaccuggugcacuacugcggcuggaacgugagauacgacgaguggaucaaggccgacaagaucgugagacccgccgacaagaacgugcccaagaucaagcacagaaagaagaucaagaacaagcuggacaaggagaaggacaaggacgagaaguacagccccaagaacugcaagcugagaagacugagcaagccccccuuccagaccaaccccagccccgagauggugagcaagcuggaccugaccgacgccaagaacagcgacaccgcccacaucaagagcaucgagaucaccagcauccugaacggccugcaggccagcgagagcagcgccgaggacagcgagcaggaggacgagagaggcgcccaggacauggacaacaacggcaaggaggagagcaagaucgaccaccugaccaacaacagaaacgaccugaucagcaaggaggagcagaacagcagcagccugcuggaggagaacaaggugcacgccgaccuggugaucagcaagcccgugagcaagagccccgagagacugagaaaggacaucgaggugcugagcgaggacaccgacuacgaggaggacgaggugaccaagaagagaaaggacgugaagaaggacaccaccgacaagagcagcaagccccagaucaagagaggcaagagaagauacugcaacaccgaggagugccugaagaccggcagccccggcaagaaggaggagaaggccaagaacaaggagagccugugcauggagaacagcagcaacagcagcagcgacgaggacgaggaggagaccaaggccaagaugacccccaccaagaaguacaacggccuggaggagaagagaaagagccugagaaccaccggcuucuacagcggcuucagcgagguggccgagaagagaaucaagcugcugaacaacagcgacgagagacugcagaacagcagagccaaggacagaaaggacguguggagcagcauccagggccaguggcccaagaagacccugaaggagcuguucagcgacagcgacaccgaggccgccgccagccccccccaccccgcccccgaggagggcguggccgaggagagccugcagaccguggccgaggaggagagcugcagccccagcguggagcuggagaagcccccccccgugaacguggacagcaagcccaucgaggagaagaccguggaggugaacgacagaaaggccgaguuccccagcagcggcagcaacagcgugcugaacaccccccccaccacccccgagagccccagcagcgugaccgugaccgagggcagcagacagcagagcagcgugaccgugagcgagccccuggcccccaaccaggaggaggugagaagcaucaagagcgagaccgacagcaccaucgagguggacagcguggccggcgagcugcaggaccugcagagcgagggcaacagcagccccgccggcuucgacgccagcgugagcagcagcagcagcaaccagcccgagcccgagcaccccgagaaggccugcaccggccagaagagagugaaggacgcccagggcggcggcagcagcagcaagaagcagaagagaagccacaaggccaccguggugaacaacaagaagaagggcaagggcaccaacagcagcgacagcgaggagcugagcgccggcgagagcaucaccaagagccagcccgugaagagcgugagcaccggcaugaagagccacagcaccaagagccccgccagaacccagagccccggcaagugcggcaagaacggcgacaaggaccccgaccugaaggagcccagcaacagacugcccaagguguacaaguggagcuuccagaugagcgaccuggagaacaugaccagcgccgagagaaucaccauccugcaggagaagcugcaggagaucagaaagcacuaccugagccugaagagcgagguggccagcaucgacagaagaagaaagagacugaagaagaaggagagagagagcgccgccaccagcagcagcagcagcagccccagcagcagcagcaucaccgccgccgugaugcugacccuggccgagcccagcaugagcagcgccagccagaacggcaugagcguggagugcagauaa

SEQ ID NO: 13814 - RNA, 2838 nt, Artificial Sequence
  ARID5B__Homo_sapiens__NP_001231567
auggcccccaaccugaagggcagacccagaaagaagaagcccugcccccagagaagagacagcuucagcggcgugaaggacagcaacaacaacagcgacggcaaggccguggccaaggugaagugcgaggccagaagcgcccugaccaagcccaagaacaaccacaacugcaagaaggugagcaacgaggagaagcccaagguggccaucggcgaggagugcagagccgacgagcaggccuuccugguggcccuguacaaguacaugaaggagagaaagacccccaucgagagaauccccuaccugggcuucaagcagaucaaccuguggaccauguuccaggccgcccagaagcugggcggcuacgagaccaucaccgccagaagacaguggaagcacaucuacgacgagcugggcggcaaccccggcagcaccagcgccgccaccugcaccagaagacacuacgagagacugauccugcccuacgagagauucaucaagggcgaggaggacaagccccugccccccaucaagcccagaaagcaggagaacagcagccaggagaacgagaacaagaccaaggugagcggcaccaagagaaucaagcacgagauccccaagagcaagaaggagaaggagaacgcccccaagccccaggacgccgccgaggugagcagcgagcaggagaaggagcaggagacccugaucagccagaagagcauccccgagccccugcccgccgccgacaugaagaagaagaucgagggcuaccaggaguucagcgccaagccccuggccagcagaguggaccccgagaaggacaacgagaccgaccagggcagcaacagcgagaagguggccgaggaggccggcgagaagggccccacccccccccugcccagcgccccccuggcccccgagaaggacagcgcccuggugcccggcgccagcaagcagccccugaccagccccagcgcccugguggacagcaagcaggagagcaagcugugcugcuucaccgagagccccgagagcgagccccaggaggccagcuuccccagcuuccccaccacccagcccccccuggccaaccagaacgagaccgaggacgacaagcugcccgccauggccgacuacaucgccaacugcaccgugaagguggaccagcugggcagcgacgacauccacaacgcccugaagcagacccccaaggugcugguggugcagagcuucgacauguucaaggacaaggaccugaccggccccaugaacgagaaccacggccugaacuacaccccccugcuguacagcagaggcaaccccggcaucaugagcccccuggccaagaagaagcugcugagccaggugagcggcgccagccugagcagcagcuaccccuacggcagcccccccccccugaucagcaagaagaagcugaucgccagagacgaccugugcagcagccugagccagacccaccacggccagagcaccgaccacauggccgugagcagacccagcgugauccagcacgugcagagcuucagaagcaagcccagcgaggagagaaagaccaucaacgacaucuucaagcacgagaagcugagcagaagcgacccccacagaugcagcuucagcaagcaccaccugaacccccuggccgacagcuacgugcugaagcaggagauccaggagggcaaggacaagcugcuggagaagagagcccugccccacagccacaugcccagcuuccuggccgacuucuacagcagcccccaccugcacagccuguacagacacaccgagcaccaccugcacaacgagcagaccagcaaguaccccagcagagacauguacagagagagcgagaacagcagcuuccccagccacagacaccaggagaagcugcacgugaacuaccugaccagccugcaccugcaggacaagaagagcgccgccgccgaggcccccaccgacgaccagcccaccgaccugagccugcccaagaacccccacaagcccaccggcaaggugcugggccuggcccacagcaccaccggcccccaggagagcaagggcaucagccaguuccaggugcugggcagccagagcagagacugccaccccaaggccugcagagugagccccaugaccaugagcggccccaagaaguaccccgagagccugagcagaagcggcaagccccaccacgugagacuggagaacuucagaaagauggagggcauggugcaccccauccugcacagaaagaugagcccccagaacaucggcgccgccagacccaucaagagaagccuggaggaccuggaccuggugaucgccggcaagaaggccagagccgugagcccccuggaccccagcaaggaggugagcggcaaggagaaggccagcgagcaggagagcgagggcagcaaggccgcccacggcggccacagcggcggcggcagcgagggccacaagcugccccugagcagccccaucuuccccggccuguacagcggcagccugugcaacagcggccugaacagcagacugcccgccggcuacagccacagccugcaguaccugaagaaccagaccgugcugagcccccugaugcagccccuggccuuccacagccuggugaugcagagaggcaucuucaccagccccaccaacagccagcagcuguacagacaccuggccgccgccacccccgugggcagcagcuacggcgaccugcugcacaacagcaucuacccccuggccgccaucaacccccaggccgccuuccccagcagccagcugagcagcgugcaccccagcaccaagcuguaa

SEQ ID NO: 13815 - RNA, 1674 nt, Artificial Sequence
  ARIH1__Homo_sapiens__NP_005735
auggacagcgacgagggcuacaacuacgaguucgacgaggacgaggagugcagcgaggaggacagcggcgccgaggaggaggaggacgaggacgacgacgagcccgacgacgacacccuggaccugggcgagguggagcugguggagcccggccugggcgugggcggcgagagagacggccugcugugcggcgagaccggcggcggcggcggcagcgcccugggccccggcggcggcggcggcggcggcggcggcggcggcggcggcggccccggccacgagcaggaggaggacuacagauacgaggugcugaccgccgagcagauccugcagcacaugguggagugcaucagagaggugaacgaggugauccagaaccccgccaccaucaccagaauccugcugagccacuucaacugggacaaggagaagcugauggagagauacuucgacggcaaccuggagaagcuguucgccgagugccacgugaucaaccccagcaagaagagcagaaccagacagaugaacaccagaagcagcgcccaggacaugcccugccagaucugcuaccugaacuaccccaacagcuacuucaccggccuggagugcggccacaaguucugcaugcagugcuggagcgaguaccugaccaccaagaucauggaggagggcaugggccagaccaucagcugccccgcccacggcugcgacauccugguggacgacaacaccgugaugagacugaucaccgacagcaaggugaagcugaaguaccagcaccugaucaccaacagcuucguggagugcaacagacugcugaaguggugccccgcccccgacugccaccacguggugaaggugcaguaccccgacgccaagcccgugagaugcaagugcggcagacaguucugcuucaacugcggcgagaacuggcacgaccccgugaagugcaaguggcugaagaaguggaucaagaagugcgacgacgacagcgagaccagcaacuggaucgccgccaacaccaaggagugccccaagugccacgugaccaucgagaaggacggcggcugcaaccacauggugugcagaaaccagaacugcaaggccgaguucugcugggugugccugggccccugggagccccacggcagcgccugguacaacugcaacagauacaacgaggacgacgccaaggccgccagagacgcccaggagagaagcagagccgcccugcagagauaccuguucuacugcaacagauacaugaaccacaugcagagccugagauucgagcacaagcuguacgcccaggugaagcagaagauggaggagaugcagcagcacaacaugagcuggaucgaggugcaguuccugaagaaggccguggacgugcugugccagugcagagccacccugauguacaccuacguguucgccuucuaccugaagaagaacaaccagagcaucaucuucgagaacaaccaggccgaccuggagaacgccaccgaggugcugagcggcuaccuggagagagacaucagccaggacagccugcaggacaucaagcagaaggugcaggacaaguacagauacugcgagagcagaagaagagugcugcugcagcacgugcacgagggcuacgagaaggaccugugggaguacaucgaggacuaa

SEQ ID NO: 13816 - RNA, 591 nt, Artificial Sequence
  ARL11__Homo_sapiens__NP_612459
augggcagcgugaacagcagaggccacaaggccgaggcccagguggugaugaugggccuggacagcgccggcaagaccacccugcuguacaagcugaagggccaccagcugguggagacccugcccaccgugggcuucaacguggagccccugaaggcccccggccacgugagccugacccugugggacgugggcggccaggccccccugagagccagcuggaaggacuaccuggagggcaccgacauccugguguacgugcuggacagcaccgacgaggccagacugcccgagagcgccgccgagcugaccgaggugcugaacgaccccaacauggccggcgugcccuuccuggugcuggccaacaagcaggaggcccccgacgcccugccccugcugaagaucagaaacagacugagccuggagagauuccaggaccacugcugggagcugagaggcugcagcgcccugaccggcgagggccugcccgaggcccugcagagccuguggagccugcugaagagcagaagcugcaugugccugcaggccagagcccacggcgccgagagaggcgacagcaagagaagcuaa

SEQ ID NO: 13817 - RNA, 771 nt, Artificial Sequence
  ARL13A__Homo_sapiens__NP_001155963
auguucagacugcugagcagcugcugcagcugccugagaaccaccgaggagaccagaagaaacgugaccauccccaucaucggccugaacaacagcggcaagaccgugcugguggaggccuuccagaagcugcugcccagcaagaccgaccacugcaugaagagcgagcugaccacccugcugcuggacgaguacgagcugagcaucuacgaccugaacggcgaccugaagggcagagaggccuggcccaacuacuacgcccaggcccacggccugguguucgugcuggacagcagcgacaucagaagaaugcaggaggugaagaucauccugacccaccugcugagcgacaagagaguggccggcaagcccauccugauccuggccaacaagcaggacaagaagaaggcccugaugcccugcgacaucaucgacuaccugcugcugaagaagcuggugaaggagaacaagugccccugcagaguggagcccugcagcgccaucagaaaccuggagagaagaaaccaccagcccaucguggagggccugagauggcugcuggccgugaucgacaccugccagcugccccccaccagcagcaucagcaucagcaagaacaacaccggcagcggcgagagaugcagcagccacagcuucagcaccagaaccggcaugagcaaggagaagagacagcaccuggagcagugcagcaucgaggccaagccccugaagagcauccugcagcccagcaaccagagcuacacccacuaa

SEQ ID NO: 13818 - RNA, 1287 nt, Artificial Sequence
  ARL13B__Homo_sapiens__NP_001167621
auguucagccugauggccagcugcugcggcugguucaagagauggagagagcccgugagaaaggugacccugcugauggugggccuggacaacgccggcaagaccgccaccgccaagggcauccagggcgaguaccccgaggacguggcccccaccgugggcuucagcaagaucaaccugagacagggcaaguucgaggugaccaucuucgaccugggcggcggcaucagaaucagaggcaucuggaagaacuacuacgccgagagcuacggcgugaucuucgugguggacagcagcgacgaggagagaauggaggagaccaaggaggccaugagcgagaugcugagacaccccagaaucagcggcaagcccauccuggugcuggccaacaagcaggacaaggagggcgcccugggcgaggccgacgugaucgagugccugagccuggagaagcuggugaacgagcacaagugccugugccagaucgagcccugcagcgccaucagcggcuacggcaagaagaucgacaagagcaucaagaagggccuguacuggcugcugcacgugaucgccagagacuucgacgcccugaacgagagaauccagaaggagaccaccgagcagagagcccuggaggagcaggagaagcaggagagagccgagagagugagaaagcugagagaggagagaaagcagaacgagcaggagcaggccgagcuggacggcaccagcggccuggccgagcuggaccccgagcccaccaaccccuuccagcccaucgccagcgugaucaucgagaacgagggcaagcuggagagagagaagaagaaccagaagauggagaaggacagcgacggcugccaccugaagcacaagauggagcacgagcagaucgagacccagggccaggugaaccacaacggccagaagaacaacgaguucggccugguggagaacuacaaggaggcccugacccagcagcugaagaacgaggacgagaccgacagacccagccuggagagcgccaacggcaagaagaagaccaagaagcugagaaugaagagaaaccacagaguggagccccugaacaucgacgacugcgcccccgagagccccacccccccccccccccccccccccgugggcuggggcacccccaaggugaccagacugcccaagcuggagccccugggcgagacccaccacaacgacuucuacagaaagccccugcccccccuggccgugccccagagacccaacagcgacgcccacgacgugaucagcuaa

SEQ ID NO: 13819 - RNA, 783 nt, Artificial Sequence
  ARL14EP__Homo_sapiens__NP_689529
augauggaccccugcagcgugggcgugcagcugagaaccaccaacgagugccacaagaccuacuacaccagacacaccggcuucaagacccugcaggagcugagcagcaacgacaugcugcugcugcagcugagaaccggcaugacccugagcggcaacaacaccaucugcuuccaccacgugaagaucuacaucgacagauucgaggaccugcagaagagcugcugcgaccccuucaacauccacaagaagcuggccaagaagaaccugcacgugaucgaccuggacgacgccaccuuccugagcgccaaguucggcagacagcuggugcccggcuggaagcugugccccaagugcacccagaucaucaacggcagcguggacguggacaccgaggacagacagaagagaaagcccgagagcgacggcagaaccgccaaggcccugagaagccugcaguucaccaaccccggcagacagaccgaguucgcccccgagaccggcaagagagagaagagaagacugaccaagaacgccaccgccggcagcgacagacaggugauccccgccaagagcaagguguacgacagccagggccugcugaucuucagcggcauggaccugugcgacugccuggacgaggacugccugggcugcuucuacgccugccccgccugcggcagcaccaagugcggcgccgagugcagaugcgacagaaaguggcuguacgagcagaucgagaucgagggcggcgagaucauccacaacaagcacgccggcuaa

SEQ ID NO: 13820 - RNA, 579 nt, Artificial Sequence
  ARL14__Homo_sapiens__NP_079323
augggcagccugggcagcaagaacccccagaccaagcaggcccaggugcugcugcugggccuggacagcgccggcaagagcacccugcuguacaagcugaagcuggccaaggacaucaccaccauccccaccaucggcuucaacguggagaugaucgagcuggagagaaaccugagccugaccgugugggacgugggcggccaggagaagaugagaaccguguggggcugcuacugcgagaacaccgacggccugguguacgugguggacagcaccgacaagcagagacuggaggagagccagagacaguucgagcacauccugaagaacgagcacaucaagaacgugcccguggugcugcuggccaacaagcaggacaugcccggcgcccugaccgccgaggacaucaccagaauguucaaggugaagaagcugugcagcgacagaaacugguacgugcagcccugcugcgcccugaccggcgagggccuggcccagggcuucagaaagcugaccggcuucgugaagagccacaugaagagcagaggcgacacccuggccuucuucaagcagaacuaa

SEQ ID NO: 13821 - RNA, 615 nt, Artificial Sequence
  ARL15__Homo_sapiens__NP_061960
augagcgaccugagaaucaccgaggccuuccuguacauggacuaccugugcuucagagcccugugcugcaagggccccccccccgccagacccgaguacgaccuggugugcaucggccugaccggcagcggcaagaccagccugcugagcaagcugugcagcgagagccccgacaacguggugagcaccaccggcuucagcaucaaggccgugcccuuccagaacgccauccugaacgugaaggagcugggcggcgccgacaacaucagaaaguacuggagcagauacuaccagggcagccagggcgugaucuucgugcuggacagcgccagcagcgaggacgaccuggaggccgccagaaacgagcugcacagcgcccugcagcacccccagcugugcacccugcccuuccugauccuggccaaccaccaggacaagcccgccgccagaagcgugcaggagaucaagaaguacuucgagcuggagccccuggccagaggcaagagauggauccugcagcccugcagccuggacgacauggacgcccugaaggacagcuucagccagcugaucaaccugcuggaggagaaggaccacgaggccgugagaauguaa

SEQ ID NO: 13822 - RNA, 546 nt, Artificial Sequence
  ARL1__Homo_sapiens__NP_001168
augggcggcuucuucagcagcaucuucagcagccuguucggcaccagagagaugagaauccugauccugggccuggacggcgccggcaagaccaccauccuguacagacugcaggugggcgagguggugaccaccauccccaccaucggcuucaacguggagaccgugaccuacaagaaccugaaguuccaggugugggaccugggcggccagaccagcaucagacccuacuggagaugcuacuacagcaacaccgacgccgugaucuacgugguggacagcugcgacagagacagaaucggcaucagcaagagcgagcugguggccaugcuggaggaggaggagcugagaaaggccauccuggugguguucgccaacaagcaggacauggagcaggccaugaccagcagcgagauggccaacagccugggccugcccgcccugaaggacagaaaguggcagaucuucaagaccagcgccaccaagggcaccggccuggacgaggccauggaguggcugguggagacccugaagagcagacaguaa

SEQ ID NO: 13823 - RNA, 492 nt, Artificial Sequence
  ARL2BP__Homo_sapiens__NP_036238
auggacgcccuggagggcgagagcuucgcccugagcuucagcagcgccagcgacgccgaguucgacgccguggugggcuaccuggaggacaucaucauggacgacgaguuccagcugcugcagagaaacuucauggacaaguacuaccuggaguucgaggacaccgaggagaacaagcugaucuacacccccaucuucaacgaguacaucagccugguggagaaguacaucgaggagcagcugcugcagagaauccccgaguucaacauggccgccuucaccaccacccugcagcaccacaaggacgagguggccggcgacaucuucgacaugcugcugaccuucaccgacuuccuggccuucaaggagauguuccuggacuacagagccgagaaggagggcagaggccuggaccugagcagcggccugguggugaccagccugugcaagagcagcagccugcccgccagccagaacaaccugagacacuaa

SEQ ID NO: 13824 - RNA, 474 nt, Artificial Sequence
  ARL2__Homo_sapiens__NP_001186674
augggccugcugaccauccugaagaagaugaagcagaaggagagagagcugagacugcugaugcugggccuggacaacgccggcaagaccaccauccugaagaaguucaacggcgaggacaucgacaccaucagccccacccugggcuucaacaucaagacccuggagcacagaggcuucaagcugaacaucugggacgugggcggccagaagagccugagaagcuacuggagaaacuacuucgagagcaccgacggccugaucugggugguggacagcgccgacagacagagaaugcaggacugccagagagagcugcagagccugcugguggaggaggugcuggagcuggacagcaucagaagccaccacuggugcauccagggcugcagcgccgugaccggcgagaaccugcugcccggcaucgacuggcugcuggacgacaucagcagcagaaucuucaccgccgacuaa

SEQ ID NO: 13825 - RNA, 549 nt, Artificial Sequence
  ARL3__Homo_sapiens__NP_004302
augggccugcugagcauccugagaaagcugaagagcgcccccgaccaggaggugagaauccugcugcugggccuggacaacgccggcaagaccacccugcugaagcagcuggccagcgaggacaucagccacaucacccccacccagggcuucaacaucaagagcgugcagagccagggcuucaagcugaacgugugggacaucggcggccagagaaagaucagacccuacuggaagaacuacuucgagaacaccgacauccugaucuacgugaucgacagcgccgacagaaagagauucgaggagaccggccaggagcuggccgagcugcuggaggaggagaagcugagcugcgugcccgugcugaucuucgccaacaagcaggaccugcugaccgccgcccccgccagcgagaucgccgagggccugaaccugcacaccaucagagacagaguguggcagauccagagcugcagcgcccugaccggcgagggcgugcaggacggcaugaacugggugugcaagaacgugaacgccaagaagaaguaa

SEQ ID NO: 13826 - RNA, 603 nt, Artificial Sequence
  ARL4A__Homo_sapiens__NP_001182325
augggcaacggccugagcgaccagaccagcauccugagcaaccugcccagcuuccagagcuuccacaucgugauccugggccuggacugcgccggcaagaccaccgugcuguacagacugcaguucaacgaguucgugaacaccgugcccaccaagggcuucaacaccgagaagaucaaggugacccugggcaacagcaagaccgugaccuuccacuucugggacgugggcggccaggagaagcugagaccccuguggaagagcuacaccagaugcaccgacggcaucguguucgugguggacagcguggacguggagagaauggaggaggccaagaccgagcugcacaagaucaccagaaucagcgagaaccagggcgugcccgugcugaucguggccaacaagcaggaccugagaaacagccugagccugagcgagaucgagaagcugcuggccaugggcgagcugagcagcagcacccccuggcaccugcagcccaccugcgccaucaucggcgacggccugaaggagggccuggagaagcugcacgacaugaucaucaagagaagaaagaugcugagacagcagaagaagaagagauaa

SEQ ID NO: 13827 - RNA, 606 nt, Artificial Sequence
  ARL4C__Homo_sapiens__NP_001269360
augggcaacaucagcagcaacaucagcgccuuccagagccugcacaucgugaugcugggccuggacagcgccggcaagaccaccgugcuguacagacugaaguucaacgaguucgugaacaccgugcccaccaucggcuucaacaccgagaagaucaagcugagcaacggcaccgccaagggcaucagcugccacuucugggacgugggcggccaggagaagcugagaccccuguggaagagcuacagcagaugcaccgacggcaucaucuacgugguggacagcguggacguggacagacuggaggaggccaagaccgagcugcacaaggugaccaaguucgccgagaaccagggcaccccccugcuggugaucgccaacaagcaggaccugcccaagagccugcccguggccgagaucgagaagcagcuggcccugcacgagcugauccccgccaccaccuaccacgugcagcccgccugcgccaucaucggcgagggccugaccgagggcauggacaagcuguacgagaugauccugaagagaagaaagagccugaagcagaagaagaagagaaccggcgaccugagaagcugcgagguguaa

SEQ ID NO: 13828 - RNA, 606 nt, Artificial Sequence
  ARL4D__Homo_sapiens__NP_001652
augggcaaccaccugaccgagauggcccccaccgccagcagcuuccugccccacuuccaggcccugcacgugguggugaucggccuggacagcgccggcaagaccagccugcuguacagacugaaguucaaggaguucgugcagagcgugcccaccaagggcuucaacaccgagaagaucagagugccccugggcggcagcagaggcaucaccuuccaggugugggacgugggcggccaggagaagcugagaccccuguggagaagcuacaccagaagaaccgacggccugguguucgugguggacgccgccgaggccgagagacuggaggaggccaagguggagcugcacagaaucagcagagccagcgacaaccagggcgugcccgugcuggugcuggccaacaagcaggaccagcccggcgcccugagcgccgccgagguggagaagagacuggccgugagagagcuggccgccgccacccugacccacgugcagggcugcagcgccguggacggccugggccugcagcagggccuggagagacuguacgagaugauccugaagagaaagaaggccgccagaggcggcaagaagagaagauaa

SEQ ID NO: 13829 - RNA, 429 nt, Artificial Sequence
  ARL5A__Homo_sapiens__NP_001032251
augaacgagguggugcacaccagccccaccaucggcagcaacguggaggagaucgugaucaacaacaccagauuccugaugugggacaucggcggccaggagagccugagaagcagcuggaacaccuacuacaccaacaccgaguucgugaucguggugguggacagcaccgacagagagagaaucagcgugaccagagaggagcuguacaagaugcuggcccacgaggaccugagaaaggccggccugcugaucuucgccaacaagcaggacgugaaggagugcaugaccguggccgagaucagccaguuccugaagcugaccagcaucaaggaccaccaguggcacauccaggccugcugcgcccugaccggcgagggccugugccagggccuggaguggaugaugagcagacugaagaucagauaa

SEQ ID NO: 13830 - RNA, 540 nt, Artificial Sequence
  ARL5B__Homo_sapiens__NP_848930
augggccugaucuucgccaagcuguggagccuguucugcaaccaggagcacaaggugaucaucgugggccuggacaacgccggcaagaccaccauccuguaccaguuccugaugaacgagguggugcacaccagccccaccaucggcagcaacguggaggagaucguggugaagaacacccacuuccugaugugggacaucggcggccaggagagccugagaagcagcuggaacaccuacuacagcaacaccgaguucaucauccuggugguggacagcaucgacagagagagacuggccaucaccaaggaggagcuguacagaaugcuggcccacgaggaccugagaaaggccgccgugcugaucuucgccaacaagcaggacaugaagggcugcaugaccgccgccgagaucagcaaguaccugacccugagcagcaucaaggaccaccccuggcacauccagagcugcugcgcccugaccggcgagggccugugccagggccuggaguggaugaccagcagaaucggcgugagauaa

SEQ ID NO: 13831 - RNA, 561 nt, Artificial Sequence
  ARL6__Homo_sapiens__NP_816931
augggccugcuggacagacugagcgugcugcugggccugaagaagaaggaggugcacgugcugugccugggccuggacaacagcggcaagaccaccaucaucaacaagcugaagcccagcaacgcccagagccagaacauccugcccaccaucggcuucagcaucgagaaguucaagagcagcagccugagcuucaccguguucgacaugagcggccagggcagauacagaaaccugugggagcacuacuacaaggagggccaggccaucaucuucgugaucgacagcagcgacagacugagaauggugguggccaaggaggagcuggacacccugcugaaccaccccgacaucaagcacagaagaauccccauccuguucuucgccaacaagauggaccugagagacgccgugaccagcgugaaggugagccagcugcugugccuggagaacaucaaggacaagcccuggcacaucugcgccagcgacgccaucaagggcgagggccugcaggagggcguggacuggcugcaggaccagauccagaccgugaagaccuaa

SEQ ID NO: 13832 - RNA, 612 nt, Artificial Sequence
  ARL6IP1__Homo_sapiens__NP_055976
auggccgagggcgacaacagaagcaccaaccugcuggccgccgagaccgccagccuggaggagcagcugcagggcuggggcgaggugaugcugauggccgacaaggugcugagaugggagagagccugguucccccccgccaucaugggcguggugagccugguguuccugaucaucuacuaccuggaccccagcgugcugagcggcgugagcugcuucgugauguuccugugccuggccgacuaccuggugcccauccuggcccccagaaucuucggcagcaacaaguggaccaccgagcagcagcagagauuccacgagaucugcagcaaccuggugaagaccagaagaagagccgugggcugguggaagagacuguucacccugaaggaggagaagcccaagauguacuucaugaccaugaucgugagccuggccgccguggccugggugggccagcaggugcacaaccugcugcugaccuaccugaucgugaccagccugcugcugcugcccggccugaaccagcacggcaucauccugaaguacaucggcauggccaagagagagaucaacaagcugcugaagcagaaggagaagaagaacgaguaa

SEQ ID NO: 13833 - RNA, 567 nt, Artificial Sequence
  ARL6IP5__Homo_sapiens__NP_006398
auggacgugaacaucgccccccugagagccugggacgacuucuuccccggcagcgacagauucgccagacccgacuucagagacaucagcaaguggaacaacagaguggugagcaaccugcuguacuaccagaccaacuaccuggugguggccgccaugaugaucagcaucgugggcuuccugagccccuucaacaugauccugggcggcaucgugguggugcugguguucaccggcuucgugugggccgcccacaacaaggacgugcugagaagaaugaagaagagauaccccaccaccuucgugaugguggugaugcuggccagcuacuuccugaucagcauguucggcggcgugaugguguucguguucggcaucaccuucccccugcugcugauguucauccacgccagccugagacugagaaaccugaagaacaagcuggagaacaagauggagggcaucggccugaagagaacccccaugggcaucgugcuggacgcccuggagcagcaggaggagggcaucaacagacugaccgacuacaucagcaaggugaaggaguaa

SEQ ID NO: 13834 - RNA, 927 nt, Artificial Sequence
  ARMC10__Homo_sapiens__NP_001154481
augggcggccccagaggcgccggcuggguggccgccggccugcugcugggcgccggcgccugcuacugcaucuacagacugaccagaggcagaagaagaggcgacagagagcugggcaucagaagcagcaagagcgccgaggaccugaccgacggcagcuacgacgacgugcugaacgccgagcagcugcagaagcugcuguaccugcuggagagcaccgaggaccccgugaucaucgagagagcccugaucacccugggcaacaacgccgccuucagcgugaaccaggccaucaucagagagcugggcggcauccccaucguggccaacaagaucaaccacagcaaccagagcaucaaggagaaggcccugaacgcccugaacaaccugagcgugaacguggagaaccagaucaagaucaagaucuacaucagccaggugugcgaggacguguucagcggcccccugaacagcgccgugcagcuggccggccugacccugcugaccaacaugaccgugaccaacgaccaccagcacaugcugcacagcuacaucaccgaccuguuccaggugcugcugaccggcaacggcaacaccaaggugcaggugcugaagcugcugcugaaccugagcgagaaccccgccaugaccgagggccugcugagagcccagguggacagcagcuuccugagccuguacgacagccacguggccaaggagauccugcugagagugcugacccuguuccagaacaucaagaacugccugaagaucgagggccaccuggccgugcagcccaccuucaccgagggcagccuguucuuccugcugcacggcgaggagugcgcccagaagaucagagcccugguggaccaccacgacgccgaggugaaggagaagguggugaccaucauccccaagaucuaa

SEQ ID NO: 13835 - RNA, 543 nt, Artificial Sequence
  ARMC1__Homo_sapiens__NP_001273631
augagcgccuggcccuacuucaucuacggccccagccagcccagcagcagaccccugagauucgccugcagcagcauccugggcagaaugcccugcaagcagagaaaggacgagagaagaaccggcuacgacguggagcugaccaagugcuacaccgagagcagaagaaaccugugcgaggaggcccugcugaagaucaagggcgugaucagcuucaccuuccagauggccgugcagagaugcguggugagaaucagaagcgaccugaaggccgaggcccuggccagcgccaucgccagcaccaaggugaugaaggcccagcagguggugaagagcgagagcggcgaggagaugcuggugcccuuccaggacacccccguggagguggagcagaacaccgagcugcccgacuaccugcccgaggacgagagccccaccaaggagcaggacaaggccgugagcagagugggcagccaccccgagggcggcgccagcuggcugagcaccgccgccaacuuccugagcagaagcuucuacugguaa

SEQ ID NO: 13836 - RNA, 2604 nt, Artificial Sequence
  ARMC2__Homo_sapiens__NP_115507
augcugagccccaacgacaagaugcugggcaagcuggaccccuucuaccagcccagcgugagcaagcagaagaccagcgccgagaucaucagcgaggccagaaacgcccugagaaccgugagaacccagagacccuucaccccccaggaggcccagagaaagcuguucggccccgccagcagcagaaccagcgagaacagaccccccagcagcuucagccugcacgccagcagcuucgagagcagcgacagcagacccaucagcggcaccagacugagcccccuggagcugaagcccaaggugcccgccagccccaccagagaggaggacagcugcuucagcuuccccaagccccccguggaccccgccaagaucagaagagugagcaacgccagagccagacuguucagagccgccagccagagagcccugcugcccgacagaagccugccccccagcgacagcaagaagaccguggagagcaaggagaccgugaugaugggcgacagcauggugaagaucaacggcaucuaccugaccaagagcaacgccaucugccaccugaagagccacccccugcagcugaccgacgacggcggcuucagcgagaucaaggagcaggagauguucaagggcaccaccagccugcccagccaccugaagaacggcggcgaccagggcaagagacacgccagagccagcagcugccccagcagcagcgaccugagcagacugcagaccaaggccgugcccaaggccgaccugcaggaggaggacgccgagaucgagguggacgagguguucuggaacaccagaaucgugcccauccugagagagcuggagaaggaggagaacaucgagaccgugugcgccgccugcacccagcugcaccacgcccuggaggagggcaacaugcugggcaacaaguucaagggcagaagcauccugcugaagacccugugcaagcugguggacgugggcagcgacagccugagccugaagcuggccaagaucauccuggcccugaaggugagcagaaagaaccugcugaacgugugcaagcugaucuucaagaucagcagaaacgagaagaacgacagccugauccagaacgacagcauccuggagagccugcuggaggugcugagaagcgaggaccugcagaccaacauggaggccuuccuguacugcaugggcagcaucaaguucaucagcggcaaccugggcuuccugaacgagaugaucagcaagggcgccguggagauccugaucaaccugaucaagcagaucaacgagaacaucaagaagugcggcaccuuccugcccaacagcggccaccugcuggugcaggugaccgccacccugagaaaccugguggacagcagccuggugagaagcaaguuccugaacaucagcgcccugccccagcugugcaccgccauggagcaguacaagggcgacaaggacgugugcaccaacaucgccagaaucuucagcaagcugaccagcuacagagacugcugcaccgcccuggccagcuacagcagaugcuacgcccuguuccugaaccugaucaacaaguaccagaagaagcaggaccugguggugagagugguguucauccugggcaaccugaccgccaagaacaaccaggccagagagcaguucagcaaggagaagggcagcauccagacccugcugagccuguuccagaccuuccaccagcuggaccugcacagccagaagcccgugggccagagaggcgagcagcacagagcccagagaccccccagcgaggccgaggacgugcugaucaagcugaccagagugcuggccaacaucgccauccaccccggcgugggccccgugcuggccgccaaccccggcaucgugggccugcugcugaccacccuggaguacaagagccuggacgacugcgaggagcuggugaucaacgccaccgccaccaucaacaaccugagcuacuaccaggugaagaacagcaucauccaggacaagaagcuguacaucgccgagcugcugcugaagcugcuggugagcaacaacauggacggcauccuggaggccgugagaguguucggcaaccugagccaggaccacgacgugugcgacuucaucgugcagaacaacgugcacagauucaugauggcccugcuggacgcccagcaccaggacaucugcuucagcgccugcggcgugcugcugaaccugaccguggacaaggacaagagagugauccugaaggagggcggcggcaucaagaagcugguggacugccugagagaccugggccccaccgacuggcagcuggccugccuggugugcaagacccuguggaacuucagcgagaacaucaccaacgccagcagcugcuucggcaacgaggacaccaacacccugcugcugcugcugagcagcuuccuggacgaggagcuggcccuggacggcagcuucgaccccgaccugaagaacuaccacaagcugcacugggagaccgaguucaagcccguggcccagcagcugcugaacagaauccagagacaccacaccuuccuggagccccugcccauccccagcuucuaa

SEQ ID NO: 13837 - RNA, 2598 nt, Artificial Sequence
  ARMC3__Homo_sapiens__NP_001269674
augggcaagaagaucaagaaggagguggagcccccccccaaggacguguucgacccccugaugaucgagagcaagaaggccgccaccguggugcugaugcugaacagccccgaggaggagauccuggccaaggccugcgaggccaucuacaaguucgcccugaagggcgaggagaacaagaccacccugcuggagcugggcgccguggagccccugaccaagcugcugacccacgaggacaagaucgugagaagaaacgccaccaugaucuucggcauccuggccagcaacaacgacgugaagaagcugcugagagagcuggacgugaugaacagcgugaucgcccagcuggcccccgaggaggagguggugauccacgaguucgccagccugugccuggccaacaugagcgccgaguacaccagcaaggugcagaucuucgagcacggcggccuggagccccugaucagacugcugagcagccccgaccccgacgugaagaagaacagcauggagugcaucuacaaccuggugcaggacuuccagugcagagccaagcugcaggagcugaacgccaucccccccauccuggaccugcugaagagcgaguaccccgugauccagcugcuggcccugaagacccugggcgugaucgccaacgacaaggagagcagaaccaugcugagagacaaccagggccuggaccaccugaucaagauccuggagaccaaggagcugaacgaccugcacaucgaggcccuggccgugaucgccaacugccuggaggacauggacaccauggugcagauccagcagaccggcggccugaagaagcugcugagcuucgccgagaacagcaccauccccgacauccagaagaacgccgccaaggccaucaccaaggccgccuacgaccccgagaacagaaagcuguuccacgagcaggagguggagaagugccugguggcccugcugggcagcgagaacgacggcaccaagaucgccgccagccaggccaucagcgccaugugcgagaacagcggcagcaaggacuucuucaacaaccagggcaucccccagcugauccagcugcugaagagcgacaacgaggaggugagagaggccgccgcccuggcccuggccaaccugaccaccugcaaccccgccaacgccaacgccgccgccgaggccgacggcaucgacccccugaucaaccugcugagcagcaagagagacggcgccaucgccaacgccgccaccgugcugaccaacauggccaugcaggagccccugagacugaacauccagaaccacgacaucaugcacgccaucaucagcccccugagaagcgccaacaccguggugcagagcaaggccgcccuggccgugaccgccaccgccugcgacguggaggccagaaccgagcugagaaacagcggcggccuggagccccugguggagcugcugagaagcaagaacgacgaggugagaaagcacgccagcugggccgugauggugugcgccggcgacgagcugaccgccaacgagcugugcagacugggcgcccuggacauccuggaggaggugaacgugagcggcaccagaaagaacaaguucagcgaggccgccuacaacaagcugcugaacaacaaccugagccugaaguacagccagaccggcuaccugagcagcagcaacaucaucaacgacggcuucuacgacuacggcagaaucaaccccggcaccaagcugcugccccugaaggagcugugccugcaggagcccagcgaccugagagccgugcugcugaucaacagcaagagcuacgugagcccccccagcagcauggaggacaagagcgacgugggcuacggcagaagcaucagcagcagcagcagccugagaagaagcagcaaggagaagaacaacgccggcuucggcagccccaucgaggacaagagcgagcccgccagcggcagaaacaccgugcugagcaagagcgccaccaaggagaagggcuggagaaagagcaagggcaagaaggaggaggagaaggugaaggaggaggaggaggugaugguggugcccaaguucgugggcgagggcagcagcgacaaggaguggugcccccccagcgaccccgacuucagcauguacguguacgaggugaccaagagcauccugcccaucaccaacaucaaggagcagaucgaggaccuggccaaguacguggccgagaagaugggcggcaagauccccaaggagaagcugcccgacuucagcugggagcugcacaucagcgagcugaaguuccagcugaagagcaacgugauccccaucggccacgugaagaagggcaucuucuaccacagagcccugcuguucaaggcccuggccgacagaaucggcaucggcugcagccuggugagaggcgaguacggcagagccuggaacgaggugaugcugcagaacgacagcagaaagggcgugaucggcggccugcccgcccccgagauguacgugaucgaccugauguuccaccccggcggccugaugaagcugagaagcagagaggccgaccuguacagauucaucuaa

SEQ ID NO: 13838 - RNA, 1839 nt, Artificial Sequence
  ARMC4__Homo_sapiens__NP_001276950
augagagacuucagccuggcccaggagaccugccagcuggccaucagagacgugggcggccuggaggugcugaucaaccugcuggagaccgacgaggugaagugcaagaucggcagccugaagauccugaaggagaucagccacaacccccagaucagacagaacaucguggaccugggcggccugcccaucauggugaacauccuggacagcccccacaagagccugaagugccuggccgccgagaccaucgccaacguggccaaguucaagagagccagaagaguggugagacagcacggcggcaucaccaagcugguggcccugcuggacugcgcccacgacagcaccaagcccgcccagagcagccuguacgaggccagagacguggagguggccagaugcggcgcccuggcccuguggagcugcagcaagagccacaccaacaaggaggccaucagaaaggccggcggcaucccccugcuggccagacugcugaagaccagccacgagaacaugcugauccccguggugggcacccugcaggagugcgccagcgaggagaacuacagagccgccaucaaggccgagagaaucaucgagaaccuggugaagaaccugaacagcgagaacgagcagcugcaggagcacugcgccauggccaucuaccagugcgccgaggacaaggagaccagagaccuggugagacugcacggcggccugaagccccuggccagccugcugaacaacaccgacaacaaggagagacuggccgccgugaccggcgccaucuggaagugcagcaucagcaaggagaacgugaccaaguucagagaguacaaggccaucgagacccuggugggccugcugaccgaccagcccgaggaggugcuggugaacguggugggcgcccugggcgagugcugccaggagagagagaacagagugaucgugagaaagugcggcggcauccagccccuggugaaccugcuggugggcaucaaccaggcccugcuggugaacgugaccaaggccgugggcgccugcgccguggagcccgagagcaugaugaucaucgacagacuggacggcgugagacugcuguggagccugcugaagaacccccaccccgacgugaaggccagcgccgccugggcccugugccccugcaucaagaacgccaaggacgccggcgagauggugagaagcuucgugggcggccuggagcugaucgugaaccugcugaagagcgacaacaaggaggugcuggccagcgugugcgccgccaucaccaacaucgccaaggaccaggagaaccuggccgugaucaccgaccacggcguggugccccugcugagcaagcuggccaacaccaacaacaacaagcugagacaccaccuggccgaggccaucagcagaugcugcauguggggcagaaacagaguggccuucggcgagcacaaggccguggccccccuggugagauaccugaagagcaacgacaccaacgugcacagagccaccgcccaggcccuguaccagcugagcgaggacgccgacaacugcaucaccaugcacgagaacggcgccgugaagaccgagagcagacacguggccagacuggagugcagcgacaacgaccugggcagccugcagccccccccccccggcuucaagagauucagcugccugagccugcugagcagcugggacuacagcuucuacuggaucuggcugggcccccugaccagaaucagcagaaagcugcagcuggugguguaccccaucagcgccggcuggcugcugcugcagagaagacaggacacccuggagaucuaa

SEQ ID NO: 13839 - RNA, 2808 nt, Artificial Sequence
  ARMC5__Homo_sapiens__NP_001098717
auggccgccgccaagcccacccugaccgacagccugagcuucugccuggcccagcuggccgccgccgccggcgaggcccugggcggcgagaaggaccccgccaccaacgagaccccccugagcagagcccugcuggcccugagaaccagacacaucaaggccgccggcggcaucgagagauucagagccagaggcggccugagaccccugcuggcccugcugagaagagccgccgccgccggcagcgcccccagccaggccggccccggcagcgcccccagcagcgccgccagcggcgccagcagccccgcccccgccagcggccccgcccccagcgccgugagcagcagcagccccaccccccccgugagacugagaaagacccuggaccuggcccugagcauccuggccgacugcugcaccgagggcgccugcagaaccgaggugagaagacugggcggcauccugccccuggugaccauccugcagugcaugaagaccgacagcauccagaacagaaccgccagagcccugggcaaccuggccauggagcccgagagcugcggcgacauccacugcgccggcgccgugccccugcugguggagagccugaccgccugccaggacagccagugccugcagagcguggugagagcccugagaaaccuggccgacagcccccagcacagacuggcccuggcccagcagggcgccgugagaccccuggccgagcugcuggccaccgcccccgacgccgcccugacccuggcccuggugagagcccugcuggagcugagcagaggcugcagcagagccugcgccgagcagcugagccugggcggcggccugggcccccuggugagccuggccagccaccccaagagagccgugagagagggcaccauccugauccuggccaaccugugcgcccagggccugaucagacccgcccugggcaacgccggcggcguggaggugcugguggacgagcugagacagagaagagaccccaacggcgccagccccaccagccagcagccccuggugagagccgugugccugcugugcagagaggccaucaacagagccagacugagagacgccggcggccuggaccugcugaugggccugcugagagaccccagagccagcgccuggcaccccagaaucguggccgcccuggugggcuuccuguacgacaccggcgcccugggcagacugcaggcccugggccuggugccccugcuggccggccagcugugcggcgaggccggcgaggaggaggaggagggcagagaggccgccagcugggacuuccccgaggagagaacccccgagagagcccagggcggcagcuucagaagccugagaagcuggcugaucagcgagggcuacgccaccggccccgacgacaucagccccgacuggagccccgagcagugcccccccgagcccauggagcccgccagccccgcccccacccccaccagccugagagcccccagaacccagagaacccccggcagaagccccgccgccgccaucgaggagcccuggggcagagagggccccgcccugcugcugcugagcagauucagccaggcccccgaccccagcggcgcccuggugaccggccccgcccuguacggccugcugaccuacgugaccggcgcccccggcccccccagccccagagcccugagaauccugagcagacugaccugcaaccccgccugccuggaggccuucgugagaagcuacggcgccgcccugcugagagccuggcuggugcugggcguggcccccgacgacuggcccgcccccagagccagacccacccugcacagcagacacagagagcugggcgagagacugcugcagaaccugaccgugcaggccgagagccccuucggcgugggcgcccugacccaccugcugcugagcggcagccccgaggacagaguggccugcgcccugacccugcccuucaucugcagaaagcccagccuguggagaagacugcugcuggagcagggcggccugagacugcugcuggccgcccugaccagacccgccccccacccccuguuccuguucuucgccgccgacagccugagcugccugcaggaccuggugagccccaccgugagccccgccgugccccaggccgugcccauggaccuggacagccccagccccugccuguacgagccccugcugggccccgcccccgugcccgcccccgaccugcacuuccugcuggacagcggccugcagcugcccgcccagagagccgccagcgccaccgccagccccuucuucagagcccugcugagcggcagcuucgccgaggcccagauggaccuggugccccugagaggccugagccccggcgccgccuggcccgugcugcaccaccugcacggcugcagaggcugcggcgccgcccugggccccgugcccccccccggccagccccugcugggcagcgaggccgaggaggcccuggaggccgccggcagauuccugcugcccggccuggaggaggagcuggaggaggccgugggcagaauccaccugggcccccagggcggccccgagagcgugggcgagguguucagacugggcagacccagacuggccgcccacugcgccagauggacccugggcagcgagcagugccccagaaagagaggccuggcccuggugggccugguggaggccgccggcgaggaggccggcccccugaccgaggcccugcuggccguggugaugggcaucgagcugggcgccagagugcccgccuaa

SEQ ID NO: 13840 - RNA, 1929 nt, Artificial Sequence
  ARMC8__Homo_sapiens__NP_001253970
auggccugccugcuggagacccccaucagaaugagcgugcugagcgaggugaccgccagcagcagacacuacguggacagacuguucgaccccgacccccagaaggugcugcagggcgugaucgacaugaagaacgccgugaucggcaacaacaagcagaaggccaaccugaucgugcugggcgccgugcccagacugcuguaccugcugcagcaggagaccagcagcaccgagcugaagaccgagugcgccguggugcugggcagccuggccaugggcaccgagaacaacgugaagagccugcuggacugccacaucauccccgcccugcugcagggccugcugagccccgaccugaaguucaucgaggccugccugagaugccugagaaccaucuucaccagccccgugacccccgaggagcugcuguacaccggccccgaccaccagaccauccuguucaaccacggcgccgugcagaacaucgcccaccugcugaccagccugagcuacaaggugagaaugcaggcccugaagugcuucagcgugcuggccuucgagaacccccaggugagcaugacccuggugaacgugcugguggacggcgagcugcugccccagaucuucgugaagaugcugcagagagacaagcccaucgagaugcagcugaccagcgccaagugccugaccuacaugugcagagccggcgccaucagaaccgacgacaacugcaucgugcugaagacccugcccugccuggugagaaugugcagcaaggagagacugcuggaggagagaguggagggcgccgagacccuggccuaccugaucgagcccgacguggagcugcagagaaucgccagcaucaccgaccaccugaucgccaugcuggccgacuacuucaaguaccccagcagcgugagcgccaucaccgacaucaagagacuggaccacgaccugaagcacgcccacgagcugagacaggccgccuucaagcuguacgccagccugggcgccaacgacgaggacaucagaaagaagaucaucgagaccgagaacaugauggacagaaucgugaccggccugagcgagagcagcgugaaggugagacuggccgccgugagaugccugcacagccugagcagaagcgugcagcagcugagaaccagcuuccaggaccacgccguguggaagccccugaugaaggugcugcagaacgcccccgacgagauccuggugguggccagcagcaugcugugcaaccugcugcuggaguucagccccagcaaggagcccauccuggagagcggcgccguggagcugcugugcggccugacccagagcgagaaccccgcccugagagugaacggcaucugggcccugaugaacauggccuuccaggccgagcagaagaucaaggccgacauccugagaagccugagcaccgagcagcuguucagacugcugagcgacagcgaccugaacgugcugaugaagacccugggccugcugagaaaccugcugagcaccagaccccacaucgacaagaucaugagcacccacggcaagcagaucaugcaggccgugacccugauccuggagggcgagcacaacaucgaggugaaggagcagacccugugcauccuggccaacaucgccgacggcaccaccgccaaggaccugaucaugaccaacgacgacauccugcagaagaucaaguacuacaugggccacagccacgugaagcugcagcuggccgccauguucugcaucagcaaccugaucuggaacgaggaggagggcagccaggagagacaggacaagcugagagacaugggcaucguggacauccugcacaagcugagccagagccccgacagcaaccugugcgacaaggccaagauggcccugcagcaguaccuggccuaa

SEQ ID NO: 13841 - RNA, 2457 nt, Artificial Sequence
  ARMC9__Homo_sapiens__NP_001258395
augggcgacauccuggcccacgagagcgagcugcugggccuggugaaggaguaccuggacuucgccgaguucgaggacacccugaagaccuucagcaaggagugcaagaucaagggcaagccccugugcaagaccgugggcggcagcuucagagacagcaagagccugaccauccagaaggaccugguggccgccuucgacaacggcgaccagaagguguucuucgaccugugggaggagcacaucagcagcagcaucagagacggcgacagcuucgcccagaagcuggaguucuaccugcacauccacuucgccaucuaccugcugaaguacagcgugggcagacccgacaaggaggagcuggacgagaagaucagcuacuucaagaccuaccuggagaccaagggcgccgcccugagccagaccaccgaguuccugcccuucuacgcccugcccuucgugcccaaccccauggugcaccccagcuucaaggagcuguuccaggacagcuggacccccgagcugaagcugaagcuggagaaguuccuggcccugaucagcaaggccagcaacacccccaagcugcugaccaucuacaaggagaacggccagagcaacaaggagauccugcagcagcugcaccagcagcugguggaggccgagagaagaagcgugaccuaccugaagagauacaacaagauccaggccgacuaccacaaccugaucggcgugaccgccgagcugguggacagccuggaggccaccgugagcggcaagaugaucacccccgaguaccugcagagcgugugcgugagacuguucagcaaccagaugagacagagccuggcccacagcguggacuucaccagacccggcaccgccagcaccaugcugagagccagccuggcccccgugaagcugaaggacgugccccugcugcccagccuggacuacgagaagcugaagaaggaccugauccugggcagcgacagacugaaggccuuccugcugcaggcccugagauggagacugaccaccagccaccccggcgagcagagagagaccgugcugcaggccuacaucagcaacgaccugcuggacugcuacagccacaaccagagaagcgugcugcagcugcugcacagcaccagcgacguggugagacaguacauggccagacugaucaacgccuucgccagccuggccgagggcagacuguaccuggcccagaacaccaaggugcugcagaugcuggagggcagacugaaggaggaggacaaggacaucaucaccagagagaacgugcugggcgcccugcagaaguucagccugagaagaccccugcagaccgccaugauccaggacggccugaucuucuggcugguggacgugcugaaggaccccgacugccugagcgacuacacccuggaguacagcguggcccugcugaugaaccugugccugagaagcaccggcaagaacaugugcgccaagguggccggccuggugcugaaggugcugagcgaccugcugggccacgagaaccacgagauccagcccuacgugaacggcgcccuguacagcauccugagcgugcccagcaucagagaggaggccagagccaugggcauggaggacauccugagaugcuucaucaaggagggcaacgccgagaugaucagacagaucgaguucaucaucaagcagcugaacagcgaggagcugcccgacggcgugcuggagagcgacgacgacgaggacgaggacgacgaggaggaccacgacaucauggaggccgaccuggacaaggacgagcugauccagccccagcugggcgagcugagcggcgagaagcugcugaccaccgaguaccugggcaucaugaccaacaccggcaagaccagaagaaagggccuggccaacgugcaguggagcggcgacgagccccugcagagacccgugacccccggcggccacagaaacggcuaccccgugguggaggaccagcacacccccccccagaccgcccagcacgccagaaacggccacccccaggcccugcccgccgcccacgaggccguguacagagagggcaagcccagcacccccgagagcugcgugagcagcagcagcgccaucaucgccaagcccggcgaguggcugcccagaggcagacaggaggagcccagacccgcccccaccggcacccccagacagcccagagaggccccccaggaccccggcaacggcgugaccaccagagagugcgccagcgccuucaccugcaagcccagagcccccugcacccccgagaugcuggacuggaacccccccaaggccaaggccagcgugcuggccccccuguucagcagcugcggcccccagcaggccagcagacccggcagcaccgccagcagcaccagaggccugcccagcagccagagccacagaaaguaa

SEQ ID NO: 13842 - RNA, 1362 nt, Artificial Sequence
  ARMCX1__Homo_sapiens__NP_057692
augggcagaaccagagaggccggcugcguggccgccggcguggugaucggcgccggcgccugcuacugcguguacagacuggccuggggcagagacgagaacgagaagaucugggacgaggacgaggagagcaccgacaccagcgagaucggcguggagaccgugaagggcgccaagaccaacgccggcgccggcagcggcgccaagcugcagggcgacagcgaggugaagcccgaggugagccugggccuggaggacugccccggcgugaaggagaaggcccacagcggcagccacagcggcggcggccuggaggccaaggccaaggcccuguucaacacccugaaggagcaggccagcgccaaggccggcaagggcgccagagugggcaccaucagcggcaacagaacccuggcccccagccugcccugccccggcggcagaggcggcggcugccaccccaccagaagcggcagcagagccggcggcagagccagcggcaagagcaagggcaaggccagaagcaagagcaccagagcccccgccaccaccuggcccgugagaagaggcaaguucaacuuccccuacaagaucgacgacauccugagcgcccccgaccugcagaaggugcugaacauccuggagagaaccaacgaccccuucauccaggagguggcccuggugacccugggcaacaacgccgccuacagcuucaaccagaacgccaucagagagcugggcggcgugcccaucaucgccaagcugaucaagaccaaggaccccaucaucagagagaagaccuacaacgcccugaacaaccugagcgugaacgccgagaaccagggcaagaucaagaccuacaucagccaggugugcgacgacaccauggugugcagacuggacagcgccgugcagauggccggccugagacugcugaccaacaugaccgugaccaaccacuaccagcaccugcugagcuacagcuuccccgacuucuucgcccugcuguuccugggcaaccacuucaccaagauccagaucaugaagcugaucaucaacuucaccgagaaccccgccaugaccagagagcuggugagcugcaaggugcccagcgagcugaucagccuguucaacaaggagugggacagagagauccugcugaacauccugacccuguucgagaacaucaacgacaacaucaagaacgagggccuggccagcagcagaaaggaguucagcagaagcagccuguucuuccuguucaaggagagcggcgugugcgugaagaagaucaaggcccuggccaaccacaacgaccugguggugaaggugaaggugcugaaggugcugaccaagcuguaa

SEQ ID NO: 13843 - RNA, 324 nt, Artificial Sequence
  ARMS2__Homo_sapiens__NP_001093137
augcugagacuguaccccggccccauggugaccgaggccgagggcaagggcggccccgagauggccagccugagcagcagcguggugcccgugagcuucaucagcacccugagagagagcgugcuggaccccggcgugggcggcgagggcgccagcgacaagcagagaagcaagcugagccugagccacagcaugauccccgccgccaagauccacaccgagcugugccugcccgccuucuucagccccgccggcacccagagaagauuccagcagccccagcaccaccugacccugagcaucauccacaccgccgccagauaa

SEQ ID NO: 13844 - RNA, 969 nt, Artificial Sequence
  ARMT1__Homo_sapiens__NP_001273491
auguacagaagaauccacgaggccaucauccagagcccccccaucgacuacuucgacguguucaaggagagcaaggagcagaacuucuacggcagccaggagagcaucaucgcccugugcacccaccugcagcagcugaucagaaccaucgaggaccuggacgagaaccagcugaaggacgaguucuucaagcugcugcagaucagccuguggggcaacaagugcgaccugagccugagcggcggcgagagcagcagccagaacaccaacgugcugaacagccuggaggaccugaagcccuucauccugcugaacgacauggagcaccuguggagccugcugagcaacugcaagaagaccagagagaaggccagcgccaccagaguguacaucgugcuggacaacagcggcuucgagcuggugaccgaccugauccuggccgacuuccugcugagcagcgagcuggccaccgaggugcacuucuacggcaagaccauccccugguucgugagcgacaccaccauccacgacuucaacuggcugaucgagcaggugaagcacagcaaccacaaguggaugagcaagugcggcgccgacugggaggaguacaucaagaugggcaaguggguguaccacaaccacaucuucuggacccugccccacgaguacugcgccaugccccagguggcccccgaccuguacgccgagcugcagaaggcccaccugauccuguucaagggcgaccugaacuacagaaagcugaccggcgacagaaagugggaguucagcgugcccuuccaccaggcccugaacggcuuccaccccgccccccugugcaccaucagaacccugaaggccgagauccaggugggccugcagcccggccagggcgagcagcugcuggccagcgagcccagcugguggaccaccggcaaguacggcaucuuccaguacgacggcccccuguaa

SEQ ID NO: 13845 - RNA, 2154 nt, Artificial Sequence
  ARNT2__Homo_sapiens__NP_055677
auggccacccccgccgccgugaacccccccgagauggccagcgacauccccggcagcgugacccugcccguggcccccauggccgccaccggccaggugagaauggccggcgccaugcccgccagaggcggcaagagaagaagcggcauggacuucgacgacgaggacggcgagggccccagcaaguucagcagagagaaccacagcgagaucgagagaagaagaagaaacaagaugacccaguacaucaccgagcugagcgacauggugcccaccugcagcgcccuggccagaaagcccgacaagcugaccauccugagaauggccgugagccacaugaagagcaugagaggcaccggcaacaagagcaccgacggcgccuacaagcccagcuuccugaccgagcaggagcugaagcaccugauccuggaggccgccgacggcuuccuguucgugguggccgccgagaccggcagagugaucuacgugagcgacagcgugacccccgugcugaaccagccccagagcgagugguucggcagcacccuguacgagcaggugcaccccgacgacguggagaagcugagagagcagcugugcaccagcgagaacagcaugaccggcagaauccuggaccugaagaccggcaccgugaagaaggagggccagcagagcagcaugagaaugugcaugggcagcagaagaagcuucaucugcagaaugagaugcggcaacgccccccuggaccaccugccccugaacagaaucaccaccaugagaaagagauucagaaacggccugggccccgugaaggagggcgaggcccaguacgccguggugcacugcaccggcuacaucaaggccuggccccccgccggcaugaccauccccgaggaggacgccgacgugggccagggcagcaaguacugccugguggccaucggcagacugcaggugaccagcagccccgugugcauggacaugaacggcaugagcgugcccaccgaguuccugagcagacacaacagcgacggcaucaucaccuucguggaccccagaugcaucagcgugaucggcuaccagccccaggaccugcugggcaaggacauccuggaguucugccaccccgaggaccagagccaccugagagagagcuuccagcagguggugaagcugaagggccaggugcugagcgugauguacagauucagaaccaagaacagagaguggaugcugaucagaaccagcagcuucaccuuccagaaccccuacagcgacgagaucgaguacaucaucugcaccaacaccaacgugaagcagcugcagcagcagcaggccgagcuggaggugcaccagagagacggccugagcagcuacgaccugagccaggugcccgugcccaaccugcccgccggcgugcacgaggccggcaagagcguggagaaggccgacgccaucuucagccaggagagagaccccagauucgccgagauguucgccggcaucagcgccagcgagaagaagaugaugagcagcgccagcgccgccggcacccagcagaucuacagccagggcagccccuuccccagcggccacagcggcaaggccuucagcagcagcguggugcacgugcccggcgugaacgacauccagagcagcagcagcaccggccagaacaugagccagaucagcagacagcugaaccagagccagguggccuggaccggcagcagaccccccuuccccggccagcagauccccagccagagcagcaagacccagagcagccccuucggcaucggcaccagccacaccuaccccgccgaccccagcagcuacagcccccugagcagccccgccaccagcagccccagcggcaacgccuacagcagccuggccaacagaacccccggcuucgccgagagcggccagagcagcggccaguuccagggcagacccagcgagguguggagccaguggcagagccagcaccacggccagcagagcggcgagcagcacagccaccagcagcccggccagaccgagguguuccaggacaugcugcccaugcccggcgaccccacccagggcaccggcaacuacaacaucgaggacuucgccgaccugggcauguucccccccuucagcgaguaa

SEQ ID NO: 13846 - RNA, 2319 nt, Artificial Sequence
  ARNT__Homo_sapiens__XP_011507849
auguaccaccacugggugcagccccugccccuggagacccuggaccuggaguucaagguggaggagccccugagcagaggccugcugagcggcgaccaggccggccugaaguaccugcugcuggccuuccugagacuggacuucgacgacgacggcgagggcaacagcaaguuccugagaugcgacgacgaccagaugagcaacgacaaggagagauucgccagagagaaccacagcgagaucgagagaagaagaagaaacaagaugaccgccuacaucaccgagcugagcgacauggugcccaccugcagcgcccuggccagaaagcccgacaagcugaccauccugagaauggccgugagccacaugaagagccugagaggcaccggcaacaccagcaccgacggcagcuacaagcccagcuuccugaccgaccaggagcugaagcaccugauccuggaggccgccgacggcuuccuguucaucgugagcugcgagaccggcagagugguguacgugagcgacagcgugacccccgugcugaaccagccccagagcgagugguucggcagcacccuguacgaccaggugcaccccgacgacguggacaagcugagagagcagcugagcaccagcgagaacgcccugaccggcagaauccuggaccugaagaccggcaccgugaagaaggagggccagcagagcagcaugagaaugugcaugggcagcagaagaagcuucaucugcagaaugagaugcggcagcagcagcguggaccccgugagcgugaacagacugagcuucgugagaaacagaugcagaaacggccugggcagcgugaaggacggcgagccccacuucgugguggugcacugcaccggcuacaucaaggccuggccccccgccggcgugagccugcccgacgacgaccccgaggccggccagggcagcaaguucugccugguggccaucggcagacugcaggugaccagcagccccaacugcaccgacaugagcaacgugugccagcccaccgaguucaucagcagacacaacaucgagggcaucuucaccuucguggaccacagaugcguggccaccgugggcuaccagccccaggagcugcugggcaagaacaucguggaguucugccaccccgaggaccagcagcugcugagagacagcuuccagcagguggugaagcugaagggccaggugcugagcgugauguucagauucagaagcaagaaccaggaguggcuguggaugagaaccagcagcuucaccuuccagaaccccuacagcgacgagaucgaguacaucaucugcaccaacaccaacgugaagaacagcagccaggagcccagacccacccugagcaacaccauccagagaccccagcugggccccaccgccaaccugccccuggagaugggcagcggccagcuggcccccagacagcagcagcagcagaccgagcuggacauggugcccggcagagacggccuggccagcuacaaccacagccagguggugcagcccgugaccaccaccggccccgagcacagcaagccccuggagaagagcgacggccuguucgcccaggacagagaccccagauucagcgagaucuaccacaacaucaacgccgaccagagcaagggcaucagcagcagcaccgugcccgccacccagcagcuguucagccagggcaacaccuucccccccacccccagacccgccgagaacuucagaaacagcggccuggccccccccgugaccaucgugcagcccagcgccagcgccggccagaugcuggcccagaucagcagacacagcaaccccacccagggcgccacccccaccuggacccccaccaccagaagcggcuucagcgcccagguggccacccaggccaccgccaagaccagaaccagccaguucggcgugggcagcuuccagacccccagcagcuucagcagcaugagccugcccggcgcccccaccgccagccccggcgccgccgccuaccccagccugaccaacagaggcagcaacuucgcccccgagaccggccagaccgccggccaguuccagaccagaaccgccgagggcgugggcguguggccccaguggcagggccagcagccccaccacagaagcagcagcagcgagcagcacgugcagcagccccccgcccagcagcccggccagcccgagguguuccaggagaugcugagcaugcugggcgaccagagcaacagcuacaacaacgaggaguuccccgaccugaccauguucccccccuucagcgaguaa

SEQ ID NO: 13847 - RNA, 1869 nt, Artificial Sequence
  ARNTL2__Homo_sapiens__NP_001234931
auggccgccgaggaggaggccgccgccggcggcaaggugcugagagaggagaaccagugcaucgcccccguggugagcagcagagugagccccggcaccagacccaccgccaugggcagcuucagcagccacaugaccgaguuccccagaaagagaaagggcagcgacagcgaccccagccagagcggcaucaugaccgagaaggugguggagaagcugagccagaacccccugaccuaccugcugagcaccagaaucgagaucagcgccagcagcggcagcagagaggcccacagccagaccgagaagagaagaagagacaagaugaacaaccugaucgaggagcugagcgccaugaucccccagugcaaccccauggccagaaagcuggacaagcugaccgugcugagaauggccgugcagcaccugagaagccugaagggccugaccaacagcuacgugggcagcaacuacagacccagcuuccugcaggacaacgagcugagacaccugauccugaagaccgccgagggcuuccuguucguggugggcugcgagagaggcaagauccuguucgugagcaagagcgugagcaagauccugaacuacgaccaggccagccugaccggccagagccuguucgacuuccugcaccccaaggacguggccaaggugaaggagcagcugagcagcuucgacaucagccccagagagaagcugaucgacgccaagaccggccugcaggugcacagcaaccugcacgccggcagaaccagaguguacagcggcagcagaagaagcuucuucugcagaaucaagagcugcaagaucagcgugaaggaggagcacggcugccugcccaacagcaagaagaaggagcacagaaaguucuacaccauccacugcaccggcuaccugagaagcuggccccccaacaucgugggcauggaggaggagagaaacagcaagaaggacaacagcaacuucaccugccugguggccaucggcagacugcagcccuacaucgugccccagaacagcggcgagaucaacgugaagcccaccgaguucaucaccagauucgccgugaacggcaaguucguguacguggaccagagagccaccgccauccugggcuaccugccccaggagcugcugggcaccagcugcuacgaguacuuccaccaggacgaccacaacaaccugaccgacaagcacaaggccgugcugcagagcaaggagaagauccugaccgacagcuacaaguucagagccaaggacggcagcuucgugacccugaagagccagugguucagcuucaccaaccccuggaccaaggagcuggaguacaucgugagcgugaacacccuggugcugggccacagcgagcccggcgaggccagcuuccugcccugcagcagccagagcagcgaggagagcagcagacagagcugcaugagcgugcccggcaugagcaccggcaccgugcugggcgccggcagcaucggcaccgacaucgccaacgagauccuggaccugcagagacugcagagcagcagcuaccuggacgacagcagccccaccggccugaugaaggacacccacaccgugaacugcagaagcaugagcaacaaggagcuguucccccccagccccagcgagaugggcgagcuggaggccaccagacagaaccagagcaccguggccgugcacagccacgagccccugcugagcgacggcgcccagcuggacuucgacgcccugugcgacaacgacgacaccgccauggccgccuucaugaacuaccuggaggccgagggcggccugggcgaccccggcgacuucagcgacauccaguggacccuguaa

SEQ ID NO: 13848 - RNA, 1878 nt, Artificial Sequence
  ARNTL__Homo_sapiens__NP_001025443
auggccgaccagagaauggacaucagcagcaccaucagcgacuucaugagccccggccccaccgaccugcugagcagcagccugggcaccagcggcguggacugcaacagaaagagaaagggcagcagcaccgacuaccaggagagcauggacaccgacaaggacgacccccacggcagacuggaguacaccgagcaccagggcagaaucaagaacgccagagaggcccacagccagaucgagaagagaagaagagacaagaugaacagcuucaucgacgagcuggccagccuggugcccaccugcaacgccaugagcagaaagcuggacaagcugaccgugcugagaauggccgugcagcacaugaagacccugagaggcgccaccaaccccuacaccgaggccaacuacaagcccaccuuccugagcgacgacgagcugaagcaccugauccugagagccgccgacggcuuccuguucguggugggcugcgacagaggcaagauccuguucgugagcgagagcguguucaagauccugaacuacagccagaacgaccugaucggccagagccuguucgacuaccugcaccccaaggacaucgccaaggugaaggagcagcugagcagcagcgacaccgcccccagagagagacugaucgacgccaagaccggccugcccgugaagaccgacaucacccccggccccagcagacugugcagcggcgccagaagaagcuucuucugcagaaugaagugcaacagacccagcgugaagguggaggacaaggacuuccccagcaccugcagcaagaagaaggacagaaagagcuucugcaccauccacagcaccggcuaccugaagagcuggccccccaccaagaugggccuggacgaggacaacgagcccgacaacgagggcugcaaccugagcugccugguggccaucggcagacugcacagccacguggugccccagcccgugaacggcgagaucagagugaagagcauggaguacgugagcagacacgccaucgacggcaaguucguguucguggaccagagagccaccgccauccuggccuaccugccccaggagcugcugggcaccagcugcuacgaguacuuccaccaggacgacaucggccaccuggccgagugccacagacaggugcugcagaccagagagaagaucaccaccaacugcuacaaguucaagaucaaggacggcagcuucaucacccugagaagcagaugguucagcuucaugaaccccuggaccaaggagguggaguacaucgugagcaccaacaccguggugcuggccaacgugcuggagggcggcgaccccaccuucccccagcugaccgccagcccccacagcauggacagcaugcugcccagcggcgagggcggccccaagagaacccaccccaccgugcccggcauccccggcggcaccagagccggcgccggcaagaucggcagaaugaucgccgaggagaucauggagauccacagaaucagaggcagcagccccagcagcugcggcagcagcccccugaacaucaccagcacccccccccccgacgccagcagccccggcggcaagaagauccugaacggcggcacccccgacauccccagcagcggccugcugagcggccaggcccaggagaaccccggcuaccccuacagcgacagcagcagcauccugggcgagaacccccacaucggcaucgacaugaucgacaacgaccagggcagcagcagccccagcaacgacgaggccgccauggccgugaucaugagccugcuggaggccgacgccggccugggcggccccguggacuucagcgaccugcccuggccccuguaa

SEQ ID NO: 13849 - RNA, 1071 nt, Artificial Sequence
  ARPC1A__Homo_sapiens__NP_001177925
augcccggcaccggcaucgugcugaucgcccugagccccaacaaccacgaggugcacaucuacaagaagaacggcagccagugggugaaggcccacgagcugaaggagcacaacggccacaucaccggcaucgacugggcccccaagagcgacagaaucgugaccugcggcgccgacagaaacgccuacguguggagccagaaggacggcguguggaagcccacccuggugauccugagaaucaacagagccgccaccuucgugaaguggagcccccuggagaacaaguucgccgugggcagcggcgccagacugaucagcgugugcuacuucgagagcgagaacgacuggugggugagcaagcacaucaagaagcccaucagaagcaccgugcugagccuggacuggcaccccaacaacgugcugcuggccgccggcagcugcgacuucaagugcagaguguucagcgccuacaucaaggagguggacgagaagcccgccagcacccccuggggcagcaagaugcccuucggccagcugaugagcgaguucggcggcagcggcaccggcggcugggugcacggcgugagcuucagcgccagcggcagcagacuggccugggugagccacgacagcaccgugagcguggccgacgccagcaagagcgugcaggugagcacccugaagaccgaguuccugccccugcugagcgugagcuucgugagcgagaacagcgugguggccgccggccacgacugcugccccaugcuguucaacuacgacgacagaggcugccugaccuucgugagcaagcuggacauccccaagcagagcauccagagaaacaugagcgccauggagagauucagaaacauggacaagagagccaccaccgaggacagaaacaccgcccuggagacccugcaccagaacagcaucacccaggugagcaucuacgagguggacaagcaggacugcagaaaguucugcaccaccggcaucgacggcgccaugaccaucugggacuucaagacccuggagagcagcauccagggccugagaaucauguaa

SEQ ID NO: 13850 - RNA, 1119 nt, Artificial Sequence
  ARPC1B__Homo_sapiens__NP_005711
auggccuaccacagcuuccugguggagcccaucagcugccacgccuggaacaaggacagaacccagaucgccaucugccccaacaaccacgaggugcacaucuacgagaagagcggcgccaaguggaccaaggugcacgagcugaaggagcacaacggccaggugaccggcaucgacugggcccccgagagcaacagaaucgugaccugcggcaccgacagaaacgccuacguguggacccugaagggcagaaccuggaagcccacccuggugauccugagaaucaacagagccgccagaugcgugagaugggcccccaacgagaacaaguucgccgugggcagcggcagcagagugaucagcaucugcuacuucgagcaggagaacgacuggugggugugcaagcacaucaagaagcccaucagaagcaccgugcugagccuggacuggcaccccaacaacgugcugcuggccgccggcagcugcgacuucaagugcagaaucuucagcgccuacaucaaggagguggaggagagacccgcccccacccccuggggcagcaagaugcccuucggcgagcugauguucgagagcagcagcagcugcggcugggugcacggcgugugcuucagcgccagcggcagcagaguggccugggugagccacgacagcaccgugugccuggccgacgccgacaagaagauggccguggccacccuggccagcgagacccugccccugcuggcccugaccuucaucaccgacaacagccugguggccgccggccacgacugcuuccccgugcuguucaccuacgacgccgccgccggcaugcugagcuucggcggcagacuggacgugcccaagcagagcagccagagaggccugaccgccagagagagauuccagaaccuggacaagaaggccagcagcgagggcggcaccgccgccggcgccggccuggacagccugcacaagaacagcgugagccagaucagcgugcugagcggcggcaaggccaagugcagccaguucugcaccaccggcauggacggcggcaugagcaucugggacgugaagagccuggagagcgcccugaaggaccugaagaucaaguaa

SEQ ID NO: 13851 - RNA, 903 nt, Artificial Sequence
  ARPC2__Homo_sapiens__NP_005722
augauccugcuggaggugaacaacagaaucaucgaggagacccuggcccugaaguucgagaacgccgccgccggcaacaagcccgaggccguggaggugaccuucgccgacuucgacggcgugcuguaccacaucagcaaccccaacggcgacaagaccaaggugauggugagcaucagccugaaguucuacaaggagcugcaggcccacggcgccgacgagcugcugaagagaguguacggcagcuuccuggugaaccccgagagcggcuacaacgugagccugcuguacgaccuggagaaccugcccgccagcaaggacagcaucgugcaccaggccggcaugcugaagagaaacugcuucgccagcguguucgagaaguacuuccaguuccaggaggagggcaaggagggcgagaacagagccgugauccacuacagagacgacgagaccauguacguggagagcaagaaggacagagugaccgugguguucagcaccguguucaaggacgacgacgacguggugaucggcaagguguucaugcaggaguucaaggagggcagaagagccagccacaccgccccccaggugcuguucagccacagagagcccccccuggagcugaaggacaccgacgccgccgugggcgacaacaucggcuacaucaccuucgugcuguuccccagacacaccaacgccagcgccagagacaacaccaucaaccugauccacaccuucagagacuaccugcacuaccacaucaagugcagcaaggccuacauccacaccagaaugagagccaagaccagcgacuuccugaaggugcugaacagagccagacccgacgccgagaagaaggagaugaagaccaucaccggcaagaccuucagcagcagauaa

SEQ ID NO: 13852 - RNA, 537 nt, Artificial Sequence
  ARPC3__Homo_sapiens__NP_001265485
augcccgccuaccacagcagccugauggaccccgacaccaagcugaucggcaacauggcccugcugcccaucagaagccaguucaagggccccgcccccagagagaccaaggacaccgacaucguggacgaggccaucuacuacuucaaggccaacguguucuucaagaacuacgagaucaagaacgaggccgacagaacccugaucuacaucacccuguacaucagcgagugccugaagaagcugcagaagugcaacagcaagagccagggcgagaaggagauguacacccugggcaucaccaacuuccccauccccggcgagcccggcuucccccugaacgccaucuacgccaagcccgccaacaagcaggaggacgaggugaugagagccuaccugcagcagcugagacaggagaccggccugagacugugcgagaagguguucgacccccagaacgacaagcccagcaagugguggaccugcuucgugaagagacaguucaugaacaagagccugagcggccccggccaguaa

SEQ ID NO: 13853 - RNA, 465 nt, Artificial Sequence
  ARPC5__Homo_sapiens__NP_001257368
augagcaagaacaccgugagcagcgccagauucagaaagguggacguggacgaguacgacgagaacaaguucguggacgaggaggacggcggcgacggccaggccggccccgacgagggcgagguggacagcugccugagacacagcaucaccggcaacaugaccgccgcccugcaggccgcccugaagaacccccccaucaacaccaagagccaggccgugaaggacagagccggcagcaucgugcugaaggugcugaucagcuucaaggccaacgacaucgagaaggccgugcagagccuggacaagaacggcguggaccugcugaugaaguacaucuacaagggcuucgagagccccagcgacaacagcagcgccaugcugcugcaguggcacgagaaggcccuggccgccggcggcgugggcagcaucgugagagugcugaccgccagaaagaccguguaa

SEQ ID NO: 13854 - RNA, 681 nt, Artificial Sequence
  ARPIN__Homo_sapiens__NP_872422
augagcagaaucuaccacgacggcgcccugagaaacaaggccgugcagagcgugagacugcccggcgccugggaccccgccgcccaccagggcggcaacggcgugcugcuggagggcgagcugaucgacgugagcagacacagcauccuggacacccacggcagaaaggagagauacuacgugcuguacaucagacccagccacauccacagaagaaaguucgacgccaagggcaacgagaucgagcccaacuucagcgccaccagaaaggugaacaccggcuuccugaugagcagcuacaagguggaggccaagggcgacaccgacagacugacccccgaggcccugaagggccuggugaacaagcccgagcugcuggcccugaccgagagccugacccccgaccacaccguggccuucuggaugcccgagagcgagauggaggugauggagcuggagcugggcgccggcgugagacugaagaccagaggcgacggccccuuccuggacagccuggccaagcuggaggccggcaccgugaccaagugcaacuucaccggcgacggcaagaccggcgccagcuggaccgacaacaucauggcccagaagugcagcaagggcgccgccgccgagaucagagagcagggcgacggcgccgaggacgaggagugggacgacuaa

SEQ ID NO: 13855 - RNA, 270 nt, Artificial Sequence
  ARPP21__Homo_sapiens__NP_001020240
augagcgagcagggcgaccugaaccaggccaucgccgaggagggcggcaccgagcaggagaccgccacccccgagaacggcaucgugaagagcgagagccuggacgaggaggagaagcuggagcugcagagaagacuggaggcccagaaccaggagagaagaaagagcaagagcggcgccggcaagggcaagcugaccagaagccuggccgugugcgaggagagcagcgccagacccggcggcgagagccugcaggaccagacccuguaa

SEQ ID NO: 13856 - RNA, 1167 nt, Artificial Sequence
  ARR3__Homo_sapiens__NP_004303
augagcaagguguucaagaagaccagcagcaacggcaagcugagcaucuaccugggcaagagagacuucguggaccacguggacaccguggagcccaucgacggcguggugcugguggaccccgaguaccugaagugcagaaagcuguucgugaugcugaccugcgccuucagauacggcagagacgaccuggaggugaucggccugaccuucagaaaggaccuguacgugcagacccugcagguggugcccgccgagagcagcagcccccagggcccccugaccgugcugcaggagagacugcugcacaagcugggcgacaacgccuaccccuucacccugcagauggugaccaaccugcccugcagcgugacccugcagcccggccccgaggacgccggcaagcccugcggcaucgacuucgaggugaagagcuucugcgccgagaaccccgaggagaccgugagcaagagagacuacgugagacugguggugagaaaggugcaguucgccccccccgaggccggccccggccccagcgcccagaccaucagaagauuccugcugagcgcccagccccugcagcugcaggccuggauggacagagaggugcacuaccacggcgagcccaucagcgugaacgugagcaucaacaacugcaccaacaaggugaucaagaagaucaagaucagcguggaccagaucaccgacguggugcuguacagccuggacaaguacaccaagaccguguucauccaggaguucaccgagaccguggccgccaacagcagcuucagccagagcuucgccgugacccccauccuggccgccagcugccagaagagaggccuggcccuggacggcaagcugaagcacgaggacaccaaccuggccagcagcaccaucaucagacccggcauggacaaggagcugcugggcauccuggugagcuacaaggugagagugaaccugauggugagcugcggcggcauccugggcgaccugaccgccagcgacgugggcguggagcugccccuggugcugauccaccccaagcccagccacgaggccgccagcagcgaggacaucgugaucgaggaguucaccagaaagggcgaggaggagagccagaaggccguggaggccgagggcgacgagggcagcuaa

SEQ ID NO: 13857 - RNA, 1257 nt, Artificial Sequence
  ARRB1__Homo_sapiens__NP_004032
augggcgacaagggcaccagaguguucaagaaggccagccccaacggcaagcugaccguguaccugggcaagagagacuucguggaccacaucgaccugguggaccccguggacggcguggugcugguggaccccgaguaccugaaggagagaagaguguacgugacccugaccugcgccuucagauacggcagagaggaccuggacgugcugggccugaccuucagaaaggaccuguucguggccaacgugcagagcuucccccccgcccccgaggacaagaagccccugaccagacugcaggagagacugaucaagaagcugggcgagcacgccuaccccuucaccuucgagaucccccccaaccugcccugcagcgugacccugcagcccggccccgaggacaccggcaaggccugcggcguggacuacgaggugaaggccuucugcgccgagaaccuggaggagaagauccacaagagaaacagcgugagacuggugaucagaaaggugcaguacgcccccgagagacccggcccccagcccaccgccgagaccaccagacaguuccugaugagcgacaagccccugcaccuggaggccagccuggacaaggagaucuacuaccacggcgagcccaucagcgugaacgugcacgugaccaacaacaccaacaagaccgugaagaagaucaagaucagcgugagacaguacgccgacaucugccuguucaacaccgcccaguacaagugccccguggccauggaggaggccgacgacaccguggcccccagcagcaccuucugcaagguguacacccugacccccuuccuggccaacaacagagagaagagaggccuggcccuggacggcaagcugaagcacgaggacaccaaccuggccagcagcacccugcugagagagggcgccaacagagagauccugggcaucaucgugagcuacaaggugaaggugaagcugguggugagcagaggcggccugcugggcgaccuggccagcagcgacguggccguggagcugcccuucacccugaugcaccccaagcccaaggaggagcccccccacagagaggugcccgagaacgagacccccguggacaccaaccugaucgagcuggacaccaacgacgacgacaucguguucgaggacuucgccagacagagacugaagggcaugaaggacgacaaggaggaggaggaggacggcaccggcagcccccagcugaacaacagauaa

SEQ ID NO: 13858 - RNA, 993 nt, Artificial Sequence
  ARRB2__Homo_sapiens__NP_001244258
augggcgagaagcccggcaccagaguguucaagaagagcagccccaacugcaagcugaccguguaccugggcaagagagacuucguggaccaccuggacaagguggaccccguggacggcguggugcugguggaccccgacuaccugaaggacagaaagguguucgugacccugaccugcgccuucagauacggcagagaggaccuggacgugcugggccugagcuucagaaaggaccuguucaucgccaccuaccaggccuucccccccgugcccaacccccccagaccccccaccagacugcaggacagacugcugagaaagcugggccagcacgcccaccccuucuucuucaccaucccccagaaccugcccugcagcgugacccugcagcccggccccgaggacaccggcaaggccugcggcguggacuucgagaucagagccuucugcgccaagagccuggaggagaagagccacaagagaaacagcgugagacuggugaucagaaaggugcaguucgcccccgagaagcccggcccccagcccagcgccgagaccaccagacacuuccugaugagcgacagaagccugcaccuggaggccagccuggacaaggagcuguacuaccacggcgagccccugaacgugaacgugcacgugaccaacaacagcaccaagaccgugaagaagaucaaggugagcgugagacaguacgccgacaucugccuguucagcaccgcccaguacaagugccccguggcccagcuggagcaggacgaccagagagagggcggcugccagcagggcggcgccggcaaccccggcgugcugcagggccagggcgaggccggcggcgugagcagaagaggcugccugugcggcgccgccuucugcagcuacgccccccaggcccccagaccccacccccccccccagacccccgugagcagaagcggcgacagaugccccugcggccaccagccccacuaa

SEQ ID NO: 13859 - RNA, 1209 nt, Artificial Sequence
  ARRDC2__Homo_sapiens__NP_001020775
augagaagcggcggcgugagaagcuucgcccuggagcuggccagaggccccggcggcgccuacagaggcggcgagagacugugcggcagagugcugcuggaggccgccgccccccugagagugagagcccuggaggugaaggccagaggcggcgccgccacccacuggcuggagggcagaagcgugggcgugaacgccgugagcagcgacuacgccgccgccgagaccuaccugagaagaagacagcugcugcugagagacaccggcgagaccaccacccugccccccggcagacacgaguuccuguucagcuuccagcugccccccacccuggugaccagcuucgagggcaagcacggcagcgugagauacugcaucaaggccacccugcacagacccugggugcccgccagaagagccagaaagguguucaccgugaucgagcccguggacaucaacacccccgcccugcuggccccccaggccggcgccagagagaagguggccagaagcugguacugcaacagaggccuggugagccugagcgccaagaucgacagaaagggcuacacccccggcgaggugauccccguguucgccgagaucgacaacggcagcaccagacccgugcugcccagagccgccguggugcagacccagaccuucauggccagaggcgccagaaagcagaagagagccgugguggccagccuggccggcgagcccgugggccccggccagagagcccuguggcagggcagagcccugagaaucccccccgugggccccagcauccugcacugcagagugcugcacguggacuacgcccugaaggugugcguggacauccccggcaccagcaagcugcugcuggagcugccccuggugaucggcaccaucccccugcaccccuucggcagcagaagcagcagcgugggcagccacgccagcuuccugcuggacuggagacugggcgcccugcccgagagacccgaggccccccccgaguacagcgaggugguggccgacaccgaggaggccgcccugggccagagccccuucccccugccccaggaccccgacaugagccuggagggccccuucuucgccuacauccaggaguucagauacagaccccccccccuguacagcgaggaggaccccaacccccugcugggcgacaugagacccagaugcaugaccugcuaa

SEQ ID NO: 13860 - RNA, 1245 nt, Artificial Sequence
  ARRDC3__Homo_sapiens__NP_065852
auggugcugggcaaggugaagagccugaccaucagcuucgacugccugaacgacagcaacgugcccguguacagcagcggcgacaccgugagcggcagagugaaccuggaggugaccggcgagaucagagugaagagccugaagauccacgccagaggccacgccaaggugagauggaccgagagcagaaacgccggcagcaacaccgccuacacccagaacuacaccgaggagguggaguacuucaaccacaaggacauccugaucggccacgagagagacgacgacaacagcgaggagggcuuccacaccauccacagcggcagacacgaguacgccuucagcuucgagcugccccagaccccccuggccaccagcuucgagggcagacacggcagcgugagauacugggugaaggccgagcugcacagacccuggcugcugcccgugaagcugaagaaggaguucaccguguucgagcacaucgacaucaacacccccagccugcugagcccccaggccggcaccaaggagaagacccugugcugcugguucugcaccagcggccccaucagccugagcgccaagaucgagagaaagggcuacacccccggcgagagcauccagaucuucgccgagaucgagaacugcagcagcagaaugguggugcccaaggccgccaucuaccagacccaggccuucuacgccaagggcaagaugaaggaggugaagcagcugguggccaaccugagaggcgagagccugagcagcggcaagaccgagaccuggaacggcaagcugcugaagaucccccccgugagccccagcauccuggacugcagcaucaucagaguggaguacagccugaugguguacguggacauccccggcgccauggaccuguuccugaaccugccccuggugaucggcaccaucccccugcaccccuucggcagcagaaccagcagcgugagcagccagugcagcaugaacaugaacuggcugagccugagccugcccgagagacccgaggccccccccagcuacgccgagguggugaccgaggagcagagaagaaacaaccuggcccccgugagcgccugcgacgacuucgagagagcccugcagggcccccuguucgccuacauccaggaguucagauuccugccccccccccuguacagcgagaucgaccccaaccccgaccagagcgccgacgacagacccagcugccccagcagauaa

SEQ ID NO: 13861 - RNA, 1257 nt, Artificial Sequence
  ARRDC4__Homo_sapiens__NP_899232
augggcggcgaggccggcugcgccgccgccgugggcgccgagggcagagugaagagccugggccugguguucgaggacgagagaaagggcugcuacagcagcggcgagaccguggccggccacgugcugcuggaggccagcgagcccguggcccugagagcccugagacuggaggcccagggcagagccaccgccgccuggggccccagcaccugccccagagccagcgccagcaccgccgcccuggccguguucagcgagguggaguaccugaacgugagacugagccugagagagccccccgccggcgagggcaucauccugcugcagcccggcaagcacgaguuccccuucagauuccagcugcccagcgagccccuggugaccagcuucaccggcaaguacggcagcauccaguacugcgugagagccgugcuggagagacccaaggugcccgaccagagcgugaagagagagcugcagguggugagccacguggacgugaacacccccgcccugcugacccccgugcugaagacccaggagaagauggugggcugcugguucuucaccagcggccccgugagccugagcgccaagaucgagagaaagggcuacugcaacggcgaggccauccccaucuacgccgagaucgagaacugcagcagcagacugaucgugcccaaggccgccaucuuccagacccagaccuaccuggccagcggcaagaccaagaccaucagacacaugguggccaacgugagaggcaaccacaucgccagcggcagcaccgacaccuggaacggcaagacccugaagaucccccccgugacccccagcauccuggacugcugcaucaucagaguggacuacagccuggccguguacauccacauccccggcgccaagaagcugaugcuggagcugccccuggugaucggcaccauccccuacaacggcuucggcagcagaaacagcagcaucgccagccaguucagcauggacaugagcuggcugacccugacccugcccgagcagcccgaggccccccccaacuacgccgacguggugagcgaggaggaguucagcagacacaucccccccuacccccagccccccaacugcgagggcgaggugugcugccccguguucgccugcauccaggaguucagauuccagccccccccccuguacagcgagguggacccccaccccagcgacguggaggagagccagcccgugagcuucauccuguaa

SEQ ID NO: 13862 - RNA, 1530 nt, Artificial Sequence
  ARSA__Homo_sapiens__NP_001078895
augagcaugggcgcccccagaagccugcugcuggcccuggccgccggccuggccguggccagaccccccaacaucgugcugaucuucgccgacgaccugggcuacggcgaccugggcugcuacggccaccccagcagcaccacccccaaccuggaccagcuggccgccggcggccugagauucaccgacuucuacgugcccgugagccugugcacccccagcagagccgcccugcugaccggcagacugcccgugagaaugggcauguaccccggcgugcuggugcccagcagcagaggcggccugccccuggaggaggugaccguggccgaggugcuggccgccagaggcuaccugaccggcauggccggcaaguggcaccugggcgugggccccgagggcgccuuccugcccccccaccagggcuuccacagauuccugggcauccccuacagccacgaccagggccccugccagaaccugaccugcuucccccccgccacccccugcgacggcggcugcgaccagggccuggugcccaucccccugcuggccaaccugagcguggaggcccagccccccuggcugcccggccuggaggccagauacauggccuucgcccacgaccugauggccgacgcccagagacaggacagacccuucuuccuguacuacgccagccaccacacccacuacccccaguucagcggccagagcuucgccgagagaagcggcagaggccccuucggcgacagccugauggagcuggacgccgccgugggcacccugaugaccgccaucggcgaccugggccugcuggaggagacccuggugaucuucaccgccgacaacggccccgagaccaugagaaugagcagaggcggcugcagcggccugcugagaugcggcaagggcaccaccuacgagggcggcgugagagagcccgcccuggccuucuggcccggccacaucgcccccggcgugacccacgagcuggccagcagccuggaccugcugcccacccuggccgcccuggccggcgccccccugcccaacgugacccuggacggcuucgaccugagcccccugcugcugggcaccggcaagagccccagacagagccuguucuucuaccccagcuaccccgacgaggugagaggcguguucgccgugagaaccggcaaguacaaggcccacuucuucacccagggcagcgcccacagcgacaccaccgccgaccccgccugccacgccagcagcagccugaccgcccacgagcccccccugcuguacgaccugagcaaggaccccggcgagaacuacaaccugcugggcggcguggccggcgccacccccgaggugcugcaggcccugaagcagcugcagcugcugaaggcccagcuggacgccgccgugaccuucggccccagccagguggccagaggcgaggaccccgcccugcagaucugcugccaccccggcugcacccccagacccgccugcugccacugccccgacccccacgccuaa

SEQ ID NO: 13863 - RNA, 1602 nt, Artificial Sequence
  ARSB__Homo_sapiens__NP_000037
augggccccagaggcgccgccagccugcccagaggccccggccccagaagacugcugcugcccguggugcugccccugcugcugcugcugcugcuggccccccccggcagcggcgccggcgccagcagacccccccaccugguguuccugcuggccgacgaccugggcuggaacgacgugggcuuccacggcagcagaaucagaaccccccaccuggacgcccuggccgccggcggcgugcugcuggacaacuacuacacccagccccugugcacccccagcagaagccagcugcugaccggcagauaccagaucagaaccggccugcagcaccagaucaucuggcccugccagcccagcugcgugccccuggacgagaagcugcugccccagcugcugaaggaggccggcuacaccacccacauggugggcaaguggcaccugggcauguacagaaaggagugccugcccaccagaagaggcuucgacaccuacuucggcuaccugcugggcagcgaggacuacuacagccacgagagaugcacccugaucgacgcccugaacgugaccagaugcgcccuggacuucagagacggcgaggagguggccaccggcuacaagaacauguacagcaccaacaucuucaccaagagagccaucgcccugaucaccaaccacccccccgagaagccccuguuccuguaccuggcccugcagagcgugcacgagccccugcaggugcccgaggaguaccugaagcccuacgacuucauccaggacaagaacagacaccacuacgccggcauggugagccugauggacgaggccgugggcaacgugaccgccgcccugaagagcagcggccuguggaacaacaccguguucaucuucagcaccgacaacggcggccagacccuggccggcggcaacaacuggccccugagaggcagaaaguggagccugugggagggcggcgugagaggcgugggcuucguggccagcccccugcugaagcagaagggcgugaagaacagagagcugauccacaucagcgacuggcugcccacccuggugaagcuggccagaggccacaccaacggcaccaagccccuggacggcuucgacguguggaagaccaucagcgagggcagccccagccccagaaucgagcugcugcacaacaucgaccccaacuucguggacagcagccccugccccagaaacagcauggcccccgccaaggacgacagcagccugcccgaguacagcgccuucaacaccagcgugcacgccgccaucagacacggcaacuggaagcugcugaccggcuaccccggcugcggcuacugguuccccccccccagccaguacaacgugagcgagauccccagcagcgacccccccaccaagacccuguggcuguucgacaucgacagagaccccgaggagagacacgaccugagcagagaguacccccacaucgugaccaagcugcugagcagacugcaguucuaccacaagcacagcgugcccguguacuuccccgcccaggaccccagaugcgaccccaaggccaccggcguguggggccccuggauguaa

SEQ ID NO: 13864 - RNA, 1782 nt, Artificial Sequence
  ARSD__Homo_sapiens__NP_001660
augagaagcgccgccagaagaggcagagccgcccccgccgccagagacagccugcccgugcugcuguuccugugccugcugcugaagaccugcgagcccaagaccgccaacgccuucaagcccaacauccugcugaucauggccgacgaccugggcaccggcgaccugggcugcuacggcaacaacacccugagaacccccaacaucgaccagcuggccgaggagggcgugagacugacccagcaccuggccgccgccccccugugcacccccagcagagccgccuuccugaccggcagacacagcuucagaagcggcauggacgccagcaacggcuacagagcccugcaguggaacgccggcagcggcggccugcccgagaacgagaccaccuucgccagaauccugcagcagcacggcuacgccaccggccugaucggcaaguggcaccagggcgugaacugcgccagcagaggcgaccacugccaccacccccugaaccacggcuucgacuacuucuacggcaugcccuucacccugaccaacgacugcgaccccggcagaccccccgagguggacgccgcccugagagcccagcuguggggcuacacccaguuccuggcccugggcauccugacccuggccgccggccagaccugcggcuucuucagcgugagcgccagagccgugaccggcauggccggcgugggcugccuguucuucaucagcugguacagcagcuucggcuucgugagaagauggaacugcauccugaugagaaaccacgacgugaccgagcagcccauggugcuggagaagaccgccagccugaugcugaaggaggccgugagcuacaucgagagacacaagcacggccccuuccugcuguuccugagccugcugcacgugcacaucccccuggugaccaccagcgccuuccugggcaagagccagcacggccuguacggcgacaacguggaggagauggacuggcugaucggcaaggugcugaacgccaucgaggacaacggccugaagaacagcaccuucaccuacuucaccagcgaccacggcggccaccuggaggccagagacggccacagccagcugggcggcuggaacggcaucuacaagggcggcaagggcaugggcggcugggagggcggcaucagagugcccggcaucuuccacuggcccggcgugcugcccgccggcagagugaucggcgagcccaccagccugauggacguguuccccaccguggugcagcuggugggcggcgaggugccccaggacagagugaucgacggccacagccuggugccccugcugcagggcgccgaggccagaagcgcccacgaguuccuguuccacuacugcggccagcaccugcacgccgccagauggcaccagaaggacagcggcagcguguggaaggugcacuacaccaccccccaguuccaccccgagggcgccggcgccugcuacggcagaggcgugugccccugcagcggcgagggcgugacccaccacagacccccccugcuguucgaccugagcagagaccccagcgaggccagaccccugacccccgacagcgagccccuguaccacgccgugaucgccagagugggcgccgccgugagcgagcacagacagacccugagccccgugccccagcaguucagcaugagcaacauccuguggaagcccuggcugcagcccugcugcggccacuuccccuucugcagcugccacgaggacggcgacggcacccccuaa

SEQ ID NO: 13865 - RNA, 1845 nt, Artificial Sequence
  ARSE__Homo_sapiens__NP_001269557
augagacccgugaucaacagaugcgcccccggcagccuggaccugaugcugccccaggccgccagcgagggcaucguguuccacagccugcagaucagccugugcuucagaagcuggcugcccgccaugcuggccgugcugcugagccuggcccccagcgccagcagcgacaucagcgccagcagacccaacauccugcugcugauggccgacgaccugggcaucggcgacaucggcugcuacggcaacaacaccaugagaacccccaacaucgacagacuggccgaggacggcgugaagcugacccagcacaucagcgccgccagccugugcacccccagcagagccgccuuccugaccggcagauaccccgugagaagcggcauggugagcagcaucggcuacagagugcugcaguggaccggcgccagcggcggccugcccaccaacgagaccaccuucgccaagauccugaaggagaagggcuacgccaccggccugaucggcaaguggcaccugggccugaacugcgagagcgccagcgaccacugccaccacccccugcaccacggcuucgaccacuucuacggcaugcccuucagccugaugggcgacugcgccagaugggagcugagcgagaagagagugaaccuggagcagaagcugaacuuccuguuccaggugcuggcccugguggcccugacccugguggccggcaagcugacccaccugauccccgugagcuggaugcccgugaucuggagcgcccugagcgccgugcugcugcuggccagcagcuacuucgugggcgcccugaucgugcacgccgacugcuuccugaugagaaaccacaccaucaccgagcagcccaugugcuuccagagaaccaccccccugauccugcaggagguggccagcuuccugaagagaaacaagcacggccccuuccugcuguucgugagcuuccugcacgugcacaucccccugaucaccauggagaacuuccugggcaagagccugcacggccuguacggcgacaacguggaggagauggacuggauggugggcagaauccuggacacccuggacguggagggccugagcaacagcacccugaucuacuucaccagcgaccacggcggcagccuggagaaccagcugggcaacacccaguacggcggcuggaacggcaucuacaagggcggcaagggcaugggcggcugggagggcggcaucagagugcccggcaucuucagauggcccggcgugcugcccgccggcagagugaucggcgagcccaccagccugauggacguguuccccaccguggugagacuggccggcggcgaggugccccaggacagagugaucgacggccaggaccugcugccccugcugcugggcaccgcccagcacagcgaccacgaguuccugaugcacuacugcgagagauuccugcacgccgccagauggcaccagagagacagaggcaccauguggaaggugcacuucgugacccccguguuccagcccgagggcgccggcgccugcuacggcagaaaggugugccccugcuucggcgagaagguggugcaccacgaccccccccugcuguucgaccugagcagagaccccagcgagacccacauccugacccccgccagcgagcccguguucuaccaggugauggagagagugcagcaggccgugugggagcaccagagaacccugagccccgugccccugcagcuggacagacugggcaacaucuggagacccuggcugcagcccugcugcggccccuucccccugugcuggugccugagagaggacgacccccaguaa

SEQ ID NO: 13866 - RNA, 1773 nt, Artificial Sequence
  ARSF__Homo_sapiens__NP_004033
augagacccagaagaccccugguguucaugagccuggugugcgcccugcugaacaccugccaggcccacagagugcacgacgacaagcccaacaucgugcugaucaugguggacgaccugggcaucggcgaccugggcugcuacggcaacgacaccaugagaaccccccacaucgacagacuggccagagagggcgugagacugacccagcacaucagcgccgccagccugugcagccccagcagaagcgccuuccugaccggcagauaccccaucagaagcggcauggugagcagcggcaacagaagagugauccagaaccuggccgugcccgccggccugccccugaacgagaccacccuggccgcccugcugaagaagcagggcuacagcaccggccugaucggcaaguggcaccagggccugaacugcgacagcagaagcgaccagugccaccaccccuacaacuacggcuucgacuacuacuacggcaugcccuucacccugguggacagcugcuggcccgaccccagcagaaacaccgagcuggccuucgagagccagcuguggcugugcgugcagcugguggccaucgccauccugacccugaccuucggcaagcugagcggcugggugagcgugcccuggcugcugaucuucagcaugauccuguucaucuuccugcugggcuacgccugguucagcagccacaccagcccccuguacugggacugccugcugaugagaggccacgagaucaccgagcagcccaugaaggccgagagagccggcagcaucauggugaaggaggccaucagcuuccuggagagacacagcaaggagaccuuccugcuguucuucagcuuccugcacgugcacaccccccugcccaccaccgacgacuucaccggcaccagcaagcacggccuguacggcgacaacguggaggagauggacagcauggugggcaagauccuggacgccaucgacgacuucggccugagaaacaacacccugguguacuucaccagcgaccacggcggccaccuggaggccagaagaggccacgcccagcugggcggcuggaacggcaucuacaagggcggcaagggcaugggcggcugggagggcggcaucagagugcccggcaucgugagauggcccggcaaggugcccgccggcagacugaucaaggagcccaccagccugauggacauccugcccaccguggccagcgugagcggcggcagccugccccaggacagagugaucgacggcagagaccugaugccccugcugcagggcaacgugagacacagcgagcacgaguuccuguuccacuacugcggcagcuaccugcacgccgugagauggauccccaaggacgacagcggcagcguguggaaggcccacuacgugacccccguguuccagccccccgccagcggcggcugcuacgugaccagccugugcagaugcuucggcgagcaggugaccuaccacaaccccccccugcuguucgaccugagcagagaccccagcgagagcaccccccugacccccgccaccgagccccugcacgacuucgugaucaagaagguggccaacgcccugaaggagcaccaggagaccaucgugcccgugaccuaccagcugagcgagcugaaccagggcagaaccuggcugaagcccugcugcggcguguuccccuucugccugugcgacaaggaggaggaggugagccagcccagaggccccaacgagaagagauaa

SEQ ID NO: 13867 - RNA, 1578 nt, Artificial Sequence
  ARSG__Homo_sapiens__NP_055775
augggcuggcuguuccugaaggugcugcuggccggcgugagcuucagcggcuuccuguacccccugguggacuucugcaucagcggcaagaccagaggccagaagcccaacuucgugaucauccuggccgacgacaugggcuggggcgaccugggcgccaacugggccgagaccaaggacaccgccaaccuggacaagauggccagcgagggcaugagauucguggacuuccacgccgccgccagcaccugcagccccagcagagccagccugcugaccggcagacugggccugagaaacggcgugaccagaaacuucgccgugaccagcgugggcggccugccccugaacgagaccacccuggccgaggugcugcagcaggccggcuacgugaccggcaucaucggcaaguggcaccugggccaccacggcagcuaccaccccaacuucagaggcuucgacuacuacuucggcauccccuacagccacgacaugggcugcaccgacacccccggcuacaaccacccccccugccccgccugcccccagggcgacggccccagcagaaaccugcagagagacugcuacaccgacguggcccugccccuguacgagaaccugaacaucguggagcagcccgugaaccugagcagccuggcccagaaguacgccgagaaggccacccaguucauccagagagccagcaccagcggcagacccuuccugcuguacguggcccuggcccacaugcacgugccccugcccgugacccagcugcccgccgcccccagaggcagaagccuguacggcgccggccugugggagauggacagccuggugggccagaucaaggacaagguggaccacaccgugaaggagaacaccuuccugugguucaccggcgacaacggccccugggcccagaagugcgagcuggccggcagcgugggccccuucaccggcuucuggcagaccagacagggcggcagccccgccaagcagaccaccugggagggcggccacagagugcccgcccuggccuacuggcccggcagagugcccgugaacgugaccagcaccgcccugcugagcgugcuggacaucuuccccaccgugguggcccuggcccaggccagccugccccagggcagaagauucgacggcguggacgugagcgaggugcuguucggcagaagccagcccggccacagagugcuguuccaccccaacagcggcgccgccggcgaguucggcgcccugcagaccgugagacuggagagauacaaggccuucuacaucaccggcggcgccagagccugcgacggcagcaccggccccgagcugcagcacaaguucccccugaucuucaaccuggaggacgacaccgccgaggccgugccccuggagagaggcggcgccgaguaccaggccgugcugcccgaggugagaaaggugcuggccgacgugcugcaggacaucgccaacgacaacaucagcagcgccgacuacacccaggaccccagcgugacccccugcugcaaccccuaccagaucgccugcagaugccaggccgccuaa

SEQ ID NO: 13868 - RNA, 1689 nt, Artificial Sequence
  ARSH__Homo_sapiens__NP_001011719
augaccagaaacgccagacccaacaucgugcugcugauggccgacgaccugggcgugggcgaccugugcugcuacggcaacaacagcgugagcacccccaacaucgacagacuggccagcgagggcgugagacugacccagcaccuggccgccgccagcaugugcacccccagcagagccgccuuccugaccggcagauaccccaucagaagcggcauggugagcgccuacaaccugaacagagccuucaccuggcugggcggcagcggcggccugcccaccaacgagaccaccuucgccaagcugcugcagcacagaggcuacagaaccggccugaucggcaaguggcaccugggccugagcugcgccagcagaaacgaccacugcuaccacccccugaaccacggcuuccacuacuucuacggcgugcccuucggccugcugagcgacugccaggccagcaagacccccgagcugcacagauggcugagaaucaagcuguggaucagcaccguggcccuggcccuggugcccuuccugcugcugauccccaaguucgccagaugguucagcgugcccuggaaggugaucuucguguucgcccugcuggccuuccuguucuucaccagcugguacagcagcuacggcuucaccagaagauggaacugcauccugaugagaaaccacgagaucauccagcagcccaugaaggaggagaagguggccagccugaugcugaaggaggcccuggccuucaucgagagauacaagagagagcccuuccugcuguucuucagcuuccugcacgugcacaccccccugaucagcaagaagaaguucgugggcagaagcaaguacggcagauacggcgacaacguggaggagauggacuggauggugggcaagauccuggacgcccuggaccaggagagacuggccaaccacacccugguguacuucaccagcgacaacggcggccaccuggagccccuggacggcgccgugcagcugggcggcuggaacggcaucuacaagggcggcaagggcaugggcggcugggagggcggcaucagagugcccggcaucuucagauggcccagcgugcuggaggccggcagagugaucaacgagcccaccagccugauggacaucuaccccacccugagcuacaucggcggcggcauccugagccaggacagagugaucgacggccagaaccugaugccccugcuggagggcagagccagccacagcgaccacgaguuccuguuccacuacugcggcguguaccugcacaccgugagauggcaccagaaggacugcgccaccguguggaaggcccacuacgugacccccaaguucuaccccgagggcaccggcgccugcuacggcagcggcaucugcagcugcagcggcgacgugaccuaccacgaccccccccugcuguucgacaucagcagagaccccagcgaggcccugccccugaaccccgacaacgagccccuguucgacagcgugaucaagaagauggaggccgccaucagagagcacagaagaacccugacccccgugccccagcaguucagcguguucaacaccaucuggaagcccuggcugcagcccugcugcggcaccuuccccuucugcggcugcgacaaggaggacgacauccugcccauggcccccuaa

SEQ ID NO: 13869 - RNA, 1710 nt, Artificial Sequence
  ARSI__Homo_sapiens__NP_001012301
augcacacccugaccggcuucagccuggugagccugcugagcuucggcuaccugagcugggacugggccaagcccagcuucguggccgacggccccggcgaggccggcgagcagcccagcgccgcccccccccagcccccccacaucaucuucauccugaccgacgaccagggcuaccacgacgugggcuaccacggcagcgacaucgagacccccacccuggacagacuggccgccaagggcgugaagcuggagaacuacuacauccagcccaucugcacccccagcagaagccagcugcugaccggcagauaccagauccacaccggccugcagcacagcaucaucagaccccagcagcccaacugccugccccuggaccaggugacccugccccagaagcugcaggaggccggcuacagcacccacauggugggcaaguggcaccugggcuucuacagaaaggagugccugcccaccagaagaggcuucgacaccuuccugggcagccugaccggcaacguggacuacuacaccuacgacaacugcgacggccccggcgugugcggcuucgaccugcacgagggcgagaacguggccuggggccugagcggccaguacagcaccaugcuguacgcccagagagccagccacauccuggccagccacagcccccagagaccccuguuccuguacguggccuuccaggccgugcacaccccccugcagagccccagagaguaccuguacagauacagaaccaugggcaacguggccagaagaaaguacgccgccauggugaccugcauggacgaggccgugagaaacaucaccugggcccugaagagauacggcuucuacaacaacagcgugaucaucuucagcagcgacaacggcggccagaccuucagcggcggcagcaacuggccccugagaggcagaaagggcaccuacugggagggcggcgugagaggccugggcuucgugcacagcccccugcugaagagaaagcagagaaccagcagagcccugaugcacaucaccgacugguaccccacccuggugggccuggccggcggcaccaccagcgccgccgacggccuggacggcuacgacguguggcccgccaucagcgagggcagagccagccccagaaccgagauccugcacaacaucgacccccuguacaaccacgcccagcacggcagccuggagggcggcuucggcaucuggaacaccgccgugcaggccgccaucagagugggcgaguggaagcugcugaccggcgaccccggcuacggcgacuggauccccccccagacccuggccaccuuccccggcagcugguggaaccuggagagaauggccagcgugagacaggccguguggcuguucaacaucagcgccgaccccuacgagagagaggaccuggccggccagagacccgacguggugagaacccugcuggccagacuggccgaguacaacagaaccgccauccccgugagauaccccgccgagaaccccagagcccaccccgacuucaacggcggcgccuggggccccugggccagcgacgaggaggaggaggaggaggagggcagagccagaagcuucagcagaggcagaagaaagaagaagugcaagaucugcaagcugagaagcuucuucagaaagcugaacaccagacugaugagccagagaaucuaa

SEQ ID NO: 13870 - RNA, 1800 nt, Artificial Sequence
  ARSJ__Homo_sapiens__NP_078866
auggcccccagaggcugcgccggccacccccccccccccagcccccaggccugcgugugccccggcaagaugcuggccaugggcgcccuggccggcuucuggauccugugccugcugaccuacggcuaccugagcuggggccaggcccuggaggaggaggaggagggcgcccugcuggcccaggccggcgagaagcuggagcccagcaccaccagcaccagccagccccaccugaucuucauccuggccgacgaccagggcuucagagacgugggcuaccacggcagcgagaucaagacccccacccuggacaagcuggccgccgagggcgugaagcuggagaacuacuacgugcagcccaucugcacccccagcagaagccaguucaucaccggcaaguaccagauccacaccggccugcagcacagcaucaucagacccacccagcccaacugccugccccuggacaacgccacccugccccagaagcugaaggaggugggcuacagcacccacauggugggcaaguggcaccugggcuucuacagaaaggagugcaugcccaccagaagaggcuucgacaccuucuucggcagccugcugggcagcggcgacuacuacacccacuacaagugcgacagccccggcaugugcggcuacgaccuguacgagaacgacaacgccgccugggacuacgacaacggcaucuacagcacccagauguacacccagagagugcagcagauccuggccagccacaaccccaccaagcccaucuuccuguacaucgccuaccaggccgugcacagcccccugcaggcccccggcagauacuucgagcacuacagaagcaucaucaacaucaacagaagaagauacgccgccaugcugagcugccuggacgaggccaucaacaacgugacccuggcccugaagaccuacggcuucuacaacaacagcaucaucaucuacagcagcgacaacggcggccagcccaccgccggcggcagcaacuggccccugagaggcagcaagggcaccuacugggagggcggcaucagagccgugggcuucgugcacagcccccugcugaagaacaagggcaccgugugcaaggagcuggugcacaucaccgacugguaccccacccugaucagccuggccgagggccagaucgacgaggacauccagcuggacggcuacgacaucugggagaccaucagcgagggccugagaagccccagaguggacauccugcacaacaucgaccccaucuacaccaaggccaagaacggcagcugggccgccggcuacggcaucuggaacaccgccauccagagcgccaucagagugcagcacuggaagcugcugaccggcaaccccggcuacagcgacugggugcccccccagagcuucagcaaccugggccccaacagauggcacaacgagagaaucacccugagcaccggcaagagcguguggcuguucaacaucaccgccgaccccuacgagagaguggaccugagcaacagauaccccggcaucgugaagaagcugcugagaagacugagccaguucaacaagaccgccgugcccgugagauacccccccaaggaccccagaagcaaccccagacugaacggcggcguguggggccccugguacaaggaggagaccaagaagaagaagcccagcaagaaccaggccgagaagaagcagaagaagagcaagaagaagaagaagaagcagcagaaggccgugagcggcagcaccugccacagcggcgugaccugcggcuaa

SEQ ID NO: 13871 - RNA, 1611 nt, Artificial Sequence
  ARSK__Homo_sapiens__NP_937793
augcugcugcugugggugagcgugguggccgcccuggcccuggccgugcuggcccccggcgccggcgagcagagaagaagagccgccaaggcccccaacguggugcugguggugagcgacagcuucgacggcagacugaccuuccaccccggcagccagguggugaagcugcccuucaucaacuucaugaagaccagaggcaccagcuuccugaacgccuacaccaacagccccaucugcugccccagcagagccgccauguggagcggccuguucacccaccugaccgagagcuggaacaacuucaagggccuggaccccaacuacaccaccuggauggacgugauggagagacacggcuacagaacccagaaguucggcaagcuggacuacaccagcggccaccacagcaucagcaacagaguggaggccuggaccagagacguggccuuccugcugagacaggagggcagacccauggugaaccugaucagaaacagaaccaaggugagagugauggagagagacuggcagaacaccgacaaggccgugaacuggcugagaaaggaggccaucaacuacaccgagcccuucgugaucuaccugggccugaaccugccccaccccuaccccagccccagcagcggcgagaacuucggcagcagcaccuuccacaccagccuguacuggcuggagaaggugagccacgacgccaucaagauccccaaguggagcccccugagcgagaugcaccccguggacuacuacagcagcuacaccaagaacugcaccggcagauucaccaagaaggagaucaagaacaucagagccuucuacuacgccaugugcgccgagaccgacgccaugcugggcgagaucauccuggcccugcaccagcuggaccugcugcagaagaccaucgugaucuacagcagcgaccacggcgagcuggccauggagcacagacaguucuacaagaugagcauguacgaggccagcgcccacgugccccugcugaugaugggccccggcaucaaggccggccugcaggugagcaacguggugagccugguggacaucuaccccaccaugcuggacaucgccggcaucccccugccccagaaccugagcggcuacagccugcugccccugagcagcgagaccuucaagaacgagcacaaggugaagaaccugcacccccccuggauccugagcgaguuccacggcugcaacgugaacgccagcaccuacaugcugagaaccaaccacuggaaguacaucgccuacagcgacggcgccagcauccugccccagcuguucgaccugagcagcgaccccgacgagcugaccaacguggccgugaaguuccccgagaucaccuacagccuggaccagaagcugcacagcaucaucaacuaccccaaggugagcgccagcgugcaccaguacaacaaggagcaguucaucaaguggaagcagagcaucggccagaacuacagcaacgugaucgccaaccugagauggcaccaggacuggcagaaggagcccagaaaguacgagaacgccaucgaccaguggcugaagacccacaugaaccccagagccguguaa

SEQ ID NO: 13872 - RNA, 984 nt, Artificial Sequence
  ART1__Homo_sapiens__NP_004305
augcagaugcccgccaugaugagccugcugcuggugagcgugggccugauggaggcccugcaggcccagagccaccccaucaccagaagagaccuguucagccaggagauccagcuggacauggcccuggccagcuucgacgaccaguacgccggcugcgccgccgccaugaccgccgcccugcccgaccugaaccacaccgaguuccaggccaaccagguguacgccgacagcuggacccuggccagcagccaguggcaggagagacaggccagauggcccgaguggagccugagccccaccagacccagcccccccccccugggcuucagagacgagcacggcguggcccugcuggccuacaccgccaacagcccccugcacaaggaguucaacgccgccgugagagaggccggcagaagcagagcccacuaccugcaccacuucagcuucaagacccugcacuuccugcugaccgaggcccugcagcugcugggcagcggccagagaccccccagaugccaccagguguucagaggcgugcacggccugagauucagacccgccggccccagagccaccgugagacugggcggcuucgccagcgccagccugaagcacguggccgcccagcaguucggcgaggacaccuucuucggcaucuggaccugccugggcgcccccaucaagggcuacagcuucuuccccggcgaggaggaggugcugaucccccccuucgagaccuuccaggugaucaacgccagcagacuggcccagggccccgccagaaucuaccugagagcccugggcaagcacagcaccuacaacugcgaguacaucaaggacaagaagugcaagagcggccccugccaccuggacaacagcgccaugggccagagcccccugagcgccguguggagccugcugcugcugcugugguuccugguggugagagccuuccccgacggccccggccugcuguaa

SEQ ID NO: 13873 - RNA, 1170 nt, Artificial Sequence
  ART3__Homo_sapiens__NP_001123488
augaagaccggccacuucgagaucgugaccaugcugcuggccaccaugauccugguggacaucuuccaggugaaggccgaggugcuggacauggccgacaacgccuucgacgacgaguaccugaagugcaccgacagaauggagaucaaguacgugccccagcugcugaaggaggagaaggccagccaccagcagcuggacaccgugugggagaacgccaaggccaagugggccgccagaaagacccagaucuuccugcccaugaacuucaaggacaaccacggcaucgcccugauggccuacaucagcgaggcccaggagcagacccccuucuaccaccuguucagcgaggccgugaagauggccggccagagcagagaggacuacaucuacggcuuccaguucaaggccuuccacuucuaccugaccagagcccugcagcugcugagaaagcccugcgaggccagcagcaagaccgugguguacagaaccagccagggcaccagcuucaccuucggcggccugaaccaggccagauucggccacuucacccuggccuacagcgccaagccccaggccgccaacgaccagcugaccgugcugagcaucuacaccugccugggcguggacaucgagaacuuccuggacaaggagagcgagagaaucacccugaucccccugaacgagguguuccaggugagccaggagggcgccggcaacaaccugauccugcagagcaucaacaagaccugcagccacuacgagugcgccuuccugggcggccugaagaccgagaacugcaucgagaaccuggaguacuuccagcccaucuacguguacaaccccggcgagaagaaccagaagcuggaggaccacagcgagaagaacuggaagcuggaggaccacggcgagaagaaccagaagcuggaggaccacggcgugaagauccuggagcccacccagauccccggcaugaagauccccgagcccuucccccugcccgaggacaagagccagggcaacaucaacaaccccacccccggccccgugcccgugcccggccccaagagccaccccagcgccagcagcggcaagcugcugcugccccaguucggcauggugaucauccugaucagcgugagcgccaucaaccuguucguggcccuguaa

SEQ ID NO: 13874 - RNA, 945 nt, Artificial Sequence
  ART4__Homo_sapiens__NP_066549
augggcccccugaucaacagaugcaagaagauccugcugcccaccaccgugccccccgccaccaugagaaucuggcugcugggcggccugcugcccuuccugcugcugcugagcggccugcagagacccaccgagggcagcgagguggccaucaagaucgacuucgacuucgcccccggcagcuucgacgaccaguaccagggcugcagcaagcaggugauggagaagcugacccagggcgacuacuucaccaaggacaucgaggcccagaagaacuacuucagaauguggcagaaggcccaccuggccuggcugaaccagggcaaggugcugccccagaacaugaccaccacccacgccguggccauccuguucuacacccugaacagcaacgugcacagcgacuucaccagagccauggccagcguggccagaaccccccagcaguacgagagaagcuuccacuucaaguaccugcacuacuaccugaccagcgccauccagcugcugagaaaggacagcaucauggagaacggcacccugugcuacgaggugcacuacagaaccaaggacgugcacuucaacgccuacaccggcgccaccaucagauucggccaguuccugagcaccagccugcugaaggaggaggcccaggaguucggcaaccagacccuguucaccaucuucaccugccugggcgcccccgugcaguacuucagccugaagaaggaggugcugaucccccccuacgagcuguucaaggugaucaacaugagcuaccaccccagaggcgacuggcugcagcugagaagcaccggcaaccugagcaccuacaacugccagcugcugaaggccagcagcaagaagugcauccccgaccccaucgccaucgccagccugagcuuccugaccagcgugaucaucuucagcaagagcagaguguaa

SEQ ID NO: 13875 - RNA, 2871 nt, Artificial Sequence
  ARVCF__Homo_sapiens__XP_005261300
auggaggacugcaacgugcacagcgccgccagcauccuggccagcgugaaggagcaggaggccagauucgagagacugaccagagcccuggagcaggagagaagacacguggcccugcagcuggagagagcccagcagcccggcauggugagcggcggcaugggcagcggccagccccugcccauggccuggcagcagcuggugcugcaggagcagagccccggcagccaggccagccuggccaccaugcccgaggcccccgacgugcuggaggagaccgugaccguggaggaggaccccggcacccccaccagccacgugagcaucgugaccagcgaggacggcaccaccagaagaaccgagaccaaggugaccaagaccgugaagaccgugaccaccagaaccgugagacaggugcccgugggccccgacggccugccccugcuggacggcggccccccccugggccccuucgccgacggcgcccuggacagacacuuccugcugagaggcggcggccccguggccacccugagcagagccuaccugagcagcggcggcggcuuccccgagggccccgagcccagagacagccccagcuacggcagccugagcagaggccugggcaugagaccccccagagccggcccccugggccccggccccggcgacggcugcuucacccugcccggccacagagaggccuuccccgugggccccgagcccggcccccccggcggcagaagccugcccgagagauuccaggccgagcccuacggccuggaggacgacaccagaagccuggccgccgacgacgagggcggccccgagcuggagcccgacuacggcaccgccaccagaagaagacccgagugcggcagaggccugcacaccagagccuacgaggacaccgccgacgacggcggcgagcuggccgacgagagacccgccuuccccauggugaccgccccccuggcccagcccgagagaggcagcaugggcagccuggacagacuggugagaagaagccccagcguggacagcgccagaaaggagcccagauggagagaccccgagcugcccgaggugcuggccaugcugagacaccccguggaccccgugaaggccaacgccgccgccuaccugcagcaccugugcuucgagaacgagggcgugaagagaagagugagacagcugagaggccugccccugcugguggcccugcuggaccaccccagagccgaggugagaagaagagccugcggcgcccugagaaaccugagcuacggcagagacaccgacaacaaggccgccaucagagacugcggcggcgugcccgcccuggugagacugcugagagccgccagagacaacgaggugagagagcuggugaccggcacccuguggaaccugagcagcuacgagccccugaagauggugaucaucgaccacggccugcagacccugacccacgaggugaucgugccccacagcggcugggagagagagcccaacgaggacagcaagcccagagacgccgaguggaccaccguguucaagaacaccagcggcugccugagaaacgugagcagcgacggcgccgaggccagaagaagacugagagagugcgagggccugguggacgcccugcugcacgcccugcagagcgccgugggcagaaaggacaccgacaacaagagcguggagaacugcgugugcaucaugagaaaccugagcuaccacgugcacaaggaggugcccggcgccgacagauaccaggaggccgagcccggcccccugggcagcgccgugggcagccagagaagaagaagagacgacgccagcugcuucggcggcaagaaggccaagggcaagaaggacggcgagauggacagaaacuucgacacccuggaccugcccaagagaaccgaggccgccaagggcuucgagcugcuguaccagcccgagguggugagacuguaccugagccugcugaccgagagcagaaacuucaacacccuggaggccgccgccggcgcccugcagaaccugagcgccggcaacuggaugugggccaccuacaucagagccaccgugagaaaggagagaggccugcccgugcugguggagcugcugcagagcgagaccgacaagguggugagagccguggccaucgcccugagaaaccugagccuggacagaagaaacaaggaccugaucggcagcuacgccauggccgagcuggugagaaacgugagaaacgcccaggccccccccagacccggcgccugccuggaggaggacaccgugguggccgugcugaacaccauccacgagaucgugagcgacagccuggacaacgccagaagccugcugcaggccagaggcgugcccgcccugguggcccugguggccagcagccagagcgugagagaggccaaggccgccagccacgugcugcagaccguguggagcuacaaggagcugagaggcacccugcagaaggacggcuggaccaaggccagauuccagagcgccgccgccaccgccaagggccccaagggcgcccugagccccggcggcuucgacgacagcacccugccccugguggacaagagccuggagggcgagaagaccggcagcagagacgugauccccauggacgcccugggccccgacggcuacagcaccguggacagaagagagagaagacccagaggcgccagcagcgccggcgaggccagcgagaaggagccccugaagcuggaccccagcagaaaggcccccccccccggccccagcagacccgccgugagacugguggacgccgugggcgacgccaagccccagcccguggacagcuggguguaa

SEQ ID NO: 13876 - RNA, 1689 nt, Artificial Sequence
  ARX__Homo_sapiens__NP_620689
augagcaaccaguaccaggaggagggcugcagcgagagacccgagugcaagagcaagagccccacccugcugagcagcuacugcaucgacagcauccugggcagaagaagccccugcaagaugagacugcugggcgccgcccagagccugcccgccccccugaccagcagagccgaccccgagaaggccgugcagggcagccccaagagcagcagcgcccccuucgaggccgagcugcaccugccccccaagcugagaagacuguacggccccggcggcggcagacugcugcagggcgccgccgccgccgccgccgccgccgccgccgccgccgccgccgccgccaccgccaccgccggccccagaggcgaggccccccccccccccccccccaccgccagacccggcgagagacccgacggcgccggcgccgccgccgccgccgccgccgccgccgccgccgccugggacacccugaagaucagccaggccccccaggugagcaucagcagaagcaagagcuacagagagaacggcgcccccuucgugccccccccccccgcccuggacgagcugggcggccccggcggcgugacccaccccgaggagagacugggcguggccggcggccccggcagcgcccccgccgccggcggcggcaccggcaccgaggacgacgaggaggagcugcuggaggacgaggaggacgaggacgaggaggaggagcugcuggaggacgacgaggaggagcugcuggaggacgacgccagagcccugcugaaggagcccagaagaugccccguggccgccaccggcgccguggccgccgccgccgccgccgccguggccaccgagggcggcgagcugagccccaaggaggagcugcugcugcaccccgaggacgccgagggcaaggacggcgaggacagcgugugccugagcgccggcagcgacagcgaggagggccugcugaagagaaagcagagaagauacagaaccaccuucaccagcuaccagcuggaggagcuggagagagccuuccagaagacccacuaccccgacguguucaccagagaggagcuggccaugagacuggaccugaccgaggccagagugcaggugugguuccagaacagaagagccaaguggagaaagagagagaaggccggcgcccagacccacccccccggccugcccuuccccggcccccugagcgccacccacccccugagccccuaccuggacgccagccccuuccccccccaccaccccgcccuggacagcgccuggaccgccgccgccgccgccgccgccgccgccuuccccagccugccccccccccccggcagcgccagccugccccccagcggcgccccccugggccugagcaccuuccugggcgccgccguguucagacaccccgccuucaucagccccgccuucggcagacuguucagcaccauggccccccugaccagcgccagcaccgccgccgcccugcugagacagcccacccccgccguggagggcgccguggccagcggcgcccuggccgaccccgccaccgccgccgccgacagaagagccagcagcaucgccgcccugagacugaaggccaaggagcacgccgcccagcugacccagcugaacauccugcccggcaccagcaccggcaaggaggugugcuaa

SEQ ID NO: 13877 - RNA, 1128 nt, Artificial Sequence
  AS3MT__Homo_sapiens__NP_065733
auggccgcccugagagacgccgagauccagaaggacgugcagaccuacuacggccaggugcugaagagaagcgccgaccugcagaccaacggcugcgugaccaccgccagacccgugcccaagcacaucagagaggcccugcagaacgugcacgaggagguggcccugagauacuacggcugcggccuggugauccccgagcaccuggagaacugcuggauccuggaccugggcagcggcagcggcagagacugcuacgugcugagccagcuggugggcgagaagggccacgugaccggcaucgacaugaccaagggccagguggagguggccgagaaguaccuggacuaccacauggagaaguacggcuuccaggccagcaacgugaccuucauccacggcuacaucgagaagcugggcgaggccggcaucaagaacgagagccacgacaucguggugagcaacugcgugaucaaccuggugcccgacaagcagcaggugcugcaggaggccuacagagugcugaagcacggcggcgagcuguacuucagcgacguguacaccagccuggagcugcccgaggagaucagaacccacaaggugcuguggggcgagugccugggcggcgcccuguacuggaaggagcuggccgugcuggcccagaagaucggcuucugcccccccagacuggugaccgccaaccugaucaccauccagaacaaggagcuggagagagugaucggcgacugcagauucgugagcgccaccuucagacuguucaagcacagcaagaccggccccaccaagagaugccaggugaucuacaacggcggcaucaccggccacgagaaggagcugauguucgacgccaacuucaccuucaaggagggcgagaucguggagguggacgaggagaccgccgccauccugaagaacagcagauucgcccaggacuuccugaucagacccaucggcgagaagcugcccaccagcggcggcugcagcgcccuggagcugaaggacaucaucaccgaccccuucaagcuggccgaggagagcgacagcaugaagagcagaugcgugcccgacgccgccggcggcugcugcggcaccaagaagagcugcuaa

SEQ ID NO: 13878 - RNA, 1170 nt, Artificial Sequence
  ASAH1__Homo_sapiens__NP_001120977
augaacugcugcaucggccugggcgagaaggccagaggcagccacagagccagcuaccccagccugagcgcccuguucaccgaggccagcauccugggcuucggcagcuucgccgugaaggcccaguggaccgaggacugcagaaagagcaccuacccccccagcggccccaccguguuccccgccgugaucagauacagaggcgccgugcccugguacaccaucaaccuggaccugccccccuacaagagauggcacgagcugaugcuggacaaggcccccgugcccggccugcugggcaacuuccccggccccuucgaggaggagaugaagggcaucgccgccgugaccgacaucccccugggcgagaucaucagcuucaacaucuucuacgagcuguucaccaucugcaccagcaucguggccgaggacaagaagggccaccugauccacggcagaaacauggacuucggcguguuccugggcuggaacaucaacaacgacaccugggugaucaccgagcagcugaagccccugaccgugaaccuggacuuccagagaaacaacaagaccguguucaaggccagcagcuucgccggcuacgugggcaugcugaccggcuucaagcccggccuguucagccugacccugaacgagagauucagcaucaacggcggcuaccugggcauccuggaguggauccugggcaagaaggacgugauguggaucggcuuccugaccagaaccgugcuggagaacagcaccagcuacgaggaggccaagaaccugcugaccaagaccaagauccuggcccccgccuacuucauccugggcggcaaccagagcggcgagggcugcgugaucaccagagacagaaaggagagccuggacguguacgagcuggacgccaagcagggcagaugguacguggugcagaccaacuacgacagauggaagcaccccuucuuccuggacgacagaagaacccccgccaagaugugccugaacagaaccagccaggagaacaucagcuucgagaccauguacgacgugcugagcaccaagcccgugcugaacaagcugaccguguacaccacccugaucgacgugaccaagggccaguucgagaccuaccugagagacugccccgaccccugcaucggcugguaa

SEQ ID NO: 13879 - RNA, 2238 nt, Artificial Sequence
  ASAH2__Homo_sapiens__NP_001137446
auggccaagagaaccuucagcaaccuggagaccuuccugaucuuccugcuggugaugaugagcgccaucaccguggcccugcugagccugcuguucaucaccagcggcaccaucgagaaccacaaggaccugggcggccacuucuucagcaccacccagagcccccccgccacccagggcagcaccgccgcccagagaagcaccgccacccagcacagcaccgccacccagagcagcaccgccacccagaccagccccgugccccugacccccgagagcccccuguuccagaacuucagcggcuaccacaucggcgugggcagagccgacugcaccggccagguggccgacaucaaccugaugggcuacggcaagagcggccagaacgcccagggcauccugaccagacuguacagcagagccuucaucauggccgagcccgacggcagcaacagaaccguguucgugagcaucgacaucggcauggugagccagagacugagacuggaggugcugaacagacugcagagcaaguacggcagccuguacagaagagacaacgugauccugagcggcacccacacccacagcggccccgccggcuacuuccaguacaccguguucgugaucgccagcgagggcuucagcaaccagaccuuccagcacauggugaccggcauccugaagagcaucgacaucgcccacaccaacaugaagcccggcaagaucuucaucaacaagggcaacguggacggcgugcagaucaacagaagccccuacagcuaccugcagaacccccagagcgagagagccagauacagcagcaacaccgacaaggagaugaucgugcugaagaugguggaccugaacggcgacgaccugggccugaucagcugguucgccauccaccccgugagcaugaacaacagcaaccaccuggugaacagcgacaacgugggcuacgccagcuaccugcuggagcaggagaagaacaagggcuaccugcccggccagggccccuucguggccgccuucgccagcagcaaccugggcgacgugagccccaacauccugggccccagaugcaucaacaccggcgagagcugcgacaacgccaacagcaccugccccaucggcggccccagcaugugcaucgccaagggccccggccaggacauguucgacagcacccagaucaucggcagagccauguaccagagagccaagagcaagaccugcaagcccgcccugggcuacagcuucgccgccggcaccaucgacggcgugggcggccugaacuucacccagggcaagaccgagggcgaccccuucugggacaccaucagagaccagauccugggcaagcccagcgaggagaucaaggagugccacaagcccaagcccauccugcugcacaccggcgagcugagcaagccccaccccuggcaccccgacaucguggacgugcagaucaucacccugggcagccuggccaucaccgccauccccggcgaguucaccaccaugagcggcagaagacugagagaggccgugcaggccgaguucgccagccacggcaugcagaacaugaccguggugaucagcggccugugcaacguguacacccacuacaucaccaccuacgaggaguaccaggcccagagauacgaggccgccagcaccaucuacggcccccacacccugagcgccuacauccagcuguucagaaaccuggccaaggccaucgccaccgacaccguggccaaccugagcagaggccccgagccccccuucuucaagcagcugaucgugccccugauccccagcaucguggacagagcccccaagggcagaaccuucggcgacgugcugcagcccgccaagcccgaguacagagugggcgagguggccgaggugaucuucgugggcgccaaccccaagaacagcgugcagaaccagacccaccagaccuuccugaccguggagaaguacgaggccaccagcaccagcuggcagaucgugugcaacgacgccagcugggagaccagauucuacuggcacaagggccugcugggccugagcaacgccaccguggaguggcacauccccgacaccgcccagcccggcaucuacagaaucagauacuucggccacaacagaaagcaggacauccugaagcccgccgugauccugagcuucgagggcaccagccccgccuucgagguggugaccaucuaa

SEQ ID NO: 13880 - RNA, 3390 nt, Artificial Sequence
  ASAP1__Homo_sapiens__NP_060952
augagaagcagcgccagcagacugagcagcuucagcagcagagacagccuguggaacagaaugcccgaccagaucagcgugagcgaguucaucgccgagaccaccgaggacuacaacagccccaccaccagcagcuucaccaccagacugcacaacugcagaaacaccgugacccugcuggaggaggcccuggaccaggacagaaccgcccugcagaaggugaagaagagcgugaaggccaucuacaacagcggccaggaccacgugcagaacgaggagaacuacgcccaggugcuggacaaguucggcagcaacuuccugagcagagacaaccccgaccugggcaccgccuucgugaaguucagcacccugaccaaggagcugagcacccugcugaagaaccugcugcagggccugagccacaacgugaucuucacccuggacagccugcugaagggcgaccugaagggcgugaagggcgaccugaagaagcccuucgacaaggccuggaaggacuacgagaccaaguucaccaagaucgagaaggagaagagagagcacgccaagcagcacggcaugaucagaaccgagaucaccggcgccgagaucgccgaggagauggagaaggagagaagacuguuccagcugcagaugugcgaguaccugaucaaggugaacgagaucaagaccaagaagggcguggaccugcugcagaaccugaucaaguacuaccacgcccagugcaacuucuuccaggacggccugaagaccgccgacaagcugaagcaguacaucgagaagcuggccgccgaccuguacaacaucaagcagacccaggacgaggagaagaagcagcugaccgcccugagagaccugaucaagagcagccugcagcuggaccagaaggaggacagccagagcagacagggcggcuacagcaugcaccagcugcagggcaacaaggaguacggcagcgagaagaagggcuaccugcugaagaagagcgacggcaucagaaagguguggcagagaagaaagugcagcgugaagaacggcauccugaccaucagccacgccaccagcaacagacagcccgccaagcugaaccugcugaccugccaggugaagcccaacgccgaggacaagaagagcuucgaccugaucagccacaacagaaccuaccacuuccaggccgaggacgagcaggacuacguggccuggaucagcgugcugaccaacagcaaggaggaggcccugaccauggccuucagaggcgagcagagcgccggcgagaacagccuggaggaccugaccaaggccaucaucgaggacgugcagagacugcccggcaacgacaucugcugcgacugcggcagcagcgagcccaccuggcugagcaccaaccugggcauccugaccugcaucgagugcagcggcauccacagagagaugggcgugcacaucagcagaauccagagccuggagcuggacaagcugggcaccagcgagcugcugcuggccaagaacgugggcaacaacagcuucaacgacaucauggaggccaaccugcccagccccagccccaagcccacccccagcagcgacaugaccgugagaaaggaguacaucaccgccaaguacguggaccacagauucagcagaaagaccugcagcaccagcagcgccaagcugaacgagcugcuggaggccaucaagagcagagaccugcuggcccugauccagguguacgccgagggcguggagcugauggagccccugcuggagcccggccaggagcugggcgagaccgcccugcaccuggccgugagaaccgccgaccagaccagccugcaccugguggacuuccuggugcagaacugcggcaaccuggacaagcagaccgcccugggcaacaccgugcugcacuacugcagcauguacagcaagcccgagugccugaagcugcugcugagaagcaagcccaccguggacaucgugaaccaggccggcgagaccgcccuggacaucgccaagagacugaaggccacccagugcgaggaccugcugagccaggccaagagcggcaaguucaacccccacgugcacguggaguacgaguggaaccugagacaggaggagaucgacgagagcgacgacgaccuggacgacaagcccagccccaucaagaaggagagaagccccagaccccagagcuucugccacagcagcagcaucagcccccaggacaagcuggcccugcccggcuucagcacccccagagacaagcagagacugagcuacggcgccuucaccaaccagaucuucgugagcaccagcaccgacagccccaccagccccaccaccgaggcccccccccugccccccagaaacgccggcaagggccccaccggcccccccagcacccugccccugagcacccagaccagcagcggcagcagcacccugagcaagaagagaccccccccccccccccccggccacaagagaacccugagcgacccccccagcccccugccccacggcccccccaacaagggcgccgugcccuggggcaacgacggcggccccagcagcagcagcaagaccaccaacaaguucgagggccugagccagcagagcagcaccagcagcgccaagaccgcccugggccccagagugcugcccaagcugccccagaagguggcccugagaaagaccgaccaccugagccuggacaaggccaccaucccccccgagaucuuccagaagagcagccagcuggccgagcugccccagaagcccccccccggcgaccugccccccaagcccaccgagcuggcccccaagccccagaucggcgaccugccccccaagcccggcgagcugccccccaagccccagcugggcgaccugccccccaagccccagcugagcgaccugccccccaagccccagaugaaggaccugccccccaagccccagcugggcgaccugcuggccaagagccagaccggcgacgugagccccaaggcccagcagcccagcgaggugacccugaagagccacccccuggaccugagccccaacgugcagagcagagacgccauccagaagcaggccagcgaggacagcaacgaccugacccccacccugcccgagacccccgugccccugcccagaaagaucaacaccggcaagaacaaggugagaagagugaagaccaucuacgacugccaggccgacaacgacgacgagcugaccuucaucgagggcgaggugaucaucgugaccggcgaggaggaccaggagugguggaucggccacaucgagggccagcccgagagaaagggcguguuccccgugagcuucgugcacauccugagcgacuaa

SEQ ID NO: 13881 - RNA, 2886 nt, Artificial Sequence
  ASAP2__Homo_sapiens__NP_001128663
augcccgaccagaucagcgugagcgaguucguggccgagacccacgaggacuacaaggcccccaccgccagcagcuucaccaccagaaccgcccagugcagaaacaccguggccgccaucgaggaggcccuggacguggacagaauggugcuguacaagaugaagaagagcgugaaggccaucaacagcagcggccuggcccacguggagaacgaggagcaguacacccaggcccuggagaaguucggcggcaacugcgugugcagagacgaccccgaccugggcagcgccuuccugaaguucagcguguucaccaaggagcugaccgcccuguucaagaaccugauccagaacaugaacaacaucaucagcuucccccuggacagccugcugaagggcgaccugaagggcgugaagggcgaccugaagaagcccuucgacaaggccuggaaggacuacgagaccaagaucaccaagaucgagaaggagaagaaggagcacgccaagcugcacggcaugaucagaaccgagaucagcggcgccgagaucgccgaggagauggagaaggagagaagauucuuccagcugcagaugugcgaguaccugcugaaggugaacgagaucaagaucaagaagggcguggaccugcugcagaaccugaucaaguacuuccacgcccagugcaacuucuuccaggacggccugaaggccguggagagccugaagcccagcaucgagacccugagcaccgaccugcacaccaucaagcaggcccaggacgaggagagaagacagcugauccagcugagagacauccugaagagcgcccugcagguggagcagaaggaggacagccagaucagacagagcaccgccuacagccugcaccagccccagggcaacaaggagcacggcaccgagagaaacggcagccuguacaagaagagcgacggcaucagaaagguguggcagaagagaaagugcagcgugaagaacggcuuccugaccaucagccacggcaccgccaacagaccccccgccaagcugaaccugcugaccugccaggugaagaccaaccccgaggagaagaagugcuucgaccugaucagccacgacagaaccuaccacuuccaggccgaggacgagcaggagugccagaucuggaugagcgugcugcagaacagcaaggaggaggcccugaacaacgccuucaagggcgacgacaacaccggcgagaacaacaucgugcaggagcugaccaaggagaucaucagcgaggugcagagaaugaccggcaacgacgugugcugcgacugcggcgcccccgaccccaccuggcugagcaccaaccugggcauccugaccugcaucgagugcagcggcauccacagagagcugggcgugcacuacagcagaaugcagagccugacccuggacgugcugggcaccagcgagcugcugcuggccaagaacaucggcaacgccggcuucaacgagaucauggagugcugccugcccgccgaggacagcgugaagcccaaccccggcagcgacaugaacgccagaaaggacuacaucaccgccaaguacaucgagagaagauacgccagaaagaagcacgccgacaacgccgccaagcugcacagccugugcgaggccgugaagaccagagacaucuucggccugcugcaggccuacgccgacggcguggaccugaccgagaagaucccccuggccaacggccacgagcccgacgagaccgcccugcaccuggccgugagaagcguggacagaaccagccugcacaucguggacuuccuggugcagaacagcggcaaccuggacaagcagaccggcaagggcagcaccgcccugcacuacugcugccugaccgacaacgccgagugccugaagcugcugcugagaggcaaggccagcaucgagaucgccaacgagagcggcgagaccccccuggacaucgccaagagacugaagcacgagcacugcgaggagcugcugacccaggcccugagcggcagauucaacagccacgugcacguggaguacgaguggagacugcugcacgaggaccuggacgagagcgacgacgacauggacgagaagcugcagcccagccccaacagaagagaggacagacccaucagcuucuaccagcugggcagcaaccagcugcagagcaacgccgugagccuggccagagacgccgccaaccuggccaaggagaagcagagagccuucaugcccagcauccugcagaacgagaccuacggcgcccugcugagcggcagccccccccccgcccagcccgccgcccccagcaccaccagcgcccccccccugccccccagaaacgugggcaaggacccccugacccccaccccccccccccccguggccaagacccccagcgugauggaggcccugagccagcccagcaagcccgccccccccggcaucagccagaucagaccccccccccugcccccccagccccccagcagacugccccagaagaagcccgcccccggcgccgacaagagcaccccccugaccaacaagggccagcccagaggccccguggaccugagcgccaccgaggcccugggcccccugagcaacgccauggugcugcagccccccgcccccaugcccagaaagagccaggccaccaagcugaagcccaagagagugaaggcccuguacaacugcguggccgacaaccccgacgagcugaccuucagcgagggcgacgugaucaucguggacggcgaggaggaccaggagugguggaucggccacaucgacggcgaccccggcagaaagggcgccuuccccgugagcuucgugcacuucaucgccgacuaa

SEQ ID NO: 13882 - RNA, 1404 nt, Artificial Sequence
  ASB10__Homo_sapiens__NP_001135931
augcugaugagcuggagccccgaggagugcaagggccagggcgagccccuggacgacagacacccccugugcgccagacugguggagaagcccagcagaggcagcgaggagcaccugaagagcggccccggccccaucgugaccagaaccgccagcggccccgcccuggccuucuggcaggccgugcuggccggcgacgugggcugcgugagcagaauccuggccgacagcagcaccggccuggcccccgacagcguguucgacaccagcgaccccgagagauggagagacuucagauucaacaucagagcccugagacuguggagccugaccuacgaggaggagcugaccaccccccugcacguggccgccagcagaggccacaccgaggugcugagacugcugcugagaagaagagccagacccgacagcgcccccggcggcagaaccgcccugcacgaggccugcgccgccggccacaccgccugcgugcacgugcugcugguggccggcgccgaccccaacaucgccgaccaggacggcaagagaccccugcaccugugcagaggccccggcacccuggagugcgccgagcugcugcugagauucggcgccagaguggacggcagaagcgaggaggaggaggagaccccccugcacguggccgccagacugggccacguggagcuggccgaccugcugcugagaagaggcgccugccccgacgccagaaacgccgagggcuggaccccccugcuggccgccugcgacgugagaugccagagcaucaccgacgccgaggccaccaccgccagaugccugcagcugugcagccugcugcugagcgccggcgccgacgccgacgccgccgaccaggacaagcagagaccccugcaccuggccugcagaagaggccacgccgccgugguggagcugcugcugagcugcggcgugagcgccaacaccauggacuacggcggccacaccccccugcacugcgcccugcagggccccgccgccgcccuggcccagagccccgagcacguggugagagcccugcugaaccacggcgccgugagaguguggcccggcgcccugcccaaggugcuggagagauggagcaccugccccagaaccaucgaggugcugaugaacaccuacagcguggugcagcugcccgaggaggccgugggccuggugacccccgagacccugcagaagcaccagagauucuacagcagccuguucgcccuggugagacagcccagaagccugcagcaccugagcagaugcgcccugagaagccaccuggagggcagccugccccaggcccugcccagacugccccugccccccagacugcugagauaccugcagcuggacuucgagggcgugcuguacuaa

SEQ ID NO: 13883 - RNA, 837 nt, Artificial Sequence
  ASB13__Homo_sapiens__NP_078977
auggagcccagagccgccgacggcugcuuccugggcgacgugggcuucuggguggagagaacccccgugcacgaggccgcccagagaggcgagagccugcagcugcagcagcugaucgagagcggcgccugcgugaaccaggugaccguggacagcaucaccccccugcacgccgccagccugcagggccaggccagaugcgugcagcugcugcuggccgccggcgcccagguggacgccagaaacaucgacggcagcaccccccugugcgacgccugcgccagcggcagcaucgagugcgugaagcugcugcugagcuacggcgccaaggugaaccccccccuguacaccgccagcccccugcacgaggccugcaugagcggcagcagcgagugcgugagacugcugaucgacgugggcgccaaccuggaggcccacgacugccacuucggcaccccccugcacguggccugcgccagagagcaccuggacugcgugaaggugcugcugaacgccggcgccaacgugaacgccgccaagcugcacgagaccgcccugcaccacgccgccaaggugaagaacguggaccugaucgagaugcugaucgaguucggcggcaacaucuacgccagagacaacagaggcaagaagcccagcgacuacaccuggagcagcagcgcccccgccaagugcuucgaguacuacgagaagaccccccugacccugagccagcugugcagagugaaccugagaaaggccaccggcgugagaggccuggagaagaucgccaagcugaacaucccccccagacugaucgacuaccugagcuacaacuaa

SEQ ID NO: 13884 - RNA, 1767 nt, Artificial Sequence
  ASB15__Homo_sapiens__XP_005250203
auggacaccaacgacgaccccgacgaggaccaccugaccagcuacgacauccagcugagcauccaggagagcaucgaggccagcaagaccgcccugugccccgagagauucgugccccugagcgcccagaacagaaagcugguggaggccaucaagcagggccacauccccgagcugcaggaguacgugaaguacaaguacgccauggacgaggccgacgagaagggcugguucccccugcacgaggccguggugcagcccauccagcagauccuggagaucgugcuggacgccagcuacaagacccugugggaguucaagaccugcgacggcgagaccccccugacccuggccgugaaggccggccugguggagaacgugagaacccugcuggagaagggcguguggcccaacaccaagaacgacaagggcgagaccccccugcugaucgccgugaagaagggcagcuacgacauggugagcacccugaucaagcacaacaccagccuggaccagcccugcgugaagagauggagcgccaugcacgaggccgccaagcagggcagaaaggacaucguggcccugcugcugaagcacggcggcaacgugcaccugagagacggcuucggcgugaccccccugggcguggccgccgaguacggccacugcgacgugcuggagcaccugauccacaagggcggcgacgugcuggcccuggccgacgacggcgccagcgugcuguucgaggccgccggcggcggcaaccccgacugcaucagccugcugcuggaguacggcggcagcggcaacgugcccaacagagccggccaccugcccauccacagagccgccuacgagggccacuaccuggcccugaaguaccugauccccgugaccagcaagaacgccaucagaaagagcggccugacccccauccacagcgccgccgacggccagaacgcccagugccuggagcugcugaucgagaacggcuucgacgugaacacccugcuggccgaccacaucagccagagcuacgacgacgagagaaagaccgcccuguacuucggcgugagcaacaacgacgugcacugcaccgaggugcugcuggccgccggcgccgaccccaaccuggacccccugaacugccugcugguggccgugagagccaacaacuacgagaucgugagacugcugcugagccacggcgccaacgugaacugcuacuucaugcacgugaacgacaccagauuccccagcgugauccaguacgcccugaacgacgaggugaugcugagacugcugcugaacaacggcuaccagguggagaugugcuucgacugcaugcacggcgacaucuucggcaacagcuucguguggagcgagauccaggaggaggugcugcccggcuggaccagcugcgugaucaaggacaaccccuucugcgaguucaucaccgugcccuggaugaagcaccuggugggcagagugaccagagugcugaucgacuacauggacuacgugccccugugcgccaagcugaagagcgcccuggaggugcagagagaguggcccgagaucagacagauccuggagaaccccugcagccugaagcaccugugcagacugaagaucagaagacugaugggccugcagaagcugugccagcccgccagcguggagaagcugccccugccccccgccauccagagauacauccuguucaaggaguacgaccuguacggccaggagcugaagcugaccuaa

SEQ ID NO: 13885 - RNA, 1401 nt, Artificial Sequence
  ASB18__Homo_sapiens__NP_997721
augagcaacagcgacuaccugcccgacuacccccugaacagcgaccuggugaagagacugaagagcgcccuggacgccaaggacgaggagagagugagagaccugaucugcaccgagaucacccccguggacgccgugaucgagcuggccaacgacgacuggaugaaggaccccagcgcccagcugcccaccggcaugcugcugggcgaccuggaccaccugaagccccugauggaccaguucuuccaggacgccaacgugguguucgagaucaacaaggacgagauggaguggcaggugaagagccccgccaccuucggccugagcggccuguggacccuggaguacaagagagagcugaccaccccccugugcaucgccgccgcccacggccacaccgccugcgugagacaccugcugggcagaggcgccgaccccgacgccagccccggcggcagaggcgcccugcacgaggccugccugggcggccacaccgccugcgugagacugcugcugcagcacagagccgaccccgaccugcugagcgccgagggccuggccccccugcaccugugcagaaccgccgccagccugggcugcgcccaggcccugcuggagcacggcgccagcgugcagagagugggcggcaccggcagagacaccccccugcacguggccgcccagagaggccuggacgagcacgccagacuguaccugggcagaggcgcccacguggacgccagaaacggcagaggcgagaccgcccugagcgccgccugcggcgccgccagaagacccgacgagcacggcagaugccugagacugugcgcccugcugcugagaagaggcgccgaggccgacgccagagacgaggacgagagaagcccccugcacaaggccugcggccacgccagccacagccuggccagacugcugcugagacacggcgccgacgccggcgcccuggacuacggcggcgccagcccccugggcagagugcugcagaccgccagcugcgcccugcaggccagcccccagagaaccgugcaggcccugcugaaccacggcagccccaccguguggcccgacgccuuccccaaggugcugaagaccugcgccagcgugcccgccgugaucgaggugcuguucaacagcuacccccagcugugccugagcgagagcuggaaggaggugauccccgaggagguguuccagaugcacaagcccuucuaccagagccuguucgcccuggcccugacccccagaugccugcagcaccugugcagaugcgcccugagaagacuguucggcaagagaugcuucgaccugaucccccugcugccccugcccaagccccugcagaacuaccugcugcuggagccccagggcgugcugcacuaa

SEQ ID NO: 13886 - RNA, 1008 nt, Artificial Sequence
  ASB1__Homo_sapiens__NP_001035535
auggccgagggcggcagccccgacggcagagccggccccggcagcgccggcagaaaccugaaggaguggcugagagagcaguucugcgaccacccccuggagcacugcgaggacaccagacugcacgacgccgccuacgugggcgaccugcagacccugagaagccugcugcaggaggagagcuacagaagcagaaucaacgagaagagcguguggugcugcggcuggcugcccugcaccccccugagaaucgccgccaccgccggccacggcagcugcguggacuuccugaucagaaagggcgccgagguggaccugguggacgugaagggccagaccgcccuguacguggccguggugaacggccaccuggagagcacccagauccugcuggaggccggcgccgaccccaacggcagcagacaccacagaagcacccccguguaccacgccagcagagugggcagagccgacauccugaaggcccugaucagauacggcgccgacguggacgugaaccaccaccugacccccgacgugcagcccagauucagcagaagacugaccagccugguggugugcccccuguacaucagcgccgccuaccacaaccugcagugcuucagacugcugcugcuggccggcgccaaccccgacuucaacugcaacggccccgugaacacccagggcuucuacagaggcagccccggcugcgugauggacgccgugcugagacacggcugcgaggccgccuucgugagccugcugguggaguucggcgccaaccugaaccuggugaagugggagagccugggccccgagagcagaggcagaagaaagguggaccccgaggcccugcagguguucaaggaggccagaagcgugcccagaacccugcugugccugugcagaguggccgugagaagagcccugggcaagcacagacugcaccugauccccagccugccccugcccgaccccaucaagaaguuccugcugcacgaguaa

SEQ ID NO: 13887 - RNA, 1764 nt, Artificial Sequence
  ASB2__Homo_sapiens__NP_057234
augaccagauucagcuacgccgaguacuucagccuguuccacagcugcagcgcccccagcagaagcaccgccccccccgagagcagccccgccagagcccccaugggccuguuccagggcgugaugcagaaguacagcagcagccuguucaagaccagccagcuggcccccgccgacccccugaucaaggccaucaaggacggcgacgaggaggcccugaagaccaugaucaaggagggcaagaaccuggccgagcccaacaaggagggcuggcugccccugcacgaggccgccuacuacggccaggugggcugccugaaggugcugcagagagccuaccccggcaccaucgaccagagaacccugcaggaggagaccgccguguaccuggccaccugcagaggccaccuggacugccugcugagccugcugcaggccggcgccgagcccgacaucagcaacaagagcagagagaccccccuguacaaggccugcgagagaaagaacgccgaggccgugaagauccuggugcagcacaacgccgacaccaaccacagaugcaacagaggcuggaccgcccugcacgagagcgugagcagaaacgaccuggaggugaugcagauccuggugagcggcggcgccaagguggagagcaagaacgccuacggcaucaccccccuguucguggccgcccagagcggccagcuggaggcccugagauuccuggccaaguacggcgccgacaucaacacccaggccagcgacaacgccagcgcccuguacgaggccugcaagaacgagcacgaggaggugguggaguuccugcugagccagggcgccgacgccaacaagaccaacaaggacggccugcugccccugcacaucgccagcaagaagggcaacuacagaaucgugcagaugcugcugcccgugaccagcagaaccagaaucagaagaagcggcgugagcccccugcaccuggccgccgagagaaaccacgacgaggugcuggaggcccugcugagcgccagauucgacgugaacaccccccuggcccccgagagagccagacuguacgaggacagaagaagcagcgcccuguacuucgccguggugaacaacaacguguacgccaccgagcugcugcugcagcacggcgccgaccccaacagagacgugaucagcccccugcugguggccaucagacacggcugccugagaaccaugcagcugcugcuggaccacggcgccaacaucgacgccuacaucgccacccaccccaccgccuuccccgccaccaucauguucgccaugaagugccugagccugcugaaguuccugauggaccugggcugcgacggcgagcccugcuucagcugccuguacggcaacggcccccacccccccgccccccagcccagcagcagauucaacgacgcccccgccgccgacaaggagcccagcguggugcaguucugcgaguucgugagcgcccccgaggugagcagaugggccggccccaucaucgacgugcugcuggacuacgugggcaacgugcagcugugcagcagacugaaggagcacaucgacagcuucgaggacugggccgugaucaaggagaaggccgagccccccagaccccuggcccaccugugcagacugagagugagaaaggccaucggcaaguacagaaucaagcugcuggacacccugccccugcccggcagacugaucagauaccugaaguacgagaacacccaguaa

SEQ ID NO: 13888 - RNA, 1266 nt, Artificial Sequence
  ASB6__Homo_sapiens__NP_060343
augcccuuccugcacggcuucagaagaaucaucuucgaguaccagccccugguggacgccauccugggcagccugggcauccaggaccccgagagacaggagagccuggacagacccagcuacguggccagcgaggagagcagaauccuggugcugaccgagcugcuggagagaaaggcccacagccccuucuaccaggagggcgugagcaacgcccugcugaagauggccgagcugggccugaccagagccgccgacgugcugcugagacacggcgccaaccugaacuucgaggaccccgugaccuacuacaccgcccugcacaucgccgugcugagaaaccagcccgacaugguggagcugcuggugcaccacggcgccgacgugaacagaagagacagaauccacgagagcagcccccuggaccuggccagcgaggagcccgagagacugcccugccugcagagacugcuggaccugggcgccgacgugaacgccgccgacaagcacggcaagaccgcccugcugcacgcccuggccagcagcgacggcgugcagauccacaacaccgagaacaucagacugcugcuggagggcggcgccgacgugaaggccaccaccaaggacggcgacaccguguucaccugcaucaucuuccugcugggcgagaccgugggcggcgacaaggaggaggcccagaugaucaacagauucugcuuccaggugaccagacugcugcuggcccacggcgccgaccccagcgagugccccgcccacgagagccugacccacaucugccugaagagcuucaagcugcacuucccccugcugagauuccugcuggagagcggcgccgccuacaacugcagccugcacggcgccagcugcuggagcggcuuccacaucaucuucgagagacugugcagccaccccggcugcaccgaggacgagagccacgccgaccugcugagaaaggccgagaccgugcuggaccugauggugaccaacagccagaagcugcagcugcccgagaacuucgacauccaccccgugggcagccuggccgagaagauccaggcccugcacuucagccugagacagcuggagagcuacccccccccccugaagcaccugugcagaguggccaucagacuguaccugcagcccuggcccguggacgugaaggugaaggcccugccccugcccgacagacugaagugguaccugcugagcgagcacagcggcagcguggaggacgacaucuaa

SEQ ID NO: 13889 - RNA, 825 nt, Artificial Sequence
  ASB7__Homo_sapiens__NP_078984
augcugcaccaccacugcagaagaaaccccgagcugcaggaggagcugcagauccaggccgccguggccgccggcgacgugcacaccgugagaaagaugcuggagcagggcuacagccccaacggcagagacgccaacggcuggacccugcugcacuucagcgccgccagaggcaaggagagaugcgugagaguguuccuggagcacggcgccgaccccaccgugaaggaccugaucggcggcuucaccgcccugcacuacgccgccaugcacggcagagccagaaucgccagacugaugcuggagagcgaguacagaagcgacaucaucaacgccaagagcaacgacggcuggaccccccugcacguggccgcccacuacggcagagacagcuucgugagacugcugcuggaguucaaggccgagguggacccccugagcgacaagggcaccaccccccugcagcuggccaucaucagagagagaagcagcugcgugaagauccugcuggaccacaacgccaacaucgacauccagaacggcuuccugcugagauacgccgugaucaagagcaaccacagcuacugcagaauguuccugcagagaggcgccgacaccaaccugggcagacuggaggacggccagaccccccugcaccugagcgcccugagagacgacgugcugugcgccagaaugcuguacaacuacggcgccgacaccaacaccagaaacuacgagggccagaccccccuggccgugagcaucagcaucagcggcagcagcagacccugccuggacuuccugcaggaggugaccagcauguaa

SEQ ID NO: 13890 - RNA, 1074 nt, Artificial Sequence
  ASCC1__Homo_sapiens__NP_001185727
auggaggugcugagaccccagcugaucagaaucgacggcagaaacuacagaaagaaccccgugcaggagcagaccuaccagcacgaggaggacgaggaggacuucuaccagggcagcauggagugcgccgacgagcccugcgacgccuacgagguggagcagaccccccagggcuucagaagcacccugagagcccccagccugcuguacaagcacaucgugggcaagagaggcgacaccagaaagaagaucgagauggagaccaagaccagcaucagcauccccaagcccggccaggacggcgagaucgugaucaccggccagcacagaaacggcgugaucagcgccagaaccagaaucgacgugcugcuggacaccuucagaagaaagcagcccuucacccacuuccuggccuucuuccugaacgagguggaggugcaggagggcuuccugagauuccaggaggaggugcuggccaagugcagcauggaccacggcguggacagcagcaucuuccagaaccccaagaagcugcaccugaccaucggcaugcuggugcugcugagcgaggaggagauccagcagaccugcgagaugcugcagcagugcaaggaggaguucaucaacgacaucagcggcggcaagccccuggagguggagauggccggcaucgaguacaugaacgacgaccccggcaugguggacgugcuguacgccaaggugcacaugaaggacggcagcaacagacugcaggagcugguggacagagugcuggagagauuccaggccagcggccugaucgugaaggaguggaacagcgugaagcugcacgccaccgugaugaacacccuguucagaaaggaccccaacgccgagggcagauacaaccuguacaccgccgagggcaaguacaucuucaaggagagagagagcuucgacggcagaaacauccugaagcuguucgagaacuucuacuucggcagccugaagcugaacagcauccacaucagccagagauucaccguggacagcuucggcaacuacgccagcugcggccagaucgacuucagcuaa

SEQ ID NO: 13891 - RNA, 2046 nt, Artificial Sequence
  ASCC2__Homo_sapiens__NP_001229835
augcccgcccugccccuggaccagcugcagaucacccacaaggaccccaagaccggcaagcugagaaccagccccgcccuggugaucuucgacgagacccugcagaagugccuggacagcuaccugagauacgugcccagaaaguucgacgagggcguggccagcgcccccgaggugguggacaugcagaagagacugcacagaagcguguuccugaccuuccugagaaugagcacccacaaggagagcaagauccuggaccugugcgugcuguucggcaagggcaacagcccccugcugcagaagaugaucggcaacaucuucacccagcagcccagcuacuacagcgaccuggacgagacccugcccaccauccugcagguguucagcaacauccugcagcacugcggccugcagggcgacggcgccaacaccaccccccagaagcuggaggagagaggcagacugacccccagcgacaugccccugcuggagcugaaggacaucgugcuguaccugugcgacaccugcaccacccugugggccuuccuggacaucuucccccuggccugccagaccuuccagaagcacgacuucugcuacagacuggccagcuucuacgaggccgccauccccgagauggagagcgccaucaagaagagaagacuggaggacagcaagcugcugggcgaccuguggcagagacugagccacagcagaaagaagcugauggagaucuuccacaucauccugaaccagaucugccugcugcccauccuggagagcagcugcgacaacauccagggcuucaucgaggaguuccugcagaucuucagcagccugcugcaggagaagagauuccugagagacuacgacgcccuguuccccguggccgaggacaucagccugcugcagcaggccagcagcgugcuggacgagaccagaaccgccuacauccugcaggccguggagagcgccugggagggcguggacagaagaaaggccaccgacgccaaggaccccagcgugaucgaggagcccaacggcgagcccaacggcgugaccgugaccgccgaggccgugagccaggccagcagccaccccgagaacagcgaggaggaggagugcaugggcgccgccgccgccgugggccccgccaugugcggcguggagcuggacagccugaucagccaggugaaggaccugcugcccgaccugggcgagggcuucauccuggccugccuggaguacuaccacuacgaccccgagcaggugaucaacaacauccuggaggagagacuggcccccacccugagccagcuggacagaaaccuggacagagagaugaagcccgaccccaccccccugcugaccagcagacacaacguguuccagaacgacgaguucgacguguucagcagagacagcguggaccugagcagagugcacaagggcaagagcaccagaaaggaggagaacaccagaagccugcugaacgacaagagagccguggccgcccagagacagagauacgagcaguacagcguggugguggaggaggugccccugcagcccggcgagagccugcccuaccacagcguguacuacgaggacgaguacgacgacaccuacgacggcaaccaggugggcgccaacgacgccgacagcgacgacgagcugaucagcagaagacccuucaccaucccccaggugcugagaaccaaggugcccagagagggccaggaggaggacgacgacgacgaggaggacgacgccgacgaggaggcccccaagcccgaccacuucgugcaggaccccgccgugcugagagagaaggccgaggccagaagaauggccuuccuggccaagaagggcuacagacacgacagcagcaccgccguggccggcagccccagaggccacggccagagcagagagaccacccaggagagaagaaagaaggaggccaacaaggccaccagagccaaccacaacagaagaaccauggccgacagaaagagaagcaagggcaugauccccagcuaa

SEQ ID NO: 13892 - RNA, 2196 nt, Artificial Sequence
  ASCC3__Homo_sapiens__NP_001271200
auggcccugcccagacugaccggcgcccugagaagcuucagcaacgugaccaagcaggacaacuacaacgaggagguggccgaccugaagaucaagagaagcaagcugcacgagcaggugcuggaccugggccugaccuggaagaagaucaucaaguuccugaacgagaagcuggagaagagcaagaugcagagcaucaacgaggaccugaaggacauccugcacgccgccaagcagaucgugggcaccgacaacggcagagaggccaucgagagcggcgccgccuuccuguucaugaccuuccaccugaaggacagcgugggccacaaggagaccaaggccaucaagcagauguucggccccuuccccagcagcagcgccaccgccgccugcaacgccaccaacagaaucaucagccacuucagccaggacgaccugaccgcccuggugcagaugaccgagaaggagcacggcgacagaguguucuucggcaagaaccuggccuucagcuucgacaugcacgaccuggaccacuucgacgagcugcccaucaacggcgagacccagaagaccaucagccuggacuacaagaaguuccugaacgagcaccugcaggaggccugcacccccgagcugaagcccguggagaagaccaacggcagcuuccuguggugcgagguggagaaguaccugaacagcacccugaaggagaugaccgaggugcccagaguggaggaccugugcugcacccuguacgacaugcuggccagcaucaagagcggcgacgagcugcaggacgagcuguucgagcugcugggccccgagggccuggagcugaucgagaagcugcugcagaacagaaucaccaucguggacagauuccugaacagcagcaacgaccacagauuccaggcccugcaggacaacugcaagaagauccugggcgagaacgccaagcccaacuacggcugccaggugaccauccagagcgagcaggagaagcagcugaugaagcaguacagaagagaggagaagagaaucgccagaagagagaagaaggccggcgaggaccuggaggugagcgagggccugaugugcuucgaccccaaggagcugagaauccagagagagcaggcccugcugaacgccagaagcgugcccauccugagcagacagagagacgccgacguggagaagauccacuacccccacguguacgacagccaggccgaggccaugaagaccagcgccuucaucgccggcgccaagaugauccugcccgagggcauccagagagagaacaacaagcuguacgaggaggugagaauccccuacagcgagcccaugccccugagcuucgaggagaagcccguguacauccaggaccuggacgagaucggccagcuggccuucaagggcaugaagagacugaacagaauccagagcaucguguucgagaccgccuacaacaccaacgagaacaugcugaucugcgcccccaccggcgccggcaagaccaacaucgccaugcugaccgugcugcacgagaucagacagcacuuccagcagggcgugaucaagaagaacgaguucaagaucguguacguggcccccaugaaggcccuggccgccgagaugaccgacuacuucagcagaagacuggagccccugggcaucaucgugaaggagcugaccggcgacaugcagcugagcaagagcgagauccugagaacccagaugcuggugaccacccccgagaagugggacguggugaccagaaagagcgugggcgacguggcccugagccagaucgugagacugcugauccuggacgaggugcaccugcugcacgaggacagaggccccgugcuggagagcaucguggccagaacccugagacagguggagagcacccagagcaugaucagaauccugggccugagcgccacccugcccaacuaccuggacguggccaccuuccugcacgugaaccccuacaucggccuguucuucuucgacggcagauucagacccgugccccugggccagaccuuccugggcaucaagugcgccaacaagaugcagcagcugaacaacauggacgaggugugcuacgagaacgugcugaagcaggugaaggccggccaccaggugcaccuguucuaccugcugcugcaccuguucaucugcuucuaa

SEQ ID NO: 13893 - RNA, 711 nt, Artificial Sequence
  ASCL1__Homo_sapiens__NP_004307
auggagagcagcgccaagauggagagcggcggcgccggccagcagccccagccccagccccagcagcccuuccugccccccgccgccugcuucuucgccaccgccgccgccgccgccgccgccgccgccgccgccgccgcccagagcgcccagcagcagcagcagcagcagcagcagcagcagcaggccccccagcugagacccgccgccgacggccagcccagcggcggcggccacaagagcgcccccaagcaggugaagagacagagaagcagcagccccgagcugaugagaugcaagagaagacugaacuucagcggcuucggcuacagccugccccagcagcagcccgccgccguggccagaagaaacgagagagagagaaacagagugaagcuggugaaccugggcuucgccacccugagagagcacgugcccaacggcgccgccaacaagaagaugagcaagguggagacccugagaagcgccguggaguacaucagagcccugcagcagcugcuggacgagcacgacgccgugagcgccgccuuccaggccggcgugcugagccccaccaucagccccaacuacagcaacgaccugaacagcauggccggcagccccgugagcagcuacagcagcgacgagggcagcuacgacccccugagccccgaggagcaggagcugcuggacuucaccaacugguucuaa

SEQ ID NO: 13894 - RNA, 582 nt, Artificial Sequence
  ASCL2__Homo_sapiens__NP_005161
auggacggcggcacccugcccagaagcgccccccccgccccccccgugcccgugggcugcgccgccagaagaagacccgccagccccgagcugcugagaugcagcagaagaagaagacccgccaccgccgagaccggcggcggcgccgccgccguggccagaagaaacgagagagagagaaacagagugaagcuggugaaccugggcuuccaggcccugagacagcacgugccccacggcggcgccagcaagaagcugagcaagguggagacccugagaagcgccguggaguacaucagagcccugcagagacugcuggccgagcacgacgccgugagaaacgcccuggccggcggccugagaccccaggccgugagacccagcgcccccagaggcccccccggcaccacccccguggccgccagccccagcagagccagcagcagccccggcagaggcggcagcagcgagcccggcagccccagaagcgccuacagcagcgacgacagcggcugcgagggcgcccugagccccgccgagagagagcugcuggacuucagcagcuggcugggcggcuacuaa

SEQ ID NO: 13895 - RNA, 522 nt, Artificial Sequence
  ASCL4__Homo_sapiens__NP_982260
augauggagaccagaaagcccgccgagagacuggcccugcccuacagccugagaaccgccccccugggcgugcccggcacccugcccggccugcccagaagagacccccugagaguggcccugagacuggacgccgccugcugggagugggccagaagcggcugcgccagaggcuggcaguaccugcccgugccccuggacagcgccuucgagcccgccuuccugagaaagagaaacgagagagagagacagagagugagaugcgugaacgagggcuacgccagacugagagaccaccugcccagagagcuggccgacaagagacugagcaagguggagacccugagagccgccaucgacuacaucaagcaccugcaggagcugcuggagagacaggccuggggccuggagggcgccgccggcgccgugccccagagaagagccgagugcaacagcgacggcgagagcaaggccagcagcgcccccagccccagcagcgagcccgaggagggcggcagcuaa

SEQ ID NO: 13896 - RNA, 615 nt, Artificial Sequence
  ASF1A__Homo_sapiens__NP_054753
auggccaaggugcaggugaacaacgugguggugcuggacaaccccagccccuucuacaaccccuuccaguucgagaucaccuucgagugcaucgaggaccugagcgaggaccuggaguggaagaucaucuacgugggcagcgccgagagcgaggaguacgaccaggugcuggacagcgugcuggugggccccgugcccgccggcagacacauguucguguuccaggccgacgcccccaaccccggccugauccccgacgccgacgccgugggcgugaccguggugcugaucaccugcaccuacagaggccaggaguucaucagagugggcuacuacgugaacaacgaguacaccgagaccgagcugagagagaacccccccgugaagcccgacuucagcaagcugcagagaaacauccuggccagcaaccccagagugaccagauuccacaucaacugggaggacaacaccgagaagcuggaggacgccgagagcagcaaccccaaccugcagagccugcugagcaccgacgcccugcccagcgccagcaagggcuggagcaccagcgagaacagccugaacgugaugcuggagagccacauggacugcauguaa

SEQ ID NO: 13897 - RNA, 609 nt, Artificial Sequence
  ASF1B__Homo_sapiens__NP_060624
auggccaaggugagcgugcugaacguggccgugcuggagaaccccagccccuuccacagccccuucagauucgagaucagcuucgagugcagcgaggcccuggccgacgaccuggaguggaagaucaucuacgugggcagcgccgagagcgaggaguucgaccagauccuggacagcgugcuggugggccccgugcccgccggcagacacauguucguguuccaggccgacgcccccaaccccagccugauccccgagaccgacgccgugggcgugaccguggugcugaucaccugcaccuaccacggccaggaguucaucagagugggcuacuacgugaacaacgaguaccugaaccccgagcugagagagaacccccccaugaagcccgacuucagccagcugcagagaaacauccuggccagcaaccccagagugaccagauuccacaucaacugggacaacaacauggacagacuggaggccaucgagacccaggaccccagccugggcugcggccugccccugaacugcacccccaucaagggccugggccugcccggcugcauccccggccugcugcccgagaacagcauggacugcaucuaa

SEQ ID NO: 13898 - RNA, 8895 nt, Artificial Sequence
  ASH1L__Homo_sapiens__XP_006711513
auggaccccagaaacaccgccaugcugggccugggcagcgacagcgagggcuucagcagaaagagccccagcgccaucagcaccggcacccuggugagcaagagagagguggagcuggagaagaacaccaaggaggaggaggaccugagaaagagaaacagagagagaaacaucgaggccggcaaggacgacggccugaccgacgcccagcagcaguucagcgugaaggagaccaacuucagcgagggcaaccugaagcugaagaucggccugcaggccaagagaaccaagaagccccccaagaaccuggagaacuacgugugcagacccgccaucaagaccaccaucaagcaccccagaaaggcccugaagagcggcaagaugaccgacgagaagaacgagcacugccccagcaagagagaccccagcaagcuguacaagaaggccgacgacguggccgccaucgagugccagagcgaggaggugaucagacugcacagccagggcgagaacaacccccugagcaagaagcugagccccgugcacagcgagauggccgacuacaucaacgccacccccagcacccugcugggcagcagagaccccgaccugaaggacagagcccugcugaacggcggcaccagcgugaccgagaagcuggcccagcugaucgccaccugcccccccagcaagagcagcaagaccaagcccaagaagcugggcaccggcaccaccgccggccuggugagcaaggaccugaucagaaaggccggcgugggcagcguggccggcaucauccacaaggaccugaucaagaagcccaccaucagcaccgccgugggccuggugaccaaggaccccggcaagaagcccguguucaacgccgccgugggccuggugaacaaggacagcgugaagaagcugggcaccggcaccaccgccguguucaucaacaagaaccugggcaagaagcccggcaccaucaccaccgugggccugcugagcaaggacagcggcaagaagcugggcaucggcaucgugcccggccuggugcacaaggagagcggcaagaagcugggccugggcaccguggugggccuggugaacaaggaccugggcaagaagcugggcagcaccgugggccugguggccaaggacugcgccaagaagaucguggccagcagcgccaugggccuggugaacaaggacaucggcaagaagcugaugagcugcccccuggccggccugaucagcaaggacgccaucaaccugaaggccgaggcccugcugcccacccaggagccccugaaggccagcugcagcaccaacaucaacaaccaggagagccaggagcugagcgagagccugaaggacagcgccaccagcaagaccuucgagaagaacguggugagacagaacaaggagagcauccuggagaaguucagcgugagaaaggagaucaucaaccuggagaaggagauguucaacgagggcaccugcauccagcaggacagcuucagcagcagcgagaagggcagcuacgagaccagcaagcacgagaagcagccccccguguacugcaccagccccgacuucaagaugggcggcgccagcgacgugagcaccgccaagagccccuucagcgccgugggcgagagcaaccugcccagccccagccccaccgugagcgugaacccccugaccagaagcccccccgagaccagcagccagcuggcccccaacccccugcugcugagcagcaccaccgagcugaucgaggagaucagcgagagcgugggcaagaaccaguucaccagcgagagcacccaccugaacgugggccacagaagcgugggccacagcaucagcaucgagugcaagggcaucgacaaggaggugaacgacagcaagaccacccacaucgacauccccagaaucagcagcagccugggcaagaagcccagccugaccagcgagagcagcauccacaccaucacccccagcguggugaacuucaccagccuguucagcaacaagcccuuccugaagcugggcgccgugagcgccagcgacaagcacugccagguggccgagagccugagcaccagccugcagagcaagccccugaagaagagaaagggcagaaagcccagauggaccaaggugguggccagaagcaccugcagaagccccaagggccuggagcuggagagaagcgagcuguucaagaacgugagcugcagcagccugagcaacagcaacagcgagcccgccaaguucaugaagaacaucggcccccccagcuucguggaccacgacuuccugaagagaagacugcccaagcugagcaagagcaccgcccccagccuggcccugcuggccgacagcgagaagcccagccacaagagcuucgccacccacaagcugagcagcagcaugugcgugagcagcgaccugcugagcgacaucuacaagcccaagagaggcagacccaagagcaaggagaugccccagcuggagggcccccccaagagaacccugaagauccccgccagcaagguguucagccugcagagcaaggaggagcaggagccccccauccugcagcccgagaucgagauccccagcuucaagcagggccugagcgugagccccuuccccaagaagagaggcagacccaagagacagaugagaagccccgugaagaugaagccccccgugcugagcguggcccccuucguggccaccgagagccccagcaagcuggagagcgagagcgacaaccacagaagcagcagcgacuucuucgagagcgaggaccagcugcaggaccccgacgaccuggacgacagccacagacccagcgugugcagcaugagcgaccuggagauggagcccgacaagaagaucaccaagagaaacaacggccagcugaugaagaccaucaucagaaagaucaacaagaugaagacccugaagagaaagaagcugcugaaccagauccugagcagcagcguggagagcagcaacaagggcaaggugcagagcaagcugcacaacaccgugagcagccuggccgccaccuucggcagcaagcugggccagcagaucaacgugagcaagaagggcaccaucuacaucggcaagagaagaggcagaaagcccaagaccgugcugaacggcauccugagcggcagccccaccagccuggccgugcuggagcagaccgcccagcaggccgccggcagcgcccugggccagauccugcccccccugcugcccagcagcgccagcagcagcgagauccugcccagccccaucugcagccagagcagcggcaccagcggcggccagagccccgugagcagcgacgccggcuucguggagcccagcagcgugcccuaccugcaccugcacagcagacagggcagcaugauccagacccuggccaugaagaaggccagcaagggcagaagaagacugagcccccccacccugcugcccaacagccccagccaccugagcgagcugaccagccugaaggaggccacccccagccccaucagcgagagccacagcgacgagaccauccccagcgacagcggcaucggcaccgacaacaacagcaccagcgacagagccgagaaguucugcggccagaagaagagaagacacagcuucgagcacgugagccugaucccccccgagaccagcaccgugcugagcagccugaaggagaagcacaagcacaagugcaagagaagaaaccacgacuaccugagcuacgacaagaugaagagacagaagagaaagagaaagaagaaguacccccagcugagaaacagacaggaccccgacuucaucgccgagcuggaggagcugaucagcagacugagcgagaucagaaucacccacagaagccaccacuucauccccagagaccugcugcccaccaucuucagaaucaacuucaacagcuucuacacccaccccagcuucccccuggacccccugcacuacaucagaaagcccgaccugaagaagaagagaggcagaccccccaagaugagagaggccauggccgagaugcccuucaugcacagccugagcuucccccugagcagcaccggcuucuaccccagcuacggcaugcccuacagccccagcccccugaccgccgcccccaucggccugggcuacuacggcagauacccccccacccuguacccccccccccccagccccagcuucaccaccccccugcccccccccagcuacaugcacgccggccaccugcugcugaaccccgccaaguaccacaagaagaagcacaagcugcugagacaggaggccuuccugaccaccagcagaaccccccugcugagcaugagcaccuaccccagcgugccccccgagauggccuacggcuggaugguggagcacaagcacagacacagacacaagcacagagagcacagaagcagcgagcagccccaggugagcauggacaccggcagcagcagaagcgugcuggagagccugaagagauacagauucggcaaggacgccgugggcgagagauacaagcacaaggagaagcacagaugccacaugagcugcccccaccugagccccagcaagagccugaucaacagagaggagcagugggugcacagagagcccagcgagagcagcccccuggcccugggccugcagaccccccugcagaucgacugcagcgagagcagccccagccugagccugggcggcuucacccccaacagcgagcccgccagcagcgacgagcacaccaaccuguucaccagcgccaucggcagcugcagagugagcaaccccaacagcagcggcagaaagaagcugaccgacagccccggccuguucagcgcccaggacaccagccugaacagacugcacagaaaggagagccugcccagcaacgagagagccgugcagacccuggccggcagccagcccaccagcgacaagcccagccagagacccagcgagagcaccaacugcagccccaccagaaagagaagcagcagcgagagcaccagcagcaccgugaacggcgugcccagcagaagccccagacugguggccagcggcgacgacagcguggacagccugcugcagagaauggugcagaacgaggaccaggagcccauggagaagagcaucgacgccgugaucgccaccgccagcgccccccccagcagcagccccggcagaagccacagcaaggacagaacccugggcaagcccgacagccugcuggugcccgccgugaccagcgacagcugcaacaacagcaucagccugcugagcgagaagcugaccagcagcugcagcccccaccacaucaagagaagcgugguggaggccaugcagagacaggccagaaagaugugcaacuacgacaagauccuggccaccaagaagaaccuggaccacgugaacaagauccugaaggccaagaagcugcagagacaggccagaaccggcaacaacuucgugaagagaagacccggcagacccagaaagugcccccugcaggccguggugagcaugcaggccuuccaggccgcccaguucgugaaccccgagcugaacagagacgaggagggcgccgcccugcaccugagccccgacaccgugaccgacgugaucgaggccguggugcagagcgugaaccugaaccccgagcacaagaagggccugaagagaaagggcuggcugcuggaggagcagaccagaaagaagcagaagccccugcccgaggaggaggagcaggagaacaacaagagcuucaacgaggcccccguggagauccccagccccagcgagacccccgccaagcccagcgagcccgagagcacccugcagcccgugcugagccugauccccagagagaagaagccccccagaccccccaagaagaaguaccagaaggccggccuguacagcgacguguacaagaccaccgaccccaagagcagacugauccagcugaagaaggagaagcuggaguacacccccggcgagcacgaguacggccuguuccccgcccccauccacgugggcaaguaccugagacagaagagaaucgacuuccagcugcccuacgacauccuguggcaguggaagcacaaccagcuguacaagaagcccgacgugccccuguacaagaagaucagaagcaacguguacguggacgugaagccccugagcggcuacgaggccaccaccugcaacugcaagaagcccgacgacgacaccagaaagggcugcguggacgacugccugaacagaaugaucuucgccgagugcagccccaacaccugccccugcggcgagcagugcugcaaccagagaauccagagacacgagugggugcagugccuggagagauucagagccgaggagaagggcuggggcaucagaaccaaggagccccugaaggccggccaguucaucaucgaguaccugggcgagguggugagcgagcaggaguucagaaacagaaugaucgagcaguaccacaaccacagcgaccacuacugccugaaccuggacagcggcauggugaucgacagcuacagaaugggcaacgaggccagauucaucaaccacagcugcgaccccaacugcgagaugcagaaguggagcgugaacggcguguacagaaucggccuguacgcccugaaggacaugcccgccggcaccgagcugaccuacgacuacaacuuccacagcuucaacguggagaagcagcagcugugcaagugcggcuucgagaagugcagaggcaucaucggcggcaagagccagagagugaacggccugaccagcagcaagaacagccagcccauggccacccacaagaagagcggcagaagcaaggagaagagaaagagcaagcacaagcugaagaagagaagaggccaccugagcgaggagcccagcgagaacaucaacacccccaccagacugaccccccagcugcagaugaagcccaugagcaacagagagagaaacuucgugcugaagcaccacguguuccuggugagaaacugggagaagaucagacagaagcaggaggaggugaagcacaccagcgacaacauccacagcgccagccuguacaccagauggaacggcaucugcagagacgacggcaacaucaagagcgacguguucaugacccaguucagcgcccugcagaccgccagaagcgugagaaccagaagacuggccgccgccgaggagaacaucgagguggccagagccgccagacuggcccagaucuucaaggagaucugcgacggcaucaucagcuacaaggacagcagcagacaggcccuggccgccccccugcugaaccugccccccaagaagaagaacgccgacuacuacgagaagaucagcgacccccuggaccugaucaccaucgagaagcagauccugaccggcuacuacaagaccguggaggccuucgacgccgacaugcugaagguguucagaaacgccgagaaguacuacggcagaaagagccccgugggcagagacgugugcagacugagaaaggccuacuacaacgccagacacgaggccagcgcccagaucgacgagaucgugggcgagaccgccagcgaggccgacagcagcgagaccagcgugagcgagaaggagaacggccacgagaaggacgacgacgugaucagaugcaucugcggccuguacaaggacgagggccugaugauccagugcgacaagugcaugguguggcagcacugcgacugcaugggcgugaacagcgacguggagcacuaccugugcgagcagugcgaccccagacccguggacagagaggugcccaugauccccagaccccacuacgcccagcccggcugcguguacuucaucugccugcugagagacgaccugcugcugagacagggcgacugcguguaccugaugagagacagcagaagaacccccgacggccaccccgugagacagagcuacagacugcugagccacaucaacagagacaagcuggacaucuucagaaucgagaagcuguggaagaacgagaaggaggagagauucgccuucggccaccacuacuucagaccccacgagacccaccacagccccagcagaagauucuaccacaacgagcuguucagagugccccuguacgagaucaucccccuggaggccguggugggcaccugcugcgugcuggaccuguacaccuacugcaagggcagacccaagggcgugaaggagcaggacguguacaucugcgacuacagacuggacaagagcgcccaccuguucuacaagauccacagaaacagauaccccgugugcaccaagcccuacgccuucgaccacuuccccaagaagcugacccccaagaaggacuucagcccccacuacgugcccgacaacuacaagagaaacggcggcagaagcagcuggaagagcgagagaagcaagcccccccugaaggaccugggccaggaggacgacgcccugccccugaucgaggaggugcuggccagccaggagcaggccgccaacgagauccccagccuggaggagcccgagagagagggcgccaccgccaacgugagcgagggcgagaagaagaccgaggagagcagccaggagccccagagcaccugcacccccgaggagagaagacacaaccagagagagagacugaaccagauccugcugaaccugcuggagaagauccccggcaagaacgccaucgacgugaccuaccugcuggaggagggcagcggcagaaagcugagaagaagaacccuguucauccccgagaacagcuucagaaaguaa

SEQ ID NO: 13899 - RNA, 1605 nt, Artificial Sequence
  ASH2L__Homo_sapiens__NP_001098684
auggacacccaggccggcagcguggacgaggagaacggcagacagcugggcgagguggagcugcagugcggcaucugcaccaagugguucaccgccgacaccuucggcaucgacaccagcagcugccugcccuucaugaccaacuacagcuuccacugcaacgugugccaccacagcggcaacaccuacuuccugagaaagcaggccaaccugaaggagaugugccugagcgcccuggccaaccugaccuggcagagcagaacccaggacgagcaccccaagaccauguucagcaaggacaaggacaucauccccuucaucgacaaguacugggagugcaugaccaccagacagagacccggcaagaugaccuggcccaacaacaucgugaagaccaugagcaaggagagagacguguuccuggugaaggagcaccccgaccccggcagcaaggaccccgaggaggacuaccccaaguucggccugcuggaccaggaccugagcaacaucggccccgccuacgacaaccagaagcagagcagcgccgugagcaccagcggcaaccugaacggcggcaucgccgccggcagcagcggcaagggcagaggcgccaagagaaagcagcaggacggcggcaccaccggcaccaccaagaaggccagaagcgacccccuguucagcgcccagagacugcccccccacggcuacccccuggagcaccccuucaacaaggacggcuacagauacauccuggccgagcccgacccccacgcccccgaccccgagaagcuggagcuggacugcugggccggcaagcccauccccggcgaccuguacagagccugccuguacgagagagugcugcuggcccugcacgacagagccccccagcugaagaucagcgacgacagacugaccguggugggcgagaagggcuacagcauggugagagccagccacggcgugagaaagggcgccugguacuucgagaucaccguggacgagaugccccccgacaccgccgccagacugggcuggagccagccccugggcaaccugcaggccccccugggcuacgacaaguucagcuacagcuggagaagcaagaagggcaccaaguuccaccagagcaucggcaagcacuacagcagcggcuacggccagggcgacgugcugggcuucuacaucaaccugcccgaggacaccgagaccgccaagagccugcccgacaccuacaaggacaaggcccugaucaaguucaagagcuaccuguacuucgaggagaaggacuucguggacaaggccgagaagagccugaagcagaccccccacagcgagaucaucuucuacaagaacggcgugaaccagggcguggccuacaaggacaucuucgagggcguguacuuccccgccaucagccuguacaagagcugcaccgugagcaucaacuucggccccugcuucaaguacccccccaaggaccugaccuacagacccaugagcgacaugggcuggggcgccgugguggagcacacccuggccgacgugcuguaccacguggagaccgagguggacggcagaagaagcccccccugggagcccuaa

SEQ ID NO: 13900 - RNA, 1587 nt, Artificial Sequence
  ASIC1__Homo_sapiens__NP_001086
auggagcugaaggccgaggaggaggaggugggcggcgugcagcccgugagcauccaggccuucgccagcagcagcacccugcacggccuggcccacaucuucagcuacgagagacugagccugaagagagcccugugggcccugugcuuccugggcagccuggccgugcugcugugcgugugcaccgagagagugcaguacuacuuccacuaccaccacgugaccaagcuggacgagguggccgccagccagcugaccuuccccgccgugacccugugcaaccugaacgaguucagauucagccaggugagcaagaacgaccuguaccacgccggcgagcugcuggcccugcugaacaacagauacgagauccccgacacccagauggccgacgagaagcagcuggagauccugcaggacaaggccaacuucagaagcuucaagcccaagcccuucaacaugagagaguucuacgacagagccggccacgacaucagagacaugcugcugagcugccacuucagaggcgaggugugcagcgccgaggacuucaaggugguguucaccagauacggcaagugcuacaccuucaacagcggcagagacggcagacccagacugaagaccaugaagggcggcaccggcaacggccuggagaucaugcuggacauccagcaggacgaguaccugcccguguggggcgagaccgacgagaccagcuucgaggccggcaucaaggugcagauccacagccaggacgagccccccuucaucgaccagcugggcuucggcguggcccccggcuuccagaccuucguggccugccaggagcagagacugaucuaccugcccccccccuggggcaccugcaaggccgugaccauggacagcgaccuggacuucuucgacagcuacagcaucaccgccugcagaaucgacugcgagaccagauaccugguggagaacugcaacugcagaauggugcacaugcccggcgacgcccccuacugcacccccgagcaguacaaggagugcgccgaccccgcccuggacuuccugguggagaaggaccaggaguacugcgugugcgagaugcccugcaaccugaccagauacggcaaggagcugagcauggugaagauccccagcaaggccagcgccaaguaccuggccaagaaguucaacaagagcgagcaguacaucggcgagaacauccuggugcuggacaucuucuucgaggugcugaacuacgagaccaucgagcagaagaaggccuacgagaucgccggccugcugggcgacaucggcggccagaugggccuguucaucggcgccagcauccugaccgugcuggagcuguucgacuacgccuacgaggugaucaagcacaagcugugcagaagaggcaagugccagaaggaggccaagagaagcagcgccgacaagggcguggcccugagccuggacgacgugaagagacacaaccccugcgagagccugagaggccaccccgccggcaugaccuacgccgccaacauccugccccaccaccccgccagaggcaccuucgaggacuucaccugcuaa

SEQ ID NO: 13901 - RNA, 1539 nt, Artificial Sequence
  ASIC2__Homo_sapiens__NP_001085
auggaccugaaggagagccccagcgagggcagccugcagcccagcagcauccagaucuucgccaacaccagcacccugcacggcaucagacacaucuucguguacggcccccugaccaucagaagagugcugugggccguggccuucgugggcagccugggccugcugcugguggagagcagcgagagagugagcuacuacuucagcuaccagcacgugaccaagguggacgaggugguggcccagagccugguguuccccgccgugacccugugcaaccugaacggcuucagauucagcagacugaccaccaacgaccuguaccacgccggcgagcugcuggcccugcuggacgugaaccugcagauccccgacccccaccuggccgaccccagcgugcuggaggcccugagacagaaggccaacuucaagcacuacaagcccaagcaguucagcaugcuggaguuccugcacagagugggccacgaccugaaggacaugaugcuguacugcaaguucaagggccaggagugcggccaccaggacuucaccaccguguucaccaaguacggcaagugcuacauguucaacagcggcgaggacggcaagccccugcugaccaccgugaagggcggcaccggcaacggccuggagaucaugcuggacauccagcaggacgaguaccugcccaucuggggcgagaccgaggagaccaccuucgaggccggcgugaaggugcagauccacagccagagcgagccccccuucauccaggagcugggcuucggcguggcccccggcuuccagaccuucguggccacccaggagcagagacugaccuaccugcccccccccuggggcgagugcagaagcagcgagaugggccuggacuucuuccccguguacagcaucaccgccugcagaaucgacugcgagaccagauacaucguggagaacugcaacugcagaauggugcacaugcccggcgacgcccccuucugcacccccgagcagcacaaggagugcgccgagcccgcccugggccugcuggccgagaaggacagcaacuacugccugugcagaacccccugcaaccugaccagauacaacaaggagcugagcauggugaagauccccagcaagaccagcgccaaguaccuggagaagaaguucaacaagagcgagaaguacaucagcgagaacauccuggugcuggacaucuucuucgaggcccugaacuacgagaccaucgagcagaagaaggccuacgagguggccgcccugcugggcgacaucggcggccagaugggccuguucaucggcgccagcauccugaccauccuggagcuguucgacuacaucuacgagcugaucaaggagaagcugcuggaccugcugggcaaggaggaggacgagggcagccacgacgagaacgugagcaccugcgacaccaugcccaaccacagcgagaccaucagccacaccgugaacgugccccugcagaccacccugggcacccuggaggagaucgccugcuaa

SEQ ID NO: 13902 - RNA, 1596 nt, Artificial Sequence
  ASIC3__Homo_sapiens__NP_004760
augaagcccaccagcggccccgaggaggccagaagacccgccagcgacaucagaguguucgccagcaacugcagcaugcacggccugggccacguguucggccccggcagccugagccugagaagaggcaugugggccgccgccguggugcugagcguggccaccuuccuguaccagguggccgagagagugagauacuacagagaguuccaccaccagaccgcccuggacgagagagagagccacagacugaucuuccccgccgugacccugugcaacaucaacccccugagaagaagcagacugacccccaacgaccugcacugggccggcagcgcccugcugggccuggaccccgccgagcacgccgccuuccugagagcccugggcagaccccccgccccccccggcuucaugcccagccccaccuucgacauggcccagcuguacgccagagccggccacagccuggacgacaugcugcuggacugcagauucagaggccagcccugcggccccgagaacuucaccaccaucuucaccagaaugggcaagugcuacaccuucaacagcggcgccgacggcgccgagcugcugaccaccaccagaggcggcaugggcaacggccuggacaucaugcuggacgugcagcaggaggaguaccugcccguguggagagacaacgaggagacccccuucgaggugggcaucagagugcagauccacagccaggaggagccccccaucaucgaccagcugggccugggcgugagccccggcuaccagaccuucgugagcugccagcagcagcagcugagcuuccugcccccccccuggggcgacugcagcagcgccagccugaaccccaacuacgagcccgagcccagcgacccccugggcagccccagccccagccccagcccccccuacacccugaugggcugcagacuggccugcgagaccagauacguggccagaaagugcggcugcagaaugguguacaugcccggcgacgugcccgugugcagcccccagcaguacaagaacugcgcccaccccgccaucgacgccaugcugagaaaggacagcugcgccugccccaaccccugcgccagcaccagauacgccaaggagcugagcauggugagaauccccagcagagccgccgccagauuccuggccagaaagcugaacagaagcgaggccuacaucgccgagaacgugcuggcccuggacaucuucuucgaggcccugaacuacgagaccguggagcagaagaaggccuacgagaugagcgagcugcugggcgacaucggcggccagaugggccuguucaucggcgccagccugcugaccauccuggagauccuggacuaccugugcgagguguucagagacaaggugcugggcuacuucuggaacagacagcacagccagagacacagcagcaccaaccugcugcaggagggccugggcagccacagaacccaggugccccaccugagccugggccccagaccccccaccccccccugcgccgugaccaagacccugagcgccagccacagaaccugcuaccuggugacccagcuguaa

SEQ ID NO: 13903 - RNA, 1944 nt, Artificial Sequence
  ASIC4__Homo_sapiens__NP_878267
augcugagcggcgccgccggcgccgccagaagaggcggcgccgcccuggcccccagccugaccagaagccuggccggcacccacgccggcgccgacagcugcgccggcgccgacaagggcagccacaaggagaccaucgaggagagagacaagagacagcagagacagcagagacagagacagcaccagggcugcggcgccgccggcagcggcagcgacagccccaccagcggcccccaccccgugcccgugcuguucccccuggcccugagccuggaggagcagccccugcccccccugccccugggcagagcccccggccugcuggccagagagggccagggcagagaggcccuggccagccccagcagcagaggccagaugcccaucgagaucgugugcaagaucaaguucgccgaggaggacgccaagcccaaggagaaggaggccggcgacgagcagagccugcugggcgccguggcccccggcgccgcccccagagaccuggccaccuucgccagcaccagcacccugcacggccugggcagagccugcggccccggcccccacggccugagaagaacccugugggcccuggcccugcugaccagccuggccgccuuccuguaccaggccgccggccuggccagaggcuaccugaccagaccccaccugguggccauggaccccgccgcccccgcccccguggccggcuuccccgccgugacccugugcaacaucaacagauucagacacagcgcccugagcgacgccgacaucuuccaccuggccaaccugaccggccugccccccaaggacagagacggccacagagccgccggccugagauaccccgagcccgacaugguggacauccugaacagaaccggccaccagcuggccgacaugcugaagagcugcaacuucagcggccaccacugcagcgccagcaacuucagcgugguguacaccagauacggcaagugcuacaccuucaacgccgaccccagaagcagccugcccagcagagccggcggcaugggcagcggccuggagaucaugcuggacauccagcaggaggaguaccugcccaucuggagagagaccaacgagaccagcuucgaggccggcaucagagugcagauccacagccaggaggagccccccuacauccaccagcugggcuucggcgugagccccggcuuccagaccuucgugagcugccaggagcagagacugaccuaccugccccagcccuggggcaacugcagagccgagagcgagcugagagagcccgagcugcagggcuacagcgccuacagcgugagcgccugcagacugagaugcgagaaggaggccgugcugcagagaugccacugcagaauggugcacaugcccgacagccugggcggcggccccgagggccccugcuucugccccacccccugcaaccugaccagauacggcaaggagaucagcauggugagaauccccaacagaggcagcgccagauaccuggccagaaaguacaacagaaacgagaccuacaucagagagaacuuccuggugcuggacguguucuucgaggcccugaccagcgaggccauggagcagagagccgccuacggccugagcgcccugcugggcgaccugggcggccagaugggccuguucaucggcgccagcauccugacccugcuggagauccuggacuacaucuacgaggugagcugggacagacugaagagaguguggagaagacccaagaccccccugagaaccagcaccggcggcaucagcacccugggccugcaggagcugaaggagcagagccccugccccagcagaggcagaguggagggcggcggcgugagcagccugcugcccaaccaccaccacccccacggcccccccggcggccuguucgaggacuucgccugcuaa

SEQ ID NO: 13904 - RNA, 1518 nt, Artificial Sequence
  ASIC5__Homo_sapiens__NP_059115
auggagcagaccgagaagagcaagguguacgccgagaacggccugcuggagaagaucaagcugugccugagcaagaagccccugcccagccccaccgagagaaagaaguucgaccacgacuucgccaucagcaccagcuuccacggcauccacaacaucgugcagaacagaagcaagaucagaagagugcuguggcuggugguggugcugggcagcgugagccuggugaccuggcagaucuacaucagacugcugaacuacuucaccuggcccaccaccaccagcaucgaggugcaguacguggagaagauggaguuccccgccgugaccuucugcaaccugaacagauuccagaccgacgccguggccaaguucggcgugaucuucuuccuguggcacaucgugagcaaggugcugcaccugcaggagaucaccgccaacagcaccggcagcagagaggccaccgacuucgccgccagccaccagaacuucagcaucguggaguucaucagaaacaagggcuucuaccugaacaacagcacccugcuggacugcgaguucuucggcaagcccugcagccccaaggacuucgcccacguguucaccgaguacggcaacugcuucaccuucaaccacggcgagacccugcaggccaagagaaaggugagcgugagcggcagaggccugagccugcuguucaacgugaaccaggaggccuucaccgacaaccccgcccugggcuucguggacgccggcaucaucuucgugauccacagccccaagaaggugccccaguucgacggccugggccugcugagccccgugggcaugcacgccagagugaccaucagacaggugaagaccgugcaccaggaguaccccuggggcgagugcaaccccaacaucaagcugcagaacuucagcagcuacagcaccagcggcugccugaaggagugcaaggcccagcacaucaagaagcagugcggcugcgugcccuuccugcugcccggcuacggcaucgagugcgaccugcagaaguacuucagcugcgugagccccgugcuggaccacaucgaguucaaggaccugugcaccgugggcacccacaacagcagcugccccgugagcugcgaggagaucgaguaccccgccaccaucagcuacagcagcuuccccagccagaaggcccugaaguaccugagcaagaagcugaaccagagcagaaaguacaucagagagaaccuggugaagaucgagaucaacuacagcgaccugaacuacaagaucacccagcagcagaaggccgugagcgugagcgagcugcuggccgaccugggcggccagcugggccuguucugcggcgccagccugaucaccaucaucgagaucaucgaguaccuguucaccaacuucuacuggaucugcaucuucuuccugcugaagaucagcgagaugacccaguggaccccccccccccagaaccaccugggcaacaagaacagaaucgaggagugcuaa

SEQ ID NO: 13905 - RNA, 411 nt, Artificial Sequence
  ASIP__Homo_sapiens__XP_005260469
augccccccggcauggacgugaccagacugcugcuggccacccugcugguguuccugugcuucuucaccgccaacagccaccugccccccgaggagaagcugagagacgacagaagccugagaagcaacagcagcgugaaccugcuggacgugcccagcgugagcaucguggcccugaacaagaagagcaagcagaucggcagaaaggccgccgagaagaagagaagcagcaagaaggaggccagcaugaagaagguggugagacccagaaccccccugagcgcccccugcguggccaccagaaacagcugcaagccccccgcccccgccugcugcgaccccugcgccagcugccagugcagauucuucagaagcgccugcagcugcagagugcugagccugaacugcuaa

SEQ ID NO: 13906 - RNA, 1395 nt, Artificial Sequence
  ASL__Homo_sapiens__NP_000039
auggccagcgagagcggcaagcuguggggcggcagauucgugggcgccguggaccccaucauggagaaguucaacgccagcaucgccuacgacagacaccugugggagguggacgugcagggcagcaaggccuacagcagaggccuggagaaggccggccugcugaccaaggccgagauggaccagauccugcacggccuggacaagguggccgaggagugggcccagggcaccuucaagcugaacagcaacgacgaggacauccacaccgccaacgagagaagacugaaggagcugaucggcgccaccgccggcaagcugcacaccggcagaagcagaaacgaccagguggugaccgaccugagacuguggaugagacagaccugcagcacccugagcggccugcugugggagcugaucagaaccaugguggacagagccgaggccgagagagacgugcuguuccccggcuacacccaccugcagagagcccagcccaucagauggagccacuggauccugagccacgccguggcccugaccagagacagcgagagacugcuggaggugagaaagagaaucaacgugcugccccugggcagcggcgccaucgccggcaacccccugggcguggacagagagcugcugagagccgagcugaacuucggcgccaucacccugaacagcauggacgccaccagcgagagagacuucguggccgaguuccuguucugggccagccugugcaugacccaccugagcagaauggccgaggaccugauccuguacugcaccaaggaguucagcuucgugcagcugagcgacgccuacagcaccggcagcagccugaugccccagaagaagaaccccgacagccuggagcugaucagaagcaaggccggcagaguguucggcagaugcgccggccugcugaugacccugaagggccugcccagcaccuacaacaaggaccugcaggaggacaaggaggccguguucgaggugagcgacaccaugagcgccgugcugcagguggccaccggcgugaucagcacccugcagauccaccaggagaacaugggccaggcccugagccccgacaugcuggccaccgaccuggccuacuaccuggugagaaagggcaugcccuucagacaggcccacgaggccagcggcaaggccguguucauggccgagaccaagggcguggcccugaaccagcugagccugcaggagcugcagaccaucagcccccuguucagcggcgacgugaucugcgugugggacuacggccacagcguggagcaguacggcgcccugggcggcaccgccagaagcagcguggacuggcagaucagacaggugagagcccugcugcaggcccagcaggccuaa

SEQ ID NO: 13907 - RNA, 897 nt, Artificial Sequence
  ASMT__Homo_sapiens__NP_001164510
augggcagcagcgaggaccaggccuacagacugcugaacgacuacgccaacggcuucauggugagccaggugcuguucgccgccugcgagcugggcguguucgaccugcuggccgaggcccccggcccccuggacguggccgccguggccgccggcgugagagccagcgcccacggcaccgagcugcugcuggacaucugcgugagccugaagcugcugaagguggagaccagaggcggcaaggccuucuacagaaacaccgagcugagcagcgacuaccugaccaccgugagccccaccagccagugcagcaugcugaaguacaugggcagaaccagcuacagaugcuggggccaccuggccgacgccgugagagagggcagaaaccaguaccuggagaccuucggcgugcccgccgaggagcuguucaccgccaucuacagaagcgagggcgagagacugcaguucaugcaggcccugcaggagguguggagcgugaacggcagaagcgugcugaccgccuucgaccugagcguguucccccugaugugcgaccugggcggcgacuucuucaaggacccccugcccgaggccgaccuguacauccuggccagagugcugcacgacugggccgacggcaagugcagccaccugcuggagagaaucuaccacaccugcaagcccggcggcggcauccuggugaucgagagccugcuggacgaggacagaagaggcccccugcugacccagcuguacagccugaacaugcuggugcagaccgagggccaggagagaacccccacccacuaccacaugcugcugagcagcgccggcuucagagacuuccaguucaagaagaccggcgccaucuacgacgccauccuggccagaaaguaa

SEQ ID NO: 13908 - RNA, 1818 nt, Artificial Sequence
  ASMTL__Homo_sapiens__NP_001166945
auggugcugugccccgugaucggcaagcugcugcacaagagaguggugcuggccagcgccagccccagaagacaggagauccugagcaacgccggccugagauucgagguggugcccagcaaguucaaggagaagcuggacaaggccagcuucgccacccccuacggcuacgccauggagaccgccaagcagaaggcccuggagguggccaacagacuguaccagaccgugggcggccugauccuggagaagcccguggacaagcaggacgccuacagaaugcugagcagacugagcggcagagagcacagcguguucaccggcguggccaucgugcacugcagcagcaaggaccaccagcuggacaccagagugagcgaguucuacgaggagaccaaggugaaguucagcgagcugagcgaggagcugcugugggaguacgugcacagcggcgagcccauggacaaggccggcggcuacggcauccaggcccugggcggcaugcugguggagagcgugcacggcgacuuccugaacguggugggcuucccccugaaccacuucugcaagcagcuggugaagcuguacuacccccccagacccgaggaccugagaagaagcgugaagcacgacagcauccccgccgccgacaccuucgaggaccugagcgacguggagggcggcggcagcgagcccacccagagagacgccggcagcagagacgagaaggccgaggccggcgaggccggccaggccaccgccgaggccgagugccacagaaccagagagacccugccccccuuccccaccagacugcuggagcugaucgagggcuucaugcugagcaagggccugcugaccgccugcaagcugaagguguucgaccugcugaaggacgaggccccccagaaggccgccgacaucgccagcaagguggacgccagcgccugcggcauggagagacugcuggacaucugcgccgccaugggccugcuggagaagaccgagcagggcuacagcaacaccgagaccgccaacguguaccuggccagcgacggcgaguacagccugcacggcuucaucaugcacaacaacgaccugaccuggaaccuguucaccuaccuggaguucgccaucagagagggcaccaaccagcaccacagagcccugggcaagaaggccgaggaccuguuccaggacgccuacuaccagagccccgagaccagacugagauucaugagagccaugcacggcaugaccaagcugaccgccugccagguggccaccgccuucaaccugagcagauucagcagcgccugcgacgugggcggcugcaccggcgcccuggccagagagcuggccagagaguaccccagaaugcaggugaccguguucgaccugcccgacaucaucgagcuggccgcccacuuccagccccccggcccccaggccgugcagauccacuucgccgccggcgacuucuucagagacccccugcccagcgccgagcuguacgugcugugcagaauccugcacgacuggcccgacgacaaggugcacaagcugcugagcagaguggccgagagcugcaagcccggcgccggccugcugcugguggagacccugcuggacgaggagaagagaguggcccagagagcccugaugcagagccugaacaugcuggugcagaccgagggcaaggagagaagccugggcgaguaccagugccugcuggagcugcacggcuuccaccaggugcagguggugcaccugggcggcgugcuggacgccauccuggccaccaagguggcccccuaa

SEQ ID NO: 13909 - RNA, 1047 nt, Artificial Sequence
  ASNA1__Homo_sapiens__NP_004308
auggccgccggcguggccggcuggggcguggaggccgaggaguucgaggacgcccccgacguggagccccuggagcccacccugagcaacaucaucgagcagagaagccugaaguggaucuucgugggcggcaagggcggcgugggcaagaccaccugcagcugcagccuggccgugcagcugagcaagggcagagagagcgugcugaucaucagcaccgaccccgcccacaacaucagcgacgccuucgaccagaaguucagcaaggugcccaccaaggugaagggcuacgacaaccuguucgccauggagaucgaccccagccugggcguggccgagcugcccgacgaguucuucgaggaggacaacaugcugagcaugggcaagaagaugaugcaggaggccaugagcgccuuccccggcaucgacgaggccaugagcuacgccgaggugaugagacuggugaagggcaugaacuucagcguggugguguucgacaccgcccccaccggccacacccugagacugcugaacuuccccaccaucguggagagaggccugggcagacugaugcagaucaagaaccagaucagccccuucaucagccagaugugcaacaugcugggccugggcgacaugaacgccgaccagcuggccagcaagcuggaggagacccugcccgugaucagaagcgugagcgagcaguucaaggaccccgagcagaccaccuucaucugcgugugcaucgccgaguuccugagccuguacgagaccgagagacugauccaggagcuggccaagugcaagaucgacacccacaacaucaucgugaaccagcugguguuccccgaccccgagaagcccugcaagaugugcgaggccagacacaagauccaggccaaguaccuggaccagauggaggaccuguacgaggacuuccacaucgugaagcugccccugcugccccacgaggugagaggcgccgacaaggugaacaccuucagcgcccugcugcuggagcccuacaagccccccagcgcccaguaa

SEQ ID NO: 13910 - RNA, 1623 nt, Artificial Sequence
  ASNS__Homo_sapiens__NP_001171546
augaagaucgcccacagaggccccgacgccuucagauucgagaacgugaacggcuacaccaacugcugcuucggcuuccacagacuggccgugguggacccccuguucggcaugcagcccaucagagugaagaaguaccccuaccuguggcugugcuacaacggcgagaucuacaaccacaagaagaugcagcagcacuucgaguucgaguaccagaccaagguggacggcgagaucauccugcaccuguacgacaagggcggcaucgagcagaccaucugcaugcuggacggcguguucgccuucgugcugcuggacaccgccaacaagaagguguuccugggcagagacaccuacggcgugagaccccuguucaaggccaugaccgaggacggcuuccuggccgugugcagcgaggccaagggccuggugacccugaagcacagcgccacccccuuccugaagguggagcccuuccugcccggccacuacgaggugcuggaccugaagcccaacggcaagguggccagcguggagauggugaaguaccaccacugcagagacgugccccugcacgcccuguacgacaacguggagaagcuguuccccggcuucgagaucgagaccgugaagaacaaccugagaauccuguucaacaacgccgugaagaagagacugaugaccgacagaagaaucggcugccugcugagcggcggccuggacagcagccugguggccgccacccugcugaagcagcugaaggaggcccaggugcaguacccccugcagaccuucgccaucggcauggaggacagccccgaccugcuggccgccagaaagguggccgaccacaucggcagcgagcacuacgaggugcuguucaacagcgaggagggcauccaggcccuggacgaggugaucuucagccuggagaccuacgacaucaccaccgugagagccagcgugggcauguaccugaucagcaaguacaucagaaagaacaccgacagcguggugaucuucagcggcgagggcagcgacgagcugacccagggcuacaucuacuuccacaaggcccccagccccgagaaggccgaggaggagagcgagagacugcugagagagcuguaccuguucgacgugcugagagccgacagaaccaccgccgcccacggccuggagcugagagugcccuuccuggaccacagauucagcagcuacuaccugagccugccccccgagaugagaauccccaagaacggcaucgagaagcaccugcugagagagaccuucgaggacagcaaccugauccccaaggagauccuguggagacccaaggaggccuucagcgacggcaucaccagcgugaagaacagcugguucaagauccugcaggaguacguggagcaccagguggacgacgccaugauggccaacgccgcccagaaguuccccuucaacacccccaagaccaaggagggcuacuacuacagacagguguucgagagacacuaccccggcagagccgacuggcugagccacuacuggaugcccaaguggaucaacgccaccgaccccagcgccagaacccugacccacuacaagagcgccgugaaggccuaa

SEQ ID NO: 13911 - RNA, 942 nt, Artificial Sequence
  ASPA__Homo_sapiens__XP_006721590
augaccagcugccacaucgccgaggagcacauccagaagguggccaucuucggcggcacccacggcaacgagcugaccggcguguuccuggugaagcacuggcuggagaacggcgccgagauccagagaaccggccuggaggugaagcccuucaucaccaaccccagagccgugaagaagugcaccagauacaucgacugcgaccugaacagaaucuucgaccuggagaaccugggcaagaagaugagcgaggaccugcccuacgaggugagaagagcccaggagaucaaccaccuguucggccccaaggacagcgaggacagcuacgacaucaucuucgaccugcacaacaccaccagcaacaugggcugcacccugauccuggaggacagcagaaacaacuuccugauccagauguuccacuacaucaagaccagccuggccccccugcccugcuacguguaccugaucgagcaccccagccugaaguacgccaccaccagaagcaucgccaaguaccccgugggcaucgaggugggcccccagccccagggcgugcugagagccgacauccuggaccagaugagaaagaugaucaagcacgcccuggacuucauccaccacuucaacgagggcaaggaguucccccccugcgccaucgagguguacaagaucaucgagaagguggacuaccccagagacgagaacggcgagaucgccgccaucauccaccccaaccugcaggaccaggacuggaagccccugcaccccggcgaccccauguuccugacccuggacggcaagaccaucccccugggcggcgacugcaccguguaccccguguucgugaacgaggccgccuacuacgagaagaaggaggccuucgccaagaccaccaagcugacccugaacgccaagagcaucagaugcugccugcacuaa

SEQ ID NO: 13912 - RNA, 1722 nt, Artificial Sequence
  ASPG__Homo_sapiens__NP_001073933
auggccagagccgugggccccgagagaagacugcuggccguguacaccggcggcaccaucggcaugagaagcgagcugggcgugcuggugcccggcaccggccuggccgccauccugagaacccugcccauguuccacgacgaggagcacgccagagccagaggccugagcgaggacacccuggugcugccccccgccagcagaaaccagagaauccuguacaccgugcuggagugccagccccuguucgacagcagcgacaugaccaucgccgagugggugugccuggcccagaccaucaagagacacuacgagcaguaccacggcuucguggugauccacggcaccgacaccauggccuucgccgccagcaugcugagcuucaugcuggagaaccugcagaagaccgugauccugaccggcgcccaggugcccauccacgcccuguggagcgacggcagagagaaccugcugggcgcccugcugauggccggccaguacgugauccccgaggugugccuguucuuccagaaccagcuguucagaggcaacagagccaccaagguggacgccagaagauucgccgccuucugcagccccaaccugcugccccuggccaccgugggcgccgacaucaccaucaacagagagcuggugagaaagguggacggcaaggccggccugguggugcacagcagcauggagcaggacgugggccugcugagacuguaccccggcauccccgccgcccuggugagagccuuccugcagcccccccugaagggcguggugauggagaccuucggcagcggcaacggccccaccaagcccgaccugcugcaggagcugagaguggccaccgagagaggccuggugaucgugaacugcacccacugccugcagggcgccgugaccaccgacuacgccgccggcauggccauggccggcgccggcgugaucagcggcuucgacaugaccagcgaggccgcccuggccaagcugagcuacgugcugggccagcccggccugagccuggacgugagaaaggagcugcugaccaaggaccugagaggcgagaugaccccccccagcguggaggagagaagacccagccugcagggcaacacccugggcggcggcgugagcuggcugcugagccugagcggcagccaggaggccgacgcccugagaaacgcccuggugcccagccuggccugcgccgccgcccacgccggcgacguggaggcccugcaggcccugguggagcugggcagcgaccugggccugguggacuucaacggccagaccccccugcacgccgccgccagaggcggccacaccgaggccgugaccaugcugcugcagagaggcguggacgugaacaccagagacaccgacggcuucagcccccugcugcuggccgugagaggcagacaccccggcgugaucggccugcugagagaggccggcgccagccugagcacccaggagcuggaggaggccggcaccgagcugugcagacuggccuacagagccgaccuggagggccugcaggugugguggcaggccggcgccgaccugggccagcccggcuacgacggccacagcgcccugcacguggccgaggccgccggcaaccuggccgugguggccuuccugcagagccuggagggcgccgugggcgcccaggcccccugccccgaggugcugcccggcguguaa

SEQ ID NO: 13913 - RNA, 2190 nt, Artificial Sequence
  ASPH__Homo_sapiens__NP_001158222
auggccgaggacaaggagaccaagcacggcggccacaagaacggcagaaagggcggccugagcggcaccagcuucuucaccugguucauggugaucgcccugcugggcguguggaccagcguggccguggugugguucgaccugguggacuacgaggaggugcugggcaagcugggcaucuacgacgccgacggcgacggcgacuucgacguggacgacgccaaggugcugcugggccugaaggagagaagcaccagcgagcccgccgugccccccgaggaggccgagccccacaccgagcccgaggagcaggugcccguggaggccgagccccagaacaucgaggacgaggccaaggagcagauccagagccugcugcacgagauggugcacgccgagcacguggagggcgaggaccugcagcaggaggacggccccaccggcgagccccagcaggaggacgacgaguuccugauggccaccgacguggacgacagauucgagacccuggagcccgaggugagccacgaggagaccgagcacagcuaccacguggaggagaccgugagccaggacugcaaccaggacauggaggagaugaugagcgagcaggagaaccccgacagcagcgagcccgugguggaggacgagagacugcaccacgacaccgacgacgugaccuaccagguguacgaggagcaggccguguacgagccccuggagaacgagggcaucgagaucaccgaggugaccgccccccccgaggacaaccccguggaggacagccaggugaucguggaggaggugagcaucuuccccguggaggagcagcaggaggugccccccgagaccaacagaaagaccgacgaccccgagcagaaggccaaggugaagaagaagaagcccaagcugcugaacaaguucgacaagaccaucaaggccgagcuggacgccgccgagaagcugagaaagagaggcaagaucgaggaggccgugaacgccuucaaggagcuggugagaaaguacccccagagccccagagccagauacggcaaggcccagugcgaggacgaccuggccgagaagagaagaagcaacgaggugcugagaggcgccaucgagaccuaccaggagguggccagccugcccgacgugcccgccgaccugcugaagcugagccugaagagaagaagcgacagacagcaguuccugggccacaugagaggcagccugcugacccugcagagacuggugcagcuguuccccaacgacaccagccugaagaacgaccugggcgugggcuaccugcugaucggcgacaacgacaacgccaagaagguguacgaggaggugcugagcgugacccccaacgacggcuucgccaaggugcacuacggcuucauccugaaggcccagaacaagaucgccgagagcauccccuaccugaaggagggcaucgagagcggcgaccccggcaccgacgacggcagauucuacuuccaccugggcgacgccaugcagagagugggcaacaaggaggccuacaagugguacgagcugggccacaagagaggccacuucgccagcguguggcagagaagccuguacaacgugaacggccugaaggcccagcccugguggacccccaaggagaccggcuacaccgagcuggugaagagccuggagagaaacuggaagcugaucagagacgagggccuggccgugauggacaaggccaagggccuguuccugcccgaggacgagaaccugagagagaagggcgacuggagccaguucacccuguggcagcagggcagaagaaacgagaacgccugcaagggcgcccccaagaccugcacccugcuggagaaguuccccgagaccaccggcugcagaagaggccagaucaaguacagcaucaugcaccccggcacccacguguggccccacaccggccccaccaacugcagacugagaaugcaccugggccuggugauccccaaggagggcugcaagaucagaugcgccaacgagaccaagaccugggaggagggcaaggugcugaucuucgacgacagcuucgagcacgagguguggcaggacgccagcagcuucagacugaucuucaucguggacguguggcaccccgagcugaccccccagcagagaagaagccugcccgccaucuaa

SEQ ID NO: 13914 - RNA, 5679 nt, Artificial Sequence
  ASPM__Homo_sapiens__NP_001193775
auggccaacagaagagugggcagaggcugcugggaggugagccccaccgagagaagaccccccgccggccugagaggccccgccgccgaggaggaggccagcagcccccccgugcugagccugagccacuucugcagaagccccuuccugugcuucggcgacgugcugcugggcgccagcagaacccugagccuggcccuggacaaccccaacgaggagguggccgaggugaagaucagccacuuccccgccgccgaccugggcuucagcgugagccagagaugcuucgugcugcagcccaaggagaagaucgugaucagcgugaacuggaccccccugaaggagggcagagugagagagaucaugaccuuccuggugaacgacgugcugaagcaccaggccauccugcugggcaacgccgaggagcagaagaagaagaagagaagccugugggacaccaucaagaagaagaagaucagcgccagcaccagccacaacagaagagugagcaacauccagaacgugaacaagaccuucagcgugagccagaagguggacagagugagaagcccccugcaggccugcgagaaccuggccaugaacgagggcggcccccccaccgagaacaacagccugauccuggaggagaacaagauccccaucagccccaucagccccgccuucaacgagugccacggcgccaccugccugccccugagcgugagaagaagcaccaccuacagcagccugcacgccagcgagaacagagagcugcugaacgugcacagcgccaacgugagcaaggugagcuucaacgagaaggccgugaccgagaccagcuucaacagcgugaacgugaacggccagagaggcgagaacagcaagcugagccugacccccaacugcagcagcacccugaacaucacccagagccagauccacuuccugagccccgacagcuucgugaacaacagccacggcgccaacaacgagcuggagcuggugaccugccugagcagcgacauguucaugaaggacaacagccagcccgugcaccuggagagcaccaucgcccacgagaucuaccagaagauccugagccccgacagcuucaucaaggacaacuacggccugaaccaggaccuggagagcgagagcgugaaccccauccugagccccaaccaguuccugaaggacaacauggccuacaugugcaccagccagcagaccugcaaggugccccugagcaacgagaacagccaggugccccagagccccgaggacuggagaaagagcgaggugagccccagaauccccgagugccagggcagcaagagccccaaggccaucuucgaggagcugguggagaugaagagcaacuacuacagcuucaucaagcagaacaaccccaaguucagcgccgugcaggacaucagcagccacagccacaacaagcagcccaagagaagacccauccugagcgccaccgugaccaagagaaaggccaccugcaccagagagaaccagaccgagaucaacaagcccaaggccaagagaugccugaacagcgccgugggcgagcacgagaaggugaucaacaaccagaaggagaaggaggacuuccacagcuaccugcccaucaucgaccccauccugagcaagagcaagagcuacaagaacgaggugacccccagcagcaccaccgccagcguggccagaaagagaaagagcgacggcagcauggaggacgccaacgugagaguggccaucaccgagcacaccgaggugagagagaucaagagaauccacuucagccccagcgagcccaagaccagcgccgugaagaagaccaagaacgugaccacccccaucagcaagagaaucagcaacagagagaagcugaaccugaagaagaagaccgaccugagcaucuucagaacccccaucagcaagaccaacaagagaaccaagcccaucaucgccguggcccagagcagccugaccuucaucaagccccugaagaccgacauccccagacaccccaugcccuucgccgccaagaacauguucuacgacgagagauggaaggagaagcaggagcagggcuucaccugguggcugaacuucauccugacccccgacgacuucaccgugaagaccaacaucagcgaggugaacgccgccacccugcugcugggcaucgagaaccagcacaagaucagcgugcccagagcccccaccaaggaggagaugagccugagagccuacaccgccagaugcagacugaacagacugagaagagccgccugcagacuguucaccagcgagaagauggugaaggccaucaagaagcuggagaucgagaucgaggccagaagacugaucgugagaaaggacagacaccuguggaaggacgugggcgagagacagaaggugcugaacuggcugcugagcuacaacccccuguggcugagaaucggccuggagaccaccuacggcgagcugaucagccuggaggacaacagcgacgugaccggccuggccauguucauccugaacagacugcuguggaaccccgacaucgccgccgaguacagacaccccaccgugccccaccuguacagagacggccacgaggaggcccugagcaaguucacccugaagaagcugcugcugcuggugugcuuccuggacuacgccaagaucagcagacugaucgaccacgaccccugccuguucugcaaggacgccgaguucaaggccagcaaggagauccugcuggccuucagcagagacuuccugagcggcgagggcgaccugagcagacaccugggccugcugggccugcccgugaaccacgugcagacccccuucgacgaguucgacuucgccgugaccaaccuggccguggaccugcagugcggcgugagacuggugagaaccauggagcugcugacccagaacugggaccugagcaagaagcugagaauccccgccaucagcagacugcagaagaugcacaacguggacaucgugcugcaggugcugaagagcagaggcaucgagcugagcgacgagcacggcaacaccauccugagcaaggacaucguggacagacacagagagaagacccugagacugcuguggaagaucgccuucgccuuccagguggacaucagccugaaccuggaccagcugaaggaggagaucgccuuccugaagcacaccaagagcaucaagaagaccaucagccugcugagcugccacagcgacgaccugaucaacaagaagaagggcaagagagacagcggcagcuucgagcaguacagcgagaacaucaagcugcugauggacugggugaacgccgugugcgccuucuacaacaagaagguggagaacuucaccgugagcuucagcgacggcagagugcugugcuaccugauccaccacuaccaccccugcuacgugcccuucgacgccaucugccagagaaccacccagaccguggagugcacccagaccggcagcguggugcugaacagcagcagcgagagcgacgacagcagccuggacaugagccugaaggccuucgaccacgagaacaccagcgagcuguacaaggagcugcuggagaacgagaagaagaacuuccaccuggugagaagcgccgugagagaccugggcggcauccccgccaugaucaaccacagcgacaugagcaacaccauccccgacgagaagguggugaucaccuaccugagcuuccugugcgccagacugcuggaccugagaaaggagaucagagccgccagacugauccagaccaccuggagaaaguacaagcugaagaccgaccugaagagacaccaggagagagagaaggccgccagaaucauccagcuggccgugaucaacuuccuggccaagcagagacugagaaagagagugaacgccgcccuggugauccagaaguacuggagaagagugcuggcccagagaaagcugcugaugcugaagaaggagaagcuggagaaggugcagaacaaggccgccagccugauccaggccauguggagaagauacagagccaagaaguaccugugcaaggugaaggccgccugcaagauccaggccugguacagaugcuggagagcccacaaggaguaccuggccauccugaaggccgugaagaucauccagggcugcuucuacaccaagcuggagagaaccagauuccugaacgugagagccagcgccaucaucauccagagaaaguggagagccauccugcccgccaagaucgcccacgagcacuuccugaugaucaagagacacagagccgccugccugauccaggcccacuacagaggcuacaagggcagacagguguuccugagacagaagagcgccgcccugaucauccagaaguacaucagagccagagaggccggcaagcacgagagaaucaaguacaucgaguucaagaagagcaccgugauccugcaggcccuggugagaggcuggcuggugagaaagagauuccuggagcagagagccaagaucagacugcugcacuucaccgccgccgccuacuaccaccugaacgccgugagaauccagagagccuacaagcuguaccuggccgugaagaacgccaacaagcaggugaacagcgugaucugcauccagagaugguucagagccagacugcaggagaagagauucauccagaaguaccacagcaucaagaagaucgagcacgagggccaggagugccugagccagagaaacagagccgccagcgugauccagaaggccgugagacacuuccugcugagaaagaagcaggagaaguucaccagcggcaucaucaagauccaggcccuguggagaggcuacagcuggagaaagaagaacgacugcaccaagaucaaggccaucagacugagccugcagguggugaacagagagaucagagaggagaacaagcuguacaagagaaccgcccuggcccugcacuaccugcugaccuacaagcaccugagcgccauccuggaggcccugaagcaccuggagguggugaccagacugagcccccugugcugcgagaacauggcccagagcggcgccaucagcaagaucuucgugcugaucagaagcugcaacagaagcauccccugcauggaggugaucagauacgccgugcaggugcugcugaacgugagcaaguacgagaagaccaccagcgccguguacgacguggagaacugcaucgacauccugcuggagcugcugcagaucuacagagagaagcccggcaacaagguggccgacaagggcggcagcaucuucaccaagaccugcugccugcuggccauccugcugaagaccaccaacagagccagcgacgugagaagcagaagcaaggugguggacagaaucuacagccuguacaagcugaccgcccacaagcacaagaugaacaccgagagaauccuguacaagcagaagaagaacagcagcaucagcauccccuucauccccgagacccccgugagaaccagaaucgugagcagacugaagcccgacugggugcugagaagagacaacauggaggagaucaccaacccccugcaggccauccagauggugauggacacccugggcauccccuacuaa

SEQ ID NO: 13915 - RNA, 729 nt, Artificial Sequence
  ASPN__Homo_sapiens__NP_001180264
augaaggaguacgugcugcugcuguuccuggcccugugcagcgccaagcccuucuucagccccagccacaucgcccugaagaacaugaugcugaaggacauggaggacaccgacgacgacgacgacgacgacgacgacgacgacgacgacgaggacaacagccuguuccccaccagagagcccagaagccacuucuuccccuucgaccuguuccccaugugccccuucggcugccagugcuacagcagaguggugcacugcagcgaccugggccugaccagcgugcccaccaacauccccuucgacaccagaaugcuggaccugcagaacaacaagaucaaggagaucaaggagaacgacuucaagggccugaccagccuguacggccugauccugaacaacaacaagcugaccaagauccaccccaaggccuuccugaccaccaagaagcugagaagacuguaccugagccacaaccagcugagcgagaucccccugaaccugcccaagagccuggccgagcugagaauccacgagaacaaggugaagaagauccagaaggacaccuucaagggcaugaacgcccugcacgugcuggagaugagcgccaacccccuggacaacaacggcaucgagcccggcgccuucgagggcgugaccguguuccacaucagaaucgccgaggccaagcugaccagcgugcccaaggacaaccugcccagcuucuaa

SEQ ID NO: 13916 - RNA, 1032 nt, Artificial Sequence
  ASPRV1__Homo_sapiens__NP_690005
augggcagccccggcgccagccugggcaucaagaaggcccugcagagcgagcaggccaccgcccugcccgccagcgcccccgccgugagccagcccaccgcccccgcccccagcugccugcccaaggccggccaggugauccccacccugcugagagaggcccccuucagcagcgugaucgcccccacccugcugugcggcuuccuguuccuggccuggguggccgccgaggugcccgaggagagcagcagaauggccggcagcggcgccagaagcgaggagggcagaagacagcacgccuucgugcccgagcccuucgacggcgccaacguggugcccaaccuguggcugcacagcuucgaggugaucaacgaccugaaccacugggaccacaucaccaagcugagauuccugaaggagagccugagaggcgaggcccugggcguguacaacagacugagcccccaggaccagggcgacuacggcaccgugaaggaggcccugcugaaggccuucggcgugcccggcgccgcccccagccaccugcccaaggagaucguguucgccaacagcaugggcaagggcuacuaccugaagggcaagaucggcaaggugcccgugagauuccugguggacagcggcgcccaggugagcguggugcaccccaaccugugggaggaggugaccgacggcgaccuggacacccugcagcccuucgagaacguggugaagguggccaacggcgccgagaugaagauccugggcgugugggacaccgccgugagccugggcaagcugaagcugaaggcccaguuccugguggccaacgccagcgccgaggaggccaucaucggcaccgacgugcugcaggaccacaacgccauccuggacuucgagcacagaaccugcacccugaagggcaagaaguucagacugcugcccgugggcggcagccuggaggacgaguucgaccuggagcugaucgaggaggaccccagcagcgaggagggcagacaggagcugagccacuaa

SEQ ID NO: 13917 - RNA, 1944 nt, Artificial Sequence
  ASPSCR1__Homo_sapiens__NP_001238817
auggccgcccccgccggcggcggcggcagcgccgugagcgugcuggcccccaacggcagaagacacaccgugaaggugacccccagcaccgugcugcugcaggugcuggaggacaccugcagaagacaggacuucaaccccugcgaguacgaccugaaguuccagagaagcgugcuggaccugagccugcaguggagauucgccaaccugcccaacaacgccaagcuggagauggugcccgccagcagaagcagagagggccccgagaacauggugagaaucgcccugcagcuggacgacggcagcagacugcaggacagcuucugcagcggccagacccugugggagcugcugagccacuucccccagaucagagagugccugcagcaccccggcggcgccacccccgugugcguguacaccagagacgaggugaccggcgaggccgcccugagaggcaccacccugcagagccugggccugaccggcggcagcgccaccaucagauucgugaugaagugcuacgaccccgugggcaagacccccggcagccugggcagcagcgccagcgccggccaggccgccgccagcgccccccugccccuggagagcggcgagcugagcagaggcgaccugagcagacccgaggacgccgacaccagcggccccugcugcgagcacacccaggagaagcagagcaccagagcccccgccgccgcccccuucgugcccuucagcggcggcggccagagacugggcggcccccccggccccaccagaccccugaccagcagcagcgccaagcugcccaagagccugagcagccccggcggccccagcaagcccaagaagagcaagagcggccaggacccccagcaggagcaggagcaggagagagagagagacccccagcaggagcaggagagagagagacccguggacagagagcccguggacagagagcccguggugugccaccccgaccuggaggagagacugcaggccuggcccgccgagcugcccgacgaguucuucgagcugaccguggacgacgugagaagaagacuggcccagcugaagagcgagagaaagagacuggaggaggccccccuggugaccaaggccuucagagaggcccagaucaaggagaagcuggagagauaccccaagguggcccugagagugcuguuccccgacagauacgugcugcagggcuucuucagacccagcgagaccgugggcgaccugagagacuucgugagaagccaccugggcaaccccgagcugagcuucuaccuguucaucaccccccccaagaccgugcuggacgaccacacccagacccuguuccagccccagcugggcgacagaguggcccccuucacccugggccccagccugaagagaugccugggccccgagcagagaaccagacugcccguggugggcgacggcggcgacguggacagcggcagacugcuguucuggggccccagcagaggcagagccagccccagcaccggccagccccccugccaccccgugugcagacccagcagcccccccagccccagacccagcagcggcgaccccagcagagugaaggccggccacaagcacgugggcaccggcagagccaaccuguuccccgccgcccuggugcaccugggcgccgaggagcccgccggcguguaccuggagcccggccugcuggagcacgccaucagccccagcgccgccgacgugcugguggccagauacaugagcagagccgccggcagccccagcccccugcccgcccccgaccccgcccccaagagcgagcccgccgccgaggagggcgcccuggugccccccgagcccauccccggcaccgcccagcccgugaagagaagccugggcaaggugcccaaguggcugaagcugcccgccagcaagagauaa

SEQ ID NO: 13918 - RNA, 927 nt, Artificial Sequence
  ASRGL1__Homo_sapiens__NP_001077395
augaaccccaucgugguggugcacggcggcggcgccggccccaucagcaaggacagaaaggagagagugcaccagggcauggugagagccgccaccgugggcuacggcauccugagagagggcggcagcgccguggacgccguggagggcgccgugguggcccuggaggacgaccccgaguucaacgccggcugcggcagcgugcugaacaccaacggcgagguggagauggacgccagcaucauggacggcaaggaccugagcgccggcgccgugagcgccgugcagugcaucgccaaccccaucaagcuggccagacuggugauggagaagaccccccacugcuuccugaccgaccagggcgccgcccaguucgccgccgccaugggcgugcccgagauccccggcgagaagcuggugaccgagagaaacaagaagagacuggagaaggagaagcacgagaagggcgcccagaagaccgacugccagaagaaccugggcaccgugggcgccguggcccuggacugcaagggcaacguggccuacgccaccagcaccggcggcaucgugaacaagauggugggcagagugggcgacagccccugccugggcgccggcggcuacgccgacaacgacaucggcgccgugagcaccaccggccacggcgagagcauccugaaggugaaccuggccagacugacccuguuccacaucgagcagggcaagaccguggaggaggccgccgaccugagccugggcuacaugaagagcagagugaagggccugggcggccugaucguggugagcaagaccggcgacuggguggccaaguggaccagcaccagcaugcccugggccgccgccaaggacggcaagcugcacuucggcaucgaccccgacgacaccaccaucaccgaccugcccuaa

SEQ ID NO: 13919 - RNA, 1239 nt, Artificial Sequence
  ASS1__Homo_sapiens__XP_005272257
augagcagcaagggcagcguggugcuggccuacagcggcggccuggacaccagcugcauccugguguggcugaaggagcagggcuacgacgugaucgccuaccuggccaacaucggccagaaggaggacuucgaggaggccagaaagaaggcccugaagcugggcgccaagaagguguucaucgaggacgugagcagagaguucguggaggaguucaucuggcccgccauccagagcagcgcccuguacgaggacagauaccugcugggcaccagccuggccagacccugcaucgccagaaagcagguggagaucgcccagagagagggcgccaaguacgugagccacggcgccaccggcaagggcaacgaccaggugagauucgagcugagcugcuacagccuggccccccagaucaaggugaucgcccccuggagaaugcccgaguucuacaacagauucaagggcagaaacgaccugauggaguacgccaagcagcacggcauccccauccccgugacccccaagaaccccuggagcauggacgagaaccugaugcacaucagcuacgaggccggcauccuggagaaccccaagaaccaggccccccccggccuguacaccaagacccaggaccccgccaaggcccccaacacccccgacauccuggagaucgaguucaagaagggcgugcccgugaaggugaccaacgugaaggacggcaccacccaccagaccagccuggagcuguucauguaccugaacgagguggccggcaagcacggcgugggcagaaucgacaucguggagaacagauucaucggcaugaagagcagaggcaucuacgagacccccgccggcaccauccuguaccacgcccaccuggacaucgaggccuucaccauggacagagaggugagaaagaucaagcagggccugggccugaaguucgccgagcugguguacaccggcuucuggcacagccccgagugcgaguucgugagacacugcaucgccaagagccaggagagaguggagggcaaggugcaggugagcgugcugaagggccagguguacauccugggcagagagagcccccugagccuguacaacgaggagcuggugagcaugaacgugcagggcgacuacgagcccaccgacgccaccggcuucaucaacaucaacagccugagacugaaggaguaccacagacugcagagcaaggugaccgccaaguaa

SEQ ID NO: 13920 - RNA, 1128 nt, Artificial Sequence
  ASTN2__Homo_sapiens__NP_001171663
augcccuucaucaccuaccugagcggccugcugaccgcccagaugcugagcgacgaccagcugaucagcggcguggagaucagaugcgaggagaagggcagaugccccagcaccugccaccugugcagaagacccggcaaggagcagcugagccccacccccgugcugcuggagaucaacagaguggugccccuguacacccugauccaggacaacggcaccaaggaggccuucaagagcgcccugaugagcagcuacuggugcagcggcaagggcgacgugaucgacgacuggugcagaugcgaccugagcgccuucgacgccaacggccugcccaacugcagcccccugcugcagcccgugcugagacugagccccaccguggagcccagcagcaccguggugagccuggaguggguggacgugcagcccgccaucggcaccaaggugagcgacuacauccugcagcacaagaagguggacgaguacaccgacaccgaccuguacaccggcgaguuccugagcuucgccgacgaccugcugagcggccugggcaccagcugcguggccgccggcagaagccacggcgaggugcccgaggugagcaucuacagcgugaucuucaagugccuggagcccgacggccuguacaaguucacccuguacgccguggacaccagaggcagacacagcgagcugagcaccgugacccugagaaccgccugcccccugguggacgacaacaaggccgaggagaucgccgacaagaucuacaaccuguacaacggcuacaccagcggcaaggagcagcagauggccuacaacacccugauggaggugagcgccagcaugcuguucagagugcagcaccacuacaacagccacuacgagaaguucggcgacuucguguggagaagcgaggacgagcugggccccagaaaggcccaccugauccugagaagacuggagagagugagcagccacugcagcagccugcugagaagcgccuacauccagagcagaguggagaccgugcccuaccuguucugcagaagcgaggaggugagacccgccggcauggugugguacagcauccugaaggacaccaagaucaccuacaucaucuaa

SEQ ID NO: 13921 - RNA, 2121 nt, Artificial Sequence
  ASUN__Homo_sapiens__NP_060634
augaagaucuucagcgagagccacaagaccguguucgugguggaccacugccccuacauggccgagagcugcagacagcacguggaguucgacaugcuggugaagaacagaacccagggcaucaucccccuggcccccaucagcaagagccuguggaccugcagcguggagagcagcauggaguacugcagaaucauguacgacaucuuccccuucaagaagcuggugaacuucaucgugagcgacagcggcgcccacgugcugaacagcuggacccaggaggaccagaaccugcaggagcugauggccgcccuggccgccgugggcccccccaaccccagagccgaccccgagugcugcagcauccugcacggccugguggccgccguggagacccugugcaagaucaccgaguaccagcacgaggccagaacccugcugauggagaacgccgagagagugggcaacagaggcagaaucaucugcaucaccaacgccaagagcgacagccacgugagaaugcuggaggacugcgugcaggagaccauccacgagcacaacaagcuggccgccaacagcgaccaccugaugcagauccagaagugcgagcuggugcugauccacaccuaccccgugggcgaggacagccuggugagcgacagaagcaagaaggagcugagccccgugcugaccagcgaggugcacagcgugagagccggcagacaccuggccaccaagcugaacauccuggugcagcagcacuucgaccuggccagcaccaccaucaccaacauccccaugaaggaggagcagcacgccaacaccagcgccaacuacgacguggagcugcugcaccacaaggacgcccacguggacuuccugaagagcggcgacagccaccugggcggcggcagcagagagggcagcuucaaggagaccaucacccugaaguggugcacccccagaaccaacaacaucgagcugcacuacugcaccggcgccuacagaaucagccccguggacgugaacagcagacccagcagcugccugaccaacuuccugcugaacggcagaagcgugcugcuggagcagcccagaaagagcggcagcaaggugaucagccacaugcugagcagccacggcggcgagaucuuccugcacgugcugagcagcagcagaagcauccuggaggacccccccagcaucagcgagggcugcggcggcagagugaccgacuacagaaucaccgacuucggcgaguucaugagagagaacagacugacccccuuccuggaccccagauacaagaucgacggcagccuggaggugccccuggagagagccaaggaccagcuggagaagcacaccagauacuggcccaugaucaucagccagaccaccaucuucaacaugcaggccguggugccccuggccagcgugaucgugaaggagagccugaccgaggaggacgugcugaacugccagaagaccaucuacaaccugguggacauggagagaaagaacgacccccugcccaucagcaccgugggcaccagaggcaagggccccaagagagacgagcaguacagaaucauguggaacgagcuggagacccuggugagagcccacaucaacaacagcgagaagcaccagagagugcuggagugccugauggccugcagaagcaagccccccgaggaggaggagagaaagaagagaggcagaaagagagaggacaaggaggacaagagcgagaaggccgugaaggacuacgagcaggagaagagcuggcaggacagcgagagacugaagggcauccuggagagaggcaaggaggagcuggccgaggccgagaucaucaaggacagccccgacagccccgagccccccaacaagaagccccugguggagauggacgagaccccccagguggagaagagcaagggccccgugagccugcugagccuguggagcaacagaaucaacaccgccaacagcagaaagcaccaggaguucgccggcagacugaacagcgugaacaacagagccgagcuguaccagcaccugaaggaggagaacggcauggagaccaccgagaacggcaaggccagcagacaguaa

SEQ ID NO: 13922 - RNA, 258 nt, Artificial Sequence
  ASXL1__Homo_sapiens__NP_001158075
augaaggacaagcagaagaagaagaaggagagaaccugggccgaggccgccagacuggugcuggagaacuacagcgacgcccccaugacccccaagcagauccugcaggugaucgaggccgagggccugaaggagaugagaagcggcaccagcccccuggccugccugaacgccaugcugcacagcaacagcagaggcggcgagggccuguucuacaagcugcccggcagaaucagccuguucacccugaagguguaa

SEQ ID NO: 13923 - RNA, 4308 nt, Artificial Sequence
  ASXL2__Homo_sapiens__NP_060733
augagagagaagggcagaagaaagaagggcagaaccugggccgaggccgccaagaccgugcuggagaaguaccccaacacccccaugagccacaaggagauccugcaggugauccagagagagggccugaaggagaucagaagcggcaccagcccccuggccugccugaacgccaugcugcacaccaacagcagaggcgaggagggcaucuucuacaaggugcccggcagaaugggcguguacacccugaagaaggacgugcccgacggcgugaaggagcugagcgagggcagcgaggagagcagcgacggccagagcgacagccagagcagcgagaacagcagcagcagcagcgacggcggcagcaacaaggagggcaagaagagcagauggaagagaaaggugagcagcagcagcccccagagcggcugccccagccccaccauccccgccggcaaggugaucagccccagccagaagcacagcaagaaggcccugaagcaggcccugaagcagcagcagcagaagaagcagcagcagcagugcagacccagcaucagcaucagcagcaaccagcaccugagccugaagaccgugaaggccgccagcgacagcgugcccgccaagcccgccaccugggagggcaagcagagcgacggccagaccggcagcccccagaacagcaacagcagcuucagcagcagcgugaagguggagaacacccugcugggccugggcaagaagagcuuccagagaagcgagagacugcacaccagacagaugaagagaaccaagugcgccgacaucgacguggagacccccgacagcauccuggugaacaccaaccugagagcccugaucaacaagcacaccuucagcgugcugcccggcgacugccagcagagacugcugcugcugcugcccgagguggacagacaggugggccccgacggccugaugaagcugaacggcagcgcccugaacaacgaguucuucaccagcgccgcccagggcuggaaggagagacugagcgagggcgaguucacccccgagaugcaggugagaaucagacaggagaucgagaaggagaagaagguggagcccuggaaggagcaguucuucgagagcuacuacggccagagcagcggccugagccuggaggacagcaagaagcugaccgccagccccagcgaccccaaggugaagaagacccccgccgagcagcccaagagcaugcccgugagcgaggccagccugaucagaaucgugcccguggugagccagagcgagugcaaggaggaggcccugcagaugagcagccccggcagaaaggaggagugcgagagccagggcgaggugcagcccaacuucagcaccagcagcgagccccugcugagcagcgcccugaacacccacgagcugagcagcauccugcccaucaagugccccaaggacgaggaccugcuggagcagaagcccgugaccagcgccgagcaggagagcgagaagaaccaccugaccaccgccagcaacuacaacaagagcgagagccaggagagccuggugaccagccccagcaagcccaagagccccggcguggagaagcccaucgugaagcccaccgccggcgccggcccccaggagaccaacaugaaggagccccuggccacccugguggaccagagccccgagagccugaagagaaagagcagccugacccaggaggaggcccccgugagcugggagaagagacccagagugaccgagaacagacagcaccagcagcccuuccaggugagcccccagcccuuccugaacagaggcgacagaauccaggugagaaaggugcccccccugaagauccccgugagcagaaucagccccaugcccuuccaccccagccaggugagccccagagccagauuccccgugagcaucaccagccccaacagaaccggcgccagaacccuggccgacaucaaggccaaggcccagcuggugaaggcccagagagccgccgccgccgccgccgccgccgccgccgccgccgccagcgugggcggcaccauccccggccccggccccggcggcggccagggccccggcgagggcggcgagggccagaccgccagaggcggcagccccggcagcgacagagugagcgagaccggcaagggccccacccuggagcuggccggcaccggcagcagaggcggcaccagagagcugcugcccugcggccccgagacccagccccagagcgagaccaagaccacccccagccaggcccagccccacagcgugagcggcgcccagcugcagcagaccccccccgugccccccacccccgccgugagcggcgccugcaccagcgugcccagccccgcccacaucgagaagcuggacaacgagaagcugaaccccaccagagccaccgccaccguggccagcgugagccacccccagggccccagcagcugcagacaggagaaggcccccagccccaccggccccgcccugaucagcggcgccagccccgugcacugcgccgccgacggcaccguggagcugaaggccggccccagcaagaacauccccaaccccagcgccagcagcaagaccgacgccagcgugcccguggccgugacccccagcccccugaccagccugcugaccaccgccacccuggagaagcugcccgugccccaggugagcgccaccaccgcccccgccggcagcgccccccccagcagcacccugcccgccgccagcagccugaagacccccggcaccagccugaacaugaacggccccacccugagacccaccagcagcauccccgccaacaacccccuggugacccagcugcugcagggcaaggacgugcccauggagcagauccugcccaagccccugaccaagguggagaugaagaccgugccccugaccgccaaggaggagagaggcaugggcgcccugaucgccaccaacaccaccgagaacagcaccagagaggaggugaacgagagacagagccaccccgccacccagcagcagcugggcaagacccugcagagcaagcagcugccccaggugcccagaccccugcagcuguucagcgccaaggagcugagagacagcagcaucgacacccaccaguaccacgagggccugagcaaggccacccaggaccagauccugcagacccugauccagagagugagaagacagaaccugcugagcguggugccccccagccaguucaacuucgcccacagcggcuuccagcuggaggacaucagcaccagccagagauucaugcugggcuucgccggcagaagaaccagcaagcccgccauggccggccacuaccugcugaacaucagcaccuacggcagaggcagcgagagcuucagaagaacccacagcgugaaccccgaggacagauucugccugagcagccccaccgaggcccugaagaugggcuacaccgacugcaagaacgccaccggcgagagcagcagcagcaaggaggacgacaccgacgaggagagcaccggcgacgagcaggagagcgugaccgugaaggaggagccccaggugagccagagcgccggcaagggcgacaccagcagcggcccccacagcagagagacccugagcaccagcgacugccuggccagcaagaacgugaaggccgagaucccccugaacgagcagaccacccugagcaaggagaacuaccuguucaccagaggccagaccuucgacgagaagacccuggccagagaccugauccaggccgcccagaagcagauggcccacgccgugagaggcaaggccaucagaagcagccccgagcuguucagcagcaccgugcugccccugcccgccgacagccccacccaccagccccugcugcugcccccccugcagacccccaagcuguacggcagccccacccagaucggccccagcuacagaggcaugaucaacgugagcaccagcagcgacauggaccacaacagcgccgugcccggcagccaggugagcagcaacgugggcgacgugaugagcuucagcgugaccgugaccaccauccccgccagccaggccaugaaccccagcagccacggccagaccauccccgugcaggccuucagcgaggagaacagcaucgagggcacccccagcaagugcuacugcagacugaaggccaugaucaugugcaagggcugcggcgccuucugccacgacgacugcaucggccccagcaagcugugcgugagcugccugguggugagauaa

SEQ ID NO: 13924 - RNA, 6747 nt, Artificial Sequence
  ASXL3__Homo_sapiens__NP_085135
augaaggacaagagaaagaagaaggacagaaccugggccgaggccgccagacuggcccuggagaagcaccccaacagccccaugaccgccaagcagauccuggaggugauccagaaggagggccugaaggagaccagcggcaccagcccccuggccugccugaacgccaugcugcacaccaacaccagaaucggcgacggcaccuucuucaagauccccggcaagagcggccuguacgcccugaagaaggaggagagcagcugccccgccgacggcacccuggaccuggugugcgagagcgagcuggacggcaccgacauggccgaggccaacgcccacggcgaggagaacggcgugugcagcaagcaggugaccgacgaggccagcagcaccagagacagcagccugaccaacaccgccgugcagagcaagcuggugagcagcuuccagcagcacaccaagaaggcccugaagcaggcccugagacagcagcagaagagaagaaacggcgugagcaugauggugaacaagaccgugcccagaguggugcugaccccccugaaggugagcgacgagcagagcgacagccccagcggcagcgagagcaagaacggcgaggccgacagcagcgacaaggagaugaagcacggccagaagagccccaccggcaagcagaccagccagcaccugaagagacugaagaagagcggccugggccaccugaaguggaccaaggccgaggacaucgacaucgagacccccggcagcauccuggugaacaccaaccugagagcccugaucaacaagcacaccuucgccagccugccccagcacuuccagcaguaccugcugcugcugcugcccgagguggacagacagaugggcagcgacggcauccugagacugagcaccagcgcccugaacaacgaguucuucgccuacgccgcccagggcuggaagcagagacuggccgagggcgaguucacccccgagaugcagcugagaaucagacaggagaucgagaaggagaagaagaccgagcccuggaaggagaaguucuucgagagauucuacggcgagaagcugggcaugagcagagaggagagcgugaagcugaccaccggccccaacaacgccggcgcccagagcagcagcagcugcggcaccagcggccugcccgugagcgcccagaccgcccuggccgagcagcagcccaagagcaugaagagccccgccagccccgagcccggcuucugcgccacccugugccccaugguggagaucccccccaaggacaucauggccgagcuggagagcgaggacauccugauccccgaggagagcgugauccaggaggagaucgccgaggagguggagaccagcaucugcgagugccaggacgagaaccacaagaccauccccgaguucagcgaggaggccgagagccugaccaacagccacgaggagccccagaucgccccccccgaggacaaccuggagagcugcgugaugaugaacgacgugcuggagacccugccccacaucgaggugaagaucgagggcaagagcgagagcccccaggaggagaugaccguggugaucgaccagcuggaggugugcgacagccugauccccagcaccagcagcaugacccacgugagcgacaccgagcacaaggagagcgagaccgccguggagaccagcacccccaagaucaagaccggcagcagcagccuggagggccaguuccccaacgagggcaucgccaucgacauggagcugcagagcgaccccgaggagcagcugagcgagaacgccugcaucagcgagaccagcuucagcagcgagagccccgagggcgccugcaccagccugcccagccccggcggcgagacccagagcaccagcgaggagagcugcacccccgccagccuggagaccaccuucugcagcgaggugagcagcaccgagaacaccgacaaguacaaccagagaaacagcaccgacgagaacuuccacgccagccugaugagcgagaucagccccaucagcaccagccccgagaucagcgaggccagccugaugagcaaccugccccugaccagcgaggccagccccgugagcaaccugccccugaccagcgagaccagccccaugagcgaccugccccugaccagcgagaccagcagcgugagcagcaugcugcugaccagcgagaccaccuucgugagcagccugccccugcccagcgagaccagccccaucagcaacagcagcaucaacgagagaauggcccaccagcagagaaagagccccagcgugagcgaggagccccugagcccccagaaggacgagagcagcgccaccgccaagccccugggcgagaaccugaccagccagcagaagaaccugagcaacacccccgagcccaucaucaugagcagcagcagcaucgcccccgaggccuuccccagcgaggaccugcacaacaagacccugagccagcagaccugcaagagccacguggacaccgagaagcccuaccccgccagcauccccgagcuggccagcaccgagaugaucaaggugaagaaccacagcgugcugcagagaaccgagaagaaggugcugcccagcccccuggagcugagcguguucagcgagggcaccgacaacaagggcaacgagcugcccagcgccaagcugcaggacaagcaguacaucagcagcguggacaaggcccccuucagcgagggcagcagaaacaagacccacaagcagggcagcacccagagcagacuggagaccagccacaccagcaagagcagcgagcccagcaagagccccgacggcaucagaaacgagagcagagacagcgagaucagcaagagaaagaccgccgagcagcacagcuucggcaucugcaaggagaagagagccagaaucgaggacgaccagagcaccagaaacaucagcagcagcagcccccccgagaaggagcagccccccagagaggagcccagagugcccccccugaagauccagcugagcaagaucggcccccccuucaucaucaagagccagcccgugagcaagcccgagagcagagccagcaccagcaccagcgugagcggcggcagaaacaccggcgccagaacccuggccgacaucaaggccagagcccagcaggccagagcccagagagaggccgccgccgccgccgccguggccgccgccgccagcaucgugagcggcgccaugggcagccccggcgagggcggcaagaccagaacccuggcccacaucaaggagcagaccaaggccaagcuguucgccaagcaccaggccagagcccaccuguuccagaccagcaaggagaccagacugccccccccccugagcagcaaggagggcccccccaaccuggaggugagcagcacccccgagaccaagauggagggcagcaccggcgugaucaucgugaaccccaacugcagaagccccagcaacaagagcgcccaccugagagagaccaccaccgugcugcagcagagccugaaccccagcaagcugcccgagaccgccaccgaccugagcgugcacagcagcgacgagaacauccccgugagccaccugagcgagaagaucgugagcagcaccagcagcgagaacagcagcgugcccaugcuguucaacaagaacagcgugcccgugagcgugugcagcaccgccaucagcggcgccaucaaggagcaccccuucgugagcagcguggacaagagcagcgugcugaugagcguggacagcgccaacaccaccaucagcgccugcaacaucagcaugcugaagaccauccagggcaccgacacccccugcaucgccaucauccccaagugcaucgagagcacccccaucagcgccaccaccgagggcagcagcaucagcagcagcauggacgacaagcagcugcugaucagcagcagcagcgccagcaaccuggugagcacccaguacaccagcgugcccacccccagcaucggcaacaaccugcccaaccugagcaccagcagcgugcugaucccccccaugggcaucaacaacagauuccccagcgagaagaucgccauccccggcagcgaggagcaggccaccgugagcaugggcaccaccgugagagccgcccugagcugcagcgacagcguggccgugaccgacagccugguggcccaccccaccguggccauguucaccggcaacaugcugaccaucaacagcuacgacagcccccccaagcugagcgccgagagccuggacaagaacagcggccccagaaacagagccgacaacagcggcaagccccagcagccccccggcggcuucgcccccgccgccaucaacagaagcauccccugcaaggugaucguggaccacagcaccacccugaccagcagccugagccugaccgugagcguggagagcagcgaggccagccuggaccugcagggcagacccgugagaaccgaggccagcgugcagcccguggccugcccccaggugagcgugaucagcagacccgagcccguggccaacgagggcaucgaccacagcagcaccuucaucgccgccagcgccgccaagcaggacagcaagacccugcccgccaccugcaccagccugagagagcugccccuggugcccgacaagcugaacgagcccaccgcccccagccacaacuucgccgagcaggccagaggccccgcccccuucaagagcgaggccgacaccaccugcagcaaccaguacaaccccagcaacagaaucugcuggaacgacgacggcaugagaagcaccggccagccccuggugacccacagcggcagcagcaagcagaaggaguaccuggagcagagcugccccaaggccaucaagaccgagcacgccaacuaccugaacgugagcgagcugcaccccagaaaccuggugaccaacguggcccugcccgugaagagcgagcugcacgaggccgacaagggcuucagaauggacaccgaggacuuccccggccccgagcugcccccccccgccgccgagggcgccagcagcgugcagcagacccagaacaugaaggccagcaccagcagccccauggaggaggccaucagccuggccaccgacgcccugaagagagugcccggcgccggcagcagcggcugcagacugagcagcguggaggccaacaacccccuggugacccagcugcugcagggcaaccugccccuggagaaggugcugccccagcccagacugggcgccaagcuggagaucaacagacugccccugccccugcagaccaccagcgugggcaagaccgcccccgagagaaacguggagaucccccccagcagccccaaccccgacggcaagggcuaccuggccggcacccuggccccccugcagaugagaaagagagagaaccaccccaagaagagaguggccagaaccgugggcgagcacacccaggugaagugcgagcccggcaagcugcugguggagcccgacgugaagggcgugcccugcgugaucagcagcggcaucagccagcugggccacagccagcccuucaagcaggaguggcugaacaagcacagcaugcagaacagaaucgugcacagccccgaggugaagcagcagaagagacugcugcccagcugcagcuuccagcagaaccuguuccacguggacaagaacggcggcuuccacaccgacgccggcaccagccacagacagcaguucuaccagaugcccguggccgccagaggccccauccccaccgccgcccugcugcaggccagcagcaagacccccgugggcugcaacgccuucgccuucaacagacaccuggagcagaagggccugggcgaggugagccugagcagcgccccccaccagcugagacuggccaacaugcugagccccaacaugcccaugaaggagggcgacgaggugggcggcaccgcccacaccaugcccaacaaggcccuggugcaccccccccccccccccccccccccccccccccccccccuggcccugccccccccccccccccccccccccccccugccccccccccugcccaacgccgaggugcccagcgaccagaagcagccccccgugaccauggagaccaccaagagacugagcuggccccagagcaccggcaucugcagcaacaucaagagcgagccccugagcuucgaggagggccugagcagcagcugcgagcugggcaugaagcaggugagcuacgaccagaacgagaugaaggagcagcugaaggccuucgcccugaagagcgccgacuucagcagcuaccugcugagcgagccccagaagcccuucacccagcuggccgcccagaagaugcaggugcagcagcagcagcagcugugcggcaacuaccccaccauccacuucggcagcaccagcuucaagagagccgccagcgccaucgagaagagcaucggcauccugggcagcggcagcaaccccgccaccggccugagcggccagaacgcccagaugcccgugcagaacuucgccgacagcagcaacgccgacgagcuggagcugaagugcagcugcagacugaaggccaugaucgugugcaagggcugcggcgccuucugccacgacgacugcaucggccccagcaagcugugcguggccugccugguggugagauaa

SEQ ID NO: 13925 - RNA, 1428 nt, Artificial Sequence
  ASZ1__Homo_sapiens__NP_570124
auggccgccagcgcccugagaggccugcccguggccggcggcggcgagagcagcgagagcgaggacgacggcugggagaucggcuaccuggacagaaccagccagaagcugaagagacugcugcccaucgaggagaagaaggagaaguucaagaaggccaugaccaucggcgacgugagccuggugcaggagcugcuggacagcggcaucagcguggacagcaacuuccaguacggcuggaccccccugauguacgccgccagcguggccaacgccgagcuggugagagugcugcuggacagaggcgccaacgccagcuucgagaaggacaagcagagcauccugaucaccgccugcagcgcccacggcagcgaggagcagauccugaagugcguggagcugcugcugagcagaaacgccgaccccaacguggccugcagaagacugaugacccccaucauguacgccgccagagacggccacacccaggugguggcccugcugguggcccacggcgccgaggugaacacccaggacgagaacggcuacaccgcccugaccugggccgccagacagggccacaagaacaucgugcugaagcugcuggagcugggcgccaacaagaugcugcagaccaaggacggcaagaugcccagcgagaucgccaagagaaacaagcaccacgagaucuucaaccugcugagcuucacccugaacccccuggagggcaagcugcagcagcugaccaaggaggacaccaucugcaagauccugaccaccgacagcgacagagagaaggaccacaucuucagcagcuacaccgccuucggcgaccuggagguguuccugcacggccugggccuggagcacaugaccgaccugcugaaggagagagacaucacccugagacaccugcugaccaugagagaggacgaguucaccaagaacggcaucaccagcaaggaccagcagaagauccuggccgcccugaaggagcugcagguggaggagauccaguucggcgagcugagcgaggagaccaagcuggagaucagcggcgacgaguuccugaacuuccugcugaagcugaacaagcagugcggccaccugaucaccgccgugcagaacgugaucaccgagcugcccgugaacagccagaagaucacccuggagugggccagcccccagaacuucaccagcgugugcgaggagcuggugaacaacguggaggaccugagcgagaaggugugcaagcugaaggaccugauccagaagcugcagaacgagagagagaacgaccccacccacauccagcugagagaggaggugagcaccuggaacagcagaauccugaagagaaccgccaucaccaucugcggcuucggcuuccugcuguucaucugcaagcugaccuuccagagaaaguaa

SEQ ID NO: 13926 - RNA, 4173 nt, Artificial Sequence
  ATAD2__Homo_sapiens__NP_054828
augguggugcugagaagcagccuggagcugcacaaccacagcgccgccagcgccaccggcagccuggaccugagcagcgacuuccugagccuggagcacaucggcagaagaagacugagaagcgccggcgccgcccagaagaagcccgccgccaccaccgccaaggccggcgacggcagcagcgugaaggagguggagaccuaccacagaaccagagcccugagaagccugagaaaggacgcccagaacagcagcgacagcagcuucgagaagaacguggagaucaccgagcagcuggccaacggcagacacuucaccagacagcuggccagacagcaggccgacaagaagaaggaggagcacagagaggacaaggugauccccgugaccagaagccugagagccagaaacaucgugcagagcaccgagcaccugcacgaggacaacggcgacguggaggugagaagaagcugcagaaucagaagcagauacagcggcgugaaccagagcaugcuguucgacaagcugaucaccaacaccgccgaggccgugcugcagaagauggacgacaugaagaagaugagaagacagagaaugagagagcuggaggaccugggcguguucaacgagaccgaggagagcaaccugaacauguacaccagaggcaagcagaaggacauccagagaaccgacgaggagaccaccgacaaccaggagggcagcguggagagcagcgaggagggcgaggaccaggagcacgaggacgacggcgaggacgaggacgacgaggacgacgacgacgacgacgacgacgacgacgacgacgacgacgaggacgacgaggacgaggaggacggcgaggaggagaaccagaagagauacuaccugagacagagaaaggccaccguguacuaccaggccccccuggagaagcccagacaccagagaaagcccaacaucuucuacagcggccccgccagccccgccagacccagauacagacugagcagcgccggccccagaagccccuacugcaagagaaugaacagaagaagacacgccauccacagcagcgacagcaccagcagcagcagcagcgaggacgagcagcacuucgagagaagaagaaagagaagcagaaacagagccaucaacagaugccugccccugaacuucagaaaggacgagcugaagggcaucuacaaggacagaaugaagaucggcgccagccuggccgacguggaccccaugcagcuggacagcagcgugagauucgacagcgugggcggccugagcaaccacaucgccgcccugaaggagauggugguguucccccugcuguaccccgagguguucgagaaguucaagauccagccccccagaggcugccuguucuacggcccccccggcaccggcaagacccugguggccagagcccuggccaacgagugcagccagggcgacaagagaguggccuucuucaugagaaagggcgccgacugccugagcaagugggugggcgagagcgagagacagcugagacugcuguucgaccaggccuaccagaugagacccagcaucaucuucuucgacgagaucgacggccuggcccccgugagaagcagcagacaggaccagauccacagcagcaucgugagcacccugcuggcccugauggacggccuggacagcagaggcgagaucguggugaucggcgccaccaacagacuggacagcaucgaccccgcccugagaagacccggcagauucgacagagaguuccuguucagccugcccgacaaggaggccagaaaggagauccugaagauccacaccagagacuggaaccccaagccccuggacaccuuccuggaggagcuggccgagaacugcgugggcuacugcggcgccgacaucaagagcaucugcgccgaggccgcccugugcgcccugagaagaagauacccccagaucuacaccaccagcgagaagcugcagcuggaccugagcagcaucaacaucagcgccaaggacuucgagguggccaugcagaagaugauccccgccagccagagagccgugaccagccccggccaggcccugagcaccguggugaagccccugcugcagaacaccguggacaagauccuggaggcccugcagagaguguucccccacgccgaguucagaaccaacaagacccuggacagcgacaucagcugcccccugcuggagagcgaccuggccuacagcgacgacgacgugcccagcguguacgagaacggccugagccagaagagcagccacaaggccaaggacaacuucaacuuccugcaccugaacagaaacgccugcuaccagcccaugagcuucagacccagaauccugaucgugggcgagcccggcuucggccagggcagccaccuggcccccgccgugauccacgcccuggagaaguucaccguguacacccuggacauccccgugcuguucggcgugagcaccaccagccccgaggagaccugcgcccaggugaucagagaggccaagagaaccgcccccagcaucguguacgugccccacauccacguguggugggagaucgugggccccacccugaaggccaccuucaccacccugcugcagaacauccccagcuucgcccccgugcugcugcuggccaccagcgacaagccccacagcgcccugcccgaggaggugcaggagcuguucaucagagacuacggcgagaucuucaacgugcagcugcccgacaaggaggagagaaccaaguucuucgaggaccugauccugaagcaggccgccaagccccccaucagcaagaagaaggccgugcugcaggcccuggaggugcugcccguggcccccccccccgagcccagaagccugaccgccgaggaggugaagagacuggaggagcaggaggaggacaccuucagagagcugagaaucuuccugagaaacgugacccacagacuggccaucgacaagagauucagaguguucaccaagcccguggaccccgacgaggugcccgacuacgugaccgugaucaagcagcccauggaccugagcagcgugaucagcaagaucgaccugcacaaguaccugaccgugaaggacuaccugagagacaucgaccugaucugcagcaacgcccuggaguacaaccccgacagagaccccggcgacagacugaucagacacagagccugcgcccugagagacaccgccuacgccaucaucaaggaggagcuggacgaggacuucgagcagcugugcgaggagauccaggagagcagaaagaagagaggcugcagcagcagcaaguacgcccccagcuacuaccacgugaugcccaagcagaacagcacccuggugggcgacaagagaagcgaccccgagcagaacgagaagcugaagacccccagcacccccguggccugcagcacccccgcccagcugaagagaaagaucagaaagaagagcaacugguaccugggcaccaucaagaagagaagaaagaucagccaggccaaggacgacagccagaacgccaucgaccacaagaucgagagcgacaccgaggagacccaggacaccagcguggaccacaacgagaccggcaacaccggcgagagcagcguggaggagaacgagaagcagcagaacgccagcgagagcaagcuggagcugagaaacaacagcaacaccugcaacaucgagaacgagcuggaggacagcagaaagaccaccgccugcaccgagcugagagacaagaucgccugcaacggcgacgccagcagcagccagaucauccacaucagcgacgagaacgagggcaaggagaugugcgugcugagaaugaccagagccagaagaagccagguggagcagcagcagcugaucaccguggagaaggcccuggccauccugagccagcccacccccagccuggugguggaccacgagagacugaagaaccugcugaagaccguggugaagaagagccagaacuacaacaucuuccagcuggagaaccuguacgccgugaucagccagugcaucuacagacacagaaaggaccacgacaagaccagccugauccagaagauggagcaggagguggagaacuucagcugcagcagauaa

SEQ ID NO: 13927 - RNA, 1443 nt, Artificial Sequence
  ATAD3B__Homo_sapiens__XP_011540545
augagaagagccaccguggagagagagauggagcugagacacaagaacgagaugcugagaguggagaccgaggccagagccagagccaaggccgagagagagaacgccgacaucaucagagagcagaucagacugaaggccagcgagcacagacagaccgugcuggagagcaucagaaccgccggcacccuguucggcgagggcuucagagccuucgugaccgacagagacaaggugaccgccaccguggccggccugacccugcuggccgugggcguguacagcgccaagaacgccaccgccgugaccggcagauucaucgaggccagacugggcaagcccagccuggugagagagaccagcagaaucaccgugcuggaggcccugagacaccccauccaggugagcagaagacugcugagcagaccccaggacgugcuggagggcguggugcugagccccagccuggaggccagagugagagacaucgccaucgccaccagaaacaccaagaagaacagaggccuguacagacacauccugcuguacggcccccccggcaccggcaagacccuguucgccaagaagcuggcccugcacagcggcauggacuacgccaucaugaccggcggcgacguggcccccaugggcagagagggcgugaccgccaugcacaagcuguucgacugggccaacaccagcagaagaggccugcugcuguucauggacgaggccgacgccuuccugagaaagagagccaccgaggagaucagcaaggaccugagagccacccugaacgccuuccuguaccacaugggccagcacagcaacaaguucaugcuggugcuggccagcaaccugcccgagcaguucgacugcgccaucaacagcagaaucgacgugauggugcacuucgaccugccccagcaggaggagagagagagacuggugagacugcacuucgacaacugcgugcugaagcccgccaccgagggcaagagaagacugaagcuggcccaguucgacuacggcagaaagugcagcgagguggccagacugaccgagggcaugagcggcagagagaucgcccagcuggccgugagcuggcaggccaccgccuacgccagcaaggacggcgugcugaccgaggccaugauggacgccugcgugcaggacgccgugcagcaguacagacagaagaugagauggcugaaggccgagggccccggcagaggcguggagcacccccugagcggcgugcagggcgagacccugaccagcuggagccuggccaccgaccccagcuaccccugccuggccggccccugcaccuucagaaucugcagcuggaugggcaccggccugugccccggcccccugagccccagaaugagcugcggcggcggcagacccuucugcccccccggccacccccugcuguaa

SEQ ID NO: 13928 - RNA, 1290 nt, Artificial Sequence
  ATAD3C__Homo_sapiens__XP_011539310
augcagagagcccacagaagagccgaccccagcgagcugcagugccuggaggccaugagcaaggacgcccugaaccuggcccagaugcaggagcagacccugcagcuggagcagcagagcaagcugaagcagcuggugaacgaggaccugagaaagcaggaggagagcgugcagaagcaccaccagaccuuccuggagagcaucagagccgccggcacccuguucggcgagggcuucagagccuucgugaccgacagagacaaggugaccgccaccguggccggccugacccugcuggccgugggcguguacagcgccaagaacgccaccgccgugaccggcagauacaucgaggccagacugggcaagcccagccuggugagagagaccagcagaaucaccgugcuggaggcccugagacaccccauccagcaggugagcagaagacugcugagcagaccccaggacgugcuggagggcguggugcugagccccagccuggaggccagagugagagacaucgccaucaugaccagaaacaucaagaagaacagaggccuguacagacacauccugcuguacggcccccccggcaccggcaagacccuguucgccaagaagcuggcccugcacagcggcauggacuacgccaucaugaccggcggcgacguggcccccaugggcagagagggcgugaccgccaugcacaagcuguucgacugggccaacaccagcagaagaggccugcugcuguucguggacgaggccgacgccuuccugagaaagagagccaccgagaagaucagcgaggaccugagagccacccugaacgccuuccuguacagaaccggccagcacagcaacaaguucaugcugauccuggccagcugccaccccgagcaguucgacugggccaucaacgccugcaucgacgugauggugcacuucgaccugcccggccaggaggagagagccagacuggugagaauguaccugaacgaguacgugcugaagcccgccaccgagggcaagagaagacugaagcuggcccaguucgacuacggcagaaagugccuggagaucgccagacugaccgagggcaugagcugcagaaagaucgcccagcuggccgugagcuggcaggccaccgccuacgccagcaaggacggcgugcugaccgaggccaugauggacgccugcgugcaggacuucgugcagcagcaccagcagaugaugagauggcugaagggcgagagacccggccccgaggacgagcagcccagcagcuaa

SEQ ID NO: 13929 - RNA, 5535 nt, Artificial Sequence
  ATAD5__Homo_sapiens__NP_079133
auggugggcgugcuggccauggccgccgccgccgcccccccccccgugaaggacugcgagaucgagcccugcaagaagagaaagaaggacgacgacaccagcaccugcaagaccaucaccaaguaccugagcccccugggcaagaccagagacagaguguucgccccccccaagcccagcaacauccuggacuacuucagaaagaccagccccaccaacgagaagacccagcugggcaaggagugcaagaucaagagccccgagagcgugcccguggacagcaacaaggacugcaccaccccccuggagauguucagcaacguggaguucaagaagaagagaaagagagugaaccugagccaccagcugaacaacaucaagaccgagaacgaggcccccaucgagaucagcagcgacgacagcaaggaggacuacagccugaacaacgacuucguggagagcagcaccagcgugcugagauacaagaagcagguggaggugcuggccgagaacauccaggacaccaagagccagcccaacaccaugaccagccugcagaacagcaagaaggugaaccccaagcagggcaccaccaagaacgacuucaagaagcugagaaagagaaagugcagagacgugguggaccugagcgagagccugccccuggccgaggagcugaaccugcugaagaaggacggcaaggacaccaagcagauggagaacaccaccagccacgccaacagcagagacaacgugaccgaggccgcccagcugaacgacagcaucaucaccgugagcuacgaggaguuccugaagagccacaaggagaacaagguggaggagauccccgacagcaccaugagcaucugcgugcccagcgagaccguggacgagaucgugaagagcggcuacaucagcgagagcgagaacagcgagaucagccagcaggugagauucaagaccgugaccgugcuggcccaggugcaccccaucccccccaagaagaccggcaagauccccagaaucuuccugaagcagaagcaguucgagauggagaacagccugagcgaccccgagaacgagcagaccgugcagaagagaaagagcaacguggugauccaggaggaggagcuggagcuggccgugcuggaggccggcagcagcgaggccgugaagcccaagugcacccuggaggagagacagcaguucaugaaggccuucagacagcccgccagcgacgcccugaagaacggcgugaagaagagcagcgacaagcagaaggaccugaacgagaagugccuguacgaggugggcagagacgacaacagcaagaagaucauggagaacagcggcauccagauggugagcaagaacggcaaccugcagcugcacaccgacaagggcagcuuccugaaggagaagaacaagaagcugaagaagaagaacaagaagacccuggacaccggcgccauccccggcaagaacagagagggcaacacccagaagaaggagaccaccuucuuccugaaggagaagcaguaccagaacagaaugagccugagacagagaaagaccgaguucuucaagagcagcacccuguucaacaacgagagccugguguacgaggacaucgccaacgacgaccugcugaaggugagcagccugugcaacaacaacaagcugagcagaaagaccagcauccccgugaaggacaucaagcugacccagagcaaggccgagagcgaggccagccugcugaacgugagcacccccaagagcaccagaagaagcggcagaaucagcagcacccccaccaccgagaccaucagaggcaucgacagcgacgacgugcaggacaacagccagcugaaggccagcacccagaaggccgccaaccugagcgagaagcacagccuguacaccgccgagcugaucaccgugcccuucgacagcgagagccccaucagaaugaaguucaccagaaucagcacccccaagaagagcaagaagaagagcaacaagagaagcgagaagagcgaggccaccgacggcggcuucaccagccagaucagaaaggccagcaacaccagcaagaacaucagcaaggccaagcagcugaucgagaaggccaaggcccugcacaucagcagaagcaaggugaccgaggagaucgccaucccccugagaagaagcagcagacaccagacccugcccgagagaaagaagcugagcgagaccgaggacagcgugaucaucaucgacagcagccccaccgcccugaagcaccccgagaagaaccagaagaagcugcagugccugaacgacgugcugggcaagaagcugaacaccagcaccaagaacgugcccggcaagaugaagguggccccccuguuccuggugagaaaggcccagaaggccgccgaccccgugcccagcuucgacgagagcagccaggacaccagcgagaagagccaggacugcgacgugcagugcaaggccaagagagacuuccugaugagcggccugcccgaccugcugaagagacagaucgccaagaaggccgccgcccuggacguguacaacgccgugagcaccagcuuccagagaguggugcacgugcagcagaaggacgacggcugcugccuguggcaccugaagccccccagcugcccccugcugaccaaguucaaggagcugaacaccaaggugaucgaccugagcaagugcggcaucgcccugggcgaguucagcacccugaacagcaagcugaagagcggcaacagcgccgccguguucaugagaaccagaaaggaguucaccgaggaggugagaaaccugcugcuggaggagaucagauggagcaaccccgaguucagccugaagaaguacuucccccugcugcugaagaagcagaucgagcaccaggugcugagcagcgagugccacagcaagcaggagcuggaggccgacgugagccacaaggagaccaagagaaagcugguggaggccgagaacagcaagagcaagagaaagaagcccaacgaguacagcaagaaccuggagaagaccaacagaaagagcgaggagcugagcaagagaaacaacagcagcggcaucaagcuggacagcagcaaggacagcggcaccgaggacaugcuguggaccgagaaguaccagccccagaccgccagcgagcugaucggcaacgagcuggccaucaagaagcugcacagcuggcugaaggacuggaagagaagagccgagcuggaggagagacagaaccugaagggcaagagagacgagaagcacgaggacuucagcggcggcaucgacuucaagggcagcagcgacgacgaggaggagagcagacugugcaacaccgugcugaucaccggccccaccggcgugggcaagaccgccgccguguacgccugcgcccaggagcugggcuucaagaucuucgaggugaacgccagcagccagagaagcggcagacagauccugagccagcugaaggaggccacccagagccaccagguggacaagcagggcgugaacagccagaagcccugcuucuucaacagcuacuacaucggcaagagccccaagaagaucagcagccccaagaagguggugaccagccccagaaaggugcccccccccagccccaagagcagcggccccaagagagcccugccccccaagacccuggccaacuacuucaaggugagccccaagcccaagaacaacgaggagaucggcaugcugcuggagaacaacaagggcaucaagaacagcuucgagcagaagcagaucacccagaccaagagcaccaacgccaccaacagcaacgugaaggacgugggcgccgaggagcccagcagaaagaacgccaccagccugauccuguucgaggagguggacgugaucuucgacgaggacgccggcuuccugaacgccaucaagaccuucauggccaccaccaagagacccgugauccugaccaccagcgaccccaccuucagccugauguucgacggcugcuucgaggagaucaaguucagcacccccagccugcugaacguggccagcuaccugcagaugaucugccugaccgagaacuucagaaccgacgugaaggacuucgugacccugcugaccgccaacaccugcgacaucagaaagagcauccuguaccugcaguucuggaucagaagcggcggcggcgugcuggaggagagaccccugacccuguacagaggcaacagcagaaacgugcagcuggugugcagcgagcacggccuggacaacaagaucuaccccaagaacaccaagaagaagagaguggaccugcccaagugcgacagcggcugcgccgagacccuguucggccugaagaacaucuucagccccagcgaggaccuguucagcuuccugaagcacaagaucaccaugaaggaggaguggcacaaguucauccagcugcugaccgaguuccagaugagaaacguggacuuccuguacagcaaccuggaguucauccugccccugcccguggacaccauccccgagaccaagaacuucugcggccccagcgugaccguggacgccagcgccgccaccaagagcaugaacugccuggccagaaagcacagcgagagagagcagccccugaagaagagccagaagaagaagcagaagaagacccuggugauccuggacgacagcgaccuguucgacaccgaccuggacuuccccgaccagagcaucagccugagcagcgugagcagcagcagcaacgccgaggagagcaagaccggcgacgaggagagcaaggccagagacaagggcaacaaccccgagaccaagaagagcauccccugcccccccaagaccaccgccggcaagaagugcagcgcccuggugagccacugccugaacagccugagcgaguucauggacaacaugagcuuccuggacgcccugcugaccgacgugagagagcagaacaaguacggcagaaacgacuucagcuggaccaacggcaaggugaccagcggccugugcgacgaguucagccuggagagcaacgacggcuggaccagccagagcagcggcgagcugaaggccgccgccgaggcccugagcuucaccaagugcagcagcgccaucagcaaggcccuggagacccugaacagcugcaagaagcugggcagagaccccaccaacgaccugaccuucuacgugagccagaagagaaacaacguguacuucagccagagcgccgccaaccuggacaacgccuggaagagaaucagcgugaucaagagcguguucagcagcagaagccugcuguacgugggcaacagacaggccagcaucaucgaguaccugcccacccugagaaacaucugcaagaccgagaagcugaaggagcagggcaagagcaagagaagauuccugcacuacuucgagggcauccaccuggacauccccaaggagaccgugaacacccuggccgccgacuuccccuaa

SEQ ID NO: 13930 - RNA, 1230 nt, Artificial Sequence
  ATAT1__Homo_sapiens__NP_001026892
auguggcugaccuggcccuucugcuuccugaccaucacccugagagaggagggcgugugccaccuggagagcguggaccugcagcagcagaucaugaccaucaucgacgagcugggcaaggccagcgccaaggcccagaaccugagcgcccccaucaccagcgccagcagaaugcagagcaacagacacgugguguacauccugaaggacagcagcgccagacccgccggcaagggcgccaucaucggcuucaucaaggugggcuacaagaagcuguucgugcuggacgacagagaggcccacaacgagguggagccccugugcauccuggacuucuacauccacgagagcgugcagagacacggccacggcagagagcuguuccaguacaugcugcagaaggagagaguggagccccaccagcuggccaucgacagacccagccagaagcugcugaaguuccugaacaagcacuacaaccuggagaccaccgugccccaggugaacaacuucgugaucuucgagggcuucuucgcccaccagcacagaccccccgcccccagccugagagccaccagacacagcagagccgccgccguggaccccacccccgccgcccccgccagaaagcugccccccaagagagccgagggcgacaucaagcccuacagcagcagcgacagagaguuccugaagguggccguggagccccccuggccccugaacagagcccccagaagagccaccccccccgcccaccccccccccagaagcagcagccugggcaacagccccgagagaggcccccugagacccuucgugcccgagcaggagcugcugagaagccugagacugugccccccccaccccaccgccagacugcugcuggccgccgaccccggcggcagccccgcccagagaagaagaaccagaggcaccccccccggccugguggcccagagcugcugcuacagcagacacggcggcgugaacagcagcagccccaacaccggcaaccaggacagcaagcagggcgagcaggagaccaagaacagaagcgccagcgaggagcaggcccugagccaggacggcagcggcgagaagcccaugcacaccgcccccccccaggcccccgccccccccgcccagagcuggaccgugggcggcgacauccugaacgccagauucaucagaaaccugcaggagagaagaagcaccagacccugguaa

SEQ ID NO: 13931 - RNA, 1116 nt, Artificial Sequence
  ATCAY__Homo_sapiens__NP_149053
augggcaccaccgaggccacccugagaauggagaacguggacgugaaggaggaguggcaggacgaggaccugcccagaccccugcccgaggagaccggcguggagcugcugggcagccccguggaggacaccagcagcccccccaacacccugaacuucaacggcgcccacagaaagagaaagacccugguggcccccgagaucaacaucagccuggaccagagcgagggcagccugcugagcgacgacuuccuggacacccccgacgaccuggacaucaacguggacgacaucgagacccccgacgagaccgacagccuggaguuccugggcaacggcaacgagcuggagugggaggacgacacccccguggccaccgccaagaacaugcccggcgacagcgccgaccuguucggcgacggcaccaccgaggacggcagcgccgccaacggcagacuguggagaaccgugaucaucggcgagcaggagcacagaaucgaccugcacaugaucagacccuacaugaagguggugacccacggcggcuacuacggcgagggccugaacgccaucaucguguucgccgccugcuuccugcccgacagcagccugcccgacuaccacuacaucauggagaaccuguuccuguacgugaucagcagccuggagcugcugguggccgaggacuacaugaucguguaccugaacggcgccacccccagaagaagaaugcccggcaucggcuggcugaagaagugcuaccagaugaucgacagaagacugagaaagaaccugaagagccugaucaucgugcaccccagcugguucaucagaaccgugcuggccaucagcagacccuucaucagcgugaaguucaucaacaagauccaguacgugcacagccuggaggaccuggagcagcugauccccauggagcacgugcagauccccgacugcgugcugcaguacgaggaggagagacugaaggccagaagagagagcgccagaccccagcccgaguucgugcugcccagaagcgaggagaagcccgagguggcccccguggagaacagaagcgcccuggugagcgaggaccaggagaccagcaugagcuaa

SEQ ID NO: 13932 - RNA, 1557 nt, Artificial Sequence
  ATE1__Homo_sapiens__NP_001001976
auggccuucugggccggcggcagccccagcgugguggacuacuuccccagcgaggacuucuacagaugcggcuacugcaagaacgagagcggcagcagaagcaacggcaugugggcccacagcaugaccgugcaggacuaccaggaccugaucgacagaggcuggagaagaagcggcaaguacguguacaagcccgugaugaaccagaccugcugcccccaguacaccaucagaugcagaccccugcaguuccagcccagcaagagccacaagaaggugcugaagaagaugcugaaguuccuggccaagggcgaggugcccaagggcagcugcgaggacgagcccauggacagcaccauggacgacgccguggccggcgacuucgcccugaucaacaagcuggacauccagugcgaccugaagacccugagcgacgacaucaaggagagccuggagagcgagggcaagaacagcaagaaggaggagccccaggagcugcugcagagccaggacuucgugggcgagaagcugggcagcggcgagcccagccacagcgugaaggugcacaccgugcccaagcccggcaagggcgccgaccugagcaagccccccugcagaaaggccaaggagaucagaaaggagagaaagagacugaagcugaugcagcagaaccccgccggcgagcuggagggcuuccaggcccagggccacccccccagccuguucccccccaaggccaagagcaaccagcccaagagccuggaggaccugaucuucgagagccugcccgagaacgccagccacaagcuggaggugagaguggugagaagcagcccccccagcagccaguucaaggccacccugcuggagagcuaccagguguacaagagauaccagauggugauccacaagaacccccccgacacccccaccgagagccaguucaccagauuccugugcagcagcccccuggaggccgagaccccccccaacggccccgacugcggcuacggcagcuuccaccagcaguacuggcuggacggcaagaucaucgccgugggcgugaucgacauccugcccaacugcgugagcagcguguaccuguacuacgaccccgacuacagcuuccugagccugggcguguacagcgcccugagagagaucgccuucaccagacagcugcacgagaagaccagccagcugagcuacuacuacaugggcuucuacauccacagcugccccaagaugaaguacaagggccaguacagacccagcgaccugcugugccccgagaccuacgugugggugcccaucgagcagugccugcccagccuggagaacagcaaguacugcagauucaaccaggaccccgaggccguggacgaggacagaagcaccgagcccgacagacugcagguguuccacaagagagccaucaugcccuacggcguguacaagaagcagcagaaggaccccagcgaggaggccgccgugcugcaguacgccagccuggugggccagaagugcagcgagagaaugcugcuguucagaaacuaa

SEQ ID NO: 13933 - RNA, 816 nt, Artificial Sequence
  ATF1__Homo_sapiens__XP_011536689
auggaggacagccacaagagcaccaccagcgagaccgccccccagcccggcagcgccgugcagggcgcccacaucagccacaucgcccagcaggugagcagccugagcgagagcgaggagagccaggacagcagcgacagcaucggcagcagccagaaggcccacggcauccuggccagaagacccagcuacagaaagauccugaaggaccugagcagcgaggacaccagaggcagaaagggcgacggcgagaacagcggcgugagcgccgccgugaccagcaugagcgugcccacccccaucuaccagaccagcagcggccaguacaucgccaucgcccccaacggcgcccugcagcuggccagccccggcaccgacggcgugcagggccugcagacccugaccaugaccaacagcggcagcacccagcagggcaccaccauccugcaguacgcccagaccagcgacggccagcagauccuggugcccagcaaccaggugguggugcagaccgccagcggcgacaugcagaccuaccagaucagaaccacccccagcgccaccagccugccccagaccguggugaugaccagccccgugacccugaccagccagaccaccaagaccgacgacccccagcugaagagagagaucagacugaugaagaacagagaggccgccagagagugcagaagaaagaagaaggaguacgugaagugccuggagaacagaguggccgugcuggagaaccagaacaagacccugaucgaggagcugaagacccugaaggaccuguacagcaacaagagcguguaa

SEQ ID NO: 13934 - RNA, 1518 nt, Artificial Sequence
  ATF2__Homo_sapiens__NP_001243019
augaaguucaagcugcacgugaacagcgccagacaguacaaggaccuguggaacaugagcgacgacaagcccuuccugugcaccgcccccggcugcggccagagauucaccaacgaggaccaccuggccgugcacaagcacaagcacgagaugacccugaaguucggccccgccagaaacgacagcgugaucguggccgaccagacccccacccccaccagauuccugaagaacugcgaggaggugggccuguucaacgagcuggccagccccuucgagaacgaguucaagaaggccagcgaggacgacaucaagaagaugccccuggaccugagcccccuggccacccccaucaucagaagcaagaucgaggagcccagcgugguggagaccacccaccaggacagcccccugccccaccccgagagcaccaccagcgacgagaaggaggugccccuggcccagaccgcccagcccaccagcgccaucgugagacccgccagccugcaggugcccaacgugcugcugaccagcagcgacagcagcgugaucauccagcaggccgugcccagccccaccagcagcaccgugaucacccaggcccccagcagcaacagacccaucgugcccgugcccggccccuucccccugcugcugcaccugcccaacggccagaccaugcccguggccauccccgccagcaucaccagcagcaacgugcacgugcccgccgccgugccccuggugagacccgugaccauggugcccagcgugcccggcauccccggccccagcagcccccagcccgugcagagcgaggccaagaugagacugaaggccgcccugacccagcagcacccccccgugaccaacggcgacaccgugaagggccacggcagcggccuggugagaacccagagcgaggagagcagaccccagagccugcagcagcccgccaccagcaccaccgagacccccgccagccccgcccacaccaccccccagacccagagcaccagcggcagaagaagaagagccgccaacgaggaccccgacgagaagagaagaaaguuccuggagagaaacagagccgccgccagcagaugcagacagaagagaaaggugugggugcagagccuggagaagaaggccgaggaccugagcagccugaacggccagcugcagagcgaggugacccugcugagaaacgagguggcccagcugaagcagcugcugcuggcccacaaggacugccccgugaccgccaugcagaagaagagcggcuaccacaccgccgacaaggacgacagcagcgaggacaucagcgugcccagcagcccccacaccgaggccauccagcacagcagcgugagcaccagcaacggcgugagcagcaccagcaaggccgaggccguggccaccagcgugcugacccagauggccgaccagagcaccgagcccgcccugagccagaucgugauggcccccagcagccagagccagcccagcggcagcuaa

SEQ ID NO: 13935 - RNA, 408 nt, Artificial Sequence
  ATF3__Homo_sapiens__NP_001035709
augaugcugcagcaccccggccaggugagcgccagcgaggugagcgccagcgccaucgugcccugccugagcccccccggcagccugguguucgaggacuucgccaaccugacccccuucgugaaggaggagcugagauucgccauccagaacaagcaccugugccacagaaugagcagcgcccuggagagcgugaccgugagcgacagaccccugggcgugagcaucaccaaggccgagguggcccccgaggaggacgagagaaagaagagaagaagagagagaaacaagaucgccgccgccaagugcagaaacaagaagaaggagaagaccgagugccugcagaagcugcccagacccuucugggugcagaagaccugcaucugggccguggacagcugcaaguaa

SEQ ID NO: 13936 - RNA, 1056 nt, Artificial Sequence
  ATF4__Homo_sapiens__NP_001666
augaccgagaugagcuuccugagcagcgaggugcuggugggcgaccugaugagccccuucgaccagagcggccugggcgccgaggagagccugggccugcuggacgacuaccuggagguggccaagcacuucaagccccacggcuucagcagcgacaaggccaaggccggcagcagcgaguggcuggccguggacggccuggugagccccagcaacaacagcaaggaggacgccuucagcggcaccgacuggaugcuggagaagauggaccugaaggaguucgaccuggacgcccugcugggcaucgacgaccuggagaccaugcccgacgaccugcugaccacccuggacgacaccugcgaccuguucgccccccuggugcaggagaccaacaagcagcccccccagaccgugaaccccaucggccaccugcccgagagccugaccaagcccgaccagguggcccccuucaccuuccugcagccccugccccugagccccggcgugcugagcagcacccccgaccacagcuucagccuggagcugggcagcgagguggacaucaccgagggcgacagaaagcccgacuacaccgccuacguggccaugaucccccagugcaucaaggaggaggacacccccagcgacaacgacagcggcaucugcaugagccccgagagcuaccugggcagcccccagcacagccccagcaccagaggcagccccaacagaagccugcccagccccggcgugcugugcggcagcgccagacccaagcccuacgacccccccggcgagaagaugguggccgccaaggugaagggcgagaagcuggacaagaagcugaagaagauggagcagaacaagaccgccgccaccagauacagacagaagaagagagccgagcaggaggcccugaccggcgagugcaaggagcuggagaagaagaacgaggcccugaaggagagagccgacagccuggccaaggagauccaguaccugaaggaccugaucgaggaggugagaaaggccagaggcaagaagagagugcccuaa

SEQ ID NO: 13937 - RNA, 849 nt, Artificial Sequence
  ATF5__Homo_sapiens__NP_001277675
augagccugcuggccacccugggccuggagcuggacagagcccugcugcccgccagcggccugggcuggcugguggacuacggcaagcugccccccgcccccgccccccuggcccccuacgaggugcugggcggcgcccuggagggcggccugcccgugggcggcgagccccuggccggcgacggcuucagcgacuggaugaccgagagaguggacuucaccgcccugcugccccuggagcccccccugccccccggcacccugccccagcccagccccaccccccccgaccuggaggccauggccagccugcugaagaaggagcuggagcagauggaggacuucuuccuggacgcccccccccugcccccccccagcccccccccccugcccccccccccccugccccccgcccccagccugccccugagccugcccagcuucgaccugccccagccccccgugcuggacacccuggaccugcuggccaucuacugcagaaacgaggccggccaggaggaggugggcaugcccccccugccccccccccagcagccccccccccccagccccccccagcccagcagacuggcccccuacccccaccccgccaccaccagaggcgacagaaagcagaagaagagagaccagaacaagagcgccgcccugagauacagacagagaaagagagccgagggcgaggcccuggagggcgagugccagggccuggaggccagaaacagagagcugaaggagagagccgagagcguggagagagagauccaguacgugaaggaccugcugaucgagguguacaaggccagaagccagagaaccagaagcugcuaa

SEQ ID NO: 13938 - RNA, 2103 nt, Artificial Sequence
  ATF6B__Homo_sapiens__NP_001129625
auggccgagcugaugcugcugagcgagaucgccgaccccaccagauucuucaccgacaaccugcugagccccgaggacugggacagcacccuguacagcggccuggacgagguggccgaggagcagacccagcuguucagaugccccgagcaggacgugcccuucgacggcagcagccuggacgugggcauggacgugagccccagcgagccccccugggagcugcugcccaucuuccccgaccugcaggugaagagcgagcccagcagccccugcagcagcagcagccugagcagcgagagcagcagacugagcaccgagcccagcagcgaggcccugggcgugggcgaggugcugcacgugaagaccgagagccuggcccccccccugugccugcugggcgacgaccccaccagcagcuucgagaccgugcagaucaacgugauccccaccagcgacgacagcagcgacgugcagaccaagaucgagcccgugagccccugcagcagcgugaacagcgaggccagccugcugagcgccgacagcagcagccaggccuucaucggcgaggaggugcuggaggugaagaccgagagccugagccccagcggcugccugcugugggacgugcccgcccccagccugggcgccgugcagaucagcaugggccccagccuggacggcagcagcggcaaggcccugcccaccagaaagcccccccugcagcccaagcccguggugcugaccaccgugcccaugcccagcagagccgugccccccagcaccaccgugcugcugcagagccuggugcagcccccccccgugagccccguggugcugauccagggcgccaucagagugcagcccgagggccccgcccccagccugcccagacccgagagaaagagcaucgugcccgcccccaugcccggcaacagcugcccccccgagguggacgccaagcugcugaagagacagcagagaaugaucaagaacagagagagcgccugccagagcagaagaaagaagaaggaguaccugcagggccuggaggccagacugcaggccgugcuggccgacaaccagcagcugagaagagagaacgccgcccugagaagaagacuggaggcccugcuggccgagaacagcgagcugaagcugggcagcggcaacagaaagguggugugcaucaugguguuccugcuguucaucgccuucaacuucggccccgugagcaucagcgagccccccagcgcccccaucagccccagaaugaacaagggcgagccccagcccagaagacaccugcugggcuucagcgagcaggagcccgugcagggcguggagccccugcagggcagcagccagggccccaaggagccccagcccagccccaccgaccagcccagcuucagcaaccugaccgccuuccccggcggcgccaaggagcugcugcugagagaccuggaccagcuguuccugagcagcgacugcagacacuucaacagaaccgagagccugagacuggccgacgagcugagcggcugggugcagagacaccagagaggcagaagaaagaucccccagagagcccaggagagacagaagagccagcccagaaagaagagcccccccgugaaggccgugcccauccagccccccggcccccccgagagagacagcgugggccagcugcagcuguacagacaccccgacagaagccagcccgccuuccuggacgccaucgacagaagagaggacaccuucuacguggugagcuucagaagagaccaccugcugcugcccgccaucagccacaacaagaccagcagacccaagaugagccuggugaugcccgccauggcccccaacgagacccugagcggcagaggcgcccccggcgacuacgaggagaugaugcagaucgagugcgaggugauggacaccagagugauccacaucaagaccagcaccgugccccccagccugagaaagcagcccagccccacccccggcaacgccaccggcggcccccugcccgugagcgccgccagccaggcccaccaggccagccaccagccccuguaccugaaccaccccuaa

SEQ ID NO: 13939 - RNA, 2013 nt, Artificial Sequence
  ATF6__Homo_sapiens__NP_031374
augggcgagcccgccggcguggccggcaccauggagagccccuucagccccggccuguuccacagacuggacgaggacugggacagcgcccuguucgccgagcugggcuacuucaccgacaccgacgagcugcagcuggaggccgccaacgagaccuacgagaacaacuucgacaaccuggacuucgaccuggaccugaugcccugggagagcgacaucugggacaucaacaaccagaucugcaccgugaaggacaucaaggccgagccccagccccugagccccgccagcagcagcuacagcgugagcagccccagaagcguggacagcuacagcagcacccagcacgugcccgaggagcuggaccugagcagcagcagccagaugagcccccugagccuguacggcgagaacagcaacagccugagcagcgccgagccccugaaggaggacaagcccgugaccggccccagaaacaagaccgagaacggccugacccccaagaagaagauccaggugaacagcaagcccagcauccagcccaagccccugcugcugcccgccgcccccaagacccagaccaacagcagcgugcccgccaagaccaucaucauccagaccgugcccacccugaugccccuggccaagcagcagcccaucaucagccugcagcccgcccccaccaagggccagaccgugcugcugagccagcccaccguggugcagcugcaggcccccggcgugcugcccagcgcccagcccgugcuggccguggccggcggcgugacccagcugcccaaccacguggugaacguggugcccgcccccagcgccaacagccccgugaacggcaagcugagcgugaccaagcccgugcugcagagcaccaugagaaacgugggcagcgacaucgccgugcugagaagacagcagagaaugaucaagaacagagagagcgccugccagagcagaaagaagaagaaggaguacaugcugggccuggaggccagacugaaggccgcccugagcgagaacgagcagcugaagaaggagaacggcacccugaagagacagcuggacgagguggugagcgagaaccagagacugaaggugcccagccccaagagaagaguggugugcgugaugaucgugcuggccuucaucauccugaacuacggccccaugagcaugcuggagcaggacagcagaagaaugaaccccagcgugagccccgccaaccagagaagacaccugcugggcuucagcgccaaggaggcccaggacaccagcgacggcaucauccagaagaacagcuacagauacgaccacagcgugagcaacgacaaggcccugauggugcugaccgaggagccccugcuguacaucccccccccccccugccagccccugaucaacaccaccgagagccugagacugaaccacgagcugagaggcugggugcacagacacgagguggagagaaccaagagcagaagaaugaccaacaaccagcagaagaccagaauccugcagggcgcccuggagcagggcagcaacagccagcugauggccgugcaguacaccgagaccaccagcagcaucagcagaaacagcggcagcgagcugcagguguacuacgccagccccagaagcuaccaggacuucuucgaggccaucagaagaagaggcgacaccuucuacguggugagcuucagaagagaccaccugcugcugcccgccaccacccacaacaagaccaccagacccaagaugagcaucgugcugcccgccaucaacaucaacgagaacgugaucaacggccaggacuacgaggugaugaugcagaucgacugccaggugauggacaccagaauccugcacaucaagagcagcagcgugccccccuaccugagagaccagcagagaaaccagaccaacaccuucuucggcagcccccccgccgccaccgaggccacccacguggugagcaccauccccgagagccugcaguaa

SEQ ID NO: 13940 - RNA, 1389 nt, Artificial Sequence
  ATF7__Homo_sapiens__NP_001123532
augggcgacgacagacccuucgugugcaacgcccccggcugcggccagagauucaccaacgaggaccaccuggccgugcacaagcacaagcacgagaugacccugaaguucggccccgccagaaccgacagcgugaucaucgccgaccagacccccacccccaccagauuccugaagaacugcgaggaggugggccuguucaacgagcuggccagcagcuucgagcacgaguucaagaaggccgccgacgaggacgagaagaaggccgccgccggcccccuggacaugagccugcccagcacccccgacaucaagaucaaggaggaggagcccguggaggaggugacccccaagcccgugcugaucagcacccccacccccaccaucgugagacccggcagccugccccugcaccugggcuacgacccccugcaccccacccugcccagccccaccagcgugaucacccaggccccccccagcaacagacagaugggcagccccaccggcagccugccccuggugaugcaccuggccaacggccagaccaugcccgugcugcccggcccccccgugcagaugcccagcgugaucagccuggccagacccgugagcauggugcccaacauccccggcauccccggcccccccgugaacagcagcggcagcaucagccccagcggccaccccauccccagcgaggccaagaugagacugaaggccacccugacccaccaggugagcagcaucaacggcggcugcggcaugguggugggcaccgccagcaccauggugaccgccagacccgagcagagccagauccugauccagcaccccgacgcccccagccccgcccagccccaggugagccccgcccagcccacccccagcaccggcggcagaagaagaagaaccguggacgaggaccccgacgagagaagacagagauuccuggagagaaacagagccgccgccagcagaugcagacagaagagaaagcugugggugagcagccuggagaagaaggccgaggagcugaccagccagaacauccagcugagcaacgaggugacccugcugagaaacgagguggcccagcugaagcagcugcugcuggcccacaaggacugccccgugaccgcccugcagaagaagacccagggcuaccuggagagccccaaggagagcagcgagcccaccggcagccccgcccccgugauccagcacagcagcgccaccgcccccagcaacggccugagcgugagaagcgccgccgaggccguggccaccagcgugcugacccagauggccagccagagaaccgagcugagcaugcccauccagagccacgugaucaugaccccccagagccagagcgccggcagauaa

SEQ ID NO: 13941 - RNA, 3318 nt, Artificial Sequence
  ATF7IP__Homo_sapiens__NP_001273444
auggacagccuggaggagccccagaagaagguguucaaggccagaaagaccaugagagugagcgacagacagcagcuggaggccguguacaaggugaaggaggagcugcugaagaccgacgugaagcugcugaacggcaaccacgagaacggcgaccuggaccccaccagcccccuggagaacauggacuacaucaaggacaaggaggaggugaacggcaucgaggagaucugcuucgaccccgagggcagcaaggccgaguggaaggagacccccugcauccugagcgugaacgugaagaacaagcaggacgacgaccugaacugcgagccccugagcccccacaacaucacccccgagcccgugagcaagcugcccgccgagcccgugagcggcgaccccgcccccggcgaccuggacgccggcgaccccgccagcggcgugcuggccagcggcgacagcaccagcggcgaccccaccagcagcgagcccagcagcagcgacgccgccagcggcgacgccaccagcggcgacgcccccagcggcgacgugagccccggcgacgccaccagcggcgacgccaccgccgacgaccugagcagcggcgaccccaccagcagcgaccccauccccggcgagcccgugcccguggagcccaucagcggcgacugcgccgccgacgacaucgccagcagcgagaucaccagcguggaccuggccagcggcgcccccgccagcaccgaccccgccagcgacgaccuggccagcggcgaccugagcagcagcgagcuggccagcgacgaccuggccaccggcgagcuggccagcgacgagcugaccagcgagagcaccuucgacagaaccuucgagcccaagagcgugcccgugugcgagcccgugcccgagaucgacaacaucgagcccagcagcaacaaggacgacgacuuccuggagaagaacggcgccgacgagaagcuggagcagauccagagcaaggacagccuggacgagaagaacaaggccgacaacaacaucgacgccaacgaggagacccuggagaccgacgacaccaccaucugcagcgacagaccccccgagaacgagaagaagguggaggaggacaucaucaccgagcuggcccugggcgaggacgccaucagcagcagcauggagaucgaccagggcgagaagaacgaggacgagaccagcgccgaccugguggagaccaucaacgagaacgugaucgaggacaacaagagcgagaacauccuggagaacaccgacagcauggagaccgacgagaucauccccauccuggagaagcuggcccccagcgaggacgagcugaccugcuucagcaagaccagccugcugcccaucgacgagaccaaccccgaccuggaggagaagauggagagcagcuucggcagccccagcaagcaggagagcagcgagagccugcccaaggaggccuuccuggugcugagcgacgaggaggacaucagcggcgagaaggacgagagcgaggugaucagccagaacgagaccugcagccccgagguggagagcaacgagaaggacaacaagcccgaggaggaggagcaggugauccacgaggacgacgagagacccagcgagaagaacgaguucagcagaagaaagagaagcaagagcgaggacauggacaacgugcagagcaagagaagaagauacauggaggaggaguacgaggccgaguuccaggugaagaucaccgccaagggcgacaucaaccagaagcugcagaaggugauccaguggcugcuggaggagaagcugugcgcccugcagugcgccguguucgacaagacccuggccgagcugaagaccagaguggagaagaucgagugcaacaagagacacaagaccgugcugaccgagcugcaggccaagaucgccagacugaccaagagauucgaggccgccaaggaggaccugaagaagagacacgagcacccccccaacccccccgugagccccggcaagaccgugaacgacgugaacagcaacaacaacaugagcuacagaaacgccggcaccgugagacagaugcuggagagcaagagaaacgugagcgagagcgccccccccagcuuccagacccccgugaacaccgugagcagcaccaaccuggugaccccccccgccguggugagcagccagcccaagcugcagacccccgugaccagcggcagccugaccgccaccagcgugcugcccgcccccaacaccgccaccgugguggccaccacccaggugcccagcggcaacccccagcccaccaucagccugcagccccugcccgugauccugcacgugcccguggccgugagcagccagccccagcugcugcagagccaccccggcacccuggugaccaaccagcccagcggcaacguggaguucaucagcgugcagagcccccccaccgugagcggccugaccaagaaccccgugagccugcccagccugcccaaccccaccaagcccaacaacgugcccagcgugcccagccccagcauccagagaaaccccaccgccagcgccgccccccugggcaccacccuggccgugcaggccgugcccaccgcccacagcaucgugcaggccaccagaaccagccugcccaccgugggccccagcggccuguacagccccagcaccaacagaggccccauccagaugaagauccccaucagcgccuucagcaccagcagcgccgccgagcagaacagcaacaccacccccagaaucgagaaccagaccaacaagaccaucgacgccagcgugagcaagaaggccgccgacagcaccagccagugcggcaaggccaccggcagcgacagcagcggcgugaucgaccugaccauggacgacgaggagagcggcgccagccaggaccccaagaagcugaaccacacccccgugagcaccaugagcagcagccagcccgugagcagaccccugcagcccauccagcccgcccccccccugcagcccagcggcgugcccaccagcggccccagccagaccaccauccaccugcugcccaccgcccccaccaccgugaacgugacccacagacccgugacccaggugaccaccagacugcccgugcccagagcccccgccaaccaccaggugguguacaccacccugcccgccccccccgcccaggccccccugagaggcaccgugaugcaggcccccgccgugagacaggugaacccccagaacagcaagagauucuuccuguacauggcccccagauacauguaa

SEQ ID NO: 13942 - RNA, 663 nt, Artificial Sequence
  ATG10__Homo_sapiens__XP_005248667
auggaggaggacgaguucaucggcgagaagaccuuccagagauacugcgccgaguucaucaagcacagccagcagaucggcgacagcugggaguggagacccagcaaggacugcagcgacggcuacaugugcaagauccacuuccagaucaagaacggcagcgugaugagccaccugggcgccagcacccacggccagaccugccugcccauggaggaggccuucgagcugccccuggacgacugcgaggugaucgagaccgccgccgccagcgaggugaucaaguacgaguaccacgugcuguacagcugcagcuaccaggugcccgugcuguacuucagagccagcuuccuggacggcagaccccugacccugaaggacaucugggagggcgugcacgagugcuacaagaugagacugcugcagggccccugggacaccaucacccagcaggagcaccccauccugggccagcccuucuucgugcugcaccccugcaagaccaacgaguucaugacccccgugcugaagaacagccagaagaucaacaagaacgugaacuacaucaccagcuggcugagcaucgugggccccguggugggccugaaccugccccugagcuacgccaaggccaccagccaggacgagagaaacgugcccuaa

SEQ ID NO: 13943 - RNA, 225 nt, Artificial Sequence
  ATG12__Homo_sapiens__NP_001264712
auggccgaggagccccagagcgugcugcagcugcccaccagcaucgccgccggcggcgagggccugaccgacgugagccccgagaccaccacccccgagccccccagcagcgccgccgugagccccggcaccgaggagcccgccggcgacaccaagaagaagaucuaccugugcgagagcgugcugugcagcuuccccagacccagaagcuggaacagccuguaa

SEQ ID NO: 13944 - RNA, 1767 nt, Artificial Sequence
  ATG16L1__Homo_sapiens__NP_060444
augagcagcggccugagagccgccgacuuccccagauggaagagacacaucagcgagcagcugagaagaagagacagacugcagagacaggccuucgaggagaucauccugcaguacaacaagcugcuggagaagagcgaccugcacagcgugcuggcccagaagcugcaggccgagaagcacgacgugcccaacagacacgagaucagccccggccacgacggcaccuggaacgacaaccagcugcaggagauggcccagcugagaaucaagcaccaggaggagcugaccgagcugcacaagaagagaggcgagcuggcccagcuggugaucgaccugaacaaccagaugcagagaaaggacagagagaugcagaugaacgaggccaagaucgccgagugccugcagaccaucagcgaccuggagaccgagugccuggaccugagaaccaagcugugcgaccuggagagagccaaccagacccugaaggacgaguacgacgcccugcagaucaccuucaccgcccuggagggcaagcugagaaagaccaccgaggagaaccaggagcuggugaccagauggauggccgagaaggcccaggaggccaacagacugaacgccgagaacgagaaggacagcagaagaagacaggccagacugcagaaggagcuggccgaggccgccaaggagccccugcccguggagcaggacgacgacaucgaggugaucguggacgagaccagcgaccacaccgaggagaccagccccgugagagccaucagcagagccgccaccagaagaagcgugagcagcuuccccgugccccaggacaacguggacacccaccccggcagcggcaaggaggugagagugcccgccaccgcccugugcguguucgacgcccacgacggcgaggugaacgccgugcaguucagccccggcagcagacugcuggccaccggcggcauggacagaagagugaagcugugggagguguucggcgagaagugcgaguucaagggcagccugagcggcagcaacgccggcaucaccagcaucgaguucgacagcgccggcagcuaccugcuggccgccagcaacgacuucgccagcagaaucuggaccguggacgacuacagacugagacacacccugaccggccacagcggcaaggugcugagcgccaaguuccugcuggacaacgccagaaucgugagcggcagccacgacagaacccugaagcugugggaccugagaagcaaggugugcaucaagaccguguucgccggcagcagcugcaacgacaucgugugcaccgagcagugcgugaugagcggccacuucgacaagaagaucagauucugggacaucagaagcgagagcaucgugagagagauggagcugcugggcaagaucaccgcccuggaccugaaccccgagagaaccgagcugcugagcugcagcagagacgaccugcugaaggugaucgaccugagaaccaacgccaucaagcagaccuucagcgcccccggcuucaagugcggcagcgacuggaccagagugguguucagccccgacggcagcuacguggccgccggcagcgccgagggcagccuguacaucuggagcgugcugaccggcaagguggagaaggugcugagcaagcagcacagcagcagcaucaacgccguggccuggagccccagcggcagccacguggugagcguggacaagggcugcaaggccgugcugugggcccaguacuaa

SEQ ID NO: 13945 - RNA, 6237 nt, Artificial Sequence
  ATG2B__Homo_sapiens__NP_060506
augcccuggcccuucagcgagagcaucaagaagagagccugcagauaccugcugcagagauaccugggccacuuccugcaggagaagcugagccuggagcagcugagccuggaccuguaccagggcaccggcagccuggcccaggugccccuggacaaguggugccugaacgagauccuggagagcgccgacgccccccuggaggugaccgagggcuucauccagagcaucagccugagcgugcccuggggcagccugcugcaggacaacugcgcccuggaggugagaggccuggagaugguguucagacccagacccagacccgccaccggcagcgagcccauguacuggagcagcuucaugaccagcagcaugcagcuggccaaggagugccugagccagaagcugaccgacgagcagggcgagggcagccagcccuucgagggccuggagaaguucgccgagaccaucgagaccgugcugagaagagugaaggugaccuucaucgacaccgugcugagaaucgagcacgugcccgagaacagcaagaccggcaccgcccuggagaucagaaucgagagaaccguguacugcgacgagaccgccgacgagagcagcggcaucaacgugcaccagcccaccgccuucgcccacaagcugcugcagcugagcggcgugagccuguucugggacgaguucagcgccagcgccaagagcagccccgugugcagcaccgcccccguggagaccgagcccaagcugagccccagcuggaaccccaagaucaucuacgagccccacccccagcugaccagaaaccugcccgagaucgcccccagcgaccccgugcagaucggcagacugaucggcagacuggagcugagccugacccugaagcagaacgaggugcugcccggcgccaagcuggacguggacggccagaucgacagcauccaccugcugcugagccccagacaggugcaccugcugcuggacaugcuggccgccaucgccggccccgagaacagcagcaagaucggccuggccaacaaggacagaaagaacagacccaugcagcaggaggacgaguacagaauccagauggagcugaacagauacuaccugagaaaggacagccugagcgugggcgugagcagcgagcagagcuucuacgagaccgagaccgccagaacccccagcagcagagaggaggagguguucuucagcauggccgacauggacaugagccacagccugagcagccugcccccccugggcgacccccccaacauggaccuggagcugagccugaccagcaccuacaccaacacccccgccggcagcccccugagcgccaccgugcugcagcccaccuggggcgaguuccuggaccaccacaaggagcagcccgugagaggcagcaccuuccccagcaaccuggugcaccccaccccccugcagaagaccagccugcccagcagaagcgugagcguggacgagagcagacccgagcugaucuucagacuggccgugggcaccuucagcaucagcgugcugcacaucgacccccugagcccccccgagaccagccagaaccugaacccccugacccccauggccguggccuucuucaccugcaucgagaagaucgaccccgccagauucagcaccgaggacuucaagagcuucagagccguguucgccgaggccugcagccacgaccaccugagauucaucggcaccggcaucaaggugagcuacgagcagagacagagaagcgccagcagauacuucagcaccgacaugagcaucggccagauggaguuccuggagugccuguuccccaccgacuuccacagcgugcccccccacuacaccgagcugcugaccuuccacagcaaggaggagaccggcagccacagccccgugugccugcagcugcacuacaagcacagcgagaacagaggcccccagggcaaccaggccagacugagcagcgugccccacaaggccgagcugcagaucaagcugaaccccgugugcugcgagcuggacaucagcaucguggacagacugaacagccugcugcagccccagaagcuggccaccguggagaugauggccagccacauguacaccagcuacaacaagcacaucagccugcacaaggccuucaccgagguguuccuggacgacagccacagccccgccaacugcagaaucagcgugcagguggccacccccgcccugaaccugagcgugagauuccccauccccgaccugagaagcgaccaggagagaggccccugguucaagaagagccugcagaaggagauccuguaccuggccuucaccgaccuggaguucaagaccgaguucaucggcggcagcacccccgagcagaucaagcuggagcugaccuucagagagcugaucggcagcuuccaggaggagaagggcgaccccagcaucaaguucuuccacgugagcagcggcguggacggcgacaccaccagcagcgacgacuucgacuggcccagaaucgugcugaagaucaacccccccgccaugcacagcauccuggagagaaucgccgccgaggaggaggaggagaacgacggccacuaccaggaggaggaggagggcggcgcccacagccugaaggacgugugcgaccugagaagacccgcccccagccccuucagcagcagaagagugauguucgagaacgagcagauggugaugcccggcgaccccguggagaugaccgaguuccaggacaaggccaucagcaacagccacuacgugcuggagcugacccugcccaacaucuacgugacccugcccaacaagagcuucuacgagaagcuguacaacagaaucuucaacgaccugcugcugugggagcccaccgcccccagccccguggagaccuucgagaacaucagcuacggcaucggccugagcguggccagccagcugaucaacaccuucaacaaggacagcuucagcgccuucaagagcgccgugcacuacgacgaggagagcggcagcgaggaggagacccugcaguacuucagcaccguggaccccaacuacagaagcagaagaaagaagaagcuggacagccagaacaagaacagccagagcuuccugagcgugcugcugaacaucaaccacggccugaucgccguguucaccgacgugaagcaggacaacggcgaccugcuggagaacaagcacggcgaguucuggcuggaguucaacagcggcagccuguucugcgugaccaaguacgagggcuucgacgacaagcacuacaucugccugcacagcagcagcuucagccuguaccacaagggcaucgugaacggcgugauccugcccaccgagaccagacugcccagcagcaccagaccccacuggcuggagcccaccaucuacagcagcgaggaggacggccugagcaagaccagcagcgacggcgugggcggcgacagccugaacaugcugagcguggccgugaagauccugagcgacaagagcgagagcaacaccaaggaguuccugaucgccgugggccugaagggcgccacccugcagcacagaaugcugcccagcggccugagcuggcacgagcagauccuguacuuccugaacaucgccgacgagcccgugcugggcuacaacccccccaccagcuucaccaccuuccacgugcaccuguggagcugcgcccuggacuacagaccccuguaccugcccaucagaagccugcugaccguggagaccuucagcgugagcagcagcguggcccuggacaagagcagcagcacccugagaaucauccuggacgaggccgcccugcaccugagcgacaagugcaacaccgugaccaucaaccugagcagagacuacgugagagugauggacaugggccugcuggagcugaccaucaccgccgugaagagcgacagcgacggcgagcagaccgagcccagauucgagcugcacugcagcagcgacguggugcacaucagaaccugcagcgacagcugcgccgcccugaugaaccugauccaguacaucgccagcuacggcgaccugcagacccccaacaaggccgacaugaagcccggcgccuuccagagaagaagcaagguggacagcagcggcagaagcagcagcagaggccccgugcugcccgaggccgaccagcagaugcugagagaccugaugagcgacgccauggaggagaucgacaugcagcagggcaccagcagcgugaagccccaggccaacggcgugcuggacgagaagagccagauccaggagcccugcugcagcgaccuguuccuguuccccgacgagagcggcaacgugagccaggagagcggccccaccuacgccagcuucagccaccacuucaucagcgacgccaugaccggcgugcccaccgagaacgacgacuucugcauccuguucgcccccaaggccgccaugcaggagaaggaggaggagcccgugaucaagaucaugguggacgacgccaucgugaucagagacaacuacuucagccugcccgugaacaagaccgacaccagcaaggccccccugcacuuccccauccccgugaucagauacguggugaaggaggugagccugguguggcaccuguacggcggcaaggacuucggcaccgugccccccaccagccccgccaagagcuacaucagcccccacagcagccccagccacacccccaccagacacggcagaaacaccgugugcggcggcaagggcagaaaccacgacuuccugauggagauccagcugagcaaggugaaguuccagcacgagguguacccccccugcaagcccgacugcgacagcagccugagcgagcaccccgugagcagacagguguucaucgugcaggaccuggagaucagagacagacuggccaccagccagaugaacaaguuccuguaccuguacugcagcaaggagaugcccagaaaggcccacagcaacaugcugaccgugaaggcccugcacgugugccccgagagcggcagaagcccccaggagugcugccugagagugagccugaugccccugagacugaacaucgaccaggacgcccuguucuuccugaaggacuucuucaccagccugagcgccgagguggagcugcagaugacccccgaccccgaggugaagaagagccccggcgccgacgugaccugcagccugcccagacaccugagcaccagcaaggagcccaaccuggugaucagcuucagcggccccaagcagcccagccagaacgacagcgccaacagcguggagguggugaacggcauggaggagaagaacuucagcgccgaggaggccagcuucagagaccagcccguguucuucagagaguucagauucaccagcgaggugcccaucagacuggacuaccacggcaagcacgugagcauggaccagggcacccuggccggcauccugaucggccuggcccagcugaacugcagcgagcugaagcugaagagacugagcuacagacacggccugcugggcguggacaagcuguucagcuacgccaucaccgaguggcugaacgacaucaagaagaaccagcugcccggcauccugggcggcgugggccccaugcacagccuggugcagcuggugcagggccugaaggaccugguguggcugcccaucgagcaguacagaaaggacggcagaaucgugagaggcuuccagagaggcgccgccagcuucggcaccagcaccgccauggccgcccuggagcugaccaacagaauggugcagaccauccaggccgccgccgagaccgccuacgacauggugagccccggcacccugagcaucgagcccaagaagaccaagagauucccccaccacagacuggcccaccagcccguggaccugagagagggcguggccaaggccuacagcguggugaaggagggcaucaccgacaccgcccagaccaucuacgagaccgccgccagagagcacgagagcagaggcgugaccggcgccgugggcgaggugcugagacagaucccccccgccguggugaagccccugaucguggccaccgaggccaccagcaacgugcugggcggcaugagaaaccagaucagacccgacgugagacaggacgagagccagaaguggagacacggcgacgacuaa

SEQ ID NO: 13946 - RNA, 945 nt, Artificial Sequence
  ATG3__Homo_sapiens__NP_071933
augcagaacgugaucaacaccgugaagggcaaggcccuggagguggccgaguaccugacccccgugcugaaggagagcaaguucaaggagaccggcgugaucacccccgaggaguucguggccgccggcgaccaccuggugcaccacugccccaccuggcagugggccaccggcgaggagcugaaggugaaggccuaccugcccaccggcaagcaguuccuggugaccaagaacgugcccugcuacaagagaugcaagcagauggaguacagcgacgagcuggaggccaucaucgaggaggacgacggcgacggcggcuggguggacaccuaccacaacaccggcaucaccggcaucaccgaggccgugaaggagaucacccuggagaacaaggacaacaucagacugcaggacugcagcgcccugugcgaggaggaggaggacgaggacgagggcgaggccgccgacauggaggaguacgaggagagcggccugcuggagaccgacgaggccacccuggacaccagaaagaucguggaggccugcaaggccaagaccgacgccggcggcgaggacgccauccugcagaccagaaccuacgaccuguacaucaccuacgacaaguacuaccagacccccagacuguggcuguucggcuacgacgagcagagacagccccugaccguggagcacauguacgaggacaucagccaggaccacgugaagaagaccgugaccaucgagaaccacccccaccugccccccccccccaugugcagcgugcaccccugcagacacgccgaggugaugaagaagaucaucgagaccguggccgagggcggcggcgagcugggcgugcacauguaccugcugaucuuccugaaguucgugcaggccgugauccccaccaucgaguacgacuacaccagacacuucaccauguaa

SEQ ID NO: 13947 - RNA, 1197 nt, Artificial Sequence
  ATG4A__Homo_sapiens__NP_443168
auggagagcgugcugagcaaguacgaggaccagaucaccaucuucaccgacuaccuggaggaguaccccgacaccgacgagcugguguggauccugggcaagcagcaccugcugaagaccgagaagagcaagcugcugagcgacaucagcgccagacugugguucaccuacagaagaaaguucagccccaucggcggcaccggccccagcagcgacgccggcuggggcugcaugcugagaugcggccagaugaugcuggcccaggcccugaucugcagacaccugggcagagacuggagcugggagaagcagaaggagcagcccaaggaguaccagagaauccugcagugcuuccuggacagaaaggacugcugcuacagcauccaccagauggcccagaugggcgugggcgagggcaagagcaucggcgagugguucggccccaacaccguggcccaggugcugaagaagcuggcccuguucgacgaguggaacagccuggccguguacgugagcauggacaacaccguggugaucgaggacaucaagaagaugugcagagugcugccccugagcgccgacaccgccggcgacagaccccccgacagccugaccgccagcaaccagagcaagggcaccagcgccuacugcagcgccuggaagccccugcugcugaucgugccccugagacugggcaucaaccagaucaaccccguguacguggacgccuucaaggagugcuucaagaugccccagagccugggcgcccugggcggcaagcccaacaacgccuacuacuucaucggcuuccugggcgacgagcugaucuuccuggacccccacaccacccagaccuucguggacaccgaggagaacggcaccgugaacgaccagaccuuccacugccugcagagcccccagagaaugaacauccugaaccuggaccccagcguggcccugggcuucuucugcaaggaggagaaggacuucgacaacuggugcagccuggugcagaaggagauccugaaggagaaccugagaauguucgagcuggugcagaagcaccccagccacuggccccccuucgugccccccgccaagcccgaggugaccaccaccggcgccgaguucaucgacagcaccgagcagcuggaggaguucgaccuggaggaggacuucgagauccugagcguguaa

SEQ ID NO: 13948 - RNA, 1182 nt, Artificial Sequence
  ATG4B__Homo_sapiens__NP_037457
auggacgccgccacccugaccuacgacacccugagauucgccgaguucgaggacuuccccgagaccagcgagcccguguggauccugggcagaaaguacagcaucuucaccgagaaggacgagauccugagcgacguggccagcagacugugguucaccuacagaaagaacuuccccgccaucggcggcaccggccccaccagcgacaccggcuggggcugcaugcugagaugcggccagaugaucuucgcccaggcccuggugugcagacaccugggcagagacuggagauggacccagagaaagagacagcccgacagcuacuucagcgugcugaacgccuucaucgacagaaaggacagcuacuacagcauccaccagaucgcccagaugggcgugggcgagggcaagagcaucggccagugguacggccccaacaccguggcccaggugcugaagaagcuggccguguucgacaccuggagcagccuggccgugcacaucgccauggacaacaccguggugauggaggagaucagaagacugugcagaaccagcgugcccugcgccggcgccaccgccuuccccgccgacagcgacagacacugcaacggcuuccccgccggcgccgaggugaccaacagacccagccccuggagaccccuggugcugcugaucccccugagacugggccugaccgacaucaacgaggccuacguggagacccugaagcacugcuucaugaugccccagagccugggcgugaucggcggcaagcccaacagcgcccacuacuucaucggcuacgugggcgaggagcugaucuaccuggacccccacaccacccagcccgccguggagcccaccgacggcugcuucauccccgacgagagcuuccacugccagcacccccccugcagaaugagcaucgccgagcuggaccccagcaucgccgugggcuucuucugcaagaccgaggacgacuucaacgacuggugccagcaggugaagaagcugagccugcugggcggcgcccugcccauguucgagcugguggagcugcagcccagccaccuggccugccccgacgugcugaaccugagccuggacagcagcgacguggagagacuggagagauucuucgacagcgaggacgaggacuucgagauccugagccuguaa

SEQ ID NO: 13949 - RNA, 1272 nt, Artificial Sequence
  ATG4C__Homo_sapiens__XP_011540615
auggaggccaccggcaccgacgagguggacaagcugaagaccaaguucaucagcgccuggaacaacaugaaguacagcugggugcugaagaccaagaccuacuucagcagaaacagccccgugcugcugcugggcaagugcuaccacuucaaguacgaggacgaggacaagacccugcccgccgagagcggcugcaccaucgaggaccacgugaucgccggcaacguggaggaguucagaaaggacuucaucagcagaaucuggcugaccuacagagaggaguucccccagaucgagggcagcgcccugaccaccgacugcggcuggggcugcacccugagaaccggccagaugcugcuggcccagggccugauccugcacuuccugggcagagccuggaccuggcccgacgcccugaacaucgagaacagcgacagcgagagcuggaccagccacaccgugaagaaguucaccgccagcuucgaggccagccugagcggcgagagagaguucaagacccccaccaucagccugaaggagaccaucggcaaguacagcgacgaccacgagaugagaaacgagguguaccacagaaagaucaucagcugguucggcgacagcccccuggcccuguucggccugcaccagcugaucgaguacggcaagaagagcggcaagaaggccggcgacugguacggccccgccgugguggcccacauccugagaaaggccguggaggaggccagacaccccgaccugcagggcaucaccaucuacguggcccaggacugcaccguguacaacagcgacgugaucgacaagcagagcgccagcaugaccagcgacaacgccgacgacaaggccgugaucauccuggugcccgugagacugggcggcgagagaaccaacaccgacuaccuggaguucgugaagggcauccugagccuggaguacugcgugggcaucaucggcggcaagcccaagcagagcuacuacuucgccggcuuccaggacgacagccugaucuacauggacccccacuacugccagagcuucguggacgugagcaucaaggacuucccccuggagaccuuccacugccccagccccaagaagaugagcuucagaaagauggaccccagcugcaccaucggcuucuacugcagaaacgugcaggacuucaagagagccagcgaggagaucaccaagaaccagaucaugaucaaggccgccaucaucaacauccacgugcaggacuucauguggaccuaa

SEQ ID NO: 13950 - RNA, 828 nt, Artificial Sequence
  ATG5__Homo_sapiens__NP_001273035
augaccgacgacaaggacgugcugagagacgugugguucggcagaauccccaccugcuucacccuguaccaggacgagaucaccgagagagaggccgagcccuacuaccugcugcugcccagagugagcuaccugacccuggugaccgacaaggugaagaagcacuuccagaaggugaugagacaggaggacaucagcgagaucugguucgaguacgagggcaccccccugaaguggcacuaccccaucggccugcuguucgaccugcuggccagcagcagcgcccugcccuggaacaucaccgugcacuucaagagcuuccccgagaaggaccugcugcacugccccagcaaggacgccaucgaggcccacuucaugagcugcaugaaggaggccgacgcccugaagcacaagagccaggugaucaacgagaugcagaagaaggaccacaagcagcuguggaugggccugcagaacgacagauucgaccaguucugggccaucaacagaaagcugauggaguaccccgccgaggagaacggcuucagauacauccccuucagaaucuaccagaccaccaccgagagacccuucauccagaagcuguucagacccguggccgccgacggccagcugcacacccugggcgaccugcugaaggaggugugccccagcgccaucgaccccgaggacggcgagaagaagaaccaggugaugauccacggcaucgagcccaugcuggagaccccccugcaguggcugagcgagcaccugagcuaccccgacaacuuccugcacaucagcaucaucccccagcccaccgacuaa

SEQ ID NO: 13951 - RNA, 2031 nt, Artificial Sequence
  ATG7__Homo_sapiens__NP_001129503
auggccgccgccaccggcgaccccggccugagcaagcugcaguucgcccccuucagcagcgcccuggacgugggcuucuggcacgagcugacccagaagaagcugaacgaguacagacuggacgaggcccccaaggacaucaagggcuacuacuacaacggcgacagcgccggccugcccgccagacugacccuggaguucagcgccuucgacaugagcgcccccacccccgccagaugcugccccgccaucggcacccuguacaacaccaacacccuggagagcuucaagaccgccgacaagaagcugcugcuggagcaggccgccaacgagaucugggagagcaucaagagcggcaccgcccuggagaaccccgugcugcugaacaaguuccugcugcugaccuucgccgaccugaagaaguaccacuucuacuacugguucugcuaccccgcccugugccugcccgagagccugccccugauccagggccccgugggccuggaccagagauucagccugaagcagaucgaggcccuggagugcgccuacgacaaccugugccagaccgagggcgugaccgcccugcccuacuuccugaucaaguacgacgagaacauggugcuggugagccugcugaagcacuacagcgacuucuuccagggccagagaaccaagaucaccaucggcguguacgaccccugcaaccuggcccaguaccccggcuggccccugagaaacuuccuggugcuggccgcccacagauggagcagcagcuuccagagcguggagguggugugcuucagagacagaaccaugcagggcgccagagacguggcccacagcaucaucuucgaggugaagcugcccgagauggccuucagccccgacugccccaaggccgugggcugggagaagaaccagaagggcggcaugggccccagaauggugaaccugagcgagugcauggaccccaagagacuggccgagagcagcguggaccugaaccugaagcugaugugcuggagacuggugcccacccuggaccuggacaagguggugagcgugaagugccugcugcugggcgccggcacccugggcugcaacguggccagaacccugaugggcuggggcgugagacacaucaccuucguggacaacgccaagaucagcuacagcaaccccgugagacagccccuguacgaguucgaggacugccugggcggcggcaagcccaaggcccuggccgccgccgacagacugcagaagaucuuccccggcgugaacgccagaggcuucaacaugagcauccccaugcccggccaccccgugaacuucagcagcgugacccuggagcaggccagaagagacguggagcagcuggagcagcugaucgagagccacgacgugguguuccugcugauggacaccagagagagcagauggcugcccgccgugaucgccgccagcaagagaaagcuggugaucaacgccgcccugggcuucgacaccuucguggugaugagacacggccugaagaagcccaagcagcagggcgccggcgaccugugccccaaccaccccguggccagcgccgaccugcugggcagcagccuguucgccaacauccccggcuacaagcugggcugcuacuucugcaacgacgugguggcccccggcgacagcaccagagacagaacccuggaccagcagugcaccgugagcagacccggccuggccgugaucgccggcgcccuggccguggagcugauggugagcgugcugcagcaccccgagggcggcuacgccaucgccagcagcagcgacgacagaaugaacgagccccccaccagccugggccuggugccccaccaggugcuggaccaguacgagagagagggcuucaacuuccuggccaagguguucaacagcagccacagcuuccuggaggaccugaccggccugacccugcugcaccaggagacccaggccgccgagaucugggacaugagcgacgacgagaccaucuaa

SEQ ID NO: 13952 - RNA, 2520 nt, Artificial Sequence
  ATG9A__Homo_sapiens__NP_001070666
auggcccaguucgacaccgaguaccagagacuggaggccagcuacagcgacagcccccccggcgaggaggaccugcuggugcacguggccgagggcagcaagagccccuggcaccacaucgagaaccuggaccuguucuucagcagaguguacaaccugcaccagaagaacggcuucaccugcaugcugaucggcgagaucuucgagcugaugcaguuccuguucgugguggccuucaccaccuuccuggugagcugcguggacuacgacauccuguucgccaacaagauggugaaccacagccugcaccccaccgagcccgugaaggugacccugcccgacgccuuccugcccgcccaggugugcagcgccagaauccaggagaacggcagccugaucaccauccuggugaucgccggcguguucuggauccacagacugaucaaguucaucuacaacaucugcugcuacugggagauccacagcuucuaccugcacgcccugagaauccccaugagcgcccugcccuacugcaccuggcaggaggugcaggccagaaucgugcagacccagaaggagcaccagaucugcauccacaagagagagcugaccgagcuggacaucuaccacagaauccugagauuccagaacuacaugguggcccuggugaacaagagccugcugccccugagauucagacugcccggccugggcgaggccguguucuucaccagaggccugaaguacaacuucgagcugauccuguucuggggccccggcagccuguuccugaacgaguggagccugaaggccgaguacaagagaggcggccagagacuggagcuggcccagagacugagcaacagaauccuguggaucggcaucgccaacuuccugcugugcccccugauccugaucuggcagauccuguacgccuucuucagcuacgccgaggugcugaagagagagcccggcgcccugggcgccagaugcuggagccuguacggcagaugcuaccugagacacuucaacgagcuggagcacgagcugcagagcagacugaacagaggcuacaagcccgccagcaaguacaugaacugcuuccugagcccccugcugacccugcuggccaagaacggcgccuucuucgccggcagcauccuggccgugcugaucgcccugaccaucuacgacgaggacgugcuggccguggagcacgugcugaccaccgugacccugcugggcgugaccgugaccgugugcagaagcuucauccccgaccagcacaugguguucugccccgagcagcugcugagagugauccuggcccacauccacuacaugcccgaccacuggcagggcaacgcccacagaagccagaccagagacgaguucgcccagcuguuccaguacaaggccguguucauccuggaggagcugcugagccccaucgugaccccccugauccugaucuucugccugagacccagagcccuggagaucaucgacuucuucagaaacuucaccguggagguggugggcgugggcgacaccugcagcuucgcccagauggacgugagacagcacggccacccccaguggcugagcgccggccagaccgaggccagcguguaccagcaggccgaggacggcaagaccgagcugagccugaugcacuucgccaucaccaaccccggcuggcagccccccagagagagcaccgccuuccugggcuuccugaaggagcaggugcagagagacggcgccgccgccagccuggcccagggcggccugcugcccgagaacgcccuguucaccagcauccagagccugcagagcgagagcgagccccugagccugaucgccaacgugguggccggcagcagcugcagaggccccccccugcccagagaccugcagggcagcagacacagagccgagguggccagcgcccugagaagcuucagcccccugcagcccggccaggcccccaccggcagagcccacagcaccaugaccggcagcggcguggacgccagaaccgccagcagcggcagcagcgugugggagggccagcugcagagccuggugcugagcgaguacgccagcaccgagaugagccugcacgcccuguacaugcaccagcugcacaagcagcaggcccaggccgagcccgagagacacguguggcacagaagagagagcgacgagagcggcgagagcgcccccgacgagggcggcgagggcgccagagccccccagagcauccccagaagcgccagcuaccccugcgccgcccccagacccggcgcccccgagaccaccgcccugcacggcggcuuccagagaagauacggcggcaucaccgaccccggcaccgugcccagagugcccagccacuucagcagacugccccugggcggcugggccgaggacggccagagcgccagcagacaccccgagcccgugcccgaggagggcagcgaggacgagcugcccccccaggugcacaagguguaa

SEQ ID NO: 13953 - RNA, 1779 nt, Artificial Sequence
  ATIC__Homo_sapiens__NP_004035
auggcccccggccagcuggcccuguucagcgugagcgacaagaccggccugguggaguucgccagaaaccugaccgcccugggccugaaccugguggccagcggcggcaccgccaaggcccugagagacgccggccuggccgugagagacgugagcgagcugaccggcuuccccgagaugcugggcggcagagugaagacccugcaccccgccgugcacgccggcauccuggccagaaacauccccgaggacaacgccgacauggccagacuggacuucaaccugaucagagugguggccugcaaccuguaccccuucgugaagaccguggccagccccggcgugaccguggaggaggccguggagcagaucgacaucggcggcgugacccugcugagagccgccgccaagaaccacgccagagugaccguggugugcgagcccgaggacuacgugguggugagcaccgagaugcagagcagcgagagcaaggacaccagccuggagaccagaagacagcuggcccugaaggccuucacccacaccgcccaguacgacgaggccaucagcgacuacuucagaaagcaguacagcaagggcgugagccagaugccccugagauacggcaugaacccccaccagacccccgcccagcuguacacccugcagcccaagcugcccaucaccgugcugaacggcgcccccggcuucaucaaccugugcgacgcccugaacgccuggcagcuggugaaggagcugaaggaggcccugggcauccccgccgccgccagcuucaagcacgugagccccgccggcgccgccgugggcaucccccugagcgaggacgaggccaaggugugcaugguguacgaccuguacaagacccugacccccaucagcgccgccuacgccagagccagaggcgccgacagaaugagcagcuucggcgacuucguggcccugagcgacgugugcgacgugcccaccgccaagaucaucagcagagaggugagcgacggcaucaucgcccccggcuacgaggaggaggcccugaccauccugagcaagaagaagaacggcaacuacugcgugcugcagauggaccagagcuacaagcccgacgagaacgaggugagaacccuguucggccugcaccugagccagaagagaaacaacggcgugguggacaagagccuguucagcaacguggugaccaagaacaaggaccugcccgagagcgcccugagagaccugaucguggccaccaucgccgugaaguacacccagagcaacagcgugugcuacgccaagaacggccaggugaucggcaucggcgccggccagcagagcagaauccacugcaccagacuggccggcgacaaggccaacuacugguggcugagacaccacccccaggugcugagcaugaaguucaagaccggcgugaagagagccgagaucagcaacgccaucgaccaguacgugaccggcaccaucggcgaggacgaggaccugaucaaguggaaggcccuguucgaggaggugcccgagcugcugaccgaggccgagaagaaggaguggguggagaagcugaccgaggugagcaucagcagcgacgccuucuuccccuucagagacaacguggacagagccaagagaagcggcguggccuacaucgccgcccccagcggcagcgccgccgacaagguggugaucgaggccugcgacgagcugggcaucauccuggcccacaccaaccugagacuguuccaccacuaa

SEQ ID NO: 13954 - RNA, 1662 nt, Artificial Sequence
  ATL1__Homo_sapiens__NP_001121185
auggccaagaacagaagagacagaaacagcuggggcggcuucagcgagaagaccuacgaguggagcagcgaggaggaggagcccgugaagaaggccggccccgugcaggugcugaucgugaaggacgaccacagcuucgagcuggacgagaccgcccugaacagaauccugcugagcgaggccgugagagacaaggaggugguggccgugagcguggccggcgccuucagaaagggcaagagcuuccugauggacuucaugcugagauacauguacaaccaggagagcguggacugggugggcgacuacaacgagccccugaccggcuucagcuggagaggcggcagcgagagagagaccaccggcauccagaucuggagcgagaucuuccugaucaacaagcccgacggcaagaagguggccgugcugcugauggacacccagggcaccuucgacagccagagcacccugagagacagcgccaccguguucgcccugagcaccaugaucagcagcauccagguguacaaccugagccagaacgugcaggaggacgaccugcagcaccugcagcuguucaccgaguacggcagacuggccauggaggagaccuuccugaagcccuuccagagccugaucuuccuggugagagacuggagcuuccccuacgaguucagcuacggcgccgacggcggcgccaaguuccuggagaagagacugaaggugagcggcaaccagcacgaggagcugcagaacgugagaaagcacauccacagcugcuucaccaacaucagcugcuuccugcugccccaccccggccugaagguggccaccaaccccaacuucgacggcaagcugaaggagaucgacgacgaguucaucaagaaccugaagauccugauccccuggcugcugagccccgagagccuggacaucaaggagaucaacggcaacaagaucaccugcagaggccugguggaguacuucaaggccuacaucaagaucuaccagggcgaggagcugccccaccccaagagcaugcugcaggccaccgccgaggccaacaaccuggccgccguggccaccgccaaggacaccuacaacaagaagauggaggagaucugcggcggcgacaagcccuuccuggcccccaacgaccugcagaccaagcaccugcagcugaaggaggagagcgugaagcuguucagaggcgugaagaagaugggcggcgaggaguucagcagaagauaccugcagcagcuggagagcgagaucgacgagcuguacauccaguacaucaagcacaacgacagcaagaacaucuuccacgccgccagaacccccgccacccuguucguggugaucuucaucaccuacgugaucgccggcgugaccggcuucaucggccuggacaucaucgccagccugugcaacaugaucaugggccugacccugaucacccugugcaccugggccuacaucagauacagcggcgaguacagagagcugggcgccgugaucgaccagguggccgccgcccugugggaccaggcccuguacaagcuguacagcgccgccgccacccacagacaccuguaccaccaggccuuccccacccccaagagcgagagcaccgagcagagcgagaagaagaagauguaa

SEQ ID NO: 13955 - RNA, 1752 nt, Artificial Sequence
  ATL2__Homo_sapiens__NP_001129145
auggccgagggcgacgaggccgccagaggccagcagccccaccagggccuguggagaagaagaagaaccagcgaccccagcgccgccgugaaccacgugagcagcaccaccagccugggcgagaacuacgaggacgacgaccuggugaacagcgacgaggugaugaagaagcccugccccgugcagaucgugcuggcccacgaggacgaccacaacuucgagcuggacgaggaggcccuggagcagauccugcugcaggagcacaucagagaccugaacaucgugguggugagcguggccggcgccuucagaaagggcaagagcuuccugcuggacuucaugcugagauacauguacaacaaggacagccagagcuggaucggcggcaacaacgagccccugaccggcuucaccuggagaggcggcugcgagagagagaccaccggcauccagguguggaacgagguguucgugaucgacagacccaacggcaccaagguggccgugcugcugauggacacccagggcgccuucgacagccagagcaccaucaaggacugcgccaccguguucgcccugagcaccaugaccagcagcgugcagguguacaaccugagccagaacauccaggaggacgaccugcagcaccugcagcuguucaccgaguacggcagacuggccauggaggagaucuaccagaagcccuuccagacccugauguuccugaucagagacuggagcuaccccuacgagcacagcuacggccuggagggcggcaagcaguuccuggagaagagacugcaggugaagcagaaccagcacgaggagcugcagaacgugagaaagcacauccacaacugcuucagcaaccugggcugcuuccugcugccccaccccggccugaagguggccaccaaccccagcuucgacggcagacugaaggacaucgacgaggacuucaagagagagcugagaaaccuggugccccugcugcuggcccccgagaaccugguggagaaggagaucagcggcagcaaggugaccugcagagaccugguggaguacuucaaggccuacaucaagaucuaccagggcgaggagcugccccaccccaagagcaugcugcaggccaccgccgaggccaacaaccuggccgccguggccggcgccagagacaccuacugcaagagcauggagcaggugugcggcggcgacaagcccuacaucgcccccagcgaccuggagagaaagcaccuggaccugaaggagguggccaucaagcaguucagaagcgugaagaagaugggcggcgacgaguucugcagaagauaccaggaccagcuggaggccgagaucgaggagaccuacgccaacuucaucaagcacaacgacggcaagaacaucuucuacgccgccagaacccccgccacccuguucgccgugauguucgccauguacaucaucagcggccugaccggcuucaucggccugaacagcaucgccgugcugugcaaccuggugaugggccuggcccugaucuuccugugcaccugggccuacgugaaguacagcggcgaguucagagagaucggcaccgugaucgaccagaucgccgagacccugugggagcaggugcugaagccccugggcgacaaccugauggaggagaacaucagacagagcgugaccaacagcaucaaggccggccugaccgaccaggugagccaccacgccagacugaagaccgacuaa

SEQ ID NO: 13956 - RNA, 1572 nt, Artificial Sequence
  ATL3__Homo_sapiens__NP_001276977
auggagagcagcaagcccggccccgugcagguggugcuggugcagaaggaccagcacagcuucgagcuggacgagaaggcccuggccagcauccugcugcaggaccacaucagagaccuggacguggugguggugagcguggccggcgccuucagaaagggcaagagcuucauccuggacuucaugcugagauaccuguacagccagaaggagagcggccacagcaacuggcugggcgaccccgaggagccccugaccggcuucagcuggagaggcggcagcgaccccgagaccaccggcauccagaucuggagcgagguguucaccguggagaagcccggcggcaagaagguggccguggugcugauggacacccagggcgccuucgacagccagagcaccgugaaggacugcgccaccaucuucgcccugagcaccaugaccagcagcgugcagaucuacaaccugagccagaacauccaggaggacgaccugcagcagcugcagcuguucaccgaguacggcagacuggccauggacgagaucuuccagaagcccuuccagacccugauguuccuggugagagacuggagcuuccccuacgaguacagcuacggccugcagggcggcauggccuuccuggacaagagacugcaggugaaggagcaccagcacgaggagauccagaacgugagaaaccacauccacagcugcuucagcgacgugaccugcuuccugcugccccaccccggccugcagguggccaccagccccgacuucgacggcaagcugaaggacaucgccggcgaguucaaggagcagcugcaggcccugauccccuacgugcugaaccccagcaagcugauggagaaggagaucaacggcagcaaggugaccugcagaggccugcuggaguacuucaaggccuacaucaagaucuaccagggcgaggaccugccccaccccaagagcaugcugcaggccaccgccgaggccaacaaccuggccgccgccgccagcgccaaggacaucuacuacaacaacauggaggaggugugcggcggcgagaagcccuaccugagccccgacauccuggaggagaagcacugcgaguucaagcagcuggcccuggaccacuucaagaagaccaagaagaugggcggcaaggacuucagcuucagauaccagcaggagcuggaggaggagaucaaggagcuguacgagaacuucugcaagcacaacggcagcaagaacguguucagcaccuucagaacccccgccgugcuguucaccggcaucguggcccuguacaucgccagcggccugaccggcuucaucggccuggaggugguggcccagcuguucaacugcauggugggccugcugcugaucgcccugcugaccuggggcuacaucagauacagcggccaguacagagagcugggcggcgccaucgacuucggcgccgccuacgugcuggagcaggccagcagccacaucggcaacagcacccaggccaccgugagagacgccguggugggcagacccagcauggacaagaaggcccaguaa

SEQ ID NO: 13957 - RNA, 9171 nt, Artificial Sequence
  ATM__Homo_sapiens__XP_006718906
augagccuggugcugaacgaccugcugaucugcugcagacagcuggagcacgacagagccaccgagagaaagaaggagguggagaaguucaagagacugaucagagaccccgagaccaucaagcaccuggacagacacagcgacagcaagcagggcaaguaccugaacugggacgccguguucagauuccugcagaaguacauccagaaggagaccgagugccugagaaucgccaagcccaacgugagcgccagcacccaggccagcagacagaagaagaugcaggagaucagcagccuggugaaguacuucaucaagugcgccaacagaagagcccccagacugaagugccaggagcugcugaacuacaucauggacaccgugaaggacagcagcaacggcgccaucuacggcgccgacugcagcaacauccugcugaaggacauccugagcgugagaaaguacuggugcgagaucagccagcagcaguggcuggagcuguucagcguguacuucagacuguaccugaagcccagccaggacgugcacagagugcugguggccagaaucauccacgccgugaccaagggcugcugcagccagaccgacggccugaacagcaaguuccuggacuucuucagcaaggccauccagugcgccagacaggagaagagcagcagcggccugaaccacauccuggccgcccugaccaucuuccugaagacccuggccgugaacuucagaaucagagugugcgagcugggcgacgagauccugcccacccugcuguacaucuggacccagcacagacugaacgacagccugaaggaggugaucaucgagcuguuccagcugcagaucuacauccaccaccccaagggcgccaagacccaggagaagggcgccuacgagagcaccaaguggagaagcauccuguacaaccuguacgaccugcuggugaacgagaucagccacaucggcagcagaggcaaguacagcagcggcuucagaaacaucgccgugaaggagaaccugaucgagcugauggccgacaucugccaccagguguucaacgaggacaccagaagccuggagaucagccagagcuacaccaccacccagagagagagcagcgacuacagcgugcccugcaagagaaagaagaucgagcugggcugggaggugaucaaggaccaccugcagaagagccagaacgacuucgaccuggugcccuggcugcagaucgccacccagcugaucagcaaguaccccgccagccugcccaacugcgagcugagcccccugcugaugauccugagccagcugcugccccagcagagacacggcgagagaacccccuacgugcugagaugccugaccgagguggcccugugccaggacaagagaagcaaccuggagagcagccagaagagcgaccugcugaagcuguggaacaagaucuggugcaucaccuucagaggcaucagcagcgagcagauccaggccgagaacuucggccugcugggcgccaucauccagggcagccugguggagguggacagagaguucuggaagcuguucaccggcagcgccugcagacccagcugccccgccgugugcugccugacccuggcccugaccaccagcaucgugcccggcaccgugaagaugggcaucgagcagaacaugugcgaggugaacagaagcuucagccugaaggagagcaucaugaaguggcugcuguucuaccagcuggagggcgaccuggagaacagcaccgaggugccccccauccugcacagcaacuucccccaccuggugcuggagaagauccuggugagccugaccaugaagaacugcaaggccgccaugaacuucuuccagagcgugcccgagugcgagcaccaccagaaggacaaggaggagcugagcuucagcgagguggaggagcuguuccugcagaccaccuucgacaagauggacuuccugaccaucgugagagagugcggcaucgagaagcaccagagcagcaucggcuucagcgugcaccagaaccugaaggagagccuggacagaugccugcugggccugagcgagcagcugcugaacaacuacagcagcgagaucaccaacagcgagacccuggugagaugcagcagacugcuggugggcgugcugggcugcuacugcuacaugggcgugaucgccgaggaggaggccuacaagagcgagcuguuccagaaggccaagagccugaugcagugcgccggcgagagcaucacccuguucaagaacaagaccaacgaggaguucagaaucggcagccugagaaacaugaugcagcugugcaccagaugccugagcaacugcaccaagaagagccccaacaagaucgccagcggcuucuuccugagacugcugaccagcaagcugaugaacgacaucgccgacaucugcaagagccuggccagcuucaucaagaagcccuucgacagaggcgagguggagagcauggaggacgacaccaacggcaaccugauggagguggaggaccagagcagcaugaaccuguucaacgacuaccccgacagcagcgugagcgacgccaacgagcccggcgagagccagagcaccaucggcgccaucaacccccuggccgaggaguaccugagcaagcaggaccugcuguuccuggacaugcugaaguuccugugccugugcgugaccaccgcccagaccaacaccgugagcuucagagccgccgacaucagaagaaagcugcugaugcugaucgacagcagcacccuggagcccaccaagagccugcaccugcacauguaccugaugcugcugaaggagcugcccggcgaggaguacccccugcccauggaggacgugcuggagcugcugaagccccugagcaacgugugcagccuguacagaagagaccaggacgugugcaagaccauccugaaccacgugcugcacguggugaagaaccugggccagagcaacauggacagcgagaacaccagagacgcccagggccaguuccugaccgugaucggcgccuucuggcaccugaccaaggagagaaaguacaucuucagcgugagaauggcccuggugaacugccugaagacccugcuggaggccgaccccuacagcaagugggccauccugaacgugaugggcaaggacuuccccgugaacgagguguucacccaguuccuggccgacaaccaccaccaggugagaaugcuggccgccgagagcaucaacagacuguuccaggacaccaagggcgacagcagcagacugcugaaggcccugccccugaagcugcagcagaccgccuucgagaacgccuaccugaaggcccaggagggcaugagagagaugagccacagcgccgagaaccccgagacccuggacgagaucuacaacagaaagagcgugcugcugacccugaucgccguggugcugagcugcagccccaucugcgagaagcaggcccuguucgcccugugcaagagcgugaaggagaacggccuggagccccaccuggugaagaaggugcuggagaaggugagcgagaccuucggcuacagaagacuggaggacuucauggccagccaccuggacuaccuggugcuggaguggcugaaccugcaggacaccgaguacaaccugagcagcuuccccuucauccugcugaacuacaccaacaucgaggacuucuacagaagcugcuacaaggugcugaucccccaccuggugaucagaagccacuucgacgaggugaagagcaucgccaaccagauccaggaggacuggaagagccugcugaccgacugcuuccccaagauccuggugaacauccugcccuacuucgccuacgagggcaccagagacagcggcauggcccagcagagagagaccgccaccaagguguacgacaugcugaagagcgagaaccugcugggcaagcagaucgaccaccuguucaucagcaaccugcccgagaucgugguggagcugcugaugacccugcacgagcccgccaacagcagcgccagccagagcaccgaccugugcgacuucagcggcgaccuggaccccgcccccaaccccccccacuuccccagccacgugaucaaggccaccuucgccuacaucagcaacugccacaagaccaagcugaagagcauccuggagauccugagcaagagccccgacagcuaccagaagauccugcuggccaucugcgagcaggccgccgagaccaacaacguguacaagaagcacagaauccugaagaucuaccaccuguucgugagccugcugcugaaggacaucaagagcggccugggcggcgccugggccuucgugcugagagacgugaucuacacccugauccacuacaucaaccagagacccagcugcaucauggacgugagccugagaagcuucagccugugcugcgaccugcugagccaggugugccagaccgccgugaccuacugcaaggacgcccuggagaaccaccugcacgugaucgugggcacccugaucccccugguguacgagcagguggaggugcagaagcaggugcuggaccugcugaaguaccuggugaucgacaacaaggacaacgagaaccuguacaucaccaucaagcugcuggaccccuuccccgaccacgugguguucaaggaccugagaaucacccagcagaagaucaaguacagcagaggccccuucagccugcuggaggagaucaaccacuuccugagcgugagcguguacgacgcccugccccugaccagacuggagggccugaaggaccugagaagacagcuggagcugcacaaggaccagaugguggacaucaugagagccagccaggacaacccccaggacggcaucauggugaagcugguggugaaccugcugcagcugagcaagauggccaucaaccacaccggcgagaaggaggugcuggaggccgugggcagcugccugggcgaggugggccccaucgacuucagcaccaucgccauccagcacagcaaggacgccagcuacaccaaggcccugaagcuguucgaggacaaggagcugcaguggaccuucaucaugcugaccuaccugaacaacacccugguggaggacugcgugaaggugagaagcgccgccgugaccugccugaagaacauccuggccaccaagaccggccacagcuucugggagaucuacaagaugaccaccgaccccaugcuggccuaccugcagcccuucagaaccagcagaaagaaguuccuggaggugcccagauucgacaaggagaaccccuucgagggccuggacgacaucaaccuguggaucccccugagcgagaaccacgacaucuggaucaagacccugaccugcgccuuccuggacagcggcggcaccaagugcgagauccugcagcugcugaagcccaugugcgaggugaagaccgacuucugccagaccgugcugcccuaccugauccacgacauccugcugcaggacaccaacgagagcuggagaaaccugcugagcacccacgugcagggcuucuucaccagcugccugagacacuucagccagaccagcagaagcaccacccccgccaaccuggacagcgagagcgagcacuucuucagaugcugccuggacaagaagagccagagaaccaugcuggccgugguggacuacaugagaagacagaagagacccagcagcggcaccaucuucaacgacgccuucuggcuggaccugaacuaccuggagguggccaagguggcccagagcugcgccgcccacuucaccgcccugcuguacgccgagaucuacgccgacaagaagagcauggacgaccaggagaagagaagccuggccuucgaggagggcagccagagcaccaccaucagcagccugagcgagaagagcaaggaggagaccggcaucagccugcaggaccugcugcuggagaucuacagaagcaucggcgagcccgacagccuguacggcugcggcggcggcaagaugcugcagcccaucaccagacugagaaccuacgagcacgaggccauguggggcaaggcccuggugaccuacgaccuggagaccgccauccccagcagcaccagacaggccggcaucauccaggcccugcagaaccugggccugugccacauccugagcguguaccugaagggccuggacuacgagaacaaggacuggugccccgagcuggaggagcugcacuaccaggccgccuggagaaacaugcagugggaccacugcaccagcgugagcaaggagguggagggcaccagcuaccacgagagccuguacaacgcccugcagagccugagagacagagaguucagcaccuucuacgagagccugaaguacgccagagugaaggagguggaggagaugugcaagagaagccuggagagcguguacagccuguaccccacccugagcagacugcaggccaucggcgagcuggagagcaucggcgagcuguucagcagaagcgugacccacagacagcugagcgagguguacaucaaguggcagaagcacagccagcugcugaaggacagcgacuucagcuuccaggagcccaucauggcccugagaaccgugauccuggagauccugauggagaaggagauggacaacagccagagagagugcaucaaggacauccugaccaagcaccugguggagcugagcauccuggccagaaccuucaagaacacccagcugcccgagagagccaucuuccagaucaagcaguacaacagcgugagcugcggcgugagcgaguggcagcuggaggaggcccagguguucugggccaagaaggagcagagccuggcccugagcauccugaagcagaugaucaagaagcuggacgccagcugcgccgccaacaaccccagccugaagcugaccuacaccgagugccugagagugugcggcaacuggcuggccgagaccugccuggagaaccccgccgugaucaugcagaccuaccuggagaaggccguggagguggccggcaacuacgacggcgagagcagcgacgagcugagaaacggcaagaugaaggccuuccugagccuggccagauucagcgacacccaguaccagagaaucgagaacuacaugaagagcagcgaguucgagaacaagcaggcccugcugaagagagccaaggaggaggugggccugcugagagagcacaagauccagaccaacagauacaccgugaaggugcagagagagcuggagcuggacgagcuggcccugagagcccugaaggaggacagaaagagauuccugugcaaggccguggagaacuacaucaacugccugcugagcggcgaggagcacgacauguggguguucagacugugcagccuguggcuggagaacagcggcgugagcgaggugaacggcaugaugaagagagacggcaugaagauccccaccuacaaguuccugccccugauguaccagcuggccgccagaaugggcaccaagaugaugggcggccugggcuuccacgaggugcugaacaaccugaucagcagaaucagcauggaccacccccaccacacccuguucaucauccuggcccuggccaacgccaacagagacgaguuccugaccaagcccgagguggccagaagaagcagaaucaccaagaacgugcccaagcagagcagccagcuggacgaggacagaaccgaggccgccaacagaaucaucugcaccaucagaagcagaagaccccagauggugagaagcguggaggcccugugcgacgccuacaucauccuggccaaccuggacgccacccaguggaagacccagagaaagggcaucaacauccccgccgaccagcccaucaccaagcugaagaaccuggaggacgugguggugcccaccauggagaucaagguggaccacaccggcgaguacggcaaccuggugaccauccagagcuucaaggccgaguucagacuggccggcggcgugaaccugcccaagaucaucgacugcgugggcagcgacggcaaggagagaagacagcuggugaagggcagagacgaccugagacaggacgccgugaugcagcagguguuccagaugugcaacacccugcugcagagaaacaccgagaccagaaagagaaagcugaccaucugcaccuacaagguggugccccugagccagagaagcggcgugcuggaguggugcaccggcaccgugcccaucggcgaguuccuggugaacaacgaggacggcgcccacaagagauacagacccaacgacuucagcgccuuccagugccagaagaagaugauggaggugcagaagaagagcuucgaggagaaguacgagguguucauggacgugugccagaacuuccagcccguguucagauacuucugcauggagaaguuccuggaccccgccaucugguucgagaagagacuggccuacaccagaagcguggccaccagcagcaucgugggcuacauccugggccugggcgacagacacgugcagaacauccugaucaacgagcagagcgccgagcuggugcacaucgaccugggcguggccuucgagcagggcaagauccugcccacccccgagaccgugcccuucagacugaccagagacaucguggacggcaugggcaucaccggcguggagggcguguucagaagaugcugcgagaagaccauggaggugaugagaaacagccaggagacccugcugaccaucguggaggugcugcuguacgacccccuguucgacuggaccaugaacccccugaaggcccuguaccugcagcagagacccgaggacgagaccgagcugcaccccacccugaacgccgacgaccaggagugcaagagaaaccugagcgacaucgaccagagcuucaacaagguggccgagagagugcugaugagacugcaggagaagcugaagggcguggaggagggcaccgugcugagcgugggcggccaggugaaccugcugauccagcaggccaucgaccccaagaaccugagcagacuguuccccggcuggaaggccuggguguaa

SEQ ID NO: 13958 - RNA, 3573 nt, Artificial Sequence
  ATN1__Homo_sapiens__NP_001007027
augaagaccagacagaacaaggacagcaugagcaugagaagcggcagaaagaaggaggcccccggccccagagaggagcugagaagcagaggcagagccagccccggcggcgugagcaccagcagcagcgacggcaaggccgagaagagcagacagaccgccaagaaggccagaguggaggaggccagcacccccaaggugaacaagcagggcagaagcgaggagaucagcgagagcgagagcgaggagaccaacgcccccaagaagaccaagaccgagcaggagcugcccagaccccagagccccagcgaccuggacagccuggacggcagaagccugaacgacgacggcagcagcgaccccagagacaucgaccaggacaacagaagcaccagccccagcaucuacagccccggcagcguggagaacgacagcgacagcagcagcggccugagccagggccccgccagacccuaccacccccccccccuguucccccccagcccccagccccccgacagcacccccagacagcccgaggccagcuucgagccccaccccagcgugacccccaccggcuaccacgcccccauggagccccccaccagcagaauguuccaggccccccccggcgccccccccccccacccccagcuguaccccggcggcaccggcggcgugcugagcggcccccccaugggccccaagggcggcggcgccgccagcagcgugggcggccccaacggcggcaagcagcaccccccccccaccacccccaucagcgugagcagcagcggcgccagcggcgccccccccaccaagccccccaccacccccgugggcggcggcaaccugcccagcgcccccccccccgccaacuucccccacgugacccccaaccugccccccccccccgcccugagaccccugaacaacgccagcgccagcccccccggccugggcgcccagccccugcccggccaccugcccagcccccacgccaugggccagggcaugggcggccugccccccggccccgagaagggccccacccuggcccccagcccccacagccugccccccgccagcagcagcgcccccgccccccccaugagauuccccuacagcagcagcagcagcagcagcgccgccgccagcagcagcagcagcagcagcagcagcagcgccagccccuuccccgccagccaggcccugcccagcuacccccacagcuuccccccccccaccagccugagcgugagcaaccagccccccaaguacacccagcccagccugcccagccaggccguguggagccagggcccccccccccccccccccuacggcagacugcuggccaacagcaacgcccaccccggccccuucccccccagcaccggcgcccagagcaccgcccacccccccgugagcacccaccaccaccaccaccagcagcagcagcagcagcagcagcagcagcagcagcagcagcagcagcagcagcagcaccacggcaacagcggcccccccccccccggcgccuucccccacccccuggagggcggcagcagccaccacgcccaccccuacgccaugagccccagccugggcagccugagacccuacccccccggccccgcccaccugccccccccccacagccaggugagcuacagccaggccggccccaacggcccccccgugagcagcagcagcaacagcagcagcagcaccagccagggcagcuaccccugcagccaccccagccccagccagggcccccagggcgcccccuaccccuucccccccgugcccaccgugaccaccagcagcgccacccugagcaccgugaucgccaccguggccagcagccccgccggcuacaagaccgccagcccccccggccccccccccuacggcaagagagcccccagccccggcgccuacaagaccgccaccccccccggcuacaagcccggcagcccccccagcuucagaaccggcaccccccccggcuacagaggcaccagcccccccgccggccccggcaccuucaagcccggcagccccaccgugggccccggcccccugccccccgccggccccagcggccugcccagccugccccccccccccgccgcccccgccagcggccccccccugagcgccacccagaucaagcaggagcccgccgaggaguacgagacccccgagagccccgugccccccgccagaagccccagccccccccccaaggugguggacgugcccagccacgccagccagagcgccagauucaacaagcaccuggacagaggcuucaacagcugcgccagaagcgaccuguacuucgugccccuggagggcagcaagcuggccaagaagagagccgaccugguggagaaggugagaagagaggccgagcagagagccagagaggagaaggagagagagagagagagagagagagagaaggagagagagagagagaaggagagagagcuggagagaagcgugaagcuggcccaggagggcagagcccccguggagugccccagccugggccccgugccccacagaccccccuucgagcccggcagcgccguggccaccgugccccccuaccugggccccgacacccccgcccugagaacccugagcgaguacgccagaccccacgugaugagccccggcaacagaaaccaccccuucuacgugccccugggcgccguggaccccggccugcugggcuacaacgugcccgcccuguacagcagcgaccccgccgccagagagagagagagagaggccagagagagagaccugagagacagacugaagcccggcuucgaggugaagcccagcgagcuggagccccugcacggcgugcccggccccggccuggaccccuuccccagacacggcggccuggcccugcagcccggcccccccggccugcaccccuuccccuuccaccccagccugggcccccuggagagagagagacuggcccuggccgccggccccgcccugagacccgacaugagcuacgccgagagacuggccgccgagagacagcacgccgagagaguggccgcccugggcaacgacccccuggccagacugcagaugcugaacgugaccccccaccaccaccagcacagccacauccacagccaccugcaccugcaccagcaggacgccauccacgccgccagcgccagcgugcacccccugaucgacccccuggccagcggcagccaccugaccagaauccccuaccccgccggcacccugcccaacccccugcugccccacccccugcacgagaacgaggugcugagacaccagcuguucgccgcccccuacagagaccugcccgccagccugagcgcccccaugagcgccgcccaccagcugcaggccaugcacgcccagagcgccgagcugcagagacuggcccuggagcagcagcaguggcugcacgcccaccacccccugcacagcgugccccugcccgcccaggaggacuacuacagccaccugaagaaggagagcgacaagccccuguaa

SEQ ID NO: 13959 - RNA, 1065 nt, Artificial Sequence
  ATOH1__Homo_sapiens__NP_005163
augagcagacugcugcacgccgaggagugggccgaggugaaggagcugggcgaccaccacagacagccccagccccaccaccugccccagccccccccccccccccagccccccgccacccugcaggccagagagcaccccguguacccccccgagcugagccugcuggacagcaccgaccccagagccuggcuggcccccacccugcagggcaucugcaccgccagagccgcccaguaccugcugcacagccccgagcugggcgccagcgaggccgccgcccccagagacgagguggacggcagaggcgagcuggugagaagaagcagcggcggcgccagcagcagcaagagccccggccccgugaaggugagagagcagcugugcaagcugaagggcggcguggugguggacgagcugggcugcagcagacagagagcccccagcagcaagcaggugaacggcgugcagaagcagagaagacuggccgccaacgccagagagagaagaagaaugcacggccugaaccacgccuucgaccagcugagaaacgugauccccagcuucaacaacgacaagaagcugagcaaguacgagacccugcagauggcccagaucuacaucaacgcccugagcgagcugcugcagacccccagcggcggcgagcagcccccccccccccccgccagcugcaagagcgaccaccaccaccugagaaccgccgccagcuacgagggcggcgccggcaacgccaccgccgccggcgcccagcaggccagcggcggcagccagagacccaccccccccggcagcugcagaaccagauucagcgcccccgccagcgccggcggcuacagcgugcagcuggacgcccugcacuucagcaccuucgaggacagcgcccugaccgccaugauggcccagaagaaccugagccccagccugcccggcagcauccugcagcccgugcaggaggagaacagcaagaccagccccagaagccacagaagcgacggcgaguucagcccccacagccacuacagcgacagcgacgaggccagcuaa

SEQ ID NO: 13960 - RNA, 459 nt, Artificial Sequence
  ATOH7__Homo_sapiens__NP_660161
augaagagcugcaagcccagcggcccccccgccggcgccagaguggccccccccugcgccggcggcaccgagugcgccggcaccugcgccggcgccggcagacuggagagcgccgccagaagaagacuggccgccaacgccagagagagaagaagaaugcagggccugaacaccgccuucgacagacugagaagaguggugccccaguggggccaggacaagaagcugagcaaguacgagacccugcagauggcccugagcuacaucauggcccugaccagaauccuggccgaggccgagagauucggcagcgagagagacugggugggccugcacugcgagcacuucggcagagaccacuaccugcccuuccccggcgccaagcugcccggcgagagcgagcuguacagccagagacuguucggcuuccagcccgagcccuuccagauggccaccuaa

SEQ ID NO: 13961 - RNA, 207 nt, Artificial Sequence
  ATOX1__Homo_sapiens__NP_004036
augcccaagcacgaguucagcguggacaugaccugcggcggcugcgccgaggccgugagcagagugcugaacaagcugggcggcgugaaguacgacaucgaccugcccaacaagaaggugugcaucgagagcgagcacagcauggacacccugcuggccacccugaagaagaccggcaagaccgugagcuaccugggccuggaguaa

SEQ ID NO: 13962 - RNA, 4500 nt, Artificial Sequence
  ATP10A__Homo_sapiens__NP_077816
auggagagagagcccgccggcaccgaggagcccggcccccccggcagaagaagaagaagagagggcagaaccagaaccgugagaagcaaccugcugcccccccccggcgccgaggaccccgccgccggcgccgccaagggcgagagaagaagaagaagaggcugcgcccagcaccuggccgacaacagacugaagaccaccaaguacacccugcugagcuuccugcccaagaaccuguucgagcaguuccacagacccgccaacguguacuucguguucaucgcccugcugaacuucgugcccgccgugaacgccuuccagcccggccuggcccuggcccccgugcuguucauccuggccaucaccgccuucagagaccugugggaggacuacagcagacacagaagcgaccacaagaucaaccaccugggcugccugguguucagcagagaggagaagaaguacgugaacagauucuggaaggagauccacgugggcgacuucgugagacugagaugcaacgagaucuuccccgccgacauccugcugcugagcagcagcgaccccgacggccugugccacaucgagaccgccaaccuggacggcgagaccaaccugaagagaagacagguggugagaggcuucagcgagcuggugagcgaguucaacccccugaccuucaccagcgugaucgagugcgagaagcccaacaacgaccugagcagauucagaggcugcaucauccacgacaacggcaagaaggccggccuguacaaggagaaccugcugcugagaggcugcacccugagaaacaccgacgccguggugggcaucgugaucuacgccggccacgagaccaaggcccugcugaacaacagcggccccagauacaagagaagcaagcuggagagacagaugaacugcgacgugcuguggugcgugcugcugcuggugugcaugagccuguucagcgccgugggccacggccuguggaucuggagauaccaggagaagaagagccuguucuacgugcccaagagcgacggcagcagccugagccccgugaccgccgccguguacagcuuccugaccaugaucaucgugcugcaggugcugauccccaucagccuguacgugagcaucgagaucgugaaggccugccagguguacuucaucaaccaggacaugcagcuguacgacgaggagaccgacagccagcugcagugcagagcccugaacaucaccgaggaccugggccagauccaguacaucuucagcgacaagaccggcacccugaccgagaacaagaugguguucagaagaugcaccgugagcggcguggaguacagccacgacgccaacgcccagagacuggccagauaccaggaggccgacagcgaggaggaggagguggugcccagaggcggcagcgugagccagagaggcagcaucggcagccaccagagcgugagaguggugcacagaacccagagcaccaagagccacagaagaaccggcagcagagccgaggccaagagagccagcaugcugagcaagcacaccgccuucagcagccccauggagaaggacaucacccccgaccccaagcugcuggagaaggugagcgagugcgacaagagccuggccguggccagacaccaggagcaccugcuggcccaccugagccccgagcugagcgacguguucgacuucuucaucgcccugaccaucugcaacaccgugguggugaccagccccgaccagcccagaaccaaggugagagugagauucgagcugaagagccccgugaagaccaucgaggacuuccugagaagauucacccccagcugccugaccagcggcugcagcagcaucggcagccuggccgccaacaagagcagccacaagcugggcagcagcuuccccagcacccccagcagcgacggcaugcugcugagacuggaggagagacugggccagcccaccagcgccaucgccagcaacggcuacagcagccaggccgacaacugggccagcgagcuggcccaggagcaggagagcgagagagagcugagauacgaggccgagagccccgacgaggccgcccugguguacgccgccagagccuacaacugcgugcugguggagagacugcacgaccaggugagcguggagcugccccaccugggcagacugaccuucgagcugcugcacacccugggcuucgacagcgugagaaagagaaugagcguggugaucagacacccccugaccgacgagaucaacguguacaccaagggcgccgacagcguggugauggaccugcugcagcccugcagcagcguggacgccagaggcagacaccagaagaagaucagaagcaagacccagaacuaccugaacguguacgccgccgagggccugagaacccugugcaucgccaagagagugcugagcaaggaggaguacgccugcuggcugcagagccaccuggaggccgagagcagccuggagaacagcgaggagcugcuguuccagagcgccaucagacuggagaccaaccugcaccugcugggcgccaccggcaucgaggacagacugcaggacggcgugcccgagaccaucagcaagcugagacaggccggccugcagaucugggugcugaccggcgacaagcaggagaccgccgugaacaucgccuacgccugcaagcugcuggaccacgacgaggaggugaucacccugaacgccaccagccaggaggccugcgccgcccugcuggaccagugccugugcuacgugcagagcagaggccugcagagagcccccgagaagaccaagggcaaggugagcaugagauucagcagccugugcccccccagcaccagcaccgccagcggcagaagacccagccuggugaucgacggcagaagccuggccuacgcccuggagaagaaccuggaggacaaguuccuguuccuggccaagcagugcagaagcgugcugugcugcagaagcaccccccugcagaagagcaugguggugaagcuggugagaagcaagcugaaggccaugacccuggccaucggcgacggcgccaacgacgugagcaugauccagguggccgacgugggcgugggcaucagcggccaggagggcaugcaggccgugauggccagcgacuucgccgugcccaaguucagauaccuggagagacugcugauccugcacggccacuggugcuacagcagacuggccaacauggugcuguacuucuucuacaagaacaccauguucgugggccugcuguucugguuccaguucuucugcggcuucagcgccagcaccaugaucgaccagugguaccugaucuucuucaaccugcuguucagcagccugcccccccuggugaccggcgugcuggacagagacgugcccgccaacgugcugcugaccaacccccagcuguacaagagcggccagaacauggaggaguacagacccagaaccuucugguucaacauggccgacgccgccuuccagagccuggugugcuucagcauccccuaccuggccuacuacgacagcaacguggaccuguucaccuggggcacccccaucgugaccaucgcccugcugaccuuccugcugcaccugggcaucgagaccaagaccuggaccuggcugaacuggaucaccugcggcuucagcgugcugcuguucuucaccguggcccugaucuacaacgccagcugcgccaccugcuacccccccagcaaccccuacuggaccaugcaggcccugcugggcgaccccguguucuaccugaccugccugaugacccccguggccgcccugcugcccagacuguucuucagaagccugcagggcagaguguuccccacccagcugcagcuggccagacagcugaccagaaagagccccagaagaugcagcgcccccaaggagaccuucgcccagggcagacugcccaaggacagcggcaccgagcacagcagcggcagaaccgugaagaccagcgugccccugagccagcccagcuggcacacccagcagcccgugugcagccuggaggccagcggcgagcccagcaccguggacaugagcaugcccgugagagagcacacccugcuggagggccugagcgcccccgcccccaugagcagcgcccccggcgaggccgugcugagaagccccggcggcugccccgaggagagcaaggugagagccgccagcaccggcagagugaccccccugagcagccuguucagccugcccaccuucagccugcugaacuggaucagcagcuggagccuggugagcagacugggcagcgugcugcaguucagcagaaccgagcagcuggccgacggccaggccggcagaggccugcccgugcagccccacagcggcagaagcggccugcagggccccgaccacagacugcugaucggcgccagcagcagaagaagccaguaa

SEQ ID NO: 13963 - RNA, 4386 nt, Artificial Sequence
  ATP10B__Homo_sapiens__NP_079429
auggcccugagcguggacagcagcuggcacagauggcaguggagagugagagacggcuucccccacugccccagcgagaccaccccccugcugagccccgagaagggcagacagagcuacaaccugacccagcagagagugguguuccccaacaacagcaucuuccaccaggacugggaggaggugagcagaagauaccccggcaacagaaccugcaccaccaaguacacccuguucaccuuccugcccagaaaccuguucgagcaguuccacagaugggccaaccuguacuuccuguuccuggugauccugaacuggaugcccagcauggagguguuccacagagagaucaccaugcugccccuggccaucgugcuguucgugaucaugaucaaggacggcauggaggacuucaagagacacagauucgacaaggccaucaacugcagcaacaucagaaucuacgagagaaaggagcagaccuacgugcagaagugcuggaaggacgugagagugggcgacuucauccagaugaagugcaacgagaucgugcccgccgacauccugcugcuguucagcagcgaccccaacggcaucugccaccuggagaccgccagccuggacggcgagaccaaccugaagcagagaugcguggugaagggcuucagccagcaggaggugcaguucgagcccgagcuguuccacaacaccaucgugugcgagaagcccaacaaccaccugaacaaguucaagggcuacauggagcaccccgaccagaccagaaccggcuucggcugcgagagccugcugcugagaggcugcaccaucagaaacaccgagauggccgugggcaucgugaucuacgccggccacgagaccaaggccaugcugaacaacagcggccccagauacaagagaagcaagaucgagagaagaaugaacaucgacaucuucuucugcaucggcauccugauccugaugugccugaucggcgccgugggccacagcaucuggaacggcaccuucgaggagcacccccccuucgacgugcccgacgccaacggcagcuuccugcccagcgcccugggcggcuucuacauguuccugaccaugaucauccugcugcaggugcugauccccaucagccuguacgugagcaucgagcuggugaagcugggccagguguucuuccugagcaacgaccuggaccuguacgacgaggagaccgaccugagcauccagugcagagcccugaacaucgccgaggaccugggccagauccaguacaucuucagcgacaagaccggcacccugaccgagaacaagaugguguucagaagaugcaccaucaugggcagcgaguacagccaccaggagaacgccaagagacuggagacccccaaggagcuggacagcgacggcgaggaguggacccaguaccagugccugagcuucagcgccagaugggcccaggaccccgccaccaugagaagccagaagggcgcccagccccugagaagaagccagagcgccagagugcccauccagggccacuacagacagagaagcaugggccacagagagagcagccagccccccguggccuucagcagcagcaucgagaaggacgugacccccgacaagaaccugcugaccaaggugagagacgccgcccuguggcuggagacccugagcgacagcagacccgccaaggccagccugagcaccaccagcagcaucgccgacuucuuccuggcccugaccaucugcaacagcgugauggugagcaccaccaccgagcccagacagagagugaccaucaagcccagcagcaaggcccugggcaccagccuggagaagauccagcagcuguuccagaagcugaagcugcugagccugagccagagcuucagcagcaccgcccccagcgacaccgaccugggcgagagccugggcgccaacguggccaccaccgacagcgacgagagagacgacgccagcgugugcagcggcggcgacagcaccgacgacggcggcuacagaagcagcaugugggaccagggcgacauccuggagagcggcagcggcaccagccuggaggaggcccuggaggcccccgccaccgaccuggccagacccgaguucugcuacgaggccgagagccccgacgaggccgcccuggugcacgccgcccacgccuacagcuucacccuggugagcagaacccccgagcaggugaccgugagacugccccagggcaccugccugaccuucagccugcugugcacccugggcuucgacagcgugagaaagagaaugagcgugguggugagacacccccugaccggcgagaucgugguguacaccaagggcgccgacagcgugaucauggaccugcuggaggaccccgccugcgugcccgacaucaacauggagaagaagcugagaaagaucagagccagaacccagaagcaccuggaccuguacgccagagacggccugagaacccugugcaucgccaagaagguggugagcgaggaggacuucagaagaugggccagcuucagaagagaggccgaggccagccuggacaacagagacgagcugcugauggagaccgcccagcaccuggagaaccagcugacccugcugggcgccaccggcaucgaggacagacugcaggagggcgugcccgacaccaucgccacccugagagaggccggcauccagcugugggugcugaccggcgacaagcaggagaccgccgugaacaucgcccacagcugcagacugcugaaccagaccgacaccguguacaccaucaacaccgagaaccaggagaccugcgagagcauccugaacugcgcccuggaggagcugaagcaguucagagagcugcagaagcccgacagaaagcuguucggcuucagacugcccagcaagacccccagcaucaccagcgaggccguggugcccgaggccggccuggugaucgacggcaagacccugaacgccaucuuccagggcaagcuggagaagaaguuccuggagcugacccaguacugcagaagcgugcugugcugcagaagcaccccccugcagaagagcaugaucgugaagcuggugagagacaagcugagagugaugacccugagcaucggcgacggcgccaacgacgugagcaugauccaggccgccgacaucggcaucggcaucagcggccaggagggcaugcaggccgugaugagcagcgacuucgccaucaccagauucaagcaccugaagaagcugcugcuggugcacggccacuggugcuacagcagacuggccagaauggugguguacuaccuguacaagaacgugugcuacgugaaccugcuguucugguaccaguucuucugcggcuucagcagcagcaccaugaucgacuacuggcagaugaucuucuucaaccuguucuucaccagccugcccccccugguguucggcgugcuggacaaggacaucagcgccgagacccugcuggcccugcccgagcuguacaagagcggccagaacagcgagugcuacaaccugagcaccuucuggaucagcaugguggacgccuucuaccagagccugaucugcuucuucauccccuaccuggccuacaagggcagcgacaucgacguguucaccuucggcacccccaucaacaccaucagccugaccaccauccugcugcaccaggccauggagaugaagaccuggaccaucuuccacggcguggugcugcugggcagcuuccugauguacuuccuggugagccugcuguacaacgccaccugcgugaucugcaacagccccaccaaccccuacugggugauggagggccagcugagcaaccccaccuucuaccuggugugcuuccugacccccgugguggcccugcugcccagauacuucuuccugagccugcagggcaccugcggcaagagccugaucagcaaggcccagaagaucgacaagcugccccccgacaagagaaaccuggagauccagagcuggagaagcagacagagacccgcccccgugcccgagguggccagacccacccaccaccccgugagcagcaucaccggccaggacuucagcgccagcacccccaagagcagcaacccccccaagagaaagcacguggaggagagcgugcugcacgagcagagaugcggcaccgagugcaugagagacgacagcugcagcggcgacagcagcgcccagcugagcagcggcgagcaccugcugggccccaacagaaucauggccuacagcagaggccagaccgacaugugcagaugcagcaagagaagcagccacagaagaagccagagcagccugaccaucuaa

SEQ ID NO: 13964 - RNA, 4281 nt, Artificial Sequence
  ATP10D__Homo_sapiens__NP_065186
augaccgaggcccugcagugggccagauaccacuggagaagacugaucagaggcgccaccagagacgacgacagcggccccuacaacuacagcagccugcuggccugcggcagaaagagcagccagacccccaagcugagcggcagacacagaaucguggugccccacauccagcccuucaaggacgaguacgagaaguucagcggcgccuacgugaacaacagaaucagaaccaccaaguacacccugcugaacuucgugcccagaaaccuguucgagcaguuccacagagccgccaaccuguacuuccuguuccugguggugcugaacugggugccccugguggaggccuuccagaaggagaucaccaugcugccccuggugguggugcugaccaucaucgccaucaaggacggccuggaggacuacagaaaguacaagaucgacaagcagaucaacaaccugaucaccaagguguacagcagaaaggagaagaaguacaucgacagaugcuggaaggacgugaccgugggcgacuucaucagacugagcugcaacgaggugauccccgccgacauggugcugcuguucagcaccgaccccgacggcaucugccacaucgagaccagcggccuggacggcgagagcaaccugaagcagagacagguggugagaggcuacgccgagcaggacagcgagguggaccccgagaaguucagcagcagaaucgagugcgagagccccaacaacgaccugagcagauucagaggcuuccuggagcacagcaacaaggagagagugggccugagcaaggagaaccugcugcugagaggcugcaccaucagaaacaccgaggccguggugggcaucgugguguacgccggccacgagaccaaggccaugcugaacaacagcggccccagauacaagagaagcaagcuggagagaagagccaacaccgacgugcuguggugcgugaugcugcuggugaucaugugccugaccggcgccgugggccacggcaucuggcugagcagauacgagaagaugcacuucuucaacgugcccgagcccgacggccacaucaucagcccccugcuggccggcuucuacauguucuggaccaugaucauccugcugcaggugcugauccccaucagccuguacgugagcaucgagaucgugaagcugggccagaucuacuucauccagagcgacguggacuucuacaacgagaagauggacagcaucgugcagugcagagcccugaacaucgccgaggaccugggccagauccaguaccuguucagcgacaagaccggcacccugaccgagaacaagaugguguucagaagaugcagcguggccggcuucgacuacugccacgaggagaacgccagaagacuggagagcuaccaggaggccgugagcgaggacgaggacuucaucgacaccgugagcggcagccugagcaacauggccaagcccagagcccccagcugcagaaccgugcacaacggcccccugggcaacaagcccagcaaccaccuggccggcagcagcuucacccugggcagcggcgagggcgccagcgaggugccccacagcagacaggccgccuucagcagccccaucgagaccgacguggugcccgacaccagacugcuggacaaguucagccagaucacccccagacuguucaugccccuggacgagaccauccagaacccccccauggagacccuguacaucaucgacuucuucaucgcccuggccaucugcaacaccgugguggugagcgcccccaaccagcccagacagaagaucagacaccccagccugggcggccugcccaucaagagccuggaggagaucaagagccuguuccagagauggagcgugagaagaagcagcagccccagccugaacagcggcaaggagcccagcagcggcgugcccaacgccuucgugagcagacugccccuguucagcagaaugaagcccgccagccccguggaggaggaggugagccaggugugcgagagcccccagugcagcagcagcagcgccugcugcaccgagaccgagaagcagcacggcgacgccggccugcugaacggcaaggccgagagccugcccggccagccccuggccugcaaccugugcuacgaggccgagagccccgacgaggccgcccugguguacgccgccagagccuaccagugcacccugagaagcagaacccccgagcaggugaugguggacuucgccgcccugggcccccugaccuuccagcugcugcacauccugcccuucgacagcgugagaaagagaaugagcgugguggugagacacccccugagcaaccagguggugguguacaccaagggcgccgacagcgugaucauggagcugcugagcguggccagccccgacggcgccagccuggagaagcagcagaugaucgugagagagaagacccagaagcaccuggacgacuacgccaagcagggccugagaacccugugcaucgccaagaaggugaugagcgacaccgaguacgccgaguggcugagaaaccacuuccuggccgagaccagcaucgacaacagagaggagcugcugcuggagagcgccaugagacuggagaacaagcugacccugcugggcgccaccggcaucgaggacagacugcaggagggcgugcccgagagcaucgaggcccugcacaaggccggcaucaagaucuggaugcugaccggcgacaagcaggagaccgccgugaacaucgccuacgccugcaagcugcuggagcccgacgacaagcuguucauccugaacacccagagcaaggacgccugcggcaugcugaugagcaccauccugaaggagcugcagaagaagacccaggcccugcccgagcaggugagccugagcgaggaccugcugcagccccccgugcccagagacagcggccugagagccggccugaucaucaccggcaagacccuggaguucgcccugcaggagagccugcagaagcaguuccuggagcugaccagcuggugccaggccguggugugcugcagagccaccccccugcagaagagcgagguggugaagcuggugagaagccaccugcaggugaugacccuggccaucggcgacggcgccaacgacgugagcaugauccagguggccgacaucggcaucggcgugagcggccaggagggcaugcaggccgugauggccagcgacuucgccgugagccaguucaagcaccugagcaagcugcugcuggugcacggccacuggugcuacaccagacugagcaacaugauccuguacuucuucuacaagaacguggccuacgugaaccugcuguucugguaccaguucuucugcggcuucagcggcaccagcaugaccgacuacugggugcugaucuucuucaaccugcuguucaccagcgccccccccgugaucuacggcgugcuggagaaggacgugagcgccgagacccugaugcagcugcccgagcuguacagaagcggccagaagagcgaggccuaccugccccacaccuucuggaucacccugcuggacgccuucuaccagagccuggugugcuucuucgugcccuacuucaccuaccagggcagcgacaccgacaucuucgccuucggcaacccccugaacaccgccgcccuguucaucgugcugcugcaccuggugaucgagagcaagagccugaccuggauccaccugcuggugaucaucggcagcauccugagcuacuuccuguucgccaucguguucggcgccaugugcgugaccugcaacccccccagcaaccccuacuggaucaugcaggagcacaugcuggaccccguguucuaccuggugugcauccugaccaccagcaucgcccugcugcccagauucguguacagagugcugcagggcagccuguuccccagccccauccugagagccaagcacuucgacagacugacccccgaggagagaaccaaggcccugaagaaguggagaggcgccggcaagaugaaccaggugaccagcaaguacgccaaccagagcgccggcaagagcggcagaagacccaugcccggccccagcgccguguucgccaugaagagcgccagcagcugcgccaucgagcagggcaaccugagccugugcgagaccgcccuggaccagggcuacagcgagaccaaggccuucgagauggccggccccagcaagggcaaggagagcuaa

SEQ ID NO: 13965 - RNA, 3405 nt, Artificial Sequence
  ATP11A__Homo_sapiens__NP_056020
auggacugcagccuggugagaacccuggugcacagauacugcgccggcgaggagaacuggguggacagcagaaccaucuacgugggccacagagagcccccccccggcgccgaggccuacaucccccagagauaccccgacaacagaaucgugagcagcaaguacaccuucuggaacuucauccccaagaaccuguucgagcaguucagaagaguggccaacuucuacuuccugaucaucuuccuggugcagcugaucaucgacacccccaccagccccgugaccagcggccugccccuguucuucgugaucaccgugaccgccaucaagcagggcuacgaggacuggcugagacacaaggccgacaacgccaugaaccagugccccgugcacuucauccagcacggcaagcuggugagaaagcagagcagaaagcugagagugggcgacaucgugauggugaaggaggacgagaccuuccccugcgaccugaucuuccugagcagcaacagaggcgacggcaccugccacgugaccaccgccagccuggacggcgagagcagccacaagacccacuacgccgugcaggacaccaagggcuuccacaccgaggaggacaucggcggccugcacgccaccaucgagugcgagcagccccagcccgaccuguacaaguucgugggcagaaucaacguguacagcgaccugaacgaccccguggugagaccccugggcagcgagaaccugcugcugagaggcgccacccugaagaacaccgagaagaucuucggcguggccaucuacaccggcauggagaccaagauggcccugaacuaccagagcaagagccagaagagaagcgccguggagaagagcaugaacgccuuccugaucguguaccugugcauccugaucagcaaggcccugaucaacaccgugcugaaguacauguggcagagcgagcccuucagagacgagcccugguacaaccagaagaccgagagcgagagacagagaaaccuguuccugaaggccuucaccgacuuccuggccuucauggugcuguucaacuacaucauccccgugagcauguacgugaccguggagaugcagaaguuccugggcagcuacuucaucaccugggacgaggacauguucgacgaggagaccggcgagggcccccuggugaacaccagcgaccugaacgaggagcugggccagguggaguacaucuucaccgacaagaccggcacccugaccgagaacaacauggaguucaaggagugcugcaucgagggccacguguacgugccccacgugaucugcaacggccaggugcugcccgagagcagcggcaucgacaugaucgacagcagccccagcgugaacggcagagagagagaggagcuguucuucagagcccugugccugugccacaccgugcaggugaaggacgacgacagcguggacggccccagaaagagccccgacggcggcaagagcugcguguacaucagcagcagccccgacgagguggcccugguggagggcgugcagagacugggcuucaccuaccugagacugaaggacaacuacauggagauccugaacagagagaaccacaucgagagauucgagcugcuggagauccugagcuucgacagcgugagaagaagaaugagcgugaucgugaagagcgccaccggcgagaucuaccuguucugcaagggcgccgacagcagcaucuuccccagagugaucgagggcaagguggaccagaucagagccagaguggagagaaacgccguggagggccugagaacccugugcguggccuacaagagacugauccaggaggaguacgagggcaucugcaagcugcugcaggccgccaagguggcccugcaggacagagagaagaagcuggccgaggccuacgagcagaucgagaaggaccugacccugcugggcgccaccgccguggaggacagacugcaggagaaggccgccgacaccaucgaggcccugcagaaggccggcaucaaggugugggugcugaccggcgacaagauggagaccgccgccgccaccugcuacgccugcaagcuguucagaagaaacacccagcugcuggagcugaccaccaagagaaucgaggagcagagccugcacgacgugcuguucgagcugagcaagaccgugcugagacacagcggcagccugaccagagacaaccugagcggccugagcgccgacaugcaggacuacggccugaucaucgacggcgccgcccugagccugaucaugaagcccagagaggacggcagcagcggcaacuacagagagcuguuccuggagaucugcagaagcugcagcgccgugcugugcugcagaauggccccccugcagaaggcccagaucgugaagcugaucaaguucagcaaggagcaccccaucacccuggccaucggcgacggcgccaacgacgugagcaugauccuggaggcccacgugggcaucggcgugaucggcaaggagggcagacaggccgccagaaacagcgacuacgccauccccaaguucaagcaccugaagaagaugcugcuggugcacggccacuucuacuacaucagaaucagcgagcuggugcaguacuucuucuacaagaacgugugcuucaucuucccccaguuccuguaccaguucuucugcggcuucagccagcagacccuguacgacaccgccuaccugacccuguacaacaucagcuucaccagccugcccauccugcuguacagccugauggagcagcacgugggcaucgacgugcugaagagagaccccacccuguacagagacguggccaagaacgcccugcugagauggagaguguucaucuacuggacccugcugggccuguucgacgcccugguguucuucuucggcgccuacuucguguucgagaacaccaccgugaccagcaacggccagaucuucggcaacuggaccuucggcacccugguguucaccgugaugguguucaccgugacccugaagcuggcccuggacacccacuacuggaccuggaucaaccacuucgugaucuggggcagccugcuguucuacgugguguucagccugcuguggggcggcgugaucuggcccuuccugaacuaccagagaauguacuacguguucauccagaugcugagcagcggccccgccuggcuggccaucgugcugcuggugaccaucagccugcugcccgacgugcugaagaaggugcugugcagacagcuguggcccaccgccaccgagagagugcagaccaagagccagugccugagcguggagcagagcaccaucuucaugcugagccagaccagcagcagccugagcuucuaa

SEQ ID NO: 13966 - RNA, 366 nt, Artificial Sequence
  ATP11AUN__Homo_sapiens__NP_997323
augaacagccccgaggccagacugugcguggcccagugcagagacagcuaccccggcugccagccccugaaggacaccagagccugggccagcagccugaagauggaccccgccggccuggagggcggccccagagacgagagcagagacgagccccccaucagagcccaggccgccagcugggaccagccccagggcugccugaccuacaagggcagaagaagcgccagcggcacccagaagcagcugcagcugcccgacacccugagcagccugcugugcuggagaggcgccaucaugguguacaucaaggugaccgugcagaccgacgacagcaacaagcugcugagccugcuguacagauaa

SEQ ID NO: 13967 - RNA, 3534 nt, Artificial Sequence
  ATP11B__Homo_sapiens__NP_055431
auguggagauggaucagacagcagcugggcuucgaccccccccaccagagcgacaccagaaccaucuacguggccaacagauucccccagaacggccuguacaccccccagaaguucaucgacaacagaaucaucagcagcaaguacaccguguggaacuucgugcccaagaaccuguucgagcaguucagaagaguggccaacuucuacuuccugaucaucuuccuggugcagcugaugaucgacacccccaccagccccgugaccagcggccugccccuguucuucgugaucaccgugaccgccaucaagcagggcuacgaggacuggcugagacacaacagcgacaacgaggugaacggcgcccccguguacguggugagaagcggcggccuggugaagaccagaagcaagaacaucagagugggcgacaucgugagaaucgccaaggacgagaucuuccccgccgaccuggugcugcugagcagcgacagacuggacggcagcugccacgugaccaccgccagccuggacggcgagaccaaccugaagacccacguggccgugcccgagaccgcccugcugcagaccguggccaaccuggacacccugguggccgugaucgagugccagcagcccgaggccgaccuguacagauucaugggcagaaugaucaucacccagcagauggaggagaucgugagaccccugggccccgagagccugcugcugagaggcgccagacugaagaacaccaaggagaucuucggcguggccguguacaccggcauggagaccaagauggcccugaacuacaagagcaagagccagaagagaagcgccguggagaagagcaugaacaccuuccugaucaucuaccuggugauccugaucagcgaggccgugaucagcaccauccugaaguacaccuggcaggccgaggagaagugggacgagcccugguacaaccagaagaccgagcaccagagaaacagcagcaagauccugagauucaucagcgacuuccuggccuuccuggugcuguacaacuucaucauccccaucagccuguacgugaccguggagaugcagaaguuccugggcagcuucuucaucggcugggaccuggaccuguaccacgaggagagcgaccagaaggcccaggugaacaccagcgaccugaacgaggagcugggccagguggaguacguguucaccgacaagaccggcacccugaccgagaacgagaugcaguucagagagugcagcaucaacggcaugaaguaccaggagaucaacggcagacuggugcccgagggccccacccccgacagcagcgagggcaaccugagcuaccugagcagccugagccaccugaacaaccugagccaccugaccaccagcagcagcuucagaaccagccccgagaacgagaccgagcugaucaaggagcacgaccuguucuucaaggccgugagccugugccacaccgugcagaucagcaacgugcagaccgacugcaccggcgacggccccuggcagagcaaccuggcccccagccagcuggaguacuacgccagcagccccgacgagaaggcccugguggaggccgccgccagaaucggcaucguguucaucggcaacagcgaggagaccauggaggugaagacccugggcaagcuggagagauacaagcugcugcacauccuggaguucgacagcgacagaagaagaaugagcgugaucgugcaggcccccagcggcgagaagcugcuguucgccaagggcgccgagagcagcauccugcccaagugcaucggcggcgagaucgagaagaccagaauccacguggacgaguucgcccugaagggccugagaacccugugcaucgccuacagaaaguucaccagcaaggaguacgaggagaucgacaagagaaucuucgaggccagaaccgcccugcagcagagagaggagaagcuggccgccguguuccaguucaucgagaaggaccugauccugcugggcgccaccgccguggaggacagacugcaggacaaggugagagagaccaucgaggcccugagaauggccggcaucaaggugugggugcugaccggcgacaagcacgagaccgccgugagcgugagccugagcugcggccacuuccacagaaccaugaacauccuggagcugaucaaccagaagagcgacagcgagugcgccgagcagcugagacagcuggccagaagaaucaccgaggaccacgugauccagcacggccuggugguggacggcaccagccugagccuggcccugagagagcacgagaagcuguucauggaggugugcagaaacugcagcgccgugcugugcugcagaauggccccccugcagaaggccaaggugaucagacugaucaagaucagccccgagaagcccaucacccuggccgugggcgacggcgccaacgacgugagcaugauccaggaggcccacgugggcaucggcaucaugggcaaggagggcagacaggccgccagaaacagcgacuacgccaucgccagauucaaguuccugagcaagcugcuguucgugcacggccacuucuacuacaucagaaucgccacccuggugcaguacuucuucuacaagaacgugugcuucaucaccccccaguuccuguaccaguucuacugccuguucagccagcagacccuguacgacagcguguaccugacccuguacaacaucugcuucaccagccugcccauccugaucuacagccugcuggagcagcacguggacccccacgugcugcagaacaagcccacccuguacagagacaucagcaagaacagacugcugagcaucaagaccuuccuguacuggaccauccugggcuucagccacgccuucaucuucuucuucggcagcuaccugcugaucggcaaggacaccagccugcugggcaacggccagauguucggcaacuggaccuucggcacccugguguucaccgugauggugaucaccgugaccgugaagauggcccuggagacccacuucuggaccuggaucaaccaccuggugaccuggggcagcaucaucuucuacuucguguucagccuguucuacggcggcauccuguggcccuuccugggcagccagaacauguacuucguguucauccagcugcugagcagcggcagcgccugguucgccaucauccugaugguggugaccugccuguuccuggacaucaucaagaagguguucgacagacaccugcaccccaccagcaccgagaaggcccagcugaccgagaccaacgccggcaucaagugccuggacagcaugugcugcuuccccgagggcgaggccgccugcgccagcgugggcagaaugcuggagagagugaucggcagaugcagccccacccacaucagcagaagcuggagcgccagcgaccccuucuacaccaacgacagaagcauccugacccugagcaccauggacagcagcaccugcuaa

SEQ ID NO: 13968 - RNA, 3138 nt, Artificial Sequence
  ATP12A__Homo_sapiens__NP_001172014
augcaccagaagacccccgagaucuacagcguggagcugagcggcaccaaggacaucgugaagaccgacaagggcgacggcaaggagaaguacagaggccugaagaacaacugccuggagcugaagaagaagaaccacaaggaggaguuccagaaggagcugcaccuggacgaccacaagcugagcaacagagagcuggaggagaaguacggcaccgacaucaucaugggccugagcagcaccagagccgccgagcugcuggccagagacggccccaacagccugaccccccccaagcagacccccgagaucgugaaguuccugaagcagauggugggcggcuucagcauccugcugugggugggcgccuuccugugcuggaucgccuacggcauccaguacagcagcgacaagagcgccagccugaacaacguguaccugggcugcgugcugggccugguggugauccugaccggcaucuucgccuacuaccaggaggccaagagcaccaacaucaugagcagcuucaacaagaugaucccccagcaggcccuggugaucagagacagcgagaagaagaccauccccagcgagcagcugguggugggcgacaucguggaggugaagggcggcgaccagauccccgccgacaucagagugcugagcagccagggcugcagaguggacaacagcagccugaccggcgagagcgagccccagcccagaagcagcgaguucacccacgagaacccccuggagaccaagaacaucugcuucuacagcaccaccugccuggaggccagcaccagccccgugggcaccgugaccggcauggugaucaacaccggcgacagaaccaucaucggccacaucgccagccuggccagcggcgugggcaacgagaagacccccaucgccaucgagaucgagcacuucgugcacaucguggccggcguggccgugagcaucggcauccuguucuucaucaucgccgugagccugaaguaccaggugcuggacagcaucaucuuccugaucggcaucaucguggccaacgugcccgagggccugcuggccaccgugaccgugacccugagccugaccgccaagagaauggccaagaagaacugccuggugaagaaccuggaggccguggagacccugggcagcaccagcaucaucugcagcgacaagaccggcacccugacccagaacagaaugaccguggcccaccugugguucgacaaccagaucuucguggccgacaccagcgaggaccacagcaaccagguguucgaccagagcagcagaaccugggccagccugagcaagaucaucacccugugcaacagagccgaguucaagcccggccaggagaacgugcccaucaugaagaaggccgugaucggcgacgccagcgagaccgcccugcugaaguucagcgaggugauccugggcgacgugauggagaucagaaagagaaacagaaagguggccgagauccccuucaacagcaccaacaaguuccagcugagcauccacgagauggacgacccccacggcaagagauuccugauggugaugaagggcgcccccgagagaauccuggagaagugcagcaccaucaugaucaacggcgaggagcacccccuggacaagagcaccgccaagaccuuccacaccgccuacauggagcugggcggccugggcgagagagugcugggcuucugccaccuguaccugcccgccgacgaguuccccgagaccuacagcuucgacaucgacgccaugaacuuccccaccagcaaccugugcuucgugggccugcugagcaugaucgacccccccagaagcaccgugcccgacgccgugaccaagugcagaagcgccggcaucaaggugaucauggugaccggcgaccaccccaucaccgccaaggccaucgccaagagcgugggcaucaucagcgccaacagcgagaccguggaggacaucgcccacagacugaacaucgccguggagcaggugaacaagagagacgccaaggccgccguggugaccggcauggagcugaaggacaugagcagcgagcagcuggacgagauccuggccaacuaccaggagaucguguucgccagaaccagcccccagcagaagcugaucaucguggagggcugccagagacaggacgccgugguggccgugaccggcgacggcgugaacgacagccccgcccugaagaaggccgacaucggcaucgccaugggcaucgccggcagcgacgccgccaagaacgccgccgacauggugcugcuggacgacaacuucgccagcaucgugaccggcguggaggagggcagacugaucuucgacaaccugaagaagaccaucgccuacagccugaccaagaacaucgccgagcugugccccuuccugaucuacaucaucgugggccugccccugcccaucggcaccaucaccauccuguucaucgaccugggcaccgacaucauccccagcaucgcccuggccuacgagaaggccgagagcgacaucaugaacagaaagcccagacacaagaacaaggacagacuggugaaccagccccuggccguguacagcuaccugcacaucggccugaugcaggcccugggcgccuuccugguguacuucaccguguacgcccaggagggcuuccugcccagaacccugaucaaccugagaguggagugggagaaggacuacgugaacgaccugaaggacagcuacggccaggaguggaccagauaccagagagaguaccuggaguggaccggcuacaccgccuucuucgugggcauccuggugcagcagaucgccgaccugaucaucagaaagaccagaagaaacagcaucuuccagcagggccuguucagaaacaaggugaucugggugggcaucaccagccagaucaucaucggccugauccugagcuacggccugggcagcgugaccgcccugagcuucaccaugcugagagcccaguacugguucguggccgugccccacgccauccugaucuggguguacgacgaggugagaaagcuguucaucagacuguaccccggcagcuggugggacaagaacauguacuacuaa

SEQ ID NO: 13969 - RNA, 3681 nt, Artificial Sequence
  ATP13A3__Homo_sapiens__NP_078800
auggacagagaggagagaaagaccaucaaccagggccaggaggacgagauggagaucuacggcuacaaccugagcagauggaagcuggccaucgugagccugggcgugaucugcagcggcggcuuccugcugcugcugcuguacuggaugcccgaguggagagugaaggccaccugcgugagagccgccaucaaggacugcgagguggugcugcugagaaccaccgacgaguucaagaugugguucugcgccaagaucagagugcugagccuggagaccuaccccgugagcagccccaagagcaugagcaacaagcugagcaacggccacgccgugugccugaucgagaaccccaccgaggagaacagacacagaaucagcaaguacagccagaccgagagccagcagaucagauacuucacccaccacagcgugaaguacuucuggaacgacaccauccacaacuucgacuuccugaagggccuggacgagggcgugagcugcaccagcaucuacgagaagcacagcgccggccugaccaagggcaugcacgccuacagaaagcugcuguacggcgugaacgagaucgccgugaaggugcccagcguguucaagcugcugaucaaggaggugcugaaccccuucuacaucuuccagcuguucagcgugauccuguggagcaccgacgaguacuacuacuacgcccuggccaucguggugaugagcaucgugagcaucgugagcagccuguacagcaucagaaagcaguacgugaugcugcacgacaugguggccacccacagcaccgugagagugagcgugugcagagugaacgaggagaucgaggagaucuucagcaccgaccuggugcccggcgacgugauggugaucccccugaacggcaccaucaugcccugcgacgccgugcugaucaacggcaccugcaucgugaacgagagcaugcugaccggcgagagcgugcccgugaccaagaccaaccugcccaaccccagcguggacgugaagggcaucggcgacgagcuguacaaccccgagacccacaagagacacacccuguucugcggcaccaccgugauccagaccagauucuacaccggcgagcuggugaaggccaucguggugagaaccggcuucagcaccagcaagggccagcuggugagaagcauccuguaccccaagcccaccgacuucaagcuguacagagacgccuaccuguuccugcugugccugguggccguggccggcaucggcuucaucuacaccaucaucaacagcauccugaacgaggugcaggugggcgugaucaucaucgagagccuggacaucaucaccaucaccgugccccccgcccugcccgccgccaugaccgccggcaucguguacgcccagagaagacugaagaagaucggcaucuucugcaucagcccccagagaaucaacaucugcggccagcugaaccuggugugcuucgacaagaccggcacccugaccgaggacggccuggaccuguggggcauccagagaguggagaacgccagauuccugagccccgaggagaacgugugcaacgagaugcuggugaagagccaguucguggccugcauggccaccugccacagccugaccaagaucgagggcgugcugagcggcgacccccuggaccugaagauguucgaggccaucggcuggauccuggaggaggccaccgaggaggagaccgcccugcacaacagaaucaugcccaccguggugagaccccccaagcagcugcugcccgagagcacccccgccggcaaccaggagauggagcuguucgagcugcccgccaccuacgagaucggcaucgugagacaguuccccuucagcagcgcccugcagagaaugagcgugguggccagagugcugggcgacagaaagauggacgccuacaugaagggcgcccccgaggccaucgccggccugugcaagcccgagaccgugcccguggacuuccagaacgugcuggaggacuucaccaagcagggcuucagagugaucgcccuggcccacagaaagcuggagagcaagcugaccuggcacaaggugcagaacaucagcagagacgccaucgagaacaacauggacuucaugggccugaucaucaugcagaacaagcugaagcaggagacccccgccgugcuggaggaccugcacaaggccaacaucagaaccgugauggugaccggcgacagcaugcugaccgccgugagcguggccagagacugcggcaugauccugccccaggacaaggugaucaucgccgaggcccugccccccaaggacggcaagguggccaagaucaacuggcacuacgccgacagccugacccagugcagccaccccagcgccaucgaccccgaggccauccccgugaagcuggugcacgacagccuggaggaccugcagaugaccagauaccacuucgccaugaacggcaagagcuucagcgugauccuggagcacuuccaggaccuggugcccaagcugaugcugcacggcaccguguucgccagaauggcccccgaccagaagacccagcugaucgaggcccugcagaacguggacuacuucgugggcaugugcggcgacggcgccaacgacugcggcgcccugaagagagcccacggcggcaucagccugagcgagcuggaggccagcguggccagccccuucaccagcaagacccccagcaucagcugcgugcccaaccugaucagagagggcagagccgcccugaucaccagcuucugcguguucaaguucauggcccuguacagcaucauccaguacuucagcgugacccugcuguacagcauccugagcaaccugggcgacuuccaguuccuguucaucgaccuggccaucauccugguggugguguucaccaugagccugaaccccgccuggaaggagcugguggcccagagaccccccagcggccugaucagcggcgcccugcuguucagcgugcugagccagaucaucaucugcaucggcuuccagagccugggcuucuucugggugaagcagcagcccugguacgagguguggcaccccaagagcgacgccugcaacaccaccggcagcggcuucuggaacagcagccacguggacaacgagaccgagcuggacgagcacaacauccagaacuacgagaacaccaccguguucuucaucagcagcuuccaguaccugaucguggccaucgccuucagcaagggcaagcccuucagacagcccugcuacaagaacuacuucuucguguucagcgugaucuuccuguacaucuucauccuguucaucaugcuguaccccguggccagcguggaccaggugcugcagaucgugugcgugcccuaccaguggagagugaccaugcugaucaucgugcuggugaacgccuucgugagcaucaccguggaggagagcguggacagauggggcaagugcugccugcccugggcccugggcugcagaaagaagacccccaaggccaaguacauguaccuggcccaggagcugcugguggaccccgaguggccccccaagccccagaccaccaccgaggccaaggcccuggugaaggagaacggcagcugccagaucaucaccaucaccuaa

SEQ ID NO: 13970 - RNA, 3591 nt, Artificial Sequence
  ATP13A4__Homo_sapiens__NP_115655
augggccacuucgagaagggccagcacgcccugcugaacgagggcgaggagaacgagauggagaucuucggcuacagaacccagggcugcagaaagagccugugccuggccggcagcaucuucagcuucggcauccugccccugguguucuacuggagacccgccuggcacgugugggcccacugcgugcccugcagccugcaggaggccgacaccgugcugcugagaaccaccgacgaguuccagaucuacagcuggaagaaggugaucuggaucuaccugagcgcccugaacagcgccuucggccugacccccgaccacccccugaugaccgacgaggaguacaucaucaacagagccaucagaaagcccgaccugaaggugagaugcaucaaggugcagaagaucagauacguguggaacuaccuggagggccaguuccagaagaucggcagccuggaggacuggcugagcagcgccaagauccaccagaaguucggcagcggccugaccagagaggagcaggagaucagaagacugaucugcggccccaacaccaucgacguggaggugacccccaucuggaagcugcugaucaaggaggugcugaaccccuucuacaucuuccagcuguucagcgugugccugugguucagcgaggacuacaaggaguacgccuucgccaucaucaucaugagcaucaucagcaucagccugaccguguacgaccugagagagcagagcgugaagcugcaccaccugguggagagccacaacagcaucaccgugagcgugugcggcagaaaggccggcgugcaggagcuggagagcagagugcuggugcccggcgaccugcugauccugaccggcaacaaggugcugaugcccugcgacgccgugcugaucgagggcagcugcgugguggacgagggcaugcugaccggcgagagcauccccgugaccaagaccccccugcccaagauggacagcagcgugcccuggaagacccagagcgaggccgacuacaagagacacgugcuguucugcggcaccgaggugauccaggccaaggccgccugcagcggcaccgugagagccguggugcugcagaccggcuucaacaccgccaagggcgaccuggugagaagcauccuguaccccaagcccgugaacuuccagcuguacagagacgccaucagauuccugcugugccuggugggcaccgccaccaucggcaugaucuacacccugugcguguacgugcugagcggcgagccccccgaggagguggugagaaaggcccuggacgugaucaccaucgccgugccccccgcccugcccgccgcccugaccaccggcaucaucuacgcccagagaagacugaagaagagaggcaucuucugcaucagcccccagagaaucaacgugugcggccagcugaaccuggugugcuucgacaagaccggcacccugaccagagacggccuggaccuguggggcguggugagcugcgacagaaacggcuuccaggaggugcacagcuucgccagcggccaggcccugcccuggggcccccugugcgccgccauggccagcugccacagccugauccugcuggacggcaccauccagggcgacccccuggaccugaagauguucgaggccaccaccugggagauggccuucagcggcgacgacuuccacaucaagggcgugcccgcccacgccaugguggugaagcccugcagaaccgccagccaggugcccguggagggcaucgccauccugcaccaguuccccuucagcagcgcccugcagagaaugaccgugaucgugcaggagaugggcggcgacagacuggccuucaugaagggcgcccccgagagaguggccagcuucugccagcccgagaccgugcccaccagcuucgugagcgagcugcagaucuacaccacccagggcuucagagugaucgcccuggccuacaagaagcuggagaacgaccaccacgccaccacccugaccagagagaccguggagagcgaccugaucuuccugggccugcugauccuggagaacagacugaaggaggagaccaagcccgugcuggaggagcugaucagcgccagaaucagaaccgugaugaucaccggcgacaaccugcagaccgccaucaccguggccagaaagagcggcauggugagcgagagccagaaggugauccugaucgaggccaacgagaccaccggcagcagcagcgccagcaucagcuggacccugguggaggagaagaagcacaucauguacggcaaccaggacaacuacaucaacaucagagacgaggugagcgacaagggcagagagggcagcuaccacuucgcccugaccggcaagagcuuccacgugaucagccagcacuucagcagccugcugcccaagauccugaucaacggcaccaucuucgccagaaugagccccggccagaagagcagccugguggaggaguuccagaagcuggacuacuucgugggcaugugcggcgacggcgccaacgacugcggcgcccugaagauggcccacgugggcaucagccugagcgagcaggaggccagcguggccagccccuucaccagcaagacccccaacaucgagugcgugccccaccugaucaaggagggcagagccgcccuggugaccagcuucugcauguucaaguacauggcccuguacagcaugauccaguacgugggcgugcugcugcuguacugggagaccaacagccugagcaacuaccaguuccuguuccaggaccuggccaucaccacccugaucggcgugaccaugaaccugaacggcgccuaccccaagcuggugcccuucagacccgccggcagacugaucagccccccccugcugcugagcgugaucuucaacauccugcugagccuggccaugcacaucgccggcuucauccuggugcagagacagcccugguacagcguggagauccacagcgccugcaccgugcagaacgagagcaucagcgagcugaccaugagccccaccgcccccgagaagauggagagcaacagcaccuucaccagcuucgagaacaccaccgugugguuccugggcaccaucaacugcaucaccguggcccugguguucagcaagggcaagcccuucagacagcccaccuacaccaacuacaucuucgugcuggugcugaucauccagcugggcgugugccuguucauccuguucgccgacauccccgagcuguacagaagacuggaccugcugugcacccccgugcuguggagagccagcaucgugaucaugcugagccugaacuucaucgugagccugguggccgaggaggccgugaucgagaacagagcccuguggaugaugaucaagagaugcuucggcuaccagagcaagagccaguacagaaucuggcagagagaccuggccaacgaccccagcuggcccccccugaaccagaccagccacagcgacaugcccgagugcggcagaggcgugagcuacagcaaccccguguucgagagcaacgaggagcagcuguaa

SEQ ID NO: 13971 - RNA, 3063 nt, Artificial Sequence
  ATP1A2__Homo_sapiens__NP_000693
augggcagaggcgccggcagagaguacagccccgccgccaccaccgccgagaacggcggcggcaagaagaagcagaaggagaaggagcuggacgagcugaagaaggagguggccauggacgaccacaagcugagccuggacgagcugggcagaaaguaccagguggaccugagcaagggccugaccaaccagagagcccaggacgugcuggccagagacggccccaacgcccugacccccccccccaccacccccgagugggugaaguucugcagacagcuguucggcggcuucagcauccugcuguggaucggcgccauccugugcuuccuggccuacggcauccaggccgccauggaggacgagcccagcaacgacaaccuguaccugggcguggugcuggccgccguggugaucgugaccggcugcuucagcuacuaccaggaggccaagagcagcaagaucauggacagcuucaagaacauggugccccagcaggcccuggugaucagagagggcgagaagaugcagaucaacgccgaggaggugguggugggcgaccugguggaggugaagggcggcgacagagugcccgccgaccugagaaucaucagcagccacggcugcaagguggacaacagcagccugaccggcgagagcgagccccagaccagaagccccgaguucacccacgagaacccccuggagaccagaaacaucugcuucuucagcaccaacugcguggagggcaccgccagaggcaucgugaucgccaccggcgacagaaccgugaugggcagaaucgccacccuggccagcggccuggaggugggcagaacccccaucgccauggagaucgagcacuucauccagcugaucaccggcguggccguguuccugggcgugagcuucuucgugcugagccugauccugggcuacagcuggcuggaggccgugaucuuccugaucggcaucaucguggccaacgugcccgagggccugcuggccaccgugaccgugugccugacccugaccgccaagagaauggccagaaagaacugccuggugaagaaccuggaggccguggagacccugggcagcaccagcaccaucugcagcgacaagaccggcacccugacccagaacagaaugaccguggcccacaugugguucgacaaccagauccacgaggccgacaccaccgaggaccagagcggcgccaccuucgacaagagaagccccaccuggaccgcccugagcagaaucgccggccugugcaacagagccguguucaaggccggccaggagaacaucagcgugagcaagagagacaccgccggcgacgccagcgagagcgcccugcugaagugcaucgagcugagcugcggcagcgugagaaagaugagagacagaaaccccaagguggccgagauccccuucaacagcaccaacaaguaccagcugagcauccacgagagagaggacagcccccagagccacgugcuggugaugaagggcgcccccgagagaauccuggacagaugcagcaccauccuggugcagggcaaggagaucccccuggacaaggagaugcaggacgccuuccagaacgccuacauggagcugggcggccugggcgagagagugcugggcuucugccagcugaaccugcccagcggcaaguuccccagaggcuucaaguucgacaccgacgagcugaacuuccccaccgagaagcugugcuucgugggccugaugagcaugaucgacccccccagagccgccgugcccgacgccgugggcaagugcagaagcgccggcaucaaggugaucauggugaccggcgaccaccccaucaccgccaaggccaucgccaagggcgugggcaucaucagcgagggcaacgagaccguggaggacaucgccgccagacugaacauccccaugagccaggugaaccccagagaggccaaggccugcguggugcacggcagcgaccugaaggacaugaccagcgagcagcuggacgagauccugaagaaccacaccgagaucguguucgccagaaccagcccccagcagaagcugaucaucguggagggcugccagagacagggcgccaucguggccgugaccggcgacggcgugaacgacagccccgcccugaagaaggccgacaucggcaucgccaugggcaucagcggcagcgacgugagcaagcaggccgccgacaugauccugcuggacgacaacuucgccagcaucgugaccggcguggaggagggcagacugaucuucgacaaccugaagaagagcaucgccuacacccugaccagcaacauccccgagaucacccccuuccugcuguucaucaucgccaacaucccccugccccugggcaccgugaccauccugugcaucgaccugggcaccgacauggugcccgccaucagccuggccuacgaggccgccgagagcgacaucaugaagagacagcccagaaacagccagaccgacaagcuggugaacgagagacugaucagcauggccuacggccagaucggcaugauccaggcccugggcggcuucuucaccuacuucgugauccuggccgagaacggcuuccugcccagcagacugcugggcaucagacuggacugggacgacagaaccaugaacgaccuggaggacagcuacggccaggaguggaccuacgagcagagaaaggugguggaguucaccugccacaccgccuucuucgccagcaucgugguggugcagugggccgaccugaucaucugcaagaccagaagaaacagcguguuccagcagggcaugaagaacaagauccugaucuucggccugcuggaggagaccgcccuggccgccuuccugagcuacugccccggcaugggcguggcccugagaauguacccccugaaggugaccuggugguucugcgccuuccccuacagccugcugaucuucaucuacgacgaggugagaaagcugauccugagaagauaccccggcggcuggguggagaaggagaccuacuacuaa

SEQ ID NO: 13972 - RNA, 3075 nt, Artificial Sequence
  ATP1A3__Homo_sapiens__NP_001243142
augggcggcugggaggaggagagaaacagaagagccaccgacaagaaggacgacaaggacagccccaagaagaacaagggcaaggagagaagagaccuggacgaccugaagaaggagguggccaugaccgagcacaagaugagcguggaggaggugugcagaaaguacaacaccgacugcgugcagggccugacccacagcaaggcccaggagauccuggccagagacggccccaacgcccugacccccccccccaccacccccgagugggugaaguucugcagacagcuguucggcggcuucagcauccugcuguggaucggcgccauccugugcuuccuggccuacggcauccaggccggcaccgaggacgaccccagcggcgacaaccuguaccugggcaucgugcuggccgccguggugaucaucaccggcugcuucagcuacuaccaggaggccaagagcagcaagaucauggagagcuucaagaacauggugccccagcaggcccuggugaucagagagggcgagaagaugcaggugaacgccgaggaggugguggugggcgaccugguggagaucaagggcggcgacagagugcccgccgaccugagaaucaucagcgcccacggcugcaagguggacaacagcagccugaccggcgagagcgagccccagaccagaagccccgacugcacccacgacaacccccuggagaccagaaacaucaccuucuucagcaccaacugcguggagggcaccgccagaggcguggugguggccaccggcgacagaaccgugaugggcagaaucgccacccuggccagcggccuggaggugggcaagacccccaucgccaucgagaucgagcacuucauccagcugaucaccggcguggccguguuccugggcgugagcuucuucauccugagccugauccugggcuacaccuggcuggaggccgugaucuuccugaucggcaucaucguggccaacgugcccgagggccugcuggccaccgugaccgugugccugacccugaccgccaagagaauggccagaaagaacugccuggugaagaaccuggaggccguggagacccugggcagcaccagcaccaucugcagcgacaagaccggcacccugacccagaacagaaugaccguggcccacaugugguucgacaaccagauccacgaggccgacaccaccgaggaccagagcggcaccagcuucgacaagagcagccacaccuggguggcccugagccacaucgccggccugugcaacagagccguguucaagggcggccaggacaacauccccgugcugaagagagacguggccggcgacgccagcgagagcgcccugcugaagugcaucgagcugagcagcggcagcgugaagcugaugagagagagaaacaagaagguggccgagauccccuucaacagcaccaacaaguaccagcugagcauccacgagaccgaggaccccaacgacaacagauaccugcuggugaugaagggcgcccccgagagaauccuggacagaugcagcaccauccugcugcagggcaaggagcagccccuggacgaggagaugaaggaggccuuccagaacgccuaccuggagcugggcggccugggcgagagagugcugggcuucugccacuacuaccugcccgaggagcaguuccccaagggcuucgccuucgacugcgacgacgugaacuucaccaccgacaaccugugcuucgugggccugaugagcaugaucgacccccccagagccgccgugcccgacgccgugggcaagugcagaagcgccggcaucaaggugaucauggugaccggcgaccaccccaucaccgccaaggccaucgccaagggcgugggcaucaucagcgagggcaacgagaccguggaggacaucgccgccagacugaacauccccgugagccaggugaaccccagagacgccaaggccugcgugauccacggcaccgaccugaaggacuucaccagcgagcagaucgacgagauccugcagaaccacaccgagaucguguucgccagaaccagcccccagcagaagcugaucaucguggagggcugccagagacagggcgccaucguggccgugaccggcgacggcgugaacgacagccccgcccugaagaaggccgacaucggcguggccaugggcaucgccggcagcgacgugagcaagcaggccgccgacaugauccugcuggacgacaacuucgccagcaucgugaccggcguggaggagggcagacugaucuucgacaaccugaagaagagcaucgccuacacccugaccagcaacauccccgagaucacccccuuccugcuguucaucauggccaacaucccccugccccugggcaccaucaccauccugugcaucgaccugggcaccgacauggugcccgccaucagccuggccuacgaggccgccgagagcgacaucaugaagagacagcccagaaaccccagaaccgacaagcuggugaacgagagacugaucagcauggccuacggccagaucggcaugauccaggcccugggcggcuucuucagcuacuucgugauccuggccgagaacggcuuccugcccggcaaccuggugggcaucagacugaacugggacgacagaaccgugaacgaccuggaggacagcuacggccagcaguggaccuacgagcagagaaaggugguggaguucaccugccacaccgccuucuucgugagcaucgugguggugcagugggccgaccugaucaucugcaagaccagaagaaacagcguguuccagcagggcaugaagaacaagauccugaucuucggccuguucgaggagaccgcccuggccgccuuccugagcuacugccccggcauggacguggcccugagaauguacccccugaagcccagcuggugguucugcgccuuccccuacagcuuccugaucuucguguacgacgagaucagaaagcugauccugagaagaaaccccggcggcuggguggagaaggagaccuacuacuaa

SEQ ID NO: 13973 - RNA, 498 nt, Artificial Sequence
  ATP1A4__Homo_sapiens__NP_001001734
augauccaggcccuggccggcuucuucaccuacuucgugauccuggccgagaacggcuucagacccguggaccugcugggcaucagacugcacugggaggacaaguaccugaacgaccuggaggacagcuacggccagcaguggaccuacgagcagagaaaggugguggaguucaccugccagaccgccuucuucgugaccaucgugguggugcagugggccgaccugaucaucagcaagaccagaagaaacagccuguuccagcagggcaugagaaacaaggugcugaucuucggcauccuggaggagacccugcuggccgccuuccugagcuacacccccggcauggacguggcccugagaauguacccccugaagaucaccugguggcugugcgccauccccuacagcauccugaucuucguguacgacgagaucagaaagcugcugaucagacagcaccccgacggcuggguggagagagagaccuacuacuaa

SEQ ID NO: 13974 - RNA, 912 nt, Artificial Sequence
  ATP1B1__Homo_sapiens__NP_001668
auggccagaggcaaggccaaggaggagggcagcuggaagaaguucaucuggaacagcgagaagaaggaguuccugggcagaaccggcggcagcugguucaagauccugcuguucuacgugaucuucuacggcugccuggccggcaucuucaucggcaccauccaggugaugcugcugaccaucagcgaguucaagcccaccuaccaggacagaguggccccccccggccugacccagaucccccagauccagaagaccgagaucagcuucagacccaacgaccccaagagcuacgaggccuacgugcugaacaucgugagauuccuggagaaguacaaggacagcgcccagagagacgacaugaucuucgaggacugcggcgacgugcccagcgagcccaaggagagaggcgacuucaaccacgagagaggcgagagaaaggugugcagauucaagcuggaguggcugggcaacugcagcggccugaacgacgagaccuacggcuacaaggagggcaagcccugcaucaucaucaagcugaacagagugcugggcuucaagcccaagccccccaagaacgagagccuggagaccuaccccgugaugaaguacaaccccaacgugcugcccgugcagugcaccggcaagagagacgaggacaaggacaaggugggcaacguggaguacuucggccugggcaacagccccggcuucccccugcaguacuaccccuacuacggcaagcugcugcagcccaaguaccugcagccccugcuggccgugcaguucaccaaccugaccauggacaccgagaucagaaucgagugcaaggccuacggcgagaacaucggcuacagcgagaaggacagauuccagggcagauucgacgugaagaucgaggugaagagcuaa

SEQ ID NO: 13975 - RNA, 873 nt, Artificial Sequence
  ATP1B2__Homo_sapiens__NP_001669
auggugauccagaaggagaagaagagcugcggccaggugguggaggaguggaaggaguucguguggaaccccagaacccaccaguucaugggcagaaccggcaccagcugggccuucauccugcuguucuaccugguguucuacggcuuccugaccgccauguucacccugaccaugugggugaugcugcagaccgugagcgaccacacccccaaguaccaggacagacuggccacccccggccugaugaucagacccaagaccgagaaccuggacgugaucgugaacgugagcgacaccgagagcugggaccagcacgugcagaagcugaacaaguuccuggagcccuacaacgacagcauccaggcccagaagaacgacgugugcagacccggcagauacuacgagcagcccgacaacggcgugcugaacuaccccaagagagccugccaguucaacagaacccagcugggcaacugcagcggcaucggcgacagcacccacuacggcuacagcaccggccagcccugcguguucaucaagaugaacagagugaucaacuucuacgccggcgccaaccagagcaugaacgugaccugcgccggcaagagagacgaggacgccgagaaccugggcaacuucgugauguuccccgccaacggcaacaucgaccugauguacuuccccuacuacggcaagaaguuccacgugaacuacacccagccccugguggccgugaaguuccugaacgugacccccaacguggaggugaacguggagugcagaaucaacgccgccaacaucgccaccgacgacgagagagacaaguucgccggcagaguggccuucaagcugagaaucaacaagaccuaa

SEQ ID NO: 13976 - RNA, 2610 nt, Artificial Sequence
  ATP2A1__Homo_sapiens__NP_001273004
augggcaagguguacagagccgacagaaagagcgugcagagaaucaaggccagagacaucgugcccggcgacaucguggagguggccgugggcgacaaggugcccgccgacaucagaauccuggccaucaagagcaccacccugagaguggaccagagcauccugaccggcgagagcgugagcgugaucaagcacaccgagcccgugcccgaccccagagccgugaaccaggacaagaagaacaugcuguucagcggcaccaacaucgccgccggcaaggcccugggcaucguggccaccaccggcgugggcaccgagaucggcaagaucagagaccagauggccgccaccgagcaggacaagaccccccugcagcagaagcuggacgaguucggcgagcagcugagcaaggugaucagccugaucugcguggccguguggcugaucaacaucggccacuucaacgaccccgugcacggcggcagcugguucagaggcgccaucuacuacuucaagaucgccguggcccuggccguggccgccauccccgagggccugcccgccgugaucaccaccugccuggcccugggcaccagaagaauggccaagaagaacgccaucgugagaagccugcccagcguggagacccugggcugcaccagcgugaucugcagcgacaagaccggcacccugaccaccaaccagaugagcgugugcaagauguucaucaucgacaagguggacggcgacaucugccugcugaacgaguucagcaucaccggcagcaccuacgcccccgagggcgaggugcugaagaacgacaagcccgugagacccggccaguacgacggccugguggagcuggccaccaucugcgcccugugcaacgacagcagccuggacuucaacgaggccaagggcguguacgagaaggugggcgaggccaccgagaccgcccugaccacccugguggagaagaugaacguguucaacaccgacgugagaagccugagcaagguggagagagccaacgccugcaacagcgugaucagacagcugaugaagaaggaguucacccuggaguucagcagagacagaaagagcaugagcguguacugcagccccgccaagagcagcagagccgccgugggcaacaagauguucgugaagggcgcccccgagggcgugaucgacagaugcaacuacgugagagugggcaccaccagagugccccugaccggccccgugaaggagaagaucauggccgugaucaaggaguggggcaccggcagagacacccugagaugccuggcccuggccaccagagacaccccccccaagagagaggagauggugcuggacgacagcgccagauuccuggaguacgagaccgaccugaccuucgugggcguggugggcaugcuggacccccccagaaaggaggugaccggcagcauccagcugugcagagacgccggcaucagagugaucaugaucaccggcgacaacaagggcaccgccaucgccaucugcagaagaaucggcaucuucggcgagaacgaggagguggccgacagagccuacaccggcagagaguucgacgaccugccccuggccgagcagagagaggccugcagaagagccugcugcuucgccagaguggagcccagccacaagagcaagaucguggaguaccugcagagcuacgacgagaucaccgccaugaccggcgacggcgugaacgacgcccccgcccugaagaaggccgagaucggcaucgccaugggcagcggcaccgccguggccaagaccgccagcgagauggugcuggccgacgacaacuucagcaccaucguggccgccguggaggagggcagagccaucuacaacaacaugaagcaguucaucagauaccugaucagcagcaacgugggcgagguggugugcaucuuccugaccgccgcccugggccugcccgaggcccugauccccgugcagcugcugugggugaaccuggugaccgacggccugcccgccaccgcccugggcuucaacccccccgaccuggacaucauggacagaccccccagaagccccaaggagccccugaucagcggcuggcuguucuucagauacauggccaucggcggcuacgugggcgccgccaccgugggcgccgccgccuggugguuccuguacgccgaggacggcccccacgugaacuacagccagcugacccacuucaugcagugcaccgaggacaacacccacuucgagggcaucgacugcgagguguucgaggcccccgagcccaugaccauggcccugagcgugcuggugaccaucgagaugugcaacgcccugaacagccugagcgagaaccagagccugcugagaaugccccccugggugaacaucuggcugcugggcagcaucugccugagcaugagccugcacuuccugauccuguacguggacccccugcccaugaucuucaagcugagagcccuggaccugacccaguggcugauggugcugaagaucagccugcccgugaucggccuggacgagauccugaaguucguggccagaaacuaccuggagggcuaa

SEQ ID NO: 13977 - RNA, 2994 nt, Artificial Sequence
  ATP2A2__Homo_sapiens__NP_001672
auggagaacgcccacaccaagaccguggaggaggugcugggccacuucggcgugaacgagagcaccggccugagccuggagcaggugaagaagcugaaggagagauggggcagcaacgagcugcccgccgaggagggcaagacccugcuggagcuggugaucgagcaguucgaggaccugcuggugagaauccugcugcuggccgccugcaucagcuucgugcuggccugguucgaggagggcgaggagaccaucaccgccuucguggagcccuucgugauccugcugauccugguggccaacgccaucgugggcguguggcaggagagaaacgccgagaacgccaucgaggcccugaaggaguacgagcccgagaugggcaagguguacagacaggacagaaagagcgugcagagaaucaaggccaaggacaucgugcccggcgacaucguggagaucgccgugggcgacaaggugcccgccgacaucagacugaccagcaucaagagcaccacccugagaguggaccagagcauccugaccggcgagagcgugagcgugaucaagcacaccgaccccgugcccgaccccagagccgugaaccaggacaagaagaacaugcuguucagcggcaccaacaucgccgccggcaaggccaugggcguggugguggccaccggcgugaacaccgagaucggcaagaucagagacgagaugguggccaccgagcaggagagaaccccccugcagcagaagcuggacgaguucggcgagcagcugagcaaggugaucagccugaucugcaucgccguguggaucaucaacaucggccacuucaacgaccccgugcacggcggcagcuggaucagaggcgccaucuacuacuucaagaucgccguggcccuggccguggccgccauccccgagggccugcccgccgugaucaccaccugccuggcccugggcaccagaagaauggccaagaagaacgccaucgugagaagccugcccagcguggagacccugggcugcaccagcgugaucugcagcgacaagaccggcacccugaccaccaaccagaugagcgugugcagaauguucauccuggacagaguggagggcgacaccugcagccugaacgaguucaccaucaccggcagcaccuacgcccccaucggcgaggugcacaaggacgacaagcccgugaacugccaccaguacgacggccugguggagcuggccaccaucugcgcccugugcaacgacagcgcccuggacuacaacgaggccaagggcguguacgagaaggugggcgaggccaccgagaccgcccugaccugccugguggagaagaugaacguguucgacaccgagcugaagggccugagcaagaucgagagagccaacgccugcaacagcgugaucaagcagcugaugaagaaggaguucacccuggaguucagcagagacagaaagagcaugagcguguacugcacccccaacaagcccagcagaaccagcaugagcaagauguucgugaagggcgcccccgagggcgugaucgacagaugcacccacaucagagugggcagcaccaaggugcccaugaccagcggcgugaagcagaagaucaugagcgugaucagagaguggggcagcggcagcgacacccugagaugccuggcccuggccacccacgacaacccccugagaagagaggagaugcaccuggaggacagcgccaacuucaucaaguacgagaccaaccugaccuucgugggcugcgugggcaugcuggacccccccagaaucgagguggccagcagcgugaagcugugcagacaggccggcaucagagugaucaugaucaccggcgacaacaagggcaccgccguggccaucugcagaagaaucggcaucuucggccaggacgaggacgugaccagcaaggccuucaccggcagagaguucgacgagcugaaccccagcgcccagagagacgccugccugaacgccagaugcuucgccagaguggagcccagccacaagagcaagaucguggaguuccugcagagcuucgacgagaucaccgccaugaccggcgacggcgugaacgacgcccccgcccugaagaaggccgagaucggcaucgccaugggcagcggcaccgccguggccaagaccgccagcgagauggugcuggccgacgacaacuucagcaccaucguggccgccguggaggagggcagagccaucuacaacaacaugaagcaguucaucagauaccugaucagcagcaacgugggcgagguggugugcaucuuccugaccgccgcccugggcuuccccgaggcccugauccccgugcagcugcugugggugaaccuggugaccgacggccugcccgccaccgcccugggcuucaacccccccgaccuggacaucaugaacaagccccccagaaaccccaaggagccccugaucagcggcuggcuguucuucagauaccuggccaucggcugcuacgugggcgccgccaccgugggcgccgccgccuggugguucaucgccgccgacggcggccccagagugagcuucuaccagcugagccacuuccugcagugcaaggaggacaaccccgacuucgagggcguggacugcgccaucuucgagagccccuaccccaugaccauggcccugagcgugcuggugaccaucgagaugugcaacgcccugaacagccugagcgagaaccagagccugcugagaaugccccccugggagaacaucuggcuggugggcagcaucugccugagcaugagccugcacuuccugauccuguacguggagccccugccccugaucuuccagaucaccccccugaacgugacccaguggcugauggugcugaagaucagccugcccgugauccugauggacgagacccugaaguucguggccagaaacuaccuggagcccgccauccuggaguaa

SEQ ID NO: 13978 - RNA, 3159 nt, Artificial Sequence
  ATP2A3__Homo_sapiens__NP_777613
auggaggccgcccaccugcugcccgccgccgacgugcugagacacuucagcgugaccgccgagggcggccugagccccgcccaggugaccggcgccagagagagauacggccccaacgagcugcccagcgaggagggcaagagccugugggagcuggugcuggagcaguucgaggaccugcuggugagaauccugcugcuggccgcccuggugagcuucgugcuggccugguucgaggagggcgaggagaccaccaccgccuucguggagccccuggugaucaugcugauccugguggccaacgccaucgugggcguguggcaggagagaaacgccgagagcgccaucgaggcccugaaggaguacgagcccgagaugggcaaggugaucagaagcgacagaaagggcgugcagagaaucagagccagagacaucgugcccggcgacaucguggagguggccgugggcgacaaggugcccgccgaccugagacugaucgagaucaagagcaccacccugagaguggaccagagcauccugaccggcgagagcgugagcgugaccaagcacaccgaggccauccccgaccccagagccgugaaccaggacaagaagaacaugcuguucagcggcaccaacaucaccagcggcaaggccgugggcguggccguggccaccggccugcacaccgagcugggcaagaucagaagccagauggccgccguggagcccgagagaaccccccugcagagaaagcuggacgaguucggcagacagcugagccacgccaucagcgugaucugcguggccgugugggugaucaacaucggccacuucgccgaccccgcccacggcggcagcuggcugagaggcgccguguacuacuucaagaucgccguggcccuggccguggccgccauccccgagggccugcccgccgugaucaccaccugccuggcccugggcaccagaagaauggccagaaagaacgccaucgugagaagccugcccagcguggagacccugggcugcaccagcgugaucugcagcgacaagaccggcacccugaccaccaaccagaugagcgugugcagaauguucgugguggccgaggccgacgccggcagcugccugcugcacgaguucaccaucagcggcaccaccuacacccccgagggcgaggugagacagggcgaccagcccgugagaugcggccaguucgacggccugguggagcuggccaccaucugcgcccugugcaacgacagcgcccuggacuacaacgaggccaagggcguguacgagaaggugggcgaggccaccgagaccgcccugaccugccugguggagaagaugaacguguucgacaccgaccugcaggcccugagcagaguggagagagccggcgccugcaacaccgugaucaagcagcugaugagaaaggaguucacccuggaguucagcagagacagaaagagcaugagcguguacugcacccccaccagaccccaccccaccggccagggcagcaagauguucgugaagggcgcccccgagagcgugaucgagagaugcagcagcgugagagugggcagcagaaccgccccccugacccccaccagcagagagcagauccuggccaagaucagagacuggggcagcggcagcgacacccugagaugccuggcccuggccaccagagacgccccccccagaaaggaggacauggagcuggacgacugcagcaaguucgugcaguacgagaccgaccugaccuucgugggcugcgugggcaugcuggacccccccagacccgagguggccgccugcaucaccagaugcuaccaggccggcaucagaguggugaugaucaccggcgacaacaagggcaccgccguggccaucugcagaagacugggcaucuucggcgacaccgaggacguggccggcaaggccuacaccggcagagaguucgacgaccugagccccgagcagcagagacaggccugcagaaccgccagaugcuucgccagaguggagcccgcccacaagagcagaaucguggagaaccugcagagcuucaacgagaucaccgccaugaccggcgacggcgugaacgacgcccccgcccugaagaaggccgagaucggcaucgccaugggcagcggcaccgccguggccaagagcgccgccgagauggugcugagcgacgacaacuucgccagcaucguggccgccguggaggagggcagagccaucuacagcaacaugaagcaguucaucagauaccugaucagcagcaacgugggcgagguggugugcaucuuccugaccgccauccugggccugcccgaggcccugauccccgugcagcugcugugggugaaccuggugaccgacggccugcccgccaccgcccugggcuucaacccccccgaccuggacaucauggagaagcugcccagaagccccagagaggcccugaucagcggcuggcuguucuucagauaccuggccaucggcguguacgugggccuggccaccguggccgccgccaccuggugguucguguacgacgccgagggcccccacaucaacuucuaccagcugagaaacuuccugaagugcagcgaggacaacccccuguucgccggcaucgacugcgagguguucgagagcagauuccccaccaccauggcccugagcgugcuggugaccaucgagaugugcaacgcccugaacagcgugagcgagaaccagagccugcugagaaugccccccuggaugaaccccuggcugcugguggccguggccaugagcauggcccugcacuuccugauccugcuggugcccccccugccccugaucuuccaggugaccccccugagcggcagacagugggugguggugcugcagaucagccugcccgugauccugcuggacgaggcccugaaguaccugagcagaaaccacaugcacgccugccuguaccccggccugcugagaaccgugagccaggccuggagcagacagccccugaccaccagcuggacccccgaccacaccggccuggccagccugggccagggccacagcaucgugagccugagcgagcugcugagagagggcggcagcagagaggagaugagccagaaguaa

SEQ ID NO: 13979 - RNA, 3663 nt, Artificial Sequence
  ATP2B1__Homo_sapiens__XP_011536710
augggcgacauggccaacaacagcguggccuacagcggcgugaagaacagccugaaggaggccaaccacgacggcgacuucggcaucacccuggccgagcugagagcccugauggagcugagaagcaccgacgcccugagaaagauccaggagagcuacggcgacguguacggcaucugcaccaagcugaagaccagccccaacgagggccugagcggcaaccccgccgaccuggagagaagagaggccguguucggcaagaacuucaucccccccaagaagcccaagaccuuccugcagcuggugugggaggcccugcaggacgugacccugaucauccuggagaucgccgccaucgugagccugggccugagcuucuaccagccccccgagggcgacaacgcccugugcggcgaggugagcgugggcgaggaggagggcgagggcgagaccggcuggaucgagggcgccgccauccugcugagcguggugugcguggugcuggugaccgccuucaacgacuggagcaaggagaagcaguucagaggccugcagagcagaaucgagcaggagcagaaguucaccgugaucagaggcggccaggugauccagauccccguggccgacaucaccgugggcgacaucgcccaggugaaguacggcgaccugcugcccgccgacggcauccugauccagggcaacgaccugaagaucgacgagagcagccugaccggcgagagcgaccacgugaagaagagccuggacaaggacccccugcugcugagcggcacccacgugauggagggcagcggcagaaugguggugaccgccgugggcgugaacagccagaccggcaucaucuucacccugcugggcgccggcggcgaggaggaggagaagaaggacgagaagaagaaggagaagaagaacaagaagcaggacggcgccaucgagaacagaaacaaggccaaggcccaggacggcgccgccauggagaugcagccccugaagagcgaggagggcggcgacggcgacgagaaggacaagaagaaggccaaccugcccaagaaggagaagagcgugcugcagggcaagcugaccaagcuggccgugcagaucggcaaggccggccugcugaugagcgccaucaccgugaucauccuggugcuguacuucgugaucgacaccuucugggugcagaagagacccuggcuggccgagugcacccccaucuacauccaguacuucgugaaguucuucaucaucggcgugaccgugcuggugguggccgugcccgagggccugccccuggccgugaccaucagccuggccuacagcgugaagaagaugaugaaggacaacaaccuggugagacaccuggacgccugcgagaccaugggcaacgccaccgccaucugcagcgacaagaccggcacccugaccaugaacagaaugaccguggugcaggccuacaucaacgagaagcacuacaagaaggugcccgagcccgaggccaucccccccaacauccugagcuaccuggugaccggcaucagcgugaacugcgccuacaccagcaagauccugccccccgagaaggagggcggccugcccagacacgugggcaacaagaccgagugcgcccugcugggccugcugcuggaccugaagagagacuaccaggacgugagaaacgagauccccgaggaggcccuguacaagguguacaccuucaacagcgugagaaagagcaugagcaccgugcugaagaacagcgacggcagcuacagaaucuucagcaagggcgccagcgagaucauccugaagaagugcuucaagauccugagcgccaacggcgaggccaagguguucagacccagagacagagacgacaucgugaagaccgugaucgagcccauggccagcgagggccugagaaccaucugccuggccuucagagacuuccccgccggcgagcccgagcccgagugggacaacgagaacgacaucgugaccggccugaccugcaucgccguggugggcaucgaggaccccgugagacccgaggugcccgacgccaucaagaagugccagagagccggcaucaccgugagaauggugaccggcgacaacaucaacaccgccagagccaucgccaccaagugcggcauccugcaccccggcgaggacuuccugugccuggagggcaaggacuucaacagaagaaucagaaacgagaagggcgagaucgagcaggagagaaucgacaagaucuggcccaagcugagagugcuggccagaagcagccccaccgacaagcacacccuggugaagggcaucaucgacagcaccgugagcgaccagagacaggugguggccgugaccggcgacggcaccaacgacggccccgcccugaagaaggccgacgugggcuucgccaugggcaucgccggcaccgacguggccaaggaggccagcgacaucauccugaccgacgacaacuucaccagcaucgugaaggccgugauguggggcagaaacguguacgacagcaucagcaaguuccugcaguuccagcugaccgugaacgugguggccgugaucguggccuucaccggcgccugcaucacccaggacagcccccugaaggccgugcagaugcugugggugaaccugaucauggacacccuggccagccuggcccuggccaccgagccccccaccgagagccugcugcugagaaagcccuacggcagaaacaagccccugaucagcagaaccaugaugaagaacauccugggccacgccuucuaccagcugguggugguguucacccugcuguucgccggcgagaaguucuucgacaucgacagcggcagaaacgccccccugcacgccccccccagcgagcacuacaccaucguguucaacaccuucgugcugaugcagcuguucaacgagaucaacgccagaaagauccacggcgagagaaacguguucgagggcaucuucaacaacgccaucuucugcaccaucgugcugggcaccuucguggugcagaucaucaucgugcaguucggcggcaagcccuucagcugcagcgagcugagcaucgagcaguggcuguggagcaucuuccugggcaugggcacccugcuguggggccagcugaucagcaccauccccaccagcagacugaaguuccugaaggaggccggccacggcacccagaaggaggagauccccgaggaggagcuggccgaggacguggaggagaucgaccacgccgagagagagcugagaagaggccagauccugugguucagaggccugaacagaauccagacccagaucagaguggugaacgccuucagaagcagccuguacgagggccuggagaagcccgagagcagaagcagcauccacaacuucaugacccaccccgaguucagaaucgaggacagcgagccccacaucccccugaucgacgacaccgacgccgaggacgacgcccccaccaagagaaacagcagccccccccccagccccaacaagaacaacaacgccguggacagcggcauccaccugaccaucgagaugaacaagagcgccaccagcagcagccccggcagcccccugcacagccuggagaccagccuguaa

SEQ ID NO: 13980 - RNA, 3732 nt, Artificial Sequence
  ATP2B2__Homo_sapiens__NP_001001331
augggcgacaugaccaacagcgacuucuacagcaagaaccagagaaacgagagcagccacggcggcgaguucggcugcaccauggaggagcugagaagccugauggagcugagaggcaccgaggccguggugaagaucaaggagaccuacggcgacaccgaggccaucugcagaagacugaagaccagccccguggagggccugcccggcaccgcccccgaccuggagaagagaaagcagaucuucggccagaacuucaucccccccaagaagcccaagaccuuccugcagcuggugugggaggcccugcaggacgugacccugaucauccuggagaucgccgccaucaucagccugggccugagcuucuaccacccccccggcgagggcaacgagggcugcgccaccgcccagggcggcgccgaggacgagggcgaggccgaggccggcuggaucgagggcgccgccauccugcugagcgugaucugcguggugcuggugaccgccuucaacgacuggagcaaggagaagcaguucagaggccugcagagcagaaucgagcaggagcagaaguucaccguggugagagccggccagguggugcagauccccguggccgagaucguggugggcgacaucgcccaggugaaguacggcgaccugcugcccgccgacggccuguucauccagggcaacgaccugaagaucgacgagagcagccugaccggcgagagcgaccaggugagaaagagcguggacaaggaccccaugcugcugagcggcacccacgugauggagggcagcggcagaaugcuggugaccgccgugggcgugaacagccagaccggcaucaucuucacccugcugggcgccggcggcgaggaggaggagaagaaggacaagaagggcgugaagaagggcgacggccugcagcugcccgccgccgacggcgccgccgccagcaacgccgccgacagcgccaacgccagccuggugaacggcaagaugcaggacggcaacguggacgccagccagagcaaggccaagcagcaggacggcgccgccgccauggagaugcagccccugaagagcgccgagggcggcgacgccgacgacagaaagaaggccagcaugcacaagaaggagaagagcgugcugcagggcaagcugaccaagcuggccgugcagaucggcaaggccggccuggugaugagcgccaucaccgugaucauccuggugcuguacuucaccguggacaccuucguggugaacaagaagcccuggcugcccgagugcacccccguguacgugcaguacuucgugaaguucuucaucaucggcgugaccgugcuggugguggccgugcccgagggccugccccuggccgugaccaucagccuggccuacagcgugaagaagaugaugaaggacaacaaccuggugagacaccuggacgccugcgagaccaugggcaacgccaccgccaucugcagcgacaagaccggcacccugaccaccaacagaaugaccguggugcaggccuacgugggcgacgugcacuacaaggagauccccgaccccagcagcaucaacaccaagaccauggagcugcugaucaacgccaucgccaucaacagcgccuacaccaccaagauccugccccccgagaaggagggcgcccugcccagacaggugggcaacaagaccgagugcggccugcugggcuucgugcuggaccugaagcaggacuacgagcccgugagaagccagaugcccgaggagaagcuguacaagguguacaccuucaacagcgugagaaagagcaugagcaccgugaucaagcugcccgacgagagcuucagaauguacagcaagggcgccagcgagaucgugcugaagaagugcugcaagauccugaacggcgccggcgagcccagaguguucagacccagagacagagacgagauggugaagaaggugaucgagcccauggccugcgacggccugagaaccaucugcguggccuacagagacuuccccagcagccccgagcccgacugggacaacgagaacgacauccugaacgagcugaccugcaucugcguggugggcaucgaggaccccgugagacccgaggugcccgaggccaucagaaagugccagagagccggcaucaccgugagaauggugaccggcgacaacaucaacaccgccagagccaucgccaucaagugcggcaucauccaccccggcgaggacuuccugugccuggagggcaaggaguucaacagaagaaucagaaacgagaagggcgagaucgagcaggagagaaucgacaagaucuggcccaagcugagagugcuggccagaagcagccccaccgacaagcacacccuggugaagggcaucaucgacagcacccacaccgagcagagacaggugguggccgugaccggcgacggcaccaacgacggccccgcccugaagaaggccgacgugggcuucgccaugggcaucgccggcaccgacguggccaaggaggccagcgacaucauccugaccgacgacaacuucagcagcaucgugaaggccgugauguggggcagaaacguguacgacagcaucagcaaguuccugcaguuccagcugaccgugaacgugguggccgugaucguggccuucaccggcgccugcaucacccaggacagcccccugaaggccgugcagaugcugugggugaaccugaucauggacaccuucgccagccuggcccuggccaccgagccccccaccgagacccugcugcugagaaagcccuacggcagaaacaagccccugaucagcagaaccaugaugaagaacauccugggccacgccguguaccagcuggcccugaucuucacccugcuguucgugggcgagaagauguuccagaucgacagcggcagaaacgccccccugcacagcccccccagcgagcacuacaccaucaucuucaacaccuucgugaugaugcagcuguucaacgagaucaacgccagaaagauccacggcgagagaaacguguucgacggcaucuucagaaaccccaucuucugcaccaucgugcugggcaccuucgccauccagaucgugaucgugcaguucggcggcaagcccuucagcugcagcccccugcagcuggaccaguggauguggugcaucuucaucggccugggcgagcugguguggggccaggugaucgccaccauccccaccagcagacugaaguuccugaaggaggccggcagacugacccagaaggaggagauccccgaggaggagcugaacgaggacguggaggagaucgaccacgccgagagagagcugagaagaggccagauccugugguucagaggccugaacagaauccagacccagaucagaguggugaaggccuucagaagcagccuguacgagggccuggagaagcccgagagcagaaccagcauccacaacuucauggcccaccccgaguucagaaucgaggacagccagccccacaucccccugaucgacgacaccgaccuggaggaggacgccgcccugaagcagaacagcagcccccccagcagccugaacaagaacaacagcgccaucgacagcggcaucaaccugaccaccgacaccagcaagagcgccaccagcagcagccccggcagccccauccacagccuggagaccagccuguaa

SEQ ID NO: 13981 - RNA, 3663 nt, Artificial Sequence
  ATP2B3__Homo_sapiens__XP_005274747
augggcgacauggccaacagcagcaucgaguuccaccccaagccccagcagcagagagacgugccccaggccggcggcuucggcugcacccuggccgagcugagaacccugauggagcugagaggcgccgaggcccugcagaagaucgaggaggccuacggcgacgugagcggccugugcagaagacugaagaccagccccaccgagggccuggccgacaacaccaacgaccuggagaagagaagacagaucuacggccagaacuucaucccccccaagcagcccaagaccuuccugcagcuggugugggaggcccugcaggacgugacccugaucauccuggagguggccgccaucgugagccugggccugagcuucuacgccccccccggcgaggagagcgaggccugcggcaacgugagcggcggcgccgaggacgagggcgaggccgaggccggcuggaucgagggcgccgccauccugcugagcgugaucugcguggugcuggugaccgccuucaacgacuggagcaaggagaagcaguucagaggccugcagagcagaaucgagcaggagcagaaguucaccgugaucagaaacggccagcugcugcaggugcccguggccgcccugguggugggcgacaucgcccaggugaaguacggcgaccugcugcccgccgacggcgugcugauccaggccaacgaccugaagaucgacgagagcagccugaccggcgagagcgaccacgugagaaagagcgccgacaaggaccccaugcugcugagcggcacccacgugauggagggcagcggcagaaugguggugaccgccgugggcgugaacagccagaccggcaucaucuucacccugcugggcgccggcggcgaggaggaggagaagaaggacaagaagggcaagcagcaggacggcgccauggagagcagccagaccaaggccaagaagcaggacggcgccguggccauggagaugcagccccugaagagcgccgagggcggcgagauggaggagagagagaagaagaaggccaacgcccccaagaaggagaagagcgugcugcagggcaagcugaccaagcuggccgugcagaucggcaaggccggccuggugaugagcgccaucaccgugaucauccuggugcuguacuucgugaucgagaccuucgugguggagggcagaaccuggcuggccgagugcacccccguguacgugcaguacuucgugaaguucuucaucaucggcgugaccgugcuggugguggccgugcccgagggccugccccuggccgugaccaucagccuggccuacagcgugaagaagaugaugaaggacaacaaccuggugagacaccuggacgccugcgagaccaugggcaacgccaccgccaucugcagcgacaagaccggcacccugaccaccaacagaaugaccguggugcagagcuaccugggcgacacccacuacaaggagauccccgcccccagcgcccugacccccaagauccuggaccugcuggugcacgccaucagcaucaacagcgccuacaccaccaagauccugccccccgagaaggagggcgcccugcccagacaggugggcaacaagaccgagugcgcccugcugggcuucgugcuggaccugaagagagacuuccagcccgugagagagcagauccccgaggacaagcuguacaagguguacaccuucaacagcgugagaaagagcaugagcaccgugaucagaaugcccgacggcggcuucagacuguucagcaagggcgccagcgagauccugcugaagaagugcaccaacauccugaacagcaacggcgagcugagaggcuucagacccagagacagagacgacauggugagaaagaucaucgagcccauggccugcgacggccugagaaccaucugcaucgccuacagagacuucagcgccggccaggagcccgacugggacaacgagaacgagguggugggcgaccugaccugcaucgccguggugggcaucgaggaccccgugagacccgaggugcccgaggccaucagaaagugccagagagccggcaucaccgugagaauggugaccggcgacaacaucaacaccgccagagccaucgccgccaagugcggcaucauccagcccggcgaggacuuccugugccuggagggcaaggaguucaacagaagaaucagaaacgagaagggcgagaucgagcaggagagacuggacaagguguggcccaagcugagagugcuggccagaagcagccccaccgacaagcacacccuggugaagggcaucaucgacagcaccaccggcgagcagagacaggugguggccgugaccggcgacggcaccaacgacggccccgcccugaagaaggccgacgugggcuucgccaugggcaucgccggcaccgacguggccaaggaggccagcgacaucauccugaccgacgacaacuucaccagcaucgugaaggccgugauguggggcagaaacguguacgacagcaucagcaaguuccugcaguuccagcugaccgugaacgugguggccgugaucguggccuucaccggcgccugcaucacccaggacagcccccugaaggccgugcagaugcugugggugaaccugaucauggacaccuucgccagccuggcccuggccaccgagccccccaccgagagccugcugcugagaaagcccuacggcagagacaagccccugaucagcagaaccaugaugaagaacauccugggccacgccguguaccagcuggccaucaucuucacccugcuguucgugggcgagcuguucuucgacaucgacagcggcagaaacgccccccugcacagcccccccagcgagcacuacaccaucaucuucaacaccuucgugaugaugcagcuguucaacgagaucaacgccagaaagauccacggcgagagaaacguguucgacggcaucuucagcaaccccaucuucugcaccaucgugcugggcaccuucggcauccagaucgugaucgugcaguucggcggcaagcccuucagcugcagcccccugagcaccgagcaguggcuguggugccuguucgugggcgugggcgagcugguguggggccaggugaucgccaccauccccaccagccagcugaagugccugaaggaggccggccacggccccggcaaggacgagaugaccgacgaggagcuggccgagggcgaggaggagaucgaccacgccgagagagagcugagaagaggccagauccugugguucagaggccugaacagaauccagacccagaucagaguggugaaggccuucagaagcagccuguacgagggccuggagaagcccgagagcaagaccagcauccacaacuucauggccacccccgaguuccugaucaacgacuacacccacaacaucccccugaucgacgacaccgacguggacgagaacgaggagagacugagagccccccccccccccagccccaaccagaacaacaacgccaucgacagcggcaucuaccugaccacccacgugaccaagagcgccaccagcagcguguucagcagcagccccggcagcccccugcacagcguggagaccagccuguaa

SEQ ID NO: 13982 - RNA, 3513 nt, Artificial Sequence
  ATP2B4__Homo_sapiens__NP_001001396
augaccaaccccagcgacagagugcugcccgccaacagcauggccgagagcagagagggcgacuucggcugcaccgugauggagcugagaaagcugauggagcugagaagcagagacgcccugacccagaucaacgugcacuacggcggcgugcagaaccugugcagcagacugaagaccagccccguggagggccugagcggcaaccccgccgaccuggagaagagaagacagguguucggccacaacgugaucccccccaagaagcccaagaccuuccuggagcuggugugggaggcccugcaggacgugacccugaucauccuggagaucgccgccaucaucagccuggugcugagcuucuacagacccgccggcgaggagaacgagcugugcggccagguggccaccacccccgaggacgagaacgaggcccaggccggcuggaucgagggcgccgccauccuguucagcgugaucaucguggugcuggugaccgccuucaacgacuggagcaaggagaagcaguucagaggccugcagugcagaaucgagcaggagcagaaguucagcaucaucagaaacggccagcugauccagcugcccguggccgagaucguggugggcgacaucgcccaggugaaguacggcgaccugcugcccgccgacggcauccugauccagggcaacgaccugaagaucgacgagagcagccugaccggcgagagcgaccacgugaagaagagccuggacaaggaccccaugcugcugagcggcacccacgugauggagggcagcggcagaaugguggugaccgccgugggcgugaacagccagaccggcaucauccugacccugcugggcgugaacgaggacgacgagggcgagaagaagaagaagggcaagaagcagggcgugcccgagaacagaaacaaggccaagacccaggacggcguggcccuggagauccagccccugaacagccaggagggcaucgacaacgaggagaaggacaagaaggccgugaaggugcccaagaaggagaagagcgugcugcagggcaagcugaccagacuggccgugcagaucggcaaggccggccugcugaugagcgcccugaccguguucauccugauccuguacuucgugaucgacaacuucgugaucaacagaagacccuggcugcccgagugcacccccaucuacauccaguacuucgugaaguucuucaucaucggcaucaccgugcuggugguggccgugcccgagggccugccccuggccgugaccaucagccuggccuacagcgugaagaagaugaugaaggacaacaaccuggugagacaccuggacgccugcgagaccaugggcaacgccaccgccaucugcagcgacaagaccggcacccugaccaugaacagaaugaccguggugcaggccuacaucggcggcauccacuacagacagauccccagccccgacguguuccugcccaaggugcuggaccugaucgugaacggcaucagcaucaacagcgccuacaccagcaagauccugccccccgagaaggagggcggccugcccagacaggugggcaacaagaccgagugcgcccugcugggcuucgugaccgaccugaagcaggacuaccaggccgugagaaacgaggugcccgaggagaagcuguacaagguguacaccuucaacagcgugagaaagagcaugagcaccgugaucagaaaccccaacggcggcuucagaauguacagcaagggcgccagcgagaucauccugagaaagugcaacagaauccuggacagaaagggcgaggccgugcccuucaagaacaaggacagagacgacauggugagaaccgugaucgagcccauggccugcgacggccugagaaccaucugcaucgccuacagagacuucgacgacaccgagcccagcugggacaacgagaacgagauccugaccgagcugaccugcaucgccguggugggcaucgaggaccccgugagacccgaggugcccgacgccaucgccaagugcaagcaggccggcaucaccgugagaauggugaccggcgacaacaucaacaccgccagagccaucgccaccaagugcggcauccugacccccggcgacgacuuccugugccuggagggcaaggaguucaacagacugaucagaaacgagaagggcgagguggagcaggagaagcuggacaagaucuggcccaagcugagagugcuggccagaagcagccccaccgacaagcacacccuggugaagggcaucaucgacagcaccgugggcgagcacagacaggugguggccgugaccggcgacggcaccaacgacggccccgcccugaagaaggccgacgugggcuucgccaugggcaucgccggcaccgacguggccaaggaggccagcgacaucauccugaccgacgacaacuucaccagcaucgugaaggccgugauguggggcagaaacguguacgacagcaucagcaaguuccugcaguuccagcugaccgugaacgugguggccgugaucguggccuucaccggcgccugcaucacccaggacagcccccugaaggccgugcagaugcugugggugaaccugaucauggacaccuucgccagccuggcccuggccaccgagccccccaccgagagccugcugaagagaagacccuacggcagaaacaagccccugaucagcagaaccaugaugaagaacauccugggccacgccuucuaccagcugaucgugaucuucauccugguguucgccggcgagaaguucuucgacaucgacagcggcagaaaggccccccugcacagcccccccagccagcacuacaccaucguguucaacaccuucgugcugaugcagcuguucaacgagaucaacagcagaaagauccacggcgagaagaacguguucagcggcaucuacagaaacaucaucuucugcagcguggugcugggcaccuucaucugccagaucuucaucguggaguucggcggcaagcccuucagcugcaccagccugagccugagccaguggcuguggugccuguucaucggcaucggcgagcugcuguggggccaguucaucagcgccauccccaccagaagccugaaguuccugaaggaggccggccacggcaccaccaaggaggagaucaccaaggacgccgagggccuggacgagaucgaccacgccgagauggagcugagaagaggccagauccugugguucagaggccugaacagaauccagacccagaucgacgugaucaacaccuuccagaccggcgccagcuucaagggcgugcugagaagacagaacaugggccagcaccuggacgugaagcuggugcccagcagcagcuacguggccguggcccccgugaagagcagccccaccaccagcgugcccgccgugagcagcccccccaugggcaaccagagcggccagagcgugcccuaa

SEQ ID NO: 13983 - RNA, 2850 nt, Artificial Sequence
  ATP2C1__Homo_sapiens__NP_001001486
augaagguggccagauuccagaagauccccaacggcgagaacgagaccaugauccccgugcugaccagcaagaaggccagcgagcugcccgugagcgagguggccagcauccugcaggccgaccugcagaacggccugaacaagugcgaggugagccacagaagagccuuccacggcuggaacgaguucgacaucagcgaggacgagccccuguggaagaaguacaucagccaguucaagaacccccugaucaugcugcugcuggccagcgccgugaucagcgugcugaugcaccaguucgacgacgccgugagcaucaccguggccauccugaucguggugaccguggccuucgugcaggaguacagaagcgagaagagccuggaggagcugagcaagcuggugccccccgagugccacugcgugagagagggcaagcuggagcacacccuggccagagaccuggugcccggcgacaccgugugccugagcgugggcgacagagugcccgccgaccugagacuguucgaggccguggaccugagcaucgacgagagcagccugaccggcgagaccacccccugcagcaaggugaccgccccccagcccgccgccaccaacggcgaccuggccagcagaagcaacaucgccuucaugggcacccuggugagaugcggcaaggccaagggcguggugaucggcaccggcgagaacagcgaguucggcgagguguucaagaugaugcaggccgaggaggcccccaagaccccccugcagaagagcauggaccugcugggcaagcagcugagcuucuacagcuucggcaucaucggcaucaucaugcuggugggcuggcugcugggcaaggacauccuggagauguucaccaucagcgugagccuggccguggccgccauccccgagggccugcccaucguggugaccgugacccuggcccugggcgugaugagaauggugaagaagagagccaucgugaagaagcugcccaucguggagacccugggcugcugcaacgugaucugcagcgacaagaccggcacccugaccaagaacgagaugaccgugacccacaucuucaccagcgacggccugcacgccgaggugaccggcgugggcuacaaccaguucggcgaggugaucguggacggcgacguggugcacggcuucuacaaccccgccgugagcagaaucguggaggccggcugcgugugcaacgacgccgugaucagaaacaacacccugaugggcaagcccaccgagggcgcccugaucgcccuggccaugaagaugggccuggacggccugcagcaggacuacaucagaaaggccgaguaccccuucagcagcgagcagaaguggauggccgugaagugcgugcacagaacccagcaggacagacccgagaucugcuucaugaagggcgccuacgagcaggugaucaaguacugcaccaccuaccagagcaagggccagacccugacccugacccagcagcagagagacguguaccagcaggagaaggccagaaugggcagcgccggccugagagugcuggcccuggccagcggccccgagcugggccagcugaccuuccugggccuggugggcaucaucgacccccccagaaccggcgugaaggaggccgugaccacccugaucgccagcggcgugagcaucaagaugaucaccggcgacagccaggagaccgccguggccaucgccagcagacugggccuguacagcaagaccagccagagcgugagcggcgaggagaucgacgccauggacgugcagcagcugagccagaucgugcccaagguggccguguucuacagagccagccccagacacaagaugaagaucaucaagagccugcagaagaacggcagcgugguggccaugaccggcgacggcgugaacgacgccguggcccugaaggccgccgacaucggcguggccaugggccagaccggcaccgacgugugcaaggaggccgccgacaugauccugguggacgacgacuuccagaccaucaugagcgccaucgaggagggcaagggcaucuacaacaacaucaagaacuucgugagauuccagcugagcaccagcaucgccgcccugacccugaucagccuggccacccugaugaacuuccccaacccccugaacgccaugcagauccuguggaucaacaucaucauggacggcccccccgcccagagccugggcguggagcccguggacaaggacgugaucagaaagccccccagaaacuggaaggacagcauccugaccaagaaccugauccugaagauccuggugagcagcaucaucaucgugugcggcacccuguucguguucuggagagagcugagagacaacgugaucacccccagagacaccaccaugaccuucaccugcuucguguucuucgacauguucaacgcccugagcagcagaagccagaccaagagcguguucgagaucggccugugcagcaacagaauguucugcuacgccgugcugggcagcaucaugggccagcugcuggugaucuacuuccccccccugcagaagguguuccagaccgagagccugagcauccuggaccugcuguuccugcugggccugaccagcagcgugugcaucguggccgagaucaucaagaagguggagagaagcagagagaagauccagaagcacgugagcagcaccagcagcagcuuccuggagguguggcugugggagagaagcggccagcagcugguggagauccacccccaccuggagaccggccugccccugaccgaggacgugagcugcguguaa

SEQ ID NO: 13984 - RNA, 2928 nt, Artificial Sequence
  ATP2C2__Homo_sapiens__NP_001273456
augguggagggcagagugagcgaguuccugaagaagcugggcuucagcggcggcggcagacaguaccaggcccuggagaaggacgaggaggaggcccugaucgacgagcagagcgagcugaaggccaucgagaaggagaagaaggugaccgcccugccccccaaggaggccugcaagugccagaaggaggaccuggccagagccuucugcguggaccugcacaccggccugagcgaguucagcgugacccagagaagacuggcccacggcuggaacgaguucguggccgacaacagcgagcccguguggaagaaguaccuggaccaguucaagaacccccugauccugcugcugcugggcagcgcccuggugagcgugcugaccaaggaguacgaggacgccgugagcaucgccaccgccgugcuggugguggugaccguggccuucauccaggaguacagaagcgagaagagccuggaggagcugaccaagcuggugccccccgagugcaacugccugagagagggcaagcugcagcaccugcuggccagagagcuggugcccggcgacguggugagccugagcaucggcgacagaauccccgccgacaucagacugaccgaggugaccgaccugcugguggacgagagcagcuucaccggcgaggccgagcccugcagcaagaccgacagcccccugaccggcggcggcgaccugaccacccugagcaacaucguguucaugggcacccuggugcaguacggcagaggccagggcguggugaucggcaccggcgagagcagccaguucggcgagguguucaagaugaugcaggccgaggagacccccaagaccccccugcagaagagcauggacagacugggcaagcagcugacccuguucagcuucggcaucaucggccugaucaugcugaucggcuggagccagggcaagcagcugcugagcauguucaccaucggcgugagccuggccguggccgccauccccgagggccugcccaucguggugauggugacccuggugcugggcgugcugagaauggccaagaagagagugaucgugaagaagcugcccaucguggagacccugggcugcugcagcgugcugugcagcgacaagaccggcacccugaccgccaacgagaugaccgugacccagcuggugaccagcgacggccugagagccgaggugagcggcgugggcuacgacggccagggcaccgugugccugcugcccagcaaggaggugaucaaggaguucagcaacgugagcgugggcaagcugguggaggccggcugcguggccaacaacgccgugaucagaaagaacgccgugaugggccagcccaccgagggcgcccugauggcccuggccaugaagauggaccugagcgacaucaagaacagcuacaucagaaagaaggagauccccuucagcagcgagcagaaguggauggccgugaagugcagccugaagaccgaggaccaggaggacaucuacuucaugaagggcgcccuggaggaggugaucagauacugcaccauguacaacaacggcggcaucccccugccccugaccccccagcagagaagcuucugccugcaggaggagaagagaaugggcagccugggccugagagugcuggcccuggccagcggccccgagcugggcagacugaccuuccugggccuggugggcaucaucgacccccccagagugggcgugaaggaggccgugcaggugcugagcgagagcggcgugagcgugaagaugaucaccggcgacgcccuggagaccgcccuggccaucggcagaaacaucggccugugcaacggcaagcugcaggccaugagcggcgaggagguggacagcguggagaagggcgagcuggccgacagagugggcaaggugagcguguucuucagaaccagccccaagcacaagcugaagaucaucaaggcccugcaggagagcggcgccaucguggccaugaccggcgacggcgugaacgacgccguggcccugaagagcgccgacaucggcaucgccaugggccagaccggcaccgacgugagcaaggaggccgccaacaugauccugguggacgacgacuucagcgccaucaugaacgccguggaggagggcaagggcaucuucuacaacaucaagaacuucgugagauuccagcugagcaccagcaucagcgcccugagccugaucacccugagcaccguguucaaccugcccagcccccugaacgccaugcagauccuguggaucaacaucaucauggacggcccccccgcccagagaagcagccagaagaccgaggugugcugcaccgccgugagacugggcguggagggcagaggcgagagcaccugggccggcagagccggccugggcguggagcccguggacaaggacgccuucagacagccccccagaagcgugagagacaccauccugagcagagcccugauccugaagauccugaugagcgccgccaucaucaucagcggcacccuguucaucuucuggaaggagaugcccgaggacagagccagcacccccagaaccaccaccaugaccuucaccugcuucguguucuucgaccuguucaacgcccugaccugcagaagccagaccaagcugaucuucgagaucggcuuccugagaaaccacauguuccuguacagcgugcugggcagcauccugggccagcuggccgugaucuacauccccccccugcagagaguguuccagaccgagaaccugggcgcccuggaccugcuguuccugaccggccuggccagcagcguguucauccugagcgagcugcugaagcugugcgagaaguacugcugcagccccaagagagugcagaugcaccccgaggacguguaa

SEQ ID NO: 13985 - RNA, 3108 nt, Artificial Sequence
  ATP4A__Homo_sapiens__NP_000695
augggcaaggccgagaacuacgagcuguacagcguggagcugggccccggccccggcggcgacauggccgccaagaugagcaagaagaagaaggccggcggcggcggcggcaagagaaaggagaagcuggagaacaugaagaaggagauggagaucaacgaccaccagcugagcguggccgagcuggagcagaaguaccagaccagcgccaccaagggccugagcgccagccuggccgccgagcugcugcugagagacggccccaacgcccugagaccccccagaggcacccccgaguacgugaaguucgccagacagcuggccggcggccugcagugccugauguggguggccgccgccaucugccugaucgccuucgccauccaggccagcgagggcgaccugaccaccgacgacaaccuguaccuggccaucgcccugaucgccguggugguggugaccggcugcuucggcuacuaccaggaguucaagagcaccaacaucaucgccagcuucaagaaccuggugccccagcaggccaccgugaucagagacggcgacaaguuccagaucaacgccgaccagcugguggugggcgaccugguggagaugaagggcggcgacagagugcccgccgacaucagaauccuggccgcccagggcugcaagguggacaacagcagccugaccggcgagagcgagccccagaccagaagccccgagugcacccacgagagcccccuggagaccagaaacaucgccuucuucagcaccaugugccuggagggcaccgugcagggccugguggugaacaccggcgacagaaccaucaucggcagaaucgccagccuggccagcggcguggagaacgagaagacccccaucgccaucgagaucgagcacuucguggacaucaucgccggccuggccauccuguucggcgccaccuucuucaucguggccaugugcaucggcuacaccuuccugagagccaugguguucuucauggccaucgugguggccuacgugcccgagggccugcuggccaccgugaccgugugccugagccugaccgccaagagacuggccagcaagaacugcguggugaagaaccuggaggccguggagacccugggcagcaccagcgugaucugcagcgacaagaccggcacccugacccagaacagaaugaccgugagccaccugugguucgacaaccacauccacaccgccgacaccaccgaggaccagagcggccagaccuucgaccagagcagcgagaccuggagagcccugugcagagugcugacccugugcaacagagccgccuucaagagcggccaggacgccgugcccgugcccaagagaaucgugaucggcgacgccagcgagaccgcccugcugaaguucagcgagcugacccugggcaacgccaugggcuacagagacagauuccccaaggugugcgagauccccuucaacagcaccaacaaguuccagcugagcauccacacccuggaggaccccagagaccccagacaccugcuggugaugaagggcgcccccgagagagugcuggagagaugcagcagcauccugaucaagggccaggagcugccccuggacgagcaguggagagaggccuuccagaccgccuaccugagccugggcggccugggcgagagagugcugggcuucugccagcuguaccugaacgagaaggacuacccccccggcuacgccuucgacguggaggccaugaacuuccccagcagcggccugugcuucgccggccuggugagcaugaucgacccccccagagccaccgugcccgacgccgugcugaagugcagaaccgccggcaucagagugaucauggugaccggcgaccaccccaucaccgccaaggccaucgccgccagcgugggcaucaucagcgagggcagcgagaccguggaggacaucgccgccagacugagagugcccguggaccaggugaacagaaaggacgccagagccugcgugaucaacggcaugcagcugaaggacauggaccccagcgagcugguggaggcccugagaacccaccccgagaugguguucgccagaaccagcccccagcagaagcuggugaucguggagagcugccagagacugggcgccaucguggccgugaccggcgacggcgugaacgacagccccgcccugaagaaggccgacaucggcguggccaugggcaucgccggcagcgacgccgccaagaacgccgccgacaugauccugcuggacgacaacuucgccagcaucgugaccggcguggagcagggcagacugaucuucgacaaccugaagaagagcaucgccuacacccugaccaagaacauccccgagcugacccccuaccugaucuacaucaccgugagcgugccccugccccugggcugcaucaccauccuguucaucgagcugugcaccgacaucuuccccagcgugagccuggccuacgagaaggccgagagcgacaucaugcaccugagacccagaaaccccaagagagacagacuggugaacgagccccuggccgccuacagcuacuuccagaucggcgccauccagagcuucgccggcuucaccgacuacuucaccgccauggcccaggagggcugguucccccugcugugcgugggccugagagcccagugggaggaccaccaccugcaggaccugcaggacagcuacggccaggaguggaccuucggccagagacuguaccagcaguacaccugcuacaccguguucuucaucagcaucgaggugugccagaucgccgacgugcugaucagaaagaccagaagacugagcgccuuccagcagggcuucuucagaaacaagauccuggugaucgccaucguguuccaggugugcaucggcugcuuccugugcuacugccccggcaugcccaacaucuucaacuucaugcccaucagauuccagugguggcuggugccccugcccuacggcauccugaucuucguguacgacgagaucagaaagcugggcgugagaugcugccccggcagcuggugggaccaggagcuguacuacuaa

SEQ ID NO: 13986 - RNA, 876 nt, Artificial Sequence
  ATP4B__Homo_sapiens__NP_000696
auggccgcccugcaggagaagaagaccugcggccagagaauggaggaguuccagagauacugcuggaaccccgacaccggccagaugcugggcagaacccugagcagauggguguggaucagccuguacuacguggccuucuacguggugaugaccggccuguucgcccugugccuguacgugcugaugcagaccguggaccccuacacccccgacuaccaggaccagcugagaagccccggcgugacccugagacccgacguguacggcgagaagggccuggagaucguguacaacgugagcgacaacagaaccugggccgaccugacccagacccugcacgccuuccuggccggcuacagccccgccgcccaggaggacagcaucaacugcaccagcgagcaguacuucuuccaggagagcuucagagcccccaaccacaccaaguucagcugcaaguucaccgccgacaugcugcagaacugcagcggccuggccgaccccaacuucggcuucgaggagggcaagcccugcuucaucaucaagaugaacagaaucgugaaguuccugcccagcaacggcagcgcccccagaguggacugcgccuuccuggaccagcccagagagcugggccagccccugcaggugaaguacuacccccccaacggcaccuucagccugcacuacuuccccuacuacggcaagaaggcccagccccacuacagcaacccccugguggccgccaagcugcugaacauccccagaaacgccgagguggccaucgugugcaaggugauggccgagcacgugaccuucaacaacccccacgaccccuacgagggcaagguggaguucaagcugaagaucgagaaguaa

SEQ ID NO: 13987 - RNA, 1662 nt, Artificial Sequence
  ATP5A1__Homo_sapiens__NP_001001937
augcugagcgugagaguggccgccgccguggugagagcccugcccagaagagccggccuggugagcagaaacgcccugggcagcagcuucaucgccgccagaaacuuccacgccagcaacacccaccugcagaagaccggcaccgccgagaugagcagcauccuggaggagagaauccugggcgccgacaccagcguggaccuggaggagaccggcagagugcugagcaucggcgacggcaucgccagagugcacggccugagaaacgugcaggccgaggagaugguggaguucagcagcggccugaagggcaugagccugaaccuggagcccgacaacgugggcguggugguguucggcaacgacaagcugaucaaggagggcgacaucgugaagagaaccggcgccaucguggacgugcccgugggcgaggagcugcugggcagagugguggacgcccugggcaacgccaucgacggcaagggccccaucggcagcaagaccagaagaagagugggccugaaggcccccggcaucauccccagaaucagcgugagagagcccaugcagaccggcaucaaggccguggacagccuggugcccaucggcagaggccagagagagcugaucaucggcgacagacagaccggcaagaccagcaucgccaucgacaccaucaucaaccagaagagauucaacgacggcagcgacgagaagaagaagcuguacugcaucuacguggccaucggccagaagagaagcaccguggcccagcuggugaagagacugaccgacgccgacgccaugaaguacaccaucguggugagcgccaccgccagcgacgccgccccccugcaguaccuggcccccuacagcggcugcagcaugggcgaguacuucagagacaacggcaagcacgcccugaucaucuacgacgaccugagcaagcaggccguggccuacagacagaugagccugcugcugagaagaccccccggcagagaggccuaccccggcgacguguucuaccugcacagcagacugcuggagagagccgccaagaugaacgacgccuucggcggcggcagccugaccgcccugcccgugaucgagacccaggccggcgacgugagcgccuacauccccaccaacgugaucagcaucaccgacggccagaucuuccuggagaccgagcuguucuacaagggcaucagacccgccaucaacgugggccugagcgugagcagagugggcagcgccgcccagaccagagccaugaagcagguggccggcaccaugaagcuggagcuggcccaguacagagagguggccgccuucgcccaguucggcagcgaccuggacgccgccacccagcagcugcugagcagaggcgugagacugaccgagcugcugaagcagggccaguacagccccauggccaucgaggagcagguggccgugaucuacgccggcgugagaggcuaccuggacaagcuggagcccagcaagaucaccaaguucgagaacgccuuccugagccacguggugagccagcaccaggcccugcugggcaccaucagagccgacggcaagaucagcgagcagagcgacgccaagcugaaggagaucgugaccaacuuccuggccggcuucgaggccuaa

SEQ ID NO: 13988 - RNA, 1590 nt, Artificial Sequence
  ATP5B__Homo_sapiens__NP_001677
augcugggcuucgugggcagaguggccgccgcccccgccagcggcgcccugagaagacugacccccagcgccagccugccccccgcccagcugcugcugagagccgcccccaccgccgugcaccccgugagagacuacgccgcccagaccagccccagccccaaggccggcgccgccaccggcagaaucguggccgugaucggcgccgugguggacgugcaguucgacgagggccugccccccauccugaacgcccuggaggugcagggcagagagaccagacuggugcuggagguggcccagcaccugggcgagagcaccgugagaaccaucgccauggacggcaccgagggccuggugagaggccagaaggugcuggacagcggcgcccccaucaagauccccgugggccccgagacccugggcagaaucaugaacgugaucggcgagcccaucgacgagagaggccccaucaagaccaagcaguucgcccccauccacgccgaggcccccgaguucauggagaugagcguggagcaggagauccuggugaccggcaucaaggugguggaccugcuggcccccuacgccaagggcggcaagaucggccuguucggcggcgccggcgugggcaagaccgugcugaucauggagcugaucaacaacguggccaaggcccacggcggcuacagcguguucgccggcgugggcgagagaaccagagagggcaacgaccuguaccacgagaugaucgagagcggcgugaucaaccugaaggacgccaccagcaagguggcccugguguacggccagaugaacgagccccccggcgccagagccagaguggcccugaccggccugaccguggccgaguacuucagagaccaggagggccaggacgugcugcuguucaucgacaacaucuucagauucacccaggccggcagcgaggugagcgcccugcugggcagaauccccagcgccgugggcuaccagcccacccuggccaccgacaugggcaccaugcaggagagaaucaccaccaccaagaagggcagcaucaccagcgugcaggccaucuacgugcccgccgacgaccugaccgaccccgcccccgccaccaccuucgcccaccuggacgccaccaccgugcugagcagagccaucgccgagcugggcaucuaccccgccguggacccccuggacagcaccagcagaaucauggaccccaacaucgugggcagcgagcacuacgacguggccagaggcgugcagaagauccugcaggacuacaagagccugcaggacaucaucgccauccugggcauggacgagcugagcgaggaggacaagcugaccgugagcagagccagaaagauccagagauuccugagccagcccuuccagguggccgagguguucaccggccacaugggcaagcuggugccccugaaggagaccaucaagggcuuccagcagauccuggccggcgaguacgaccaccugcccgagcaggccuucuacauggugggccccaucgaggaggccguggccaaggccgacaagcuggccgaggagcacagcagcuaa

SEQ ID NO: 13989 - RNA, 897 nt, Artificial Sequence
  ATP5C1__Homo_sapiens__NP_001001973
auguucagcagagccggcguggccggccugagcgccuggacccugcagccccaguggauccaggugagaaacauggccacccugaaggacaucaccagaagacugaagagcaucaagaacauccagaagaucaccaagagcaugaagaugguggccgccgccaaguacgccagagccgagagagagcugaagcccgccagaaucuacggccugggcagccuggcccuguacgagaaggccgacaucaagggccccgaggacaagaagaagcaccugcugaucggcgugagcagcgacagaggccugugcggcgccauccacagcagcaucgccaagcagaugaagagcgagguggccacccugaccgccgccggcaaggaggugaugcuggugggcaucggcgacaagaucagaggcauccuguacagaacccacagcgaccaguuccugguggccuucaaggaggugggcagaaagccccccaccuucggcgacgccagcgugaucgcccuggagcugcugaacagcggcuacgaguucgacgagggcagcaucaucuucaacaaguucagaagcgugaucagcuacaagaccgaggagaagcccaucuucagccugaacaccguggccagcgccgacagcaugagcaucuacgacgacaucgacgccgacgugcugcagaacuaccaggaguacaaccuggccaacaucaucuacuacagccugaaggagagcaccaccagcgagcagagcgccagaaugaccgccauggacaacgccagcaagaacgccagcgagaugaucgacaagcugacccugaccuucaacagaaccagacaggccgugaucaccaaggagcugaucgagaucaucagcggcgccgccgcccuggacuaa

SEQ ID NO: 13990 - RNA, 507 nt, Artificial Sequence
  ATP5D__Homo_sapiens__NP_001001975
augcugcccgccgcccugcugagaagacccggccugggcagacuggugagacacgccagagccuacgccgaggccgccgccgcccccgccgccgccagcggccccaaccagaugagcuucaccuucgccagccccacccagguguucuucaacggcgccaacgugagacagguggacgugcccacccugaccggcgccuucggcauccuggccgcccacgugcccacccugcaggugcugagacccggccuggugguggugcacgccgaggacggcaccaccagcaaguacuucgugagcagcggcagcaucgccgugaacgccgacagcagcgugcagcugcuggccgaggaggccgugacccuggacaugcuggaccugggcgccgccaaggccaaccuggagaaggcccaggccgagcuggugggcaccgccgacgaggccaccagagccgagauccagaucagaaucgaggccaacgaggcccuggugaaggcccuggaguaa

SEQ ID NO: 13991 - RNA, 156 nt, Artificial Sequence
  ATP5E__Homo_sapiens__NP_008817
augguggccuacuggagacaggccggccugagcuacaucagauacagccagaucugcgccaaggccgugagagacgcccugaagaccgaguucaaggccaacgccgagaagaccagcggcagcaacgugaagaucgugaaggugaagaaggaguaa

SEQ ID NO: 13992 - RNA, 411 nt, Artificial Sequence
  ATP5G1__Homo_sapiens__NP_005166
augcagaccgccggcgcccuguucaucagccccgcccugaucagaugcugcaccagaggccugaucagacccgugagcgccagcuuccugaacagccccgugaacagcagcaagcagcccagcuacagcaacuucccccugcagguggccagaagagaguuccagaccagcguggugagcagagacaucgacaccgccgccaaguucaucggcgccggcgccgccaccgugggcguggccggcagcggcgccggcaucggcaccguguucggcagccugaucaucggcuacgccagaaaccccagccugaagcagcagcuguucagcuacgccauccugggcuucgcccugagcgaggccaugggccuguucugccugaugguggccuuccugauccuguucgccauguaa

SEQ ID NO: 13993 - RNA, 474 nt, Artificial Sequence
  ATP5G2__Homo_sapiens__NP_001002031
augcccgagcugauccugagccccgccaccgccccccacccccugaagauguucgccugcagcaaguucgugagcacccccagccuggugaagagcaccagccagcugcugagcagaccccugagcgccguggugcugaagagacccgagauccugaccgacgagagccugagcagccuggccgugagcugcccccugaccagccuggugagcagcagaagcuuccagaccagcgccaucagcagagacaucgacaccgccgccaaguucaucggcgccggcgccgccaccgugggcguggccggcagcggcgccggcaucggcaccguguucggcagccugaucaucggcuacgccagaaaccccagccugaagcagcagcuguucagcuacgccauccugggcuucgcccugagcgaggccaugggccuguucugccugaugguggccuuccugauccuguucgccauguaa

SEQ ID NO: 13994 - RNA, 429 nt, Artificial Sequence
  ATP5G3__Homo_sapiens__NP_001002258
auguucgccugcgccaagcuggccugcacccccagccugaucagagccggcagcagaguggccuacagacccaucagcgccagcgugcugagcagacccgaggccagcagaaccggcgagggcagcaccguguucaacggcgcccagaacggcgugagccagcugauccagagagaguuccagaccagcgccaucagcagagacaucgacaccgccgccaaguucaucggcgccggcgccgccaccgugggcguggccggcagcggcgccggcaucggcaccguguucggcagccugaucaucggcuacgccagaaaccccagccugaagcagcagcuguucagcuacgccauccugggcuucgcccugagcgaggccaugggccuguucugccugaugguggccuuccugauccuguucgccauguaa

SEQ ID NO: 13995 - RNA, 414 nt, Artificial Sequence
  ATP5H__Homo_sapiens__NP_001003785
auggccggcagaaagcuggcccugaagaccaucgacuggguggccuucgccgagaucaucccccagaaccagaaggccaucgccagcagccugaagagcuggaacgagacccugaccagcagacuggccgcccugcccgagaacccccccgccaucgacugggccuacuacaaggccaacguggccaaggccggccugguggacgacuucgagaagaaggugaagagcugcgccgagugggugagccugagcaaggccagaaucguggaguacgagaaggagauggagaagaugaagaaccugauccccuucgaccagaugaccaucgaggaccugaacgaggccuuccccgagaccaagcuggacaagaagaaguaccccuacuggccccaccagcccaucgagaaccuguaa

SEQ ID NO: 13996 - RNA, 267 nt, Artificial Sequence
  ATP5J2__Homo_sapiens__NP_001003713
auggccagcguggugcccgugaaggacaagaagcugcuggaggugaagcugggcgagcugcccagcuggauccugaugagagacuucagccccagcggcaucuucggcgccuuccagagaggcuacuacagauacuacaacaaguacaucaacgugaagaagggcagcaucagcggcaucaccauggugcuggccugcuacgugcuguucagcuacagcuucagcuacaagcaccugaagcacgagagacugagaaaguaccacuaa

SEQ ID NO: 13997 - RNA, 327 nt, Artificial Sequence
  ATP5J__Homo_sapiens__NP_001003696
augauccugcagagacuguucagauucagcagcgugaucagaagcgccgugagcgugcaccugagaagaaacaucggcgugaccgccguggccuucaacaaggagcuggaccccauccagaagcuguucguggacaagaucagagaguacaagagcaagagacagaccagcggcggccccguggacgccagcagcgaguaccagcaggagcuggagagagagcuguucaagcugaagcagauguucggcaacgccgacaugaacaccuuccccaccuucaaguucgaggaccccaaguucgaggugaucgagaagccccaggccuaa

SEQ ID NO: 13998 - RNA, 312 nt, Artificial Sequence
  ATP5L__Homo_sapiens__NP_006467
auggcccaguucgugagaaaccugguggagaagacccccgcccuggugaacgccgccgugaccuacagcaagcccagacuggccaccuucugguacuacgccaagguggagcuggugccccccacccccgccgagauccccagagccauccagagccugaagaagaucgugaacagcgcccagaccggcagcuucaagcagcugaccgugaaggaggccgugcugaacggccugguggccaccgaggugcugaugugguucuacgugggcgagaucaucggcaagagaggcaucaucggcuacgacguguaa

SEQ ID NO: 13999 - RNA, 642 nt, Artificial Sequence
  ATP5O__Homo_sapiens__NP_001688
auggccgcccccgccgugagcggccugagcagacaggugagaugcuucagcaccagcguggugagacccuucgccaagcuggugagaccccccgugcagguguacggcaucgagggcagauacgccaccgcccuguacagcgccgccagcaagcagaacaagcuggagcagguggagaaggagcugcugagaguggcccagauccugaaggagcccaagguggccgccagcgugcugaaccccuacgugaagagaagcaucaaggugaagagccugaacgacaucaccgccaaggagagauucagcccccugaccaccaaccugaucaaccugcuggccgagaacggcagacugagcaacacccagggcguggugagcgccuucagcaccaugaugagcgugcacagaggcgaggugcccugcaccgugaccagcgccagcccccuggaggaggccacccugagcgagcugaagaccgugcugaagagcuuccugagccagggccaggugcugaagcuggaggccaagaccgaccccagcauccugggcggcaugaucgugagaaucggcgagaaguacguggacaugagcgugaagaccaagauccagaagcugggcagagccaugagagagaucguguaa

SEQ ID NO: 14000 - RNA, 1413 nt, Artificial Sequence
  ATP6AP1__Homo_sapiens__NP_001174
augauggccgccauggccaccgccagagugagaaugggccccagaugcgcccaggcccuguggagaaugcccuggcugcccguguuccugagccuggccgccgccgccgccgccgccgccgccgagcagcaggugccccuggugcuguggagcagcgacagagaccugugggcccccgccgccgacacccacgagggccacaucaccagcgaccugcagcugagcaccuaccuggaccccgcccuggagcugggccccagaaacgugcugcuguuccugcaggacaagcugagcaucgaggacuucaccgccuacggcggcguguucggcaacaagcaggacagcgccuucagcaaccuggagaacgcccuggaccuggcccccagcagccuggugcugcccgccguggacugguacgccgugagcacccugaccaccuaccugcaggagaagcugggcgccagcccccugcacguggaccuggccacccugagagagcugaagcugaacgccagccugcccgcccugcugcugaucagacugcccuacaccgccagcagcggccugauggcccccagagaggugcugaccggcaacgacgaggugaucggccaggugcugagcacccugaagagcgaggacgugcccuacaccgccgcccugaccgccgugagacccagcagaguggccagagacguggccgugguggccggcggccugggcagacagcugcugcagaagcagcccgugagccccgugauccacccccccgugagcuacaacgacaccgcccccagaauccuguucugggcccagaacuucagcguggccuacaaggaccagugggaggaccugaccccccugaccuucggcgugcaggagcugaaccugaccggcagcuucuggaacgacagcuucgccagacugagccugaccuacgagagacuguucggcaccaccgugaccuucaaguucauccuggccaacagacuguaccccgugagcgccagacacugguucaccauggagagacuggaggugcacagcaacggcagcguggccuacuucaacgccagccaggugaccggccccagcaucuacagcuuccacugcgaguacgugagcagccugagcaagaagggcagccugcugguggccagaacccagcccagccccuggcagaugaugcugcaggacuuccagauccaggccuucaacgugaugggcgagcaguucagcuacgccagcgacugcgccagcuucuucagccccggcaucuggaugggccugcugaccagccuguucaugcuguucaucuucaccuacggccugcacaugauccugagccugaagaccauggacagauucgacgaccacaagggccccaccaucagccugacccagaucguguaa

SEQ ID NO: 14001 - RNA, 675 nt, Artificial Sequence
  ATP6AP1L__Homo_sapiens__XP_011542025
augagacuguggaaggccagagugcugaagcuggugcugaagaccgccaaggacagcagacugggccugaacagcaaguggcugagccugaagcugggcgacgccggcaaccccagaagccuggccaucagauucauccugaccaacuacaacaagcugagcauccagagcugguucagccugagaagaguggagaucaucagcaacaacagcauccaggccguguucaaccccaccggcguguacgcccccagcggcuacagcuacagaugccagagagugggcagccugcagcaggaccaggcccugcugcugcccagcgacaccgacgacggcagcagccugugggaggugaccuucaucgacuuccagauccagggcuucgccaucaagggcggcagauucaccaaggcccaggacugcgccagcagcuucagccccgccuuccugaucggccuggccaugagccugauccugcugcuggugcuggccuacgcccugcacaugcugaucuaccugagauaccuggaccagcaguacgaccugaucgccagccccgcccacuucagccagcugaaggccagagacaccgccgaggagaaggagcugcugagaagccagggcgccgagugcuacaagcugagaagccagcagaucagcaagaucuacguguaa

SEQ ID NO: 14002 - RNA, 1053 nt, Artificial Sequence
  ATP6AP2__Homo_sapiens__NP_005756
auggccguguucguggugcugcuggcccugguggccggcgugcugggcaacgaguucagcauccugaagagccccggcagcgugguguucagaaacggcaacuggcccauccccggcgagagaauccccgacguggccgcccugagcaugggcuucagcgugaaggaggaccugagcuggcccggccuggccgugggcaaccuguuccacagacccagagccaccgugauggugauggugaagggcgugaacaagcuggcccugccccccggcagcgugaucagcuacccccuggagaacgccgugcccuucagccuggacagcguggccaacagcauccacagccuguucagcgaggagacccccguggugcugcagcuggcccccagcgaggagagaguguacauggugggcaaggccaacagcguguucgaggaccugagcgugacccugagacagcugagaaacagacuguuccaggagaacagcgugcugagcagccugccccugaacagccugagcagaaacaacgagguggaccugcuguuccugagcgagcugcaggugcugcacgacaucagcagccugcugagcagacacaagcaccuggccaaggaccacagccccgaccuguacagccuggagcuggccggccuggacgagaucggcaagagauacggcgaggacagcgagcaguucagagacgccagcaagauccugguggacgcccugcagaaguucgccgacgacauguacagccuguacggcggcaacgccgugguggagcuggugaccgugaagagcuucgacaccagccugaucagaaagaccagaaccauccuggaggccaagcaggccaagaaccccgccagccccuacaaccuggccuacaaguacaacuucgaguacagcgugguguucaacauggugcuguggaucaugaucgcccuggcccuggccgugaucaucaccagcuacaacaucuggaacauggaccccggcuacgacagcaucaucuacagaaugaccaaccagaagaucagaauggacuaa

SEQ ID NO: 14003 - RNA, 2517 nt, Artificial Sequence
  ATP6V0A1__Homo_sapiens__NP_001123492
augggcgagcuguucagaagcgaggagaugacccuggcccagcuguuccugcagagcgaggccgccuacugcugcgugagcgagcugggcgagcugggcaaggugcaguucagagaccugaaccccgacgugaacguguuccagagaaaguucgugaacgaggugagaagaugcgaggagauggacagaaagcugagauucguggagaaggagaucagaaaggccaacauccccaucauggacaccggcgagaaccccgaggugcccuuccccagagacaugaucgaccuggaggccaacuucgagaagaucgagaacgagcugaaggagaucaacaccaaccaggaggcccugaagagaaacuuccuggagcugaccgagcugaaguucauccugagaaagacccagcaguucuucgacgaggccgagcugcaccaccagcagauggccgaccccgaccugcuggaggagagcagcagccugcuggagcccagcgagaugggcagaggcaccccccugagacugggcuucguggccggcgugaucaacagagagagaauccccaccuucgagagaaugcuguggagagugugcagaggcaacguguuccugagacaggccgagaucgagaacccccuggaggaccccgugaccggcgacuacgugcacaagagcguguucaucaucuucuuccagggcgaccagcugaagaacagagugaagaagaucugcgagggcuucagagccagccuguaccccugccccgagaccccccaggagagaaaggagauggccagcggcgugaacaccagaaucgacgaccugcagauggugcugaaccagaccgaggaccacagacagagagugcugcaggccgccgccaagaacaucagagugugguucaucaaggugagaaagaugaaggccaucuaccacacccugaaccugugcaacaucgacgugacccagaagugccugaucgccgagguguggugccccgugaccgaccuggacagcauccaguucgcccugagaagaggcaccgagcacagcggcagcaccgugcccagcauccugaacagaaugcagaccaaccagaccccccccaccuacaacaagaccaacaaguucaccuacggcuuccagaacaucguggacgccuacggcaucggcaccuacagagagaucaaccccgcccccuacaccaucaucaccuuccccuuccuguucgccgugauguucggcgacuucggccacggcauccugaugacccuguucgccguguggauggugcugagagagagcagaauccugagccagaagaacgagaacgagauguucagcaccguguucagcggcagauacaucauccugcugaugggcguguucagcauguacaccggccugaucuacaacgacugcuucagcaagagccugaacaucuucggcagcagcuggagcgugagacccauguucaccuacaacuggaccgaggagacccugagaggcaaccccgugcugcagcugaaccccgcccugcccggcguguucggcggccccuaccccuucggcaucgaccccaucuggaacaucgccaccaacaagcugaccuuccugaacagcuucaagaugaagaugagcgugauccugggcaucauccacaugcuguucggcgugagccugagccuguucaaccacaucuacuucaagaagccccugaacaucuacuucggcuucauccccgagaucaucuucaugaccagccuguucggcuaccuggugauccugaucuucuacaaguggaccgccuacgacgcccacaccagcgagaacgcccccagccugcugauccacuucaucaacauguuccuguucagcuaccccgagagcggcuacagcaugcuguacagcggccagaagggcauccagugcuuccugguggugguggcccugcugugcgugcccuggaugcugcuguucaagccccuggugcugagaagacaguaccugagaagaaagcaccugggcacccugaacuucggcggcaucagagugggcaacggccccaccgaggaggacgccgagaucauccagcacgaccagcugagcacccacagcgaggacgccgacgaguucgacuucggcgacaccauggugcaccaggccauccacaccaucgaguacugccugggcugcaucagcaacaccgccagcuaccugagacugugggcccugagccuggcccacgcccagcugagcgaggugcuguggaccauggugauccacaucggccugagcgugaagagccuggccggcggccuggugcuguucuucuucuucaccgccuucgccacccugaccguggccauccugcugaucauggagggccugagcgccuuccugcacgcccugagacugcacuggguggaguuccagaacaaguucuacagcggcaccggcuucaaguuccugcccuucagcuucgagcacaucagagagggcaaguucgaggaguaa

SEQ ID NO: 14004 - RNA, 2571 nt, Artificial Sequence
  ATP6V0A2__Homo_sapiens__NP_036595
augggcagccuguucagaagcgagaccaugugccuggcccagcuguuccugcagagcggcaccgccuacgagugccugagcgcccugggcgagaagggccuggugcaguucagagaccugaaccagaacgugagcagcuuccagagaaaguucgugggcgaggugaagagaugcgaggagcuggagagaauccugguguaccuggugcaggagaucaacagagccgacaucccccugcccgagggcgaggccagcccccccgcccccccccugaagcaggugcuggagaugcaggagcagcugcagaagcuggagguggagcugagagaggugaccaagaacaaggagaagcugagaaagaaccugcuggagcugaucgaguacacccacaugcugagagugaccaagaccuucgugaagagaaacguggaguucgagcccaccuacgaggaguuccccagccuggagagcgacagccugcuggacuacagcugcaugcagagacugggcgccaagcugggcuucgugagcggccugaucaaccagggcaagguggaggccuucgagaagaugcuguggagagugugcaagggcuacaccaucgugagcuacgccgagcuggacgagagccuggaggaccccgagaccggcgaggugaucaagugguacguguuccugaucagcuucuggggcgagcagaucggccacaaggugaagaagaucugcgacugcuaccacugccacguguaccccuaccccaacaccgccgaggagagaagagagauccaggagggccugaacaccagaauccaggaccuguacaccgugcugcacaagaccgaggacuaccugagacaggugcugugcaaggccgccgagagcguguacagcagagugauccaggugaagaagaugaaggccaucuaccacaugcugaacaugugcagcuucgacgugaccaacaagugccugaucgccgagguguggugccccgaggccgaccugcaggaccugagaagagcccuggaggagggcagcagagagagcggcgccaccauccccagcuucaugaacaucauccccaccaaggagaccccccccaccagaaucagaaccaacaaguucaccgagggcuuccagaacaucguggacgccuacggcgugggcagcuacagagaggugaaccccgcccuguucaccaucaucaccuuccccuuccuguucgccgugauguucggcgacuucggccacggcuucgugauguuccuguucgcccugcugcuggugcugaacgagaaccaccccagacugaaccagagccaggagaucaugagaauguucuucaacggcagauacauccugcugcugaugggccuguucagcguguacaccggccugaucuacaacgacugcuucagcaagagcgugaaccuguucggcagcggcuggaacgugagcgccauguacagcagcagccacccccccgccgagcacaagaagauggugcuguggaacgacagcguggugagacacaacagcauccugcagcuggaccccagcauccccggcguguucagaggccccuacccccugggcaucgaccccaucuggaaccuggccaccaacagacugaccuuccugaacagcuucaagaugaagaugagcgugauccugggcaucauccacaugaccuucggcgugauccugggcaucuucaaccaccugcacuucagaaagaaguucaacaucuaccuggugagcauccccgagcugcuguucaugcugugcaucuucggcuaccugaucuucaugaucuucuacaaguggcugguguucagcgccgagaccagcagaguggcccccagcauccugaucgaguucaucaacauguuccuguuccccgccagcaagaccagcggccuguacaccggccaggaguacgugcagagagugcugcugguggugaccgcccugagcgugcccgugcuguuccugggcaagccccuguuccugcuguggcugcacaacggcagaagcugcuucggcgugaacagaagcggcuacacccugaucagaaaggacagcgaggaggaggugagccugcugggcagccaggacaucgaggagggcaaccaccagguggaggacggcugcagagagauggccugcgaggaguucaacuucggcgagauccugaugacccaggugauccacagcaucgaguacugccugggcugcaucagcaacaccgccagcuaccugagacugugggcccugagccuggcccacgcccagcugagcgacgugcugugggccaugcugaugagagugggccugagaguggacaccaccuacggcgugcugcugcugcugcccgugaucgcccuguucgccgugcugaccaucuucauccugcugaucauggagggccugagcgccuuccugcacgccaucagacugcacuggguggaguuccagaacaaguucuacgugggcgccggcaccaaguucgugcccuucagcuucagccugcugagcagcaaguucaacaacgacgacagcguggccuaa

SEQ ID NO: 14005 - RNA, 2523 nt, Artificial Sequence
  ATP6V0A4__Homo_sapiens__XP_005250451
auggugagcguguucagaagcgaggagaugugccugagccagcuguuccugcagguggaggccgccuacugcugcguggccgagcugggcgagcugggccuggugcaguucaaggaccugaacaugaacgugaacagcuuccagagaaaguucgugaacgaggugagaagaugcgagagccuggagagaauccugagauuccuggaggacgagaugcagaacgagaucguggugcagcugcuggagaagagcccccugaccccccugcccagagagaugaucacccuggagaccgugcuggagaagcuggagggcgagcugcaggaggccaaccagaaccagcaggcccugaagcagagcuuccuggagcugaccgagcugaaguaccugcugaagaagacccaggacuucuucgagaccgagaccaaccuggccgacgacuucuucaccgaggacaccagcggccugcuggagcugaaggccgugcccgccuacaugaccggcaagcugggcuucaucgccggcgugaucaacagagagagaauggccagcuucgagagacugcuguggagaaucugcagaggcaacguguaccugaaguucagcgagauggacgccccccuggaggaccccgugaccaaggaggagauccagaagaacaucuucaucaucuucuaccagggcgagcagcugagacagaagaucaagaagaucugcgacggcuucagagccaccguguaccccugccccgagcccgccguggagagaagagagaugcuggagagcgugaacgugagacuggaggaccugaucaccgugaucacccagaccgagagccacagacagagacugcugcaggaggccgccgccaacuggcacagcuggcugaucaaggugcagaagaugaaggccguguaccacauccugaacaugugcaacaucgacgugacccagcagugcgugaucgccgagaucugguuccccguggccgacgccaccagaaucaagagagcccuggagcagggcauggagcugagcggcagcagcauggcccccaucaugaccaccgugcagagcaagaccgccccccccaccuucaacagaaccaacaaguucaccgccggcuuccagaacaucguggacgccuacggcgugggcagcuacagagagaucaaccccgcccccuacaccaucaucaccuuccccuuccuguucgccgugauguucggcgacugcggccacggcaccgugaugcugcuggccgcccuguggaugauccugaacgagagaagacugcugagccagaagaccgacaacgagaucuggaacaccuucuuccacggcagauaccugauccugcugaugggcaucuucagcaucuacaccggccugaucuacaacgacugcuucagcaagagccugaacaucuucggcagcagcuggagcgugcagcccauguucagaaacggcaccuggaacacccacgugauggaggagagccuguaccugcagcuggaccccgccauccccggcguguacuucggcaaccccuaccccuucggcaucgaccccaucuggaaccuggccagcaacaagcugaccuuccugaacagcuacaagaugaagaugagcgugauccugggcaucgugcagaugguguucggcgugauccugagccuguucaaccacaucuacuucagaagaacccugaacaucauccugcaguucauccccgagaugaucuucauccugugccuguucggcuaccugguguucaugaucaucuucaaguggugcugcuucgacgugcacgugagccagcacgcccccagcauccugauccacuucaucaacauguuccuguucaacuacagcgacagcagcaacgccccccuguacaagcaccagcaggaggugcagagcuucuucguggugauggcccugaucagcgugcccuggaugcugcugaucaagcccuucauccugagagccagccacagaaagagccagcugcaggccagcagaauccaggaggacgccaccgagaacaucgagggcgacagcagcagccccagcagcagaagcggccagagaaccagcgccgacacccacggcgcccuggacgaccacggcgaggaguucaacuucggcgacguguucgugcaccaggccauccacaccaucgaguacugccugggcugcaucagcaacaccgccagcuaccugagacugugggcccugagccuggcccacgcccagcugagcgaggugcuguggaccauggugaugaacagcggccugcagaccagaggcuggggcggcaucgugggcguguucaucaucuucgccguguucgccgugcugaccguggccauccugcugaucauggagggccugagcgccuuccugcacgcccugagacugcacuggguggaguuccagaacaaguucuacgugggcgacggcuacaaguucagccccuucagcuucaagcacauccuggacggcaccgccgaggaguaa

SEQ ID NO: 14006 - RNA, 468 nt, Artificial Sequence
  ATP6V0C__Homo_sapiens__NP_001185498
augagcgagagcaagagcggccccgaguacgccagcuucuucgccgugaugggcgccagcgccgccaugguguucagcgcccugggcgccgccuacggcaccgccaagagcggcaccggcaucgccgccaugagcgugaugagacccgagcagaucaugaagagcaucauccccguggugauggccggcaucaucgccaucuacggccuggugguggccgugcugaucgccaacagccugaacgacgacaucagccuguacaagagcuuccugcagcugggcgccggccugagcgugggccugagcggccuggccgccggcuucgccaucggcaucgugggcgacgccggcgugagaggcaccgcccagcagcccagacuguucgugggcaugauccugauccugaucuucgccgaggugcugggccuguacggccugaucguggcccugauccugagcaccaaguaa

SEQ ID NO: 14007 - RNA, 1056 nt, Artificial Sequence
  ATP6V0D1__Homo_sapiens__NP_004682
augagcuucuuccccgagcuguacuucaacguggacaacggcuaccuggagggccuggugagaggccugaaggccggcgugcugagccaggccgacuaccugaaccuggugcagugcgagacccuggaggaccugaagcugcaccugcagagcaccgacuacggcaacuuccuggccaacgaggccagcccccugaccgugagcgugaucgacgacagacugaaggagaagauggugguggaguucagacacaugagaaaccacgccuacgagccccuggccagcuuccuggacuucaucaccuacagcuacaugaucgacaacgugauccugcugaucaccggcacccugcaccagagaagcaucgccgagcuggugcccaagugccacccccugggcagcuucgagcagauggaggccgugaacaucgcccagacccccgccgagcuguacaacgccauccugguggacaccccccuggccgccuucuuccaggacugcaucagcgagcaggaccuggacgagaugaacaucgagaucaucagaaacacccuguacaaggccuaccuggagagcuucuacaaguucugcacccugcugggcggcaccaccgccgacgccaugugccccauccuggaguucgaggccgacagaagagccuucaucaucaccaucaacagcuucggcaccgagcugagcaaggaggacagagccaagcuguucccccacugcggcagacuguaccccgagggccuggcccagcuggccagagccgacgacuacgagcaggugaagaacguggccgacuacuaccccgaguacaagcugcuguucgagggcgccggcagcaaccccggcgacaagacccuggaggacagauucuucgagcacgaggugaagcugaacaagcuggccuuccugaaccaguuccacuucggcguguucuacgccuucgugaagcugaaggagcaggagugcagaaacaucguguggaucgccgagugcaucgcccagagacacagagccaagaucgacaacuacauccccaucuucuaa

SEQ ID NO: 14008 - RNA, 246 nt, Artificial Sequence
  ATP6V0E1__Homo_sapiens__NP_003936
auggccuaccacggccugaccgugccccugaucgugaugagcguguucuggggcuucgugggcuuccuggugcccugguucauccccaagggccccaacagaggcgugaucaucaccaugcuggugaccugcagcgugugcugcuaccuguucuggcugaucgccauccuggcccagcugaacccccuguucggcccccagcugaagaacgagaccaucugguaccugaaguaccacuggcccuaa

SEQ ID NO: 14009 - RNA, 642 nt, Artificial Sequence
  ATP6V0E2__Homo_sapiens__NP_001094062
augagagugagaggccccgccagacugaucgccagcggcgccagacugcugcugagaaugcugagcgcccugcccggcuggggccccgcccaccugcagagaccccugcugggccccgccagcugccugggcauccugagacccgccaugaccgcccacagcuucgcccugcccgugaucaucuucaccaccuucuggggccuggugggcaucgccggccccugguucgugcccaagggccccaacagaggcgugaucaucaccaugcugguggccaccgccgugugcugcuaccugcugugccccgcccugggcaugaccguggccccccugagccugaccacccccagcagcggccccagccccacccagcugugccuggugaccagcagccugcugcuggcccccagagaccccgacccccagggccugcccggcagcuggaagagcagccagagcagccagcccgccagagcccugggcagccccggccacagcagcggcagaggcgacgugcugcugcaguacccccacugcagcggcgugugcccccugagccagggcgacgccgccggcgagcuggugugggugggcagcuucccccugcagaccggccagaugcccggccugagccccagcuaa

SEQ ID NO: 14010 - RNA, 1542 nt, Artificial Sequence
  ATP6V1B1__Homo_sapiens__NP_001683
auggccauggagaucgacagcagacccggcggccugcccggcagcagcugcaaccugggcgccgccagagagcacaugcaggccgugaccagaaacuacaucacccaccccagagugaccuacagaaccgugugcagcgugaacggcccccugguggugcuggacagagugaaguucgcccaguacgccgagaucgugcacuucacccugcccgacggcacccagagaagcggccaggugcuggagguggccggcaccaaggccaucgugcagguguucgagggcaccagcggcaucgacgccagaaagaccaccugcgaguucaccggcgacauccugagaacccccgugagcgaggacaugcugggcagaguguucaacggcagcggcaagcccaucgacaagggccccguggugauggccgaggacuuccuggacaucaacggccagcccaucaacccccacagcagaaucuaccccgaggagaugauccagaccggcaucagccccaucgacgugaugaacagcaucgccagaggccagaagauccccaucuucagcgccgccggccugccccacaacgagaucgccgcccagaucugcagacaggccggccuggugaagaagagcaaggccgugcuggacuaccacgacgacaacuucgccaucguguucgccgccaugggcgugaacauggagaccgccagauucuucaagagcgacuucgagcagaacggcaccaugggcaacgugugccuguuccugaaccuggccaacgaccccaccaucgagagaaucaucacccccagacuggcccugaccaccgccgaguuccuggccuaccagugcgagaagcacgugcuggugauccugaccgacaugagcagcuacgccgaggcccugagagaggugagcgccgccagagaggaggugcccggcagaagaggcuuccccggcuacauguacaccgaccuggccaccaucuacgagagagccggcagaguggagggcagaggcggcagcaucacccagauccccauccugaccaugcccaacgacgacaucacccaccccauccccgaccugaccggcuucaucaccgagggccagaucuacguggacagacagcugcacaacagacagaucuacccccccaucaacgugcugcccagccugagcagacugaugaagagcgccaucggcgagggcaugaccagaaaggaccacggcgacgugagcaaccagcuguacgccugcuacgccaucggcaaggacgugcaggccaugaaggccguggugggcgaggaggcccugaccagcgaggaccugcuguaccuggaguuccugcagaaguucgagaagaacuucaucaaccagggccccuacgagaacagaagcguguucgagagccuggaccugggcuggaagcugcugagaaucuuccccaaggagaugcugaagagaaucccccaggccgugaucgacgaguucuacagcagagagggcgcccugcaggaccuggcccccgacaccgcccuguaa

SEQ ID NO: 14011 - RNA, 1536 nt, Artificial Sequence
  ATP6V1B2__Homo_sapiens__NP_001684
auggcccugagagccaugagaggcaucgugaacggcgccgcccccgagcugcccgugcccaccggcggccccgccgugggcgccagagagcaggcccuggccgugagcagaaacuaccugagccagcccagacugaccuacaagaccgugagcggcgugaacggcccccuggugauccuggaccacgugaaguuccccagauacgccgagaucgugcaccugacccugcccgacggcaccaagagaagcggccaggugcuggaggugagcggcagcaaggccguggugcagguguucgagggcaccagcggcaucgacgccaagaagaccagcugcgaguucaccggcgacauccugagaacccccgugagcgaggacaugcugggcagaguguucaacggcagcggcaagcccaucgacagaggccccguggugcuggccgaggacuuccuggacaucaugggccagcccaucaacccccagugcagaaucuaccccgaggagaugauccagaccggcaucagcgccaucgacggcaugaacagcaucgccagaggccagaagauccccaucuucagcgccgccggccugccccacaacgagaucgccgcccagaucugcagacaggccggccuggugaagaagagcaaggacgugguggacuacagcgaggagaacuucgccaucguguucgccgccaugggcgugaacauggagaccgccagauucuucaagagcgacuucgaggagaacggcagcauggacaacgugugccuguuccugaaccuggccaacgaccccaccaucgagagaaucaucacccccagacuggcccugaccaccgccgaguuccuggccuaccagugcgagaagcacgugcuggugauccugaccgacaugagcagcuacgccgaggcccugagagaggugagcgccgccagagaggaggugcccggcagaagaggcuuccccggcuacauguacaccgaccuggccaccaucuacgagagagccggcagaguggagggcagaaacggcagcaucacccagauccccauccugaccaugcccaacgacgacaucacccaccccauccccgaccugaccggcuacaucaccgagggccagaucuacguggacagacagcugcacaacagacagaucuacccccccaucaacgugcugcccagccugagcagacugaugaagagcgccaucggcgagggcaugaccagaaaggaccacgccgacgugagcaaccagcuguacgccugcuacgccaucggcaaggacgugcaggccaugaaggccguggugggcgaggaggcccugaccagcgacgaccugcuguaccuggaguuccugcagaaguucgagagaaacuucaucgcccagggccccuacgagaacagaaccguguucgagacccuggacaucggcuggcagcugcugagaaucuuccccaaggagaugcugaagagaaucccccagagcacccugagcgaguucuaccccagagacagcgccaagcacuaa

SEQ ID NO: 14012 - RNA, 1149 nt, Artificial Sequence
  ATP6V1C1__Homo_sapiens__NP_001686
augaccgaguucuggcugaucagcgcccccggcgagaagaccugccagcagaccugggagaagcugcacgccgccaccagcaagaacaacaaccuggccgugaccagcaaguucaacauccccgaccugaaggugggcacccuggacgugcuggugggccugagcgacgagcuggccaagcuggacgccuucguggagggcguggugaagaagguggcccaguacauggccgacgugcuggaggacagcaaggacaaggugcaggagaaccugcuggccaacggcguggaccuggugaccuacaucaccagauuccagugggacauggccaaguaccccaucaagcagagccugaagaacaucagcgagaucaucgccaagggcgugacccagaucgacaacgaccugaagagcagagccagcgccuacaacaaccugaagggcaaccugcagaaccuggagagaaagaacgccggcagccugcugaccagaagccuggccgagaucgugaagaaggacgacuucgugcuggacagcgaguaccuggugacccugcuggugguggugcccaagcugaaccacaacgacuggaucaagcaguacgagacccuggccgagaugguggugcccagaagcagcaacgugcugagcgaggaccaggacagcuaccugugcaacgugacccuguucagaaaggccguggacgacuucagacacaaggccagagagaacaaguucaucgugagagacuuccaguacaacgaggaggagaugaaggccgacaaggaggagaugaacagacugagcaccgacaagaagaagcaguucggcccccuggugagauggcugaaggugaacuucagcgaggccuucaucgccuggauccacgugaaggcccugagaguguucguggagagcgugcugagauacggccugcccgugaacuuccaggccaugcugcugcagcccaacaagaagacccugaagaagcugagagaggugcugcacgagcuguacaagcaccuggacagcagcgccgccgccaucaucgacgcccccauggacauccccggccugaaccugagccagcaggaguacuaccccuacguguacuacaagaucgacugcaaccugcuggaguucaaguaa

SEQ ID NO: 14013 - RNA, 744 nt, Artificial Sequence
  ATP6V1D__Homo_sapiens__NP_057078
augagcggcaaggacagaaucgagaucuuccccagcagaauggcccagaccaucaugaaggccagacugaagggcgcccagaccggcagaaaccugcugaagaagaagagcgacgcccugacccugagauucagacagauccugaagaagaucaucgagaccaagaugcugaugggcgaggugaugagagaggccgccuucagccuggccgaggccaaguucaccgccggcgacuucagcaccaccgugauccagaacgugaacaaggcccaggugaagaucagagccaagaaggacaacguggccggcgugacccugcccguguucgagcacuaccacgagggcaccgacagcuacgagcugaccggccuggccagaggcggcgagcagcuggccaagcugaagagaaacuacgccaaggccguggagcugcugguggagcuggccagccugcagaccagcuucgugacccuggacgaggccaucaagaucaccaacagaagagugaacgccaucgagcacgugaucauccccagaaucgagagaacccuggccuacaucaucaccgagcuggacgagagagagagagaggaguucuacagacugaagaagauccaggagaagaagaagauccugaaggagaagagcgagaaggaccuggagcagagaagagccgccggcgaggugcuggagcccgccaaccugcuggccgaggagaaggacgaggaccugcuguucgaguaa

SEQ ID NO: 14014 - RNA, 615 nt, Artificial Sequence
  ATP6V1E1__Homo_sapiens__NP_001034455
auggcccugagcgacgccgacgugcagaagcaggccgaggaggaguucaacaucgagaagggcagacuggugcagacccagagacugaagaucauggaguacuacgagaagaaggagaagcagaucgagcagcagaagaagauccagaugagcaaccugaugaaccaggccagacugaaggugcugagagccagagacgaccugaucaccgaccugcugaacgaggccaagcagagacugagcaagguggugaaggacaccaccagauaccaggugcugcuggacggccuggugcugcagggccuguaccagcugcuggagcccagaaugaucgugagaugcagaaagcaggacuucccccuggugaaggccgccgugcagaaggccauccccauguacaagaucgccaccaagaacgacguggacgugcagaucgaccaggagagcuaccugcccgaggacaucgccggcggcguggagaucuacaacggcgacagaaagaucaaggugagcaacacccuggagagcagacuggaccugaucgcccagcagaugaugcccgaggugagaggcgcccuguucggcgccaacgccaacagaaaguuccuggacuaa

SEQ ID NO: 14015 - RNA, 444 nt, Artificial Sequence
  ATP6V1F__Homo_sapiens__NP_001185838
auggccggcagaggcaagcugaucgccgugaucggcgacgaggacaccgugaccggcuuccugcugggcggcaucggcgagcugaacaagaacagacaccccaacuuccuggugguggagaaggacaccaccaucaacgagaucgaggacaccuucagaagccugggcagccugcccggcagcgugguggaggccaaccccaaccagagagaccccccccugugggacgagaucgacagcagacaguuccugaacagagacgacaucggcaucauccugaucaaccaguacaucgccgagauggugagacacgcccuggacgcccaccagcagagcauccccgccgugcuggagauccccagcaaggagcaccccuacgacgccgccaaggacagcauccugagaagagccagaggcauguucaccgccgaggaccugagauaa

SEQ ID NO: 14016 - RNA, 357 nt, Artificial Sequence
  ATP6V1G1__Homo_sapiens__NP_004879
auggccagccagagccagggcauccagcagcugcugcaggccgagaagagagccgccgagaaggugagcgaggccagaaagagaaagaacagaagacugaagcaggccaaggaggaggcccaggccgagaucgagcaguacagacugcagagagagaaggaguucaaggccaaggaggccgccgcccugggcagcagaggcagcugcagcaccgagguggagaaggagacccaggagaagaugaccauccugcagaccuacuucagacagaacagagacgaggugcuggacaaccugcuggccuucgugugcgacaucagacccgagauccacgagaacuacagaaucaacggcuaa

SEQ ID NO: 14017 - RNA, 237 nt, Artificial Sequence
  ATP6V1G2__Homo_sapiens__NP_001191007
auggccagccagagccagggcauccagcagcugcugcaggccgagaagagagccgccgagaagguggccgacgccagaaagagaaaggccagaagacugaagcaggccaccagaagacaggugcagggcaugcagagcagccagcagagaaacagagagagagugcuggcccagcugcugggcauggugugcgacgugagaccccaggugcaccccaacuacagaaucagcgccuaa

SEQ ID NO: 14018 - RNA, 357 nt, Artificial Sequence
  ATP6V1G3__Homo_sapiens__XP_006725021
augaccagccagagccagggcauccaccagcugcugcaggccgagaagagagccaaggacaagcuggaggaggccaagaagagaaagggcaagagacugaagcaggccaaggaggaggccaugguggagaucgaccaguacagaaugcagagagacaaggaguucagacugaagcagagcaagaucaugggcagccagaacaaccugagcgacgagaucgaggagcagacccugggcaagauccaggagcugaacggccacuacaacaaguacauggagagcgugaugaaccagcugcugagcauggugugcgacaugaagcccgagauccacgugaacuacagagccaccaacuaa

SEQ ID NO: 14019 - RNA, 4503 nt, Artificial Sequence
  ATP7A__Homo_sapiens__NP_000043
auggaccccagcaugggcgugaacagcgugaccaucagcguggagggcaugaccugcaacagcugcguguggaccaucgagcagcagaucggcaaggugaacggcgugcaccacaucaaggugagccuggaggagaagaacgccaccaucaucuacgaccccaagcugcagacccccaagacccugcaggaggccaucgacgacaugggcuucgacgccgugauccacaaccccgacccccugcccgugcugaccgacacccuguuccugaccgugaccgccagccugacccugcccugggaccacauccagagcacccugcugaagaccaagggcgugaccgacaucaagaucuacccccagaagagaaccguggccgugaccaucauccccagcaucgugaacgccaaccagaucaaggagcuggugcccgagcugagccuggacaccggcacccuggagaagaagagcggcgccugcgaggaccacagcauggcccaggccggcgagguggugcugaagaugaagguggagggcaugaccugccacagcugcaccagcaccaucgagggcaagaucggcaagcugcagggcgugcagagaaucaaggugagccuggacaaccaggaggccaccaucguguaccagccccaccugaucagcguggaggagaugaagaagcagaucgaggccaugggcuuccccgccuucgugaagaagcagcccaaguaccugaagcugggcgccaucgacguggagagacugaagaacacccccgugaagagcagcgagggcagccagcagagaagccccagcuacaccaacgacagcaccgccaccuucaucaucgacggcaugcacugcaagagcugcgugagcaacaucgagagcacccugagcgcccugcaguacgugagcagcaucguggugagccuggagaacagaagcgccaucgugaaguacaacgccagcagcgugacccccgagagccugagaaaggccaucgaggccgugagccccggccuguacagagugagcaucaccagcgagguggagagcaccagcaacagccccagcagcagcagccugcagaagaucccccugaacguggugagccagccccugacccaggagaccgugaucaacaucgacggcaugaccugcaacagcugcgugcagagcaucgagggcgugaucagcaagaagcccggcgugaagagcaucagagugagccuggccaacagcaacggcaccguggaguacgacccccugcugaccagccccgagacccugagaggcgccaucgaggacaugggcuucgacgccacccugagcgacaccaacgagccccugguggugaucgcccagcccagcagcgagaugccccugcugaccagcaccaacgaguucuacaccaagggcaugacccccgugcaggacaaggaggagggcaagaacagcagcaagugcuacauccaggugaccggcaugaccugcgccagcugcguggccaacaucgagagaaaccugagaagagaggagggcaucuacagcauccugguggcccugauggccggcaaggccgaggugagauacaaccccgccgugauccagccccccaugaucgccgaguucaucagagagcugggcuucggcgccaccgugaucgagaacgccgacgagggcgacggcgugcuggagcugguggugagaggcaugaccugcgccagcugcgugcacaagaucgagagcagccugaccaagcacagaggcauccuguacugcagcguggcccuggccaccaacaaggcccacaucaaguacgaccccgagaucaucggccccagagacaucauccacaccaucgagagccugggcuucgaggccagccuggugaagaaggacagaagcgccagccaccuggaccacaagagagagaucagacaguggagaagaagcuuccuggugagccuguucuucugcauccccgugaugggccugaugaucuacaugauggugauggaccaccacuucgccacccugcaccacaaccagaacaugagcaaggaggagaugaucaaccugcacagcagcauguuccuggagagacagauccugcccggccugagcgugaugaaccugcugagcuuccugcugugcgugcccgugcaguucuucggcggcugguacuucuacauccaggccuacaaggcccugaagcacaagaccgccaacauggacgugcugaucgugcuggccaccaccaucgccuucgccuacagccugaucauccugcugguggccauguacgagagagccaaggugaaccccaucaccuucuucgacaccccccccaugcuguucguguucaucgcccugggcagauggcuggagcacaucgccaagggcaagaccagcgaggcccuggccaagcugaucagccugcaggccaccgaggccaccaucgugacccuggacagcgacaacauccugcugagcgaggagcagguggacguggagcuggugcagagaggcgacaucaucaagguggugcccggcggcaaguuccccguggacggcagagugaucgagggccacagcaugguggacgagagccugaucaccggcgaggccaugcccguggccaagaagcccggcagcaccgugaucgccggcagcaucaaccagaacggcagccugcugaucugcgccacccacgugggcgccgacaccacccugagccagaucgugaagcugguggaggaggcccagaccagcaaggcccccauccagcaguucgccgacaagcugagcggcuacuucgugcccuucaucguguucgugagcaucgccacccugcugguguggaucgugaucggcuuccugaacuucgagaucguggagaccuacuuccccggcuacaacagaagcaucagcagaaccgagaccaucaucagauucgccuuccaggccagcaucaccgugcugugcaucgccugccccugcagccugggccuggccacccccaccgccgugauggugggcaccggcgugggcgcccagaacggcauccugaucaagggcggcgagccccuggagauggcccacaaggugaagguggugguguucgacaagaccggcaccaucacccacggcacccccguggugaaccaggugaaggugcugaccgagagcaacagaaucagccaccacaagauccuggccaucgugggcaccgccgagagcaacagcgagcacccccugggcaccgccaucaccaaguacugcaagcaggagcuggacaccgagacccugggcaccugcaucgacuuccagguggugcccggcugcggcaucagcugcaaggugaccaacaucgagggccugcugcacaagaacaacuggaacaucgaggacaacaacaucaagaacgccagccuggugcagaucgacgccagcaacgagcagagcagcaccagcagcagcaugaucaucgacgcccagaucagcaacgcccugaacgcccagcaguacaaggugcugaucggcaacagagaguggaugaucagaaacggccuggugaucaacaacgacgugaacgacuucaugaccgagcacgagagaaagggcagaaccgccgugcugguggccguggacgacgagcugugcggccugaucgccaucgccgacaccgugaagcccgaggccgagcuggccauccacauccugaagagcaugggccuggagguggugcugaugaccggcgacaacagcaagaccgccagaagcaucgccagccaggugggcaucaccaagguguucgccgaggugcugcccagccacaagguggccaaggugaagcagcugcaggaggagggcaagagaguggccauggugggcgacggcaucaacgacagccccgcccuggccauggccaacgugggcaucgccaucggcaccggcaccgacguggccaucgaggccgccgacguggugcugaucagaaacgaccugcuggacgugguggccagcaucgaccugagcagaaagaccgugaagagaaucagaaucaacuucguguucgcccugaucuacaaccuggugggcauccccaucgccgccggcguguucaugcccaucggccuggugcugcagcccuggaugggcagcgccgccauggccgccagcagcgugagcguggugcugagcagccuguuccugaagcuguacagaaagcccaccuacgagagcuacgagcugcccgccagaagccagaucggccagaagagccccagcgagaucagcgugcacgugggcaucgacgacaccagcagaaacagccccaagcugggccugcuggacagaaucgugaacuacagcagagccagcaucaacagccugcugagcgacaagagaagccugaacagcguggugaccagcgagcccgacaagcacagccugcuggugggcgacuucagagaggacgacgacaccgcccuguaa

SEQ ID NO: 14020 - RNA, 3777 nt, Artificial Sequence
  ATP7B__Homo_sapiens__NP_001005918
augcccgagcaggagagacagaucaccgccagagagggcgccagcagaaagauccugagcaagcugagccugcccaccagagccugggagcccgccaugaagaagagcuucgccuucgacaacgugggcuacgagggcggccuggacggccugggccccagcagccagguggccaccagcaccgugagaauccugggcaugaccugccagagcugcgugaagagcaucgaggacagaaucagcaaccugaagggcaucaucagcaugaaggugagccuggagcagggcagcgccaccgugaaguacgugcccagcguggugugccugcagcaggugugccaccagaucggcgacaugggcuucgaggccagcaucgccgagggcaaggccgccagcuggcccagcagaagccugcccgcccaggaggccguggugaagcugagaguggagggcaugaccugccagagcugcgugagcagcaucgagggcaaggugagaaagcugcagggcguggugagagugaaggugagccugagcaaccaggaggccgugaucaccuaccagcccuaccugauccagcccgaggaccugagagaccacgugaacgacaugggcuucgaggccgccaucaagagcaagguggccccccugagccugggccccaucgacaucgagagacugcagagcaccaaccccaagagaccccugagcagcgccaaccagaacuucaacaacagcgagacccugggccaccagggcagccacguggugacccugcagcugagaaucgacggcaugcacugcaagagcugcgugcugaacaucgaggagaacaucggccagcugcugggcgugcagagcauccaggugagccuggagaacaagaccgcccaggugaaguacgaccccagcugcaccagccccguggcccugcagagagccaucgaggcccugccccccggcaacuucaaggugagccugcccgacggcgccgagggcagcggcaccgaccacagaagcagcagcagccacagccccggcagcccccccagaaaccaggugcagggcaccugcagcaccacccugaucgccaucgccggcaugaccugcgccagcugcgugcacagcaucgagggcaugaucagccagcuggagggcgugcagcagaucagcgugagccuggccgagggcaccgccaccgugcuguacaaccccagcgugaucagccccgaggagcugagagccgccaucgaggacaugggcuucgaggccagcguggugagcgagagcugcagcaccaacccccugggcaaccacagcgccggcaacagcauggugcagaccaccgacggcacccccaccagcgugcaggagguggccccccacaccggcagacugcccgccaaccacgcccccgacauccuggccaagagcccccagagcaccagagccguggccccccagaagugcuuccugcagaucaagggcaugaccugcgccagcugcgugagcaacaucgagagaaaccugcagaaggaggccggcgugcugagcgugcugguggcccugauggccggcaaggccgagaucaaguacgaccccgaggugauccagccccuggagaucgcccaguucauccaggaccugggcuucgaggccgccgugauggaggacuacgccggcagcgacggcaacaucgagcugaccaucaccggcaugaccugcgccagcugcgugcacaacaucgagagcaagcugaccagaaccaacggcaucaccuacgccagcguggcccuggccaccagcaaggcccuggugaaguucgaccccgagaucaucggccccagagacaucaucaagaucaucgagagcaagaccagcgaggcccuggccaagcugaugagccugcaggccaccgaggccaccguggugacccugggcgaggacaaccugaucaucagagaggagcaggugcccauggagcuggugcagagaggcgacaucgugaagguggugcccggcggcaaguuccccguggacggcaaggugcuggagggcaacaccauggccgacgagagccugaucaccggcgaggccaugcccgugaccaagaagcccggcagcaccgugaucgccggcagcaucaacgcccacggcagcgugcugaucaaggccacccacgugggcaacgacaccacccuggcccagaucgugaagcugguggaggaggcccagaugagcaagaaccccaacaagcacaucagccagaccgaggugaucaucagauucgccuuccagaccagcaucaccgugcugugcaucgccugccccugcagccugggccuggccacccccaccgccgugauggugggcaccggcguggccgcccagaacggcauccugaucaagggcggcaagccccuggagauggcccacaagaucaagaccgugauguucgacaagaccggcaccaucacccacggcgugcccagagugaugagagugcugcugcugggcgacguggccacccugccccugagaaaggugcuggccguggugggcaccgccgaggccagcagcgagcacccccugggcguggccgugaccaaguacugcaaggaggagcugggcaccgagacccugggcuacugcaccgacuuccaggccgugcccggcugcggcaucggcugcaaggugagcaacguggagggcauccuggcccacagcgagagaccccugagcgcccccgccagccaccugaacgaggccggcagccugcccgccgagaaggacgccgugccccagaccuucagcgugcugaucggcaacagagaguggcugagaagaaacggccugaccaucagcagcgacgugagcgacgccaugaccgaccacgagaugaagggccagaccgccauccugguggccaucgacggcgugcugugcggcaugaucgccaucgccgacgccgugaagcaggaggccgcccuggccgugcacacccugcagagcaugggcguggacguggugcugaucaccggcgacaacagaaagaccgccagagccaucgccacccaggugggcaucaacaagguguucgccgaggugcugcccagccacaagguggccaaggugcaggagcugcagaacaagggcaagaagguggccauggugggcgacggcgugaacgacagccccgcccuggcccaggccgacaugggcguggccaucggcaccggcaccgacguggccaucgaggccgccgacguggugcugaucagaaacgaccugcuggacgugguggccagcauccaccugagcaagagaaccgugagaagaaucagaaucaaccuggugcuggcccugaucuacaaccuggugggcauccccaucgccgccggcguguucaugcccaucggcaucgugcugcagcccuggaugggcagcgccgccauggccgccagcagcgugagcguggugcugagcagccugcagcugaagugcuacaagaagcccgaccuggagagauacgaggcccaggcccacggccacaugaagccccugaccgccagccaggugagcgugcacaucggcauggacgacagauggagagacagccccagagccacccccugggaccaggugagcuacgugagccaggugagccugagcagccugaccagcgacaagcccagcagacacagcgccgccgccgacgacgacggcgacaaguggagccugcugcugaacggcagagacgaggagcaguacaucuaa

SEQ ID NO: 14021 - RNA, 3450 nt, Artificial Sequence
  ATP8A1__Homo_sapiens__NP_001098999
augcccaccaugagaagaaccgugagcgagaucagaagcagagccgagggcuacgagaagaccgacgacgugagcgagaagaccagccuggccgaccaggaggaggugagaaccaucuucaucaaccagccccagcugaccaaguucugcaacaaccacgugagcaccgccaaguacaacaucaucaccuuccugcccagauuccuguacagccaguucagaagagccgccaacagcuucuuccuguucaucgcccugcugcagcagauccccgacgugagccccaccggcagauacaccacccuggugccccugcuguucauccuggccguggccgccaucaaggagaucaucgaggacaucaagagacacaaggccgacaacgccgugaacaagaagcagacccaggugcugagaaacggcgccugggagaucgugcacugggagaaggugaacgugggcgacaucgugaucaucaagggcaaggaguacauccccgccgacaccgugcugcugagcagcagcgagccccaggccaugugcuacaucgagaccagcaaccuggacggcgagaccaaccugaagaucagacagggccugcccgccaccagcgacaucaaggacguggacagccugaugagaaucagcggcagaaucgagugcgagagccccaacagacaccuguacgacuucgugggcaacaucagacuggacggccacggcaccgugccccugggcgccgaccagauccugcugagaggcgcccagcugagaaacacccagugggugcacggcaucgugguguacaccggccacgacaccaagcugaugcagaacagcaccagccccccccugaagcugagcaacguggagagaaucaccaacgugcagauccugauccuguucugcauccugaucgccaugagccuggugugcagcgugggcagcgccaucuggaacagaagacacagcggcaaggacugguaccugaaccugaacuacggcggcgccagcaacuucggccugaacuuccugaccuucaucauccuguucaacaaccugauccccaucagccugcuggugacccuggagguggugaaguucacccaggccuacuucaucaacugggaccuggacaugcacuacgagcccaccgacaccgccgccauggccagaaccagcaaccugaacgaggagcugggccaggugaaguacaucuucagcgacaagaccggcacccugaccugcaacgugaugcaguucaagaagugcaccaucgccggcguggccuacggccagaacagccaguucggcgacgagaagaccuucagcgacagcagccugcuggagaaccugcagaacaaccaccccaccgcccccaucaucugcgaguuccugaccaugauggccgugugccacaccgccgugcccgagagagagggcgacaagaucaucuaccaggccgccagccccgacgagggcgcccuggugagagccgccaagcagcugaacuucguguucaccggcagaacccccgacagcgugaucaucgacagccugggccaggaggagagauacgagcugcugaacgugcuggaguucaccagcgccagaaagagaaugagcgugaucgugagaacccccagcggcaagcugagacuguacugcaagggcgccgacaccgugaucuacgacagacuggccgagaccagcaaguacaaggagaucacccugaagcaccuggagcaguucgccaccgagggccugagaacccugugcuucgccguggccgagaucagcgagagcgacuuccaggaguggagagccguguaccagagagccagcaccagcgugcagaacagacugcugaagcuggaggagagcuacgagcugaucgagaagaaccugcagcugcugggcgccaccgccaucgaggacaagcugcaggaccaggugcccgagaccaucgagacccugaugaaggccgacaucaagaucuggauccugaccggcgacaagcaggagaccgccaucaacaucggccacagcugcaagcugcugaagaagaacaugggcaugaucgugaucaacgagggcagccuggacggcaccagagagacccugagcagacacugcaccacccugggcgacgcccugagaaaggagaacgacuucgcccugaucaucgacggcaagacccugaaguacgcccugaccuucggcgugagacaguacuuccuggaccuggcccugagcugcaaggccgugaucugcugcagagugagcccccugcagaagagcgaggugguggagauggugaagaagcaggugaagguggugacccuggccaucggcgacggcgccaacgacgugagcaugauccagaccgcccacgugggcgugggcaucagcggcaacgagggccugcaggccgccaacagcagcgacuacagcaucgcccaguucaaguaccugaagaaccugcugaugauccacggcgccuggaacuacaacagagugagcaagugcauccuguacugcuucuacaagaacaucgugcuguacaucaucgagaucugguucgccuucgugaacggcuucagcggccagauccuguucgagagauggugcaucggccuguacaacgugauguucaccgccaugcccccccugacccugggcaucuucgagagaagcugcagaaaggagaacaugcugaaguaccccgagcuguacaagaccagccagaacgcccuggacuucaacaccaagguguucugggugcacugccugaacggccuguuccacagcgugauccuguucugguucccccugaaggcccugcaguacggcaccgccuucggcaacggcaagaccagcgacuaccugcugcugggcaacuucguguacaccuucguggugaucaccgugugccugaaggccggccuggagaccagcuacuggaccugguucagccacaucgccaucuggggcagcaucgcccugugggugguguucuucggcaucuacagcagccuguggcccgccauccccauggcccccgacaugagcggcgaggccgccaugcuguucagcagcggcguguucuggaugggccugcuguucauccccguggccagccugcugcuggacgugguguacaaggugaucaagagaaccgccuucaagacccugguggacgaggugcaggagcuggaggccaagagccaggaccccggcgccguggugcugggcaagagccugaccgagagagcccagcugcugaagaacguguucaagaagaaccacgugaaccuguacagaagcgagagccugcagcagaaccugcugcacggcuacgccuucagccaggacgagaacggcaucgugagccagagcgaggugaucagagccuacgacaccaccaagcagagacccgacgagugguaa

SEQ ID NO: 14022 - RNA, 3567 nt, Artificial Sequence
  ATP8A2__Homo_sapiens__NP_057613
augcugaacggcgccggccuggacaaggcccugaagaugagccugcccagaagaagcagaaucagaagcagcgugggccccgugagaagcagccugggcuacaagaaggccgaggacgagaugagcagagccaccagcgugggcgaccagcuggaggcccccgccagaaccaucuaccugaaccagccccaccugaacaaguucagagacaaccagaucagcaccgccaaguacagcgugcugaccuuccugcccagauuccuguacgagcagaucagaagagccgccaacgccuucuuccuguucaucgcccugcugcagcagauccccgacgugagccccaccggcagauacaccacccuggugccccugaucaucauccugaccaucgccggcaucaaggagaucguggaggacuucaagagacacaaggccgacaacgccgugaacaagaagaagaccaucgugcugagaaacggcauguggcacaccaucauguggaaggagguggccgugggcgacaucgugaagguggugaacggccaguaccugcccgccgacguggugcugcugagcagcagcgagccccaggccaugugcuacguggagaccgccaaccuggacggcgagaccaaccugaagaucagacagggccugagccacaccgccgacaugcagaccagagaggugcugaugaagcugagcggcaccaucgagugcgagggccccaacagacaccuguacgacuucaccggcaaccugaaccuggacggcaagagccugguggcccugggccccgaccagauccugcugagaggcacccagcugagaaacacccaguggguguucggcaucgugguguacaccggccacgacaccaagcugaugcagaacagcaccaaggccccccugaagagaagcaacguggagaaggugaccaacgugcagauccuggugcuguucggcauccugcuggugauggcccuggugagcagcgccggcgcccuguacuggaacagaagccacggcgagaagaacugguacaucaagaagauggacaccaccagcgacaacuucggcuacaaccugcugaccuucaucauccuguacaacaaccugauccccaucagccugcuggugacccuggagguggugaaguacacccaggcccuguucaucaacugggacaccgacauguacuacaucggcaacgacacccccgccauggccagaaccagcaaccugaacgaggagcugggccaggugaaguaccuguucagcgacaagaccggcacccugaccugcaacaucaugaacuucaagaagugcagcaucgccggcgugaccuacggccacuuccccgagcuggccagagagcccagcagcgacgacuucugcagaaugcccccccccugcagcgacagcugcgacuucgacgaccccagacugcugaagaacaucgaggacagacaccccaccgcccccugcauccaggaguuccugacccugcuggccgugugccacaccguggugcccgagaaggacggcgacaacaucaucuaccaggccagcagccccgacgaggccgcccuggugaagggcgccaagaagcugggcuucguguucaccgccagaacccccuucagcgugaucaucgaggccaugggccaggagcagaccuucggcauccugaacgugcuggaguucagcagcgacagaaagagaaugagcgugaucgugagaacccccagcggcagacugagacuguacugcaagggcgccgacaacgugaucuucgagagacugagcaaggacagcaaguacauggaggagacccugugccaccuggaguacuucgccaccgagggccugagaacccugugcguggccuacgccgaccugagcgagaacgaguacgaggaguggcugaagguguaccaggaggccagcaccauccugaaggacagagcccagagacuggaggagugcuacgagaucaucgagaagaaccugcugcugcugggcgccaccgccaucgaggacagacugcaggccggcgugcccgagaccaucgccacccugcugaaggccgagaucaagaucugggugcugaccggcgacaagcaggagaccgccaucaacaucggcuacagcugcagacuggugagccagaacauggcccugauccugcugaaggaggacagccuggacgccaccagagccgccaucacccagcacugcaccgaccugggcaaccugcugggcaaggagaacgacguggcccugaucaucgacggccacacccugaaguacgcccugagcuucgaggugagaagaagcuuccuggaccuggcccugagcugcaaggccgugaucugcugcagagugagcccccugcagaagagcgagaucguggacguggugaagaagagagugaaggccaucacccuggccaucggcgacggcgccaacgacgugggcaugauccagaccgcccacgugggcgugggcaucagcggcaacgagggcaugcaggccaccaacaacagcgacuacgccaucgcccaguucagcuaccuggagaagcugcugcuggugcacggcgccuggagcuacaacagagugaccaagugcauccuguacugcuucuacaagaacguggugcuguacaucaucgagcugugguucgccuucgugaacggcuucagcggccagauccuguucgagagauggugcaucggccuguacaacgugaucuucaccgcccugccccccuucacccugggcaucuucgagagaagcugcacccaggagagcaugcugagauucccccagcuguacaagaucacccagaacggcgagggcuucaacaccaagguguucuggggccacugcaucaacgcccuggugcacagccugauccuguucugguuccccaugaaggcccuggagcacgacaccgugcugaccagcggccacgccaccgacuaccuguucgugggcaacaucguguacaccuacgugguggugaccgugugccugaaggccggccuggagaccaccgccuggaccaaguucagccaccuggccguguggggcagcaugcugaccuggcugguguucuucggcaucuacagcaccaucuggcccaccauccccaucgcccccgacaugagaggccaggccaccauggugcugagcagcgcccacuucuggcugggccuguuccuggugcccaccgccugccugaucgaggacguggccuggagagccgccaagcacaccugcaagaagacccugcuggaggaggugcaggagcuggagaccaagagcagagugcugggcaaggccgugcugagagacagcaacggcaagagacugaacgagagagacagacugaucaagagacugggcagaaagaccccccccacccuguucagaggcagcagccugcagcagggcgugccccacggcuacgccuucagccaggaggagcacggcgccgugagccaggaggaggugaucagagccuacgacaccaccaagaagaagagcagaaagaaguaa

SEQ ID NO: 14023 - RNA, 3756 nt, Artificial Sequence
  ATP8B1__Homo_sapiens__XP_011524324
augagcaccgagagagacagcgagaccaccuucgacgaggacagccagcccaacgacgagguggugcccuacagcgacgacgagaccgaggacgagcuggacgaccagggcagcgccguggagcccgagcagaacagagugaacagagaggccgaggagaacagagagcccuucagaaaggagugcaccuggcaggugaaggccaacgacagaaaguaccacgagcagccccacuucaugaacaccaaguuccugugcaucaaggagagcaaguacgccaacaacgccaucaagaccuacaaguacaacgccuucaccuucauccccaugaaccuguucgagcaguucaagagagccgccaaccuguacuuccuggcccugcugauccugcaggccgugccccagaucagcacccuggccugguacaccacccuggugccccugcugguggugcugggcgugaccgccaucaaggaccugguggacgacguggccagacacaagauggacaaggagaucaacaacagaaccugcgaggugaucaaggacggcagauucaagguggccaaguggaaggagauccaggugggcgacgugaucagacugaagaagaacgacuucgugcccgccgacauccugcugcugagcagcagcgagcccaacagccugugcuacguggagaccgccgagcuggacggcgagaccaaccugaaguucaagaugagccuggagaucaccgaccaguaccugcagagagaggacacccuggccaccuucgacggcuucaucgagugcgaggagcccaacaacagacuggacaaguucaccggcacccuguucuggagaaacaccagcuucccccuggacgccgacaagauccugcugagaggcugcgugaucagaaacaccgacuucugccacggccuggugaucuucgccggcgccgacaccaagaucaugaagaacagcggcaagaccagauucaagagaaccaagaucgacuaccugaugaacuacaugguguacaccaucuucguggugcugauccugcugagcgccggccuggccaucggccacgccuacugggaggcccaggugggcaacagcagcugguaccuguacgacggcgaggacgacacccccagcuacagaggcuuccugaucuucuggggcuacaucaucgugcugaacaccauggugcccaucagccuguacgugagcguggaggugaucagacugggccagagccacuucaucaacugggaccugcagauguacuacgccgagaaggacacccccgccaaggccagaaccaccacccugaacgagcagcugggccagauccacuacaucuucagcgacaagaccggcacccugacccagaacaucaugaccuucaagaagugcugcaucaacggccagaucuacggcgaccacagagacgccagccagcacaaccacaacaagaucgagcagguggacuucagcuggaacaccuacgccgacggcaagcuggccuucuacgaccacuaccugaucgagcagauccagagcggcaaggagcccgaggugagacaguucuucuuccugcuggccgugugccacaccgugaugguggacagaaccgacggccagcugaacuaccaggccgccagccccgacgagggcgcccuggugaacgccgccagaaacuucggcuucgccuuccuggccagaacccagaacaccaucaccaucagcgagcugggcaccgagagaaccuacaacgugcuggccauccuggacuucaacagcgacagaaagagaaugagcaucaucgugagaacccccgagggcaacaucaagcuguacugcaagggcgccgacaccgugaucuacgagagacugcacagaaugaaccccaccaagcaggagacccaggacgcccuggacaucuucgccaacgagacccugagaacccugugccugugcuacaaggagaucgaggagaaggaguucaccgaguggaacaagaaguucauggccgccagcguggccagcaccaacagagacgaggcccuggacaagguguacgaggagaucgagaaggaccugauccugcugggcgccaccgccaucgaggacaagcugcaggacggcgugcccgagaccaucagcaagcuggccaaggccgacaucaagaucugggugcugaccggcgacaagaaggagaccgccgagaacaucggcuucgccugcgagcugcugaccgaggacaccaccaucugcuacggcgaggacaucaacagccugcugcacgccagaauggagaaccagagaaacagaggcggcguguacgccaaguucgccccccccgugcaggagagcuucuucccccccggcggcaacagagcccugaucaucaccggcagcuggcugaacgagauccugcuggagaagaagaccaagagaaacaagauccugaagcugaaguuccccagaaccgaggaggagagaagaaugagaacccagagcaagagaagacuggaggccaagaaggagcagagacagaagaacuucguggaccuggccugcgagugcagcgccgugaucugcugcagagugacccccaagcagaaggccauggugguggaccuggugaagagauacaagaaggccaucacccuggccaucggcgacggcgccaacgacgugaacaugaucaagaccgcccacaucggcgugggcaucagcggccaggagggcaugcaggccgugaugagcagcgacuacagcuucgcccaguucagauaccugcagagacugcugcuggugcacggcagauggagcuacaucagaaugugcaaguuccugagauacuucuucuacaagaacuucgccuucacccuggugcacuucugguacagcuucuucaacggcuacagcgcccagaccgccuacgaggacugguucaucacccuguacaacgugcuguacaccagccugcccgugcugcugaugggccugcuggaccaggacgugagcgacaagcugagccugagauuccccggccuguacaucgugggccagagagaccugcuguucaacuacaagagauucuucgugagccugcugcacggcgugcugaccagcaugauccuguucuucaucccccugggcgccuaccugcagaccgugggccaggacggcgaggcccccagcgacuaccagagcuucgccgugaccaucgccagcgcccuggugaucaccgugaacuuccagaucggccuggacaccagcuacuggaccuucgugaacgccuucagcaucuucggcagcaucgcccuguacuucggcaucauguucgacuuccacagcgccggcauccacgugcuguuccccagcgccuuccaguucaccggcaccgccagcaacgcccugagacagcccuacaucuggcugaccaucauccuggccguggccgugugccugcugcccgugguggccaucagauuccugagcaugaccaucuggcccagcgagagcgacaagauccagaagcacagaaagagacugaaggccgaggagcaguggcagagaagacagcagguguucagaagaggcgugagcaccagaagaagcgccuacgccuucagccaccagagaggcuacgccgaccugaucagcagcggcagaagcaucagaaagaagagaagcccccuggacgccaucguggccgacggcaccgccgaguacagaagaaccggcgacagcuaa

SEQ ID NO: 14024 - RNA, 3792 nt, Artificial Sequence
  ATP8B3__Homo_sapiens__NP_001171473
augggcgacagccccggcagaggcgcccccgagagaagacacaaggcccagcccggcagagccagaaaguacgaguggagacccgagggccccaccagcaugggcagccugggccagagagaggaccugcaggacgaggacagaaacagcgccuucaccuggaaggugcaggccaacaacagagccuacaacggccaguucaaggagaaggugauccugugcuggcagagaaagaaguacaagaccaacgugaucagaaccgccaaguacaacuucuacagcuuccugccccugaaccuguacgagcaguuccacagagugagcaaccuguucuuccugaucaucaucauccugcagagcauccccgacaucagcacccugcccugguucagccugagcacccccauggugugccugcuguucaucagagccaccagagaccugguggacgacaugggcagacacaagagcgacagagccaucaacaacagacccugccagauccugaugggcaagagcuucaagcagaagaaguggcaggaccugugcgugggcgacguggugugccugagaaaggacaacaucgugcccgccgacaugcugcugcuggccagcaccgagcccagcagccugugcuacguggagaccguggacaucgacggcgagaccaaccugaaguucagacaggcccugauggugacccacaaggagcuggccaccaucaagaagauggccagcuuccagggcaccgugaccugcgaggcccccaacagcagaaugcaccacuucgugggcugccuggaguggaacgacaagaaguacagccuggacaucggcaaccugcugcugagaggcugcagaaucagaaacaccgacaccugcuacggccuggugaucuacgccgacggcuacauguucgugggcuucgacaccaagaucaugaagaacugcggcaagauccaccugaagagaaccaagcuggaccugcugaugaacaagcuggugguggugaucuucaucagcguggugcuggugugccuggugcuggccuucggcuucggcuucagcgugaaggaguucaaggaccaccacuacuaccugagcggcgugcacggcagcagcguggccgccgagagcuucuucguguucuggagcuuccugauccugcugagcgugaccauccccaugagcauguucauccugagcgaguucaucuaccugggcaacagcguguucaucgacugggacgugcagauguacuacaagccccaggacgugcccgccaaggccagaagcaccagccugaacgaccaccugggccagguggaguacaucuucagcgacaagaccggcacccugacccagaacauccugaccuucaacaagugcugcaucagcggcagaguguacggccccgacagcgaggccaccaccagacccaaggagaaccccuaccuguggaacaaguucgccgacggcaagcugcuguuccacaacgccgcccugcugcaccuggugagaaccaacggcgacgaggccgugagagaguucuggagacugcuggccaucugccacaccgugauggugagagagagccccagagagagacccgaccagcugcuguaccaggccgccagccccgacgagggcgcccuggugaccgccgccagaaacuucggcuacguguuccugagcagaacccaggacaccgugaccaucauggagcugggcgaggagagaguguaccaggugcuggccaucauggacuucaacagcaccagaaagagaaugagcgugcuggugagaaagcccgagggcgccaucugccuguacaccaagggcgccgacaccgugaucuucgagagacugcacagaagaggcgccauggaguucgccaccgaggaggcccuggccgccuucgcccaggagacccugagaacccugugccuggccuacagagagguggccgaggacaucuacgaggacuggcagcagagacaccaggaggccagccugcugcugcagaacagagcccaggcccugcagcagguguacaacgagauggagcaggaccugagacugcugggcgccaccgccaucgaggacagacugcaggacggcgugcccgagaccaucaagugccugaagaagagcaacaucaagaucugggugcugaccggcgacaagcaggagaccgccgugaacaucggcuucgccugcgagcugcugagcgagaacaugcugauccuggaggagaaggagaucagcagaauccuggagaccuacugggagaacagcaacaaccugcugaccagagagagccugagccaggugaagcuggcccuggugaucaacggcgacuuccuggacaagcugcuggugagccugagaaaggagcccagagcccuggcccagaacgugaacauggacgaggccuggcaggagcugggccagagcagaagagacuuccuguacgccagaagacugagccugcugugcagaagauucggccugccccuggccgccccccccgcccaggacagcagagccagaagaagcagcgaggugcugcaggagagagccuucguggaccuggccagcaagugccaggccgugaucugcugcagagugacccccaagcagaaggcccugaucguggcccuggugaagaaguaccaccagguggugacccuggccaucggcgacggcgccaacgacaucaacaugaucaagaccgccgacgugggcgugggccuggccggccaggagggcaugcaggccgugcagaacagcgacuucgugcugggccaguucugcuuccugcagagacugcugcuggugcacggcagauggagcuacgugagaaucugcaaguuccugagauacuucuucuacaagagcauggccagcaugauggugcaggugugguucgccugcuacaacggcuucaccggccagccccuguacgagggcugguuccuggcccuguucaaccugcuguacagcacccugcccgugcuguacaucggccuguucgagcaggacgugagcgccgagcagagccuggagaagcccgagcuguacguggugggccagaaggacgagcuguucaacuacuggguguucgugcaggccaucgcccacggcgugaccaccagccuggugaacuucuucaugacccuguggaucagcagagacaccgccggccccgccagcuucagcgaccaccagagcuucgccguggugguggcccugagcugccugcugagcaucaccauggaggugauccugaucaucaaguacuggaccgcccugugcguggccaccauccugcugagccugggcuucuacgccaucaugaccaccaccacccagagcuucuggcuguucagagugagccccaccaccuuccccuuccuguacgccgaccugagcgugaugagcagccccagcauccugcugguggugcugcugagcgugagcaucaacaccuuccccgugcuggcccugagagugaucuuccccgcccugaaggagcugagagccaaggaggagaagguggaggagggccccagcgaggagaucuucaccauggagccccugccccacgugcacagagagagcagagccagaagaagcagcuacgccuucagccacagagagggcuacgccaaccugaucacccagggcaccauccugagaagaggccccggcgugagcagcgacaucgccagcgagagccuggaccccagcgacgaggaggccgccagcagccccaaggagagccaguaa

SEQ ID NO: 14025 - RNA, 3579 nt, Artificial Sequence
  ATP8B4__Homo_sapiens__NP_079113
auguucugcagcgagaagaagcugagagagguggagagaaucgugaaggccaacgacagagaguacaacgagaaguuccaguacgccgacaacagaauccacaccagcaaguacaacauccugaccuuccugcccaucaaccuguucgagcaguuccagagaguggccaacgccuacuuccugugccugcugauccugcagcugauccccgagaucagcagccugaccugguucaccaccaucgugccccuggugcuggugaucaccaugaccgccgugaaggacgccaccgacgacuacuucagacacaagagcgacaaccaggugaacaacagacagagcgaggugcugaucaacagcaagcugcagaacgagaaguggaugaacgugaaggugggcgacaucaucaagcuggagaacaaccaguucguggccgccgaccugcugcugcugagcagcagcgagccccacggccugugcuacguggagaccgccgagcuggacggcgagaccaaccugaaggugagacacgcccugagcgugaccagcgagcugggcgccgacaucagcagacuggccggcuucgacggcaucguggugugcgaggugcccaacaacaagcuggacaaguucaugggcauccugagcuggaaggacagcaagcacagccugaacaacgagaagaucauccugagaggcugcauccugagaaacaccagcuggugcuucggcauggugaucuucgccggccccgacaccaagcugaugcagaacagcggcaagaccaaguucaagagaaccagcaucgacagacugaugaacacccuggugcuguggaucuucggcuuccugaucugccugggcaucauccuggccaucggcaacagcaucugggagagccagaccggcgaccaguucagaaccuuccuguucuggaacgagggcgagaagagcagcguguucagcggcuuccugaccuucuggagcuacaucaucauccugaacaccguggugcccaucagccuguacgugagcguggaggugaucagacugggccacagcuacuucaucaacugggacagaaagauguacuacagcagaaaggccauccccgccguggccagaaccaccacccugaacgaggagcugggccagaucgaguacaucuucagcgacaagaccggcacccugacccagaacaucaugaccuucaagagaugcagcaucaacggcagaaucuacggcgaggugcacgacgaccuggaccagaagaccgagaucacccaggagaaggagcccguggacuucagcgugaagagccaggccgacagagaguuccaguucuucgaccaccaccugauggagagcaucaagaugggcgaccccaaggugcacgaguuccugagacugcuggcccugugccacaccgugaugagcgaggagaacagcgccggcgagcugaucuaccaggugcagagccccgacgagggcgcccuggugaccgccgccagaaacuucggcuucaucuucaagagcagaacccccgagaccaucaccaucgaggagcugggcacccuggugaccuaccagcugcuggccuuccuggacuucaacaacaccagaaagagaaugagcgugaucgugagaaaccccgagggccagaucaagcuguacagcaagggcgccgacaccauccuguucgagaagcugcaccccagcaacgaggugcugcugagccugaccagcgaccaccugagcgaguucgccggcgagggccugagaacccuggccaucgccuacagagaccuggacgacaaguacuucaaggaguggcacaagaugcuggaggacgccaacgccgccaccgaggagagagacgagagaaucgccggccuguacgaggagaucgagagagaccugaugcugcugggcgccaccgccguggaggacaagcugcaggagggcgugaucgagaccgugaccagccugagccuggccaacaucaagaucugggugcugaccggcgacaagcaggagaccgccaucaacaucggcuacgccugcaacaugcugaccgacgacaugaacgacguguucgugaucgccggcaacaacgccguggaggugagagaggagcugagaaaggccaagcagaaccuguucggccagaacagaaacuucagcaacggccacguggugugcgagaagaagcagcagcuggagcuggacagcaucguggaggagaccaucaccggcgacuacgcccugaucaucaacggccacagccuggcccacgcccuggagagcgacgugaagaacgaccugcuggagcuggccugcaugugcaagaccgugaucugcugcagagugaccccccugcagaaggcccaggugguggagcuggugaagaaguacagaaacgccgugacccuggccaucggcgacggcgccaacgacgugagcaugaucaagagcgcccacaucggcgugggcaucagcggccaggagggccugcaggccgugcuggccagcgacuacagcuucgcccaguucagauaccugcagagacugcugcuggugcacggcagauggagcuacuucagaaugugcaaguuccugugcuacuucuucuacaagaacuucgccuucacccuggugcacuucugguucggcuucuucugcggcuucagcgcccagaccguguacgaccagugguucaucacccuguucaacaucguguacaccagccugcccgugcuggccaugggcaucuucgaccaggacgugagcgaccagaacagcguggacugcccccagcuguacaagcccggccagcugaaccugcuguucaacaagagaaaguucuucaucugcgugcugcacggcaucuacaccagccuggugcuguucuucauccccuacggcgccuucuacaacguggccggcgaggacggccagcacaucgccgacuaccagagcuucgccgugaccauggccaccagccuggugaucguggugagcgugcagaucgcccuggacaccagcuacuggaccuucaucaaccacguguucaucuggggcagcaucgccaucuacuucagcauccuguucaccaugcacagcaacggcaucuucggcaucuuccccaaccaguuccccuucgugggcaacgccagacacagccugacccagaagugcaucuggcuggugauccugcugaccaccguggccagcgugaugcccgugguggccuucagauuccugaagguggaccuguaccccacccugagcgaccagaucagaagauggcagaaggcccagaagaaggccagaccccccagcagcagaagacccagaaccagaagaagcagcagcagaagaagcggcuacgccuucgcccaccaggagggcuacggcgagcugaucaccagcggcaagaacaugagagccaagaaccccccccccaccagcggccuggagaagacccacuacaacagcaccagcuggaucgagaaccugugcaagaagaccaccgacaccgugagcagcuucagccaggacaagaccgugaagcuguaa

SEQ ID NO: 14026 - RNA, 3444 nt, Artificial Sequence
  ATP9B__Homo_sapiens__NP_940933
auggccgaccagaucccccuguaccccgugagaagcgccgccgccgccgccgccaacagaaagagagccgccuacuacagcgccgccggccccagacccggcgccgacagacacagcagauaccagcuggaggacgagagcgcccaccuggacgagaugccccugaugaugagcgaggagggcuucgagaacgaggagagcgacuaccacacccugcccagagccagaaucaugcagagaaagagaggccuggagugguucgugugcgacggcuggaaguuccugugcaccagcugcugcggcuggcugaucaacaucugcagaagaaagaaggagcugaaggccagaaccguguggcugggcugccccgagaagugcgaggagaagcaccccagaaacagcaucaagaaccagaaguacaacguguucaccuucauccccggcgugcuguacgagcaguucaaguucuuccugaaccuguacuuccuggugaucagcugcagccaguucgugcccgcccugaagaucggcuaccuguacaccuacugggccccccugggcuucgugcuggccgugaccaugaccagagaggccaucgacgaguucagaagauuccagagagacaaggaggugaacagccagcuguacagcaagcugaccgugagaggcaaggugcaggugaagagcagcgacauccaggugggcgaccugaucaucguggagaagaaccagagaauccccagcgacaugguguuccugagaaccagcgagaaggccggcagcugcuucaucagaaccgaccagcuggacggcgagaccgacuggaagcugaagguggccgugagcugcacccagcagcugcccgcccugggcgaccuguucagcaucagcgccuacguguacgcccagaagccccagauggacauccacagcuucgagggcaccuucaccagagaggacagcgacccccccauccacgagagccugagcaucgagaacacccugugggccagcaccaucguggccagcggcaccgugaucggcguggugaucuacaccggcaaggagaccagaagcgugaugaacaccagcaaccccaagaacaaggugggccugcuggaccuggagcugaacagacugaccaaggcccuguuccuggcccugguggcccugagcaucgugauggugacccugcagggcuucgugggccccugguacagaaaccuguucagauuccugcugcuguucagcuacaucauccccaucagccugagagugaaccuggacaugggcaaggccguguacggcuggaugaugaugaaggacgagaacauccccggcaccguggugagaaccagcaccauccccgaggagcugggcagacugguguaccugcugaccgacaagaccggcacccugacccagaacgagaugaucuucaagagacugcaccugggcaccgugagcuacggcgccgacaccauggacgagauccagagccacgugagagacagcuacagccagaugcagagccaggccggcggcaacaacaccggcagcaccccccugagaaaggcccagagcagcgcccccaaggugagaaagagcgugagcagcagaauccacgaggccgugaaggccaucgugcugugccacaacgugacccccguguacgagagcagagccggcgugaccgaggagaccgaguucgccgaggccgaccaggacuucagcgacgagaacagaaccuaccaggccagcagccccgacgagguggcccuggugcaguggaccgagagcgugggccugacccuggugagcagagaccugaccagcaugcagcugaagacccccagcggccaggugcugagcuucugcauccugcagcuguuccccuucaccagcgagagcaagagaaugggcgugaucgugagagacgagagcaccgccgagaucaccuucuacaugaagggcgccgacguggccaugagccccaucgugcaguacaacgacuggcuggaggaggagugcggcaacauggccagagagggccugagaacccuggugguggccaagaaggcccugaccgaggagcaguaccaggacuucgagagcagauacacccaggccaagcugagcaugcacgacagaagccugaagguggccgccgugguggagagccuggagagagagauggagcugcugugccugaccggcguggaggaccagcugcaggccgacgugagacccacccuggagaugcugagaaacgccggcaucaagaucuggaugcugaccggcgacaagcuggagaccgccaccugcaucgccaagagcagccaccuggugagcagaacccaggacauccacaucuucagacaggugaccagcagaggcgaggcccaccuggagcugaacgccuucagaagaaagcacgacugcgcccuggugaucagcggcgacagccuggaggugugccugaaguacuacgagcacgaguucguggagcuggccugccagugccccgccguggugugcugcagaugcagccccacccagaaggccagaaucgugacccugcugcagcagcacaccggcagaagaaccugcgccaucggcgacggcggcaacgacgugagcaugauccaggccgccgacugcggcaucggcaucgagggcaaggagggcaagcaggccagccuggccgccgacuucagcaucacccaguucagacacaucggcagacugcugauggugcacggcagaaacagcuacaagagaagcgccgcccugggccaguucgugaugcacagaggccugaucaucagcaccaugcaggccguguucagcagcguguucuacuucgccagcgugccccuguaccagggcuuccugauggugggcuacgccaccaucuacaccauguuccccguguucagccuggugcuggaccaggacgugaagcccgagauggccaugcuguaccccgagcuguacaaggaccugaccaagggcagaagccugagcuucaagaccuuccugaucugggugcugaucagcaucuaccagggcggcauccugauguacggcgcccuggugcuguucgagagcgaguucgugcacgugguggccaucagcuucaccgcccugauccugaccgagcugcugaugguggcccugaccgugagaaccuggcacuggcugauggugguggccgaguuccugagccugggcugcuacgugagcagccuggccuuccugaacgaguacuucggcaucggcagagugagcuucggcgccuuccuggacguggccuucaucaccaccgugaccuuccuguggaaggugagcgccaucaccguggugagcugccugccccuguacgugcugaaguaccugagaagaaagcugagcccccccagcuacugcaagcuggccagcuaa

SEQ ID NO: 14027 - RNA, 870 nt, Artificial Sequence
  ATPAF2__Homo_sapiens__NP_663729
auguggagaagcugccugagacugagagacggcggcagaagacugcugaacagacccgccggcggccccagcgccagcaugagccccggccccaccauccccagccccgccagagccuacgccccccccaccgagagaaagagauucuaccagaacgugagcaucacccagggcgagggcggcuucgagaucaaccuggaccacagaaagcugaagaccccccaggccaagcuguucaccgugcccagcgaggcccuggccaucgccguggccaccgagugggacagccagcaggacaccaucaaguacuacaccaugcaccugaccacccugugcaacaccagccuggacaaccccacccagagaaacaaggaccagcugaucagagccgccgugaaguuccuggacaccgacaccaucugcuacagaguggaggagcccgagacccugguggagcugcagagaaacgagugggaccccaucaucgagugggccgagaagagauacggcguggagaucagcagcagcaccagcaucaugggccccagcauccccgccaagaccagagaggugcuggugagccaccuggccagcuacaacaccugggcccugcagggcaucgaguucguggccgcccagcugaagagcauggugcugacccugggccugaucgaccugagacugaccguggagcaggccgugcugcugagcagacuggaggaggaguaccagauccagaaguggggcaacaucgagugggcccacgacuacgagcugcaggagcugagagccagaaccgccgccggcacccuguucauccaccugugcagcgagagcaccaccgugaagcacaagcugcugaaggaguaa

SEQ ID NO: 14028 - RNA, 690 nt, Artificial Sequence
  ATRAID__Homo_sapiens__NP_001164266
auggccccccacgaccccggcagccugaccacccuggugcccugggccgccgcccugcugcuggcccugggcguggagagagcccuggcccugcccgagaucugcacccagugccccggcagcgugcagaaccugagcaagguggccuucuacugcaagaccaccagagagcugaugcugcacgccagaugcugccugaaccagaagggcaccauccugggccuggaccugcagaacugcagccuggaggaccccggccccaacuuccaccaggcccacaccaccgugaucaucgaccugcaggccaacccccugaagggcgaccuggccaacaccuucagaggcuucacccagcugcagacccugauccugccccagcacgugaacugccccggcggcaucaacgccuggaacaccaucaccagcuacaucgacaaccagaucugccagggccagaagaaccugugcaacaacaccggcgaccccgagaugugccccgagaacggcagcugcgugcccgacggccccggccugcugcagugcgugugcgccgacggcuuccacggcuacaagugcaugagacagggcagcuucagccugcugauguucuucggcauccugggcgccaccacccugagcgugagcauccugcugugggccacccagagaagaaaggccaagaccagcuaa

SEQ ID NO: 14029 - RNA, 7935 nt, Artificial Sequence
  ATR__Homo_sapiens__NP_001175
augggcgagcacggccuggagcuggccagcaugauccccgcccugagagagcugggcagcgccacccccgaggaguacaacaccguggugcagaagcccagacagauccugugccaguucaucgacagaauccugaccgacgugaacgugguggccguggagcuggugaagaagaccgacagccagcccaccagcgugaugcugcuggacuucauccagcacaucaugaagagcagcccccugauguucgugaacgugagcggcagccacgaggccaagggcagcugcaucgaguucagcaacuggaucaucaccagacugcugagaaucgccgccacccccagcugccaccugcugcacaagaagaucugcgaggugaucugcagccugcuguuccuguucaagagcaagagccccgccaucuucggcgugcugaccaaggagcugcugcagcuguucgaggaccugguguaccugcacagaagaaacgugaugggccacgccguggaguggcccguggugaugagcagauuccugagccagcuggacgagcacaugggcuaccugcagagcgccccccugcagcugaugagcaugcagaaccuggaguucaucgaggugacccugcugauggugcugaccagaaucaucgccaucguguucuucagaagacaggagcugcugcuguggcagaucggcugcgugcugcuggaguacggcagccccaagaucaagagccuggccaucagcuuccugaccgagcuguuccagcugggcggccugcccgcccagcccgccagcaccuucuucagcagcuuccuggagcugcugaagcaccugguggagauggacaccgaccagcugaagcuguacgaggagccccugagcaagcugaucaagacccuguuccccuucgaggccgaggccuacagaaacaucgagcccguguaccugaacaugcugcuggagaagcugugcgugauguucgaggacggcgugcugaugagacugaagagcgaccugcugaaggccgcccugugccaccugcugcaguacuuccugaaguucgugcccgccggcuacgagagcgcccugcaggugagaaagguguacgugagaaacaucugcaaggcccugcuggacgugcugggcaucgagguggacgccgaguaccugcugggcccccuguacgccgcccugaagauggagagcauggagaucaucgaggagauccagugccagacccagcaggagaaccugagcagcaacagcgacggcaucagccccaagagaagaagacugagcagcagccugaaccccagcaagagagcccccaagcagaccgaggagaucaagcacguggacaugaaccagaagagcauccuguggagcgcccugaagcagaaggccgagagccugcagaucagccuggaguacagcggccugaagaaccccgugaucgagaugcuggagggcaucgccguggugcugcagcugaccgcccugugcaccgugcacugcagccaccagaacaugaacugcagaaccuucaaggacugccagcacaagagcaagaagaagcccagcguggugaucaccuggaugagccuggacuucuacaccaaggugcugaagagcugcagaagccugcuggagagcgugcagaagcuggaccuggaggccaccaucgacaagguggugaagaucuacgacgcccugaucuacaugcaggugaacagcagcuucgaggaccacauccuggaggaccugugcggcaugcugagccugcccuggaucuacagccacagcgacgacggcugccugaagcugaccaccuucgccgccaaccugcugacccugagcugcagaaucagcgacagcuacagcccccaggcccagagcagaugcguguuccugcugacccuguuccccagaagaaucuuccuggaguggagaaccgccguguacaacugggcccugcagagcagccacgaggugaucagagccagcugcgugagcggcuucuucauccugcugcagcagcagaacagcugcaacagagugcccaagauccugaucgacaaggugaaggacgacagcgacaucgugaagaaggaguucgccagcauccugggccagcuggugugcacccugcacggcauguucuaccugaccagcagccugaccgagcccuucagcgagcacggccacguggaccuguucugcagaaaccugaaggccaccagccagcacgagugcagcagcagccagcugaaggccagcgugugcaagcccuuccuguuccugcugaagaagaagauccccagccccgugaagcuggccuucaucgacaaccugcaccaccugugcaagcaccuggacuucagagaggacgagaccgacgugaaggccgugcugggcacccugcugaaccugauggaggaccccgacaaggacgugagaguggccuucagcggcaacaucaagcacauccuggagagccuggacagcgaggacggcuucaucaaggagcuguucgugcugagaaugaaggaggccuacacccacgcccagaucagcagaaacaacgagcugaaggacacccugauccugaccaccggcgacaucggcagagccgccaagggcgaccuggugcccuucgcccugcugcaccugcugcacugccugcugagcaagagcgccagcgugagcggcgccgccuacaccgagaucagagcccugguggccgccaagagcgugaagcugcagagcuucuucagccaguacaagaagcccaucugccaguuccugguggagagccugcacagcagccagaugaccgcccugcccaacacccccugccagaacgccgacgugagaaagcaggacguggcccaccagagagagauggcccugaacacccugagcgagaucgccaacguguucgacuuccccgaccugaacagauuccugaccagaacccugcaggugcugcugcccgaccuggccgccaaggccagccccgccgccagcgcccugaucagaacccugggcaagcagcugaacgugaacagaagagagauccugaucaacaacuucaaguacaucuucagccaccuggugugcagcugcagcaaggacgagcuggagagagcccugcacuaccugaagaacgagaccgagaucgagcugggcagccugcugagacaggacuuccagggccugcacaacgagcugcugcugagaaucggcgagcacuaccagcagguguucaacggccugagcauccuggccagcuucgccagcagcgacgaccccuaccagggccccagagacaucaucagccccgagcugauggccgacuaccugcagcccaagcugcugggcauccuggccuucuucaacaugcagcugcugagcagcagcgugggcaucgaggacaagaagauggcccugaacagccugaugagccugaugaagcugaugggccccaagcacgugagcagcgugagagugaagaugaugaccacccugagaaccggccugagauucaaggacgacuuccccgagcugugcugcagagccugggacugcuucgugagaugccuggaccacgccugccugggcagccugcugagccacgugaucguggcccugcugccccugauccacauccagcccaaggagaccgccgccaucuuccacuaccugaucaucgagaacagagacgccgugcaggacuuccugcacgagaucuacuuccugcccgaccaccccgagcugaagaagaucaaggccgugcugcaggaguacagaaaggagaccagcgagagcaccgaccugcagaccacccugcagcugagcaugaaggccauccagcacgagaacguggacgugagaauccacgcccugaccagccugaaggagacccuguacaagaaccaggagaagcugaucaaguacgccaccgacagcgagaccguggagcccaucaucagccagcuggugaccgugcugcugaagggcugccaggacgccaacagccaggccagacugcugugcggcgagugccugggcgagcugggcgccaucgaccccggcagacuggacuucagcaccaccgagacccagggcaaggacuucaccuucgugaccggcguggaggacagcagcuucgccuacggccugcugauggagcugaccagagccuaccuggccuacgccgacaacagcagagcccaggacagcgccgccuacgccauccaggagcugcugagcaucuacgacugcagagagauggagaccaacggccccggccaccagcuguggagaagauuccccgagcacgugagagagauccuggagccccaccugaacaccagauacaagagcagccagaagagcaccgacuggagcggcgugaagaagcccaucuaccugagcaagcugggcagcaacuucgccgaguggagcgccagcugggccggcuaccugaucaccaaggugagacacgaccuggccagcaagaucuucaccugcugcagcaucaugaugaagcacgacuucaaggugaccaucuaccugcugccccacauccugguguacgugcugcugggcugcaaccaggaggaccagcaggagguguacgccgagaucauggccgugcugaagcacgacgaccagcacaccaucaacacccaggacaucgccagcgaccugugccagcugagcacccagaccguguucagcaugcuggaccaccugacccagugggccagacacaaguuccaggcccugaaggccgagaagugcccccacagcaagagcaacagaaacaagguggacagcauggugagcaccguggacuacgaggacuaccagagcgugaccagauuccuggaccugaucccccaggacacccuggccguggccagcuucagaagcaaggccuacaccagagccgugaugcacuucgagagcuucaucaccgagaagaagcagaacauccaggagcaccugggcuuccugcagaagcuguacgccgccaugcacgagcccgacggcguggccggcgugagcgccaucagaaaggccgagcccagccugaaggagcagauccuggagcacgagagccugggccugcugagagacgccaccgccugcuacgacagagccauccagcuggagcccgaccagaucauccacuaccacggcguggugaagagcaugcugggccugggccagcugagcaccgugaucacccaggugaacggcgugcacgccaacagaagcgaguggaccgacgagcugaacaccuacagaguggaggccgccuggaagcugagccagugggaccugguggagaacuaccuggccgccgacggcaagagcaccaccuggagcgugagacugggccagcugcugcugagcgccaagaagagagacaucaccgccuucuacgacagccugaagcuggugagagccgagcagaucgugccccugagcgccgccagcuucgagagaggcagcuaccagagaggcuacgaguacaucgugagacugcacaugcugugcgagcuggagcacagcaucaagccccuguuccagcacagccccggcgacagcagccaggaggacagccugaacuggguggccagacuggagaugacccagaacagcuacagagccaaggagcccauccuggcccugagaagagcccugcugagccugaacaagagacccgacuacaacgagauggugggcgagugcuggcugcagagcgccagaguggccagaaaggccggccaccaccagaccgccuacaacgcccugcugaacgccggcgagagcagacuggccgagcuguacguggagagagccaaguggcuguggagcaagggcgacgugcaccaggcccugaucgugcugcagaagggcguggagcugugcuuccccgagaacgagaccccccccgagggcaagaacaugcugauccacggcagagccaugcugcuggugggcagauucauggaggagaccgccaacuucgagagcaacgccaucaugaagaaguacaaggacgugaccgccugccugcccgagugggaggacggccacuucuaccuggccaaguacuacgacaagcugaugcccauggugaccgacaacaagauggagaagcagggcgaccugaucagauacaucgugcugcacuucggcagaagccugcaguacggcaaccaguucaucuaccagagcaugcccagaaugcugacccuguggcuggacuacggcaccaaggccuacgagugggagaaggccggcagaagcgacagagugcagaugagaaacgaccugggcaagaucaacaaggugaucaccgagcacaccaacuaccuggcccccuaccaguuccugaccgccuucagccagcugaucagcagaaucugccacagccacgacgagguguucguggugcugauggagaucaucgccaagguguuccuggccuacccccagcaggccauguggaugaugaccgccgugagcaagagcagcuaccccaugagagugaacagaugcaaggagauccugaacaaggccauccacaugaagaagagccuggagaaguucgugggcgacgccaccagacugaccgacaagcugcuggagcugugcaacaagcccguggacggcagcagcagcacccugagcaugagcacccacuucaagaugcugaagaagcugguggaggaggccaccuucagcgagauccugaucccccugcagagcgugaugauccccacccugcccagcauccugggcacccacgccaaccacgccagccacgagcccuuccccggccacugggccuacaucgccggcuucgacgacaugguggagauccuggccagccugcagaagcccaagaagaucagccugaagggcagcgacggcaaguucuacaucaugaugugcaagcccaaggacgaccugagaaaggacugcagacugauggaguucaacagccugaucaacaagugccugagaaaggacgccgagagcagaagaagagagcugcacaucagaaccuacgccgugaucccccugaacgacgagugcggcaucaucgagugggugaacaacaccgccggccugagacccauccugaccaagcuguacaaggagaagggcguguacaugaccggcaaggagcugagacagugcaugcugcccaagagcgccgcccugagcgagaagcugaagguguucagagaguuccugcugcccagacacccccccaucuuccacgagugguuccugagaaccuuccccgaccccaccagcugguacagcagcagaagcgccuacugcagaagcaccgccgugaugagcauggugggcuacauccugggccugggcgacagacacggcgagaacauccuguucgacagccugaccggcgagugcgugcacguggacuucaacugccuguucaacaagggcgagaccuucgaggugcccgagaucgugcccuucagacugacccacaacauggugaacggcaugggccccaugggcaccgagggccuguucagaagagccugcgaggugaccaugagacugaugagagaccagagagagccccugaugagcgugcugaagaccuuccugcacgacccccugguggaguggagcaagcccgugaagggccacagcaaggccccccugaacgagaccggcgagguggugaacgagaaggccaagacccacgugcuggacaucgagcagagacugcagggcgugaucaagaccagaaacagagugaccggccugccccugagcaucgagggccacgugcacuaccugauccaggaggccaccgacgagaaccugcugugccagauguaccugggcuggacccccuacauguaa

SEQ ID NO: 14030 - RNA, 2097 nt, Artificial Sequence
  ATRIP__Homo_sapiens__NP_001257952
augagcaagaaccccagcggcaagaacagagagaccgugcccaucaaggacaacuucgagcuggaggugcugcaggcccaguacaaggagcugaaggagaagaugaaggugauggaggaggaggugcugaucaagaacggcgagaucaagauccugagagacagccugcaccagaccgagagcgugcuggaggagcagagaagaagccacuuccugcuggagcaggagaagacccaggcccugagcgacaaggagaaggaguucagcaagaagcugcagagccugcagagcgagcugcaguucaaggacgccgagaugaacgagcugagaaccaagcugcagaccagcgagagagccaacaagcuggccgcccccagcgugagccacgugagccccagaaagaaccccagcguggugaucaagcccgaggccugcagcccccaguucggcaagaccagcuuccccaccaaggagagcuucagcgccaacaugagccugccccaccccugccagaccgagagcggcuacaagccccuggugggcagagaggacagcaagccccacagccugagaggcgacagcaucaagcaggaggaggcccagaagagcuucguggacagcuggagacagagaagcaacacccagggcagcauccugaucaaccugcugcugaagcagccccugauccccggcagcagccugagccugugccaccugcugagcagcagcagcgagagccccgccggcaccccccugcagccccccggcuucggcagcacccuggccggcaugagcggccugagaaccaccggcagcuacgacggcagcuucagccugagcgcccugagagaggcccagaaccuggccuucaccggccugaaccugguggccagaaacgagugcagcagagacggcgaccccgccgagggcggcagaagagccuucccccugugccagcugcccggcgccgugcacuuccugccccuggugcaguucuucaucggccugcacugccaggcccugcaggaccuggccgccgccaagagaagcggcgcccccggcgacagccccacccacagcagcugcgugagcagcggcguggagaccaaccccgaggacagcgugugcauccuggagggcuucagcgugaccgcccugagcauccugcagcaccuggugugccacagcggcgccguggugagccugcugcugagcggcgugggcgccgacagcgccgccggcgagggcaacagaagccuggugcacagacugagcgacggcgacaugaccagcgcccugagaggcguggccgacgaccagggccagcacccccugcugaagaugcugcugcaccugcuggccuucagcagcgccgccaccggccaccugcaggccagcgugcugacccagugccugaaggugcuggugaagcuggccgagaacaccagcugcgacuuccugcccagauuccagugcguguuccaggugcugcccaagugccugagccccgagaccccccugcccagcgugcugcuggccguggagcugcugagccugcuggccgaccacgaccagcuggccccccagcugugcagccacagcgagggcugccugcugcugcugcuguacauguacaucaccagcagacccgacagaguggcccuggagacccaguggcugcagcuggagcaggaggugguguggcugcuggccaagcugggcgugcagagcccccugccccccgugaccggcagcaacugccagugcaacguggagguggugagagcccugaccgugaugcugcacagacaguggcugaccgugagaagagccggcggcccccccagaaccgaccagcagagaagaaccgugagaugccugagagacaccgugcugcugcugcacggccugagccagaaggacaagcuguucaugaugcacugcguggaggugcugcaccaguucgaccaggugaugcccggcgugagcaugcugaucagaggccugcccgacgugaccgacugcgaggaggccgcccuggacgaccugugcgccgccgagaccgacguggaggaccccgagguggagugcggcuaa

SEQ ID NO: 14031 - RNA, 4290 nt, Artificial Sequence
  ATRN__Homo_sapiens__NP_647537
augguggccgccgccgccgccaccgaggccagacugagaagaagaaccgccgccaccgccgcccuggccggcagaagcggcggcccccacugggacugggacgugaccagagccggcagacccggccugggcgccggccugagacugcccagacugcugagccccccccugagacccagacugcugcugcugcugcugcugcugagccccccccugcugcugcugcugcugcccugcgaggccgaggccgccgccgccgccgccgccgugagcggcagcgccgccgccgaggccaaggagugcgacagacccugcgugaacggcggcagaugcaaccccggcaccggccagugcgugugccccgccggcugggugggcgagcagugccagcacugcggcggcagauucagacugaccggcagcagcggcuucgugaccgacggccccggcaacuacaaguacaagaccaagugcaccuggcugaucgagggccagcccaacagaaucaugagacugagauucaaccacuucgccaccgagugcagcugggaccaccuguacguguacgacggcgacagcaucuacgccccccugguggccgccuucagcggccugaucgugcccgagagagacggcaacgagaccgugcccgaggugguggccaccagcggcuacgcccugcugcacuucuucagcgacgccgccuacaaccugaccggcuucaacaucaccuacagcuucgacaugugccccaacaacugcagcggcagaggcgagugcaagaucagcaacagcagcgacaccguggagugcgagugcagcgagaacuggaagggcgaggccugcgacaucccccacugcaccgacaacugcggcuucccccacagaggcaucugcaacagcagcgacgugagaggcugcagcugcuucagcgacuggcagggccccggcugcagcgugcccgugcccgccaaccagagcuucuggaccagagaggaguacagcaaccugaagcugcccagagccagccacaaggccguggugaacggcaacaucauguggguggugggcggcuacauguucaaccacagcgacuacaacauggugcuggccuacgaccuggccagcagagaguggcugccccugaacagaagcgugaacaacgugguggugagauacggccacagccuggcccuguacaaggacaagaucuacauguacggcggcaagaucgacagcaccggcaacgugaccaacgagcugagaguguuccacauccacaacgagagcugggugcugcugacccccaaggccaaggagcaguacgccguggugggccacagcgcccacaucgugacccugaagaacggcagaguggugaugcuggugaucuucggccacugcccccuguacggcuacaucagcaacgugcaggaguacgaccuggacaagaacaccuggagcauccugcacacccagggcgcccuggugcagggcggcuacggccacagcagcguguacgaccacagaaccagagcccuguacgugcacggcggcuacaaggccuucagcgccaacaaguacagacuggccgacgaccuguacagauacgacguggacacccagauguggaccauccugaaggacagcagauucuucagauaccugcacaccgccgugaucgugagcggcaccaugcugguguucggcggcaacacccacaacgacaccagcaugagccacggcgccaagugcuucagcagcgacuucauggccuacgacaucgccugcgacagauggagcgugcugcccagacccgaccugcaccacgacgugaacagauucggccacagcgccgugcugcacaacagcaccauguacguguucggcggcuucaacagccugcugcugagcgacauccugguguucaccagcgagcagugcgacgcccacagaagcgaggccgccugccuggccgccggccccggcaucagaugcguguggaacaccggcagcagccagugcaucagcugggcccuggccaccgacgagcaggaggagaagcugaagagcgagugcuucagcaagagaacccuggaccacgacagaugcgaccagcacaccgacugcuacagcugcaccgccaacaccaacgacugccacuggugcaacgaccacugcgugcccagaaaccacagcugcagcgagggccagaucagcaucuucagauacgagaacugccccaaggacaaccccauguacuacugcaacaagaagaccagcugcagaagcugcgcccuggaccagaacugccagugggagcccagaaaccaggagugcaucgcccugcccgagaacaucugcggcaucggcuggcaccuggugggcaacagcugccugaagaucaccaccgccaaggagaacuacgacaacgccaagcuguucugcagaaaccacaacgcccugcuggccagccugaccacccagaagaagguggaguucgugcugaagcagcugagaaucaugcagagcagccagagcaugagcaagcugacccugacccccugggugggccugagaaagaucaacgugagcuacuggugcugggaggacaugagccccuucaccaacagccugcugcaguggaugcccagcgagcccagcgacgccggcuucugcggcauccugagcgagcccagcaccagaggccugaaggccgccaccugcaucaacccccugaacggcagcgugugcgagagacccgccaaccacagcgccaagcagugcagaacccccugcgcccugagaaccgccugcggcgacugcaccagcggcagcagcgagugcauguggugcagcaacaugaagcagugcguggacagcaacgccuacguggccagcuuccccuucggccagugcauggagugguacaccaugagcaccugcccccccgagaacugcagcggcuacugcaccugcagccacugccuggagcagcccggcugcggcuggugcaccgaccccagcaacaccggcaagggcaagugcaucgagggcagcuacaagggccccgugaagaugcccagccaggcccccaccggcaacuucuacccccagccccugcugaacagcagcaugugccuggaggacagcagauacaacuggagcuucauccacugccccgccugccagugcaacggccacagcaagugcaucaaccagagcaucugcgagaagugcgagaaccugaccaccggcaagcacugcgagaccugcaucagcggcuucuacggcgaccccaccaacggcggcaagugccagcccugcaagugcaacggccacgccagccugugcaacaccaacaccggcaagugcuucugcaccaccaagggcgugaagggcgacgagugccagcugugcgagguggagaacagauaccagggcaacccccugagaggcaccugcuacuacacccugcugaucgacuaccaguucaccuucagccugagccaggaggacgacagauacuacaccgccaucaacuucguggccacccccgacgagcagaacagagaccuggacauguucaucaacgccagcaagaacuucaaccugaacaucaccugggccgccagcuucagcgccggcacccaggccggcgaggagaugcccguggugagcaagaccaacaucaaggaguacaaggacagcuucagcaacgagaaguucgacuucagaaaccaccccaacaucaccuucuucguguacgugagcaacuucaccuggcccaucaagauccagaucgccuucagccagcacagcaacuucauggaccuggugcaguucuucgugaccuucuucagcugcuuccugagccugcugcugguggccgccgugguguggaagaucaagcagagcugcugggccagcagaagaagagagcagcugcugagagagaugcagcagauggccagcagacccuucgccagcgugaacguggcccuggagaccgacgaggagccccccgaccugaucggcggcagcaucaagaccgugcccaagcccaucgcccuggagcccugcuucggcaacaaggccgccgugcugagcguguucgugagacugcccagaggccugggcggcauccccccccccggccagagcggccuggccguggccagcgcccugguggacaucagccagcagaugcccaucguguacaaggagaagagcggcgccgugagaaacagaaagcagcagccccccgcccagcccggcaccugcaucuaa

SEQ ID NO: 14032 - RNA, 4140 nt, Artificial Sequence
  ATRNL1__Homo_sapiens__NP_997186
auggagaccggcggcagagccagaaccggcaccccccagcccgccgcccccggcguguggagagccagacccgccggcggcggcggcggcggcgccagcagcuggcugcuggacggcaacagcuggcugcugugcuacggcuuccuguaccuggcccuguacgcccaggugagccagagcaagcccugcgagagaaccggcagcugcuucagcggcagaugcgugaacagcaccugccugugcgaccccggcugggugggcgaccagugccagcacugccagggcagauucaagcugaccgagcccagcggcuaccugaccgacggccccaucaacuacaaguacaagaccaagugcaccuggcugaucgagggcuaccccaacgccgugcugagacugagauucaaccacuucgccaccgagugcagcugggaccacauguacguguacgacggcgacagcaucuacgccccccugaucgccgugcugagcggccugaucgugcccgagaucagaggcaacgagaccgugcccgagguggugaccaccagcggcuacgcccugcugcacuucuucagcgacgccgccuacaaccugaccggcuucaacaucuucuacagcaucaacagcugccccaacaacugcagcggccacggcaagugcaccaccagcgugagcgugcccagccagguguacugcgagugcgacaaguacuggaagggcgaggccugcgacauccccuacugcaaggccaacugcggcagccccgaccacggcuacugcgaccugaccggcgagaagcugugcgugugcaacgacagcuggcagggccccgacugcagccugaacgugcccagcaccgagagcuacuggauccugcccaacgugaagcccuucagccccagcgugggcagagccagccacaaggccgugcugcacggcaaguucaugugggugaucggcggcuacaccuucaacuacagcagcuuccagauggugcugaacuacaaccuggagagcagcaucuggaacgugggcacccccagcagaggcccccugcagagauacggccacagccuggcccuguaccaggagaacaucuucauguacggcggcagaaucgagaccaacgacggcaacgugaccgacgagcuguggguguucaacauccacagccagagcuggagcaccaagacccccaccgugcugggccacggccagcaguacgccguggagggccacagcgcccacaucauggagcuggacagcagagacguggugaugaucaucaucuucggcuacagcgccaucuacggcuacaccagcagcauccaggaguaccacaucagcagcaacaccuggcuggugcccgagaccaagggcgccaucgugcagggcggcuacggccacaccagcguguacgacgagaucaccaagagcaucuacgugcacggcggcuacaaggcccugcccggcaacaaguacggccugguggacgaccuguacaaguacgaggugaacaccaagaccuggaccauccugaaggagagcggcuucgccagauaccugcacagcgccgugcugaucaacggcgccaugcugaucuucggcggcaacacccacaacgacaccagccugagcaacggcgccaagugcuucagcgccgacuuccuggccuacgacaucgccugcgacgaguggaagauccugcccaagcccaaccugcacagagacgugaacagauucggccacagcgccguggugaucaacggcagcauguacaucuucggcggcuucagcagcgugcugcugaacgacauccugguguacaagccccccaacugcaaggccuucagagacgaggagcugugcaagaacgccggccccggcaucaagugcguguggaacaagaaccacugcgagagcugggagagcggcaacaccaacaacauccugagagccaagugcccccccaagaccgccgccagcgacgacagaugcuacagauacgccgacugcgccagcugcaccgccaacaccaacggcugccaguggugcgacgacaagaagugcaucagcgccaacagcaacugcagcaugagcgugaagaacuacaccaagugccacgugagaaacgagcagaucugcaacaagcugaccagcugcaagagcugcagccugaaccugaacugccagugggaccagagacagcaggagugccaggcccugcccgcccaccugugcggcgagggcuggagccacaucggcgacgccugccugagagugaacagcagcagagagaacuacgacaacgccaagcuguacugcuacaaccugagcggcaaccuggccagccugaccaccagcaaggagguggaguucgugcuggacgagauccagaaguacacccagcagaaggugagccccugggugggccugagaaagaucaacaucagcuacuggggcugggaggacaugagccccuucaccaacaccacccugcaguggcugcccggcgagcccaacgacagcggcuucugcgccuaccuggagagagccgccguggccggccugaaggccaaccccugcaccagcauggccaacggccuggugugcgagaagcccguggugagccccaaccagaacgccagacccugcaagaagcccugcagccugagaaccagcugcagcaacugcaccagcaacggcauggagugcauguggugcagcagcaccaagagaugcguggacagcaacgccuacaucaucagcuuccccuacggccagugccuggaguggcagaccgccaccugcagcccccagaacugcagcggccugagaaccugcggccagugccuggagcagcccggcugcggcuggugcaacgaccccagcaacaccggcagaggccacugcaucgagggcagcagcagaggccccaugaagcugaucggcaugcaccacagcgagauggugcuggacaccaaccugugccccaaggagaagaacuacgaguggagcuucauccagugccccgccugccagugcaacggccacagcaccugcaucaacaacaacgugugcgagcagugcaagaaccugaccaccggcaagcagugccaggacugcaugcccggcuacuacggcgaccccaccaacggcggccagugcaccgccugcaccugcagcggccacgccaacaucugccaccugcacaccggcaagugcuucugcaccaccaagggcaucaagggcgaccagugccagcugugcgacagcgagaacagauacgugggcaacccccugagaggcaccugcuacuacagccugcugaucgacuaccaguucaccuucagccugcugcaggaggacgacagacaccacaccgccaucaacuucaucgccaaccccgagcagagcaacaagaaccuggacaucagcaucaacgccagcaacaacuucaaccugaacaucaccuggagcgugggcagcaccgccggcaccaucagcggcgaggagaccagcaucgugagcaagaacaacaucaaggaguacagagacagcuucagcuacgagaaguucaacuucagaagcaaccccaacaucaccuucuacguguacgugagcaacuucagcuggcccaucaagauccagaucgccuucagccagcacaacaccaucauggaccuggugcaguucuucgugaccuucuucagcugcuuccugagccugcugcugguggccgccgugguguggaagaucaagcagaccugcugggccagcagaagaagagagcagcugcugagagagagacagcagauggccagcagacccuucgccagcguggacguggcccuggaggugggcgccgagcagaccgaguuccugagaggcccccuggagggcgcccccaagcccaucgccaucgagcccugcgccggcaacagagccgccgugcugaccguguuccugugccugcccagaggcagcagcggcgcccccccccccggccagagcggccuggccaucgccagcgcccugaucgacaucagccagcagaaggccagcgacagcaaggacaagaccagcggcgugagaaacagaaagcaccugagcaccagacagggcaccugcguguaa

SEQ ID NO: 14033 - RNA, 7479 nt, Artificial Sequence
  ATRX__Homo_sapiens__NP_000480
augaccgccgagcccaugagcgagagcaagcugaacacccuggugcagaagcugcacgacuuccuggcccacagcagcgaggagagcgaggagaccagcagcccccccagacuggccaugaaccagaacaccgacaagaucagcggcagcggcagcaacagcgacaugauggagaacagcaaggaggagggcaccagcagcagcgagaagagcaagagcagcggcagcagcagaagcaagagaaagcccagcaucgugaccaaguacguggagagcgacgacgagaagccccuggacgacgagaccgugaacgaggacgccagcaacgagaacagcgagaacgacaucaccaugcagagccugcccaagggcaccgugaucgugcagcccgagcccgugcugaacgaggacaaggacgacuucaagggccccgaguucagaagcagaagcaagaugaagaccgagaaccugaagaagagaggcgaggacggccugcacggcaucgugagcugcaccgccugcggccagcaggugaaccacuuccagaaggacagcaucuacagacaccccagccugcaggugcugaucugcaagaacugcuucaaguacuacaugagcgacgacaucagcagagacagcgacggcauggacgagcagugcagauggugcgccgagggcggcaaccugaucugcugcgacuucugccacaacgccuucugcaagaagugcauccugagaaaccugggcagaaaggagcugagcaccaucauggacgagaacaaccagugguacugcuacaucugccaccccgagccccugcuggaccuggugaccgccugcaacagcguguucgagaaccuggagcagcugcugcagcagaacaagaagaagaucaagguggacagcgagaagagcaacaagguguacgagcacaccagcagauucagccccaagaagaccagcagcaacugcaacggcgaggagaagaagcuggacgacagcugcagcggcagcgugaccuacagcuacagcgcccugaucgugcccaaggagaugaucaagaaggccaagaagcugaucgagaccaccgccaacaugaacagcagcuacgugaaguuccugaagcaggccaccgacaacagcgagaucagcagcgccaccaagcugagacagcugaaggccuucaagagcgugcuggccgacaucaagaaggcccaccuggcccuggaggaggaccugaacagcgaguucagagccauggacgccgugaacaaggagaagaacaccaaggagcacaaggugaucgacgccaaguucgagaccaaggccagaaagggcgagaagcccugcgcccuggagaagaaggacaucagcaagagcgaggccaagcugagcagaaagcagguggacagcgagcacaugcaccagaacgugcccaccgaggagcagagaaccaacaagagcaccggcggcgagcacaagaagagcgacagaaaggaggagccccaguacgagcccgccaacaccagcgaggaccuggacauggacaucgugagcgugcccagcagcgugcccgaggacaucuucgagaaccuggagaccgccauggaggugcagagcagcguggaccaccagggcgacggcagcagcggcaccgagcaggagguggagagcagcagcgugaagcugaacaucagcagcaaggacaacagaggcggcaucaagagcaagaccaccgccaaggugaccaaggagcuguacgugaagcugacccccgugagccugagcaacagccccaucaagggcgccgacugccaggaggugccccaggacaaggacggcuacaagagcugcggccugaaccccaagcuggagaagugcggccugggccaggagaacagcgacaacgagcaccugguggagaacgaggugagccugcugcuggaggagagcgaccugagaagaagccccagagugaagaccaccccccugagaagacccaccgagaccaaccccgugaccagcaacagcgacgaggagugcaacgagaccgugaaggagaagcagaagcugagcgugcccgugagaaagaaggacaagagaaacagcagcgacagcgccaucgacaaccccaagcccaacaagcugcccaagagcaagcagagcgagaccguggaccagaacagcgacagcgacgagaugcuggccauccugaaggaggugagcagaaugagccacagcagcagcagcgacaccgacaucaacgagauccacaccaaccacaagacccuguacgaccugaagacccaggccggcaaggacgacaagggcaagagaaagagaaagagcagcaccagcggcagcgacuucgacaccaagaagggcaagagcgccaagagcagcaucaucagcaagaagaagagacagacccagagcgagagcagcaacuacgacagcgagcuggagaaggagaucaagagcaugagcaagaucggcgccgccagaaccaccaagaagagaauccccaacaccaaggacuucgacagcagcgaggacgagaagcacagcaagaagggcauggacaaccagggccacaagaaccugaagaccagccaggagggcagcagcgacgacgccgagagaaagcaggagagagagaccuucagcagcgccgagggcaccguggacaaggacaccaccaucauggagcugagagacagacugcccaagaagcagcaggccagcgccagcaccgacggcguggacaagcugagcggcaaggaggagagcuucaccagccuggaggugagaaagguggccgagaccaaggagaagagcaagcaccugaagaccaagaccugcaagaaggugcaggacggccugagcgacaucgccgagaaguuccugaagaaggaccagagcgacgagaccagcgaggacgacaagaagcagagcaagaagggcaccgaggagaagaagaagcccagcgacuucaagaagaaggugaucaagauggagcagcaguacgagagcagcagcgacggcaccgagaagcugcccgagagagaggagaucugccacuuccccaagggcaucaagcagaucaagaacggcaccaccgacggcgagaagaagagcaagaagaucagagacaagaccagcaagaagaaggacgagcugagcgacuacgccgagaagagcaccggcaagggcgacagcugcgacagcagcgaggacaagaagagcaagaacggcgccuacggcagagagaagaagagaugcaagcugcugggcaagagcagcagaaagagacaggacugcagcagcagcgacaccgagaaguacagcaugaaggaggacggcugcaacagcagcgacaagagacugaagagaaucgagcugagagagagaagaaaccugagcagcaagagaaacaccaaggagauccagagcggcagcagcagcagcgacgccgaggagagcagcgaggacaacaagaagaagaagcagagaaccagcagcaagaagaaggccgugaucgugaaggagaagaagagaaacagccugagaaccagcaccaagagaaagcaggccgacaucaccagcagcagcagcagcgacaucgaggacgacgaccagaacagcaucggcgagggcagcagcgacgagcagaagaucaagcccgugaccgagaaccuggugcugagcagccacaccggcuucugccagagcagcggcgacgaggcccugagcaagagcgugcccgugaccguggacgacgacgacgacgacaacgaccccgagaacagaaucgccaagaagaugcugcuggaggagaucaaggccaaccugagcagcgacgaggacggcagcagcgacgacgagcccgaggagggcaagaagagaaccggcaagcagaacgaggagaaccccggcgacgaggaggccaagaaccaggugaacagcgagagcgacagcgacagcgaggagagcaagaagcccagauacagacacagacugcugagacacaagcugaccgugagcgacggcgagagcggcgaggagaagaagaccaagcccaaggagcacaaggaggugaagggcagaaacagaagaaaggugagcagcgaggacagcgaggacagcgacuuccaggagagcggcgugagcgaggaggugagcgagagcgaggacgagcagagacccagaaccagaagcgccaagaaggccgagcuggaggagaaccagagaagcuacaagcagaagaagaagagaagaagaaucaaggugcaggaggacagcagcagcgagaacaagagcaacagcgaggaggaggaggaggagaaggaggaggaggaggaggaggaggaggaggaggaggaggaggaggaggacgagaacgacgacagcaagagccccggcaagggcagaaagaagaucagaaagauccugaaggacgacaagcugagaaccgagacccagaacgcccugaaggaggaggaggagagaagaaagagaaucgccgagagagagagagagagagagaagcugagagaggugaucgagaucgaggacgccagccccaccaagugccccaucaccaccaagcuggugcuggacgaggacgaggagaccaaggagccccuggugcaggugcacagaaacauggugaucaagcugaagccccaccagguggacggcgugcaguucaugugggacugcugcugcgagagcgugaagaagaccaagaagagccccggcagcggcugcauccuggcccacugcaugggccugggcaagacccugcagguggugagcuuccugcacaccgugcugcugugcgacaagcuggacuucagcaccgcccugguggugugcccccugaacaccgcccugaacuggaugaacgaguucgagaaguggcaggagggccugaaggacgacgagaagcuggaggugagcgagcuggccaccgugaagagaccccaggagagaagcuacaugcugcagagauggcaggaggacggcggcgugaugaucaucggcuacgagauguacagaaaccuggcccagggcagaaacgugaagagcagaaagcugaaggagaucuucaacaaggcccugguggaccccggccccgacuucguggugugcgacgagggccacauccugaagaacgaggccagcgccgugagcaaggccaugaacagcaucagaagcagaagaagaaucauccugaccggcaccccccugcagaacaaccugaucgaguaccacugcauggugaacuucaucaaggagaaccugcugggcagcaucaaggaguucagaaacagauucaucaaccccauccagaacggccagugcgccgacagcaccaugguggacgugagagugaugaagaagagagcccacauccuguacgagaugcuggccggcugcgugcagagaaaggacuacaccgcccugaccaaguuccugccccccaagcacgaguacgugcuggccgugagaaugaccagcauccagugcaagcuguaccaguacuaccuggaccaccugaccggcgugggcaacaacagcgagggcggcagaggcaaggccggcgccaagcuguuccaggacuuccagaugcugagcagaaucuggacccaccccuggugccugcagcuggacuacaucagcaaggagaacaagggcuacuucgacgaggacagcauggacgaguucaucgccagcgacagcgacgagaccagcaugagccugagcagcgacgacuacaccaagaagaagaagaagggcaagaagggcaagaaggacagcagcagcagcggcagcggcagcgacaacgacguggaggugaucaagguguggaacagcagaagcagaggcggcggcgagggcaacguggacgagaccggcaacaaccccagcgugagccugaagcuggaggagagcaaggccaccagcagcagcaaccccagcagccccgcccccgacugguacaaggacuucgugaccgacgccgacgccgaggugcuggagcacagcggcaagauggugcugcuguucgagauccugagaauggccgaggagaucggcgacaaggugcugguguucagccagagccugaucagccuggaccugaucgaggacuuccuggagcuggccagcagagagaagaccgaggacaaggacaagccccugaucuacaagggcgagggcaaguggcugagaaacaucgacuacuacagacuggacggcagcaccaccgcccagagcagaaagaagugggccgaggaguucaacgacgagaccaacgugagaggcagacuguucaucaucagcaccaaggccggcagccugggcaucaaccugguggccgccaacagagugaucaucuucgacgccagcuggaaccccagcuacgacauccagagcaucuucagaguguacagauucggccagaccaagcccguguacguguacagauuccuggcccagggcaccauggaggacaagaucuacgacagacaggugaccaagcagagccugagcuucagagugguggaccagcagcagguggagagacacuucaccaugaacgagcugaccgagcuguacaccuucgagcccgaccugcuggacgaccccaacagcgagaagaagaagaagagagacacccccaugcugcccaaggacaccauccuggccgagcugcugcagauccacaaggagcacaucgugggcuaccacgagcacgacagccugcuggaccacaaggaggaggaggagcugaccgaggaggagagaaaggccgccugggccgaguacgaggccgagaagaagggccugaccaugagauucaacauccccaccggcaccaaccugccccccgugagcuucaacagccagacccccuacauccccuucaaccugggcgcccugagcgccaugagcaaccagcagcuggaggaccugaucaaccagggcagagagaaggugguggaggccaccaacagcgugaccgccgugagaauccagccccuggaggacaucaucagcgccguguggaaggagaacaugaaccugagcgaggcccaggugcaggcccuggcccugagcagacaggccagccaggagcuggacgugaagagaagagaggccaucuacaacgacgugcugaccaagcagcagaugcugaucagcugcgugcagagaauccugaugaacagaagacugcagcagcaguacaaccagcagcagcagcagcagaugaccuaccagcaggccacccugggccaccugaugaugcccaagccccccaaccugaucaugaaccccagcaacuaccagcagaucgacaugagaggcauguaccagcccguggccggcggcaugcagccccccccccugcagagagcccccccccccaugagaagcaagaaccccggccccagccagggcaagagcauguaa

SEQ ID NO: 14034 - RNA, 1236 nt, Artificial Sequence
  ATXN10__Homo_sapiens__NP_001161093
auggccgcccccagacccccccccgccagacugagcggcgugauggugcccgcccccauccaggaccuggaggcccugagagcccugaccgcccuguucaaggagcagagaaacagaaaccuggacaccaucggcguggccguggaccugauccugcuguucagagagcugagaguggagcaggagagccugcugaccgccuucagaugcggccugcaguuccugggcaacaucgccagcagaaacgaggacagccagagcaucgugugggugcacgccuuccccgagcuguuccugagcugccugaaccaccccgacaagaagaucguggccuacagcagcaugauccuguucaccagccugaaccacgagagaaugaaggagcuggaggagaaccugaacaucgccaucgacgugaucgacgccuaccagaagcaccccgagagcgaguggcccuuccugaucaucaccgaccuguuccugaagagccccgagcuggugcaggccauguuccccaagcugaacaaccaggagagagugacccugcuggaccugaugaucgccaagaucaccagcgacgagccccugaccaaggacgacauccccguguuccugagacacgccgagcugaucgccagcaccuucguggaccagugcaagaccgugcugaagcuggccagcgaggagccccccgacgacgaggaggcccuggccaccaucagacugcuggacgugcugugcgagaugaccgugaacaccgagcugcugggcuaccugcagguguuccccggccugcuggagagagugaucgaccugcugagagugauccacguggccggcaaggagaccaccaacaucuucagcaacugcggcugcgugagagccgagggcgacaucagcaacguggccaacggcuucaagagccaccugaucagacugaucggcaaccugugcuacaagaacaaggacaaccaggacaaggugaacgagcuggacggcaucccccugauccuggacaacugcaacaucagcgacagcaaccccuuccugacccagugggugaucuacgccaucagaaaccugaccgaggacaacagccagaaccaggaccugaucgccaagauggaggagcagggccuggccgacgccagccugcugaagaaggugggcuucgagguggagaagaagggcgagaagcugauccugaagagcaccagagacacccccaagcccuaa

SEQ ID NO: 14035 - RNA, 2448 nt, Artificial Sequence
  ATXN1__Homo_sapiens__NP_001121636
augaagagcaaccaggagagaagcaacgagugccugccccccaagaagagagagauccccgccaccagcagaagcagcgaggagaaggcccccacccugcccagcgacaaccacagaguggagggcaccgccuggcugcccggcaaccccggcggcagaggccacggcggcggcagacacggccccgccggcaccagcguggagcugggccugcagcagggcaucggccugcacaaggcccugagcaccggccuggacuacagcccccccagcgcccccagaagcgugcccguggccaccacccugcccgccgccuacgccaccccccagcccggcacccccgugagccccgugcaguacgcccaccugccccacaccuuccaguucaucggcagcagccaguacagcggcaccuacgccagcuucauccccagccagcugaucccccccaccgccaaccccgugaccagcgccguggccagcgccgccggcgccaccacccccagccagagaagccagcuggaggccuacagcacccugcuggccaacaugggcagccugagccagacccccggccacaaggccgagcagcagcagcagcagcagcagcagcagcagcagcagcaccagcaccagcagcagcagcagcagcagcagcagcagcagcagcagcagcaccugagcagagcccccggccugaucacccccggcagccccccccccgcccagcagaaccaguacgugcacaucagcagcagcccccagaacaccggcagaaccgccagcccccccgccauccccgugcaccugcacccccaccagaccaugaucccccacacccugacccugggcccccccagccagguggugaugcaguacgccgacagcggcagccacuucgugcccagagaggccaccaagaaggccgagagcagcagacugcagcaggccauccaggccaaggaggugcugaacggcgagauggagaagagcagaagauacggcgcccccagcagcgccgaccugggccugggcaaggccggcggcaagagcgugccccaccccuacgagagcagacacgugguggugcaccccagccccagcgacuacagcagcagagaccccagcggcgugagagccagcgugauggugcugcccaacagcaacacccccgccgccgaccuggaggugcagcaggccacccacagagaggccagccccagcacccugaacgacaagagcggccugcaccugggcaagcccggccacagaagcuacgcccugagcccccacaccgugauccagaccacccacagcgccagcgagccccugcccgugggccugcccgccaccgccuucuacgccggcacccagccccccgugaucggcuaccugagcggccagcagcaggccaucaccuacgccggcagccugccccagcaccuggugauccccggcacccagccccugcugauccccgugggcagcaccgacauggaggccagcggcgccgcccccgccaucgugaccagcagcccccaguucgccgccgugccccacaccuucgugaccaccgcccugcccaagagcgagaacuucaaccccgaggcccuggugacccaggccgccuaccccgccauggugcaggcccagauccaccugcccguggugcagagcguggccagccccgccgccgccccccccacccugccccccuacuucaugaagggcagcaucauccagcuggccaacggcgagcugaagaagguggaggaccugaagaccgaggacuucauccagagcgccgagaucagcaacgaccugaagaucgacagcagcaccguggagagaaucgaggacagccacagccccggcguggccgugauccaguucgccgugggcgagcacagagcccaggugagcguggaggugcugguggaguaccccuucuucguguucggccagggcuggagcagcugcugccccgagagaaccagccagcuguucgaccugcccugcagcaagcugagcgugggcgacgugugcaucagccugacccugaagaaccugaagaacggcagcgugaagaagggccagcccguggaccccgccagcgugcugcugaagcacagcaaggccgacggccuggccggcagcagacacagauacgccgagcaggagaacggcaucaaccagggcagcgcccagaugcugagcgagaacggcgagcugaaguuccccgagaagaugggccugcccgccgcccccuuccugaccaagaucgagcccagcaagcccgccgccaccagaaagagaagauggagcgcccccgagagcagaaagcuggagaagagcgaggacgagcccccccugacccugcccaagcccagccugaucccccaggaggugaagaucugcaucgagggcagaagcaacgugggcaaguaa

SEQ ID NO: 14036 - RNA, 2070 nt, Artificial Sequence
  ATXN1L__Homo_sapiens__NP_001131147
augaagcccgugcacgagagaagccaggagugccugccccccaagaagagagaccugcccgugaccagcgaggacaugggcagaaccaccagcugcagcaccaaccacacccccagcagcgacgccagcgaguggagcagaggcguggugguggccggccagagccaggccggcgccagagugagccugggcggcgacggcgccgaggccaucaccggccugaccguggaccaguacggcaugcuguacaagguggccgugccccccgccaccuucagccccaccggccugcccagcguggugaacaugagcccccugccccccaccuucaacguggccagcagccugauccagcaccccggcauccacuaccccccccugcacuacgcccagcugcccagcaccagccugcaguucaucggcagccccuacagccugcccuacgccgugccccccaacuuccugcccagcccccugcugagccccagcgccaaccuggccaccagccaccugccccacuucgugcccuacgccagccugcuggccgagggcgccaccccccccccccaggcccccagccccgcccacagcuucaacaaggcccccagcgccaccagccccagcggccagcugccccaccacagcagcacccagccccuggaccuggcccccggcagaaugcccaucuacuaccagaugagcagacugcccgccggcuacacccugcacgagaccccccccgccggcgccagccccgugcugaccccccaggagagccagagcgcccuggaggccgccgccgccaacggcggccagagacccagagagagaaaccuggugagaagagagagcgaggcccuggacagccccaacagcaagggcgagggccagggccuggugcccgugguggagugcgugguggacggccagcuguucagcggcagccagacccccagaguggagguggccgcccccgcccacagaggcacccccgacaccgaccuggaggugcagagaguggugggcgcccuggccagccaggacuacagagugguggccgcccagagaaaggaggagcccagcccccugaaccugagccaccacacccccgaccaccagggcgagggcagaggcagcgccagaaaccccgccgagcuggccgagaagagccaggccagaggcuucuacccccagagccaccaggagcccgugaagcacagaccccugcccaaggccauggugguggccaacggcaaccuggugcccaccggcaccgacagcggccugcugcccgugggcagcgagauccugguggccagcagccuggacgugcaggccagagccaccuuccccgacaaggagcccacccccccccccaucaccagcagccaccugcccagccacuucaugaagggcgccaucauccagcuggccaccggcgagcugaagagaguggaggaccugcagacccaggacuucgugagaagcgccgaggugagcggcggccugaagaucgacagcagcaccgugguggacauccaggagagccaguggcccggcuucgugaugcugcacuucguggugggcgagcagcagagcaaggugagcaucgaggugccccccgagcaccccuucuucguguacggccagggcuggagcagcugcagccccggcagaaccacccagcuguucagccugcccugccacagacugcaggugggcgacgugugcaucagcaucagccugcagagccugaacagcaacagcgugagccaggccagcugcgccccccccagccagcugggcccccccagagagagacccgagagaaccgugcugggcagcagagagcugugcgacagcgagggcaagagccagcccgccggcgagggcagcagagugguggagcccagccagcccgagagcggcgcccaggccugcuggcccgcccccagcuuccagagauacagcaugcagggcgaggaggccagagccgcccugcugagacccagcuucaucccccaggaggugaagcugagcaucgagggcagaagcaacgccggcaaguaa

SEQ ID NO: 14037 - RNA, 3942 nt, Artificial Sequence
  ATXN2__Homo_sapiens__NP_002964
augagaagcgccgccgccgcccccagaagccccgccguggccaccgagagcagaagauucgccgccgccagauggcccggcuggagaagccugcagagacccgccagaagaagcggcagaggcggcggcggcgccgcccccggccccuaccccagcgccgccccccccccccccggccccggccccccccccagcagacagagcagcccccccagcgccagcgacugcuucggcagcaacggcaacggcggcggcgccuucagacccggcagcagaagacugcugggccugggcggcccccccagacccuucguggugcugcugcugccccuggccagccccggcgccccccccgccgcccccaccagagccagcccccugggcgccagagccagcccccccagaagcggcgugagccuggccagacccgcccccggcugccccagacccgccugcgagcccguguacggcccccugaccaugagccugaagccccagcagcagcagcagcagcagcagcagcagcagcagcagcagcagcagcagcagcagcagcagcagcagcccccccccgccgccgccaacgugagaaagcccggcggcagcggccugcuggccagccccgccgccgcccccagccccagcagcagcagcgugagcagcagcagcgccaccgcccccagcagcgugguggccgccaccagcggcggcggcagacccggccugggcagaggcagaaacagcaacaagggccugccccagagcaccaucagcuucgacggcaucuacgccaacaugagaauggugcacauccugaccagcguggugggcagcaagugcgaggugcaggugaagaacggcggcaucuacgagggcguguucaagaccuacagccccaagugcgaccuggugcuggacgccgcccacgagaagagcaccgagagcagcagcggccccaagagagaggagaucauggagagcauccuguucaagugcagcgacuucgugguggugcaguucaaggacauggacagcagcuacgccaagagagacgccuucaccgacagcgccaucagcgccaaggugaacggcgagcacaaggagaaggaccuggagcccugggacgccggcgagcugaccgccaacgaggagcuggaggcccuggagaacgacgugagcaacggcugggaccccaacgacauguucagauacaacgaggagaacuacggcguggugagcaccuacgacagcagccugagcagcuacaccgugccccuggagagagacaacagcgaggaguuccugaagagagaggccagagccaaccagcuggccgaggagaucgagagcagcgcccaguacaaggccagaguggcccuggagaacgacgacagaagcgaggaggagaaguacaccgccgugcagagaaacagcagcgagagagagggccacagcaucaacaccagagagaacaaguacaucccccccggccagagaaacagagaggugaucagcuggggcagcggcagacagaacagccccagaaugggccagcccggcagcggcagcaugcccagcagaagcaccagccacaccagcgacuucaaccccaacagcggcagcgaccagagaguggugaacggcggcgugcccuggcccagccccugccccagccccagcagcagaccccccagcagauaccagagcggccccaacagccugccccccagagccgccacccccaccagaccccccagcagaccccccagcagacccagcagaccccccagccaccccagcgcccacggcagccccgcccccgugagcaccaugcccaagagaaugagcagcgagggcccccccagaaugagccccaaggcccagagacaccccagaaaccacagagugagcgccggcagaggcagcaucagcagcggccuggaguucgugagccacaacccccccagcgaggccgccaccccccccguggccagaaccagccccagcggcggcaccuggagcagcguggugagcggcgugcccagacugagccccaagacccacagacccagaagccccagacagaacagcaucggcaacacccccagcggccccgugcuggccagcccccaggccggcaucauccccaccgaggccguggccaugcccauccccgccgccagccccacccccgccagccccgccagcaacagagccgugacccccagcagcgaggccaaggacagcagacugcaggaccagagacagaacagccccgccggcaacaaggagaacaucaagcccaacgagaccagccccagcuucagcaaggccgagaacaagggcaucagccccguggugagcgagcacagaaagcagaucgacgaccugaagaaguucaagaacgacuucagacugcagcccagcagcaccagcgagagcauggaccagcugcugaacaagaacagagagggcgagaagagcagagaccugaucaaggacaagaucgagcccagcgccaaggacagcuucaucgagaacagcagcagcaacugcaccagcggcagcagcaagcccaacagccccagcaucagccccagcauccugagcaacaccgagcacaagagaggccccgaggugaccagccagggcgugcagaccagcagccccgccugcaagcaggagaaggacgacaaggaggagaagaaggacgccgccgagcaggugagaaagagcacccugaaccccaacgccaaggaguucaaccccagaagcuucagccagcccaagcccagcaccacccccaccagccccagaccccaggcccagcccagccccagcauggugggccaccagcagcccacccccguguacacccagcccgugugcuucgcccccaacaugauguaccccgugcccgugagccccggcgugcagccccuguaccccauccccaugacccccaugcccgugaaccaggccaagaccuacagagccgugcccaacaugccccagcagagacaggaccagcaccaccagagcgccaugaugcaccccgccagcgccgccggcccccccaucgccgccaccccccccgccuacagcacccaguacguggccuacagcccccagcaguuccccaaccagccccuggugcagcacgugccccacuaccagagccagcacccccacguguacagccccgugauccagggcaacgccagaaugauggccccccccacccacgcccagcccggccuggugagcagcagcgccacccaguacggcgcccacgagcagacccacgccauguacgccugccccaagcugcccuacaacaaggagaccagccccagcuucuacuucgccaucagcaccggcagccuggcccagcaguacgcccaccccaacgccacccugcacccccacaccccccacccccagcccagcgccacccccaccggccagcagcagagccagcacggcggcagccaccccgcccccagccccgugcagcaccaccagcaccaggccgcccaggcccugcaccuggccagcccccagcagcagagcgccaucuaccacgccggccuggcccccaccccccccagcaugacccccgccagcaacacccagagcccccagaacagcuuccccgccgcccagcagaccguguucaccauccaccccagccacgugcagcccgccuacaccaaccccccccacauggcccacgugccccaggcccacgugcagagcggcauggugcccagccaccccaccgcccacgcccccaugaugcugaugaccacccagccccccggcggcccccaggccgcccuggcccagagcgcccugcagcccauccccgugagcaccaccgcccacuuccccuacaugacccaccccagcgugcaggcccaccaccagcagcagcuguaa

SEQ ID NO: 14038 - RNA, 3228 nt, Artificial Sequence
  ATXN2L__Homo_sapiens__NP_009176
augcugaagccccagccccugcagcagcccagccagccccagcagcccccccccacccagcaggccguggccagaagaccccccggcggcaccagcccccccaacggcggccugcccggcccccuggccaccagcgccgccccccccggcccccccgccgccgccagccccugccugggccccguggccgccgccggcagcggccugagaagaggcgccgagggcauccuggccccccagcccccccccccccagcagcaccaggagagacccggcgccgccgccaucggcagcgccagaggccagagcaccggcaagggccccccccagagccccguguucgagggcguguacaacaacagcagaaugcugcacuuccugaccgccguggugggcagcaccugcgacgugaaggugaagaacggcaccaccuacgagggcaucuucaagacccugagcagcaaguucgagcuggccguggacgccgugcacagaaaggccagcgagcccgccggcggccccagaagagaggacaucguggacaccaugguguucaagcccagcgacgugaugcuggugcacuucagaaacguggacuucaacuacgccaccaaggacaaguucaccgacagcgccaucgccaugaacagcaaggugaacggcgagcacaaggagaaggugcugcagagaugggagggcggcgacagcaacagcgacgacuacgaccuggagagcgacaugagcaacggcugggaccccaacgagauguucaaguucaacgaggagaacuacggcgugaagaccaccuacgacagcagccugagcagcuacaccgugccccuggagaaggacaacagcgaggaguucagacagagagagcugagagccgcccagcuggccagagagaucgagagcagcccccaguacagacugagaaucgccauggagaacgacgacggcagaaccgaggaggagaagcacagcgccgugcagagacagggcagcggcagagagagccccagccuggccagcagagagggcaaguacaucccccugccccagagagugagagagggccccagaggcggcgugagaugcagcagcagcagaggcggcagacccggccugagcagccugccccccagaggcccccaccaccuggacaacagcagccccggccccggcagcgaggccagaggcaucaacggcggccccagcagaaugagccccaaggcccagagaccccugagaggcgccaagacccugagcagccccagcaacagacccagcggcgagaccagcgugccccccccccccgccgugggcagaauguacccccccagaagccccaagagcgccgcccccgcccccaucagcgccagcugccccgagccccccaucggcagcgccgugcccaccagcagcgccagcauccccgugaccagcagcgugagcgaccccggcgugggcagcaucagccccgccagccccaagaucagccuggcccccaccgacgugaaggagcugagcaccaaggagcccggcagaacccuggagccccaggagcuggccagaaucgccggcaaggugcccggccugcagaacgagcagaagagauuccagcuggaggagcugagaaaguucggcgcccaguucaagcugcagcccagcagcagccccgagaacagccuggaccccuucccccccagaauccugaaggaggagcccaagggcaaggagaaggagguggacggccugcugaccagcgagcccaugggcagccccgugagcagcaagaccgagagcgugagcgacaaggaggacaagcccccccuggcccccagcggcggcaccgagggccccgagcagccccccccccccugccccagccagaccggcagcccccccgugggccugaucaagggcgaggacaaggacgagggccccguggccgagcaggugaagaagagcacccugaaccccaacgccaaggaguucaaccccaccaagccccugcugagcgugaacaagagcaccagcacccccaccagccccggccccagaacccacagcacccccagcauccccgugcugaccgccggccagagcggccuguacagcccccaguacaucagcuacaucccccagauccacaugggccccgccgugcaggccccccagauguaccccuaccccgugagcaacagcgugcccggccagcagggcaaguacagaggcgccaagggcagccugcccccccagagaagcgaccagcaccagcccgccagcgccccccccaugaugcaggccgccgccgccgccggccccccccugguggccgccacccccuacagcagcuacauccccuacaacccccagcaguuccccggccagcccgccaugaugcagcccauggcccacuaccccagccagcccguguucgcccccaugcugcagagcaaccccagaaugcugaccagcggcagccacccccaggccaucgugagcagcagcaccccccaguaccccagcgccgagcagcccaccccccaggcccuguacgccaccgugcaccagagcuacccccaccacgccacccagcugcacgcccaccagccccagcccgccaccacccccaccggcagccagccccagagccagcacgccgcccccagccccgugcagcaccaggccggccaggccccccaccugggcagcggccagccccagcagaaccuguaccaccccggcgcccugaccggcaccccccccagccugccccccggccccagcgcccagagcccccagagcagcuucccccagcccgccgccguguacgccauccaccaccagcagcugccccacggcuucaccaacauggcccacgugacccaggcccacgugcagaccggcaucaccgccgccccccccccccaccccggcgccccccaccccccccaggugaugcugcugcaccccccccagagccacggcggccccccccagggcgccgugccccagagcggcgugcccgcccugagcgccagcacccccagccccuaccccuacaucggccacccccagggcgagcagcccggccaggcccccggcuuccccggcggcgccgacgacagaaucagagaguucagccuggccggcggcaucuggcacggcagagccgagggccugcaggugggccaggacgccagagugcugggcggcgaguaa

SEQ ID NO: 14039 - RNA, 1041 nt, Artificial Sequence
  ATXN3__Homo_sapiens__NP_001121168
auggagagcaucuuccacgagaagcaggagggcagccugugcgcccagcacugccugaacaaccugcugcagggcgaguacuucagccccguggagcugagcagcaucgcccaccagcuggacgaggaggagagaaugagaauggccgagggcggcgugaccagcgaggacuacagaaccuuccugcaggugaucagcaacgcccugaagguguggggccuggagcugauccuguucaacagccccgaguaccagagacugagaaucgaccccaucaacgagagaagcuucaucugcaacuacaaggagcacugguucaccgugagaaagcugggcaagcagugguucaaccugaacagccugcugaccggccccgagcugaucagcgacaccuaccuggcccuguuccuggcccagcugcagcaggagggcuacagcaucuucguggugaagggcgaccugcccgacugcgaggccgaccagcugcugcagaugaucagagugcagcagaugcacagacccaagcugaucggcgaggagcuggcccagcugaaggagcagagagugcacaagaccgaccuggagagagugcuggaggccaacgacggcagcggcaugcuggacgaggacgaggaggaccugcagagagcccuggcccugagcagacaggagaucgacauggaggacgaggaggccgaccugagaagagccauccagcugagcaugcagggcagcagcagaaacaucagccaggacaugacccagaccagcggcaccaaccugaccagcgaggagcugagaaagagaagagaggccuacuucgagaagcagcagcagaagcagcagcagcagcagcagcagcagcagcagggcgaccugagcggccagagcagccaccccugcgagagacccgccaccagcagcggcgcccugggcagcgaccugggcgacgccaugagcgaggaggacaugcugcaggccgccgugaccaugagccuggagaccgugagaaacgaccugaagaccgagggcaagaaguaa

SEQ ID NO: 14040 - RNA, 2679 nt, Artificial Sequence
  ATXN7__Homo_sapiens__NP_000324
augagcgagagagccgccgacgacgugagaggcgagcccagaagagccgccgccgccgccggcggcgccgccgccgccgccgccagacagcagcagcagcagcagcagcagcagcagcccccccccccccagccccagagacagcagcaccccccccccccccccagaagaaccagacccgaggacggcggccccggcgccgccagcaccagcgccgccgccauggccaccgugggcgagagaagaccccugcccagccccgaggugaugcugggccagagcuggaaccuguggguggaggccagcaagcugcccggcaaggacggcaccgagcuggacgagagcuucaaggaguucggcaagaacagagaggugaugggccugugcagagaggacaugcccaucuucggcuucugccccgcccacgacgacuucuaccugguggugugcaacgacugcaaccagguggugaagccccaggccuuccagagccacuacgagagaagacacagcagcagcagcaagcccccccuggccgugccccccaccagcguguucagcuucuuccccagccugagcaagagcaagggcggcagcgccagcggcagcaacagaagcagcagcggcggcgugcugagcgccagcagcagcagcagcaagcugcugaagagccccaaggagaagcugcagcugagaggcaacaccagacccaugcaccccauccagcagagcagagugccccacggcagaaucaugacccccagcgugaagguggagaagauccaccccaagauggacggcacccugcugaagagcgccgugggccccaccugccccgccaccgugagcagccuggugaagcccggccugaacugccccagcauccccaagcccacccugcccagccccggccagauccugaacggcaagggccugcccgccccccccacccuggagaagaagcccgaggacaacagcaacaacagaaaguuccugaacaagagacugagcgagagagaguucgaccccgacauccacugcggcgugaucgaccuggacaccaagaagcccugcaccagaagccugaccugcaagacccacagccugacccagagaagagccgugcagggcagaagaaagagauucgacgugcugcuggccgagcacaagaacaagaccagagagaaggagcugaucagacaccccgacagccagcagcccccccagccccugagagacccccaccccgccccccccagaaccagccaggagccccaccagaacccccacggcgugauccccagcgagagcaagcccuucguggccagcaagcccaagccccacacccccagccugcccagaccccccggcugccccgcccagcagggcggcagcgcccccaucgaccccccccccgugcacgagagcccccaccccccccugcccgccaccgagcccgccagcagacugagcagcgaggagggcgagggcgacgacaaggaggagagcguggagaagcuggacugccacuacagcggccaccacccccagcccgccagcuucugcaccuucggcagcagacagaucggcagaggcuacuacguguucgacagcagauggaacagacugagaugcgcccugaaccugaugguggagaagcaccugaacgcccagcuguggaagaagaucccccccgugcccagcaccaccagccccaucagcaccagaaucccccacagaaccaacagcgugcccaccagccagugcggcgugagcuaccuggccgccgccaccgugagcaccagccccgugcugcugagcagcaccugcaucagccccaacagcaagagcgugcccgcccacggcaccacccugaacgcccagcccgccgccagcggcgccauggaccccgugugcagcaugcagagcagacaggugagcagcagcagcagcagccccagcacccccagcggccugagcagcgugcccagcagccccaugagcagaaagccccagaagcugaagagcagcaagagccugagacccaaggagagcagcggcaacagcaccaacugccagaacgccagcagcagcaccagcggcggcagcggcaagaagagaaagaacagcagcccccugcuggugcacagcagcagcagcagcagcagcagcagcagcagcagccacagcauggagagcuucagaaagaacugcguggcccacagcggcccccccuaccccagcaccgugaccagcagccacagcaucggccugaacugcgugaccaacaaggccaacgccgugaacgugagacacgaccagagcggcagaggcccccccaccggcagccccgccgagagcaucaagagaaugagcgugauggugaacagcagcgacagcacccugagccugggccccuucauccaccagagcaacgagcugcccgugaacagccacggcagcuucagccacagccacaccccccuggacaagcugaucggcaagaagagaaagugcagccccagcagcagcagcaucaacaacagcagcagcaagcccaccaagguggccaaggugcccgccgugaacaacgugcacaugaagcacaccggcaccauccccggcgcccagggccugaugaacagcagccugcugcaccagcccaaggccagacccuaa

SEQ ID NO: 14041 - RNA, 294 nt, Artificial Sequence
  ATXN7L3B__Homo_sapiens__NP_001129734
auggaggagaucagccuggccaaccuggacaccaacaagcuggaggccaucgcccaggagaucuacguggaccugaucgaggacagcugccugggcuucugcuucgaggugcacagagccgugaagugcggcuacuucuaccuggaguucgccgagaccggcagcgugaaggacuucggcauccagcccguggaggacaagggcgccugcagacugccccugugcagccugcccggcgagcccggcaacggccccgaccagcagcugcagagaagcccccccgaguuccaguaa

SEQ ID NO: 14042 - RNA, 1020 nt, Artificial Sequence
  AUH__Homo_sapiens__NP_001689
auggccgccgccguggccgccgcccccggcgcccugggcagccugcacgccggcggcgccagacugguggccgccugcagcgccuggcugugccccggccugagacugcccggcagccuggccggcagaagagccggccccgccaucugggcccagggcugggugcccgccgccggcggccccgcccccaagagaggcuacagcagcgagaugaagaccgaggacgagcugagagugagacaccuggaggaggagaacagaggcaucguggugcugggcaucaacagagccuacggcaagaacagccugagcaagaaccugaucaagaugcugagcaaggccguggacgcccugaagagcgacaagaaggugagaaccaucaucaucagaagcgaggugcccggcaucuucugcgccggcgccgaccugaaggagagagccaagaugagcagcagcgaggugggccccuucgugagcaagaucagagccgugaucaacgacaucgccaaccugcccgugcccaccaucgccgccaucgacggccuggcccugggcggcggccuggagcuggcccuggccugcgacaucagaguggccgccagcagcgccaagaugggccugguggagaccaagcuggccaucauccccggcggcggcggcacccagagacugcccagagccaucggcaugagccuggccaaggagcugaucuucagcgccagagugcuggacggcaaggaggccaaggccgugggccugaucagccacgugcuggagcagaaccaggagggcgacgccgccuacagaaaggcccuggaccuggccagagaguuccugccccagggccccguggccaugagaguggccaagcuggccaucaaccagggcauggagguggaccuggugaccggccuggccaucgaggaggccugcuacgcccagaccauccccaccaaggacagacuggagggccugcuggccuucaaggagaagagaccccccagauacaagggcgaguaa

SEQ ID NO: 14043 - RNA, 1212 nt, Artificial Sequence
  AURKA__Homo_sapiens__XP_006723935
auggacagaagcaaggagaacugcaucagcggccccgugaaggccaccgcccccgugggcggccccaagagagugcuggugacccagcaguuccccugccagaacccccugcccgugaacagcggccaggcccagagagugcugugccccagcaacagcagccagagaaucccccugcaggcccagaagcuggugagcagccacaagcccgugcagaaccagaagcagaagcagcugcaggccaccagcgugccccaccccgugagcagaccccugaacaacacccagaagagcaagcagccccugcccagcgcccccgagaacaaccccgaggaggagcuggccagcaagcagaagaacgaggagagcaagaagagacagugggcccuggaggacuucgagaucggcagaccccugggcaagggcaaguucggcaacguguaccuggccagagagaagcagagcaaguucauccuggcccugaaggugcuguucaaggcccagcuggagaaggccggcguggagcaccagcugagaagagagguggagauccagagccaccugagacaccccaacauccugagacuguacggcuacuuccacgacgccaccagaguguaccugauccuggaguacgccccccugggcaccguguacagagagcugcagaagcugagcaaguucgacgagcagagaaccgccaccuacaucaccgagcuggccaacgcccugagcuacugccacagcaagagagugauccacagagacaucaagcccgagaaccugcugcugggcagcgccggcgagcugaagaucgccgacuucggcuggagcgugcacgcccccagcagcagaagaaccacccugugcggcacccuggacuaccugccccccgagaugaucgagggcagaaugcacgacgagaagguggaccuguggagccugggcgugcugugcuacgaguuccuggugggcaagccccccuucgaggccaacaccuaccaggagaccuacaagagaaucagcagaguggaguucaccuuccccgacuucgugaccgagggcgccagagaccugaucagcagacugcugaagcacaaccccagccagagacccaugcugagagaggugcuggagcaccccuggaucaccgccaacagcagcaagcccagcaacugccagaacaaggagagcgccagcaagcagagcuaa

SEQ ID NO: 14044 - RNA, 1038 nt, Artificial Sequence
  AURKB__Homo_sapiens__NP_001271455
auggcccagaaggagaacagcuaccccuggcccuacggcagacagaccgcccccagcggccugagcacccugccccagagagugcugagaaaggagcccgugacccccagcgcccuggugcugaugagcagaagcaacgugcagcccaccgccgcccccggccagaaggugauggagaacagcagcggcacccccgacauccugaccagaagacacuucaccaucgacgacuucgagaucggcagaccccugggcaagggcaaguucggcaacguguaccuggccagagagaagaagagccacuucaucguggcccugaaggugcuguucaagagccagaucgagaaggagggcguggagcaccagcugagaagagagaucgagauccaggcccaccugcaccaccccaacauccugagacuguacaacuacuucuacgacagaagaagaaucuaccugauccuggaguacgcccccagaggcgagcuguacaaggagcugcagaagagcugcaccuucgacgagcagagaaccgccaccaucauggaggagcuggccgacgcccugauguacugccacggcaagaaggugauccacagagacaucaagcccgagaaccugcugcugggccugaagggcgagcugaagaucgccgacuucggcuggagcgugcacgcccccagccugagaagaaagaccaugugcggcacccuggacuaccugccccccgagaugaucgagggcagaaugcacaacgagaagguggaccuguggugcaucggcgugcugugcuacgagcugcuggugggcaacccccccuucgagagcgccagccacaacgagaccuacagaagaaucgugaagguggaccugaaguuccccgccagcgugcccaugggcgcccaggaccugaucagcaagcugcugagacacaaccccagcgagagacugccccuggcccaggugagcgcccaccccugggugagagccaacagcagaagagugcugccccccagcgcccugcagagcguggccuaa

SEQ ID NO: 14045 - RNA, 930 nt, Artificial Sequence
  AURKC__Homo_sapiens__NP_001015878
augagcagccccagagccguggugcagcugggcaaggcccagcccgccggcgaggagcuggccaccgccaaccagaccgcccagcagcccagcagccccgccaugagaagacugaccguggacgacuucgagaucggcagaccccugggcaagggcaaguucggcaacguguaccuggccagacugaaggagagccacuucaucguggcccugaaggugcuguucaagagccagaucgagaaggagggccuggagcaccagcugagaagagagaucgagauccaggcccaccugcagcaccccaacauccugagacuguacaacuacuuccacgacgccagaagaguguaccugauccuggaguacgcccccagaggcgagcuguacaaggagcugcagaagagcgagaagcuggacgagcagagaaccgccaccaucaucgaggagcuggccgacgcccugaccuacugccacgacaagaaggugauccacagagacaucaagcccgagaaccugcugcugggcuucagaggcgaggugaagaucgccgacuucggcuggagcgugcacacccccagccugagaagaaagaccaugugcggcacccuggacuaccugccccccgagaugaucgagggcagaaccuacgacgagaagguggaccuguggugcaucggcgugcugugcuacgagcugcuggugggcuacccccccuucgagagcgccagccacagcgagaccuacagaagaauccugaagguggacgugagauucccccugagcaugccccugggcgccagagaccugaucagcagacugcugagauaccagccccuggagagacugccccuggcccagauccugaagcaccccugggugcaggcccacagcagaagagugcugccccccugcgcccagauggccagcuaa

SEQ ID NO: 14046 - RNA, 3708 nt, Artificial Sequence
  AUTS2__Homo_sapiens__NP_001120703
auggacggccccaccagaggccacggccugagaaagaagagaagaagcagaagccagagagacagagagagaagaagcagaggcggccugggcgccggcgccgccggcggcggcggcgccggcagaaccagagcccugagccuggccagcagcagcggcagcgacaaggaggacaacggcaagccccccagcagcgcccccagcagacccagaccccccagaagaaagagaagagagagcaccagcgccgaggaggacaucaucgacggcuucgccaugaccagcuucgugaccuucgaggcccuggagaaggacguggcccugaagccccaggagagaguggagaagagacagaccccccugaccaagaagaagagagaggcccugaccaacggccugagcuuccacagcaagaagagcagacugagccacccccaccacuacagcagcgacagagagaacgacagaaaccugugccagcaccugggcaagagaaagaagaugcccaaggcccugagacagcugaagcccggccagaacagcugcagagacagcgacagcgagagcgccagcggcgagagcaagggcuuccacagaagcagcagcagagagagacugagcgacagcagcgcccccagcagccugggcaccggcuacuucugcgacagcgacagcgaccaggaggagaaggccagcgacgccagcagcgagaagcuguucaacaccgugaucgugaacaaggaccccgagcugggcgugggcacccugcccgagcacgacagccaggacgccggccccaucgugcccaagaucagcggccuggagagaagccaggagaagagccaggacugcugcaaggagcccaucuucgagcccguggugcugaaggaccccugcccccagguggcccagcccaucccccagccccagaccgagccccagcugagagcccccagccccgaccccgaccuggugcagagaaccgaggcccccccccagccccccccccugagcacccagcccccccagggcccccccgaggcccagcugcagcccgccccccagccccaggugcagagaccccccagaccccagagccccacccagcugcugcaccagaaccugccccccgugcaggcccaccccagcgcccagagccugagccagccccugagcgccuacaacagcagcagccugagccugaacagccugagcagcagcagaagcagcacccccgccaagacccagcccgcccccccccacaucagccaccaccccagcgccagccccuucccccugagccugcccaaccacagcccccugcacagcuucacccccacccugcagccccccgcccacagccaccaccccaacauguucgccccccccaccgcccugccccccccccccccccugaccagcggcagccugcagguggccggccaccccgccggcagcaccuacagcgagcaggacauccugagacaggagcugaacaccagauuccuggccagccagagcgccgacagaggcgccagccugggccccccccccuaccugagaaccgaguuccaccagcaccagcaccagcaccagcacacccaccagcacacccaccagcacaccuucacccccuucccccacgccaucccccccaccgccaucaugcccacccccgccccccccauguucgacaaguaccccaccaagguggaccccuucuacagacacagccuguuccacagcuacccccccgccgugagcggcaucccccccaugaucccccccaccggccccuucggcagccugcagggcgccuuccagcccaagcugaccgaccccuucagacccaugcugagaaagcccggcaaguggugcgccaugcacgugcacaucgccuggcagaucuaccaccaccagcagaaggugaagaagcagaugcagagcgacccccacaagcuggacuucggccugaagcccgaguuccugagcagaccccccggccccagccuguucggcgccauccaccacccccacgaccuggccagacccagcacccuguucagcgccgccggcgccgcccaccccaccggcacccccuucggcccccccccccaccacagcaacuuccugaaccccgccgcccaccuggagcccuucaacagacccagcaccuucaccggccuggccgccgugggcggcaacgccuucggcggccugggcaaccccagcgugacccccaacagcauguucggccacaaggacggccccagcgugcagaacuucagcaacccccacgagcccuggaacagacugcacagaaccccccccagcuuccccacccccccccccuggcugaagcccggcgagcuggagagaagcgccagcgccgccgcccacgacagagacagagacguggacaagagagacagcagcgugagcaaggacgacaaggagagagagagcguggagaagagacacagcagccaccccagccccgcccccgugcugcccgugaacgcccugggccacaccagaagcagcaccgagcagaucagagcccaccugaacaccgaggccagagagaaggacaagcccaaggagagagagagagaccacagcgagagcagaaaggaccuggccgccgacgagcacaaggccaaggagggccaccugcccgagaaggacggccacggccacgagggcagagccgccggcgaggaggccaagcagcuggccagagugcccagccccuacgugagaacccccgugguggagagcgccagacccaacagcaccagcagcagagaggccgagcccagaaagggcgagcccgccuacgagaaccccaagaagagcagcgaggugaaggugaaggaggagagaaaggaggaccacgaccugccccccgaggccccccagacccacagagccagcgagccccccccccccaacagcagcagcagcgugcaccccggcccccuggccagcaugcccaugaccgugggcgugaccggcauccaccccaugaacagcaucagcagccuggacagaaccagaaugaugacccccuucaugggcaucagcccccugcccggcggcgagagauuccccuaccccagcuuccacugggaccccaucagagacccccugagagaccccuacagagagcuggacauccacagaagagacccccugggcagagacuuccugcugagaaacgacccccugcacagacugagcacccccagacuguacgaggccgacagaagcuucagagacagagagccccacgacuacagccaccaccaccaccaccaccaccacccccugagcguggaccccagaagagagcacgagagaggcggccaccuggacgagagagagagacugcacaugcugagagaggacuacgagcacaccagacugcacagcgugcaccccgccagccuggacggccaccugccccaccccagccugaucacccccggccugcccagcaugcacuaccccagaaucagccccaccgccggcaaccagaacggccugcugaacaagaccccccccaccgccgcccugagcgccccccccccccugaucagcacccugggcggcagacccgugagccccagaagaaccaccccccugagcgccgagaucagagagagaccccccagccacacccugaaggacaucgaggccagauaa

SEQ ID NO: 14047 - RNA, 1089 nt, Artificial Sequence
  AVEN__Homo_sapiens__NP_065104
augcaggccgagagaggcgccagaggcggcagaggcagaagacccggcagaggcagacccggcggcgacagacacagcgagagacccggcgccgccgccgccguggccagaggcggcggcggcggcggcggcggcgacggcggcggcagaagaggcagaggcagaggcagaggcuucagaggcgccagaggcggcagaggcggcggcggcgcccccagaggcagcagaagagagcccggcggcuggggcgccggcgccagcgcccccguggaggacgacagcgacgccgagaccuacggcgaggagaacgacgagcagggcaacuacagcaagagaaagaucgugagcaacugggacagauaccaggacaucgagaaggaggugaacaacgagagcggcgagagccagagaggcaccgacuucagcgugcugcugagcagcgccggcgacagcuucagccaguucagauucgccgaggagaaggagugggacagcgaggccagcugccccaagcagaacagcgccuucuacguggacagcgagcugcuggugagagcccugcaggagcugccccugugccugagacugaacguggccgccgagcuggugcagggcaccgugccccuggaggugccccaggugaagcccaagagaaccgacgacggcaagggccugggcaugcagcugaagggcccccugggccccggcggcagaggccccaucuucgagcugaagagcguggccgccggcugccccgugcugcugggcaaggacaaccccagccccggccccagcagagacagccagaagcccaccagcccccugcagagcgccggcgaccaccuggaggaggagcuggaccugcugcugaaccuggacgcccccaucaaggagggcgacaacauccugcccgaccagaccagccaggaccugaagagcaaggaggacggcgagguggugcaggaggaggaggugugcgccaagcccagcgugaccgaggagaagaacauggagcccgagcagcccagcaccagcaagaacgugaccgaggaggagcuggaggacuggcuggacagcaugaucagcuaa

SEQ ID NO: 14048 - RNA, 495 nt, Artificial Sequence
  AVP__Homo_sapiens__NP_000481
augcccgacaccaugcugcccgccugcuuccugggccugcuggccuucagcagcgccugcuacuuccagaacugccccagaggcggcaagagagccaugagcgaccuggagcugagacagugccugcccugcggccccggcggcaagggcagaugcuucggccccagcaucugcugcgccgacgagcugggcugcuucgugggcaccgccgaggcccugagaugccaggaggagaacuaccugcccagccccugccagagcggccagaaggccugcggcagcggcggcagaugcgccgccuucggcgugugcugcaacgacgagagcugcgugaccgagcccgagugcagagagggcuuccacagaagagccagagccagcgacagaagcaacgccacccagcuggacggccccgccggcgcccugcugcugagacuggugcagcuggccggcgcccccgagcccuucgagcccgcccagcccgacgccuacuaa

SEQ ID NO: 14049 - RNA, 444 nt, Artificial Sequence
  AVPI1__Homo_sapiens__NP_068378
augggcacccccgccagcguggugagcgagcccccccccuggcaggcccccaucgaggccagaggcagaaagcaggccagcgccaacaucuuccaggacgccgagcugcugcagauccaggcccuguuccagagaagcggcgaccagcuggccgaggagagagcccagaucaucugggagugcgccggcgaccacagaguggccgaggcccugaagagacugagaagaaagagaccccccagacagaagccccugggccacagccugcaccacugcagcagacugagaauccuggagccccacagcgcccuggccaacccccagagcgccaccgagaccgccagcagcgagcaguaccugcacagcagaaagaagagcgccagaaucagaagaaacuggagaaagagcggccccaccagcuaccugcaccagaucagacacuaa

SEQ ID NO: 14050 - RNA, 1257 nt, Artificial Sequence
  AVPR1A__Homo_sapiens__NP_000697
augagacugagcgccggccccgacgccggccccagcggcaacagcagccccugguggccccuggccaccggcgccggcaacaccagcagagaggccgaggcccugggcgagggcaacggcccccccagagacgugagaaacgaggagcuggccaagcuggagaucgccgugcuggccgugaccuucgccguggccgugcugggcaacagcagcgugcugcuggcccugcacagaacccccagaaagaccagcagaaugcaccuguucaucagacaccugagccuggccgaccuggccguggccuucuuccaggugcugccccagaugugcugggacaucaccuacagauucagaggccccgacuggcugugcagaguggugaagcaccugcagguguucggcauguucgccagcgccuacaugcugguggugaugaccgccgacagauacaucgccgugugccacccccugaagacccugcagcagcccgccagaagaagcagacugaugaucgccgccgccugggugcugagcuucgugcugagcaccccccaguacuucguguucagcaugaucgaggugaacaacgugaccaaggccagagacugcugggccaccuucauccagcccuggggcagcagagccuacgugaccuggaugaccggcggcaucuucguggcccccguggugauccugggcaccugcuacggcuucaucugcuacaacaucuggugcaacgugagaggcaagaccgccagcagacagagcaagggcgccgagcaggccggcguggccuuccagaagggcuuccugcuggcccccugcgugagcagcgugaagagcaucagcagagccaagaucagaaccgugaagaugaccuucgugaucgugaccgccuacaucgugugcugggcccccuucuucaucauccagauguggagcgugugggaccccaugagcguguggaccgagagcgagaaccccaccaucaccaucaccgcccugcugggcagccugaacagcugcugcaaccccuggaucuacauguucuucagcggccaccugcugcaggacugcgugcagagcuuccccugcugccagaacaugaaggagaaguucaacaaggaggacaccgacagcaugagcagaagacagaccuucuacagcaacaacagaagccccaccaacagcaccggcauguggaaggacagccccaagagcagcaagagcaucaaguucauccccgugagcaccuaa

SEQ ID NO: 14051 - RNA, 1275 nt, Artificial Sequence
  AVPR1B__Homo_sapiens__NP_000698
auggacagcggcccccugugggacgccaaccccacccccagaggcacccugagcgcccccaacgccaccacccccuggcugggcagagacgaggagcuggccaagguggagaucggcgugcuggccaccgugcuggugcuggccaccggcggcaaccuggccgugcugcugacccugggccagcugggcagaaagagaagcagaaugcaccuguucgugcugcaccuggcccugaccgaccuggccguggcccuguuccaggugcugccccagcugcugugggacaucaccuacagauuccagggccccgaccugcugugcagagccgugaaguaccugcaggugcugagcauguucgccagcaccuacaugcugcuggccaugacccuggacagauaccuggccgugugccacccccugagaagccugcagcagcccggccagagcaccuaccugcugaucgccgcccccuggcugcuggccgccaucuucagccugccccagguguucaucuucagccugagagaggugauccagggcagcggcgugcuggacugcugggccgacuucggcuuccccuggggccccagagccuaccugaccuggaccacccuggccaucuucgugcugcccgugaccaugcugaccgccugcuacagccugaucugccacgagaucugcaagaaccugaaggugaagacccaggccuggagagugggcggcggcggcuggagaaccugggacagacccagccccagcacccuggccgccaccaccagaggccugcccagcagagugagcagcaucaacaccaucagcagagccaagaucagaaccgugaagaugaccuucgugaucgugcuggccuacaucgccugcugggcccccuucuucagcgugcagauguggagcgugugggacaagaacgcccccgacgaggacagcaccaacguggccuucaccaucagcaugcugcugggcaaccugaacagcugcugcaaccccuggaucuacaugggcuucaacagccaccugcugcccagaccccugagacaccuggccugcugcggcggcccccagcccagaaugagaagaagacugagcgacggcagccugagcagcagacacaccacccugcugaccagaagcagcugccccgccacccugagccugagccugagccugacccugagcggcagacccagacccgaggagagccccagagaccuggagcuggccgacggcgagggcaccgccgagaccaucaucuucuaa

SEQ ID NO: 14052 - RNA, 930 nt, Artificial Sequence
  AVPR2__Homo_sapiens__NP_001139623
augcugauggccagcaccaccagcgccgugcccggccaccccagccugcccagccugcccagcaacagcagccaggagagaccccuggacaccagagacccccugcuggccagagccgagcuggcccugcugagcaucguguucguggccguggcccugagcaacggccuggugcuggccgcccuggccagaagaggcagaagaggccacugggcccccauccacguguucaucggccaccugugccuggccgaccuggccguggcccuguuccaggugcugccccagcuggccuggaaggccaccgacagauucagaggccccgacgcccugugcagagccgugaaguaccugcagauggugggcauguacgccagcagcuacaugauccuggccaugacccuggacagacacagagccaucugcagacccaugcuggccuacagacacggcagcggcgcccacuggaacagacccgugcugguggccugggccuucagccugcugcugagccugccccagcuguucaucuucgcccagagaaacguggagggcggcagcggcgugaccgacugcugggccugcuucgccgagcccuggggcagaagaaccuacgugaccuggaucgcccugaugguguucguggcccccacccugggcaucgccgccugccaggugcugaucuucagagagauccacgccagccuggugcccggccccagcgagagacccggcggcagaagaagaggcagaagaaccggcagccccggcgagggcgcccacgugagcgccgccguggccaagaccgugagaaugacccuggugaucguggugguguacgugcugugcugggcccccuucuuccuggugcagcugugggccgccugggaccccgaggccccccuggagggcggcugcagcagaggcuaa

SEQ ID NO: 14053 - RNA, 987 nt, Artificial Sequence
  AWAT1__Homo_sapiens__NP_001013597
auggcccacagcaagcagcccagccacuuccagagccugaugcugcugcaguggccccugagcuaccuggccaucuucuggauccugcagccccuguucguguaccugcuguucaccagccuguggccccugcccgugcuguacuucgccuggcuguuccuggacuggaagacccccgagagaggcggcagaagaagcgccugggugagaaacuggugcguguggacccacaucagagacuacuuccccaucaccauccugaagaccaaggaccugagccccgagcacaacuaccugaugggcgugcacccccacggccugcugaccuucggcgccuucugcaacuucugcaccgaggccaccggcuucagcaagaccuuccccggcaucaccccccaccuggccacccugagcugguucuucaagauccccuucgugagagaguaccugauggccaagggcgugugcagcgugagccagcccgccaucaacuaccugcugagccacggcaccggcaaccuggugggcaucguggugggcggcgugggcgaggcccugcagagcgugcccaacaccaccacccugauccugcagaagagaaagggcuucgugagaaccgcccugcagcacggcgcccaccuggugcccaccuucaccuucggcgagaccgagguguacgaccaggugcuguuccacaaggacagcagaauguacaaguuccagagcugcuucagaagaaucuucggcuucuacugcugcguguucuacggccagagcuucugccagggcagcaccggccugcugcccuacagcagacccaucgugaccguggugggcgagccccugccccugccccagaucgagaagcccagccaggagaugguggacaaguaccacgcccuguacauggacgcccugcacaagcuguucgaccagcacaagacccacuacggcugcagcgagacccagaagcuguucuuccuguaa

SEQ ID NO: 14054 - RNA, 3039 nt, Artificial Sequence
  AXDND1__Homo_sapiens__NP_653297
augagccugcccaagacccccagcaccccccugaacagcaccagcaccagcgagagcaagaagcugaaggugagcguggccaaggagggcaccagaggccugcccgagcugaaggagaagaagaacaugguggacagaagcaagcugcugcccaccagccugcagaacgaguucauccccaaggaggugcugcugagccugaccuacgccgccaacgccggccccugccccgagaaccugcugccccccaagaagaucaagacccccaagggcacccugcccagacugguggaccacguguggcaccaccccgugagaagaaacaaguucaaguaccugaucgaccaccccgugagccugaccggcgccggcagagacaucagcuuccuguacgacgugaccuacgccaagggccagaccagagagaaggccgugugccccccccaccuggccagaagccugcagagccacgacggcgugaucgugccccacaagcccaagacccugaccgacacccugauccccgaggaguuccacaucgugagcagcaccggcgugagcggccuggagugcuacgacgacaaguacaccacccugcugaccgacagcgagaacagacugcugcuguuccccagcaugaagcccaacaagagaguggagguggcccagcugaacgacgugauggacaccaugcuggagagagccggcguggagaaccaggaguacaccggccccaccaagaugcacaagcugcugcacauccugaagaaggagcagaccaucuacaacaugaucuuccacgagcugaucagacaggugagcguggacugcgccgacagaggcgagcugcugagcaaggugagagagagauacgugcagaugcuggaccagaucgccagacagaugaucgacuucuacaaggaccuggugacccagagagugauggaccagagaauccuggaggagcuguacaacuucaagcacgugaucgaggagcugaccagagagcugugccuggugagagcccacgacgugaagcugaccaaggagaccgagaaggcccacaaggaccuggcccaggcccugcugaacgccgagaagaacgccaagaucguggaggaguaccacgaccuguacacccugcagagagagagaauggagaacgacaugaagaagcugguggccgagagagacaucuggagcagcgccaccuacgagcuggcccugaaggugaucgagagaaacagagugauccuggccagaagacuguaccugaacgagaagggcuggaacaaguacaccaagcacuucaucauccugcugagcaacaaggacaccgaggaccuggcccugcugcagaagcugacccagaaguggagaaaccuggugaacaagcugaagcaggagguggagcagauggaggagagcaccagcgagacccugaagaucgugaaggacggccugaucaaguggcaggaguucuucaacgagaaggacauccugagccccaacaagggcaacaucuucaacagcgugcugcuggacuucaagcaguggcagaagauccugaacgagaagaaggaggaguucaccggcgacgugcugcugagcaaguacgacacccugaagaucaucaagcaccugcaggagaacugggccgacaucggccugggcaucuucaacagacacaagagccuggagggcgagaugcccagcgagagacaguacauggaggagaucaucaagaacauccagaagcuguacaaggaguacgagaucagaaucaacggcgacaacggcuacagcaagauccugcccagccugaucagcagccuggacuucugcagcuucaagcuggagaaccuggaguuccccgacaccccccuggaggaguggcaggagaucgacgagaagaucaacgagaugaagagccaccuggacauccugcugaaccugaccggcaucgugccccagcacaucgacguggacagcgugagcgugcugcaggccuacaucuucaacaugauccagcaguggcugcugaagaucggcaacgagaucaacaacggcaacaucgagcugcagcaccacauggacgagcugcacaucagcaugauccaguggauggugaaccugcugauccugaugauccccaacuucaccgaccaggacugccugcugaagcuggaggaggagagcgccgagaagcacgacaucggcguggccagacuggagcuggacgccaucgagcugaccagaaagcuguaccaguacagcagcuaccugagcagcugcugcaagggcauggugaccgccauggcccugagcaagagcaccaacagccacaagaacgccaccgaggaccuguacgagguggacaagcugaagaaggagugcuacgaguggaucaacaccugcagcugccugcugagcaacaucaagggcagaaagaucacccugcugaccuacgaggagaucgagagacugcuggaggaggaggccgugaaggaguucaucgagcccgagaucgacgagagcuucaaggaggacgaggaggagagcaaggaggacagaaagcugcaggaggagaacaaggagagagccgaggagcagcccagcaccagcaccgagaaggagaagcugaucagauucaucggcgaggacgagaacgugcacagcaagccccuguucgagaccgacgugcugagcagcuggagagagagcgccaagcagggcacccuggcccagaaguaccuggaggccauggccgugaucgagcacaugcaggagaagcugcuggagguggagaacagagccagacaggccgaggagaaguucgaggacgccuacgagaagcugcaccacacccugaucaagaacaaggaccuggaggagcuggugaugaccagcagaaaggagagcaaggaggagaaggagaaccaggacgagagagaggugaaggaggaggaggagcagcaggaggaggaggaggugagaagcgccgagaacagcagcaagagccccaagaagggccacuaa

SEQ ID NO: 14055 - RNA, 2589 nt, Artificial Sequence
  AXIN1__Homo_sapiens__NP_003493
augaacauccaggagcagggcuucccccuggaccugggcgccagcuucaccgaggacgcccccagaccccccgugcccggcgaggagggcgagcuggugagcaccgaccccagacccgccagcuacagcuucugcagcggcaagggcgugggcaucaagggcgagaccagcaccgccacccccagaagaagcgaccuggaccugggcuacgagcccgagggcagcgccagccccaccccccccuaccugaagugggccgagagccugcacagccugcuggacgaccaggacggcaucagccuguucagaaccuuccugaagcaggagggcugcgccgaccugcuggacuucugguucgccugcaccggcuucagaaagcuggagcccugcgacagcaacgaggagaagagacugaagcuggccagagccaucuacagaaaguacauccuggacaacaacggcaucgugagcagacagaccaagcccgccaccaagagcuucaucaagggcugcaucaugaagcagcugaucgaccccgccauguucgaccaggcccagaccgagauccaggccaccauggaggagaacaccuaccccagcuuccugaagagcgacaucuaccuggaguacaccagaaccggcagcgagagccccaaggugugcagcgaccagagcagcggcagcggcaccggcaagggcaucagcggcuaccugcccacccugaacgaggacgaggaguggaagugcgaccaggacauggacgaggacgacggcagagacgccgccccccccggcagacugccccagaagcugcugcuggagaccgccgcccccagagugagcagcagcagaagauacagcgagggcagagaguucagauacggcagcuggagagagcccgugaaccccuacuacgugaacgccggcuacgcccuggcccccgccaccagcgccaacgacagcgagcagcagagccugagcagcgacgccgacacccugagccugaccgacagcagcguggacggcaucccccccuacagaaucagaaagcagcacagaagagagaugcaggagagcgugcaggugaacggcagagugccccugccccacauccccagaaccuacagagugcccaaggaggugagaguggagccccagaaguucgccgaggagcugauccacagacuggaggccgugcagagaaccagagaggccgaggagaagcuggaggagagacugaagagagugagaauggaggaggagggcgaggacggcgaccccagcagcggcccccccggccccugccacaagcugccccccgcccccgccuggcaccacuucccccccagaugcguggacaugggcugcgccggccugagagacgcccacgaggagaaccccgagagcauccuggacgagcacgugcagagagugcugagaacccccggcagacagagccccggccccggccacagaagccccgacagcggccacguggccaagaugcccguggcccugggcggcgccgccagcggccacggcaagcacgugcccaagagcggcgccaagcuggacgccgccggccugcaccaccacagacacgugcaccaccacgugcaccacagcaccgccagacccaaggagcagguggaggccgaggccaccagaagagcccagagcagcuucgccuggggccuggagccccacagccacggcgccagaagcagaggcuacagcgagagcgugggcgccgcccccaacgccagcgacggccuggcccacagcggcaaggugggcguggccugcaagagaaacgccaagaaggccgagagcggcaagagcgccagcaccgaggugcccggcgccagcgaggacgccgagaagaaccagaagaucaugcaguggaucaucgagggcgagaaggagaucagcagacacagaagaaccggccacggcagcagcggcaccagaaagccccagccccacgagaacagcagaccccugagccuggagcaccccugggccggcccccagcugagaaccagcgugcagcccagccaccuguucauccaggaccccaccaugcccccccaccccgcccccaacccccugacccagcuggaggaggccagaagaagacuggaggaggaggagaagagagccagcagagcccccagcaagcagagauacgugcaggaggugaugagaagaggcagagccugcgugagacccgccugcgcccccgugcugcacguggugcccgccgugagcgacauggagcugagcgagaccgagaccagaagccagagaaaggugggcggcggcagcgcccagcccugcgacagcaucgugguggccuacuacuucugcggcgagcccauccccuacagaacccuggugagaggcagagccgugacccugggccaguucaaggagcugcugaccaagaagggcagcuacagauacuacuucaagaaggugagcgacgaguucgacugcggcgugguguucgaggaggugagagaggacgaggccgugcugcccguguucgaggagaagaucaucggcaagguggagaagguggacuaa

SEQ ID NO: 14056 - RNA, 2532 nt, Artificial Sequence
  AXIN2__Homo_sapiens__XP_011523623
augagcagcgccaugcuggugaccugccugcccgaccccagcagcagcuucagagaggacgcccccagaccccccgugcccggcgaggagggcgagaccccccccugccagcccggcgugggcaagggccaggugaccaagcccaugcccgugagcagcaacaccagaagaaacgaggacggccugggcgagcccgagggcagagccagccccgacagcccccugaccagauggaccaagagccugcacagccugcugggcgaccaggacggcgccuaccuguucagaaccuuccuggagagagagaagugcguggacacccuggacuucugguucgccugcaacggcuucagacagaugaaccugaaggacaccaagacccugagaguggccaaggccaucuacaagagauacaucgagaacaacagcaucgugagcaagcagcugaagcccgccaccaagaccuacaucagagacggcaucaagaagcagcagaucgacagcaucauguucgaccaggcccagaccgagauccagagcgugauggaggagaacgccuaccagauguuccugaccagcgacaucuaccuggaguacgugagaagcggcggcgagaacaccgccuacaugagcaacggcggccugggcagccugaagguggugugcggcuaccugcccacccugaacgaggaggaggaguggaccugcgccgacuucaagugcaagcugagccccaccguggugggccugagcagcaagacccugagagccaccgccagcgugagaagcaccgagaccguggacagcggcuacagaagcuucaagagaagcgaccccgugaaccccuaccacaucggcagcggcuacguguucgcccccgccaccagcgccaacgacagcgagaucagcagcgacgcccugaccgacgacagcaugagcaugaccgacagcagcguggacggcaucccccccuacagagugggcagcaagaagcagcugcagagagagaugcacagaagcgugaaggccaacggccaggugagccugccccacuuccccagaacccacagacugcccaaggagaugacccccguggagcccgccaccuucgccgccgagcugaucagcagacuggagaagcugaagcuggagcuggagagcagacacagccuggaggagagacugcagcagaucagagaggacgaggagagagagggcagcgagcugacccugaacagcagagagggcgcccccacccagcacccccugagccugcugcccagcggcagcuacgaggaggacccccagaccauccuggacgaccaccugagcagagugcugaagacccccggcugccagagccccggcgugggcagauacagccccagaagcagaagccccgaccaccaccaccaccaccacagccaguaccacagccugcugccccccggcggcaagcugccccccgccgccgccagccccggcgccugcccccugcugggcggcaagggcuucgugaccaagcagaccaccaagcacgugcaccaccacuacauccaccaccacgccgugcccaagaccaaggaggagaucgaggccgaggccacccagagagugcacugcuucugccccggcggcagcgaguacuacugcuacagcaagugcaagagccacagcaaggcccccgagaccaugcccagcgagcaguucggcggcagcagaggcagcacccugcccaagagaaacggcaagggcaccgagcccggccuggcccugcccgccagagagggcggcgcccccggcggcgccggcgcccugcagcugcccagagaggagggcgacagaagccaggacguguggcaguggaugcuggagagcgagagacagagcaagcccaagccccacagcgcccagagcaccaagaaggccuacccccuggagagcgccagaagcagccccggcgagagagccagcagacaccaccuguggggcggcaacagcggccaccccagaaccacccccagagcccaccuguucacccaggaccccgccaugcccccccugaccccccccaacacccuggcccagcuggaggaggccugcagaagacuggccgaggugagcaagccccccaagcagagaugcugcguggccagccagcagagagacagaaaccacagcgccaccgugcagaccggcgccacccccuucagcaaccccagccuggcccccgaggaccacaaggagcccaagaagcuggccggcgugcacgcccugcaggccagcgagcugguggugaccuacuucuucugcggcgaggagauccccuacagaagaaugcugaaggcccagagccugacccugggccacuucaaggagcagcugagcaagaagggcaacuacagauacuacuucaagaaggccagcgacgaguucgccugcggcgccguguucgaggagaucugggaggacgagaccgugcugcccauguacgagggcagaauccugggcaagguggagagaaucgacuaa

SEQ ID NO: 14057 - RNA, 2658 nt, Artificial Sequence
  AXL__Homo_sapiens__NP_001690
auggccuggagaugccccagaaugggcagagugccccuggccuggugccuggcccugugcggcugggccugcauggcccccagaggcacccaggccgaggagagccccuucgugggcaaccccggcaacaucaccggcgccagaggccugaccggcacccugagaugccagcugcaggugcagggcgagccccccgaggugcacuggcugagagacggccagauccuggagcuggccgacagcacccagacccaggugccccugggcgaggacgagcaggacgacuggaucguggugagccagcugagaaucaccagccugcagcugagcgacaccggccaguaccagugccugguguuccugggccaccagaccuucgugagccagcccggcuacgugggccuggagggccugcccuacuuccuggaggagcccgaggacagaaccguggccgccaacacccccuucaaccugagcugccaggcccagggcccccccgagcccguggaccugcuguggcugcaggacgccgugccccuggccaccgcccccggccacggcccccagagaagccugcacgugcccggccugaacaagaccagcagcuucagcugcgaggcccacaacgccaagggcgugaccaccagcagaaccgccaccaucaccgugcugccccagcagcccagaaaccugcaccuggugagcagacagcccaccgagcuggagguggccuggacccccggccugagcggcaucuacccccugacccacugcacccugcaggccgugcugagcgacgacggcaugggcauccaggccggcgagcccgacccccccgaggagccccugaccagccaggccagcgugcccccccaccagcugagacugggcagccugcacccccacacccccuaccacaucagaguggccugcaccagcagccagggccccagcagcuggacccacuggcugcccguggagacccccgagggcgugccccugggcccccccgagaacaucagcgccaccagaaacggcagccaggccuucgugcacuggcaggagcccagagccccccugcagggcacccugcugggcuacagacuggccuaccagggccaggacacccccgaggugcugauggacaucggccugagacaggaggugacccuggagcugcagggcgacggcagcgugagcaaccugaccgugugcguggccgccuacaccgccgccggcgacggccccuggagccugcccgugccccuggaggccuggagacccgugaaggagcccagcacccccgccuucagcuggcccuggugguacgugcugcugggcgccgugguggccgccgccugcgugcugauccuggcccuguuccuggugcacagaagaaagaaggagaccagauacggcgagguguucgagcccaccguggagagaggcgagcugguggugagauacagagugagaaagagcuacagcagaagaaccaccgaggccacccugaacagccugggcaucagcgaggagcugaaggagaagcugagagacgugaugguggacagacacaagguggcccugggcaagacccugggcgagggcgaguucggcgccgugauggagggccagcugaaccaggacgacagcauccugaagguggccgugaagaccaugaagaucgccaucugcaccagaagcgagcuggaggacuuccugagcgaggccgugugcaugaaggaguucgaccaccccaacgugaugagacugaucggcgugugcuuccagggcagcgagagagagagcuuccccgcccccguggugauccugcccuucaugaagcacggcgaccugcacagcuuccugcuguacagcagacugggcgaccagcccguguaccugcccacccagaugcuggugaaguucauggccgacaucgccagcggcauggaguaccugagcaccaagagauucauccacagagaccuggccgccagaaacugcaugcugaacgagaacaugagcgugugcguggccgacuucggccugagcaagaagaucuacaacggcgacuacuacagacagggcagaaucgccaagaugcccgugaaguggaucgccaucgagagccuggccgacagaguguacaccagcaagagcgacguguggagcuucggcgugaccaugugggagaucgccaccagaggccagacccccuaccccggcguggagaacagcgagaucuacgacuaccugagacagggcaacagacugaagcagcccgccgacugccuggacggccuguacgcccugaugagcagaugcugggagcugaacccccaggacagacccagcuucaccgagcugagagaggaccuggagaacacccugaaggcccugccccccgcccaggagcccgacgagauccuguacgugaacauggacgagggcggcggcuaccccgagccccccggcgccgccggcggcgccgacccccccacccagcccgaccccaaggacagcugcagcugccugaccgccgccgaggugcaccccgccggcagauacgugcugugccccagcaccacccccagccccgcccagcccgccgacagaggcagccccgccgcccccggccaggaggacggcgccuaa

SEQ ID NO: 14058 - RNA, 897 nt, Artificial Sequence
  AZGP1__Homo_sapiens__NP_001176
auggugagaauggugcccgugcugcugagccugcugcugcugcugggccccgccgugccccaggagaaccaggacggcagauacagccugaccuacaucuacaccggccugagcaagcacguggaggacgugcccgccuuccaggcccugggcagccugaacgaccugcaguucuucagauacaacagcaaggacagaaagagccagcccaugggccuguggagacagguggagggcauggaggacuggaagcaggacagccagcugcagaaggccagagaggacaucuucauggagacccugaaggacaucguggaguacuacaacgacagcaacggcagccacgugcugcagggcagauucggcugcgagaucgagaacaacagaagcagcggcgccuucuggaaguacuacuacgacggcaaggacuacaucgaguucaacaaggagauccccgccugggugcccuucgaccccgccgcccagaucaccaagcagaagugggaggccgagcccguguacgugcagagagccaaggccuaccuggaggaggagugccccgccacccugagaaaguaccugaaguacagcaagaacauccuggacagacaggacccccccagcgugguggugaccagccaccaggcccccggcgagaagaagaagcugaagugccuggccuacgacuucuaccccggcaagaucgacgugcacuggaccagagccggcgaggugcaggagcccgagcugagaggcgacgugcugcacaacggcaacggcaccuaccagagcuggguggugguggccgugcccccccaggacaccgcccccuacagcugccacgugcagcacagcagccuggcccagccccugguggugcccugggaggccagcuaa

SEQ ID NO: 14059 - RNA, 732 nt, Artificial Sequence
  AZI2__Homo_sapiens__NP_001127904
auggacgcccugguggaggacgacaucugcauccugaaccacgagaaggcccacaagagagacaccgugacccccgugagcaucuacagcggcgacgagagcguggccagccacuucgcccuggugaccgccuacgaggacaucaagaagagacugaaggacagcgagaaggagaacagccugcugaagaagagaaucagauuccuggaggagaagcugaucgccagauucgaggaggagaccagcagcgugggcagagagcaggugaacaaggccuaccacgccuacagagaggugugcaucgacagagacaaccugaagagcaagcuggacaagaugaacaaggacaacagcgagagccugaaggugcugaacgagcagcugcagagcaaggagguggagcugcugcagcugagaaccgagguggagacccagcaggugaugagaaaccugaacccccccagcagcaacugggagguggagaagcugagcugcgaccugaagauccacggccuggagcaggagcuggagcugaugagaaaggagugcagcgaccugaagaucgagcugcagaaggccaagcagaccgaccccuaccaggaggacaaccugaagagcagagaccugcagaagcugagcaucagcagacagagcaucugcagcaccgccuggagcgccguggcccagagcugggacagcaugaacuucgaggacugcagccuguucgccuaa

SEQ ID NO: 14060 - RNA, 1092 nt, Artificial Sequence
  AZIN1__Homo_sapiens__NP_001288597
augaagggcuucaucgacgacgccaacuacagcgugggccugcuggacgagggcaccaaccugggcaacgugaucgacaacuacguguacgagcacacccugaccggcaagaacgccuucuucgugggcgaccugggcaagaucgugaagaagcacagccaguggcagaacgugguggcccagaucaagcccuucuacaccgugaagugcaacagcgcccccgccgugcuggagauccuggccgcccugggcaccggcuucgccugcagcagcaagaacgagauggcccuggugcaggagcugggcgugccccccgagaacaucaucuacaucagccccugcaagcaggugagccagaucaaguacgccgccaaggugggcgugaacauccugaccugcgacaacgagaucgagcugaagaagaucgccagaaaccaccccaacgccaaggugcugcugcacaucgccaccgaggacaacaucggcggcgaggagggcaacaugaaguucggcaccacccugaagaacugcagacaccugcuggagugcgccaaggagcuggacgugcagaucaucggcgugaaguuccacgugagcagcgccugcaaggagagccagguguacgugcacgcccugagcgacgccagaugcguguucgacauggccggcgagaucggcuucaccaugaacaugcuggacaucggcggcggcuucaccggcaccgaguuccagcuggaggaggugaaccacgugaucagcccccugcuggacaucuacuuccccgagggcagcggcgugaagaucaucagcgagcccggcagcuacuacgugagcagcgccuucacccuggccgugaacaucaucgccaagaaggugguggagaacgacaaguuccccagcggcguggagaagaccggcagcgacgagcccgccuucauguacuacaugaacgacggcguguacggcagcuucgccagcaagcugagcgaggaccugaacaccauccccgaggugcacaagaaguacaaggaggacgagccccuguucaccagcagccuguggggccccagcugcgacgagcuguucagauaa

SEQ ID NO: 14061 - RNA, 1443 nt, Artificial Sequence
  AZIN2__Homo_sapiens__NP_001288754
auggccggcuaccugagcgagagcgacuucgugaugguggaggagggcuucagcaccagagaccugcugaaggagcugacccugggcgccagccaggccaccaccgacgagguggccgccuucuucguggccgaccugggcgccaucgugagaaagcacuucugcuuccugaagugccugcccagagugagacccuucuacgccgugaagugcaacagcagccccggcgugcugaaggugcuggcccagcugggccugggcuucagcugcgccaacaaggccgagauggagcuggugcagcacaucggcauccccgccagcaagaucaucugcgccaaccccugcaagcagaucgcccagaucaaguacgccgccaagcacggcauccagcugcugagcuucgacaacgagauggagcuggccaagguggugaagagccaccccagcgccaagauggugcugugcaucgccaccgacgacagccacagccugagcugccugagccugaaguucggcgugagccugaagagcugcagacaccugcuggagaacgccaagaagcaccacguggagguggugggcgugagcuuccacaucggcagcggcugccccgacccccaggccuacgcccagagcaucgccgacgccagacugguguucgagaugggcaccgagcugggccacaagaugcacgugcuggaccugggcggcggcuuccccggcaccgagggcgccaaggugagauucgaggagaucgccagcgugaucaacagcgcccuggaccuguacuuccccgagggcugcggcguggacaucuucgccgagcugggcagauacuacgugaccagcgccuucaccguggccgugagcaucaucgccaagaaggaggugcugcuggaccagcccggcagagaggccccccugccccccccccacaucgccaccugcgccgccagcgagcccagcccccccgccgaggagaacggcagcaccagcaagaccaucguguaccaccuggacgagggcguguacggcaucuucaacagcgugcuguucgacaacaucugccccacccccauccugcagaagaagcccagcaccgagcagccccuguacagcagcagccuguggggccccgccguggacggcugcgacugcguggccgagggccuguggcugccccagcugcacgugggcgacuggcugguguucgacaacaugggcgccuacaccgugggcaugggcagccccuucuggggcacccaggccugccacaucaccuacgccaugagcagaguggccugggaggcccugagaagacagcugauggccgccgagcaggaggacgacguggagggcgugugcaagccccugagcugcggcugggagaucaccgacacccugugcgugggccccguguucacccccgccagcaucauguaa

SEQ ID NO: 14062 - RNA, 756 nt, Artificial Sequence
  AZU1__Homo_sapiens__NP_001691
augaccagacugaccgugcuggcccugcuggccggccugcuggccagcagcagagccggcagcagcccccugcuggacaucgugggcggcagaaaggccagacccagacaguuccccuuccuggccagcauccagaaccagggcagacacuucugcggcggcgcccugauccacgccagauucgugaugaccgccgccagcugcuuccagagccagaaccccggcgugagcaccguggugcugggcgccuacgaccugagaagaagagagagacagagcagacagaccuucagcaucagcagcaugagcgagaacggcuacgacccccagcagaaccugaacgaccugaugcugcugcagcuggacagagaggccaaccugaccagcagcgugaccauccugccccugccccugcagaacgccaccguggaggccggcaccagaugccagguggccggcuggggcagccagagaagcggcggcagacugagcagauuccccagauucgugaacgugaccgugacccccgaggaccagugcagacccaacaacgugugcaccggcgugcugaccagaagaggcggcaucugcaacggcgacggcggcaccccccuggugugcgagggccuggcccacggcguggccagcuucagccugggccccugcggcagaggccccgacuucuucaccagaguggcccuguucagagacuggaucgacggcgugcugaacaaccccggccccggccccgccuaa

SEQ ID NO: 14063 - RNA, 360 nt, Artificial Sequence
  B2M__Homo_sapiens__NP_004039
augagcagaagcguggcccuggccgugcuggcccugcugagccugagcggccuggaggccauccagagaacccccaagauccagguguacagcagacaccccgccgagaacggcaagagcaacuuccugaacugcuacgugagcggcuuccaccccagcgacaucgagguggaccugcugaagaacggcgagagaaucgagaagguggagcacagcgaccugagcuucagcaaggacuggagcuucuaccugcuguacuacaccgaguucacccccaccgagaaggacgaguacgccugcagagugaaccacgugacccugagccagcccaagaucgugaagugggacagagacauguaa

SEQ ID NO: 14064 - RNA, 996 nt, Artificial Sequence
  B3GALNT1__Homo_sapiens__XP_005247921
auggccagcgcccuguggaccgugcugcccagcagaaugagccugagaagccugaaguggagccugcugcugcugagccugcugagcuucuucgugaugugguaccugagccugccccacuacaacgugaucgagagagugaacuggauguacuucuacgaguacgagcccaucuacagacaggacuuccacuucacccugagagagcacagcaacugcagccaccagaaccccuuccuggugauccuggugaccagccaccccagcgacgugaaggccagacaggccaucagagugaccuggggcgagaagaagagcugguggggcuacgaggugcugaccuucuuccugcugggccaggaggccgagaaggaggacaagaugcuggcccugagccuggaggacgagcaccugcuguacggcgacaucaucagacaggacuuccuggacaccuacaacaaccugacccugaagaccaucauggccuucagaugggugaccgaguucugccccaacgccaaguacgugaugaagaccgacaccgacguguucaucaacaccggcaaccuggugaaguaccugcugaaccugaaccacagcgagaaguucuucaccggcuacccccugaucgacaacuacagcuacagaggcuucuaccagaagacccacaucagcuaccaggaguaccccuucaagguguucccccccuacugcagcggccugggcuacaucaugagcagagaccuggugcccagaaucuacgagaugaugggccacgugaagcccaucaaguucgaggacguguacgugggcaucugccugaaccugcugaaggugaacauccacauccccgaggacaccaaccuguucuuccuguacagaauccaccuggacgugugccagcugagaagagugaucgccgcccacggcuucagcagcaaggagaucaucaccuucuggcaggugaugcugagaaacaccaccugccacuacuaa

SEQ ID NO: 14065 - RNA, 981 nt, Artificial Sequence
  B3GALNT2__Homo_sapiens__NP_001264084
augagaaacuggcuggugcugcugugccccugcgugcugggcgccgcccugcaccuguggcugagacugagaagccccccccccgccugcgccagcggcgccggccccgccggcggcgugagccugcugcugcccagacuggagugcaacggcgccgugagcgcccaccccaaccugcaccugcccggcagcagagacagccccgccagcgccagccagguggccggcaucaccgaccagcuggcccuguucccccaguggaagagcacccacuacgacgugguggugggcgugcugagcgccagaaacaaccacgagcugagaaacgugaucagaagcaccuggaugagacaccugcugcagcaccccacccugagccagagagugcuggugaaguucaucaucggcgcccacggcugcgaggugcccguggaggacagagaggaccccuacagcugcaagcugcugaacaucaccaaccccgugcugaaccaggagaucgaggccuucagccugagcgaggacaccagcagcggccugcccgaggacagaguggugagcgugagcuucagagugcuguaccccaucgugaucaccagccugggcguguucuacgacgccaacgacgugggcuuccagagaaacaucaccgugaagcuguaccaggccgagcaggaggaggcccuguucaucgccagauucagcccccccagcugcggcgugcaggugaacaagcugugguacaagcccguggagcaguucauccugcccgagagcuucgagggcaccaucgugugggagagccaggaccugcacggccuggugagcagaaaccugcacaaggugaccgugaacgacggcggcggcgugcugagagugaucaccgccggcgagggcgcccugccccacgaguuccuggagggcguggagggcguggccggcggcuucaucuacaccauccagggcaaguucgccagcuaa

SEQ ID NO: 14066 - RNA, 1269 nt, Artificial Sequence
  B3GALT2__Homo_sapiens__NP_003774
augcugcaguggagaagaagacacugcugcuucgccaagaugaccuggaacgccaagagaagccuguucagaacccaccugaucggcgugcugagccugguguuccuguucgccauguuccuguucuucaaccaccacgacuggcugcccggcagagccggcuucaaggagaaccccgugaccuacaccuucagaggcuucagaagcaccaagagcgagaccaaccacagcagccugagaaacaucuggaaggagaccgugccccagacccugagaccccagaccgccaccaacagcaacaacaccgaccugagcccccagggcgugaccggccuggagaacacccugagcgccaacggcagcaucuacaacgagaagggcaccggccaccccaacagcuaccacuucaaguacaucaucaacgagcccgagaagugccaggagaagagccccuuccugauccugcugaucgccgccgagcccggccagaucgaggccagaagagccaucagacagaccuggggcaacgagagccuggcccccggcauccagaucaccagaaucuuccugcugggccugagcaucaagcugaacggcuaccugcagagagccauccuggaggagagcagacaguaccacgacaucauccagcaggaguaccuggacaccuacuacaaccugaccaucaagacccugaugggcaugaacuggguggccaccuacugcccccacauccccuacgugaugaagaccgacagcgacauguucgugaacaccgaguaccugaucaacaagcugcugaagcccgaccugccccccagacacaacuacuucaccggcuaccugaugagaggcuacgcccccaacagaaacaaggacagcaagugguacaugccccccgaccuguaccccagcgagagauaccccguguucugcagcggcaccggcuacguguucagcggcgaccuggccgagaagaucuucaaggugagccugggcaucagaagacugcaccuggaggacguguacgugggcaucugccuggccaagcugagaaucgaccccgugcccccccccaacgaguucguguucaaccacuggagagugagcuacagcagcugcaaguacagccaccugaucaccagccaccaguuccagcccagcgagcugaucaaguacuggaaccaccugcagcagaacaagcacaacgccugcgccaacgccgccaaggagaaggccggcagauacagacacagaaagcugcacuaa

SEQ ID NO: 14067 - RNA, 1137 nt, Artificial Sequence
  B3GALT4__Homo_sapiens__NP_003773
augcagcugagacuguucagaagacugcugcuggccgcccugcugcuggugaucguguggacccuguucggccccagcggccugggcgaggagcugcugagccugagccuggccagccugcugcccgcccccgccagccccggccccccccuggcccugcccagacugcugauccccaaccaggaggccugcagcggccccggcgccccccccuuccugcugauccuggugugcaccgcccccgagaaccugaaccagagaaacgccaucagagccagcuggggcggccugagagaggccagaggccugagagugcagacccuguuccugcugggcgagcccaacgcccagcaccccguguggggcagccagggcagcgaccuggccagcgagagcgccgcccagggcgacauccugcaggccgccuuccaggacagcuacagaaaccugacccugaagacccugagcggccugaacugggccgagaagcacugccccauggccagauacgugcugaagaccgacgacgacguguacgugaacgugcccgagcuggugagcgagcuggugcugagaggcggcagauggggccagugggagagaagcaccgagccccagagagaggccgagcaggagggcggccaggugcugcacagcgaggaggugccccugcuguaccugggcagagugcacuggagagugaaccccagcagaacccccggcggcagacacagagugagcgaggagcaguggccccacaccuggggccccuucccccccuacgccagcggcaccggcuacgugcugagcgccagcgccgugcagcugauccugaagguggccagcagagccccccugcugccccuggaggacguguucgugggcgugagcgccagaagaggcggccuggcccccacccagugcgugaagcuggccggcgccacccacuacccccuggacagaugcugcuacggcaaguuccugcugaccagccacagacuggaccccuggaagaugcaggaggccuggaagcuggugggcggcagcgacggcgagagaaccgcccccuucugcagcugguuccagggcgugcugggcauccugagaugcagagccaucgccuggcugcagagcuaa

SEQ ID NO: 14068 - RNA, 933 nt, Artificial Sequence
  B3GALT5__Homo_sapiens__NP_149361
auggccuuccccaagaugagacugauguacaucugccugcuggugcugggcgcccugugccuguacuucagcauguacagccugaaccccuucaaggagcagagcuucguguacaagaaggacggcaacuuccugaagcugcccgacaccgacugcagacagaccccccccuuccuggugcugcuggugaccagcagccacaagcagcuggccgagagaauggccaucagacagaccuggggcaaggagagaauggugaagggcaagcagcugaagaccuucuuccugcugggcaccaccagcagcgccgccgagaccaaggagguggaccaggagagccagagacacggcgacaucauccagaaggacuuccuggacguguacuacaaccugacccugaagaccaugaugggcaucgagugggugcacagauucugcccccaggccgccuucgugaugaagaccgacagcgacauguucaucaacguggacuaccugaccgagcugcugcugaagaagaacagaaccaccagauucuucaccggcuuccugaagcugaacgaguuccccaucagacagcccuucagcaagugguucgugagcaagagcgaguaccccugggacagauacccccccuucugcagcggcaccggcuacguguucagcggcgacguggccagccagguguacaacgugagcaagagcgugcccuacaucaagcuggaggacguguucgugggccugugccuggagagacugaacaucagacuggaggagcugcacagccagcccaccuucuuccccggcggccugagauucagcgugugccuguucagaagaaucguggccugccacuucaucaagcccagaacccugcuggacuacuggcaggcccuggagaacagcagaggcgaggacugcccccccguguaa

SEQ ID NO: 14069 - RNA, 1497 nt, Artificial Sequence
  B3GALTL__Homo_sapiens__NP_919299
augagaccccccgccugcugguggcugcuggccccccccgcccugcuggcccugcugaccugcagccuggccuucggccuggccagcgaggacaccaagaaggaggugaagcagagccaggaccuggagaagagcggcaucagcagaaagaacgacaucgaccugaagggcaucguguucgugauccagagccagagcaacagcuuccacgccaagagagccgagcagcugaagaagagcauccugaagcaggccgccgaccugacccaggagcugcccagcgugcugcugcugcaccagcuggccaagcaggagggcgccuggaccauccugccccugcugccccacuucagcgugaccuacagcagaaacagcagcuggaucuucuucugcgaggaggagaccagaauccagauccccaagcugcuggagacccugagaagauacgaccccagcaaggagugguuccugggcaaggcccugcacgacgaggaggccaccaucauccaccacuacgccuucagcgagaaccccaccguguucaaguaccccgacuucgccgccggcugggcccugagcaucccccuggugaacaagcugaccaagagacugaagagcgagagccugaagagcgacuucaccaucgaccugaagcacgagaucgcccuguacaucugggacaagggcggcggccccccccugacccccgugcccgaguucugcaccaacgacguggacuucuacugcgccaccaccuuccacagcuuccugccccugugcagaaagcccgugaagaagaaggacaucuucguggccgugaagaccugcaagaaguuccacggcgacagaauccccaucgugaagcagaccugggagagccaggccagccugaucgaguacuacagcgacuacaccgagaacagcauccccaccguggaccugggcauccccaacaccgacagaggccacugcggcaagaccuucgccauccuggagagauuccugaacagaagccaggacaagaccgccuggcuggugaucguggacgacgacacccugaucagcaucagcagacugcagcaccugcugagcugcuacgacagcggcgagcccguguuccugggcgagagauacggcuacggccugggcaccggcggcuacagcuacaucaccggcggcggcggcaugguguucagcagagaggccgugagaagacugcuggccagcaagugcagaugcuacagcaacgacgcccccgacgacauggugcugggcaugugcuucagcggccugggcauccccgugacccacagcccccuguuccaccaggccagacccguggacuaccccaaggacuaccugagccaccaggugcccaucagcuuccacaagcacuggaacaucgaccccgugaagguguacuucaccuggcuggcccccagcgacgaggacaaggccagacaggagacccagaagggcuucagagaggagcuguaa

SEQ ID NO: 14070 - RNA, 1044 nt, Artificial Sequence
  B3GAT1__Homo_sapiens__XP_011541055
augggcaacgaggagcccugggugcagcccgcccuggagaugcccaagagaagagacauccuggccaucgugcugaucgugcugcccuggacccugcugaucaccguguggcaccagagcacccuggccccccugcuggccgugcacaaggacgagggcagcgaccccagaagagagaccccccccggcgccgaccccagagaguacugcaccagcgacagagacaucguggagguggugagaaccgaguacguguacaccagacccccccccuggagcgacacccugcccaccauccacguggugacccccaccuacagcagacccgugcagaaggccgagcugaccagaauggccaacacccugcugcacgugcccaaccugcacuggcuggugguggaggacgcccccagaagaaccccccugaccgccagacugcugagagacaccggccugaacuacacccaccugcacguggagacccccagaaacuacaagcugagaggcgacgccagagaccccagaauccccagaggcaccaugcagagaaaccuggcccugagauggcugagagagaccuuccccagaaacagcagccagcccggcgugguguacuucgccgacgacgacaacaccuacagccuggagcuguucgaggagaugagaagcaccagaagagugagcguguggcccguggccuucgugggcggccugagauacgaggcccccagagugaacggcgccggcaagguggugggcuggaagaccguguucgacccccacagacccuucgccaucgacauggccggcuucgccgugaaccugagacugauccugcagagaagccaggccuacuucaagcugagaggcgugaagggcggcuaccaggagagcagccugcugagagagcuggugacccugaacgaccuggagcccaaggccgccaacugcaccaagauccugguguggcacaccagaaccgagaagcccgugcuggugaacgagggcaagaagggcuucaccgaccccagcguggagaucuaa

SEQ ID NO: 14071 - RNA, 972 nt, Artificial Sequence
  B3GAT2__Homo_sapiens__NP_542780
augaagagcgcccuguucaccagauucuucauccugcugcccuggauccugaucgugaucaucaugcuggacguggacaccagaagacccgugcccccccugacccccagacccuacuucagccccuacgccgugggcagaggcggcgccagacugccccugagaagaggcggccccgcccacggcacccagaagagaaaccagagcagaccccagccccagcccgagccccagcugcccaccaucuacgccaucacccccaccuacagcagacccgugcagaaggccgagcugaccagacuggccaacaccuucagacagguggcccagcugcacuggauccugguggaggacgccgccgccagaagcgagcuggugagcagauuccuggccagagccggccugcccagcacccaccugcacgugcccacccccagaagauacaagagacccggccugcccagagccaccgagcagagaaacgccggccuggccuggcugagacagagacaccagcaccagagagcccagcccggcgugcuguucuucgccgacgacgacaacaccuacagccuggagcuguuccaggagaugagaaccaccagaaaggugagcguguggcccgugggccuggugggcggcagaagauacgagagaccccugguggagaacggcaagguggugggcugguacaccggcuggagagccgacagacccuucgccaucgacauggccggcuucgccgugagccugcaggugauccugagcaaccccaaggccguguucaagagaagaggcagccagcccggcaugcaggagagcgacuuccugaagcagaucaccaccguggaggagcuggagcccaaggccaacaacugcaccaaggugcugguguggcacaccagaaccgagaaggugaaccuggccaacgagcccaaguaccaccuggacaccgugaagaucgagguguaa

SEQ ID NO: 14072 - RNA, 948 nt, Artificial Sequence
  B3GAT3__Homo_sapiens__NP_001275652
augaagcugaagcugaagaacguguuccuggccuacuuccuggugagcaucgccggccugcuguacgcccuggugcagcugggccagcccugcgacugccugcccccccugagagccgccgccgagcagcugagacagaaggaccugagaaucagccagcugcaggccgagcugagaagacccccccccgcccccgcccagccccccgagcccgaggcccugcccaccaucuacguggugacccccaccuacgccagacuggugcagaaggccgagcuggugagacugagccagacccugagccuggugcccagacugcacuggcugcugguggaggacgccgagggccccaccccccuggugagcggccugcuggccgccagcggccugcuguucacccaccugguggugcugacccccaaggcccagagacugagagagggcgagcccggcugggugcaccccagaggcguggagcagagaaacaaggcccuggacuggcugagaggcagaggcggcgccgugggcggcgagaaggacccccccccccccggcacccagggcgugguguacuucgccgacgacgacaacaccuacagcagagagcuguucgaggagaugagauggaccagaggcgugagcguguggcccgugggccuggugggcggccugagauucgagggcccccaggugcaggacggcagaguggugggcuuccacaccgccugggagcccagcagacccuuccccguggacauggccggcuucgccguggcccugccccugcugcuggacaagcccaacgcccaguucgacagcaccgcccccagaggccaccuggagagcagccugcugagccaccugguggaccccaaggaccuggagcccagagccgccaacugcaccagaaccgagagcagaugcgugacccaggccggcgugcaguaa

SEQ ID NO: 14073 - RNA, 1194 nt, Artificial Sequence
  B3GNT2__Homo_sapiens__NP_001306004
augagcgugggcagaagaagaaucaagcugcugggcauccugaugauggccaacguguucaucuacuucaucauggaggugagcaagagcagcagccaggagaagaacggcaagggcgaggugaucauccccaaggagaaguucuggaagaucagcaccccccccgaggccuacuggaacagagagcaggagaagcugaacagacaguacaaccccauccugagcaugcugaccaaccagaccggcgaggccggcagacugagcaacaucagccaccugaacuacugcgagcccgaccugagagugaccagcguggugaccggcuucaacaaccugcccgacagauucaaggacuuccugcuguaccugagaugcagaaacuacagccugcugaucgaccagcccgacaagugcgccaagaagcccuuccugcugcuggccaucaagagccugaccccccacuucgccagaagacaggccaucagagagagcuggggccaggagagcaacgccggcaaccagaccguggugagaguguuccugcugggccagaccccccccgaggacaaccaccccgaccugagcgacaugcugaaguucgagagcgagaagcaccaggacauccugauguggaacuacagagacaccuucuucaaccugagccugaaggaggugcuguuccugagaugggugagcaccagcugccccgacaccgaguucguguucaagggcgacgacgacguguucgugaacacccaccacauccugaacuaccugaacagccugagcaagaccaaggccaaggaccuguucaucggcgacgugauccacaacgccggcccccacagagacaagaagcugaaguacuacauccccgaggugguguacagcggccuguacccccccuacgccggcggcggcggcuuccuguacagcggccaccuggcccugagacuguaccacaucaccgaccaggugcaccuguaccccaucgacgacguguacaccggcaugugccugcagaagcugggccuggugcccgagaagcacaagggcuucagaaccuucgacaucgaggagaagaacaagaacaacaucugcagcuacguggaccugaugcuggugcacagcagaaagccccaggagaugaucgacaucuggagccagcugcagagcgcccaccugaagugcuaa

SEQ ID NO: 14074 - RNA, 1119 nt, Artificial Sequence
  B3GNT3__Homo_sapiens__XP_011525929
augaaguaccugagacacagaagacccaacgccacccugauccuggccaucggcgccuucacccugcugcuguucagccugcuggugagcccccccaccugcaaggugcaggagcagccccccgccauccccgaggcccuggccuggcccaccccccccaccagacccgcccccgcccccugccacgccaacaccagcauggugacccaccccgacuucgccacccagccccagcacgugcagaacuuccugcuguacagacacugcagacacuucccccugcugcaggacgugccccccagcaagugcgcccagcccguguuccugcugcuggugaucaagagcagccccagcaacuacgugagaagagagcugcugagaagaaccuggggcagagagagaaaggugagaggccugcagcugagacugcuguuccuggugggcaccgccagcaacccccacgaggccagaaaggugaacagacugcuggagcuggaggcccagacccacggcgacauccugcagugggacuuccacgacagcuucuucaaccugacccugaagcaggugcuguuccugcaguggcaggagaccagaugcgccaacgccagcuucgugcugaacggcgacgacgacguguucgcccacaccgacaacaugguguucuaccugcaggaccacgaccccggcagacaccuguucgugggccagcugauccagaacgugggccccaucagagccuucuggagcaaguacuacgugcccgagguggugacccagaacgagagauacccccccuacugcggcggcggcggcuuccugcugagcagauucaccgccgccgcccugagaagagccgcccacgugcuggacaucuuccccaucgacgacguguuccugggcaugugccuggagcuggagggccugaagcccgccagccacagcggcaucagaaccagcggcgugagagcccccagccagagacugagcagcuucgaccccugcuucuacagagaccugcugcuggugcacagauuccugcccuacgagaugcugcugaugugggacgcccugaaccagcccaaccugaccugcggcaaccagacccagaucuacuaa

SEQ ID NO: 14075 - RNA, 1137 nt, Artificial Sequence
  B3GNT5__Homo_sapiens__XP_011511531
augagaaugcuggugagcggcagaagagugaagaaguggcagcugaucauccagcuguucgccaccugcuuccuggccagccugauguucuucugggagcccaucgacaaccacaucgugagccacaugaagagcuacagcuacagauaccugaucaacagcuacgacuucgugaacgacacccugagccugaagcacaccagcgccggccccagauaccaguaccugaucaaccacaaggagaagugccaggcccaggacgugcugcugcugcuguucgugaagaccgcccccgagaacuacgacagaagaagcggcaucagaagaaccuggggcaacgagaacuacgugagaagccagcugaacgccaacaucaagacccuguucgcccugggcacccccaacccccuggagggcgaggagcugcagagaaagcuggccugggaggaccagagauacaacgacaucauccagcaggacuucguggacagcuucuacaaccugacccugaagcugcugaugcaguucagcugggccaacaccuacugcccccacgccaaguuccugaugaccgccgacgacgacaucuucauccacaugcccaaccugaucgaguaccugcagagccuggagcagaucggcgugcaggacuucuggaucggcagagugcacagaggcgccccccccaucagagacaagagcagcaaguacuacgugagcuacgagauguaccaguggcccgccuaccccgacuacaccgccggcgccgccuacgugaucagcggcgacguggccgccaagguguacgaggccagccagacccugaacagcagccuguacaucgacgacguguucaugggccugugcgccaacaagaucggcaucgugccccaggaccacguguucuucagcggcgagggcaagacccccuaccaccccugcaucuacgagaagaugaugaccagccacggccaccuggaggaccugcaggaccuguggaagaacgccaccgaccccaaggugaagaccaucagcaagggcuucuucggccagaucuacugcagacugaugaagaucauccugcugugcaagaucagcuacguggacaccuaccccugcagagccgccuucaucuaa

SEQ ID NO: 14076 - RNA, 1155 nt, Artificial Sequence
  B3GNT6__Homo_sapiens__NP_619651
auggccuuccccugcagaagaagccugaccgccaagacccuggccugccugcuggugggcgugagcuuccuggcccugcagcagugguuccugcaggcccccagaagccccagagaggagagaagcccccaggaggagacccccgagggccccaccgacgcccccgccgccgacgagccccccagcgagcuggugcccggcccccccugcguggccaacgccagcgccaacgccaccgccgacuucgagcagcugcccgccagaauccaggacuuccugagauacagacacugcagacacuucccccugcugugggacgcccccgccaagugcgccggcggcagaggcguguuccugcugcuggccgugaagagcgcccccgagcacuacgagagaagagagcugaucagaagaaccuggggccaggagagaagcuacggcggcagacccgugagaagacuguuccugcugggcacccccggccccgaggacgaggccagagccgagagacuggccgagcugguggcccuggaggccagagagcacggcgacgugcugcagugggccuucgccgacaccuuccugaaccugacccugaagcaccugcaccugcuggacuggcuggccgccagaugcccccacgccagauuccugcugagcggcgacgacgacguguucgugcacaccgccaacguggugagauuccugcaggcccagccccccggcagacaccuguucagcggccagcugauggagggcagcgugcccaucagagacagcuggagcaaguacuucgugcccccccagcuguuccccggcagcgccuaccccguguacugcagcggcggcggcuuccugcugagcggccccaccgccagagcccugagagccgccgccagacacaccccccuguuccccaucgacgacgccuacaugggcaugugccuggagagagccggccuggcccccagcggccacgagggcaucagacccuucggcgugcagcugcccggcgcccagcagagcagcuucgaccccugcauguacagagagcugcugcuggugcacagauucgcccccuacgagaugcugcugauguggaaggcccugcacagccccgcccugagcugcgacagaggccacagagugagcuaa

SEQ ID NO: 14077 - RNA, 1194 nt, Artificial Sequence
  B3GNT8__Homo_sapiens__NP_940942
augagaugccccaagugccugcugugccugagcgcccugcugacccugcugggccugaagguguacaucgaguggaccagcgagagcagacugagcaaggccuaccccagccccagaggcaccccccccagccccacccccgccaaccccgagcccacccugcccgccaaccugagcaccagacugggccagaccaucccccugcccuucgccuacuggaaccagcagcaguggagacugggcagccugcccagcggcgacagcaccgagaccggcggcugccaggccuggggcgccgccgccgccaccgagauccccgacuucgccagcuaccccaaggaccugagaagauuccugcugagcgccgccugcagaagcuucccccaguggcugcccggcggcggcggcagccaggugagcagcugcagcgacaccgacgugcccuaccugcugcuggccgugaagagcgagcccggcagauucgccgagagacaggccgugagagagaccuggggcagccccgcccccggcaucagacugcuguuccugcugggcagccccgugggcgaggccggccccgaccuggacagccugguggccugggagagcagaagauacagcgaccugcugcugugggacuuccuggacgugcccuucaaccagacccugaaggaccugcugcugcuggccuggcugggcagacacugccccaccgugagcuucgugcugagagcccaggacgacgccuucgugcacacccccgcccugcuggcccaccugagagcccugccccccgccagcgccagaagccuguaccugggcgagguguucacccaggccaugccccugagaaagcccggcggccccuucuacgugcccgagagcuucuucgagggcggcuaccccgccuacgccagcggcggcggcuacgugaucgccggcagacuggcccccuggcugcugagagccgccgccagaguggcccccuuccccuucgaggacguguacaccggccugugcaucagagcccugggccuggugccccaggcccaccccggcuuccugaccgccuggcccgccgacagaaccgccgaccacugcgccuucagaaaccugcugcuggugagaccccugggcccccaggccagcaucagacuguggaagcagcugcaggaccccagacugcagugcuaa

SEQ ID NO: 14078 - RNA, 1086 nt, Artificial Sequence
  B3GNTL1__Homo_sapiens__XP_006722335
augagcggcgccggcgugggcggcgccagcgaggagagccaggccaugcaggcccacgugagcaucauccugcccgugcacaacgccgagcccuggcuggacgagugccugagaagcgugcugcagcaggacuucgagggcaccauggagcugagcguguucaacgacgccagcaaggacaagagcggcgccaucaucgagaaguggagagugaagcuggaggacagcggcgugcacgugaucaucggcggccacgacagccccagccccagaggcgugggcuacgccaagaaccaggccguggcccagagcagcggcagcuaccugugcuuccuggacagcgacgacgugaugaugccccagagagugagacugcagcacgaggccgccgugcagcaccccagcagcaucaucggcugcagagugagaagagacccccccaacagcaccgagagauacaccagauggaucaaccagcugacccccgagcagcugcugacccagguguucaccagcaacggccccaccgugaucaugcccaccugguucugcagcagagccugguucagccacgugggccccuucaacgagggcggccagggcgugcccgaggaccugcuguucuucuacgagcaccugagaaagggcggcggcgugaucagaguggaccagagccugcugcuguacagacaccacccccaggccgccacccacugcgugcuggagaccaccaucuggacccacagagugagauuccuggaggagcaggcccugcccagaugggccgccuucaccaucuggaacgccggcaagcagggcagaagacuguacagaagccugaccgccggcagccagagaaaggugguggccuucugcgacguggacgagaacaagaucagaaagggcuucuacugccacgaggacagccaggagagacccaagcccagaauccccauccugcacuucagagccgccagaccccccuucgugaucugcgugaagcuggaccugaccggcggcgccuucgaggacaaccugagaagccugcaccugcaggagggccaggacuuccugcacuucagcuaa

SEQ ID NO: 14079 - RNA, 987 nt, Artificial Sequence
  B4GALNT1__Homo_sapiens__NP_001263398
auguggcugggcagaagagcccugugcgcccuggugcugcugcuggccugcgccagccugggccugcuguacgccagcaccagagacgcccccggccugagacugccccuggcccccugggcccccccccagagccccagaagacccgagcugcccgaccuggcccccgagcccagauacgcccacauccccgugagaaucaaggagcagguggugggccugcuggccuggaacaacugcagcugcgagagcagcggcggcggccugccccugcccuuccagaagcaggugagagccaucgaccugaccaaggccuucgaccccgccgagcugagagccgccagcgccaccagagagcaggaguuccaggccuuccugagcagaagccagagccccgccgaccagcugcugaucgcccccgccaacagcccccugcaguacccccugcagggcguggaggugcagccccugagaagcauccuggugcccggccugagccugcaggccgccagcggccaggagguguaccaggugaaccugaccgccagccugggcaccugggacguggccggcgaggugaccggcgugacccugaccggcgagggccaggccgaccugacccuggugagccccggccuggaccagcugaacagacagcugcagcuggugaccuacagcagcagaagcuaccagaccaacaccgccgacaccggcgccagacccggcuggagagacggccaggccggccagaccgagaagaaccagaagggcuggagcggccagauggccgagggcaugggcggcaucugggccauggccagagccgugcagccccacaacggcugcuucaacuggaccagcagagccagaggcagaaagggcgccuucgugcaccugggccuggagcaggccagaggcaagcccgagcccugggugugccugcccuucagacccaccgugggcggccccagaaagagacugguguaa

SEQ ID NO: 14080 - RNA, 1521 nt, Artificial Sequence
  B4GALNT2__Homo_sapiens__NP_001152859
augaccagcggcggcagcagauuccuguggcugcugaagauccuggugaucauccuggugcugggcaucgugggcuucauguucggcagcauguuccugcaggccguguucagcagccccaagcccgagcugcccagccccgcccccggcgugcagaagcugaagcugcugcccgaggagagacugagaaaccuguucagcuacgacggcaucuggcuguuccccaagaaccagugcaagugcgaggccaacaaggagcagggcggcuacaacuuccaggacgccuacggccagagcgaccugcccgccgugaaggccagaagacaggccgaguucgagcacuuccagagaagagagggccugcccagaccccugccccugcuggugcagcccaaccugcccuucggcuaccccgugcacggcguggaggugaugccccugcacaccgugcccauccccggccugcaguucgagggccccgacgcccccguguacgaggugacccugaccgccagccugggcacccugaacacccuggccgacgugcccgacagcguggugcagggcagaggccagaagcagcugaucaucagcaccagcgacagaaagcugcugaaguucauccugcagcacgugaccuacaccagcaccggcuaccagcaccagaagguggacaucgugagccuggagagcagaagcagcguggccaaguuccccgugaccaucagacaccccgugauccccaagcuguacgaccccggccccgagagaaagcugagaaaccuggugaccaucgccaccaagaccuuccugagaccccacaagcugaugaucaugcugagaagcaucagagaguacuaccccgaccugaccgugaucguggccgacgacagccagaagccccuggagaucaaggacaaccacguggaguacuacaccaugcccuucggcaagggcugguucgccggcagaaaccuggccaucagccaggugaccaccaaguacgugcuguggguggacgacgacuuccuguucaacgaggagaccaagaucgaggugcugguggacgugcuggagaagaccgagcuggacguggugggcggcagcgugcugggcaacguguuccaguucaagcugcugcuggagcagagcgagaacggcgccugccugcacaagagaaugggcuucuuccagccccuggacggcuuccccagcugcguggugaccagcggcguggugaacuucuuccuggcccacaccgagagacugcagagagugggcuucgaccccagacugcagagaguggcccacagcgaguucuucaucgacggccugggcacccugcuggugggcagcugccccgaggugaucaucggccaccagagcagaagccccgugguggacagcgagcuggccgcccuggagaagaccuacaacaccuacagaagcaacacccugaccagagugcaguucaagcuggcccugcacuacuucaagaaccaccugcagugcgccgccuaa

SEQ ID NO: 14081 - RNA, 2997 nt, Artificial Sequence
  B4GALNT3__Homo_sapiens__NP_775864
augggcagccccagagccgccagacccccccugcugcugagacccgugaagcugcugagaagaagauucagacugcugcuggcccuggccguggugagcgugggccuguggacccuguaccuggagcugguggccagcgcccaggugggcggcaacccccugaacagaagauacggcagcuggagagagcuggccaaggcccuggccagcagaaacauccccgccguggacccccaccugcaguucuaccacccccagagacugagccuggaggaccacgacaucgaccagggcgugagcagcaacagcagcuaccugaaguggaacaagcccgugcccuggcugagcgaguucagaggcagagccaaccugcacguguucgaggacuggugcggcagcagcauccagcagcugagaagaaaccugcacuucccccuguacccccacaucagaaccacccugagaaagcuggccgugagccccaaguggaccaacuacggccugagaaucuucggcuaccugcaccccuucaccgacggcaagauccaguucgccaucgccgccgacgacaacgccgaguucuggcugagccuggacgaccaggugagcggccugcagcugcuggccagcgugggcaagaccggcaaggaguggaccgcccccggcgaguucggcaaguucagaagccagaucagcaagcccgugagccugagcgccagccacagauacuacuucgaggugcugcacaagcagaacgaggagggcaccgaccacguggagguggccuggagaagaaacgaccccggcgccaaguucaccaucaucgacagccugagccugagccuguucaccaacgagaccuuccugcagauggacgaggugggccacaucccccagaccgccgccagccacguggacagcagcaacgcccugcccagagacgagcagccccccgccgacaugcugagacccgaccccagagacacccuguacagagugccccugauccccaagagccaccugagacacgugcugcccgacugccccuacaagcccagcuaccugguggacggccugccccugcagagauaccagggccugagauucgugcaccugagcuucguguaccccaacgacuacaccagacugagccacauggagacccacaacaagugcuucuaccaggagaacgccuacuaccaggacagauucagcuuccaggaguacaucaagaucgaccagcccgagaagcagggccuggagcagcccggcuucgaggagaaccugcuggaggagagccaguacggcgagguggccgaggagacccccgccagcaacaaccagaacgccagaaugcuggagggcagacagacccccgccagcacccuggagcaggacgccaccgacuacagacugagaagccugagaaagcugcuggcccagcccagagagggccugcuggcccccuucagcaagagaaacagcaccgccagcuuccccggcagaaccagccacauccccgugcagcagcccgagaagagaaagcagaagcccagccccgagcccagccaggacagcccccacagcgacaaguggccccccggccaccccgugaagaaccugccccagaugagaggccccagacccagacccgccggcgacagccccagaaagacccaguggcugaaccagguggagagcuacaucgccgagcagagaagaggcgacagaaugagaccccaggcccccggcagaggcuggcacggcgaggaggaggugguggccgccgccggccaggagggccagguggagggcgaggaggagggcgaggaggaggaggaggaggaggacaugagcgagguguucgaguacgugcccguguucgaccccguggugaacugggaccagaccuucagcgccagaaaccuggacuuccaggcccugagaaccgacuggaucgaccugagcugcaacaccagcggcaaccugcugcugcccgagcaggaggcccuggaggugaccagaguguuccugaagaagcugaaccagagaagcagaggcagauaccagcugcagagaaucgugaacguggagaagagacaggaccagcugagaggcggcagauaccugcuggagcuggagcugcuggagcagggccagagaguggugagacugagcgaguacgugagcgccagaggcuggcagggcaucgaccccgccggcggcgaggagguggaggccagaaaccugcagggccuggugugggacccccacaacagaagaagacaggugcugaacaccagagcccaggagcccaagcugugcuggccccagggcuucagcuggagccacagagccguggugcacuucguggugcccgugaagaaccaggccagaugggugcagcaguucaucaaggacauggagaaccuguuccaggugaccggcgacccccacuucaacaucgugaucaccgacuacagcagcgaggacauggacguggagauggcccugaagagaagcaagcugagaagcuaccaguacgugaagcugagcggcaacuucgagagaagcgccggccugcaggccggcaucgaccuggugaaggacccccacagcaucaucuuccugugcgaccugcacauccacuuccccgccggcgugaucgacgccaucagaaagcacugcguggagggcaagauggccuucgcccccauggugaugagacugcacugcggcgccaccccccaguggcccgagggcuacugggaggugaacggcuucggccugcugggcaucuacaagagcgaccuggacagaaucggcggcaugaacaccaaggaguucagagacagauggggcggcgaggacugggagcugcuggacagaauccugcaggccggccuggacguggagagacugagccugagaaacuucuuccaccacuuccacagcaagagaggcauguggagcagaagacagaugaagacccuguaa

SEQ ID NO: 14082 - RNA, 1197 nt, Artificial Sequence
  B4GALT1__Homo_sapiens__NP_001488
augagacugagagagccccugcugagcggcagcgccgccaugcccggcgccagccugcagagagccugcagacugcugguggccgugugcgcccugcaccugggcgugacccugguguacuaccuggccggcagagaccugagcagacugccccagcuggugggcgugagcaccccccugcagggcggcagcaacagcgccgccgccaucggccagagcagcggcgagcugagaaccggcggcgccagacccccccccccccugggcgccagcagccagcccagacccggcggcgacagcagccccgugguggacagcggccccggccccgccagcaaccugaccagcgugcccgugccccacaccaccgcccugagccugcccgccugccccgaggagagcccccugcuggugggccccaugcugaucgaguucaacaugcccguggaccuggagcugguggccaagcagaaccccaacgugaagaugggcggcagauacgcccccagagacugcgugagcccccacaagguggccaucaucauccccuucagaaacagacaggagcaccugaaguacuggcuguacuaccugcaccccgugcugcagagacagcagcuggacuacggcaucuacgugaucaaccaggccggcgacaccaucuucaacagagccaagcugcugaacgugggcuuccaggaggcccugaaggacuacgacuacaccugcuucguguucagcgacguggaccugauccccaugaacgaccacaacgccuacagaugcuucagccagcccagacacaucagcguggccauggacaaguucggcuucagccugcccuacgugcaguacuucggcggcgugagcgcccugagcaagcagcaguuccugaccaucaacggcuuccccaacaacuacuggggcuggggcggcgaggacgacgacaucuucaacagacugguguucagaggcaugagcaucagcagacccaacgccguggugggcagaugcagaaugaucagacacagcagagacaagaagaacgagcccaacccccagagauucgacagaaucgcccacaccaaggagaccaugcugagcgacggccugaacagccugaccuaccaggugcuggacgugcagagauacccccuguacacccagaucaccguggacaucggcacccccagcuaa

SEQ ID NO: 14083 - RNA, 1182 nt, Artificial Sequence
  B4GALT3__Homo_sapiens__NP_003770
augcugagaagacugcuggagagacccugcacccuggcccugcuggugggcagccagcuggccgugaugauguaccugagccugggcggcuucagaagccugagcgcccuguucggcagagaccagggccccaccuucgacuacagccaccccagagacguguacagcaaccugagccaccugcccggcgcccccggcggcccccccgccccccagggccugcccuacugccccgagagaagcccccugcuggugggccccgugagcgugagcuucagccccgugcccagccuggccgagaucguggagagaaaccccagaguggagcccggcggcagauacagacccgccggcugcgagcccagaagcagaaccgccaucaucgugccccacagagccagagagcaccaccugagacugcugcuguaccaccugcaccccuuccugcagagacagcagcuggccuacggcaucuacgugauccaccaggccggcaacggcaccuucaacagagccaagcugcugaacgugggcgugagagaggcccugagagacgaggagugggacugccuguuccugcacgacguggaccugcugcccgagaacgaccacaaccuguacgugugcgaccccagaggccccagacacguggccguggccaugaacaaguucggcuacagccugcccuacccccaguacuucggcggcgugagcgcccugacccccgaccaguaccugaagaugaacggcuuccccaacgaguacuggggcuggggcggcgaggacgacgacaucgccaccagagugagacuggccggcaugaagaucagcagaccccccaccagcgugggccacuacaagauggugaagcacagaggcgacaagggcaacgaggagaacccccacagauucgaccugcuggugagaacccagaacagcuggacccaggacggcaugaacagccugaccuaccagcugcuggccagagagcugggcccccuguacaccaacaucaccgccgacaucggcaccgaccccagaggccccagagcccccagcggccccagauacccccccggcagcagccaggccuucagacaggagaugcugcagagaagaccccccgccagacccggcccccugagcaccgccaaccacaccgcccugagaggcagccacuaa

SEQ ID NO: 14084 - RNA, 1035 nt, Artificial Sequence
  B4GALT4__Homo_sapiens__NP_997708
augggcuucaaccugaccuuccaccugagcuacaaguucagacugcugcugcugcugacccugugccugaccguggugggcugggccaccagcaacuacuucgugggcgccauccaggagauccccaaggccaaggaguucauggccaacuuccacaagacccugauccugggcaagggcaagacccugaccaacgaggccagcaccaagaagguggagcuggacaacugccccagcgugagccccuaccugagaggccagagcaagcugaucuucaagcccgaccugacccuggaggaggugcaggccgagaaccccaaggugagcagaggcagauacagaccccaggagugcaaggcccugcagagaguggccauccuggugccccacagaaacagagagaagcaccugauguaccugcuggagcaccugcaccccuuccugcagagacagcagcuggacuacggcaucuacgugauccaccaggccgagggcaagaaguucaacagagccaagcugcugaacgugggcuaccuggaggcccugaaggaggagaacugggacugcuucaucuuccacgacguggaccuggugcccgagaacgacuucaaccuguacaagugcgaggagcaccccaagcaccugguggugggcagaaacagcaccggcuacagacugagauacagcggcuacuucggcggcgugaccgcccugagcagagagcaguucuucaaggugaacggcuucagcaacaacuacuggggcuggggcggcgaggacgacgaccugagacugagaguggagcugcagagaaugaagaucagcagaccccugcccgaggugggcaaguacaccaugguguuccacaccagagacaagggcaacgaggugaacgccgagagaaugaagcugcugcaccaggugagcagaguguggagaaccgacggccugagcagcugcagcuacaagcuggugagcguggagcacaacccccuguacaucaacaucaccguggacuucugguucggcgccuaa

SEQ ID NO: 14085 - RNA, 1167 nt, Artificial Sequence
  B4GALT5__Homo_sapiens__NP_004767
augagagccagaagaggccugcugagacugcccagaagaagccugcuggccgcccuguucuucuucagccugagcagcagccugcuguacuucguguacguggcccccggcaucgugaacaccuaccuguucaugaugcaggcccagggcauccugaucagagacaacgugagaaccaucggcgcccagguguacgagcaggugcugagaagcgccuacgccaagagaaacagcagcgugaacgacagcgacuacccccuggaccugaaccacagcgagaccuuccugcagaccaccaccuuccugcccgaggacuucaccuacuucgccaaccacaccugccccgagagacugcccagcaugaagggccccaucgacaucaacaugagcgagaucggcauggacuacauccacgagcuguucagcaaggaccccaccaucaagcugggcggccacuggaagcccagcgacugcaugcccagauggaagguggccauccugauccccuucagaaacagacacgagcaccugcccgugcuguucagacaccugcugcccaugcugcagagacagagacugcaguucgccuucuacgugguggagcaggugggcacccagcccuucaacagagccaugcuguucaacgugggcuuccaggaggccaugaaggaccuggacugggacugccugaucuuccacgacguggaccacauccccgagagcgacagaaacuacuacggcugcggccagaugcccagacacuucgccaccaagcuggacaaguacauguaccugcugcccuacaccgaguucuucggcggcgugagcggccugaccguggagcaguucagaaagaucaacggcuuccccaacgccuucuggggcuggggcggcgaggacgacgaccuguggaacagagugcagaacgccggcuacagcgugagcagacccgagggcgacaccggcaaguacaagagcaucccccaccaccacagaggcgaggugcaguuccugggcagauacgcccugcugagaaagagcaaggagagacagggccuggacggccugaacaaccugaacuacuucgccaacaucaccuacgacgcccuguacaagaacaucaccgugaaccugacccccgagcuggcccaggugaacgaguacuaa

SEQ ID NO: 14086 - RNA, 1149 nt, Artificial Sequence
  B4GALT6__Homo_sapiens__NP_004766
augagcgugcugagaagaaugaugagagugagcaacagaagccugcuggccuucaucuucuucuucagccugagcagcagcugccuguacuucaucuacguggcccccggcaucgccaacaccuaccuguucauggugcaggccagaggcaucaugcugagagagaacgugaagaccaucggccacaugaucagacuguacaccaacaagaacagcacccugaacggcaccgacuaccccgagggcaacaacagcagcgacuaccuggugcagaccaccaccuaccugcccgagaacuucaccuacagccccuaccugcccugccccgagaagcugcccuacaugagaggcuuccugaacgugaacgugagcgaggugagcuucgacgagauccaccagcuguucagcaaggaccuggacaucgagcccggcggccacuggagacccaaggacugcaagcccagauggaagguggccgugcugauccccuucagaaacagacacgagcaccugcccaucuucuuccugcaccugauccccaugcugcagaagcagagacuggaguucgccuucuacgugaucgagcagaccggcacccagcccuucaacagagccaugcuguucaacgugggcuucaaggaggccaugaaggacagcgugugggacugcgugaucuuccacgacguggaccaccugcccgagaacgacagaaacuacuacggcugcggcgagaugcccagacacuucgccgccaagcuggacaaguacauguacauccugcccuacaaggaguucuucggcggcgugagcggccugaccguggagcaguucagaaagaucaacggcuuccccaacgccuucuggggcuggggcggcgaggacgacgaccuguggaacagagugcacuacgccggcuacaacgugaccagacccgagggcgaccugggcaaguacaagagcaucccccaccaccacagaggcgaggugcaguuccugggcagauacaagcugcugagauacagcaaggagagacaguacaucgacggccugaacaaccugaucuacagacccaagauccugguggacagacuguacaccaacaucagcgugaaccugaugcccgagcuggcccccaucgaggacuacuaa

SEQ ID NO: 14087 - RNA, 984 nt, Artificial Sequence
  B4GALT7__Homo_sapiens__NP_009186
auguuccccagcagaagaaaggccgcccagcugcccugggaggacggcagaagcggccugcugagcggcggccugcccagaaagugcagcguguuccaccuguucguggccugccugagccugggcuucuucagccugcuguggcugcagcugagcugcagcggcgacguggccagagccgugagaggccagggccaggagaccagcggcccccccagagccugcccccccgagcccccccccgagcacugggaggaggacgccagcuggggcccccacagacuggccgugcuggugcccuucagagagagauucgaggagcugcugguguucgugccccacaugagaagauuccugagcagaaagaagaucagacaccacaucuacgugcugaaccagguggaccacuucagauucaacagagccgcccugaucaacgugggcuuccuggagagcagcaacagcaccgacuacaucgccaugcacgacguggaccugcugccccugaacgaggagcuggacuacggcuuccccgaggccggccccuuccacguggccagccccgagcugcacccccuguaccacuacaagaccuacgugggcggcauccugcugcugagcaagcagcacuacagacugugcaacggcaugagcaacagauucuggggcuggggcagagaggacgacgaguucuacagaagaaucaagggcgccggccugcagcuguucagacccagcggcaucaccaccggcuacaagaccuucagacaccugcacgaccccgccuggagaaagagagaccagaagagaaucgccgcccagaagcaggagcaguucaagguggacagagagggcggccugaacaccgugaaguaccacguggccagcagaaccgcccugagcgugggcggcgcccccugcaccgugcugaacaucaugcuggacugcgacaagaccgccacccccuggugcaccuucagcuaa

SEQ ID NO: 14088 - RNA, 1248 nt, Artificial Sequence
  B4GAT1__Homo_sapiens__NP_006867
augcagaugagcuacgccaucagaugcgccuucuaccagcugcugcuggccgcccugaugcugguggccaugcugcagcugcuguaccugagccugcugagcggccugcacggccaggaggagcaggaccaguacuucgaguucuucccccccagccccagaagcguggaccaggugaaggcccagcugagaaccgcccuggccagcggcggcgugcuggacgccagcggcgacuacagaguguacagaggccugcugaagaccaccauggaccccaacgacgugauccuggccacccacgccagcguggacaaccugcugcaccugagcggccugcuggagagaugggagggcccccugagcgugagcguguucgccgccaccaaggaggaggcccagcuggccaccgugcuggccuacgcccugagcagccacugccccgacaugagagccagaguggccaugcaccuggugugccccagcagauacgaggccgccgugcccgaccccagagagcccggcgaguucgcccugcugagaagcugccaggagguguucgacaagcuggccagaguggcccagcccggcaucaacuacgcccugggcaccaacgugagcuaccccaacaaccugcugagaaaccuggccagagagggcgccaacuacgcccuggugaucgacguggacauggugcccagcgagggccuguggagaggccugagagagaugcuggaccagagcaaccaguggggcggcaccgcccugguggugcccgccuucgagaucagaagagccagaagaaugcccaugaacaagaacgagcuggugcagcuguaccaggugggcgaggugagacccuucuacuacggccugugcacccccugccaggcccccaccaacuacagcagaugggugaaccugcccgaggagagccugcugagacccgccuacguggugcccuggcaggaccccugggagcccuucuacguggccggcggcaaggugcccaccuucgacgagagauucagacaguacggcuucaacagaaucagccaggccugcgagcugcacguggccggcuucgacuucgaggugcugaacgagggcuuccuggugcacaagggcuucaaggaggcccugaaguuccacccccagaaggaggccgagaaccagcacaacaagauccuguacagacaguucaagcaggagcugaaggccaaguaccccaacagccccagaagaugcuaa

SEQ ID NO: 14089 - RNA, 444 nt, Artificial Sequence
  B9D1__Homo_sapiens__NP_001230404
augaugaccagcaccgccagcaccgcccugugcaccgccagaaccggccccccccagagaguguggagaagaggcagccacagaagccaccccagagccaagaugugcggcaagcacuggugcggcaccagcccccugaugagcccccugaaggcccccacccccaccgccggccacagaagcugcagcgccugcauggaccagaugugcagcggcaccaugugguucgaggccaugggccccugcaccugccccagccaccuggccggcaccaagggccccagccccugccugagccagaaccugagacugaacugcagaagccugcaggccggcagcuggggcggcggccccagcacccagacccccagaugguggcugagagugaaggccggcaagccccccagcggccugagcgugaaggacagcagcgugagcagauaa

SEQ ID NO: 14090 - RNA, 528 nt, Artificial Sequence
  B9D2__Homo_sapiens__NP_085055
auggccgaggugcacgugaucggccagaucaucggcgccagcggcuucagcgagagcagccuguucugcaaguggggcauccacaccggcgccgccuggaagcugcugagcggcgugagagagggccagacccagguggacaccccccagaucggcgacauggccuacuggagccaccccaucgaccugcacuucgccaccaagggccugcagggcuggcccagacugcacuuccagguguggagccaggacagcuucggcagaugccagcuggccggcuacggcuucugccacgugcccagcagccccggcacccaccagcuggccugccccaccuggagaccccugggcagcuggagagagcagcuggccagagccuucgugggcggcggcccccagcugcugcacggcgacaccaucuacagcggcgccgacagauacagacugcacaccgccgccggcggcaccgugcaccuggagaucggccugcugcugagaaacuucgacagauacggcguggagugcuaa

SEQ ID NO: 14091 - RNA, 165 nt, Artificial Sequence
  BAALC__Homo_sapiens__NP_001019543
augggcugcggcggcagcagagccgacgccaucgagcccagauacuacgagagcuggaccagagagaccgagagcaccuggcugaccuacaccgacagcgacgccccccccagcgccgccgcccccgacagcggccccgaggccggcggccugcacagcggcuaa

SEQ ID NO: 14092 - RNA, 1257 nt, Artificial Sequence
  BAAT__Homo_sapiens__NP_001692
augauccagcugaccgccacccccgugagcgcccugguggacgagcccgugcacaucagagccaccggccugauccccuuccagauggugagcuuccaggccagccuggaggacgagaacggcgacauguucuacagccaggcccacuacagagccaacgaguucggcgagguggaccugaaccacgccagcagccugggcggcgacuacaugggcgugcaccccaugggccuguucuggagccugaagcccgagaagcugcugaccagacugcugaagagagacgugaugaacagacccuuccaggugcaggugaagcuguacgaccuggagcugaucgugaacaacaagguggccagcgcccccaaggccagccugacccuggagagaugguacguggcccccggcgugaccagaaucaaggugagagagggcagacugagaggcgcccuguuccugccccccggcgagggccuguuccccggcgugaucgaccuguucggcggccugggcggccugcuggaguucagagccagccugcuggccagcagaggcuucgccagccuggcccuggccuaccacaacuacgaggaccugcccagaaagcccgaggugaccgaccuggaguacuucgaggaggccgccaacuuccugcugagacaccccaagguguucggcagcggcgugggcguggugagcgugugccagggcgugcagaucggccugagcauggccaucuaccugaagcaggugaccgccaccgugcugaucaacggcaccaacuuccccuucggcaucccccagguguaccacggccagauccaccagccccugccccacagcgcccagcugaucagcaccaacgcccugggccugcuggagcuguacagaaccuucgagaccacccaggugggcgccagccaguaccuguuccccaucgaggaggcccagggccaguuccuguucaucgugggcgagggcgacaagaccaucaacagcaaggcccacgccgagcaggccaucggccagcugaagagacacggcaagaacaacuggacccugcugagcuaccccggcgccggccaccugaucgagccccccuacagcccccugugcugcgccagcaccacccacgaccugagacugcacuggggcggcgaggugaucccccacgccgccgcccaggagcacgccuggaaggagauccagagauuccugagaaagcaccugauccccgacgugaccagccagcuguaa

SEQ ID NO: 14093 - RNA, 990 nt, Artificial Sequence
  BABAM1__Homo_sapiens__NP_001275685
auggagguggccgagcccagcagccccaccgaggaggaggaggaggaggaggagcacagcgccgagcccagacccagaaccagaagcaaccccgagggcgccgaggacagagccgugggcgcccaggccagcgugggcagcagaagcgagggcgagggcgaggccgccagcgccgacgacggcagccugaacaccagcggcgccggccccaagagcuggcaggugcccccccccgcccccgaggugcagaucagaacccccagagugaacugccccgagaaggugaucaucugccuggaccugagcgaggagaugagccugcccaagcuggagagcuucaacggcagcaagaccaacgcccugaacgugagccagaagaugaucgagauguucgugagaaccaagcacaagaucgacaagagccacgaguucgcccuggugguggugaacgacgacaccgccuggcugagcggccugaccagcgaccccagagagcugugcagcugccuguacgaccuggagaccgccagcugcagcaccuucaaccuggagggccuguucagccugauccagcagaagaccgagcugcccgugaccgagaacgugcagaccauccccccccccuacguggugagaaccauccugguguacagcagaccccccugccagccccaguucagccugaccgagcccaugaagaagauguuccagugccccuacuucuucuucgacgugguguacauccacaacggcaccgaggagaaggaggaggagaugagcuggaaggacauguucgccuucaugggcagccuggacaccaagggcaccagcuacaaguacgagguggcccuggccggccccgcccuggagcugcacaacugcauggccaagcugcuggcccacccccugcagagacccugccagagccacgccagcuacagccugcuggaggaggaggacgaggccaucgagguggaggccaccguguaa

SEQ ID NO: 14094 - RNA, 1131 nt, Artificial Sequence
  BACE1__Homo_sapiens__NP_001193978
auggugcccuucaucuaccugcaggcccacuucacccugugcagcggcuggagcagcaccuacagagaccugagaaagggcguguacgugcccuacacccagggcaagugggagggcgagcugggcaccgaccuggugagcaucccccacggccccaacgugaccgugagagccaacaucgccgccaucaccgagagcgacaaguucuucaucaacggcagcaacugggagggcauccugggccuggccuacgccgagaucgccagacugugcggcgccggcuucccccugaaccagagcgaggugcuggccagcgugggcggcagcaugaucaucggcggcaucgaccacagccuguacaccggcagccugugguacacccccaucagaagagagugguacuacgaggugaucaucgugagaguggagaucaacggccaggaccugaagauggacugcaaggaguacaacuacgacaagagcaucguggacagcggcaccaccaaccugagacugcccaagaagguguucgaggccgccgugaagagcaucaaggccgccagcagcaccgagaaguuccccgacggcuucuggcugggcgagcagcuggugugcuggcaggccggcaccacccccuggaacaucuuccccgugaucagccuguaccugaugggcgaggugaccaaccagagcuucagaaucaccauccugccccagcaguaccugagacccguggaggacguggccaccagccaggacgacugcuacaaguucgccaucagccagagcagcaccggcaccgugaugggcgccgugaucauggagggcuucuacgugguguucgacagagccagaaagagaaucggcuucgccgugagcgccugccacgugcacgacgaguucagaaccgccgccguggagggccccuucgugacccuggacauggaggacugcggcuacaacaucccccagaccgacgagagcacccugaugaccaucgccuacgugauggccgccaucugcgcccuguucaugcugccccugugccugauggugugccaguggagaugccugagaugccugagacagcagcacgacgacuucgccgacgacaucagccugcugaaguaa

SEQ ID NO: 14095 - RNA, 1557 nt, Artificial Sequence
  BACE2__Homo_sapiens__NP_036237
augggcgcccuggccagagcccugcugcugccccugcuggcccaguggcugcugagagccgcccccgagcuggcccccgcccccuucacccugccccugagaguggccgccgccaccaacagagugguggcccccacccccggccccggcacccccgccgagagacacgccgacggccuggcccuggcccuggagcccgcccuggccagccccgccggcgccgccaacuuccuggccaugguggacaaccugcagggcgacagcggcagaggcuacuaccuggagaugcugaucggcacccccccccagaagcugcagauccugguggacaccggcagcagcaacuucgccguggccggcaccccccacagcuacaucgacaccuacuucgacaccgagagaagcagcaccuacagaagcaagggcuucgacgugaccgugaaguacacccagggcagcuggaccggcuucgugggcgaggaccuggugaccauccccaagggcuucaacaccagcuuccuggugaacaucgccaccaucuucgagagcgagaacuucuuccugcccggcaucaaguggaacggcauccugggccuggccuacgccacccuggccaagcccagcagcagccuggagaccuucuucgacagccuggugacccaggccaacauccccaacguguucagcaugcagaugugcggcgccggccugcccguggccggcagcggcaccaacggcggcagccuggugcugggcggcaucgagcccagccuguacaagggcgacaucugguacacccccaucaaggaggagugguacuaccagaucgagauccugaagcuggagaucggcggccagagccugaaccuggacugcagagaguacaacgccgacaaggccaucguggacagcggcaccacccugcugagacugccccagaagguguucgacgccgugguggaggccguggccagagccagccugauccccgaguucagcgacggcuucuggaccggcagccagcuggccugcuggaccaacagcgagacccccuggagcuacuuccccaagaucagcaucuaccugagagacgagaacagcagcagaagcuucagaaucaccauccugccccagcuguacauccagcccaugaugggcgccggccugaacuacgagugcuacagauucggcaucagccccagcaccaacgcccuggugaucggcgccaccgugauggagggcuucuacgugaucuucgacagagcccagaagagagugggcuucgccgccagccccugcgccgagaucgccggcgccgccgugagcgagaucagcggccccuucagcaccgaggacguggccagcaacugcgugcccgcccagagccugagcgagcccauccuguggaucgugagcuacgcccugaugagcgugugcggcgccauccugcuggugcugaucgugcugcugcugcugcccuucagaugccagagaagacccagagaccccgagguggugaacgacgagagcagccuggugagacacagauggaaguaa

SEQ ID NO: 14096 - RNA, 2211 nt, Artificial Sequence
  BACH1__Homo_sapiens__NP_996749
augagccugagcgagaacagcguguucgccuacgagagcagcgugcacagcaccaacgugcugcugagccugaacgaccagagaaagaaggacgugcugugcgacgugaccaucuucguggagggccagagauucagagcccacagaagcgugcuggccgccugcagcagcuacuuccacagcagaaucgugggccaggccgacggcgagcugaacaucacccugcccgaggaggugaccgugaagggcuucgagccccugauccaguucgccuacaccgccaagcugauccugagcaaggagaacguggacgaggugugcaagugcguggaguuccugagcgugcacaacaucgaggagagcugcuuccaguuccugaaguucaaguuccuggacagcaccgccgaccagcaggagugccccagaaagaagugcuucagcagccacugccagaagaccgaccugaagcugagccugcuggaccagagagaccuggagaccgacgagguggaggaguuccuggagaacaagaacgugcagaccccccagugcaagcugagaagauaccagggcaacgccaaggccagccccccccugcaggacagcgccagccagaccuacgagagcaugugccuggagaaggacgccgcccuggcccugcccagccugugccccaaguacagaaaguuccagaaggccuucggcaccgacagagugagaaccggcgagagcagcgugaaggacauccacgccagcgugcagcccaacgagagaagcgagaacgagugccugggcggcgugcccgagugcagagaccugcaggugaugcugaagugcgacgagagcaagcuggccauggagcccgaggagaccaagaaggaccccgccagccagugccccaccgagaagagcgaggugacccccuucccccacaacagcagcaucgacccccacggccuguacagccugagccugcugcacaccuacgaccaguacggcgaccugaacuucgccggcaugcagaacaccaccgugcugaccgagaagccccugagcggcaccgacgugcaggagaagaccuucggcgagagccaggaccugccccugaagagcgaccugggcaccagagaggacagcagcguggccagcagcgacagaagcagcguggagagagagguggccgagcaccuggccaagggcuucuggagcgacaucugcagcaccgacacccccugccagaugcagcugagccccgccguggccaaggacggcagcgagcagaucagccagaagagaagcgagugccccuggcugggcaucagaaucagcgagagccccgagcccggccagagaaccuucaccacccugagcagcgugaacugccccuucaucagcacccugagcaccgagggcugcagcagcaaccuggagaucggcaacgacgacuacgugagcgagccccagcaggagcccugccccuacgccugcgugaucagccugggcgacgacagcgagaccgacaccgagggcgacagcgagagcugcagcgccagagagcaggagugcgaggugaagcugcccuucaacgcccagagaaucaucagccugagcagaaacgacuuccagagccugcugaagaugcacaagcugacccccgagcagcuggacugcauccacgacaucagaagaagaagcaagaacagaaucgccgcccagagaugcagaaagagaaagcuggacugcauccagaaccuggagagcgagaucgagaagcugcagagcgagaaggagagccugcugaaggagagagaccacauccugagcacccugggcgagaccaagcagaaccugaccggccugugccagaaggugugcaaggaggccgcccugagccaggagcagauccagauccuggccaaguacagcgccgccgacugcccccugagcuuccugaucagcgagaaggacaagagcacccccgacggcgagcuggcccugcccagcaucuucagccugagcgacagaccccccgccgugcugccccccugcgccagaggcaacagcgagcccggcuacgccagaggccaggagagccagcagaugagcaccgccaccagcgagcaggccggccccgccgagcagugcagacagagcggcggcaucagcgacuucugccagcagaugaccgacaagugcaccaccgacgaguaa

SEQ ID NO: 14097 - RNA, 2634 nt, Artificial Sequence
  BACH2__Homo_sapiens__XP_005248815
augagcagacacaccggcaagagaagaaagacccagguggaggagaccagccagaucagcagaaacuggaacguguucaagagcuggcagagccagggcgugaacggcaugagcguggacgagaagcccgacagccccauguacguguacgagagcaccgugcacugcaccaacauccugcugggccugaacgaccagagaaagaaggacauccugugcgacgugacccugaucguggagagaaaggaguucagagcccacagagccgugcuggccgccugcagcgaguacuucuggcaggcccuggugggccagaccaagaacgaccugguggugagccugcccgaggaggugaccgccagaggcuucggcccccugcugcaguucgccuacaccgccaagcugcugcugagcagagagaacaucagagaggugaucagaugcgccgaguuccugagaaugcacaaccuggaggacagcugcuucagcuuccugcagacccagcugcugaacagcgaggacggccuguucgugugcagaaaggacgccgccugccagagaccccacgaggacugcgagaacagcgccggcgaggaggaggacgaggaggaggagaccauggacagcgagaccgccaagauggccugccccagagaccagaugcugcccgagcccaucagcuucgaggccgccgccauccccguggccgagaaggaggaggcccugcugcccgagcccgacgugcccaccgacaccaaggagagcagcgagaaggacgcccugacccaguaccccagauacaagaaguaccagcuggccugcaccaagaacguguacaacgccagcagccacagcaccagcggcuucgccagcaccuucagagaggacaacagcagcaacagccugaagcccggccuggccagaggccagaucaagagcgagccccccagcgaggagaacgaggaggagagcaucacccugugccugagcggcgacgagcccgacgccaaggacagagccggcgacguggagauggacagaaagcagcccagccccgcccccacccccaccgcccccgccggcgccgccugccuggagagaagcagaagcguggccagccccagcugccugagaagccuguucagcaucaccaagagcguggagcugagcggccugcccagcaccagccagcagcacuucgccagaagccccgccugccccuucgacaagggcaucacccagggcgaccugaagaccgacuacacccccuucaccggcaacuacggccagccccacgugggccagaaggaggugagcaacuucaccaugggcagcccccugagaggccccggccuggaggcccugugcaagcaggagggcgagcuggacagaagaagcgugaucuucagcagcagcgccugcgaccaggugagcaccagcgugcacagcuacagcggcgugagcagccuggacaaggaccugagcgagcccgugcccaagggccugugggugggcgccggccagagccugcccagcagccaggccuacagccacggcggccugauggccgaccaccugcccggcagaaugagacccaacaccagcugccccgugcccaucaaggugugccccagaagccccccccuggagaccagaaccagaaccagcagcagcugcagcagcuacagcuacgccgaggacggcagcggcggcagccccugcagccugccccugugcgaguucagcagcagccccugcagccagggcgccagauuccuggccaccgagcaccaggagcccggccugaugggcgacggcauguacaaccaggugagaccccagaucaagugcgagcagagcuacggcaccaacagcagcgacgagagcggcagcuucagcgaggccgacagcgagagcugccccgugcaggacagaggccaggaggugaagcugcccuuccccguggaccagaucaccgaccugcccagaaacgacuuccagaugaugaucaagaugcacaagcugaccagcgagcagcuggaguucauccacgacgugagaagaagaagcaagaacagaaucgccgcccagagaugcagaaagagaaagcuggacugcauccagaaccuggagugcgagaucagaaagcuggugugcgagaaggagaagcugcugagcgagagaaaccagcugaaggccugcaugggcgagcugcuggacaacuucagcugccugagccaggaggugugcagagacauccagagccccgagcagauccaggcccugcacagauacugccccgugcugagacccauggaccugcccaccgccagcagcaucaaccccgccccccugggcgccgagcagaacaucgccgccagccagugcgccgugggcgagaacgugcccugcugccuggagcccggcgccgccccccccggcccccccugggcccccagcaacaccagcgagaacugcaccagcggcagaagacuggagggcaccgaccccggcaccuucagcgagagaggccccccccuggagcccagaagccagaccgugaccguggacuucugccaggagaugaccgacaagugcaccaccgacgagcagcccagaaaggacuacaccuaa

SEQ ID NO: 14098 - RNA, 507 nt, Artificial Sequence
  BAD__Homo_sapiens__NP_004313
auguuccagauccccgaguucgagcccagcgagcaggaggacagcagcagcgccgagagaggccugggccccagccccgccggcgacggccccagcggcagcggcaagcaccacagacaggcccccggccugcugugggacgccagccaccagcaggagcagcccaccagcagcagccaccacggcggcgccggcgccguggagaucagaagcagacacagcagcuaccccgccggcaccgaggacgacgagggcaugggcgaggagcccagccccuucagaggcagaagcagaagcgccccccccaaccugugggccgcccagagauacggcagagagcugagaagaaugagcgacgaguucguggacagcuucaagaagggccugcccagacccaagagcgccggcaccgccacccagaugagacagagcagcagcuggaccagaguguuccagagcuggugggacagaaaccugggcagaggcagcagcgcccccagccaguaa

SEQ ID NO: 14099 - RNA, 693 nt, Artificial Sequence
  BAG1__Homo_sapiens__NP_001165886
augaacagaagccaggaggugaccagagacgaggagagcaccagaagcgaggaggugaccagagaggagauggccgccgccggccugaccgugaccgugacccacagcaacgagaagcacgaccugcacgugaccagccagcagggcagcagcgagcccguggugcaggaccuggcccaggugguggaggaggugaucggcgugccccagagcuuccagaagcugaucuucaagggcaagagccugaaggagauggagaccccccugagcgcccugggcauccaggacggcugcagagugaugcugaucggcaagaagaacagcccccaggaggagguggagcugaagaagcugaagcaccuggagaagagcguggagaagaucgccgaccagcuggaggagcugaacaaggagcugaccggcauccagcagggcuuccugcccaaggaccugcaggccgaggcccugugcaagcuggacagaagagugaaggccaccaucgagcaguucaugaagauccuggaggagaucgacacccugauccugcccgagaacuucaaggacagcagacugaagagaaagggccuggugaagaaggugcaggccuuccuggccgagugcgacaccguggagcagaacaucugccaggagaccgagagacugcagagcaccaacuucgcccuggccgaguaa

SEQ ID NO: 14100 - RNA, 1728 nt, Artificial Sequence
  BAG3__Homo_sapiens__NP_004272
augagcgccgccacccacagccccaugaugcagguggccagcggcaacggcgacagagacccccugccccccggcugggagaucaagaucgacccccagaccggcuggcccuucuucguggaccacaacagcagaaccaccaccuggaacgaccccagagugcccagcgagggccccaaggagacccccagcagcgccaacggccccagcagagagggcagcagacugccccccgccagagagggccaccccguguacccccagcugagacccggcuacauccccauccccgugcugcacgagggcgccgagaacagacaggugcaccccuuccacguguacccccagcccggcaugcagagauucagaaccgaggccgccgccgccgccccccagagaagccagagcccccugagaggcaugcccgagaccacccagcccgacaagcagugcggccagguggccgccgccgccgccgcccagccccccgccagccacggccccgagagaagccagagccccgccgccagcgacugcagcagcagcagcagcagcgccagccugcccagcagcggcagaagcagccugggcagccaccagcugcccagaggcuacaucagcauccccgugauccacgagcagaacgugaccagacccgccgcccagcccagcuuccaccaggcccagaagacccacuaccccgcccagcagggcgaguaccagacccaccagcccguguaccacaagauccagggcgacgacugggagcccagaccccugagagccgccagccccuucagaagcagcgugcagggcgccagcagcagagagggcagccccgccagaagcagcaccccccugcacagccccagccccaucagagugcacaccgugguggacagaccccagcagcccaugacccacagagagaccgcccccgugagccagcccgagaacaagcccgagagcaagcccggccccgugggccccgagcugccccccggccacauccccauccaggugaucagaaaggagguggacagcaagcccgugagccagaagccccccccccccagcgagaagguggaggugaaggugccccccgcccccgugcccugccccccccccagccccggccccagcgccgugcccagcagccccaagagcguggccaccgaggagagagccgcccccagcaccgcccccgccgaggccaccccccccaagcccggcgaggccgaggccccccccaagcaccccggcgugcugaagguggaggccauccuggagaaggugcagggccuggagcaggccguggacaacuucgagggcaagaagaccgacaagaaguaccugaugaucgaggaguaccugaccaaggagcugcuggcccuggacagcguggaccccgagggcagagccgacgugagacaggccagaagagacggcgugagaaaggugcagaccauccuggagaagcuggagcagaaggccaucgacgugcccggccaggugcagguguacgagcugcagcccagcaaccuggaggccgaccagccccugcaggccaucauggagaugggcgccguggccgccgacaagggcaagaagaacgccggcaacgccgaggacccccacaccgagacccagcagcccgaggccaccgccgccgccaccagcaaccccagcagcaugaccgacacccccggcaaccccgccgcccccuaa

SEQ ID NO: 14101 - RNA, 1266 nt, Artificial Sequence
  BAG4__Homo_sapiens__NP_001191807
augagcgcccugagaagaagcggcuacggccccagcgacggccccagcuacggcagauacuacggccccggcggcggcgacgugcccgugcaccccccccccccccuguacccccugagacccgagcccccccagccccccaucagcuggagagugagaggcggcggccccgccgagaccaccuggcugggcgagggcggcggcggcgacggcuacuaccccagcggcggcgccuggcccgagcccggcagagccggcggcagccaccagagccugaacagcuacaccaacggcgccuacggccccaccuacccccccggccccggcgccaacaccgccagcuacagcggcgccuacuacgcccccggcuacacccagaccagcuacagcaccgaggugcccagcaccuacagaagcagcggcaacagccccacccccgugagcagauggaucuacccccagcaggacugccagaccgaggcccccccccugagaggccaggugcccggcuacccccccagccagaaccccggcaugacccugccccacuaccccuacggcgacggcaacagaagcgugccccagagcggccccaccgugagaccccaggaggacgccugggccagccccggcgccuacggcaugggcggcagauaccccuggcccagcagcgcccccagcgccccccccggcaaccuguacaugaccgagagcaccagccccuggcccagcagcggcagcccccagagcccccccagcccccccgugcagcagcccaaggacagcagcuaccccuacagccagagcgaccagagcaugaacagacacaacuuccccugcagcgugcaccaguacgagagcagcggcaccgugaacaacgacgacagcgaccugcuggacagccaggugcaguacagcgccgagccccagcuguacggcaacgccaccagcgaccaccccaacaaccaggaccagagcagcagccugcccgaggagugcgugcccagcgacgagagcaccccccccagcaucaagaagaucauccacgugcuggagaaggugcaguaccuggagcaggagguggaggaguucgugggcaagaagaccgacaaggccuacuggcugcuggaggagaugcugaccaaggagcugcuggagcuggacagcguggagaccggcggccaggacagcgugagacaggccagaaaggaggccgugugcaagauccaggccauccuggagaagcuggagaagaagggccuguaa

SEQ ID NO: 14102 - RNA, 1467 nt, Artificial Sequence
  BAG5__Homo_sapiens__NP_001015049
augagauuccacuggcugcccacccugagcgagcccuucgacagaaaccaggagcuggagaccugcaucagaccccuguggacccccagcggcagcgccugcgagaccgagcacaacaagagcauggacaugggcaaccagcaccccagcaucagcagacugcaggagauccagaaggaggugaagagcguggagcagcaggugaucggcuucagcggccugagcgacgacaagaacuacaagaagcuggagagaauccugaccaagcagcuguucgagaucgacagcguggacaccgagggcaagggcgacauccagcaggccagaaagagagccgcccaggagaccgagagacugcugaaggagcuggagcagaacgccaaccacccccacagaaucgagauccagaacaucuucgaggaggcccagagccuggugagagagaagaucgugcccuucuacaacggcggcaacugcgugaccgacgaguucgaggagggcauccaggacaucauccugagacugacccacgugaagaccggcggcaagaucagccugagaaaggccagauaccacacccugaccaagaucugcgccgugcaggagaucaucgaggacugcaugaagaagcagcccagccugccccugagcgaggacgcccaccccagcguggccaagaucaacuucgugaugugcgaggugaacaaggccagaggcgugcugaucgcccugcugaugggcgugaacaacaacgagaccugcagacaccugagcugcgugcugagcggccugaucgccgaccuggacgcccuggacgugugcggcagaaccgagaucagaaacuacagaagagaggugguggaggacaucaacaagcugcugaaguaccuggaccuggaggaggaggccgacaccaccaaggccuucgaccugagacagaaccacagcauccugaagaucgagaaggugcugaagagaaugagagagaucaagaacgagcugcugcaggcccagaaccccagcgagcuguaccugagcagcaagaccgagcugcagggccugaucggccagcuggacgaggugagccuggagaagaaccccugcaucagagaggccagaagaagagccgugaucgaggugcagacccugaucaccuacaucgaccugaaggaggcccuggagaagagaaagcuguucgccugcgaggagcaccccagccacaaggccguguggaacgugcugggcaaccugagcgagauccagggcgaggugcugagcuucgacggcaacagaaccgacaagaacuacaucagacuggaggagcugcugaccaagcagcugcuggcccuggacgccguggacccccagggcgaggagaagugcaaggccgccagaaagcaggccgugagacuggcccagaacauccugagcuaccuggaccugaagagcgacgagugggaguacuaa

SEQ ID NO: 14103 - RNA, 2712 nt, Artificial Sequence
  BAG6__Homo_sapiens__NP_001186626
auggagcccaacgacagcaccagcaccgccguggaggagcccgacagccuggaggugcuggugaagacccuggacagccagaccagaaccuucaucgugggcgcccagaugaacgugaaggaguucaaggagcacaucgccgccagcgugagcauccccagcgagaagcagagacugaucuaccagggcagagugcugcaggacgacaagaagcugcaggaguacaacgugggcggcaaggugauccaccugguggagagagcccccccccagacccaccugcccagcggcgccagcagcggcaccggcagcgccagcgccacccacggcggcggcagcccccccggcaccagaggccccggcgccagcgugcacgacagaaacgccaacagcuacgugauggugggcaccuucaaccugcccagcgacggcagcgccguggacgugcacaucaacauggagcaggcccccauccagagcgagcccagagugagacuggugauggcccagcacaugaucagagacauccagacccugcugagcagaauggagugcagaggcggcccccagccccagcacagccagccccccccccagccccccgccgugacccccgagcccguggcccugagcagccagaccagcgagcccguggagagcgaggccccccccagagagcccauggaggccgaggagguggaggagagagcccccgcccagaaccccgagcugacccccggccccgcccccgccggccccacccccgcccccgagaccaacgcccccaaccaccccagccccgccgaguacguggaggugcugcaggagcugcagagacuggagagcagacugcagcccuuccugcagagauacuacgaggugcugggcgccgccgccaccaccgacuacaacaacaaccacgagggcagagaggaggaccagagacugaucaaccuggugggcgagagccugagacugcugggcaacaccuucguggcccugagcgaccugagaugcaaccuggccugcaccccccccagacaccugcacguggugagacccaugagccacuacaccacccccauggugcugcagcaggccgccauccccauccagaucaacgugggcaccaccgugaccaugaccggcaacggcaccagacccccccccacccccaacgccgaggcccccccccccggccccggccaggccagcagcguggcccccagcagcaccaacguggagagcagcgccgagggcgcccccccccccggccccgcccccccccccgccaccagccaccccagagugaucagaaucagccaccagagcguggagcccguggugaugaugcacaugaacauccaggacagcggcacccagcccggcggcgugcccagcgcccccaccggcccccugggcccccccggccacggccagacccugggccagcaggugcccggcuuccccaccgcccccaccagaguggugaucgccagacccacccccccccaggccagacccagccaccccggcggcccccccgugagcggcacccugggcgccggccugggcaccaacgccagccuggcccagauggugagcggccuggugggccagcugcugaugcagcccgugcugguggcccagggcacccccggcagccccggcggccugggccuggagagccugagccccgaguucuucaccagcguggugcagggcgugcugagcagccugcugggcagccugggcgccagagccggcagcagcgagagcaucgccgccuucauccagagacugagcggcagcagcaacaucuucgagcccggcgccgacggcgcccugggcuucuucggcgcccugcugagccugcugugccagaacuucagcaugguggacguggugaugcugcugcacggccacuuccagccccugcagagacugcagccccagcugagaagcuucuuccaccagcacuaccugggcggccaggagcccacccccagcaacaucagaauggccacccacacccugaucaccggccuggaggaguacgugagagagagcuucagccuggugcaggugcagcccggcguggacaucaucagaaccaaccuggaguuccugcaggagcaguucaacagcaucgccgcccacgugcugcacugcaccgacagcggcuucggcgccagacugcuggagcugugcaaccagggccuguucgagugccuggcccugaaccugcacugccugggcggccagcagauggagcuggccgccgugaucaacggcagaaucagaagaaugagcagaggcgugaaccccagccuggugagcuggcugaccaccaugaugggccugagacugcagguggugcuggagcacaugcccgugggccccgacgccauccugagauacgugagaagagugggcgaccccccccagccccugcccgaggagcccauggaggugcagggcgccgagagagccagccccgagccccaggagugggugcccaucauccagcaggacauccagagccagagaaaggugaagccccagcccccccugagcgacgccuaccugagcggcaugcccgccaagagaagaaagcugagaagcgacauccagaagagacugcaggaggaccccaacuacagcccccagagauuccccaacgcccagagagccuucgccgacgaccccuaa

SEQ ID NO: 14104 - RNA, 1536 nt, Artificial Sequence
  BAIAP2L1__Homo_sapiens__NP_061330
augagcagaggccccgaggaggugaacagacugaccgagagcaccuacagaaacgugauggagcaguucaaccccggccugagaaaccugaucaaccugggcaagaacuacgagaaggccgugaacgccaugauccuggccggcaaggccuacuacgacggcguggccaagaucggcgagaucgccaccggcagccccgugagcaccgagcugggccacgugcugaucgagaucagcagcacccacaagaagcugaacgagagccuggacgagaacuucaagaaguuccacaaggagaucauccacgagcuggagaagaagaucgagcuggacgugaaguacaugaacgccacccugaagagauaccagaccgagcacaagaacaagcuggagagccuggagaagagccaggccgagcugaagaagaucagaagaaagagccagggcagcagaaacgcccugaaguacgagcacaaggagaucgaguacguggagaccgugaccagcagacagagcgagauccagaaguucaucgccgacggcugcaaggaggcccugcuggaggagaagagaagauucugcuuccugguggacaagcacugcggcuucgccaaccacauccacuacuaccaccugcagagcgccgagcugcugaacagcaagcugcccagauggcaggagaccugcguggacgccaucaaggugcccgagaagaucaugaacaugaucgaggagaucaagacccccgccagcacccccgugagcggcaccccccaggccagccccaugaucgagagaagcaacguggugagaaaggacuacgacacccugagcaagugcagccccaagaugccccccgcccccagcggcagagccuacaccagcccccugaucgacauguucaacaaccccgccaccgccgcccccaacagccagagagugaacaacagcaccggcaccagcgaggaccccagccugcagagaagcgugagcguggccaccggccugaacaugaugaagaagcagaaggugaagaccaucuucccccacaccgccggcagcaacaagacccugcugagcuucgcccagggcgacgugaucacccugcugauccccgaggagaaggacggcuggcuguacggcgagcacgacgugagcaaggccagaggcugguuccccagcagcuacaccaagcugcuggaggagaacgagaccgaggccgugaccgugcccacccccagccccacccccgugagaagcaucagcaccgugaaccugagcgagaacagcagcguggugauccccccccccgacuaccuggagugccugagcaugggcgccgccgccgacagaagagccgacagcgccagaaccaccagcaccuucaaggcccccgccagcaagcccgagaccgccgcccccaacgacgccaacggcaccgccaagccccccuuccugagcggcgagaaccccuucgccaccgugaagcugagacccaccgugaccaacgacagaagcgcccccaucaucagauaa

SEQ ID NO: 14105 - RNA, 3351 nt, Artificial Sequence
  BAIAP3__Homo_sapiens__NP_001186025
augagcacccugcuggacaucaagagcagcgugcugagacaggugcaggugugccccagcuucagaagaagaaccgagcaggaccccggcagcgccagcgccgacccccaggagcccgccaccggcgccuggaagcccggcgacggcguggaguucuucgcccacaugagacugaugcugaagaagggcgagggcagacagggccugcccugccuggaggugccccugagaagcggcagccccgccccccccgagcccguggaccccagccugggccugagagcccuggcccccgaggagguggagaugcuguacgaggaggcccuguacaccgugcuguacagagccggcaccaugggccccgaccagguggacgacgaggaggcccugcugagcuaccugcagcagguguucggcaccagccuggaggagcacaccgaggccaucgagagagugagaaaggccaaggcccccaccuacgcccugaaggugagcgugaugagagccaagaaccugcuggccaaggaccccaacggcuucagcgaccccuacugcaugcugggcauccugcccgccagcgacgccaccagagagcccagagcccagaaggagcagagauucggcuucagaaagggcagcaagagaggcggcccccugcccgccaagugcauccaggugaccgaggugaagagcagcacccugaaccccguguggaaggagcacuuccuguucgagaucgaggacgugagcaccgaccagcugcaccuggacaucugggaccacgacgacgacgugagccugguggaggccugcagaaagcugaacgaggugaucggccugaagggcaugggcagauacuucaagcagaucgugaagagcgccagagccaacggcaccgccggccccaccgaggaccacaccgacgacuuccugggcugccugaacauccccgugagaagagacaccgccaugagccagagaggcagaagcggcuuccugagccaccugcugcugcugagccaccugcugagacuggagcacagcgccgaggagcccaacagcagcagcuggagaggcgagcugagcacccccgccgccaccauccugugccugcacggcgcccagagcaaccugagcccccugcagcuggccgugcugcacuggcaggugagcagcagacaccaccagaccugcacccuggacuacagcuaccugcugggccugcuggaggacaugcaggcccacugggaggaggcccccagccugccccaggagcaggaggagagccuggccgacagccugagcgccuucagcgaguucggccugcagcugcugagacagcugagagacuacuuccccgccaccaacagcaccgccgugcacagacuggagcugcugcugaagugccugggcaagcugcagcuguuccagcccagcuucgagaucugccccuucgagagcgagcugaacauggacaucgccgccgcccugaagagaggcaacagagagugguacgacagaauccugaacgacaagagccccagagagcagcccggcccccagagacugcccggccugguggugcuggccgacgccguguacgacgaccugcaguucugcuacagcguguacgccagccuguuccacagcauccugaacguggacguguucacccugaccuucagacagcuggagagacugguggccgaggaggccugggugcugaccgaggagcugagccccaagaugacccuggagguggccagcggccuguucgagcuguaccugacccuggccgaccugcagagauucugggacagcauccccggcagagacagcagaagccuggcccuggccggcauccacgcccccuuccugcccgccgugaagcugugguuccaggugcugagagaccaggccaaguggagacugcagggcgccguggacauggacacccuggagcccguggacgccagcagcagacacagcagcagcgccgccaccgccggccugugccugagccacauccaggagcugugggugagacuggccuggcccgaccccgcccaggcccagggccugggcacccagcugggccaggacgugugcgaggccacccuguucuacaccgagcugcugagaaagaagguggacacccagcccggcgccgccggcgaggccgugagcgaggcccugugcguggugcugaacaacguggagcuggugagaaaggccgccggccaggcccugaagggccuggccuggcccgagggcgccaccggccccgagggcgugcugcccagaccccugcugagcugcacccaggcccuggacgacgaccugcagagagaggcccacaccgugaccgcccaccugaccagcaagauggugggcgacaucagaaaguacgugcagcacaucagccugagccccgacagcauccagaacgacgaggccguggccccccugaugaaguaccuggacgagaagcuggcccugcugaacgccagccuggugaagggcaaccugagcagagugcuggaggcccugugggagcugcugcugcaggccauccugcaggcccugggcgccaacagagacgugagcgccgacuucuacagcagauuccacuucacccuggaggcccuggugagcuucuuccacgccgagggccagggccugccccuggagagccugagagacggcagcuacaagagacugaaggaggagcugagacugcacaagugcagcaccagagagugcaucgagcaguucuaccuggacaagcugaagcagagaacccuggagcagaacagauucggcagacugagcgugagaugccacuacgaggccgccgagcagagacuggccguggaggugcugcacgccgccgaccugcugccccuggacgccaacggccugagcgaccccuucgugaucguggagcugggccccccccaccuguucccccuggugagaagccagagaacccaggugaagaccagaacccugcaccccguguacgacgagcuguucuacuucagcgugcccgccgaggccugcagaagaagagccgccugcgugcuguucaccgugauggaccacgacuggcugagcaccaacgacuucgccggcgaggccgcccugggccugggcggcgugaccggcguggccagaccccaggugggcggcggcgccagagccggccagcccgugacccugcaccugugcagacccagagcccaggugagaagcgcccugagaagacuggagggcagaaccagcaaggaggcccaggaguucgugaagaagcugaaggagcuggagaagugcauggaggccgaccccuaa

SEQ ID NO: 14106 - RNA, 636 nt, Artificial Sequence
  BAK1__Homo_sapiens__NP_001179
auggccagcggccagggccccggcccccccagacaggagugcggcgagcccgcccugcccagcgccagcgaggagcagguggcccaggacaccgaggagguguucagaagcuacguguucuacagacaccagcaggagcaggaggccgagggcguggccgcccccgccgaccccgagauggugacccugccccugcagcccagcagcaccaugggccaggugggcagacagcuggccaucaucggcgacgacaucaacagaagauacgacagcgaguuccagaccaugcugcagcaccugcagcccaccgccgagaacgccuacgaguacuucaccaagaucgccaccagccuguucgagagcggcaucaacuggggcagagugguggcccugcugggcuucggcuacagacuggcccugcacguguaccagcacggccugaccggcuuccugggccaggugaccagauucgugguggacuucaugcugcaccacugcaucgccagauggaucgcccagagaggcggcuggguggccgcccugaaccugggcaacggccccauccugaacgugcugguggugcugggcguggugcugcugggccaguucguggugagaagauucuucaagagcuaa

SEQ ID NO: 14107 - RNA, 783 nt, Artificial Sequence
  BAMBI__Homo_sapiens__NP_036474
auggacagacacagcagcuacaucuucaucuggcugcagcuggagcugugcgccauggccgugcugcugaccaagggcgagaucagaugcuacugcgacgccgcccacugcguggccaccggcuacaugugcaagagcgagcugagcgccugcuucagcagacugcuggacccccagaacagcaacagcccccugacccacggcugccuggacagccuggccagcaccaccgacaucugccaggccaagcaggccagaaaccacagcggcaccaccauccccacccuggagugcugccacgaggacaugugcaacuacagaggccugcacgacgugcugagcccccccagaggcgaggccagcggccagggcaacagauaccagcacgacggcagcagaaaccugaucaccaaggugcaggagcugaccagcagcaaggagcugugguucagagccgccgugaucgccgugcccaucgccggcggccugauccuggugcugcugaucaugcuggcccugagaaugcugagaagcgagaacaagagacugcaggaccagagacagcagaugcugagcagacugcacuacagcuuccacggccaccacagcaagaagggccagguggccaagcuggaccuggagugcauggugcccgugagcggccacgagaacugcugccugaccugcgacaagaugagacaggccgaccugagcaacgacaagauccugagccuggugcacuggggcauguacagcggccacggcaagcuggaguucguguaa

SEQ ID NO: 14108 - RNA, 270 nt, Artificial Sequence
  BANF1__Homo_sapiens__NP_001137457
augaccaccagccagaagcacagagacuucguggccgagcccaugggcgagaagcccgugggcagccuggccggcaucggcgaggugcugggcaagaagcuggaggagagaggcuucgacaaggccuacguggugcugggccaguuccuggugcugaagaaggacgaggaccuguucagagaguggcugaaggacaccugcggcgccaacgccaagcagagcagagacugcuucggcugccugagagaguggugcgacgccuuccuguaa

SEQ ID NO: 14109 - RNA, 2268 nt, Artificial Sequence
  BANK1__Homo_sapiens__NP_001077376
augaucuacgaggaggacgccgaggagugggcccuguaccugaccgagguguuccugcacguggugaagagagaggccauccugcuguacagacuggagaacuucagcuucagacaccuggagcugcugaaccugaccagcuacaagugcaagcugcugauccugagcaacagccugcugagagaccugacccccaagaagugccaguuccuggagaagauccugcacagccccaagagcguggugacccugcugugcggcgugaagagcagcgaccagcuguacgagcugcugaacaucagccagagcagaugggagaucagcaccgagcaggagcccgaggacuacaucagcgugauccagagcaucaucuucaaggacagcgaggacuacuucgaggugaacauccccaccgaccugagagccaagcacagcggcgagaucagcgagagaaaggagaucgaggagcugagcgaggccagcagaaacaccaucccccuggccguggugcugcccaccgagauccccugcgagaaccccggcgagaucuucaucauccugagagacgaggugaucggcgacaccguggagguggaguucaccagcagcaacaagagaaucagaaccagacccgcccuguggaacaagaagguguggugcaugaaggcccuggaguuccccgccggcagcgugcacgugaacguguacugcgacggcaucgugaaggccaccaccaagaucaaguacuaccccaccgccaaggccaaggagugccuguucagaauggccgacagcggcgagagccugugccagaacagcaucgaggagcuggacggcgugcugaccagcaucuucaagcacgagauccccuacuacgaguuccagagccugcagaccgagaucugcagccagaacaaguacacccacuucaaggagcugcccacccugcugcacugcgccgccaaguucggccugaagaaccuggccauccaccugcugcagugcagcggcgccaccugggccagcaagaugaagaacauggagggcagcgaccccgcccacaucgccgagagacacggccacaaggagcugaagaagaucuucgaggacuucagcauccaggagaucgacaucaacaacgagcaggagaacgacuacgaggaggacaucgccagcuucagcaccuacauccccagcacccagaaccccgccuuccaccacgagagcagaaagaccuacggccagagcgccgacggcgccgaggccaacgagauggagggcgagggcaagcagaacggcagcggcauggagaccaagcacagcccccuggaggugggcagcgagagcagcgaggaccaguacgacgaccuguacguguucauccccggcgccgaccccgagaacaacagccaggagccccugaugagcagcagacccccccugcccccccccagacccguggccaacgccuuccagcuggagagaccccacuucacccugcccggcaccaugguggagggccagauggagagaagccagaacuggggccaccccggcgugagacaggagaccggcgacgagcccaagggcgagaaggagaagaaggaggaggagaaggagcaggaggaggaggaggaccccuacaccuucgccgagaucgacgacagcgaguacgacaugauccuggccaaccugagcaucaagaagaagaccggcagcagaagcuucaucaucaacagaccccccgcccccacccccagacccaccagcaucccccccaaggaggagaccacccccuacaucgcccagguguuccagcagaagaccgccagaagacagagcgacgacgacaaguucagaggccugcccaagaagcaggacagagccagaaucgagagccccgccuucagcacccugagaggcugccugaccgacggccaggaggagcugauccugcugcaggagaaggugaagaacggcaagaugagcauggacgaggcccuggagaaguucaagcacuggcagaugggcaagagcggccuggagaugauccagcaggagaagcugagacagcugagagacugcaucaucggcaagagacccgaggaggagaacguguacaacaagcugaccaucgugcaccaccccggcggcaaggagaccgcccacaacgagaacaaguucuacaacgugcacuucagcaacaagcugcccgccagaccccagguggagaaggaguucggcuucugcugcaagaaggaccacuaa

SEQ ID NO: 14110 - RNA, 1518 nt, Artificial Sequence
  BANP__Homo_sapiens__NP_001167010
augaugagcgagcacgaccuggccgacguggugcagaucgccguggaggaccugagccccgaccaccccguggugcuggagaaccacguggugaccgacgaggacgagcccgcccugaagagacagagacuggagaucaacugccaggaccccagcaucaagagcuuccuguacagcaucaaccagaccaucugccugagacuggacagcaucgaggccaagcugcaggcccuggaggccaccugcaagagccuggaggagaagcuggaccuggugaccaacaagcagcacagccccauccaggugcccaugguggccggcagcccccugggcgccacccagaccugcaacaaggugagaugcguggugccccagaccaccgugauccugaacaacgacagacagaacgccaucguggccaagauggaggacccccugagcaacagagcccccgacagccuggagaacgugaucagcaacgccgugcccggcagaagacagaacaccaucguggugaaggugcccggccaggaggacagccaccacgaggacggcgagagcggcagcgaggccagcgacagcgugagcagcugcggccaggccggcagccagagcaucggcagcaacgugacccugaucacccugaacagcgaggaggacuaccccaacggcaccuggcugggcgacgagaacaaccccgagaugagagugagaugcgccaucauccccagcgacaugcugcacaucagcaccaacugcagaaccgccgagaagauggcccugacccugcuggacuaccuguuccacagagaggugcaggccgugagcaaccugagcggccagggcaagcacggcaagaagcagcuggacccccugaccaucuacggcaucagaugccaccuguucuacaaguucggcaucaccgagagcgacugguacagaaucaagcagagcaucgacagcaagugcagaaccgccuggagaagaaagcagagaggccagagccuggccgugaagagcuucagcagaagaacccccaacagcagcagcuacugccccagcgagcccaugaugagcacccccccccccgccagcgagcugccccagccccagccccagccccaggcccugcacuacgcccuggccaacgcccagcaggugcagauccaccagaucggcgaggacggccaggugcaggugggccaccugcacaucgcccaggugccccagggcgagcaggugcagaucacccaggacagcgagggcaaccugcagauccaccacgugggccaggacggccaggugcugcagggcgcccagcugaucgccguggccagcagcgaccccgccgccgccggcguggacggcagcccccugcagggcagcgacauccaggugcaguacgugcagcuggcccccgugagcgaccacaccgccggcgcccagaccgccgaggcccugcagcccacccugcagcccgagaugcagcuggagcacggcgccauccagauccaguaa

SEQ ID NO: 14111 - RNA, 2190 nt, Artificial Sequence
  BAP1__Homo_sapiens__NP_004647
augaacaagggcuggcuggagcuggagagcgaccccggccuguucacccugcugguggaggacuucggcgugaagggcgugcagguggaggagaucuacgaccugcagagcaagugccagggccccguguacggcuucaucuuccuguucaaguggaucgaggagagaagaagcagaagaaaggugagcacccugguggacgacaccagcgugaucgacgacgacaucgugaacaacauguucuucgcccaccagcugauccccaacagcugcgccacccacgcccugcugagcgugcugcugaacugcagcagcguggaccugggccccacccugagcagaaugaaggacuucaccaagggcuucagccccgagagcaagggcuacgccaucggcaacgcccccgagcuggccaaggcccacaacagccacgccagacccgagcccagacaccugcccgagaagcagaacggccugagcgccgugagaaccauggaggccuuccacuucgugagcuacgugcccaucaccggcagacuguucgagcuggacggccugaagguguaccccaucgaccacggccccuggggcgaggacgaggaguggaccgacaaggccagaagagugaucauggagagaaucggccuggccaccgccggcgagcccuaccacgacaucagauucaaccugauggccguggugcccgacagaagaaucaaguacgaggccagacugcacgugcugaaggugaacagacagaccgugcuggaggcccugcagcagcugaucagagugacccagcccgagcugauccagacccacaagagccaggagagccagcugcccgaggagagcaagagcgccagcaacaagagcccccuggugcuggaggccaacagagcccccgccgccagcgagggcaaccacaccgacggcgccgaggaggccgccggcagcugcgcccaggcccccagccacagcccccccaacaagcccaagcugguggugaagccccccggcagcagccugaacggcgugcaccccaaccccacccccaucgugcagagacugcccgccuuccuggacaaccacaacuacgccaagagccccaugcaggaggaggaggaccuggccgccggcgugggcagaagcagagugcccgugagacccccccagcaguacagcgacgacgaggacgacuacgaggacgacgaggaggacgacgugcagaacaccaacagcgcccugagauacaagggcaagggcaccggcaagcccggcgcccugagcggcagcgccgacggccagcugagcgugcugcagcccaacaccaucaacgugcuggccgagaagcugaaggagagccagaaggaccugagcaucccccugagcaucaagaccagcagcggcgccggcagccccgccguggccgugcccacccacagccagcccagccccacccccagcaacgagagcaccgacaccgccagcgagaucggcagcgccuucaacagcccccugagaagccccaucagaagcgccaaccccaccagacccagcagccccgugaccagccacaucagcaaggugcuguucggcgaggacgacagccugcugagaguggacugcaucagauacaacagagccgugagagaccugggccccgugaucagcaccggccugcugcaccuggccgaggacggcgugcugagcccccuggcccugaccgagggcggcaagggcagcagccccagcaucagacccauccagggcagccagggcagcagcagccccguggagaaggaggugguggaggccaccgacagcagagagaagaccggcauggugagacccggcgagccccugagcggcgagaaguacagccccaaggagcugcuggcccugcugaagugcguggaggccgagaucgccaacuacgaggccugccugaaggaggagguggagaagagaaagaaguucaagaucgacgaccagagaagaacccacaacuacgacgaguucaucugcaccuucaucagcaugcuggcccaggagggcaugcuggccaaccugguggagcagaacaucagcgugagaagaagacagggcgugagcaucggcagacugcacaagcagagaaagcccgacagaagaaagagaagcagacccuacaaggccaagagacaguaa

SEQ ID NO: 14112 - RNA, 2334 nt, Artificial Sequence
  BARD1__Homo_sapiens__NP_000456
augcccgacaacagacagcccagaaacagacagcccagaaucagaagcggcaacgagcccagaagcgcccccgccauggagcccgacggcagaggcgccugggcccacagcagagccgcccuggacagacuggagaagcugcugagaugcagcagaugcaccaacauccugagagagcccgugugccugggcggcugcgagcacaucuucugcagcaacugcgugagcgacugcaucggcaccggcugccccgugugcuacacccccgccuggauccaggaccugaagaucaacagacagcuggacagcaugauccagcugugcagcaagcugagaaaccugcugcacgacaacgagcugagcgaccugaaggaggacaagcccagaaagagccuguucaacgacgccggcaacaagaagaacagcaucaagaugugguucagccccagaagcaagaaggugagauacguggugagcaaggccagcgugcagacccagcccgccaucaagaaggacgccagcgcccagcaggacagcuacgaguucgugagccccagcccccccgccgacgugagcgagagagccaagaaggccagcgccagaagcggcaagaagcagaagaagaagacccuggccgagaucaaccagaaguggaaccuggaggccgagaaggaggacggcgaguucgacagcaaggaggagagcaagcagaagcuggugagcuucugcagccagcccagcgugaucagcagcccccagaucaacggcgagaucgaccugcuggccagcggcagccugaccgagagcgagugcuucggcagccugaccgaggugagccugccccuggccgagcagaucgagagccccgacaccaagagcagaaacgagguggugacccccgagaaggugugcaagaacuaccugaccagcaagaagagccugccccuggagaacaacggcaagagaggccaccacaacagacugagcagccccaucagcaagagaugcagaaccagcauccugagcaccagcggcgacuucgugaagcagaccgugcccagcgagaacaucccccugcccgagugcagcagcccccccagcugcaagagaaaggugggcggcaccagcggcagaaagaacagcaacaugagcgacgaguucaucagccugagccccggcaccccccccagcacccugagcagcagcagcuacagaagagugaugagcagccccagcgccaugaagcugcugcccaacauggccgugaagagaaaccacagaggcgagacccugcugcacaucgccagcaucaagggcgacauccccagcguggaguaccugcugcagaacggcagcgaccccaacgugaaggaccacgccggcuggaccccccugcacgaggccugcaaccacggccaccugaaggugguggagcugcugcugcagcacaaggcccuggugaacaccaccggcuaccagaacgacagcccccugcacgacgccgccaagaacggccacguggacaucgugaagcugcugcugagcuacggcgccagcagaaacgccgugaacaucuucggccugagacccguggacuacaccgacgacgagagcaugaagagccugcugcugcugcccgagaagaacgagagcagcagcgccagccacugcagcgugaugaacaccggccagagaagagacggcccccuggugcugaucggcagcggccugagcagcgagcagcagaagaugcugagcgagcuggccgugauccugaaggccaagaaguacaccgaguucgacagcaccgugacccacgugguggugcccggcgacgccgugcagagcacccugaagugcaugcugggcauccugaacggcugcuggauccugaaguucgagugggugaaggccugccugagaagaaaggugugcgagcaggaggagaaguacgagauccccgagggccccagaagaagcagacugaacagagagcagcugcugcccaagcuguucgacggcugcuacuucuaccuguggggcaccuucaagcaccaccccaaggacaaccugaucaagcuggugaccgccggcggcggccagauccugagcagaaagcccaagcccgacagcgacgugacccagaccaucaacaccguggccuaccacgccagacccgacagcgaccagagauucugcacccaguacaucaucuacgaggaccugugcaacuaccaccccgagagagugagacagggcaagguguggaaggcccccagcagcugguucaucgacugcgugaugagcuucgagcugcugccccuggacagcuaa

SEQ ID NO: 14113 - RNA, 984 nt, Artificial Sequence
  BARHL1__Homo_sapiens__NP_064448
auggagggcagcaacggcuucggcaucgacagcauccugagccacagagccggcagccccgcccugcccaagggcgacccccugcugggcgacugcagaagcccccuggagcugagccccagaagcgagagcagcagcgacugcagcagccccgccagccccggcagagacugccuggagaccggcacccccagacccggcggcgccagcggccccggccuggacagccaccugcagcccggccagcugagcgcccccgcccagagcagaaccgugaccagcagcuuccugaucagagacauccuggccgacugcaagccccuggccgccugcgcccccuacagcagcagcggccagcccgccgcccccgagcccggcggcagacuggccgccaaggccgccgaggacuucagagacaagcuggacaagagcggcagcaacgccagcagcgacagcgaguacaaggugaaggaggagggcgacagagagaucagcagcagcagagacagcccccccgugagacugaagaagcccagaaaggccagaaccgccuucaccgaccaccagcuggcccagcuggagagaagcuucgagagacagaaguaccugagcgugcaggacagaauggagcuggccgccagccugaaccugaccgacacccaggugaagaccugguaccagaacagaagaaccaaguggaagagacagaccgccgugggccuggagcugcuggccgaggccggcaacuacagcgcccugcagagaauguuccccagccccuacuucuacccccagagccuggugagcaaccuggaccccggcgccgcccuguaccuguacagaggccccagcgcccccccccccgcccugcagagaccccuggugcccagaauccugauccacggccugcagggcgccagcgagcccccccccccccugcccccccuggccggcgugcugcccagagccgcccagcccagauaa

SEQ ID NO: 14114 - RNA, 765 nt, Artificial Sequence
  BARX1__Homo_sapiens__NP_067545
augcagagacccggcgagcccggcgccgccagauucggcccccccgagggcugcgccgaccacagaccccacagauacagaagcuucaugaucgaggagauccugaccgagccccccggccccaagggcgccgcccccgccgccgccgccgccgccgccggcgagcugcugaaguucggcgugcaggcccugcuggccgccagacccuuccacagccaccuggccgugcugaaggccgagcaggccgccguguucaaguucccccuggccccccugggcugcagcggccugagcagcgcccugcuggccgccggccccggccugcccggcgccgccggcgccccccaccugccccuggagcugcagcugagaggcaagcuggaggccgccggccccggcgagcccggcaccaaggccaagaagggcagaagaagcagaaccguguucaccgagcugcagcugaugggccuggagaagagauucgagaagcagaaguaccugagcacccccgacagaaucgaccuggccgagagccugggccugagccagcugcaggugaagaccugguaccagaacagaagaaugaaguggaagaagaucgugcugcagggcggcggccuggagagccccaccaagcccaagggcagacccaagaagaacagcauccccaccagcgagcagcugaccgagcaggagagagccaaggacgccgagaagcccgccgaggugcccggcgagcccagcgacagaagcagagaggacuaa

SEQ ID NO: 14115 - RNA, 840 nt, Artificial Sequence
  BARX2__Homo_sapiens__NP_003649
augcacugccacgccgagcugagacugagcagccccggccagcugaaggccgccagaagaagauacaagaccuucaugaucgacgagauccugagcaaggagaccugcgacuacuucgagaagcugagccuguacagcgugugccccagccugguggugagacccaagccccugcacagcugcaccggcagccccagccugagagccuacccccugcugagcgugaucaccagacagcccaccgugaucagccaccuggugcccgccacccccggcaucgcccaggcccugagcugccaccaggugaccgaggccgugagcgccgaggcccccggcggcgaggcccuggccagcagcgagagcgagaccgagcagcccacccccagacagaagaagcccagaagaagcagaaccaucuucaccgagcugcagcugaugggccuggagaagaaguuccagaagcagaaguaccugagcacccccgacagacuggaccuggcccagagccugggccugacccagcugcaggugaagaccugguaccagaacagaagaaugaaguggaagaagauggugcugaagggcggccaggaggcccccaccaagcccaagggcagacccaagaagaacagcauccccaccagcgaggagaucgaggccgaggagaagaugaacagccaggcccagggccaggagcagcuggagcccagccagggccaggaggagcugugcgaggcccaggagcccaaggccagagacgugccccuggagauggccgagccccccgaccccccccaggagcugcccauccccagcagcgagccccccccccugagcuaa

SEQ ID NO: 14116 - RNA, 684 nt, Artificial Sequence
  BASP1__Homo_sapiens__NP_006308
augggcggcaagcugagcaagaagaagaagggcuacaacgugaacgacgagaaggccaaggagaaggacaagaaggccgagggcgccgccaccgaggaggagggcacccccaaggagagcgagccccaggccgccgccgagcccgccgaggccaaggagggcaaggagaagcccgaccaggacgccgagggcaaggccgaggagaaggagggcgagaaggacgccgccgccgccaaggaggaggcccccaaggccgagcccgagaagaccgagggcgccgccgaggccaaggccgagccccccaaggcccccgagcaggagcaggccgcccccggccccgccgccggcggcgaggcccccaaggccgccgaggccgccgccgcccccgccgagagcgccgcccccgccgccggcgaggagcccagcaaggaggagggcgagcccaagaagaccgaggcccccgccgcccccgccgcccaggagaccaagagcgacggcgcccccgccagcgacagcaagcccggcagcagcgaggccgcccccagcagcaaggagacccccgccgccaccgaggcccccagcagcacccccaaggcccagggccccgccgccagcgccgaggagcccaagcccguggaggcccccgccgccaacagcgaccagaccgugaccgugaaggaguaa

SEQ ID NO: 14117 - RNA, 825 nt, Artificial Sequence
  BATF2__Homo_sapiens__NP_612465
augcaccugugcggcggcaacggccugcugacccagaccgaccccaaggagcagcagagacagcugaagaagcagaagaacagagccgccgcccagagaagcagacagaagcacaccgacaaggccgacgcccugcaccagcagcacgagagccuggagaaggacaaccuggcccugagaaaggagauccagagccugcaggccgagcuggccugguggagcagaacccugcacgugcacgagagacugugccccauggacugcgccagcugcagcgcccccggccugcugggcugcugggaccaggccgagggccugcugggccccggcccccagggccagcacggcugcagagagcagcuggagcuguuccagacccccggcagcugcuaccccgcccagccccugagccccggcccccagccccacgacagccccagccugcugcagugcccccugcccagccugagccugggccccgccgugguggccgagccccccgugcagcugagccccagcccccugcuguucgccagccacaccggcagcagccugcagggcagcagcagcaagcugagcgcccugcagcccagccugaccgcccagaccgcccccccccagccccuggagcuggagcaccccaccagaggcaagcugggcagcagccccgacaaccccagcagcgcccugggccuggccagacugcagagcagagagcacaagcccgcccugagcgccgccaccuggcagggccuggugguggaccccagcccccacccccugcuggccuucccccugcugagcagcgcccaggugcacuucuaa

SEQ ID NO: 14118 - RNA, 378 nt, Artificial Sequence
  BATF__Homo_sapiens__NP_006390
augccccacagcagcgacagcagcgacagcagcuucagcagaagccccccccccggcaagcaggacagcagcgacgacgugagaagagugcagagaagagagaagaacagaaucgccgcccagaagagcagacagagacagacccagaaggccgacacccugcaccuggagagcgaggaccuggagaagcagaacgccgcccugagaaaggagaucaagcagcugaccgaggagcugaaguacuucaccagcgugcugaacagccacgagccccugugcagcgugcuggccgccagcacccccagcccccccgaggugguguacagcgcccacgccuuccaccagccccacgugagcagccccagauuccagcccuaa

SEQ ID NO: 14119 - RNA, 666 nt, Artificial Sequence
  BAX__Homo_sapiens__NP_001278357
auggacggcagcggcgagcagcccagaggcggcggccccaccagcagcgagcagaucaugaagaccggcgcccugcugcugcagggcuucauccaggacagagccggcagaaugggcggcgaggcccccgagcuggcccuggaccccgugccccaggacgccagcaccaagaagcugagcgagugccugaagagaaucggcgacgagcuggacagcaacauggagcugcagagaaugaucgccgccguggacaccgacagccccagagagguguucuucagaguggccgccgacauguucagcgacggcaacuucaacuggggcagagugguggcccuguucuacuucgccagcaagcuggugcugaaggcccugugcaccaaggugcccgagcugaucagaaccaucaugggcuggacccuggacuuccugagagagagacugcugggcuggauccaggaccagggcggcuggggccugccccuggccgagagccugaagagacugaugagccugagccccggcagacccccccugcugcugugggacgcccacguggccgacagagaccaccugugcggcggcagcgcccacagacugacccaccaccuggaggaggacggccugagaccccccgccgcccuggacugcguguucccccccuaa

SEQ ID NO: 14120 - RNA, 4671 nt, Artificial Sequence
  BAZ1A__Homo_sapiens__NP_038476
augccccugcugcacagaaagcccuucgugagacagaagccccccgccgaccugagacccgacgaggagguguucuacugcaaggugaccaacgagaucuucagacacuacgacgacuucuucgagagaaccauccugugcaacagccugguguggagcugcgccgugaccggcagacccggccugaccuaccaggaggcccuggagagcgagaagaaggccagacagaaccugcagagcuuccccgagccccugaucauccccgugcuguaccugaccagccugacccacagaagcagacugcacgagaucugcgacgacaucuucgccuacgugaaggacagauacuucguggaggagaccguggaggugaucagaaacaacggcgccagacugcagugcagaauccuggaggugcugccccccagccaccagaacggcuucgccaacggccacgugaacagcguggacggcgagaccaucaucaucagcgacagcgacgacagcgagacccagagcugcagcuuccagaacggcaagaagaaggacgccaucgacccccugcuguucaaguacaaggugcagcccaccaagaaggagcugcacgagagcgccaucgugaaggccacccagaucagcagaagaaagcaccuguucagcagagacaagcugaagcuguuccugaagcagcacugcgagccccaggacggcgugaucaagaucaaggccagcagccugagcaccuacaagaucgccgagcaggacuucagcuacuucuuccccgacgacccccccaccuucaucuucagccccgccaacagaagaagaggcagaccccccaagagaauccacaucagccaggaggacaacguggccaacaagcagacccuggccagcuacagaagcaaggccaccaaggagagagacaagcugcugaagcaggaggagaugaagagccuggccuucgagaaggccaagcugaagagagagaaggccgacgcccuggaggccaagaagaaggagaaggaggacaaggagaagaagagagaggagcugaagaagaucguggaggaggagagacugaagaagaaggaggagaaggagagacugaagguggagagagagaaggagagagagaagcugagagaggagaagagaaaguacguggaguaccugaagcaguggagcaagcccagagaggacauggagugcgacgaccugaaggagcugcccgagcccacccccgugaagaccagacugccccccgagaucuucggcgacgcccugauggugcuggaguuccugaacgccuucggcgagcuguucgaccugcaggacgaguuccccgacggcgugacccuggaggugcuggaggaggcccuggugggcaacgacagcgagggcccccugugcgagcugcuguucuucuuccugaccgccaucuuccaggccaucgccgaggaggaggaggagguggccaaggagcagcugaccgacgccgacaccaaggaccugaccgaggcccuggacgaggacgccgaccccaccaagagcgcccugagcgccguggccagccuggccgccgccuggccccagcugcaccagggcugcagccugaagagccuggaccuggacagcugcacccugagcgagauccugagacugcacauccuggccagcggcgccgacgugaccagcgccaacgccaaguacagauaccagaagagaggcggcuucgacgccaccgacgacgccugcauggagcugagacugagcaaccccagccuggugaagaagcugagcagcaccagcguguacgaccugacccccggcgagaagaugaagauccugcacgcccugugcggcaagcugcugacccuggugagcaccagagacuucaucgaggacuacguggacauccugagacaggccaagcaggaguucagagagcugaaggccgagcagcacagaaaggagagagaggaggccgccgccagaaucagaaagagaaaggaggagaagcugaaggagcaggagcagaagaugaaggagaagcaggagaagcugaaggaggacgagcagagaaacagcaccgccgacaucagcaucggcgaggaggagagagaggacuucgacaccagcaucgagagcaaggacaccgagcagaaggagcuggaccaggacauggugaccgaggacgaggacgaccccggcagccacaagagaggcagaagaggcaagagaggccagaacggcuucaaggaguucaccagacaggagcagaucaacugcgugaccagagagccccugaccgccgacgaggaggaggcccugaagcaggagcaccagagaaaggagaaggagcugcuggagaagauccagagcgccaucgccugcaccaacaucuucccccugggcagagacagaauguacagaagauacuggaucuuccccagcauccccggccuguucaucgaggaggacuacagcggccugaccgaggacaugcugcugcccagacccagcagcuuccagaacaacgugcagagccaggacccccaggugagcaccaagaccggcgagccccugaugagcgagagcaccagcaacaucgaccagggccccagagaccacagcgugcagcugcccaagcccgugcacaagcccaacagauggugcuucuacagcagcugcgagcagcuggaccagcugaucgaggcccugaacagcagaggccacagagagagcgcccugaaggagacccugcugcaggagaagagcagaaucugcgcccagcuggccagauucagcgaggagaaguuccacuucagcgacaagccccagcccgacagcaagcccaccuacagcagaggcagaagcagcaacgccuacgaccccagccagaugugcgccgagaagcagcuggagcugagacugagagacuuccugcuggacaucgaggacagaaucuaccagggcacccugggcgccaucaaggugaccgacagacacaucuggagaagcgcccuggagagcggcagauacgagcugcugagcgaggagaacaaggagaacggcaucaucaagaccgugaacgaggacguggaggagauggagaucgacgagcagaccaaggugaucgugaaggacagacugcugggcaucaagaccgagacccccagcaccgugagcaccaacgccagcaccccccagagcgugagcagcguggugcacuaccuggccauggcccuguuccagaucgagcagggcaucgagagaagauuccugaaggccccccuggacgccagcgacagcggcagaagcuacaagaccgugcuggacagauggagagagagccugcugagcagcgccagccugagccagguguuccugcaccugagcacccuggacagaagcgugaucuggagcaagagcauccugaacgccagaugcaagaucugcagaaagaagggcgacgccgagaacauggugcugugcgacggcugcgacagaggccaccacaccuacugcgugagacccaagcugaagaccgugcccgagggcgacugguucugccccgagugcagacccaagcagagaagcagaagacugagcagcagacagagacccagccuggagagcgacgaggacguggaggacagcaugggcggcgaggacgacgagguggacggcgacgaggaggagggccagagcgaggaggaggaguacgagguggagcaggacgaggacgacagccaggaggaggaggaggugagccugcccaagagaggcagaccccaggugagacugcccgugaagaccagaggcaagcugagcagcagcuucagcagcagaggccagcagcaggagcccggcagauaccccagcagaagccagcagagcacccccaagaccaccgugagcagcaagaccggcagaagccugagaaagaucaacagcgccccccccaccgagaccaagagccugagaaucgccagcagaagcaccagacacagccacggcccccugcaggccgacguguucguggagcugcugagccccagaagaaagagaagaggcagaaagagcgccaacaacacccccgagaacagccccaacuuccccaacuucagagugaucgccaccaagagcagcgagcagagcagaagcgugaacaucgccagcaagcugagccugcaggagagcgagagcaagagaagaugcagaaagagacagagccccgagcccagccccgugacccugggcagaagaagcagcggcagacagggcggcgugcacgagcugagcgccuucgagcagcuggugguggagcuggugagacacgacgacagcuggcccuuccugaagcuggugagcaagauccaggugcccgacuacuacgacaucaucaagaagcccaucgcccugaacaucaucagagagaaggugaacaagugcgaguacaagcuggccagcgaguucaucgacgacaucgagcugauguucagcaacugcuucgaguacaaccccagaaacaccagcgaggccaaggccggcaccagacugcaggccuucuuccacauccaggcccagaagcugggccugcacgugacccccagcaacguggaccaggugagcaccccccccgccgccaagaagagcagaaucuaa

SEQ ID NO: 14121 - RNA, 4452 nt, Artificial Sequence
  BAZ1B__Homo_sapiens__NP_115784
auggccccccugcugggcagaaagcccuucccccuggugaagccccugcccggcgaggagccccuguucaccaucccccacacccaggaggccuucagaaccagagaggaguacgaggccagacuggagagauacagcgagagaaucuggaccugcaagagcaccggcagcagccagcugacccacaaggaggccugggaggaggagcaggagguggccgagcugcugaaggaggaguuccccgccugguacgagaagcuggugcuggagauggugcaccacaacaccgccagccuggagaagcugguggacaccgccuggcuggagaucaugaccaaguacgccgugggcgaggagugcgacuucgaggugggcaaggagaagaugcugaaggugaagaucgugaagauccacccccuggagaagguggacgaggaggccaccgagaagaagagcgacggcgccugcgacagccccagcagcgacaaggagaacagcagccagaucgcccaggaccaccagaagaaggagaccguggugaaggaggacgagggcagaagagagagcaucaacgacagagccagaagaagccccagaaagcugcccaccagccugaagaagggcgagagaaagugggccccccccaaguuccugccccacaaguacgacgugaagcugcagaacgaggacaagaucaucagcaacgugcccgccgacagccugaucagaaccgagagaccccccaacaaggagaucgugagauacuucaucagacacaacgcccugagagccggcaccggcgagaacgcccccugggugguggaggacgagcuggugaagaaguacagccugcccagcaaguucagcgacuuccugcuggaccccuacaaguacaugacccugaaccccagcaccaagagaaagaacaccggcagccccgacagaaagcccagcaagaagagcaagaccgacaacagcagccugagcagcccccugaaccccaagcuguggugccacgugcaccugaagaagagccugagcggcagcccccugaaggugaagaacagcaagaacagcaagagccccgaggagcaccuggaggagaugaugaagaugaugagccccaacaagcugcacaccaacuuccacauccccaagaagggcccccccgccaagaagcccggcaagcacagcgacaagccccugaaggccaagggcagaagcaagggcauccugaacggccagaagagcaccggcaacagcaagagccccaagaagggccugaagacccccaagaccaagaugaagcagaugacccugcuggacauggccaagggcacccagaagaugaccagagcccccagaaacagcggcggcacccccagaaccagcagcaagccccacaagcaccugccccccgccgcccugcaccugaucgccuacuacaaggagaacaaggacagagaggacaagagaagcgcccugagcugcgugaucagcaagaccgccagacugcugagcagcgaggacagagccagacugcccgaggagcugagaagccuggugcagaagagauacgagcugcuggagcacaagaagagaugggccagcaugagcgaggagcagagaaaggaguaccugaagaagaagagagaggagcugaagaagaagcugaaggagaaggccaaggagagaagagagaaggagaugcuggagagacuggagaagcagaagagauacgaggaccaggagcugaccggcaagaaccugcccgccuucagacugguggacacccccgagggccugcccaacacccuguucggcgacguggccauggugguggaguuccugagcugcuacagcggccugcugcugcccgacgcccaguaccccaucaccgccgugagccugauggaggcccugagcgccgacaagggcggcuuccuguaccugaacagagugcuggugauccugcugcagacccugcugcaggacgagaucgccgaggacuacggcgagcugggcaugaagcugagcgagaucccccugacccugcacagcgugagcgagcuggugagacugugccugagaagaagcgacgugcaggaggagagcgagggcagcgacaccgacgacaacaaggacagcgccgccuucgaggacaacgaggugcaggacgaguuccuggagaagcuggagaccagcgaguucuucgagcugaccagcgaggagaagcugcagauccugaccgcccugugccacagaauccugaugaccuacagcgugcaggaccacauggagaccagacagcagaugagcgccgagcuguggaaggagagacuggccgugcugaaggaggagaacgacaagaagagagccgagaagcagaagagaaaggagauggaggccaagaacaaggagaacggcaagguggagaacggccugggcaagaccgacagaaagaaggagaucgugaaguucgagccccagguggacaccgaggccgaggacaugaucagcgccgugaagagcagaagacugcuggccauccaggccaagaaggagagagagauccaggagagagagaugaaggugaagcuggagagacaggccgaggaggagagaaucagaaagcacaaggccgccgccgagaaggccuuccaggagggcaucgccaaggccaagcuggugaugagaagaacccccaucggcaccgacagaaaccacaacagauacuggcuguucagcgacgaggugcccggccuguucaucgagaagggcugggugcacgacagcaucgacuacagauucaaccaccacugcaaggaccacaccgugagcggcgacgaggacuacugccccagaagcaagaaggccaaccugggcaagaacgccagcaugaacacccagcacggcaccgccaccgagguggccguggagaccaccacccccaagcagggccagaaccugugguuccugugcgacagccagaaggagcuggacgagcugcugaacugccugcacccccagggcaucagagagagccagcugaaggagagacuggagaagagauaccaggacaucauccacagcauccaccuggccagaaagcccaaccugggccugaagagcugcgacggcaaccaggagcugcugaacuuccugagaagcgaccugaucgagguggccaccagacugcagaagggcggccugggcuacguggaggagaccagcgaguucgaggccagagugaucagccuggagaagcugaaggacuucggcgagugcgugaucgcccugcaggccagcgugaucaagaaguuccugcagggcuucauggcccccaagcagaagagaagaaagcugcagagcgaggacagcgccaagaccgaggagguggacgaggagaagaagaugguggaggaggccaagguggccagcgcccuggagaaguggaagaccgccaucagagaggcccagaccuucagcagaaugcacgugcugcugggcaugcuggacgccugcaucaagugggacaugagcgccgagaacgccagaugcaaggugugcagaaagaagggcgaggacgacaagcugauccugugcgacgagugcaacaaggccuuccaccuguucugccugagacccgcccuguacgaggugcccgacggcgaguggcagugccccgccugccagcccgccaccgccagaagaaacagcagaggcagaaacuacaccgaggagagcgccagcgaggacagcgaggacgacgagagcgacgaggaggaggaggaggaggaggaggaggaggaggaggaggacuacgagguggccggccugagacugagacccagaaagaccaucagaggcaagcacagcgugaucccccccgccgccagaagcggcagaagacccggcaagaagccccacagcaccagaagaagccagcccaaggccccccccguggacgacgccgagguggacgagcuggugcugcagaccaagagaagcagcagaagacagagccuggagcugcagaagugcgaggagauccugcacaagaucgugaaguacagauucagcuggcccuucagagagcccgugaccagagacgaggccgaggacuacuacgacgugaucacccaccccauggacuuccagaccgugcagaacaagugcagcugcggcagcuacagaagcgugcaggaguuccugaccgacaugaagcagguguucaccaacgccgagguguacaacugcagaggcagccacgugcugagcugcauggugaagaccgagcagugccugguggcccugcugcacaagcaccugcccggccaccccuacgugagaagaaagagaaagaaguuccccgacagacuggccgaggacgagggcgacagcgagcccgaggccgugggccagagcagaggcagaagacagaagaaguaa

SEQ ID NO: 14122 - RNA, 5712 nt, Artificial Sequence
  BAZ2A__Homo_sapiens__NP_001287834
auggaggccaacgaccacuucaacuucaccggccugccccccgcccccgccgccagcggccugaagcccagccccagcagcggcgagggccuguacaccaacggcagccccaugaacuucccccagcagggcaagagccugaacggcgacgugaacgugaacggccugagcaccgugagccacaccaccaccagcggcauccugaacagcgccccccacagcagcagcaccagccaccugcaccaccccagcguggccuacgacugccuguggaacuacagccaguaccccagcgccaaccccggcagcaaccugaaggaccccccccugcugagccaguucagcggcggccaguacccccugaacggcauccugggcggcagcagacagcccagcagccccagccacaacaccaaccugagagccggcagccaggaguucugggccaacggcacccagagccccaugggccugaacuucgacagccaggagcuguacgacagcuuccccgaccagaacuucgaggugaugcccaacggcccccccagcuucuucaccagcccccagaccagccccaugcugggcagcagcauccagaccuucgcccccagccaggaggugggcagcggcauccaccccgacgaggccgccgagaaggagaugaccagcgugguggccgagaacggcaccggccuggugggcagccuggagcuggaggaggagcagcccgagcugaagaugugcggcuacaacggcagcgugcccagcguggagagccugcaccaggaggugagcgugcuggugcccgaccccaccgugagcugccuggacgaccccagccaccugcccgaccagcuggaggacacccccauccugagcgaggacagccuggagcccuucaacagccuggcccccgagcccgugagcggcggccuguacggcaucgacgacaccgagcugaugggcgccgaggacaagcugccccuggaggacagccccgugaucagcgcccuggacugccccagccugaacaacgccaccgccuucagccugcuggccgacgacagccagaccagcaccagcaucuucgccagccccaccagcccccccgugcugggcgagagcgugcugcaggacaacagcuucgaccugaacaacggcagcgacgccgagcaggaggagauggagacccagagcagcgacuucccccccagccugacccagcccgcccccgaccagagcagcaccauccagcugcaccccgccaccagccccgccgugagccccaccaccagccccgccgugagccugguggugagccccgccgccagccccgagaucagccccgaggugugccccgccgccagcaccguggugagccccgccguguucagcguggugagccccgccagcagcgccgugcugcccgccgugagccuggaggugccccugaccgccagcgugaccagccccaaggccagccccgugaccagccccgccgccgccuuccccaccgccagccccgccaacaaggacgugagcagcuuccuggagaccaccgccgacguggaggagaucaccggcgagggccugaccgccagcggcagcggcgacgugaugagaagaagaaucgccacccccgaggaggugagacugccccugcagcacggcuggagaagagaggugagaaucaagaagggcagccacagauggcagggcgagaccugguacuacggccccugcggcaagagaaugaagcaguuccccgaggugaucaaguaccugagcagaaacguggugcacagcgugagaagagagcacuucagcuucagccccagaaugcccgugggcgacuucuucgaggagagagacacccccgagggccugcagugggugcagcugagcgccgaggagauccccagcagaauccaggccaucaccggcaagagaggcagacccagaaacaccgagaaggccaagaccaaggaggugcccaaggugaagagaggcagaggcagaccccccaaggugaagaucaccgagcugcugaacaagaccgacaacagaccccugaagaagcuggaggcccaggagacccugaacgaggaggacaaggccaagaucgccaagagcaagaagaagaugagacagaaggugcagagaggcgagugccagaccaccauccagggccaggccagaaacaagagaaagcaggagaccaagagccugaagcagaaggaggccaagaagaagagcaaggccgagaaggagaagggcaagaccaagcaggagaagcugaaggagaaggugaagagagagaagaaggagaaggugaagaugaaggagaaggaggaggugaccaaggccaagcccgccugcaaggccgacaagacccuggccacccagagaagacuggaggagagacagagacagcagaugauccuggaggagaugaagaagcccaccgaggacaugugccugaccgaccaccagccccugcccgacuucagcagagugcccggccugacccugcccagcggcgccuucagcgacugccugaccaucguggaguuccugcacagcuucggcaaggugcugggcuucgaccccgccaaggacgugcccagccugggcgugcugcaggagggccugcugugccagggcgacagccugggcgaggugcaggaccugcuggugagacugcugaaggccgcccugcacgaccccggcuuccccagcuacugccagagccugaagauccugggcgagaaggugagcgagaucccccugaccagagacaacgugagcgagauccugagaugcuuccugauggccuacggcguggagcccgcccugugcgacagacugagaacccagcccuuccaggcccagcccccccagcagaaggccgccgugcuggccuuccuggugcacgagcugaacggcagcacccugaucaucaacgagaucgacaagacccuggagagcaugagcagcuacagaaagaacaaguggaucguggagggcagacugagaagacugaagaccgugcuggccaagagaaccggcagaagcgagguggagauggagggccccgaggagugccugggcagaagaagaagcagcagaaucauggaggagaccagcggcauggaggaggaggaggaggaggagagcaucgccgccgugcccggcagaagaggcagaagagacggcgagguggacgccaccgccagcagcauccccgagcuggagagacagaucgagaagcugagcaagagacagcuguucuucagaaagaagcugcugcacagcagccagaugcugagagccgugagccugggccaggacagauacagaagaagauacugggugcugcccuaccuggccggcaucuucguggagggcaccgagggcaaccuggugcccgaggaggugaucaagaaggagaccgacagccugaagguggccgcccacgccagccugaaccccgcccuguucagcaugaagauggagcuggccggcagcaacaccaccgccagcagccccgccagagccagaggcagacccagaaagaccaagcccggcagcaugcagcccagacaccugaagagccccgugagaggccaggacagcgagcagccccaggcccagcugcagcccgaggcccagcugcacgcccccgcccagccccagccccagcugcagcugcagcugcagagccacaagggcuuccuggagcaggagggcagcccccugagccugggccagagccagcacgaccugagccagagcgccuuccugagcuggcugagccagacccagagccacagcagccugcugagcagcagcgugcugacccccgacagcagccccggcaagcuggaccccgcccccagccagccccccgaggagcccgagcccgacgaggccgagagcagccccgacccccaggcccugugguucaacaucagcgcccagaugcccugcaacgccgcccccacccccccccccgccgugagcgaggaccagcccacccccagcccccagcagcuggccagcagcaagcccaugaacagacccagcgccgccaaccccugcagccccgugcaguucagcagcaccccccuggccggccuggcccccaagagaagagccggcgaccccggcgagaugccccagagccccaccggccugggccagcccaagagaagaggcagaccccccagcaaguucuucaagcagauggagcagagauaccugacccagcugaccgcccagcccgugccccccgagaugugcagcggcuggugguggaucagagaccccgagaugcuggacgccaugcugaaggcccugcaccccagaggcaucagagagaaggcccugcacaagcaccugaacaagcacagagacuuccugcaggaggugugccugagacccagcgccgaccccaucuucgagcccagacagcugcccgccuuccaggagggcaucaugagcuggagccccaaggagaagaccuacgagaccgaccuggccgugcugcaguggguggaggagcuggagcagagagugaucaugagcgaccugcagaucagaggcuggaccugccccagccccgacagcaccagagaggaccuggccuacugcgagcaccugagcgacagccaggaggacaucaccuggagaggcagaggcagagagggccuggccccccagagaaagaccaccaacccccuggaccuggccgugaugagacuggccgcccuggagcagaacguggagagaagauaccugagagagccccuguggcccacccacgagguggugcuggagaaggcccugcugagcacccccaacggcgcccccgagggcaccaccaccgagaucagcuacgagaucacccccagaaucagaguguggagacagacccuggagagaugcagaagcgccgcccaggugugccugugccugggccagcuggagagaagcaucgccugggagaagagcgugaacaaggugaccugccuggugugcagaaagggcgacaacgacgaguuccugcugcugugcgacggcugcgacagaggcugccacaucuacugccacagacccaagauggaggccgugcccgagggcgacugguucugcaccgugugccuggcccagcagguggagggcgaguucacccagaagcccggcuuccccaagagaggccagaagagaaagagcggcuacagccugaacuucagcgagggcgacggcagaagaagaagagugcugcugagaggcagagagagccccgccgccggccccagauacagcgaggagggccugagccccagcaagagaagaagacugagcaugagaaaccaccacagcgaccugaccuucugcgagaucauccugauggagauggagagccacgacgccgccuggcccuuccuggagcccgugaaccccagacuggugagcggcuacagaagaaucaucaagaaccccauggacuucagcaccaugagagagagacugcugagaggcggcuacaccagcagcgaggaguucgccgccgacgcccugcugguguucgacaacugccagaccuucaacgaggacgacagcgaggugggcaaggccggccacaucaugagaagauucuucgagagcagaugggaggaguucuaccagggcaagcaggccaaccuguaa

SEQ ID NO: 14123 - RNA, 6399 nt, Artificial Sequence
  BAZ2B__Homo_sapiens__NP_001276904
auggagagcggcgagagacugcccagcagcgccgccagcagcaccacccccaccagcagcagcacccccagcguggccagcguggugagcaagggcggccugagcaccggcguggccagccugagcagcaccaucaaccccugcggccaccuguucagaaccgccggcgaccagcccuucaaccugagcaccgugagcagcgccuuccccauggugagccaccccguguucggccugcacagcgccagcagcggccacagcgaguucggcggccugggcacccugggcacccccaccgcccuggccgcccacccccagcuggccagcuuccccgagugguggagaaccaccgacgcccacaccagaaccggcgccaccuucuuccccccccugcugggcauccccccccuguucgccccccccgcccagaaccacgacagcagcagcuuccacagcagaaccagcggcaagagcaacagaaacggccccgagaagggcgugaacggcagcaucaacggcagcaacaccagcagcgugaucggcaucaacaccagcgugcugagcaccaccgccagcagcagcaugggccagaccaagagcaccagcagcggcggcggcaacagaaagugcaaccaggagcagagcaagaaccagccccuggacgccagaguggacaagaucaaggacaagaagcccagaaagaaggccauggagagcagcagcaacagcgacagcgacagcggcaccagcagcgacaccagcagcgagggcaucagcagcagcgacagcgacgaccuggaggaggacgaggaggaggaggaccagagcaucgaggagagcgaggacgacgacagcgacagcgagagcgaggcccagcacaagagcaacaaccaggugcugcugcacggcaucagcgaccccaaggccgacggccagaaggccaccgagaaggcccaggagaagagaauccaccagccccugccccuggccagcgagagccagacccacagcuuccagagccagcagaagcagccccaggugcugagccagcagcugcccuucaucuuccagagcagccaggccaaggaggagagcgugaacaagcacaccagcgugauccagagcaccggccuggugagcaacgugaagccccugagccuggugaaccaggccaagaaggagaccuacaugaagcugaucgugcccagccccgacgugcugaaggccggcaacaagaacaccagcgaggagagcagccugcugaccagcgagcugagaagcaagagagagcaguacaagcaggccuuccccagccagcugaagaagcaggagagcagcaagagccugaagaaggugaucgccgcccugagcaaccccaaggccaccagcagcagccccgcccaccccaagcagacccuggagaacaaccaccccaaccccuuccugaccaacgcccugcugggcaaccaccagcccaacggcgugauccagagcgugauccaggaggccccccuggcccugaccaccaagaccaagaugcagagcaagaucaacgagaacaucgccgccgccagcagcacccccuucagcagccccgugaaccugagcaccagcggcagaagaacccccggcaaccagacccccgugaugcccagcgccagccccauccugcacagccagggcaaggagaaggccgugagcaacaacgugaaccccgugaagacccagcaccacagccaccccgccaagagccugguggagcaguucagaggcaccgacagcgacauccccagcagcaaggacagcgaggacagcaacgaggacgaggaggaggacgacgaggaggaggacgaggaggacgacgaggacgacgagagcgacgacagccagagcgagagcgacagcaacagcgagagcgacaccgagggcagcgaggaggaggacgacgacgacaaggaccaggacgagagcgacagcgacaccgagggcgagaagaccagcaugaagcugaacaagaccaccagcagcgugaagagccccagcaugagccugaccggccacagcacccccagaaaccugcacaucgccaaggcccccggcagcgcccccgccgcccugugcagcgagagccagagccccgccuuccugggcaccagcagcagcacccugaccagcagcccccacagcggcaccagcaagagaagaagagugaccgacgagagagagcugagaaucccccuggaguacggcuggcagagagagaccagaaucagaaacuucggcggcagacugcagggcgagguggccuacuacgcccccugcggcaagaagcugagacaguaccccgaggugaucaagggcaugcaguggugccugcugaaggaggaggacgugauccccagaaucagagccauggagggcagaagaggcagaccccccaaccccgacagacagagagccagagaggagagcagaaugagaagaagaaagggcagaccccccaacgugggcaacgccgaguuccuggacaacgccgacgccaagcugcugagaaagcugcaggcccaggagaucgccagacaggccgcccagaucaagcugcugagaaagcugcagaagcaggagcaggccagaguggccaaggaggccaagaagcagcaggccaucauggccgccgaggagaagagaaagcagaaggagcagaucaagaucaugaagcagcaggagaagaucaagagaauccagcagaucagaauggagaaggagcugagagcccagcagauccuggaggccaagaagaagaagaaggaggaggccgccaacgccaagcugcuggaggccgagaagagaaucaaggagaaggagaugagaagacagcaggccgugcugcugaagcaccaggagagagagagaagaagacagcacaugaugcugaugaaggccauggaggccagaaagaaggccgaggagaaggagagacugaagcaggagaagagagacgagaagagacugaacaaggagagaaagcuggagcagagaagacuggagcuggagauggccaaggagcugaagaagcccaacgaggacaugugccuggccgaccagaagccccugcccgagcugcccagaauccccggccuggugcugagcggcagcaccuucagcgacugccugaugguggugcaguuccugagaaacuucggcaaggugcugggcuucgacgugaacaucgacgugcccaaccugagcgugcugcaggagggccugcugaacaucggcgacagcaugggcgaggugcaggaccugcuggugagacugcugagcgccgccgugugcgaccccggccugaucaccggcuacaaggccaagaccgcccugggcgagcaccugcugaacgugggcgugaacagagacaacgugagcgagauccugcagaucuucauggaggcccacugcggccagaccgagcugaccgagagccugaagaccaaggccuuccaggcccacacccccgcccagaaggccagcgugcuggccuuccugaucaacgagcuggccugcagcaagagcguggugagcgagaucgacaagaacaucgacuacaugagcaaccugagaagagacaagugggugguggagggcaagcugagaaagcugagaaucauccacgccaagaagaccggcaagagagacaccagcggcggcaucgaccugggcgaggagcagcacccccugggcacccccacccccggcagaaagagaagaagaaagggcggcgacagcgacuacgacgacgacgacgacgacgacagcgacgaccagggcgacgaggacgacgaggacgaggaggacaaggaggacaagaagggcaagaagaccgacaucugcgaggacgaggacgagggcgaccaggccgccagcguggaggagcuggagaagcagaucgagaagcugagcaagcagcagagccaguacagaagaaagcuguucgacgccagccacagccugagaagcgugauguucggccaggacagauacagaagaagauacuggauccugccccagugcggcggcaucuucguggagggcauggagagcggcgagggccuggaggagaucgccaaggagagagagaagcugaagaaggccgagagcgugcagaucaaggaggagauguucgagaccagcggcgacagccugaacugcagcaacaccgaccacugcgagcagaaggaggaccugaaggagaaggacaacaccaaccuguuccugcagaagcccggcagcuucagcaagcugagcaagcugcuggagguggccaagaugccccccgagagcgaggugaugacccccaagcccaacgccggcgccaacggcugcacccugagcuaccagaacagcggcaagcacagccugggcagcgugcagagcaccgccacccagagcaacguggagaaggccgacagcaacaaccuguucaacaccggcagcagcggccccggcaaguucuacagcccccugcccaacgaccagcugcugaagacccugaccgagaagaacagacagugguucagccugcugcccagaacccccugcgacgacaccagccugacccacgccgacaugagcaccgccagccuggugaccccccagagccagccccccagcaagagccccagccccacccccgccccccugggcagcagcgcccagaaccccgugggccugaaccccuucgcccugagcccccugcaggugaagggcggcgugagcaugaugggccugcaguucugcggcuggcccaccggcguggugaccagcaacauccccuucaccagcagcgugcccagccugggcagcggccugggccugagcgagggcaacggcaacagcuuccugaccagcaacguggccagcagcaagagcgagagccccgugccccagaacgagaaggccaccagcgcccagcccgccgccguggagguggccaagcccguggacuuccccagccccaagcccauccccgaggagaugcaguucggcugguggagaaucaucgaccccgaggaccugaaggcccugcugaaggugcugcaccugagaggcaucagagagaaggcccugcagaagcagauccagaagcaccuggacuacaucacccaggccugccugaagaacaaggacguggccaucaucgagcugaacgagaacgaggagaaccaggugaccagagacaucguggagaacuggagcguggaggagcaggccauggagauggaccugagcgugcugcagcagguggaggaccuggagagaagaguggccagcgccagccugcaggugaagggcuggaugugccccgagcccgccagcgagagagaggaccugguguacuucgagcacaagagcuucaccaagcugugcaaggagcacgacggcgaguucaccggcgaggacgagagcagcgcccacgcccuggagagaaagagcgacaacccccuggacaucgccgugaccagacuggccgaccuggagagaaacaucgagagaagaaucgaggaggacaucgcccccggccugagaguguggagaagagcccugagcgaggccagaagcgccgcccagguggcccugugcauccagcagcugcagaagagcaucgccugggagaagagcaucaugaagguguacugccagaucugcagaaagggcgacaacgaggagcugcugcugcugugcgacggcugcgacaagggcugccacaccuacugccacagacccaagaucaccaccauccccgacggcgacugguucugccccgccugcaucgccaaggccagcggccagacccugaagaucaagaagcugcacgugaagggcaagaagaccaacgagagcaagaagggcaagaaggugacccugaccggcgacaccgaggacgaggacagcgccagcaccagcagcagccugaagagaggcaacaaggaccugaagaagagaaagauggaggagaacaccagcaucaaccugagcaagcaggagagcuucaccagcgugaagaagcccaagagagacgacagcaaggaccuggcccugugcagcaugauccugaccgagauggagacccacgaggacgccuggcccuuccugcugcccgugaaccugaagcuggugcccggcuacaagaaggugaucaagaagcccauggacuucagcaccaucagagagaagcugagcagcggccaguaccccaaccuggagaccuucgcccuggacgugagacugguguucgacaacugcgagaccuucaacgaggacgacagcgacaucggcagagccggccacaacaugagaaaguacuucgagaagaaguggaccgacaccuucaaggugagcuaa

SEQ ID NO: 14124 - RNA, 786 nt, Artificial Sequence
  BBC3__Homo_sapiens__NP_001120712
augaaguucggcaugggcagcgcccaggccugccccugccaggugcccagagccgccagcaccaccugggugcccugccagaucugcggccccagagagagacacggccccagaacccccggcggccagcugcccggcgccagaagaggccccggccccagaagacccgccccccugcccgccagaccccccggcgcccugggcagcgugcugagaccccugagagccagacccggcugcagacccagaagaccccaccccgccgccagaugccugccccugagaccccacagacccaccagaagacacagaagacccggcggcuucccccuggccuggggcagcccccagcccgcccccagacccgcccccggcagaagcagcgcccuggcccuggccggcggcgccgcccccggcguggccagagcccagagacccggcggcagcggcggcagaagccaccccggcggccccggcagccccagaggcggcggcaccgugggccccggcgacagaggccccgccgccgccgacggcggcagaccccagagaaccgugagagccgccgagaccagaggcgccgccgccgcccccccccugacccuggagggccccgugcagagccaccacggcacccccgcccugacccagggcccccagagccccagagacggcgcccagcugggcgccugcaccagacccguggacgugagagacagcggcggcagaccccugcccccccccgacacccuggccagcgccggcgacuuccugugcaccauguaa

SEQ ID NO: 14125 - RNA, 312 nt, Artificial Sequence
  BBIP1__Homo_sapiens__NP_001182233
augcugaaggccgccgccaagagacccgagcugagcggccugcugaaguucaacaacuacggcauccugagcgagagcccccugaccagccagagaaccaccuggcugcuguaccagagccccagcuucauccccggcuucgccuaccccagcagaugccugaagaccaucggcggcguguacaagcaggccagaaagaagcacuacauccagcagcugagauacggcagaagcgaggugaacgugcccggcagcagcagcaaggccagagccaccgugugcggcagauacaacgacaacggcgccguguaa

SEQ ID NO: 14126 - RNA, 1164 nt, Artificial Sequence
  BBOX1__Homo_sapiens__XP_011518705
auggccugcaccauccagaaggccgaggcccuggacggcgcccaccugaugcagauccugugguacgacgaggaggagagccuguaccccgccguguggcugagagacaacugccccugcagcgacugcuaccuggacagcgccaaggccagaaagcugcugguggaggcccuggacgugaacaucggcaucaagggccugaucuucgacagaaagaagguguacaucaccuggcccgacgagcacuacagcgaguuccaggccgacuggcugaagaagagaugcuucagcaagcaggccagagccaagcugcagagagagcuguucuuccccgagugccaguacuggggcagcgagcugcagcugcccacccuggacuucgaggacgugcugagauacgacgagcacgccuacaaguggcugagcacccugaagaaggugggcaucgugagacugaccggcgccagcgacaagcccggcgaggugagcaagcugggcaagagaaugggcuuccuguaccugaccuucuacggccacaccuggcaggugcaggacaagaucgacgccaacaacguggccuacaccaccggcaagcugagcuuccacaccgacuaccccgcccugcaccacccccccggcgugcagcugcugcacugcaucaagcagaccgugaccggcggcgacagcgagaucguggacggcuucaacgugugccagaagcugaagaagaacaacccccaggccuuccagauccugagcagcaccuucguggacuucaccgacaucggcguggacuacugcgacuucagcgugcagagcaagcacaagaucaucgagcuggacgacaagggccagguggugagaaucaacuucaacaacgccaccagagacaccaucuucgacgugcccguggagagagugcagcccuucuacgccgcccugaaggaguucguggaccugaugaacagcaaggagagcaaguucaccuucaagaugaaccccggcgacgugaucaccuucgacaacuggagacugcugcacggcagaagaagcuacgaggccggcaccgagaucagcagacaccuggagggcgccuacgccgacugggacguggugaugagcagacugagaauccugagacagagaguggagaacggcaacuaa

SEQ ID NO: 14127 - RNA, 2172 nt, Artificial Sequence
  BBS10__Homo_sapiens__NP_078961
augcugagcagcauggccgccgccggcagcgugaaggccgcccugcagguggccgaggugcuggaggccaucgugagcugcugcgugggccccgagggcagacaggugcugugcaccaagcccaccggcgaggugcugcugagcagaaacggcggcagacugcuggaggcccugcaccuggagcaccccaucgccagaaugaucguggacugcgugagcagccaccugaagaagaccggcgacggcgccaagaccuucaucaucuuccugugccaccugcugagaggccugcacgccaucaccgacagagagaaggacccccugaugugcgagaacauccagacccacggcagacacuggaagaacugcagcagauggaaguucaucagccaggcccugcugaccuuccagacccagauccuggacggcaucauggaccaguaccugagcagacacuuccugagcaucuucagcagcgccaaggagagaacccugugcagaagcagccuggagcugcugcuggaggccuacuucugcggcagagugggcagaaacaaccacaaguucaucagccagcugaugugcgacuacuucuucaagugcaugaccugcaagagcggcaucggcguguucgagcugguggacgaccacuucguggagcugaacgugggcgugaccggccugcccgugagcgacagcagaaucaucgccggccuggugcugcagaaggacuucagcguguacagacccgccgacggcgacaugagaauggugaucgugaccgagaccauccagccccuguucagcaccagcggcagcgaguucauccugaacagcgaggcccaguuccagaccagccaguucuggaucauggagaagaccaaggccaucaugaagcaccugcacagccagaacgugaagcugcugaucagcagcgugaagcagcccgaccuggugagcuacuacgccggcgugaacggcaucagcgugguggagugccugagcagcgaggaggugagccugaucagaagaaucaucggccugagccccuucgugcccccccaggccuucagccagugcgagauccccaacaccgcccuggugaaguucugcaagccccugauccugagaagcaagagauacgugcaccugggccugaucagcaccugcgccuucaucccccacagcaucgugcugugcggccccgugcacggccugaucgagcagcacgaggacgcccugcacggcgcccugaagaugcugagacagcuguucaaggaccuggaccugaacuacaugacccagaccaacgaccagaacggcaccagcagccuguucaucuacaagaacagcggcgagagcuaccaggcccccgaccccggcaacggcagcauccagagacccuaccaggacaccguggccgagaacaaggacgcccuggagaagacccagaccuaccugaaggugcacagcaaccuggugauccccgacguggagcuggagaccuacauccccuacagcacccccacccugacccccaccgacaccuuccagaccguggagacccugaccugccugagccuggagagaaacagacugaccgacuacuacgagccccugcugaagaacaacagcaccgccuacagcaccagaggcaacagaaucgagaucagcuacgagaaccugcaggugaccaacaucaccagaaagggcagcaugcugcccgugagcugcaagcugcccaacaugggcaccagccagagcuaccugagcagcagcaugcccgccggcugcgugcugcccgugggcggcaacuucgagauccugcugcacuacuaccugcugaacuacgccaagaagugccaccagagcgaggagaccauggugagcaugaucaucgccaacgcccugcugggcauccccaaggugcuguacaagagcaagaccggcaaguacagcuucccccacaccuacaucagagccgugcacgcccugcagaccaaccagccccuggugagcagccagaccggccuggagagcgugaugggcaaguaccagcugcugaccagcgugcugcagugccugaccaagauccugaccaucgacauggugaucaccgugaagagacacccccagaaggugcacaaccaggacagcgaggacgagcuguaa

SEQ ID NO: 14128 - RNA, 2133 nt, Artificial Sequence
  BBS12__Homo_sapiens__NP_689831
auggugauggccugcagaguggugaacaagagaagacacaugggccugcagcagcugagcagcuucgccgagaccggcagaaccuuccugggcccccugaagagcagcaaguucaucaucgacgaggagugccacgagagcgugcugaucagcagcaccgugagacugcuggagagccuggaccugaccagcgccgugggccagcugcugaacgaggccgugcaggcccagaacaacaccuacagaaccggcaucagcacccugcuguuccuggugggcgccuggagcagcgccguggaggagugccugcaccugggcgugcccaucagcaucaucgugagcgugaugagcgagggccugaacuucugcagcgaggagguggugagccugcacgugcccgugcacaacaucuucgacugcauggacagcaccaagaccuucagccagcuggagaccuucagcgugagccugugccccuuccugcaggugcccagcgacaccgaccugaucgaggagcugcacggccugaaggacguggccagccagacccugaccaucagcaaccugagcggcagaccccugaagagcuacgagcuguucaagccccagaccaagguggaggccgacaacaacaccagcagaacccugaagaacagccugcuggccgacaccugcugcagacagagcauccugauccacagcagacacuucaacagaaccgacaacaccgagggcgugagcaagcccgacggcuuccaggagcacgugaccgccacccacaagaccuacagaugcaacgaccugguggagcuggccgugggccugagccacggcgaccacagcagcaugaagcugguggaggaggccgugcagcugcaguaccagaacgccugcgugcagcagggcaacugcaccaagcccuucauguucgacaucagcagaaucuucaccugcugccugcccggccugcccgagaccagcagcugcgugugccccggcuacaucaccguggugagcgugagcaacaaccccgugaucaaggagcugcagaaccagcccgugagaaucgugcugaucgagggcgaccugaccgagaacuacagacaccugggcuucaacaagagcgccaacaucaagaccgugcuggacagcaugagacugcaggaggacagcagcgaggagcugugggccaaccacgugcugcaggugcugauccaguucaaggugaaccuggugcuggugcagggcaacgugagcgagagacugaucgagaagugcaucaacagcaagagacuggugaucggcagcgugaacggcagcgugaugcaggccuucgccgaggccgccggcgccgugcagguggccuacaucacccaggugaacgaggacugcgugggcgacggcgugugcgugaccuucuggagaagcagcccccuggacgugguggacagaaacaacagaaucgccauccugcugaagaccgagggcaucaaccuggugaccgccgugcugaccaaccccgugaccgcccagaugcagaucaaggaggacagauucuggaccugcgccuacagacuguacuacgcccugaaggaggagaagguguuccugggcggcggcgccguggaguuccugugccugagcugccugcacauccuggccgagcagagccugaagaaggagaaccacgccugcagcggcuggcugcacaacaccagcagcuggcuggccagcagccuggccaucuacagacccaccgugcugaaguuccuggccaacggcuggcagaaguaccugagcacccugcuguacaacaccgccaacuacagcagcgaguucgaggccagcaccuacauccagcaccaccugcagaacgccaccgacagcggcagccccagcagcuacauccugaacgaguacagcaagcugaacagcagaaucuucaacagcgacaucagcaacaagcuggagcagauccccagaguguacgacguggugacccccaagaucgaggccuggagaagagcccuggaccuggugcugcuggugcugcagaccgacagcgagaucaucaccggccacggccacacccagaucaacagccaggagcugaccggcuuccuguuccuguaa

SEQ ID NO: 14129 - RNA, 1782 nt, Artificial Sequence
  BBS1__Homo_sapiens__NP_078925
auggccgccgccagcagcagcgacagcgacgccugcggcgccgagagcaacgaggccaacagcaaguggcuggacgcccacuacgaccccauggccaacauccacaccuucagcgccugccuggcccuggccgaccugcacggcgacggcgaguacaagcugguggugggcgaccugggccccggcggccagcagcccagacugaaggugcugaagggcccccuggugaugaccgagagcccccugcccgcccugcccgccgccgccgccaccuuccugauggagcagcacgagcccagaacccccgcccuggcccuggccagcggccccugcguguacguguacaagaaccugagacccuacuucaaguucagccugccccagcugccccccaacccccuggagcaggaccuguggaaccaggccaaggaggacagaaucgacccccugacccugaaggagaugcuggagagcaucagagagaccgccgaggagccccugagcauccagagccugagauuccugcagcuggagcugagcgagauggaggccuucgugaaccagcacaagagcaacagcaucaagagacagaccgugaucaccaccaugaccacccugaagaagaaccuggccgacgaggacgccgugagcugccuggugcugggcaccgagaacaaggagcugcuggugcuggaccccgaggccuucaccauccuggccaagaugagccugcccagcgugcccguguuccuggaggugagcggccaguucgacguggaguucagacuggccgccgccugcagaaacggcaacaucuacauccugagaagagacagcaagcaccccaaguacugcaucgagcugagcgcccagcccgugggccugaucagagugcacaaggugcugguggugggcagcacccaggacagccugcacggcuucacccacaagggcaagaagcuguggaccgugcagaugcccgccgccauccugaccaugaaccugcuggagcagcacagcagaggccugcaggccgugauggccggccuggccaacggcgaggugagaaucuacagagacaaggcccugcugaacgugauccacacccccgacgccgugaccagccugugcuucggcagauacggcagagaggacaacacccugaucaugaccaccagaggcggcggccugaucaucaagauccugaagagaaccgccguguucguggagggcggcagcgaggugggccccccccccgcccaggccaugaagcugaacgugcccagaaagaccagacuguacguggaccagacccugagagagagagaggccggcaccgccaugcacagagccuuccagaccgaccuguaccugcugagacugagagccgccagagccuaccugcaggcccuggagagcagccugagcccccugagcaccaccgccagagagccccugaagcugcacgccguggugcagggccugggccccaccuucaagcugacccugcaccugcagaacaccagcaccaccagacccgugcugggccugcuggugugcuuccuguacaacgaggcccuguacagccugcccagagccuucuucaaggugccccugcuggugcccggccugaacuacccccuggagaccuucguggagagccugagcaacaagggcaucagcgacaucaucaaggugcuggugcugagagagggccagagcgccccccugcugagcgcccacgugaacaugcccggcagcgagggccuggccgccgccuaa

SEQ ID NO: 14130 - RNA, 2166 nt, Artificial Sequence
  BBS2__Homo_sapiens__XP_005256137
augcugcugcccguguucacccugaagcugagacacaagaucagccccagaaugguggccaucggcagauacgacggcacccaccccugccuggccgccgccacccagaccggcaagguguucauccacaacccccacaccagaaaccagcacgugagcgccagcagaguguuccagagcccccuggagagcgacgugagccugcugagcaucaaccaggccgugagcugccugaccgccggcgugcugaaccccgagcugggcuacgacgcccugcuggugggcacccagaccaaccugcuggccuacgacguguacaacaacagcgaccuguucuacagagagguggccgacggcgccaacgccaucgugcugggcacccugggcgacaucagcagcccccuggccaucaucggcggcaacugcgcccugcagggcuucaaccacgagggcagcgaccuguucuggaccgugaccggcgacaacgugaacagccuggcccugugcgacuucgacggcgacggcaagaaggagcugcuggugggcagcgaggacuucgacaucagaguguucaaggaggacgagaucguggccgagaugaccgagaccgagaucgugaccagccugugccccauguacggcagcagauucggcuacgcccugagcaacggcaccgugggcguguacgacaagaccagcagauacuggagaaucaagagcaagaaccacgccaugagcauccacgccuucgaccugaacagcgacggcgugaacgagcugaucaccggcuggagcaacggcaagguggacgccagaagcgacagaaccggcgaggugaucuucaaggacaacuucagcagcgccaucgccggcgugguggagggcgacuacagaauggacggccacauccagcugaucugcugcagcguggacggcgagaucagaggcuaccugcccggcaccgccgagaugagaggcaaccugauggacaccagcgccgagcaggaccugaucagagagcugagccagaagaagcagaaccugcugcuggagcugagaaacuacgaggagaacgccaaggccgagcuggccagcccccugaacgaggccgacggccacagaggcaucauccccgccaacaccagacugcacaccacccugagcgugagccugggcaacgagacccagaccgcccacaccgagcugagaaucagcaccagcaacgacaccaucaucagagccgugcugaucuucgccgagggcaucuucaccggcgagagccacguggugcaccccagcauccacaaccugagcagcagcaucugcauccccaucgugccccccaaggacgugcccguggaccugcaccugaaggccuucgugggcuacagaagcagcacccaguuccacguguucgagagcaccagacagcugcccagauucagcauguacgcccugaccagccuggaccccgccagcgagcccaucagcuacgugaacuucaccaucgccgagagagcccagagaguggugguguggcugggccagaacuuccugcugcccgaggacacccacauccagaacgcccccuuccaggugugcuucaccagccugagaaacggcggccaccugcacaucaagaucaagcugagcggcgagaucaccaucaacaccgacgacaucgaccuggccggcgacaucauccagagcauggccagcuucuucgccaucgaggaccugcagguggaggccgacuuccccguguacuucgaggagcugagaaaggugcuggugaagguggacgaguaccacagcgugcaccagaagcugagcgccgacauggccgaccacagcaaccugaucagaagccugcuggugggcgccgaggacgccagacugaugagagacaugaagaccaugaagagcagauacauggagcuguacgaccugaacagagaccugcugaacggcuacaagaucagaugcaacaaccacaccgagcugcugggcaaccugaaggccgugaaccaggccauccagagagccggcagacugagagugggcaagcccaagaaccaggugaucaccgccugcagagacgccaucagaagcaacaacaucaacacccuguucaagaucaugagagugggcaccgccagcagcuaa

SEQ ID NO: 14131 - RNA, 1560 nt, Artificial Sequence
  BBS4__Homo_sapiens__NP_149017
auggccgaggagagaguggccaccagaacccaguuccccgugagcaccgagagccagaagcccagacagaagaaggcccccgaguuccccauccuggagaagcagaacuggcugauccaccugcacuacaucagaaaggacuacgaggccugcaaggccgugaucaaggagcagcugcaggagacccagggccugugcgaguacgccaucuacgugcaggcccugaucuucagacuggagggcaacauccaggagagccuggagcuguuccagaccugcgccgugcugagcccccagagcgccgacaaccugaagcagguggccagaagccuguuccugcugggcaagcacaaggccgccaucgagguguacaacgaggccgccaagcugaaccagaaggacugggagaucagccacaaccugggcgugugcuacaucuaccugaagcaguucaacaaggcccaggaccagcugcacaacgcccugaaccugaacagacacgaccugaccuacaucaugcugggcaagauccaccugcuggagggcgaccuggacaaggccaucgagguguacaagaaggccguggaguucagccccgagaacaccgagcugcugaccacccugggccugcuguaccugcagcugggcaucuaccagaaggccuucgagcaccugggcaacgcccugaccuacgaccccaccaacuacaaggccauccuggccgccggcagcaugaugcagacccacggcgacuucgacguggcccugaccaaguacagagugguggccugcgccgugcccgagagccccccccuguggaacaacaucggcaugugcuucuucggcaagaagaaguacguggccgccaucagcugccugaagagagccaacuaccuggcccccuucgacuggaagauccuguacaaccugggccuggugcaccugaccaugcagcaguacgccagcgccuuccacuuccugagcgccgccaucaacuuccagcccaagaugggcgagcuguacaugcugcuggccguggcccugaccaaccuggaggacaucgagaacgccaagagagccuacgccgaggccgugcaccuggacaagugcaacccccuggugaaccugaacuacgccgugcugcuguacaaccagggcgagaagaagaacgcccuggcccaguaccaggagauggagaagaaggugagccugcugaaggacaacagcagccuggaguucgacagcgagaugguggagauggcccagaagcugggcgccgcccugcaggugggcgaggcccugguguggaccaagcccgugaaggaccccaagagcaagcaccagaccaccagcaccagcaagcccgccagcuuccagcagccccugggcagcaaccaggcccugggccaggccaugagcagcgccgccgccuacagaacccugcccagcggcgccggcggcaccagccaguucaccaagccccccagccugccccuggagcccgagcccgccguggagagcagccccaccgagaccagcgagcagaucagagagaaguaa

SEQ ID NO: 14132 - RNA, 1026 nt, Artificial Sequence
  BBS5__Homo_sapiens__NP_689597
augagcgugcuggacgcccugugggaggacagagacgugagauucgaccugagcgcccagcagaugaagaccagacccggcgaggugcugaucgacugccuggacagcaucgaggacaccaagggcaacaacggcgacagaggcagacugcuggugaccaaccugagaauccuguggcacagccuggcccugagcagagugaacgugagcgugggcuacaacugcauccugaacaucaccaccagaaccgccaacagcaagcugagaggccagaccgaggcccuguacauccugaccaagugcaacagcaccagauucgaguucaucuucaccaaccuggugcccggcagccccagacuguucaccagcgugauggccgugcacagagccuacgagaccagcaagauguacagagacuucaagcugagaagcgcccugauccagaacaagcagcugagacugcugccccaggagcacguguacgacaagaucaacggcguguggaaccugagcagcgaccagggcaaccugggcaccuucuucaucaccaacgugagaaucguguggcacgccaacaugaacgacagcuucaacgugagcauccccuaccugcagaucagaagcaucaagaucagagacagcaaguucggccuggcccuggugaucgagagcagccagcagagcggcggcuacgugcugggcuucaagaucgaccccguggagaagcugcaggagagcgugaaggagaucaacagccugcacaagguguacagcgccagccccaucuucggcguggacuacgagauggaggagaagccccagccccuggaggcccugaccguggagcagauccaggacgacguggagaucgacagcgacggccacaccgacgccuucguggccuacuucgccgacggcaacaagcagcaggacagagagcccguguucagcgaggagcugggccuggccaucgagaagcugaaggacggcuucacccugcagggccugugggaggugaugagcuaa

SEQ ID NO: 14133 - RNA, 2019 nt, Artificial Sequence
  BBS7__Homo_sapiens__NP_060660
auggaccugauccugaacagaauggacuaccugcaggugggcgugaccagccagaagaccaugaagcugauccccgccagcagacacagagccacccagaagguggugaucggcgaccacgacggcguggugaugugcuucggcaugaagaagggcgaggccgccgccguguucaagacccugcccggccccaagaucgccagacuggagcugggcggcgugaucaacaccccccaggagaagaucuucaucgccgccgccagcgagaucagaggcuucaccaagagaggcaagcaguuccugagcuucgagaccaaccugaccgagagcaucaaggccaugcacaucagcggcagcgaccuguuccugagcgccagcuacaucuacaaccacuacugcgacugcaaggaccagcacuacuaccugagcggcgacaagaucaacgacgugaucugccugcccguggagagacugagcagaaucacccccgugcuggccugccaggacagagugcugagagugcugcagggcagcgacgugauguacgccguggaggugcccggcccccccaccgugcuggcccugcacaacggcaacggcggcgacagcggcgaggaccugcuguucggcaccagcgacggcaagcuggcccugauccagaucaccaccagcaagcccgugagaaagugggagauccagaacgagaagaagagaggcggcauccugugcaucgacagcuucgacaucgugggcgacggcgugaaggaccugcuggugggcagagacgacggcaugguggagguguacagcuucgacaacgccaacgagcccgugcugagauucgaccagaugcugagcgagagcgugaccagcauccagggcggcugcgugggcaaggacagcuacgacgagaucguggugagcaccuacagcggcugggugaccggccugaccaccgagcccauccacaaggagagcggccccggcgaggagcugaagaucaaccaggagaugcagaacaagaucagcagccugagaaacgagcuggagcaccugcaguacaaggugcugcaggagagagagaacuaccagcagagcagccagagcagcaaggccaagagcgccgugcccagcuucggcaucaacgacaaguucacccugaacaaggacgacgccagcuacagccugauccuggaggugcagaccgccaucgacaacgugcugauccagagcgacgugcccaucgaccugcuggacguggacaagaacagcgccguggugagcuucagcagcugcgacagcgagagcaacgacaacuuccugcuggccaccuacagaugccaggccgacaccaccagacuggagcugaagaucagaagcaucgagggccaguacggcacccugcaggccuacgugacccccagaauccagcccaagaccugccaggugagacaguaccacaucaagccccugagccugcaccagagaacccacuucaucgaccacgacagacccaugaacacccugacccugaccggccaguucagcuucgccgaggugcacagcugggugguguucugccugcccgaggugcccgagaagccccccgccggcgagugcgugaccuucuacuuccagaacaccuuccuggacacccagcuggagagcaccuacagaaagggcgagggcguguucaagagcgacaacaucagcaccaucagcauccugaaggacgugcugagcaaggaggccaccaagagaaagaucaaccugaacaucagcuacgagaucaacgaggugagcgugaagcacacccugaagcugauccaccccaagcuggaguaccagcugcugcuggccaagaaggugcagcugaucgacgcccugaaggagcugcagauccacgagggcaacaccaacuuccugauccccgaguaccacugcauccuggaggaggccgaccaccugcaggaggaguacaagaagcagcccgcccaccuggagagacuguacggcuaa

SEQ ID NO: 14134 - RNA, 2559 nt, Artificial Sequence
  BBS9__Homo_sapiens__NP_001028776
augagccuguucaaggccagagacugguggagcaccauccugggcgacaaggaggaguucgaccagggcugccugugccuggccaacguggacaacagcggcaacggccaggacaagaucaucgugggcagcuucaugggcuaccugagaaucuucagcccccaccccgccaagaccggcgacggcgcccaggccgaggaccugcugcuggagguggaccugagagaccccgugcugcagguggaggugggcaaguucgugagcggcaccgagaugcugcaccuggccgugcugcacagcagaaagcugugcguguacagcgugagcggcacccugggcaacguggagcacggcaaccagugccagaugaagcugauguacgagcacaaccugcagagaaccgccugcaacaugaccuacggcagcuucggcggcgugaagggcagagaccugaucugcauccagagcauggacggcaugcugaugguguucgagcaggagagcuacgccuucggcagauuccugcccggcuuccugcugcccggcccccuggccuacagcagcagaaccgacagcuuccugaccgugagcagcugccagcagguggagagcuacaaguaccaggugcuggccuucgccaccgacgccgacaagagacaggagaccgagcagcagaagcugggcagcggcaagagacuggugguggacuggacccugaacaucggcgagcaggcccuggacaucugcaucgugagcuucaaccagagcgccagcagcguguucgugcugggcgagagaaacuucuucugccugaaggacaacggccagaucagauucaugaagaagcuggacuggagccccagcugcuuccugcccuacugcagcgugagcgagggcaccaucaacacccugaucggcaaccacaacaacaugcugcacaucuaccaggacgugacccugaagugggccacccagcugccccacauccccguggccgugagagugggcugccugcacgaccugaagggcgugaucgugacccugagcgacgacggccaccugcagugcagcuaccugggcaccgaccccagccuguuccaggcccccaacgugcagagcagagagcugaacuacgacgagcuggacguggagaugaaggagcugcagaagaucaucaaggacgugaacaagagccagggcguguggcccaugaccgagagagaggacgaccugaacgugagcgugguggugagccccaacuucgacagcgugagccaggccaccgacguggaggugggcaccgaccuggugcccagcgugaccgugaaggugacccugcagaacagagugauccugcagaaggccaagcugagcguguacgugcagcccccccuggagcugaccugcgaccaguucaccuucgaguucaugaacagaaaccccgacggcauccccagagugauccagugcaaguucagacugccccugaagcugaucugccugcccggccagcccagcaagaccgccagccacaagaucaccaucgacaccaacaagagccccgugagccugcugagccuguuccccggcuucgccagccagagcgacgacgaccaggugaacgugaugggcuuccacuuccugggcggcgccagaaucaccgugcuggccagcaagaccagccagagauacagaauccagagcgagcaguucgaggaccuguggcugaucaccaacgagcugauccugagacugcaggaguacuucgagaagcagggcgugaaggacuucgccugcagcuucagcggcagcaucccccugcaggaguacuucgagcugaucgaccaccacuucgagcugagaaucaacggcgagaagcuggaggagcugcugagcgagagagccgugcaguucagagccauccagagaagacugcuggccagauucaaggacaagacccccgccccccugcagcaccuggacacccugcuggacggcaccuacaagcaggugaucgcccuggccgacgccguggaggagaaccagggcaaccuguuccagagcuucaccagacugaagagcgccacccaccuggugauccugcugaucgcccuguggcagaagcugagcgccgaccagguggccauccuggaggccgccuuccugccccugcaggaggacacccaggagcugggcugggaggagaccguggacgccgccaucagccaccugcugaagaccugccugagcaagagcagcaaggagcaggcccugaaccugaacagccagcugaacauccccaaggacaccagccagcugaagaagcacaucacccugcugugcgacagacugagcaagggcggcagacugugccugagcaccgacgccgccgccccccagaccauggugaugcccggcggcugcaccaccauccccgagagcgaccuggaggagagaagcguggagcaggacagcaccgagcuguucaccaaccacagacaccugaccgccgagacccccagacccgaggugagcccccugcagggcgugagcgaguaa

SEQ ID NO: 14135 - RNA, 2826 nt, Artificial Sequence
  BBX__Homo_sapiens__NP_001136040
augaagggcagcaacagaaacaaggaccacagcgccgagggcgagggcgugggcaagagacccaagagaaagugccugcaguggcacccccugcuggccaagaagcugcuggacuucagcgaggaggaggaggaggaggacgaggaggaggacaucgacaaggugcagcugcugggcgccgacggccuggagcaggacgugggcgagaccgaggacgacgagagccccgagcagagagccagaagacccaugaacgccuuccugcuguucugcaagagacacagaagccuggugagacaggagcaccccagacuggacaacagaggcgccaccaagauccuggccgacuggugggccgugcuggaccccaaggagaagcagaaguacaccgacauggccaaggaguacaaggacgccuucaugaaggccaaccccggcuacaaguggugccccaccaccaacaagcccgugaagagccccacccccaccgugaaccccagaaagaagcugugggccuuccccagcgacagcagcagagaccugcccagccccaagaaggccaagaccgaggagaugccccagcugaacuucggcauggccgaccccacccagaugggcggccugagcaugcugcugcuggccggcgagcacgcccugggcacccccgaggugagcagcggcaccugcagacccgacgugagcgagagccccgagcugagacagaagagcccccuguuccaguucgccgagaucagcagcagcaccagccacagcgacgccagcaccaagcagugccagaccagcgcccuguuccaguucgccgagaucagcagcaacaccagccagcugggcggcgccgagcccgugaagagaugcggcaagagcgcccuguuccagcuggccgagaugugccuggccagcgagggcaugaagauggaggagagcaagcugaucaaggccaaggagagcgacggcggcagaaucaaggagcuggagaagggcaaggaggagaaggagaucaagauggagaagaccgacgagaccagacugcagaaggaggccgaguucgagaagagcgccaaggagaaccugagagacagcaaggagcugagaaacuucgaggcccugcagaucgacgacaucauggccaucaagauggaggaccccaaggagaucagaaaggaggagcuggaggaggaccacaagugcagccacuuccccgacuucagcuacagcgccagcagcaagaucaucaucagcgacgugcccagcagaaaggaccacaugugccacccccacggcaucaugaucaucgaggaccccgccgcccugaacaagcccgagaagcugaagaagaagaagaagaagagcaagauggacagacacggcaacgacaagagcacccccaagaagaccugcaagaagagacagagcagcgagagcgacaucgagagcgugaucuacaccaucgaggccguggccaagggcgacuggggcaucgagaagcugggcgacacccccagaaagaaggugagaaccagcagcagcggcaagggcagcauccuggacgccaagccccccaagaagaaggugaagagcagagagaagaagaugagcaaggagaagagcagcgacaccaccaaggagagcagaccccccgacuucaucagcaucagcgccagcaagaacaucagcggcgagacccccgagggcaucaaggccgagccccugacccccauggaggacgcccugccccccagccugagcggccaggccaagcccgaggacagcgacugccacagaaagaucgagaccugcggcagcagaaagagcgagagaagcugcaagggcgcccuguacaagacccuggugagcgagggcaugcugaccagccugagagccaacguggacagaggcaagagaagcagcggcaagggcaacagcagcgaccacgagggcugcuggaacgaggagagcuggaccuucagccagagcggcaccagcggcagcaagaaguucaagaagaccaagcccaaggaggacugccugcugggcagcgccaagcuggacgaggaguucgagaagaaguucaacagccugccccaguacagccccgugaccuucgacagaaagugcgugcccgugcccagaaagaagaagaagaccggcaacgugagcagcgagcccaccaagaccagcaagggccccuuccagagccagaagaagaaccuguuccacaagaucgugagcaaguacaagcacaagaaggagaagcccaacgugcccgagaagggcagcggcgacaaguggagcaacaagcagcuguuccuggacgccauccaccccaccgaggccaucuucagcgaggacagaaacaccauggagcccgugcacaaggugaagaacauccccagcaucuucaacacccccgagcccaccaccacccaggagccccuggugggcagccagaagagaaaggccagaaagaccaagaucacccaccuggugagaaccgccgacggcagagugagccccgccggcggcacccuggacgacaagcccaaggagcagcugcagagaagccugcccaaggccaccgagaccgacugcaacgacaagugcagccacaacaccgaggugggcgagaccagaagcagcacccccgagaugcccgccgugagcgccuucuucagccuggccgcccuggccgagguggccgccauggagaacgugcacagaggccagagaagcaccccccugacccacgacggccagcccaaggagaugccccaggcccccgugcugaucagcugcgccgaccaguaa

SEQ ID NO: 14136 - RNA, 1767 nt, Artificial Sequence
  BCAM__Homo_sapiens__NP_001013275
auggagccccccgacgcccccgcccaggccagaggcgcccccagacugcugcugcuggccgugcugcuggccgcccaccccgacgcccaggccgaggugagacugagcgugcccccccugguggaggugaugagaggcaagagcgugauccuggacugcacccccaccggcacccacgaccacuacaugcuggagugguuccugaccgacagaagcggcgccagacccagacuggccagcgccgagaugcagggcagcgagcugcaggugaccaugcacgacaccagaggcagaagcccccccuaccagcuggacagccagggcagacuggugcuggccgaggcccaggugggcgacgagagagacuacgugugcguggugagagccggcgccgccggcaccgccgaggccaccgccagacugaacguguucgccaagcccgaggccaccgaggugagccccaacaagggcacccugagcgugauggaggacagcgcccaggagaucgccaccugcaacagcagaaacggcaaccccgcccccaagaucaccugguacagaaacggccagagacuggaggugcccguggagaugaaccccgagggcuacaugaccagcagaaccgugagagaggccagcggccugcugagccugaccagcacccuguaccugagacugagaaaggacgacagagacgccagcuuccacugcgccgcccacuacagccugcccgagggcagacacggcagacuggacagccccaccuuccaccugacccugcacuaccccaccgagcacgugcaguucugggugggcagccccagcacccccgccggcugggugagagagggcgacaccgugcagcugcugugcagaggcgacggcagccccagccccgaguacacccuguucagacugcaggacgagcaggaggaggugcugaacgugaaccuggagggcaaccugacccuggagggcgugaccagaggccagagcggcaccuacggcugcagaguggaggacuacgacgccgccgacgacgugcagcugagcaagacccuggagcugagaguggccuaccuggacccccuggagcugagcgagggcaaggugcugagccugccccugaacagcagcgccguggugaacugcagcgugcacggccugcccacccccgcccugagauggaccaaggacagcaccccccugggcgacggccccaugcugagccugagcagcaucaccuucgacagcaacggcaccuacgugugcgaggccagccugcccaccgugcccgugcugagcagaacccagaacuucacccugcuggugcagggcagccccgagcugaagaccgccgagaucgagcccaaggccgacggcagcuggagagagggcgacgaggugacccugaucugcagcgccagaggccaccccgaccccaagcugagcuggagccagcugggcggcagccccgccgagcccauccccggcagacagggcugggugagcagcagccugacccugaaggugaccagcgcccugagcagagacggcaucagcugcgaggccagcaacccccacggcaacaagagacacguguuccacuucggcaccgugagcccccagaccagccaggccggcguggccgugauggccguggccgugagcgugggccugcugcugcuggugguggccguguucuacugcgugagaagaaagggcggccccugcugcagacagagaagagagaagggcgcccccuaa

SEQ ID NO: 14137 - RNA, 2016 nt, Artificial Sequence
  BCAN__Homo_sapiens__NP_940819
auggcccagcuguuccugccccugcuggccgcccuggugcuggcccaggcccccgccgcccuggccgacgugcuggagggcgacagcagcgaggacagagccuucagagugagaaucgccggcgacgccccccugcagggcgugcugggcggcgcccugaccauccccugccacgugcacuaccugagacccccccccagcagaagagccgugcugggcagccccagagugaaguggaccuuccugagcagaggcagagaggccgaggugcugguggccagaggcgugagagugaaggugaacgaggccuacagauucagaguggcccugcccgccuaccccgccagccugaccgacgugagccuggcccugagcgagcugagacccaacgacagcggcaucuacagaugcgaggugcagcacggcaucgacgacagcagcgacgccguggaggugaaggugaagggcgugguguuccuguacagagagggcagcgccagauacgccuucagcuucagcggcgcccaggaggccugcgccagaaucggcgcccacaucgccacccccgagcagcuguacgccgccuaccugggcggcuacgagcagugcgacgccggcuggcugagcgaccagaccgugagauaccccauccagacccccagagaggccugcuacggcgacauggacggcuuccccggcgugagaaacuacggcgugguggaccccgacgaccuguacgacguguacugcuacgccgaggaccugaacggcgagcuguuccugggcgacccccccgagaagcugacccuggaggaggccagagccuacugccaggagagaggcgccgagaucgccaccaccggccagcuguacgccgccugggacggcggccuggaccacugcagccccggcuggcuggccgacggcagcgugagauaccccaucgugacccccagccagagaugcggcggcggccugcccggcgugaagacccuguuccuguuccccaaccagaccggcuuccccaacaagcacagcagauucaacguguacugcuucagagacagcgcccagcccagcgccauccccgaggccagcaaccccgccagcaaccccgccagcgacggccuggaggccaucgugaccgugaccgagacccuggaggagcugcagcugccccaggaggccaccgagagcgagagcagaggcgccaucuacagcauccccaucauggaggacggcggcggcggcagcagcacccccgaggaccccgccgaggcccccagaacccugcuggaguucgagacccagagcauggugccccccaccggcuucagcgaggaggagggcaaggcccuggaggaggaggagaaguacgaggacgaggaggagaaggaggaggaggaggaggaggaggagguggaggacgaggcccugugggccuggcccagcgagcugagcagccccggccccgaggccagccugcccaccgagcccgccgcccaggaggagagccugagccaggcccccgccagagccgugcugcagcccggcgccagcccccugcccgacggcgagagcgaggccagcagaccccccagagugcacggcccccccaccgagacccugcccacccccagagagagaaaccuggccagccccagccccagcacccugguggaggccagagaggugggcgaggccaccggcggccccgagcugagcggcgugcccagaggcgagagcgaggagaccggcagcagcgagggcgcccccagccugcugcccgccaccagagcccccgagggcaccagagagcuggaggcccccagcgaggacaacagcggcagaaccgcccccgccggcaccagcgugcaggcccagcccgugcugcccaccgacagcgccagcagaggcggcguggccguggugcccgccagcggcaacagcgcccagggcagcaccgcccugagcauccugcugcuguucuucccccugcagcugugggugaccuaa

SEQ ID NO: 14138 - RNA, 1047 nt, Artificial Sequence
  BCAP29__Homo_sapiens__NP_001008405
augacccugcagugggccgccguggccaccuuccuguacgccgagaucggccugauccugaucuucugccugcccuucauccccccccagagauggcagaagaucuucagcuucaacguguggggcaagaucgccaccuucuggaacaaggccuuccugaccaucaucauccugcugaucgugcuguuccuggacgccgugagagaggugagaaaguacagcagcgugcacaccaucgagaagagcagcaccagcagacccgacgccuacgagcacacccagaugaagcuguucagaagccagagaaaccuguacaucagcggcuucagccuguucuucuggcuggugcugagaagacuggugacccugaucacccagcuggccaaggagcugagcaacaagggcgugcugaagacccaggccgagaacaccaacaaggccgccaagaaguucauggaggagaacgagaagcugaagagaauccugaagagccacggcaaggacgaggagugcgugcuggaggccgagaacaagaagcugguggaggaccaggagaagcugaagaccgagcugagaaagaccagcgacgcccugagcaaggcccagaacgacgugauggagaugaagaugcagagcgagagacugagcaaggaguacgaccagcugcugaaggagcacagcgagcugcagcacagcagcuucggcgaguuccugagcaagagaagccacaagaacggcagcaucggcaagcagaccggcagcagaaagggcagcuucagaaagagacagcaggagaagaccgugaacuucaucaaggacaccugcaacauccugugccagaacgacaacuucgugaugcuggccagcagaaaguucaaguucagaaagaugcacuacgacagauucgugaucuuccugaugccccacaucggcugcaucgugauggcccugagcaaguaccugaugauguuccagaucuacugcaaggugugcauccccgcccugaagaagaacaucagcaugcugaacaccaucuucaccuacuaa

SEQ ID NO: 14139 - RNA, 942 nt, Artificial Sequence
  BCAP31__Homo_sapiens__NP_001132929
augggcgccgaggccagcagcagcuggugccccggcaccgcccugcccgaggagagacugagcgugaagagagccagcgagaucagcggcuuccugggccagggcagcagcggcgaggccgcccuggacgugcugacccacgugcuggagggcgccggcaacaagcugaccagcagcugcggcaagcccagcagcaacagaaugagccugcaguggaccgccguggccaccuuccuguacgccgagguguucguggugcugcugcugugcauccccuucaucagccccaagagauggcagaagaucuucaagagcagacugguggagcugcuggugagcuacggcaacaccuucuucguggugcugaucgugauccuggugcugcuggugaucgacgccgugagagagaucagaaaguacgacgacgugaccgagaaggugaaccugcagaacaaccccggcgccauggagcacuuccacaugaagcuguucagagcccagagaaaccuguacaucgccggcuucagccugcugcugagcuuccugcugagaagacuggugacccugaucagccagcaggccacccugcuggccagcaacgaggccuucaagaagcaggccgagagcgccagcgaggccgccaagaaguacauggaggagaacgaccagcugaagaagggcgccgccguggacggcggcaagcuggacgugggcaacgccgaggugaagcuggaggaggagaacagaagccugaaggccgaccugcagaagcugaaggacgagcuggccagcaccaagcagaagcuggagaaggccgagaaccaggugcuggccaugagaaagcagagcgagggccugaccaaggaguacgacagacugcuggaggagcacgccaagcugcaggccgccguggacggccccauggacaagaaggaggaguaa

SEQ ID NO: 14140 - RNA, 2751 nt, Artificial Sequence
  BCAR1__Homo_sapiens__NP_001164185
augcccgccaagcccuuccugagcagcgugcugcugagcuggaaggugcuggacuucagcggccccggcccccagggcaccggccagcccugcagcugcggccacugggccgagggccagggcggcccccccgagcccgccggcggccccaacgugcuggccaaggcccuguacgacaacguggccgagagccccgacgagcugagcuucagaaagggcgacaucaugaccgugcuggagcaggacacccagggccuggacggcugguggcugugcagccugcacggcagacagggcaucgugcccggcaacagacugaagauccuggugggcauguacgacaagaagcccgccggccccggccccggcccccccgccacccccgcccagccccagcccggccugcacgcccccgccccccccgccagccaguacacccccaugcugcccaacaccuaccagccccagcccgacagcguguaccuggugcccacccccagcaaggcccagcagggccuguaccaggugcccggccccagcccccaguuccagagcccccccgccaagcagaccagcaccuucagcaagcagaccccccaccaccccuuccccagccccgccaccgaccuguaccaggugccccccggccccggcggccccgcccaggacaucuaccaggugccccccagcgccggcaugggccacgacaucuaccaggugccccccagcauggacaccagaagcugggagggcaccaagccccccgccaaggugguggugcccaccagagugggccagggcuacguguacgaggccgcccagcccgagcaggacgaguacgacauccccagacaccugcuggcccccggcccccaggacaucuacgacgugccccccgugagaggccugcugcccagccaguacggccaggagguguacgacaccccccccauggccgugaagggccccaacggcagagacccccugcuggagguguacgacgugccccccagcguggagaagggccugccccccagcaaccaccacgccguguacgacgugccccccagcgugagcaaggacgugcccgacggcccccugcugagagaggagaccuacgacgugccccccgccuucgccaaggccaagcccuucgaccccgccagaaccccccuggugcuggccgcccccccccccgacagcccccccgccgaggacguguacgacgugcccccccccgcccccgaccuguacgacgugccccccggccugagaagacccggccccggcacccuguacgacgugcccagagagagagugcugccccccgagguggccgacggcggcgugguggacagcggcguguacgccgugcccccccccgccgagagagaggcccccgccgagggcaagagacugagcgccagcagcaccggcagcaccagaagcagccagagcgccagcagccuggagguggccggccccggcagagagccccuggagcuggagguggccguggaggcccuggccagacugcagcagggcgugagcgccaccguggcccaccugcuggaccuggccggcagcgccggcgccaccggcagcuggagaagccccagcgagccccaggagccccuggugcaggaccugcaggccgccguggccgccgugcagagcgccgugcacgagcugcuggaguucgccagaagcgccgugggcaacgccgcccacaccagcgacagagcccugcacgccaagcugagcagacagcugcagaagauggaggacgugcaccagacccugguggcccacggccaggcccuggacgccggcagaggcggcagcggcgccacccuggaggaccuggacagacugguggccugcagcagagccgugcccgaggacgccaagcagcuggccagcuuccugcacggcaacgccagccugcuguucagaagaaccaaggccaccgcccccggccccgagggcggcggcacccugcaccccaaccccaccgacaagaccagcagcauccagagcagaccccugcccagcccccccaaguucaccagccaggacagccccgacggccaguacgagaacagcgagggcggcuggauggaggacuacgacuacgugcaccugcagggcaaggaggaguucgagaagacccagaaggagcugcuggagaagggcagcaucaccagacagggcaagagccagcuggagcugcagcagcugaagcaguucgagagacuggagcaggaggugagcagacccaucgaccacgaccuggccaacuggacccccgcccagccccuggcccccggcagaaccggcggccugggccccagcgacagacagcugcugcuguucuaccuggagcagugcgaggccaaccugaccacccugaccaacgccguggacgccuucuucaccgccguggccaccaaccagccccccaagaucuucguggcccacagcaaguucgugauccugagcgcccacaagcugguguucaucggcgacacccugagcagacaggccaaggccgccgacgugagaagccaggugacccacuacagcaaccugcugugcgaccugcugagaggcaucguggccaccaccaaggccgccgcccugcaguaccccagccccagcgccgcccaggacaugguggagagagugaaggagcugggccacagcacccagcaguucagaagagugcugggccagcuggccgccgccuaa

SEQ ID NO: 14141 - RNA, 1755 nt, Artificial Sequence
  BCAS1__Homo_sapiens__NP_003648
augggcaaccagaugagcgugccccagagaguggaggaccaggagaacgagcccgaggccgagaccuaccaggacaacgccagcgcccugaacggcgugcccgugguggugagcacccacaccgugcagcaccuggaggagguggaccugggcaucagcgugaagaccgacaacguggccaccagcagccccgagaccaccgagaucagcgccguggccgacgccaacggcaagaaccugggcaaggaggccaagcccgaggcccccgccgccaagagcagauucuuccugaugcugagcagacccgugcccggcagaaccggcgaccaggccgccgacagcagccugggcagcgugaagcuggacgugagcagcaacaaggcccccgccaacaaggaccccagcgagagcuggacccugcccguggccgccggccccggccaggacaccgacaagacccccggccacgcccccgcccaggacaaggugcugagcgccgccagagaccccacccugcugccccccgagaccggcggcgccggcggcgaggcccccagcaagcccaaggacagcagcuucuucgacaaguucuucaagcuggacaagggccaggagaaggugcccggcgacagccagcaggaggccaagagagccgagcaccaggacaagguggacgaggugcccggccugagcggccagagcgacgacgugcccgccggcaaggacaucguggacggcaaggagaaggagggccaggagcugggcaccgccgacugcagcgugcccggcgaccccgagggccuggagaccgccaaggacgacagccaggccgccgccaucgccgagaacaacaacagcaucaugagcuucuucaagacccuggugagccccaacaaggccgagaccaagaaggaccccgaggacaccggcgccgagaagagccccaccaccagcgccgaccugaagagcgacaaggccaacuucaccagccaggagacccagggcgccggcaagaacagcaagggcugcaaccccagcggccacacccagagcgugaccacccccgagcccgccaaggagggcaccaaggagaagagcggccccaccagccugccccugggcaagcuguucuggaagaagagcgugaaggaggacagcgugcccaccggcgccgaggagaacguggugugcgagagccccguggagaucaucaagagcaaggagguggagagcgcccugcagaccguggaccugaacgagggcgacgccgcccccgagcccaccgaggccaagcugaagagagaggagagcaagcccagaaccagccugauggccuuccugagacagaugagcgugaagggcgacggcggcaucacccacagcgaggagaucaacggcaaggacagcagcugccagaccagcgacagcaccgagaagaccaucaccccccccgagcccgagcccaccggcgccccccagaagggcaaggagggcagcagcaaggacaagaagagcgccgccgagaugaacaagcagaagagcaacaagcaggaggccaaggagcccgcccagugcaccgagcaggccaccguggacaccaacagccugcagaacggcgacaagcugcagaagagacccgagaagagacagcagagccugggcggcuucuucaagggccugggccccaagagaaugcuggacgcccaggugcagaccgaccccgugagcaucggccccgugggcaagagcaaguaa

SEQ ID NO: 14142 - RNA, 2787 nt, Artificial Sequence
  BCAS3__Homo_sapiens__NP_001092902
augaacgaggccauggccaccgacagccccagaagacccagcagaugcaccggcggcgugguggugagaccccaggccgugaccgagcagagcuacauggagagcguggugaccuuccugcaggacguggugccccaggccuacagcggcaccccccugaccgaggagaaggagaagaucgugugggugagauucgagaacgccgaccugaacgacaccagcagaaaccuggaguuccacgagauccacagcaccggcaacgagcccccccugcugaucaugaucggcuacagcgacggcaugcagguguggagcauccccaucagcggcgaggcccaggagcuguucagcgugagacacggccccaucagagccgccagaauccugcccgccccccaguucggcgcccagaagugcgacaacuucgccgagaagagaccccugcugggcgugugcaagagcaucggcagcagcggcaccagcccccccuacugcugcguggaccuguacagccugagaaccggcgagauggugaagagcauccaguucaagacccccaucuacgaccugcacugcaacaagagaauccuggugguggugcugcaggagaagaucgccgccuucgacagcugcaccuucaccaagaaguucuucgugaccagcugcuaccccugccccggccccaacaugaaccccaucgcccugggcagcagauggcuggccuacgccgagaacaagcugaucagaugccaccagagcagaggcggcgccugcggcgacaacauccagagcuacaccgccaccgugaucagcgccgccaagacccugaagagcggccugaccauggugggcaagguggugacccagcugaccggcacccugcccagcggcgugaccgaggacgacguggccauccacagcaacagcagaagaagcccccuggugcccggcaucaucaccgugaucgacaccgagaccgugggcgagggccaggugcuggugagcgaggacagcgacagcgacggcaucguggcccacuuccccgcccacgagaagcccgugugcugcauggccuucaacaccagcggcaugcugcuggugaccaccgacacccugggccacgacuuccacguguuccagauccugacccaccccuggagcagcagccagugcgccgugcaccaccuguacacccugcacagaggcgagaccgaggccaaggugcaggacaucugcuucagccacgacugcagaugggugguggugagcacccugagaggcaccagccacguguuccccaucaaccccuacggcggccagcccugcgugagaacccacaugagccccagaguggugaacagaaugagcagauuccagaagagcgccggccuggaggagaucgagcaggagcugaccagcaagcagggcggcagaugcagccccgugcccggccugagcagcagccccagcggcagcccccugcacggcaagcugaacagccaggacagcuacaacaacuucaccaacaacaaccccggcaaccccagacugagcccccugcccagccugaugguggugaugccccuggcccagaucaagcagcccaugacccugggcaccaucaccaagagaaccggccccuaccuguucggcgccggcugcuucagcaucaaggcccccugcaaggugaagccccccccccagaucagccccagcaagagcaugggcggcgaguucugcguggccgccaucuucggcaccagcagaagcugguucgccaacaacgccggccugaagagagagaaggaccagagcaagcagguggugguggagagccuguacaucaucagcugcuacggcacccugguggagcacaugauggagcccagaccccugagcaccgcccccaagaucagcgacgacaccccccuggagaugaugaccagccccagagccagcuggacccuggugagaaccccccaguggaacgagcugcagccccccuucaacgccaaccacccccugcugcuggccgccgacgccgugcaguacuaccaguuccugcuggccggccuggugccccccggcagccccggccccaucaccagacacggcagcuacgacagccuggccagcgaccacagcggccaggaggacgaggaguggcugagccagguggagaucgugacccacaccggcccccacagaagacuguggaugggcccccaguuccaguucaagaccauccaccccagcggccagaccaccgugaucagcagcagcagcagcgugcugcagagccacggccccagcgacaccccccagccccugcuggacuucgacaccgacgaccuggaccugaacagccugagaauccagcccgugagaagcgaccccgugagcaugcccggcagcagcagacccgugagcgacagaagaggcgugagcaccgugaucgacgccgccagcggcaccuucgacagaagcgugacccugcuggaggugugcggcagcuggcccgagggcuucggccugagacacaugagcagcauggagcacaccgaggagggccugagagagagacuggccgacgccauggccgagagccccagcagagacguggugggcagcggcaccgagcugcagagagagggcagcaucgagacccugagcaacagcagcggcagcaccagcggcagcauccccagaaacuucgacggcuacagaagcccccugcccaccaacgagagccagccccugagccuguuccccaccggcuuccccuaa

SEQ ID NO: 14143 - RNA, 477 nt, Artificial Sequence
  BCAS4__Homo_sapiens__NP_001010974
augcagagaaccggcggcggcgcccccagacccggcagaaaccacggccugcccggcagccugagacagcccgaccccguggcccugcugaugcugcugguggacgccgaccagcccgagcccaugagaagcggcgccagagagcuggcccuguuccugacccccgagcccggcgccgaggccaaggagguggaggagaccaucgagggcaugcugcugagacuggaggaguucugcagccuggccgaccugaucagaagcgacaccagccagauccuggaggagaacauccccgugcugaaggccaagcugaccgagaugagaggcaucuacgccaagguggacagacuggagaagagccccgcccccgugcccgugaccuacgagcugcccacccuguacagaaccgaggacuacuuccccguggacgccggcgaggcccagcaccaccccagaaccugccccagaccccuguaa

SEQ ID NO: 14144 - RNA, 1050 nt, Artificial Sequence
  BCAT1__Homo_sapiens__NP_001171562
augaaggacugcagcaacggcugcagcgccgagugcaccggcgagggcggcagcaaggagguggugggcaccuucaaggccaaggaccugaucgugacccccgccaccauccugaaggagaagcccgaccccaacaaccugguguucggcaccguguucaccgaccacaugcugaccguggaguggagcagcgaguucggcugggagaagccccacaucaagccccugcagaaccugagccugcaccccggcagcagcgcccugcacuacgccguggagguguucgacaaggaggagcugcuggagugcauccagcagcuggugaagcuggaccaggagugggugcccuacagcaccagcgccagccuguacaucagacccaccuucaucggcaccgagcccagccugggcgugaagaagcccaccaaggcccugcuguucgugcugcugagccccgugggccccuacuucagcagcggcaccuucaaccccgugagccugugggccaaccccaaguacgugagagccuggaagggcggcaccggcgacugcaagaugggcggcaacuacggcagcagccuguucgcccagugcgaggccguggacaacggcugccagcaggugcuguggcuguacggcgaggaccaccagaucaccgaggugggcaccaugaaccuguuccuguacuggaucaacgaggacggcgaggaggagcuggccacccccccccuggacggcaucauccugcccggcgugaccagaagaugcauccuggaccuggcccaccaguggggcgaguucaaggugagcgagagauaccugaccauggacgaccugaccaccgcccuggagggcaacagagugagagagauguucggcagcggcaccgccugcguggugugccccgugagcgacauccuguacaagggcgagaccauccacauccccaccauggagaacggccccaagcuggccagcagaauccugagcaagcugaccgacauccaguacggcagagaggagagcgacuggaccaucgugcugagcuaa

SEQ ID NO: 14145 - RNA, 903 nt, Artificial Sequence
  BCAT2__Homo_sapiens__NP_001158245
auggccgccgccgcccugggccagcuguucgagggcaugaaggccuucaagggcaaggaccagcaggugagacuguucagacccuggcugaacauggacagaaugcugagaagcgccaugagacugugccugcccagcuucgacaagcuggagcugcuggagugcaucagaagacugaucgagguggacaaggacugggugcccgacgccgccggcaccagccuguacgugagacccgugcugaucggcaacgagcccagccugggcgugagccagcccaccagagcccugcuguucgugauccugugccccgugggcgccuacuuccccggcggcagcgugacccccgugagccugcuggccgaccccgccuucaucagagccugggugggcggcgugggcaacuacaagcugggcggcaacuacggccccaccgugcuggugcagcaggaggcccugaagagaggcugcgagcaggugcuguggcuguacggccccgaccaccagcugaccgaggugggcaccaugaacaucuucguguacuggacccacgaggacggcgugcuggagcuggugacccccccccugaacggcgugauccugcccggcguggugagacagagccugcuggacauggcccagaccuggggcgaguucagagugguggagagaaccaucaccaugaagcagcugcugagagcccuggaggagggcagagugagagagguguucggcagcggcaccgccugccaggugugccccgugcacagaauccuguacaaggacagaaaccugcacauccccaccauggagaacggccccgagcugauccugagauuccagaaggagcugaaggagauccaguacggcaucagagcccacgaguggauguuccccguguaa

SEQ ID NO: 14146 - RNA, 969 nt, Artificial Sequence
  BCCIP__Homo_sapiens__NP_057651
auggccagcagaagcaagagaagagccguggagagcggcgugccccagccccccgacccccccgugcagagagacgaggaggaggagaaggagguggagaacgaggacgaggacgacgacgacagcgacaaggagaaggacgaggaggacgaggugaucgacgaggaggugaacaucgaguucgaggccuacagccugagcgacaacgacuacgacggcaucaagaagcugcugcagcagcuguuccugaaggcccccgugaacaccgccgagcugaccgaccugcugauccagcagaaccacaucggcagcgugaucaagcagaccgacgugagcgaggacagcaacgacgacauggacgaggacgagguguucggcuucaucagccugcugaaccugaccgagagaaagggcacccagugcguggagcagauccaggagcuggugcugagauucugcgagaagaacugcgagaagagcaugguggagcagcuggacaaguuccugaacgacaccaccaagcccgugggccugcugcugagcgagagauucaucaacgugcccccccagaucgcccugcccauguaccagcagcugcagaaggagcuggccggcgcccacagaaccaacaagcccugcggcaagugcuacuucuaccugcugaucagcaagaccuucguggaggccggcaagaacaacagcaagaagaagcccagcaacaagaagaaggccgcccugauguucgccaacgccgaggaggaguucuucuacgaggagcagggcaagcccgaggugcugggcggccccgacaccagaagaggccuggagcccgugcccauccagcacaacggcggcagcagaggccaggugaccgcccuggugagccugaaggccggccugauccagagcagaagcacccugagcgacuuccagggcaccuucaugaccgugggcaucgcccugagcuaa

SEQ ID NO: 14147 - RNA, 879 nt, Artificial Sequence
  BCDIN3D__Homo_sapiens__NP_859059
auggccgugcccaccgagcuggacggcggcagcgugaaggagaccgccgccgaggaggagagcagagugcuggcccccggcgccgcccccuucggcaacuucccccacuacagcagauuccacccccccgagcagagacugagacugcugccccccgagcugcugagacagcuguuccccgagagccccgagaacggccccauccugggccuggacgugggcugcaacagcggcgaccugagcguggcccuguacaagcacuuccugagccugcccgacggcgagaccugcagcgacgccagcagagaguucagacugcugugcugcgacaucgaccccgugcuggugaagagagccgagaaggagugccccuuccccgacgcccugaccuucaucacccuggacuucaugaaccagagaaccagaaaggugcugcugagcagcuuccugagccaguucggcagaagcguguucgacaucggcuucugcaugagcaucaccauguggauccaccugaaccacggcgaccacggccugugggaguuccuggcccaccugagcagccugugccacuaccugcugguggagccccagcccuggaagugcuacagagccgccgccagaagacugagaaagcugggccugcacgacuucgaccacuuccacagccuggccaucagaggcgacaugcccaaccagaucgugcagauccugacccaggaccacggcauggagcugaucugcugcuucggcaacaccagcugggacagaagccugcugcuguucagagccaagcagaccaucgagacccaccccauccccgagagccugaucgagaagggcaaggagaagaacagacugagcuuccagaagcaguaa

SEQ ID NO: 14148 - RNA, 1809 nt, Artificial Sequence
  BCHE__Homo_sapiens__NP_000046
augcacagcaaggugaccaucaucugcaucagauuccuguucugguuccugcugcugugcaugcugaucggcaagagccacaccgaggacgacaucaucaucgccaccaagaacggcaaggugagaggcaugaaccugaccguguucggcggcaccgugaccgccuuccugggcauccccuacgcccagcccccccugggcagacugagauucaagaagccccagagccugaccaaguggagcgacaucuggaacgccaccaaguacgccaacagcugcugccagaacaucgaccagagcuuccccggcuuccacggcagcgagauguggaaccccaacaccgaccugagcgaggacugccuguaccugaacguguggauccccgcccccaagcccaagaacgccaccgugcugaucuggaucuacggcggcggcuuccagaccggcaccagcagccugcacguguacgacggcaaguuccuggccagaguggagagagugaucguggugagcaugaacuacagagugggcgcccugggcuuccuggcccugcccggcaaccccgaggcccccggcaacaugggccuguucgaccagcagcuggcccugcagugggugcagaagaacaucgccgccuucggcggcaaccccaagagcgugacccuguucggcgagagcgccggcgccgccagcgugagccugcaccugcugagccccggcagccacagccuguucaccagagccauccugcagagcggcagcuucaacgcccccugggccgugaccagccuguacgaggccagaaacagaacccugaaccuggccaagcugaccggcugcagcagagagaacgagaccgagaucaucaagugccugagaaacaaggacccccaggagauccugcugaacgaggccuucguggugcccuacggcaccccccugagcgugaacuucggccccaccguggacggcgacuuccugaccgacaugcccgacauccugcuggagcugggccaguucaagaagacccagauccuggugggcgugaacaaggacgagggcaccgccuuccugguguacggcgcccccggcuucagcaaggacaacaacagcaucaucaccagaaaggaguuccaggagggccugaagaucuucuuccccggcgugagcgaguucggcaaggagagcauccuguuccacuacaccgacuggguggacgaccagagacccgagaacuacagagaggcccugggcgacguggugggcgacuacaacuucaucugccccgcccuggaguucaccaagaaguucagcgaguggggcaacaacgccuucuucuacuacuucgagcacagaagcagcaagcugcccuggcccgaguggaugggcgugaugcacggcuacgagaucgaguucguguucggccugccccuggagagaagagacaacuacaccaaggccgaggagauccugagcagaagcaucgugaagagaugggccaacuucgccaaguacggcaaccccaacgagacccagaacaacagcaccagcuggcccguguucaagagcaccgagcagaaguaccugacccugaacaccgagagcaccagaaucaugaccaagcugagagcccagcagugcagauucuggaccagcuucuuccccaaggugcuggagaugaccggcaacaucgacgaggccgagugggaguggaaggccggcuuccacagauggaacaacuacaugauggacuggaagaaccaguucaacgacuacaccagcaagaaggagagcugcgugggccuguaa

SEQ ID NO: 14149 - RNA, 1338 nt, Artificial Sequence
  BCKDHA__Homo_sapiens__NP_000700
auggccguggccaucgccgccgccagaguguggagacugaacagaggccugagccaggccgcccugcugcugcugagacagcccggcgccagaggccuggccagaagccacccccccagacagcagcagcaguucagcagccuggacgacaagccccaguuccccggcgccagcgccgaguucaucgacaagcuggaguucauccagcccaacgugaucagcggcauccccaucuacagagugauggacagacagggccagaucaucaaccccagcgaggacccccaccugcccaaggagaaggugcugaagcuguacaagagcaugacccugcugaacaccauggacagaauccuguacgagagccagagacagggcagaaucagcuucuacaugaccaacuacggcgaggagggcacccacgugggcagcgccgccgcccuggacaacaccgaccugguguucggccaguacagagaggccggcgugcugauguacagagacuacccccuggagcuguucauggcccagugcuacggcaacaucagcgaccugggcaagggcagacagaugcccgugcacuacggcugcaaggagagacacuucgugaccaucagcagcccccuggccacccagaucccccaggccgugggcgccgccuacgccgccaagagagccaacgccaacagaguggugaucugcuacuucggcgagggcgccgccagcgagggcgacgcccacgccggcuucaacuucgccgccacccuggagugccccaucaucuucuucugcagaaacaacggcuacgccaucagcacccccaccagcgagcaguacagaggcgacggcaucgccgccagaggccccggcuacggcaucaugagcaucagaguggacggcaacgacguguucgccguguacaacgccaccaaggaggccagaagaagagccguggccgagaaccagcccuuccugaucgaggccaugaccuacagaaucggccaccacagcaccagcgacgacagcagcgccuacagaagcguggacgaggugaacuacugggacaagcaggaccaccccaucagcagacugagacacuaccugcugagccagggcuggugggacgaggagcaggagaaggccuggagaaagcagagcagaagaaaggugauggaggccuucgagcaggccgagagaaagcccaagcccaaccccaaccugcuguucagcgacguguaccaggagaugcccgcccagcugagaaagcagcaggagagccuggccagacaccugcagaccuacggcgagcacuacccccuggaccacuucgacaaguaa

SEQ ID NO: 14150 - RNA, 1179 nt, Artificial Sequence
  BCKDHB__Homo_sapiens__NP_000047
auggccgugguggccgccgccgccggcuggcugcugagacugagagccgccggcgccgagggccacuggagaagacugcccggcgccggccuggccagaggcuuccugcaccccgccgccaccguggaggacgccgcccagagaagacagguggcccacuucaccuuccagcccgaccccgagcccagagaguacggccagacccagaagaugaaccuguuccagagcgugaccagcgcccuggacaacagccuggccaaggaccccaccgccgugaucuucggcgaggacguggccuucggcggcguguucagaugcaccgugggccugagagacaaguacggcaaggacagaguguucaacaccccccugugcgagcagggcaucgugggcuucggcaucggcaucgccgugaccggcgccaccgccaucgccgagauccaguucgccgacuacaucuuccccgccuucgaccagaucgugaacgaggccgccaaguacagauacagaagcggcgaccuguucaacugcggcagccugaccaucagaagccccuggggcugcgugggccacggcgcccuguaccacagccagagccccgaggccuucuucgcccacugccccggcaucaagguggugauccccagaagccccuuccaggccaagggccugcugcugagcugcaucgaggacaagaaccccugcaucuucuucgagcccaagauccuguacagagccgccgccgaggaggugcccaucgagcccuacaacaucccccugagccaggccgaggugauccaggagggcagcgacgugacccugguggccuggggcacccaggugcacgugaucagagagguggccagcauggccaaggagaagcugggcgugagcugcgaggugaucgaccugagaaccaucauccccugggacguggacaccaucugcaagagcgugaucaagaccggcagacugcugaucagccacgaggccccccugaccggcggcuucgccagcgagaucagcagcaccgugcaggaggagugcuuccugaaccuggaggcccccaucagcagagugugcggcuacgacacccccuucccccacaucuucgagcccuucuacauccccgacaaguggaagugcuacgacgcccugagaaagaugaucaacuacuaa

SEQ ID NO: 14151 - RNA, 1098 nt, Artificial Sequence
  BCKDK__Homo_sapiens__NP_001116429
augauccuggccagcgugcugagaagcggccccggcggcggccugccccugagaccccugcugggccccgcccuggcccugagagccagaagcaccagcgccaccgacacccaccacguggagauggccagagagagaagcaagaccgugaccagcuucuacaaccagagcgccaucgacgccgccgccgagaagcccagcgugagacugacccccaccaugaugcuguacgccggcagaagccaggacggcagccaccugcugaagagcgccagauaccugcagcaggagcugcccgugagaaucgcccacagaaucaagggcuucagaugccugcccuucaucaucggcugcaaccccaccauccugcacgugcacgagcuguacaucagagccuuccagaagcugaccgacuucccccccaucaaggaccaggccgacgaggcccaguacugccagcuggugagacagcugcuggacgaccacaaggacguggugacccugcuggccgagggccugagagagagcagaaagcacaucgaggacgagaagcuggugagauacuuccuggacaagacccugaccagcagacugggcaucagaaugcuggccacccaccaccuggcccugcacgaggacaagcccgacuucgugggcaucaucugcaccagacugagccccaagaagaucaucgagaaguggguggacuucgccagaagacugugcgagcacaaguacggcaacgcccccagagugagaaucaacggccacguggccgccagauuccccuucauccccaugccccuggacuacauccugcccgagcugcugaagaacgccaugagagccaccauggagagccaccuggacacccccuacaacgugcccgacguggugaucaccaucgccaacaacgacguggaccugaucaucagaaucagcgacagaggcggcggcaucgcccacaaggaccuggacagagugauggacuaccacuucaccaccgccgaggccagcacccaggaccccagaaucagcccccuguucggccaccuggacaugcacagcggcgcccagagcggccccaugcacggcuaa

SEQ ID NO: 14152 - RNA, 648 nt, Artificial Sequence
  BCL10__Homo_sapiens__XP_011540701
auggcccuggagaaccugagaguguaccugugcgagaagaucaucgccgagagacacuucgaccaccugagagccaagaagauccugagcagagaggacaccgaggagaucagcugcagaaccagcagcagaaagagagccggcaagcugcuggacuaccugcaggagaaccccaagggccuggacacccugguggagagcaucagaagagagaagacccagaacuuccugauccagaagaucaccgacgaggugcugaagcugagaaacaucaagcuggagcaccugaagggccugaagugcagcagcugcgagcccuuccccgacggcgccaccaacaaccugagcagaagcaacagcgacgagagcaacuucagcgagaagcugagagccagcaccgugauguaccaccccgagggcgagagcagcaccacccccuucuucagcaccaacagcagccugaaccugcccgugcuggaggugggcagaaccgagaacaccaucuucagcagcaccacccugcccagacccggcgaccccggcgcccccccccugccccccgaccugcagcuggaggaggagggcaccugcgccaacagcagcgagauguuccugccccugagaagcagaaccgugagcagacaguaa

SEQ ID NO: 14153 - RNA, 2322 nt, Artificial Sequence
  BCL11A__Homo_sapiens__NP_060484
augagcagaagaaagcagggcaagccccagcaccugagcaagagagaguucagccccgagccccuggaggccauccugaccgacgacgagcccgaccacggcccccugggcgcccccgagggcgaccacgaccugcugaccugcggccagugccagaugaacuucccccugggcgacauccugaucuucaucgagcacaagagaaagcagugcaacggcagccugugccuggagaaggccguggacaagccccccagccccagccccaucgagaugaagaaggccagcaaccccguggaggugggcauccaggugacccccgaggacgacgacugccugagcaccagcagcagaggcaucugccccaagcaggagcacaucgccgacaagcugcugcacuggagaggccugagcagccccagaagcgcccacggcgcccugauccccacccccggcaugagcgccgaguacgccccccagggcaucugcaaggacgagcccagcagcuacaccugcaccaccugcaagcagcccuucaccagcgccugguuccugcugcagcacgcccagaacacccacggccugagaaucuaccuggagagcgagcacggcagcccccugacccccagagugggcauccccagcggccugggcgccgagugccccagccagcccccccugcacggcauccacaucgccgacaacaaccccuucaaccugcugagaauccccggcagcgugagcagagaggccagcggccuggccgagggcagauucccccccacccccccccuguucagccccccccccagacaccaccuggacccccacagaaucgagagacugggcgccgaggagauggcccuggccacccaccaccccagcgccuucgacagagugcugagacugaaccccauggccauggagccccccgccauggacuucagcagaagacugagagagcuggccggcaacaccagcagccccccccugagccccggcagacccagccccaugcagagacugcugcagcccuuccagcccggcagcaagccccccuuccuggccacccccccccugcccccccugcagagcgcccccccccccagccagccccccgugaagagcaagagcugcgaguucugcggcaagaccuucaaguuccagagcaaccugguggugcacagaagaagccacaccggcgagaagcccuacaagugcaaccugugcgaccacgccugcacccaggccagcaagcugaagagacacaugaagacccacaugcacaagagcagccccaugaccgugaagagcgacgacggccugagcaccgccagcagccccgagcccggcaccagcgaccuggugggcagcgccagcagcgcccugaagagcgugguggccaaguucaagagcgagaacgaccccaaccugauccccgagaacggcgacgaggaggaggaggaggacgacgaggaggaggaggaggaggaggaggaggaggaggaggagcugaccgagagcgagagaguggacuacggcuucggccugagccuggaggccgccagacaccacgagaacagcagcagaggcgccguggugggcgugggcgacgagagcagagcccugcccgacgugaugcagggcauggugcugagcagcaugcagcacuucagcgaggccuuccaccaggugcugggcgagaagcacaagagaggccaccuggccgaggccgagggccacagagacaccugcgacgaggacagcguggccggcgagagcgacagaaucgacgacggcaccgugaacggcagaggcugcagccccggcgagagcgccagcggcggccugagcaagaagcugcugcugggcagccccagcagccugagccccuucagcaagagaaucaagcuggagaaggaguucgaccugccccccgccgccaugcccaacaccgagaacguguacagccaguggcuggccggcuacgccgccagcagacagcugaaggaccccuuccugagcuucggcgacagcagacagagccccuucgccagcagcagcgagcacagcagcgagaacggcagccugagauucagcaccccccccggcgagcuggacggcggcaucagcggcagaagcggcaccggcagcggcggcagcaccccccacaucagcggccccggccccggcagacccagcagcaaggagggcagaagaagcgacaccugcagcagccacacccccaucagaagaagcacccagagagcccaggacguguggcaguucagcgacggcagcagcagagcccugaaguucuaa

SEQ ID NO: 14154 - RNA, 2472 nt, Artificial Sequence
  BCL11B__Homo_sapiens__NP_075049
augagcagaagaaagcagggcaacccccagcaccugagccagagagagcugaucacccccgaggccgaccacguggaggccgccauccuggaggaggacgagggccuggagaucgaggagcccagcggccugggccugauggugggcggccccgaccccgaccugcugaccugcggccagugccagaugaacuucccccugggcgacauccugguguucaucgagcacaagagaaagcagugcggcggcagccugggcgccugcuacgacaaggcccuggacaaggacagccccccccccagcagcagaagcgagcugagaaaggugagcgagcccguggagaucggcauccaggugacccccgacgaggacgaccaccugcugagccccaccaagggcaucugccccaagcaggagaacaucgccggcaaggacgagcccagcagcuacaucugcaccaccugcaagcagcccuucaacagcgccugguuccugcugcagcacgcccagaacacccacggcuucagaaucuaccuggagcccggccccgccagcagcagccugacccccagacugaccaucccccccccccugggccccgaggccguggcccagagcccccugaugaacuuccugggcgacagcaaccccuucaaccugcugagaaugaccggccccauccugagagaccaccccggcuucggcgagggcagacugcccggcacccccccccuguucagccccccccccagacaccaccuggacccccacagacugagcgccgaggagaugggccugguggcccagcaccccagcgccuucgacagagugaugagacugaaccccauggccaucgacagccccgccauggacuucagcagaagacugagagagcuggccggcaacagcagcacccccccccccgugagccccggcagaggcaaccccaugcacagacugcugaaccccuuccagcccagccccaagagccccuuccugagcacccccccccugccccccaugccccccggcggcaccccccccccccagccccccgccaagagcaagagcugcgaguucugcggcaagaccuucaaguuccagagcaaccugaucgugcacagaagaagccacaccggcgagaagcccuacaagugccagcugugcgaccacgccugcagccaggccagcaagcugaagagacacaugaagacccacaugcacaaggccggcagccuggccggcagaagcgacgacggccugagcgccgccagcagccccgagcccggcaccagcgagcuggccggcgagggccugaaggccgccgacggcgacuucagacaccacgagagcgaccccagccugggccacgagcccgaggaggaggacgaggaggaggaggaggaggaggaggagcugcugcuggagaacgagagcagacccgagagcagcuucagcauggacagcgagcugagcagaaacagagagaacggcggcggcggcgugcccggcgugcccggcgccggcggcggcgccgccaaggcccuggccgacgagaaggcccuggugcugggcaaggugauggagaacgugggccugggcgcccugccccaguacggcgagcugcuggccgacaagcagaagagaggcgccuuccugaagagagccgccggcggcggcgacgccggcgacgacgacgacgccggcggcugcggcgacgccggcgccggcggcgccgugaacggcagaggcggcggcuucgcccccggcaccgagcccuuccccggccuguuccccagaaagcccgccccccugcccagccccggccugaacagcgccgccaagagaaucaagguggagaaggaccuggagcugccccccgccgcccugauccccagcgagaacguguacagccaguggcuggugggcuacgccgccagcagacacuucaugaaggaccccuuccugggcuucaccgacgccagacagagccccuucgccaccagcagcgagcacagcagcgagaacggcagccugagauucagcaccccccccggcgaccugcuggacggcggccugagcggcagaagcggcaccgccagcggcggcagcaccccccaccugggcggccccggccccggcagacccagcagcaaggagggcagaagaagcgacaccugcgaguacugcggcaagguguucaagaacugcagcaaccugaccgugcacagaagaagccacaccggcgagagacccuacaagugcgagcugugcaacuacgccugcgcccagagcagcaagcugaccagacacaugaagacccacggccagaucggcaaggagguguacagaugcgacaucugccagaugcccuucagcguguacagcacccuggagaagcacaugaagaaguggcacggcgagcaccugcugaccaacgacgugaagaucgagcaggccgagagaagcuaa

SEQ ID NO: 14155 - RNA, 492 nt, Artificial Sequence
  BCL2A1__Homo_sapiens__NP_001108207
augaccgacugcgaguucggcuacaucuacagacuggcccaggacuaccugcagugcgugcugcagaucccccagcccggcagcggccccagcaagaccagcagagugcugcagaacguggccuucagcgugcagaaggagguggagaagaaccugaagagcugccuggacaacgugaacguggugagcguggacaccgccagaacccuguucaaccaggugauggagaaggaguucgaggacggcaucaucaacuggggcagaaucgugaccaucuucgccuucgagggcauccugaucaagaagcugcugagacagcagaucgcccccgacguggacaccuacaaggagaucagcuacuucguggccgaguucaucaugaacaacaccggcgaguggaucagacagaacggcggcuggggcaaguggcacaaccacacccccaugcugguggagagcguggcccacaagaagagaaagauggcccuguaa

SEQ ID NO: 14156 - RNA, 720 nt, Artificial Sequence
  BCL2__Homo_sapiens__NP_000624
auggcccacgccggcagaaccggcuacgacaacagagagaucgugaugaaguacauccacuacaagcugagccagagaggcuacgagugggacgccggcgacgugggcgccgccccccccggcgccgcccccgcccccggcaucuucagcagccagcccggccacaccccccaccccgccgccagcagagaccccguggccagaaccagcccccugcagacccccgccgcccccggcgccgccgccggccccgcccugagccccgugccccccguggugcaccugacccugagacaggccggcgacgacuucagcagaagauacagaagagacuucgccgagaugagcagccagcugcaccugacccccuucaccgccagaggcagauucgccaccgugguggaggagcuguucagagacggcgugaacuggggcagaaucguggccuucuucgaguucggcggcgugaugugcguggagagcgugaacagagagaugagcccccugguggacaacaucgcccuguggaugaccgaguaccugaacagacaccugcacaccuggauccaggacaacggcggcugggacgccuucguggagcuguacggccccagcaugagaccccuguucgacuucagcuggcugagccugaagacccugcugagccuggcccuggugggcgccugcaucacccugggcgccuaccugggccacaaguaa

SEQ ID NO: 14157 - RNA, 615 nt, Artificial Sequence
  BCL2L10__Homo_sapiens__NP_065129
augguggaccagcugagagagagaaccaccauggccgacccccugagagagagaaccgagcugcugcuggccgacuaccugggcuacugcgccagagagcccggcacccccgagcccgcccccagcacccccgaggccgccgugcugagaagcgccgccgccagacugagacagauccacagaagcuucuucagcgccuaccugggcuaccccggcaacagauucgagcugguggcccugauggccgacagcgugcugagcgacagccccggccccaccuggggcagaguggugacccuggugaccuucgccggcacccugcuggagagaggcccccuggugaccgccagauggaagaaguggggcuuccagcccagacugaaggagcaggagggcgacguggccagagacugccagagacugguggcccugcugagcagcagacugaugggccagcacagagccuggcugcaggcccagggcggcugggacggcuucugccacuucuucagaacccccuucccccuggccuucuggagaaagcagcuggugcaggccuuccugagcugccugcugaccaccgccuucaucuaccuguggaccagacugcuguaa

SEQ ID NO: 14158 - RNA, 258 nt, Artificial Sequence
  BCL2L11__Homo_sapiens__NP_001191036
auggccaagcagcccagcgacgugagcagcgagugcgacagagagggcagacagcugcagcccgccgagagacccccccagcugagacccggcgcccccaccagccugcagaccgagccccaggccagcaugagacaggccgagcccgccgacaugagacccgagaucuggaucgcccaggagcugagaagaaucggcgacgaguucaacgccuacuacgccagaagacuggccaagcugcuggccagcagcaccuaa

SEQ ID NO: 14159 - RNA, 1002 nt, Artificial Sequence
  BCL2L12__Homo_sapiens__NP_001035758
augggcagacccgccggccuguuccccccccugugccccuuccugggcuucagacccgaggccugcugggagagacacaugcagaucgagagagcccccagcgugccccccuuccugagaugggccggcuacagacccggccccgugagaagaagaggcaagguggagcugaucaaguucgugagagugcaguggagaagaccccagguggaguggagaagaagaagauggggccccggccccggcgccagcauggccggcagcgaggagcugggccugagagaggacacccugagagugcuggccgccuuccugagaagaggcgaggccgccggcagccccgugcccaccccccccagccccgcccaggaggagcccaccgacuuccugagcagacugagaagaugccugcccugcagccugggcagaggcgccgcccccagcgagagccccagacccugcagccugcccaucagacccugcuacggccuggagcccggccccgccacccccgacuucuacgcccugguggcccagagacuggagcagcuggugcaggagcagcugaagagcccccccagccccgagcugcagggcccccccagcaccgagaaggaggccauccugagaagacugguggcccugcuggaggaggaggccgaggugaucaaccagaagcuggccagcgaccccgcccugagaagcaagcuggugagacugagcagcgacagcuucgccagacugguggagcuguucugcagcagagacgacagcagcagacccagcagagccugccccggcccccccccccccagccccgagccccuggccagacuggcccuggccauggagcugagcagaagaguggccggccugggcggcacccuggccggccugagcguggagcacgugcacagcuucacccccuggauccaggcccacggcggcugggagggcauccuggccgugagccccguggaccugaaccugccccuggacuaa

SEQ ID NO: 14160 - RNA, 1386 nt, Artificial Sequence
  BCL2L13__Homo_sapiens__NP_001257656
augagcggcagcagcggccccgcccccacccccgccgugaccaaggccagaagaggcgaccugacccugcagcacggcggcggcggcagacugggccccagagugggcgcccugaccgccgccggcggccccugcagaaagcagcugcccccccccccccugagcagccugcugggccagggccccggccccggcgugcagcuggacaucgccagccagagccuggaccaggagauccugcugaaggugaagaccgagaucgaggaggagcugaagagccuggacaaggagaucagcgaggccuucaccagcaccggcuucgacagacacaccagccccguguucagccccgccaaccccgagagcagcauggaggacugccuggcccaccugggcgagaaggugagccaggagcugaaggagccccugcacaaggcccugcagaugcugcugagccagcccgugaccuaccaggccuucagagagugcacccuggagaccaccgugcacgccagcggcuggaacaagggcaccguguucagccuggagagcgaggaggaggaguaccccggcaucaccgccgaggacagcaacgacaucuacauccugcccagcgacaacagcggccaggugagcccccccgagagccccaccgugaccaccagcuggcagagcgagagccugcccgugagccugagcgccagccagagcuggcacaccgagagccugcccgugagccugggccccgagagcuggcagcagaucgccauggaccccgaggaggugaagagccuggacagcaacggcgccggcgagaagagcgagaacaacagcagcaacagcgacaucgugcacguggagaaggaggaggugcccgagggcauggaggaggccgccguggccagcguggugcugcccgccagagagcugcaggaggcccugcccgaggcccccgccccccugcugccccacaucaccgccaccagccugcugggcaccagagagcccgacaccgaggugaucaccguggagaagagcagccccgccaccagccuguucguggagcuggacgaggaggaggugaaggccgccaccaccgagcccaccgagguggaggagguggugcccgcccuggagcccaccgagacccugcugagcgagaaggagaucaacgccagagaggagagccugguggaggagcugagccccgccagcgagaagaagcccgugccccccagcgagggcaagagcagacugagccccgccggcgagaugaagcccaugccccugagcgagggcaagagcauccugcuguucggcggcgccgccgccguggccauccuggccguggccaucggcguggcccuggcccugagaaagaaguaa

SEQ ID NO: 14161 - RNA, 759 nt, Artificial Sequence
  BCL2L14__Homo_sapiens__NP_110393
augugcagcaccagcggcugcgaccuggaggagaucccccuggacgacgacgaccugaacaccaucgaguucaagauccuggccuacuacaccagacaccacguguucaagagcacccccgcccuguucagccccaagcugcugagaaccagaagccugagccagagaggccugggcaacugcagcgccaacgagagcuggaccgaggugagcuggcccugcagaaacagccagagcagcgagaaggccaucaaccugggcaagaagaagagcagcuggaaggccuucuucggcgugguggagaaggaggacagccagagcacccccgccaaggugagcgcccagggccagagaacccuggaguaccaggacagccacagccagcaguggagcagaugccugagcaacguggagcagugccuggagcacgaggccguggaccccaaggugaucagcaucgccaacagaguggccgagaucguguacagcuggccccccccccaggccacccaggccggcggcuucaagagcaaggagaucuucgugaccgagggccugagcuuccagcugcagggccacgugcccguggccagcagcagcaagaaggacgaggaggagcagauccuggccaagaucguggagcugcugaaguacagcggcgaccagcuggagagaaaggacaccgccuucauccccaucccccugguggacaccagcauccagggcuucccccaggacggccugauggccugcaucuaa

SEQ ID NO: 14162 - RNA, 513 nt, Artificial Sequence
  BCL2L1__Homo_sapiens__NP_001182
augagccagagcaacagagagcuggugguggacuuccugagcuacaagcugagccagaagggcuacagcuggagccaguucagcgacguggaggagaacagaaccgaggcccccgagggcaccgagagcgagauggagacccccagcgccaucaacggcaaccccagcuggcaccuggccgacagccccgccgugaacggcgccaccggccacagcagcagccuggacgccagagaggugauccccauggccgccgugaagcaggcccugagagaggccggcgacgaguucgagcugagauacagaagagccuucagcgaccugaccagccagcugcacaucacccccggcaccgccuaccagagcuucgagcaggacaccuucguggagcuguacggcaacaacgccgccgccgagagcagaaagggccaggagagauucaacagaugguuccugaccggcaugaccguggccggcguggugcugcugggcagccuguucagcagaaaguaa

SEQ ID NO: 14163 - RNA, 582 nt, Artificial Sequence
  BCL2L2__Homo_sapiens__NP_004041
auggccacccccgccagcgcccccgacaccagagcccugguggccgacuucgugggcuacaagcugagacagaagggcuacgugugcggcgccggccccggcgagggccccgccgccgacccccugcaccaggccaugagagccgccggcgacgaguucgagaccagauucagaagaaccuucagcgaccuggccgcccagcugcacgugacccccggcagcgcccagcagagauucacccaggugagcgacgagcuguuccagggcggccccaacuggggcagacugguggccuucuucguguucggcgccgcccugugcgccgagagcgugaacaaggagauggagccccuggugggccaggugcaggaguggaugguggccuaccuggagaccagacuggccgacuggauccacagcagcggcggcugggccgaguucaccgcccuguacggcgacggcgcccuggaggaggccagaagacugagagagggcaacugggccagcgugagaaccgugcugaccggcgccguggcccugggcgcccuggugaccgugggcgccuucuucgccagcaaguaa

SEQ ID NO: 14164 - RNA, 1002 nt, Artificial Sequence
  BCL2L2-PABPN1__Homo_sapiens__NP_001186793
auggccacccccgccagcgcccccgacaccagagcccugguggccgacuucgugggcuacaagcugagacagaagggcuacgugugcggcgccggccccggcgagggccccgccgccgacccccugcaccaggccaugagagccgccggcgacgaguucgagaccagauucagaagaaccuucagcgaccuggccgcccagcugcacgugacccccggcagcgcccagcagagauucacccaggugagcgacgagcuguuccagggcggccccaacuggggcagacugguggccuucuucguguucggcgccgcccugugcgccgagagcgugaacaaggagauggagccccuggugggccaggugcaggaguggaugguggccuaccuggagaccagacuggccgacuggauccacagcagcggcggcugggagcuggaggccaucaaggccagagugagagagauggaggaggaggccgagaagcugaaggagcugcagaacgagguggagaagcagaugaacaugagccccccccccggcaacgccggccccgugaucaugagcaucgaggagaagauggaggccgacgccagaagcaucuacgugggcaacguggacuacggcgccaccgccgaggagcuggaggcccacuuccacggcugcggcagcgugaacagagugaccauccugugcgacaaguucagcggccaccccaagggcuucgccuacaucgaguucagcgacaaggagagcgugagaaccagccuggcccuggacgagagccuguucagaggcagacagaucaaggugauccccaagagaaccaacagacccggcaucagcaccaccgacagaggcuuccccagagccagauacagagccagaaccaccaacuacaacagcagcagaagcagauucuacagcggcuucaacagcagacccagaggcagaguguacagaggcagagccagagccaccagcugguacagccccuacuaa

SEQ ID NO: 14165 - RNA, 1365 nt, Artificial Sequence
  BCL3__Homo_sapiens__XP_011525499
augcccagaugccccgccggcgccauggacgagggccccguggaccugagaaccagacccaaggccgccggccugcccggcgccgcccugccccugagaaagagaccccugagagcccccagccccgagcccgccgcccccagaggcgccgccggccugguggugccccuggacccccugagaggcggcugcgaccugcccgccgugcccggccccccccacggccuggccagacccgaggcccuguacuaccccggcgcccugcugccccuguaccccaccagagccaugggcagccccuucccccuggugaaccugcccaccccccuguaccccaugaugugccccauggagcacccccugagcgccgacaucgccauggccaccagagccgacgaggacggcgacaccccccugcacaucgccguggugcagggcaaccugcccgccgugcacagacuggugaaccuguuccagcagggcggcagagagcuggacaucuacaacaaccugagacagaccccccugcaccuggccgugaucaccacccugcccagcguggugagacugcuggugaccgccggcgccagccccauggcccuggacagacacggccagaccgccgcccaccuggccugcgagcacagaagccccaccugccugagagcccugcuggacagcgccgcccccggcacccuggaccuggaggccagaaacuacgacggccugaccgcccugcacguggccgugaacaccgagugccaggagaccgugcagcugcugcuggagagaggcgccgacaucgacgccguggacaucaagagcggcagaagcccccugauccacgccguggagaacaacagccugagcauggugcagcugcugcugcagcacggcgccaacgugaacgcccagauguacagcggcagcagcgcccugcacagcgccagcggcagaggccugcugccccuggugagaacccuggugagaagcggcgccgacagcagccugaagaacugccacaacgacaccccccugaugguggccagaagcagaagagugaucgacauccugagaggcaaggccaccagacccgccagcaccagccagcccgaccccagccccgacagaagcgccaacaccagccccgagagcagcagcagacugagcagcaacggccugcugagcgccagccccagcagcagccccagccagagcccccccagagacccccccggcuuccccauggccccccccaacuucuuccugcccagccccagcccccccgccuuccugcccuucgccggcgugcugagaggccccggcagacccgugccccccagccccgcccccggcggcagcuaa

SEQ ID NO: 14166 - RNA, 1443 nt, Artificial Sequence
  BCL6B__Homo_sapiens__NP_862827
augggcagccccgccgcccccgagggcgcccugggcuacgugagagaguucaccagacacagcagcgacgugcugggcaaccugaacgagcugagacugagaggcauccugaccgacgugacccugcuggugggcggccagccccugagagcccacaaggccgugcugaucgccugcagcggcuucuucuacagcaucuucagaggcagagccggcgugggcguggacgugcugagccugcccggcggccccgaggccagaggcuucgccccccugcuggacuucauguacaccagcagacugagacugagccccgccaccgcccccgccgugcuggccgccgccaccuaccugcagauggagcacguggugcaggccugccacagauucauccaggccagcuacgagccccugggcaucagccugagaccccuggaggccgagccccccaccccccccaccgcccccccccccggcagccccagaagaagcgagggccaccccgacccccccaccgagagcagaagcugcagccagggcccccccagccccgccagccccgaccccaaggccugcaacuggaagaaguacaaguacaucgugcugaacagccaggccagccaggccggcagccuggugggcgagagaagcagcggccagcccugcccccaggccagacugcccagcggcgacgaggccagcagcagcagcagcagcagcagcagcagcagcagcgaggagggccccauccccggcccccagagcagacugagccccaccgccgccaccgugcaguucaagugcggcgcccccgccagcacccccuaccugcugaccagccaggcccaggacaccagcggcagccccagcgagagagccagaccccugcccggcagcgaguucuucagcugccagaacugcgaggccguggccggcugcagcagcggccuggacagccuggugcccggcgacgaggacaagcccuacaagugccagcugugcagaagcagcuucagauacaagggcaaccuggccagccacagaaccgugcacaccggcgagaagcccuaccacugcagcaucugcggcgccagauucaacagacccgccaaccugaagacccacagcagaauccacagcggcgagaagcccuacaagugcgagaccugcggcagcagauucgugcagguggcccaccugagagcccacgugcugauccacaccggcgagaagcccuaccccugccccaccugcggcaccagauucagacaccugcagacccugaagagccacgugagaauccacaccggcgagaagcccuaccacugcgaccccugcggccugcacuucagacacaagagccagcugagacugcaccugagacagaagcacggcgccgccaccaacaccaaggugcacuaccacauccugggcggccccuaa

SEQ ID NO: 14167 - RNA, 2121 nt, Artificial Sequence
  BCL6__Homo_sapiens__NP_001124317
auggccagccccgccgacagcugcauccaguucaccagacacgccagcgacgugcugcugaaccugaacagacugagaagcagagacauccugaccgacguggugaucguggugagcagagagcaguucagagcccacaagaccgugcugauggccugcagcggccuguucuacagcaucuucaccgaccagcugaagugcaaccugagcgugaucaaccuggaccccgagaucaaccccgagggcuucugcauccugcuggacuucauguacaccagcagacugaaccugagagagggcaacaucauggccgugauggccaccgccauguaccugcagauggagcacgugguggacaccugcagaaaguucaucaaggccagcgaggccgagauggugagcgccaucaagccccccagagaggaguuccugaacagcagaaugcugaugccccaggacaucauggccuacagaggcagagaggugguggagaacaaccugccccugagaagcgcccccggcugcgagagcagagccuucgcccccagccuguacagcggccugagcaccccccccgccagcuacagcauguacagccaccugcccgugagcagccugcuguucagcgacgaggaguucagagacgugagaaugcccguggccaaccccuuccccaaggagagagcccugcccugcgacagcgccagacccgugcccggcgaguacagcagacccacccuggaggugagccccaacgugugccacagcaacaucuacagccccaaggagaccauccccgaggaggccagaagcgacaugcacuacagcguggccgagggccugaagcccgccgcccccagcgccagaaacgcccccuacuuccccugcgacaaggccagcaaggaggaggagagacccagcagcgaggacgagaucgcccugcacuucgagccccccaacgccccccugaacagaaagggccuggugagcccccagagcccccagaagagcgacugccagcccaacagccccaccgagagcugcagcagcaagaacgccugcauccugcaggccagcggcagcccccccgccaagagccccaccgaccccaaggccugcaacuggaagaaguacaaguucaucgugcugaacagccugaaccagaacgccaagcccgagggccccgagcaggccgagcugggcagacugagccccagagccuacaccgccccccccgccugccagccccccauggagcccgagaaccuggaccugcagagccccaccaagcugagcgccagcggcgaggacagcaccaucccccaggccagcagacugaacaacaucgugaacagaagcaugaccggcagccccagaagcagcagcgagagccacagcccccuguacaugcacccccccaagugcaccagcugcggcagccagagcccccagcacgccgagaugugccugcacaccgccggccccaccuuccccgaggagaugggcgagacccagagcgaguacagcgacagcagcugcgagaacggcgccuucuucugcaacgagugcgacugcagauucagcgaggaggccagccugaagagacacacccugcagacccacagcgacaagcccuacaagugcgacagaugccaggccagcuucagauacaagggcaaccuggccagccacaagaccgugcacaccggcgagaagcccuacagaugcaacaucugcggcgcccaguucaacagacccgccaaccugaagacccacaccagaauccacagcggcgagaagcccuacaagugcgagaccugcggcgccagauucgugcagguggcccaccugagagcccacgugcugauccacaccggcgagaagcccuaccccugcgagaucugcggcaccagauucagacaccugcagacccugaagagccaccugagaauccacaccggcgagaagcccuaccacugcgagaagugcaaccugcacuucagacacaagagccagcugagacugcaccugagacagaagcacggcgccaucaccaacaccaaggugcaguacagagugagcgccaccgaccugccccccgagcugcccaaggccugcuaa

SEQ ID NO: 14168 - RNA, 633 nt, Artificial Sequence
  BCL7A__Homo_sapiens__NP_001019979
augagcggcagaagcgugagagccgagaccagaagcagagccaaggacgacaucaagagagugauggccgccaucgagaaggugagaaagugggagaagaagugggugaccgugggcgacaccagccugagaaucuacaagugggugcccgugaccgagcccaagguggacgacaagaacaagaacaagaagaagggcaaggacgagaagugcggcagcgaggugaccacccccgagaacagcagcagccccggcaugauggacaugcacgacgacaacagcaaccagagcagcaucgccgacgccagccccaucaagcaggagaacagcagcaacagcagccccgcccccgagcccaacagcgccgugcccagcgacggcaccgaggccaagguggacgaggcccaggccgacggcaaggagcaccccggcgccgaggacgccagcgacgagcagaacagccagagcagcauggagcacagcaugaacagcagcgagaagguggacagacagcccagcggcgacagcggccuggccgccgagaccagcgccaucagccaggaccuggagggcgugccccccagcaagaagaugaagcuggaggccagccagcagaacagcgaggagauguaa

SEQ ID NO: 14169 - RNA, 438 nt, Artificial Sequence
  BCL7B__Homo_sapiens__NP_001184173
augagcggcagaagcgugagagccgagaccagaagcagagccaaggacgacaucaagaaggugauggccgccaucgagaaggugagaaagugggagaagaagugggugaccgugggcgacaccagccugagaaucuucaagugggugcccgugaccgacagcaaggagaaggagaagagcaagagcaacagcagcgccgccagagagcccaacggcuuccccagcgacgccagcgccaacagcagccugcugcuggaguuccaggagcccagccugcccagcagcgagguggccgacgagccccccacccugaccaaggaggagcccgugccccuggagacccaggugguggaggaggaggaggacagcggcgcccccccccugaagagauucugcguggaccagcccaccgugccccagaccgccagcgagagcuaa

SEQ ID NO: 14170 - RNA, 729 nt, Artificial Sequence
  BCL7C__Homo_sapiens__NP_001273455
auggccggcagaaccgugagagccgagaccagaagcagagccaaggacgacaucaagaaggugauggccaccaucgagaaggugagaagaugggagaagagaugggugaccgugggcgacaccagccugagaaucuucaagugggugcccgugguggacccccaggaggaggagagaagaagagccggcggcggcgccgagagaagcagaggcagagagagaagaggcagaggcgccagccccagaggcggcggcccccugauccugcuggaccugaacgacgagaacagcaaccagagcuuccacagcgagggcagccugcagaagggcaccgagcccagccccggcggcaccccccagcccagcagacccgugagccccgccggcccccccgagggcgugcccgaggaggcccagccccccagacugggccaggagagagaccccggcggcaucaccgccggcagcaccgacgagccccccaugcugaccaaggaggagcccgugcccgagcugcuggaggccgaggacagcggcgugagaaugaccagaagagcccugcacgagaagggccugaagaccgagccccugagaagacugcugcccagaagaggccugagaaccaacgugagacccagcagcauggccgugcccgacaccagagcccccggcggcggcagcaaggcccccagagcccccagaaccaucccccagggcaagggcagauaa

SEQ ID NO: 14171 - RNA, 4500 nt, Artificial Sequence
  BCL9L__Homo_sapiens__NP_872363
augagaauccuggccaacaagaccagacugccccaccccagaagaagagaggcccccggcagccccccccugagccccagaggccacugcccccccgcccccgccaagcccaugcaccccgagaacaagcugaccaaccacggcaagaccggcaacggcggcgcccagagccagcaccagaacgugaaccagggccccaccugcaacgugggcagcaagggcgugggcgccggcaaccacggcgccaaggccaaccagaucagccccagcaacagcagccugaagaacccccaggccggcgugccccccuucagcagccugaagggcaaggugaagagagacagaagcgugagcguggacagcggcgagcagagagaggccggcacccccagccuggacagcgaggccaaggagguggcccccagaagcaagagaagaugcgugcuggagagaaagcagcccuacagcggcgacgaguggugcagcggccccgacagcgaggaggacgacaagcccaucggcgccacccacaacugcaacguggccgaccccgccauggccgccccccagcugggccccggccagaccacccagcugccccugagcgagagcagcgugcccggcgccccccacggccccccccccggccugagacccgacgcccccggcggcggcggcggcggcggcggcgugcccggcaagccccccagccaguucguguacguguucaccacccaccuggccaacaccgccgccgaggccgugcugcagggcagagccgacagcauccuggccuaccaccagcagaacgugcccagagccaagcuggaccaggcccccaaggugccccccacccccgagccccugccccugagcacccccagcgccggcaccccccagagccagccccccccccugccccccccccccccccccgcccccggcagcgccccccccgcccugccccccgagggcccccccgaggacagcagccaggaccuggcccccaacagcgugggcgccgccagcaccggcggcggcaccggcggcacccaccccaacacccccaccgccaccaccgccaacaacccccugccccccggcggcgaccccagcagcgcccccggccccgcccugcugggcgaggccgccgcccccggcaacggccagagaagccuggugggcagcgagggccugagcaaggagcagcuggagcacagagagagaagccugcagacccugagagacaucgagagacugcugcugagaagcggcgagaccgagcccuuccugaagggcccccccggcggcgccggcgagggcggcccccccgcccaggcccccccccccccccagcagccccccaccgccccccccagcggccugaagaaguacgaggagccccugcagagcaugaucagccagacccagagccugggcggccccccccuggagcacgaggugcccggccacccccccggcggcgacaugggccagcagaugaacaugaugauccagagacugggccaggacagccugacccccgagcagguggccuggagaaagcugcaggaggaguacuacgaggagaagagaagaaaggaggagcagaucggccugcacggcagcagaccccugcaggacaugaugggcaugggcggcaugauggugagaggcccccccccccccuaccacagcaagcccggcgaccaguggccccccggcaugggcgcccagcugagaggccccauggacgugcaggaccccaugcagcugagaggcggcccccccuuccccggccccagauuccccggcaaccagauccagagagugcccggcuucggcggcaugcagagcaugcccauggaggugcccaugaacgccaugcagagacccgugagacccggcaugggcuggaccgaggaccugccccccaugggcggccccagcaacuucgcccagaacaccaugcccuaccccggcggccagggcgaggccgagagauucaugacccccagagugagagaggagcugcugagacaccagcugcuggagaagagaagcaugggcaugcagagaccccugggcauggccggcagcggcaugggccagagcauggagauggagagaaugaugcaggcccacagacagauggaccccgccauguuccccggccagauggccggcggcgagggccuggccggcacccccaugggcauggaguucggcggcggcagaggccugcugagcccccccaugggccagagcggccugagagagguggacccccccaugggccccggcaaccugaacaugaacaugaacgugaacaugaacaugaacaugaaccugaacgugcagaugaccccccagcagcagaugcugaugagccagaagaugagaggccccggcgaccugaugggcccccagggccugagccccgaggagauggccagagugagagcccagaacagcagcggcgugaugggcggcccccagaagaugcugaugcccagccaguuccccaaccagggccagcagggcuucagcggcggccagggccccuaccaggccaugagccaggacaugggcaacacccaggacauguucagccccgaccagagcagcaugcccaugagcaacgugggcaccaccagacugagccacaugccccugccccccgccagcaacccccccggcaccgugcacagcgcccccaacagaggccugggcagaagacccagcgaccugaccaucagcaucaaccagaugggcagccccggcaugggccaccugaagagccccacccugagccaggugcacagcccccuggugaccagccccagcgccaaccugaagagcccccagacccccagccagauggugccccugcccagcgccaacccccccggcccccugaagagcccccaggugcugggcagcagccugagcgugagaagccccaccggcagccccagcagacugaagagccccagcauggccgugcccagccccggcuggguggccagccccaagaccgccaugcccagccccggcgugagccagaacaagcagcccccccugaacaugaacagcagcaccacccugagcaacauggagcagggcacccugccccccagcggccccagaagcagcagcagcgccccccccgccaacccccccagcggccugaugaaccccagccugcccuucaccagcagccccgaccccacccccagccagaacccccugagccugaugaugacccagaugagcaaguacgccaugcccagcagcaccccccuguaccacaacgccaucaagaccaucgccaccagcgacgacgagcugcugcccgacagaccccugcugcccccccccccccccccccagggcagcggccccggcaucagcaacagccagcccagccagaugcaccugaacagcgccgccgcccagagccccaugggcaugaaccugcccggccagcagccccugagccacgagcccccccccgccaugcugcccagccccaccccccugggcagcaacaucccccugcaccccaacgcccagggcaccggcggccccccccagaacagcaugaugauggcccccggcggccccgacagccugaacgcccccugcggccccgugcccagcagcagccagaugaugcccuucccccccagacugcagcagccccacggcgccauggcccccaccggcggcggcggcggcggccccggccugcagcagcacuaccccagcggcauggcccugccccccgaggaccugcccaaccagccccccggccccaugcccccccagcagcaccugaugggcaaggccauggccggcagaaugggcgacgccuacccccccggcgugcugcccggcguggccagcgugcugaacgaccccgagcugagcgaggugaucagacccacccccaccggcauccccgaguucgaccugagcagaaucauccccagcgagaagcccagcagcacccugcaguacuuccccaagagcgagaaccagccccccaaggcccagccccccaaccugcaccugaugaaccugcagaacaugauggccgagcagacccccagcagaccccccaaccugcccggccagcagggcgugcagagaggccugaacaugagcaugugccaccccggccagaugagccugcugggcagaaccggcgugcccccccagcagggcauggugccccacggccugcaccagggcgugaugagccccccccagggccugaugacccagcagaacuucaugcugaugaagcagagaggcgugggcggcgagguguacagccagcccccccacaugcugagcccccagggcagccugaugggcccccccccccagcagaaccugauggugagccacccccugagacagagaagcgugagccuggacagccagaugggcuaccugcccgcccccggcggcauggccaaccugcccuucuaa

SEQ ID NO: 14172 - RNA, 2610 nt, Artificial Sequence
  BCLAF1__Homo_sapiens__NP_001070908
augggcagaagcaacagcagaagccacagcagcagaagcaagagcagaagccagagcagcagcagaagcagaagcagaagccacagcagaaagaagagauacagaagcagaagcagaaccuacagcagaagcagaagcagagacagaauguacagcagagacuacagaagagacuacagaaacaacagaggcaugagaagacccuacggcuacagaggcagaggcagaggcuacuaccagggcggcggcggcagauaccacagaggcggcuacagacccguguggaacagaagacacagcagaagccccagaagaggcagaagcagaagcagaagccccaagagaagaagcgugagcagccagagaagcagaagcagaagcagaagaagcuacagaagcagcagaagccccagaagcagcagcagcagaagcagcagccccuacagcaagagccccgugagcaagagaagaggcagccaggagaagcagaccaagaaggccgagggcgagccccaggaggagagcccccugaagagcaagagccaggaggagcccaaggacaccuucgagcacgaccccagcgagagcaucgacgaguucaacaagagcagcgccaccagcggcgacaucuggcccggccugagcgccuacgacaacagccccagaagcccccacagccccagccccaucgccaccccccccagccagagcagcagcugcagcgacgcccccaugcugagcaccgugcacagcgccaagaacacccccagccagcacagccacagcauccagcacagccccgagagaagcggcagcggcagcgugggcaacggcagcagcagauacagccccagccagaacagccccauccaccacauccccagcagaagaagccccgccaagaccaucgccccccagaacgcccccagagacgagagcagaggcagaagcagcuucuaccccgacggcggcgaccaggagaccgccaagaccggcaaguuccugaagagauucaccgacgaggagagcagaguguuccugcuggacagaggcaacaccagagacaaggaggccagcaaggagaagggcagcgagaagggcagagccgagggcgagugggaggaccaggaggcccuggacuacuucagcgacaaggagagcggcaagcagaaguucaacgacagcgagggcgacgacaccgaggagaccgaggacuacagacaguucagaaagagcgugcuggccgaccagggcaagagcuucgccaccgccagccacagaaacaccgaggaggagggccugaaguacaagagcaaggugagccugaagggcaacagagagagcgacggcuucagagaggagaagaacuacaagcugaaggagaccggcuacgugguggagagacccagcaccaccaaggacaagcacaaggaggaggacaagaacagcgagagaaucaccgugaagaaggagacccagagccccgagcaggugaagagcgagaagcugaaggaccuguucgacuacagccccccccugcacaagaaccuggacgccagagagaagagcaccuucagagaggagagcccccugagaaucaagaugaucgccagcgacagccacagacccgaggugaagcugaagauggcccccgugccccuggacgacagcaacagacccgccagccugaccaaggacagacugcuggccagcacccuggugcacagcgugaagaaggagcaggaguucagaagcaucuucgaccacaucaagcugccccaggccagcaagagcaccagcgagagcuucauccagcacaucgugagccuggugcaccacgugaaggagcaguacuucaagagcgccgccaugacccugaacgagagauucaccagcuaccagaaggccaccgaggagcacagcaccagacagaagagccccgagauccacagaagaaucgacaucagccccagcacccugagaaagcacaccagacuggccggcgaggagagaguguucaaggaggagaaccagaagggcgacaagaagcugagaugcgacagcgccgaccugagacacgacaucgacagaagaagaaaggagagaagcaaggagagaggcgacagcaagggcagcagagagagcagcggcagcagaaagcaggagaagacccccaaggacuacaaggaguacaagagcuacaaggacgacagcaagcacaagagagagcaggaccacagcagaagcagcagcagcagcgccagccccagcagccccagcagcagagaggagaaggagagcaagaaggagagagaggaggaguucaagacccaccacgagaugaaggaguacagcggcuucgccggcgugagcagacccagaggcaccuuccacgacgacagagacgacggcguggacuacugggccaagagaggcagaggcagaggcaccuuccagagaggcagaggcagauucaacuucaagaagagcggcagcagccccaaguggacccacgacaaguaccagggcgacggcaucguggaggacgaggaggagaccauggagaacaacgaggagaagaaggacagaagaaaggaggagaaggaguaa

SEQ ID NO: 14173 - RNA, 1644 nt, Artificial Sequence
  BCO1__Homo_sapiens__NP_059125
auggacaucaucuucggcagaaacagaaaggagcagcuggagcccgugagagccaaggugaccggcaagauccccgccuggcugcagggcacccugcugagaaacggccccggcaugcacaccgugggcgagagcagauacaaccacugguucgacggccuggcccugcugcacagcuucaccaucagagacggcgagguguacuacagaagcaaguaccugagaagcgacaccuacaacaccaacaucgaggccaacagaaucguggugagcgaguucggcaccauggccuaccccgaccccugcaagaacaucuucagcaaggccuucagcuaccugagccacaccauccccgacuucaccgacaacugccugaucaacaucaugaagugcggcgaggacuucuacgccaccagcgagaccaacuacaucagaaagaucaacccccagacccuggagacccuggagaagguggacuacagaaaguacguggccgugaaccuggccaccagccacccccacuacgacgaggccggcaacgugcugaacaugggcaccagcaucguggagaagggcaagaccaaguacgugaucuucaagauccccgccaccgugcccgagggcaagaagcagggcaagagccccuggaagcacaccgagguguucugcagcauccccagcagaagccugcugagccccagcuacuaccacagcuucggcgugaccgagaacuacgugaucuuccuggagcagcccuucagacuggacauccugaagauggccaccgccuacaucagaagaaugagcugggccagcugccuggccuuccacagagaggagaagaccuacauccacaucaucgaccagagaaccagacagcccgugcagaccaaguucuacaccgacgccauggugguguuccaccacgugaacgccuacgaggaggacggcugcaucguguucgacgugaucgccuacgaggacaacagccuguaccagcuguucuaccuggccaaccugaaccaggacuucaaggagaacagcagacugaccagcgugcccacccugagaagauucgccgugccccugcacguggacaagaacgccgaggugggcaccaaccugaucaagguggccagcaccaccgccaccgcccugaaggaggaggacggccagguguacugccagcccgaguuccuguacgagggccuggagcugcccagagugaacuacgcccacaacggcaagcaguacagauacguguucgccaccggcgugcaguggagccccauccccaccaagaucaucaaguacgacauccugaccaagagcagccugaaguggagagaggacgacugcuggcccgccgagccccuguucgugcccgcccccggcgccaaggacgaggacgacggcgugauccugagcgccaucgugagcaccgacccccagaagcugcccuuccugcugauccuggacgccaagagcuucaccgagcuggccagagccagcguggacguggacaugcacauggaccugcacggccuguucaucaccgacauggacugggacaccaagaagcaggccgccagcgaggagcagagagacagagccagcgacugccacggcgccccccugaccuaa

SEQ ID NO: 14174 - RNA, 1620 nt, Artificial Sequence
  BCO2__Homo_sapiens__NP_001243326
augggcaacaccccccagaagaaggccguguucggccagugcagaggccugcccugcguggccccccugcugaccaccguggaggaggcccccagaggcaucagcgccagaguguggggccacuuccccaaguggcugaacggcagccugcugagaaucggccccggcaaguucgaguucggcaaggacaaguacaaccacugguucgacggcauggcccugcugcaccaguucagaauggccaagggcaccgugaccuacagaagcaaguuccugcagagcgacaccuacaaggccaacagcgccaagaacagaaucgugaucagcgaguucggcacccuggcccugcccgaccccugcaagaacguguucgagagauucaugagcagauucgagcugcccggcaaggccgccgccaugaccgacaacaccaacgugaacuacgugagauacaagggcgacuacuaccugugcaccgagaccaacuucaugaacaagguggacaucgagacccuggagaagaccgagaagguggacuggagcaaguucaucgccgugaacggcgccaccgcccacccccacuacgaccccgacggcaccgccuacaacaugggcaacagcuucggccccuacggcuucagcuacaaggugaucagagugccccccgagaagguggaccugggcgagaccauccacggcgugcaggugaucugcagcaucgccagcaccgagaagggcaagcccagcuacuaccacagcuucggcaugaccagaaacuacaucaucuucaucgagcagccccugaagaugaaccuguggaagaucgccaccagcaagaucagaggcaaggccuucagcgacggcaucagcugggagccccagugcaacaccagauuccacgugguggagaagagaaccggccagcugcugcccggcagauacuacagcaagcccuucgugaccuuccaccagaucaacgccuucgaggaccagggcugcgugaucaucgaccugugcugccaggacaacggcagaacccuggagguguaccagcugcagaaccugagaaaggccggcgagggccuggaccaggugcacaacagcgccgccaagagcuuccccagaagauucgugcugccccugaacgugagccugaacgcccccgagggcgacaaccugagcccccugagcuacaccagcgccagcgccgugaagcaggccgacggcaccaucuggugcagccacgagaaccugcaccaggaggaccuggagaaggagggcggcaucgaguucccccagaucuacuacgacagauucagcggcaagaaguaccacuucuucuacggcugcggcuucagacaccuggugggcgacagccugaucaagguggacgugguguggagagaggacggcuucuaccccagcgagcccguguucgugcccgcccccggcaccaacgaggaggacggcggcgugauccugagcguggugaucacccccaaccagaacgagagcaacuuccugcuggugcuggacgccaagaacuucgaggagcugggcagagccgaggugcccgugcagaugcccuacggcuuccacggcaccuucauccccaucuaa

SEQ ID NO: 14175 - RNA, 5166 nt, Artificial Sequence
  BCOR__Homo_sapiens__NP_001116855
augcugagcgccaccccccuguacggcaacgugcacagcuggaugaacagcgagagagugagaaugugcggcgccagcgaggacagaaagauccuggugaacgacggcgacgccagcaaggccagacuggagcugagagaggagaacccccugaaccacaacgugguggacgccagcaccgcccacagaaucgacggccuggccgcccugagcauggacagaaccggccugaucagagagggccugagagugcccggcaacaucguguacagcagccugugcggccugggcagcgagaagggcagagaggccgccaccagcacccugggcggccugggcuucagcagcgagagaaaccccgagaugcaguucaagcccaacacccccgagaccguggaggccagcgccgugagcggcaagccccccaacggcuucagcgccaucuacaagaccccccccggcauccagaagagcgccguggccaccgccgaggcccugggccuggacagacccgccagcgacaagcagagcccccugaacaucaacggcgccagcuaccugagacugcccugggugaaccccuacauggagggcgccacccccgccaucuaccccuuccuggacagccccaacaaguacagccugaacauguacaaggcccugcugccccagcagagcuacagccuggcccagccccuguacagccccgugugcaccaacggcgagagauuccuguaccugccccccccccacuacgugggcccccacauccccagcagccuggccagccccaugagacugagcacccccagcgccagccccgccauccccccccuggugcacugcgccgacaagagccugcccuggaagaugggcgugagccccggcaaccccguggacagccacgccuacccccacauccagaacagcaagcagcccagagugcccagcgccaaggccgugaccagcggccugcccggcgacaccgcccugcugcugccccccagccccagacccagccccagagugcaccugcccacccagcccgccgccgacaccuacagcgaguuccacaagcacuacgccagaaucagcaccagccccagcguggcccugagcaagcccuacaugaccgugagcagcgaguuccccgccgccagacugagcaacggcaaguaccccaaggcccccgagggcggcgagggcgcccagcccgugcccggccacgccagaaagaccgccgugcaggacagaaaggacggcagcagccccccccugcuggagaagcagaccgugaccaaggacgugaccgacaagccccuggaccugagcagcaaggugguggacguggacgccagcaaggccgaccacaugaagaagauggcccccaccgugcuggugcacagcagagccggcagcggccuggugcugagcggcagcgagauccccaaggagacccugagcccccccggcaacggcugcgccaucuacagaagcgagaucaucagcaccgcccccagcagcuggguggugcccggccccagccccaacgaggagaacaacggcaagagcaugagccugaagaacaaggcccuggacugggccaucccccagcagagaagcagcagcugccccagaaugggcggcaccgacgccgugaucaccaacgugagcggcagcgugagcagcgccggcagacccgccagcgccagccccgcccccaacgccaacgccgacggcaccaagaccagcagaagcagcguggagaccacccccagcgugauccagcacgugggccagccccccgccacccccgccaagcacagcagcagcaccagcagcaagggcgccaaggccagcaaccccgagcccagcuucaaggccaacgagaacggccugccccccagcagcaucuuccugagccccaacgaggccuucagaagcccccccauccccuaccccagaagcuaccugcccuaccccgcccccgagggcaucgccgugagcccccugagccugcacggcaagggccccguguacccccaccccgugcugcugcccaacggcagccuguuccccggccaccuggcccccaagcccggccugcccuacggccugcccaccggcagacccgaguucgugaccuaccaggacgcccugggccugggcauggugcaccccaugcugaucccccacacccccaucgagaucaccaaggaggagaagcccgagagaagaagcagaagccacgagagagccagauacgaggaccccacccugagaaacagauucagcgagauccuggagaccagcagcaccaagcugcaccccgacgugcccaccgacaagaaccugaagcccaaccccaacuggaaccagggcaagaccguggugaagagcgacaagcugguguacguggaccugcugagagaggagcccgacgccaagaccgacaccaacgugagcaagcccagcuucgccgccgagagcgugggccagagcgccgagccccccaagcccagcguggagcccgcccugcagcagcacagagacuucaucgcccugagagaggagcugggcagaaucagcgacuuccacgagaccuacaccuucaagcagcccguguucaccgugagcaaggacagcgugcuggccggcaccaacaaggagaaccugggccugcccgugagcacccccuuccuggagcccccccugggcagcgacggccccgccgugaccuucggcaagacccaggaggaccccaagcccuucugcgugggcagcgccccccccagcguggacgugacccccaccuacaccaaggacggcgccgacgaggccgagagcaacgacggcaaggugcugaagcccaagcccagcaagcuggccaagagaaucgccaacagcgccggcuacgugggcgacagauucaagugcgugaccaccgagcuguacgccgacagcagccagcugagcagagagcagagagcccugcagauggagggccugcaggaggacagcauccugugccugcccgccgccuacugcgagagagccaugaugagauucagcgagcuggagaugaaggagagagagggcggccaccccgccaccaaggacagcgagaugugcaaguucagccccgccgacugggagagacugaagggcaaccaggacaagaagcccaagagcgugacccuggaggaggccaucgccgagcagaacgagagcgagagaugcgaguacagcgugggcaacaagcacagagaccccuucgaggcccccgaggacaaggaccugcccguggagaaguacuucguggagagacagcccgugagcgagccccccgccgaccagguggccagcgacaugccccacagccccacccugagaguggacagaaagagaaaggugagcggcgacagcagccacaccgagaccaccgccgaggaggugcccgaggacccccugcugaaggccaagagaagaagagugagcaagggccugcaccccaagaagcagagacaccugcugcaccugagagagagaugggagcagcaggugagcgccgccgacggcaagcccggcagacagagcagaaaggaggugacccaggccacccagcccgaggccaucccccagggcaccaacaucaccgaggagaagcccggcagaaagagagccgaggccaagggcaacagaagcuggagcgaggagagccugaagcccagcgacaacgagcagggccugcccguguucagcggcagcccccccaugaagagccugagcagcaccagcgccggcggcaagaagcaggcccagcccagcugcgcccccgccagcagaccccccgccaagcagcagaagaucaaggagaaccagaagaccgacgugcugugcgccgacgaggaggaggacugccaggccgccagccugcugcagaaguacaccgacaacagcgagaagcccagcggcaagagacugugcaagaccaagcaccugaucccccaggagagcagaagaggccugccccugaccggcgaguacuacguggagaacgccgacggcaaggugaccgugagaagauucagaaagagacccgagcccagcagcgacuacgaccugagccccgccaagcaggagcccaagcccuucgacagacugcagcagcugcugcccgccagccagagcacccagcugcccugcagcagcagcccccaggagaccacccagagcagacccaugccccccgaggccagaagacugaucgugaacaagaacgccggcgagacccugcugcagagagccgccagacugggcuacgaggagguggugcuguacugccuggagaacaagaucugcgacgugaaccacagagacaacgccggcuacugcgcccugcacgaggccugcgccagaggcuggcugaacaucgugagacaccugcuggaguacggcgccgacgugaacugcagcgcccaggacggcaccagaccccugcacgacgccguggagaacgaccaccuggagaucgugagacugcugcugagcuacggcgccgaccccacccuggccaccuacagcggcagaaccaucaugaagaugacccacagcgagcugauggagaaguuccugaccgacuaccugaacgaccugcagggcagaaacgacgacgacgccagcggcaccugggacuucuacggcagcagcgugugcgagcccgacgacgagagcggcuacgacgugcuggccaacccccccggccccgaggaccaggacgacgacgacgacgccuacagcgacguguucgaguucgaguucagcgagaccccccugcugcccugcuacaacauccaggugagcguggcccagggccccagaaacuggcugcugcugagcgacgugcugaagaagcugaagaugagcagcagaaucuucagaugcaacuuccccaacguggagaucgugaccaucgccgaggccgaguucuacagacaggugagcgccagccugcuguucagcugcagcaaggaccuggaggccuucaaccccgagagcaaggagcugcuggaccugguggaguucaccaacgagauccagacccugcugggcagcagcguggaguggcugcaccccagcgaccuggccagcgacaacuacugguaa

SEQ ID NO: 14176 - RNA, 5136 nt, Artificial Sequence
  BCORL1__Homo_sapiens__NP_068765
augaucagcaccgccccccuguacagcggcgugcacaacuggaccagcagcgacagaaucagaaugugcggcaucaacgaggagagaagagccccccugagcgacgaggagagcaccaccggcgacugccagcacuucggcagccaggaguucugcgugagcagcagcuucagcaagguggagcugaccgccgugggcagcggcagcaacgccagaggcgccgaccccgacggcagcgccaccgagaagcugggccacaagagcgaggacaagcccgacgacccccagcccaagauggacuacgccggcaacguggccgaggccgagggccugcuggugccccugagcagccccggcgacggccugaagcugcccgccagcgacagcgccgaggccagcaacagcagagccgacugcagcuggaccccccugaacacccagaugagcaagcagguggacugcagccccgccggcgugaaggcccuggacagcagacagggcgugggcgagaagaacaccuucauccuggccacccugggcaccggcgugcccguggagggcacccugccccuggugaccaccaacuucagcccccugcccgcccccaucugcccccccgcccccggcagcgccagcgugccccacagcgugcccgacgccuuccaggugccccugagcgugcccgcccccgugccccacagcggccuggugcccgugcagguggccaccagcgugcccgcccccagccccccccuggcccccgugcccgcccuggcccccgccccccccagcgugcccacccugaucagcgacagcaacccccugagcgugagcgccagcgugcuggugcccgugcccgccagcgccccccccagcggccccgugccccugagcgcccccgcccccgccccccugagcgugcccgugagcgcccccccccuggcccugauccaggcccccgugccccccagcgcccccacccuggugcuggcccccgugcccacccccgugcuggcccccaugcccgccagcaccccccccgccgcccccgccccccccagcgugcccaugcccacccccacccccagcagcggcccccccagcacccccacccugauccccgccuucgcccccacccccgugcccgcccccacccccgcccccaucuucacccccgcccccacccccaugcccgccgccacccccgccgccauccccaccagcgcccccauccccgccagcuucagccugagcagagugugcuuccccgccgcccaggcccccgccaugcagaaggugccccugagcuuccagcccggcaccgugcugacccccagccagccccugguguacauccccccccccagcugcggccagccccugagcguggccacccugcccaccacccugggcgugagcagcacccugacccugcccgugcugcccagcuaccugcaggacagaugccugcccggcgugcuggccagccccgagcugagaagcuaccccuacgccuucagcguggccagaccccugaccagcgacagcaagcuggugagccuggaggugaacagacugcccugcaccagccccagcggcagcaccaccacccagcccgcccccgacggcgugcccggcccccuggccgacaccagccuggugaccgccagcgccaaggugcugcccaccccccagccccugcugcccgcccccagcggcagcagcgcccccccccaccccgccaagaugcccagcggcaccgagcagcagaccgagggcaccagcgugaccuucagcccccugaagagccccccccagcuggagagagagauggccagcccccccgagugcagcgagaugccccuggaccugagcagcaagagcaacagacagaagcugccccugcccaaccagagaaagaccccccccaugcccgugcugacccccgugcacaccagcagcaaggcccugcugagcaccgugcugagcagaagccagagaaccacccaggccgccggcggcaacgugaccagcugccugggcagcaccagcagccccuucgugaucuuccccgagaucgugagaaacggcgaccccagcaccugggugaagaacagcaccgcccugaucagcaccauccccggcaccuacgugggcguggccaaccccgugcccgccagccugcugcugaacaaggaccccaaccugggccugaacagagaccccagacaccugcccaagcaggagcccaucagcaucaucgaccagggcgagcccaagggcaccggcgccaccugcggcaagaagggcagccaggccggcgccgagggccagcccagcaccgugaagagauacacccccgccagaaucgcccccggccugcccggcugccagaccaaggagcugagccuguggaagcccaccggccccgccaacaucuaccccagaugcagcgugaacggcaagcccaccagcacccaggugcugcccgugggcuggagccccuaccaccaggccagccugcugagcaucggcaucagcagcgccggccagcugacccccagccagggcgcccccaucagacccaccagcguggugagcgaguucagcggcgugcccagccugagcagcagcgaggccgugcacggccugcccgagggccagcccagacccggcggcagcuucgugcccgagcaggaccccgugaccaagaacaagaccugcagaaucgccgccaagcccuacgaggagcaggugaaccccgugcugcugacccugagcccccagaccggcacccuggcccugagcgugcagcccagcggcggcgacaucagaaugaaccagggccccgaggagagcgagagccaccugugcagcgacagcacccccaagauggagggcccccagggcgccugcggccugaagcuggccggcgacaccaagcccaagaaccaggugcuggccaccuacaugagccacgagcuggugcuggccaccccccagaaccugcccaagaugcccgagcugccccugcugccccacgacagccaccccaaggagcugauccuggacguggugcccagcagcagaagaggcagcagcaccgagagaccccagcugggcagccagguggaccugggcagagugaagauggagaagguggacggcgacgugguguucaaccuggccaccugcuucagagccgacggccugcccguggccccccagagaggccaggccgaggugagagccaaggccggccaggccagagugaagcaggagagcgugggcguguucgccugcaagaacaaguggcagcccgacgacgugaccgagagccugccccccaagaagaugaagugcggcaaggagaaggacagcgaggagcagcagcugcagccccaggccaaggccguggugagaagcagccacagacccaagugcagaaagcugcccagcgacccccaggagagcaccaagaagagccccagaggcgccagcgacagcggcaaggagcacaacggcgugagaggcaagcacaagcacagaaagcccaccaagcccgagagccagagccccggcaagagagccgacagccacgaggagggcagccuggagaagaaggccaagagcagcuucagagacuucauccccguggugcugagcaccagaaccagaagccagagcggcagcaucugcagcagcuucgccggcauggccgacagcgacaugggcagccaggagguguuccccaccgaggaggaggaggaggugacccccacccccgccaagagaagaaaggugagaaagacccagagagacacccaguacagaagccaccacgcccaggacaagagccugcugagccagggcagaagacaccuguggagagccagagagaugcccuggagaaccgaggccgccagacagaugugggacaccaacgaggaggaggaggaggaggaggaggagggccugcugaagagaaagaagagaagaagacagaagagcagaaaguaccagaccggcgaguaccugaccgagcaggaggacgagcagagaagaaagggcagagccgaccugaaggccagaaagcagaagaccagcagcagccagagccuggagcacagacugagaaacagaaaccugcugcugcccaacaaggugcagggcaucagcgacagccccaacggcuuccugcccaacaaccuggaggagcccgccugccuggagaacagcgagaagcccagcggcaagagaaagugcaagaccaagcacauggccaccgugagcgaggaggccaaggacguggugcuguacugccugcagaaggacagcgaggacgugaaccacagagacaacgccggcuacaccgcccugcacgaggccugcagcagaggcuggaccgacauccugaacauccugcuggagcacggcgccaacgugaacugcagcgcccaggacggcaccagacccgugcacgacgccguggugaacgacaaccuggagaccaucuggcugcugcugagcuacggcgccgaccccacccuggccaccuacagcggccagaccgccaugaagcuggccagcagcgacaccaugaagagauuccugagcgaccaccugagcgaccugcagggcagagccgagggcgaccccggcgugagcugggacuucuacagcagcagcgugcuggaggagaaggacggcuucgccugcgaccugcugcacaacccccccggcagcagcgaccaggagggcgacgaccccauggaggaggacgacuucauguucgagcugagcgacaagccccugcugcccugcuacaaccugcaggugagcgugagcagaggccccugcaacugguuccuguucagcgacgugcugaagagacugaagcugagcagcagaaucuuccaggccagauucccccacuucgagaucaccaccaugcccaaggccgaguucuacagacagguggccagcagccagcugcugacccccgccgagagacccggcggccuggacgacagaagcccccccggcagcagcgagaccguggagcuggugagauacgagcccgaccugcugagacugcugggcagcgagguggaguuccagagcugcaacagcuaa

SEQ ID NO: 14177 - RNA, 3816 nt, Artificial Sequence
  BCR__Homo_sapiens__NP_004318
augguggaccccgugggcuucgccgaggccuggaaggcccaguuccccgacagcgagccccccagaauggagcugagaagcgugggcgacaucgagcaggagcuggagagaugcaaggccagcaucagaagacuggagcaggaggugaaccaggagagauucagaaugaucuaccugcagacccugcuggccaaggagaagaagagcuacgacagacagagauggggcuucagaagagccgcccaggcccccgacggcgccagcgagcccagagccagcgccagcagaccccagcccgcccccgccgacggcgccgaccccccccccgccgaggagcccgaggccagacccgacggcgagggcagccccggcaaggccagacccggcaccgccagaagacccggcgccgccgccagcggcgagagagacgacagaggcccccccgccagcguggccgcccugagaagcaacuucgagagaaucagaaagggccacggccagcccggcgccgacgccgagaagcccuucuacgugaacguggaguuccaccacgagagaggccuggugaaggugaacgacaaggaggugagcgacagaaucagcagccugggcagccaggccaugcagauggagagaaagaagagccagcacggcgccggcagcagcgugggcgacgccagcagaccccccuacagaggcagaagcagcgagagcagcugcggcguggacggcgacuacgaggacgccgagcugaaccccagauuccugaaggacaaccugaucgacgccaacggcggcagcagaccccccuggcccccccuggaguaccagcccuaccagagcaucuacgugggcggcaugauggagggcgagggcaagggcccccugcugagaagccagagcaccagcgagcaggagaagagacugaccuggcccagaagaagcuacagccccagaagcuucgaggacugcggcggcggcuacacccccgacugcagcagcaacgagaaccugaccagcagcgaggaggacuucagcagcggccagagcagcagagugagccccagccccaccaccuacagaauguucagagacaagagcagaagccccagccagaacagccagcagagcuucgacagcagcagcccccccaccccccagugccacaagagacacagacacugccccgugguggugagcgaggccaccaucgugggcgugagaaagaccggccagaucuggcccaacgacggcgagggcgccuuccacggcgacgccgacggcagcuucggcaccccccccggcuacggcugcgccgccgacagagccgaggagcagagaagacaccaggacggccugcccuacaucgacgacagccccagcagcagcccccaccugagcagcaagggcagaggcagcagagacgcccuggugagcggcgcccuggagagcaccaaggccagcgagcuggaccuggagaagggccuggagaugagaaagugggugcugagcggcauccuggccagcgaggagaccuaccugagccaccuggaggcccugcugcugcccaugaagccccugaaggccgccgccaccaccagccagcccgugcugaccagccagcagaucgagaccaucuucuucaaggugcccgagcuguacgagauccacaaggaguucuacgacggccuguuccccagagugcagcaguggagccaccagcagagagugggcgaccuguuccagaagcuggccagccagcugggcguguacagagccuucguggacaacuacggcguggccauggagauggccgagaagugcugccaggccaacgcccaguucgccgagaucagcgagaaccugagagccagaagcaacaaggacgccaaggaccccaccaccaagaacagccuggagacccugcuguacaagcccguggacagagugaccagaagcacccuggugcugcacgaccugcugaagcacacccccgccagccaccccgaccacccccugcugcaggacgcccugagaaucagccagaacuuccugagcagcaucaacgaggagaucacccccagaagacagagcaugaccgugaagaagggcgagcacagacagcugcugaaggacagcuucaugguggagcugguggagggcgccagaaagcugagacacguguuccuguucaccgaccugcugcugugcaccaagcugaagaagcagagcggcggcaagacccagcaguacgacugcaagugguacaucccccugaccgaccugagcuuccagaugguggacgagcuggaggccgugcccaacaucccccuggugcccgacgaggagcuggacgcccugaagaucaagaucagccagaucaagaacgacauccagagagagaagagagccaacaagggcagcaaggccaccgagagacugaagaagaagcugagcgagcaggagagccugcugcugcugaugagccccagcauggccuucagagugcacagcagaaacggcaagagcuacaccuuccugaucagcagcgacuacgagagagccgaguggagagagaacaucagagagcagcagaagaagugcuucagaagcuucagccugaccagcguggagcugcagaugcugaccaacagcugcgugaagcugcagaccgugcacagcaucccccugaccaucaacaaggaggacgacgagagccccggccuguacggcuuccugaacgugaucgugcacagcgccaccggcuucaagcagagcagcaaccuguacugcacccuggagguggacagcuucggcuacuucgugaacaaggccaagaccagaguguacagagacaccgccgagcccaacuggaacgaggaguucgagaucgagcuggagggcagccagacccugagaauccugugcuacgagaagugcuacaacaagaccaagauccccaaggaggacggcgagagcaccgacagacugaugggcaagggccaggugcagcuggacccccaggcccugcaggacagagacuggcagagaaccgugaucgccaugaacggcaucgaggugaagcugagcgugaaguucaacagcagagaguucagccugaagagaaugcccagcagaaagcagaccggcguguucggcgugaagaucgccguggugaccaagagagagagaagcaaggugcccuacaucgugagacagugcguggaggagaucgagagaagaggcauggaggaggugggcaucuacagagugagcggcguggccaccgacauccaggcccugaaggccgccuucgacgugaacaacaaggacgugagcgugaugaugagcgagauggacgugaacgccaucgccggcacccugaagcuguacuucagagagcugcccgagccccuguucaccgacgaguucuaccccaacuucgccgagggcaucgcccugagcgaccccguggccaaggagagcugcaugcugaaccugcugcugagccugcccgaggccaaccugcugaccuuccuguuccugcuggaccaccugaagagaguggccgagaaggaggccgugaacaagaugagccugcacaaccuggccaccguguucggccccacccugcugagacccagcgagaaggagagcaagcugcccgccaaccccagccagcccaucaccaugaccgacagcuggagccuggaggugaugagccaggugcaggugcugcuguacuuccugcagcuggaggccauccccgcccccgacagcaagagacagagcauccuguucagcaccgagguguaa

SEQ ID NO: 14178 - RNA, 1260 nt, Artificial Sequence
  BCS1L__Homo_sapiens__NP_001073335
augccccugagcgacuucauccuggcccugaaggacaaccccuacuucggcgccggcuucggccuggugggcgugggcaccgcccuggcccuggccagaaagggcgugcagcugggccugguggccuucagaagacacuacaugaucacccuggaggugcccgccagagacagaagcuacgccuggcugcugagcuggcugaccagacacagcaccagaacccagcaccugagcguggagaccagcuaccugcagcacgagagcggcagaaucagcaccaaguucgaguucgugcccagccccggcaaccacuucaucugguacagaggcaaguggaucagaguggagagaagcagagagaugcagaugaucgaccugcagaccggcacccccugggagagcgugaccuucaccgcccugggcaccgacagaaagguguucuucaacauccuggaggaggccagagagcuggcccugcagcaggaggagggcaagaccgugauguacaccgccgugggcagcgaguggagacccuucggcuaccccagaagaagaagaccccugaacagcguggugcugcagcagggccuggccgacagaaucgugagagacgugcaggaguucaucgacaaccccaagugguacaccgacagaggcauccccuacagaagaggcuaccugcuguacggcccccccggcugcggcaagagcagcuucaucaccgcccuggccggcgagcuggagcacagcaucugccugcugagccugaccgacagcagccugagcgacgacagacugaaccaccugcugagcguggccccccagcagagccuggugcugcuggaggacguggacgccgccuuccugagcagagaccuggccguggagaaccccgugaaguaccagggccugggcagacugaccuucagcggccugcugaacgcccuggacggcguggccagcaccgaggccagaaucguguucaugaccaccaaccacguggacagacuggaccccgcccugaucagacccggcagaguggaccugaaggaguacgugggcuacugcagccacuggcagcugacccagauguuccagagauucuaccccggccaggcccccagccuggccgagaacuucgccgagcacgugcugagagccaccaaccagaucagccccgcccaggugcagggcuacuucaugcuguacaagaacgaccccgugggcgccauccacaacgccgagagccugagaagauaa

SEQ ID NO: 14179 - RNA, 1032 nt, Artificial Sequence
  BDH1__Homo_sapiens__NP_976059
augcuggccaccagacugagcagaccccugagcagacugcccggcaagacccugagcgccugcgacagagagaacggcgccagaagaccccugcugcugggcagcaccagcuucauccccaucggcagaagaaccuacgccagcgccgccgagcccgugggcagcaaggccgugcuggugaccggcugcgacagcggcuucggcuucagccuggccaagcaccugcacagcaagggcuuccugguguucgccggcugccugaugaaggacaagggccacgacggcgugaaggagcuggacagccugaacagcgacagacugagaaccgugcagcugaacgugugcagcagcgaggagguggagaaggugguggagaucgugagaagcagccugaaggaccccgagaagggcauguggggccuggugaacaacgccggcaucagcaccuucggcgagguggaguucaccagccuggagaccuacaagcagguggccgaggugaaccuguggggcaccgugagaaugaccaagagcuuccugccccugaucagaagagccaagggcagaguggugaacaucagcagcaugcugggcagaauggccaaccccgccagaagccccuacugcaucaccaaguucggcguggaggccuucagcgacugccugagauacgagauguacccccugggcgugaaggugagcgugguggagcccggcaacuucaucgccgccaccagccuguacagccccgagagcauccaggccaucgccaagaagaugugggaggagcugcccgagguggugagaaaggacuacggcaagaaguacuucgacgagaagaucgccaagauggagaccuacugcagcagcggcagcaccgacaccagccccgugaucgacgccgugacccacgcccugaccgccaccacccccuacaccagauaccaccccauggacuacuacugguggcugagaaugcagaucaugacccaccugcccggcgccaucagcgacaugaucuacaucagauaa

SEQ ID NO: 14180 - RNA, 624 nt, Artificial Sequence
  BDH2__Homo_sapiens__XP_005263197
augggcagacuggacggcaaggugaucauccugaccgccgccgcccagggcaucggccaggccgccgcccuggccuucgccagagagggcgccaaggugaucgccaccgacaucaacgagagcaagcugcaggagcuggagaaguaccccggcauccagaccagagugcuggacgugaccaagaagaagcagaucgaccaguucgccaacgagguggagagacuggacgugcuguucaacguggccggcuucgugcaccacggcaccgugcuggacugcgaggagaaggacugggacuucagcaugaaccugaacgugagaagcauguaccugaugaucaaggccuuccugcccaagaugcuggcccagaagagcggcaacaucaucaacaugagcagcguggccagcagcgugaagggcaccguggacacccccagccugcaggagagaauccaggccagaggcaaccccgaggaggccagaaacgacuuccugaagagacagaagaccggcagauucgccaccgccgaggagaucgccaugcugugcguguaccuggccagcgacgagagcgccuacgugaccggcaaccccgugaucaucgacggcggcuggagccuguaa

SEQ ID NO: 14181 - RNA, 1062 nt, Artificial Sequence
  BDKRB1__Homo_sapiens__NP_000701
auggccagcagcuggcccccccuggagcugcagagcagcaaccagagccagcuguucccccagaacgccaccgccugcgacaacgcccccgaggccugggaccugcugcacagagugcugcccaccuucaucaucagcaucugcuucuucggccugcugggcaaccuguucgugcugcugguguuccugcugcccagaagacagcugaacguggccgagaucuaccuggccaaccuggccgccagcgaccugguguucgugcugggccugcccuucugggccgagaacaucuggaaccaguucaacuggcccuucggcgcccugcugugcagagugaucaacggcgugaucaaggccaaccuguucaucagcaucuuccuggugguggccaucagccaggacagauacagagugcuggugcaccccauggccagcagaagacagcagagaagaagacaggccagagugaccugcgugcugaucuggguggugggcggccugcugagcauccccaccuuccugcugagaagcauccaggccgugcccgaccugaacaucaccgccugcauccugcugcugccccacgaggccuggcacuucgccagaaucguggagcugaacauccugggcuuccugcugccccuggccgccaucguguucuucaacuaccacauccuggccagccugagaaccagagaggaggugagcagaaccagaugcggcggcagaaaggacagcaagaccaccgcccugauccugacccuggugguggccuuccuggugugcugggcccccuaccacuucuucgccuuccuggaguuccuguuccaggugcaggccgugagaggcugcuucugggaggacuucaucgaccugggccugcagcuggccaacuucuucgccuucaccaacagcagccugaaccccgugaucuacguguucgugggcagacuguucagaaccaaggugugggagcuguacaagcagugcacccccaagagccuggcccccaucagcagcagccacagaaaggagaucuuccagcuguucuggagaaacuaa

SEQ ID NO: 14182 - RNA, 1176 nt, Artificial Sequence
  BDKRB2__Homo_sapiens__NP_000614
auguucagccccuggaagaucagcauguuccugagcgugagagaggacagcgugcccaccaccgccagcuucagcgccgacaugcugaacgugacccugcagggccccacccugaacggcaccuucgcccagagcaagugcccccagguggaguggcugggcuggcugaacaccauccagccccccuuccugugggugcuguucgugcuggccacccuggagaacaucuucgugcugagcguguucugccugcacaagagcagcugcaccguggccgagaucuaccugggcaaccuggccgccgccgaccugauccuggccugcggccugcccuucugggccaucaccaucagcaacaacuucgacuggcuguucggcgagacccugugcagaguggugaacgccaucaucagcaugaaccuguacagcagcaucugcuuccugaugcuggugagcaucgacagauaccuggcccuggugaagaccaugagcaugggcagaaugagaggcgugagaugggccaagcuguacagccuggugaucuggggcugcacccugcugcugagcagccccaugcugguguucagaaccaugaaggaguacagcgacgagggccacaacgugaccgccugcgugaucagcuaccccagccugaucugggagguguucaccaacaugcugcugaacguggugggcuuccugcugccccugagcgugaucaccuucugcaccaugcagaucaugcaggugcugagaaacaacgagaugcagaaguucaaggagauccagaccgagagaagagccaccgugcuggugcugguggugcugcugcuguucaucaucugcuggcugcccuuccagaucagcaccuuccuggacacccugcacagacugggcauccugagcagcugccaggacgagagaaucaucgacgugaucacccagaucgccagcuucauggccuacagcaacagcugccugaacccccugguguacgugaucgugggcaagagauucagaaagaagagcugggagguguaccagggcgugugccagaagggcggcugcagaagcgagcccauccagauggagaacagcaugggcacccugagaaccagcaucagcguggagagacagauccacaagcugcaggacugggccggcagcagacaguaa

SEQ ID NO: 14183 - RNA, 744 nt, Artificial Sequence
  BDNF__Homo_sapiens__NP_001137280
augaccauccuguuccugaccauggugaucagcuacuucggcugcaugaaggccgcccccaugaaggaggccaacaucagaggccagggcggccuggccuaccccggcgugagaacccacggcacccuggagagcgugaacggccccaaggccggcagcagaggccugaccagccuggccgacaccuucgagcacgugaucgaggagcugcuggacgaggaccagaaggugagacccaacgaggagaacaacaaggacgccgaccuguacaccagcagagugaugcugagcagccaggugccccuggagcccccccugcuguuccugcuggaggaguacaagaacuaccuggacgccgccaacaugagcaugagagugagaagacacagcgaccccgccagaagaggcgagcugagcgugugcgacagcaucagcgagugggugaccgccgccgacaagaagaccgccguggacaugagcggcggcaccgugaccgugcuggagaaggugcccgugagcaagggccagcugaagcaguacuucuacgagaccaagugcaaccccaugggcuacaccaaggagggcugcagaggcaucgacaagagacacuggaacagccagugcagaaccacccagagcuacgugagagcccugaccauggacagcaagaagagaaucggcuggagauucaucagaaucgacaccagcugcgugugcacccugaccaucaagagaggcagauaa

SEQ ID NO: 14184 - RNA, 7875 nt, Artificial Sequence
  BDP1__Homo_sapiens__NP_060899
auguucagaagagccagacugagcgugaagcccaacgugagacccggcgugggcgccagaggcagcaccgccagcaacccccagagaggcagagagagccccagaccccccgaccccgccaccgacagcgccagcaagcccgccgagcccaccgacgugcccaccguggacuucggcggcgccgagccccaggagaaggcccccagaagcagcaccgagaagaccggcggcgacaacgacguggaggagagcagcagaagcagcagcaccgugagccagagaagaaagagaaucagcagcaccagcagccuggugaagagcagcgugagcgugcccagcgagagccacccccugagcaccaucaaccaggaggccccccagcccaccgccaccagcaccaaggagaagcagcccugcagcgacagauacagaaucuacaaggcccagaagcugagagagaugcugaaggaggagcugagaaaggagaagaagcaguggaagaacaaguacgccaucaacgagagccagagaccccccgacagaagcaagaugaccaugagagacuucaucuacuaccugcccgacaacaaccccaugaccagcagccuggagcaggagaagaagaccgagaagcccagcacccccgugcagaccagagagcaggagggcaagagcacccccaacgccgaggacaacgagauggaggaggagaccgacgacggcccccugcuggugcccagagugaagguggccgaggacggcagcaucauccuggacgaggagagccugaccguggaggugcugagaaccaagggccccugcgugguggaggagaacgaccccaucuucgagagaggcagcaccaccaccuacagcagcuucagaaagaacuacuacagcaagcccuggagcaacaaggagaccgacauguucuuccuggccaucagcauggugggcaccgacuucagcaugaucggccagcuguucccccacagagccagaaucgagaucaagaacaaguucaagagagaggagaagaccaacggcuggagaaucgacaaggccuuccaggagaagagacccuucgacuucgacuucuucgcccaccugcugcagaaggugcuggccgaggaggagaagagaaagcagaagagcgugaagaaccacagccugaaggagaagaagagcaccaagcccagaaagaacgugaaggugaagaagguggccugcgagggcgugaacaacgaccccgacgagagcaugagcagcagaaucagcgacaccgagagaagccagaaggacgcccagaccguggaggaggagagccugacccugagcagagaggacgccgagcagguggcccuggagguggaccugaaccagaagaagagaagaagaaagaagcaggacggcgccaacgagcugggcgugaacaaccugcuggagaacgccaccgugcaggccggccccagcaagggcgagaagcacaagaacaagugccaggccaucagacccgagcugaaggagggcgagugcagcaaggagcagaugcugagcugcacccagaacaucgacggcaucgugggcuucgccagcaccgagaagguggagaagagaaccgaccccauccugagccugagcaaccagcaggacgccaccagcguggccaccgagagcagcgagagcagcaccagcgaccugcccagcuucgaggugggcaucagagcccugugcgaggugaacaacgccgagggcagcugcaucgaggagagaaacguggaccugaagaacaacagccuggagaucgaccagaccgagaacgugaagcccaugcugagaggcagauuccagagacccaagcccaaccugagcagagccggcaagaagagcgugcugagccagggcaagaccgagagcgagagcaagaacagccacagcaagaccagcguggagaagaaccacguggagaaggacaagaugaacacccuggacauccugagaauggagaccaccgagagagagaaccccgaggccgagaccgugagcgugcugggcgagaagaacugccugcaggagggcagccagcugaaggcccugagacccgugcaggugagaggcagacugcagaagcccaagcccaacgccggcaaggccgccgagagaaaggagauccugaucagccaggaggagaucggcgccaacguggagaagaacgagaacgagagcugcgccgacagagacaccccccagcacauggaggaccagagcagaaaggacuucgaggaggaggacgugauccugcagcccgagaagaacgacagcuuccagaacgugcagcccgacgagcccaaggugcugaacgagugccugagcgugcaggagaacaacaaggccaacaagcugaaccaggugcccauccugagaaccagauuccagaagcccaagcccaacaucggcagaggcaccggcagaagagagaucagcagcaaggaggaggugcuggagaagauccuggugagcggcgagauggccgccgcccugagagagaccgugagacuggacaccagccccaaggagauggugcccgccgagaucaacaccaaggagaugcagagcgaccugaaggagaccggcagaagagccaucagccccagagagaagauccuggacgugaucgacgacaccaucgagauggagaccggccugaaggccaugggcagagagaucugccugagagagaagacccccgaggugaucgacgccaccgaggagaucgacaaggaccuggaggaggccggcagaagagagaucagcccccagaagaacggccccgaggaggugaagccccugggcgagguggagaccgaccugaaggccaccggcaacgagagcagccccagagagaagacccccgaggugaccgacgccaccgaggagaucgacaagaaccuggaggagaccggcagaagaaagaucagccccagagagaacggccccgaggaggugaagcccguggacgagauggagaccgaccugaacgccaccggcagagagagcagccccagagagaagacccccgaggugaucgacgccaccgaggagaucgaccuggaggagaccgagagagaggugagcccccaggagaacggccuggaggaggugaagccccugggcgagauggagaccgaccugaaggccaccggcagagacagcuuccccagaggcaagacccccgaggugaucgacgccaucgaggagaucgagaucgaccuggaggagaccgagagagagaucagcccccaggagaacggccuggaggaggugaagccccugggcgagaugcagaccgaccugaaggccaccggcagagagaucagccccagagagaagacccccgaggugaucgacgccaccgaggagaucgacaaggaccuggaggagaccggcagaagagagaucagccccgaggagaacggccccgaggaggugaagcccguggacgagauggagaccgaccugaagaccaccggcagagagggcagcagcagagagaagaccagagaggugaucgacgccgccgaggugaucgagaccgaccuggaggagaccgagagagagaucagcccccaggagaacggccccgaggaggugaagcccgugggcaagauggagaccgaccugaaggagaucagagaggagaucagccagagagagaaggugcuggccgaguucagcgccaucagagagaaggagaucgaccugaaggagaccggcaagagagacauccccaucauggagaaggugagcggcaagauggccgugguggaggagauggaggccgaccugaaggagaccggcaaggagaacuucagagagagaggcagcgaggagaucugcgugaccgaggagaagguggccgagcugaagcagaccggcaagaccgacaucagccccagagagaacgagcuggaggagaccagcaccagcagacagaccgacacccaccugaugcagagcggcagcaacgacuucagcgccgugcccagccuggacauccagaacaucagcagcgaggugcugagcaugaugcacacccccguggaggagaagagaaacagcgagaaggaggugagcagccacuucagccacuucaagaucagcagccagacccacgagagcgacaagaccgaggugcagggcauccagagccccgacgugcccgagcaguucagcgacaucaaccugagcaagagccugccccaggagcagaagccccuggagaucaagcccgcccccuucgugagaagcagauucaagagacccaagcccaaccuggccagagccgcccugaagagagagaccaccgagagcgagaaguacaucuacgagaagaagagcgagaccaagaagauggagaccaucgugaugcaggagaacaacgagcagaccgacacccugcccagccagcacgacgaggccagccugaugaucagcagagagaaggacacccugggccacagaaacgaggaggccgugauccugcccugcacccagaccgagagaaaccugagccccagcaacagcugcgagcccaaggaggagagccagagcgcccccgugcagaagaacgacagcguggugagcgugggcaccaacaacgugaacaccuuccagcaggagaugaaggagagcgugauccagaccgccagacaggugagaggcagacugcagagacccagacccaacaucagaaagaccggccagagacagaucguggacaagggcgaggccaagggcaucaucaaggagggcagaaccauccugcccaaggacgagaccgagaagaaggugcugaccgugagcaacagccagaucgagaccgagaucgaggugcccagcagcgccgugcccgagcacagaauguacgagaaccagagccagguggugcugguggagaaccugcacgugaacaagaccaacgagaccaucagacacgagaacaagcccuacgugcccagcagcgcccagaugaccagaagaaaguuccagaaggccaagcccaaccugggcagagcccacagcaagaaggaggagcccgugcuggagaaggugaccaccgaccagagcaaggagggcaagcccgaggaccaccugcugcagaagggcgccagcaacacccagcugcugcugaaggagaaggccgagcugcugaccagccuggaggugagcgccagaaaggacugcgugggcagcaaggagagcgcccuggccaagaucgacgccgagcuggaggaggugggccccagcagaagagugggcgaggagaccgugggcgacaacagccccagcagcgugguggaggagcaguaccugaacaagcugaccagcugcccccagccccugaacgagaccagcuacagcaagaucgcccuggacggcaagaccaccaucagcagcaccagcgaguacgagagaaacagaggcgagagaagaagccacaagaaguucaagcccaacgugaccagaggcagaggcagcaagagagugagaggcaagaccagcaagaaggagcccagagccagcaaggccaugcuggugacccugagagccagccaggaggaggacgacgacgccgacgacuucgagagcgacuacgaggaggagagcuaccaccuggcccccgaggaggugaacaaggcccccguguucgugcccgugggccugagaagccccgagcccgugagcgcccagaucgaggagaccauggaggagcuggagaucaccgugaacgugcccgacgugggcugcaucgccgugguggagcacgagcugcccaacaccgacgugaccaccgaggagaugaagcaggaggagaaccugagcgugcccuucgagaugaccaccagcgagcacauccaggacgagcccggcaccaacgacggcagcaccgaggccgccaucacccugcugaccaugggcgaccuggugcugcagagcgagaucagcagcgagcagggcgacgugggcgugugcaucaucccccacgugcacagcaaggacaagagccacauccccagcagccuggacaacgugaaccacaagaucgugcacgagugccaggagcugagcagccccgugaucaccaccagccccgccagcuucgaggagaacaagaucgugcuggaggagcagagcagcagagaggagaucagccugauggagaaggugaaggagaacgccacccccaccagaaacaccaucagcaaggugaccagcaaccugagaaucagaagcagacuggccaagcccaagcccaaccuggagaagacccugggcaccaacagacuggacgacuaccaggaggugagcagccugugcgugaccaagggcgccgagauggagacccagagagagaccgagaagaacgccagcaaggccaccgagcuggagaacaagaaccugggccccgugaccaccgccgagaacaaggaccagagcaagcuggccugcgugcacggcaucaagggcaccagcaucagcagcgaggugaaccugaccgagagaaacgagaaccaggaggagagcagccaggaggugcacaugcugagcguggcccccguggccagcagcgagaccggccccugcacccugggccuggacagaggccugggcgagaacagcguggaggagccccagaucaaggacagcaagggcgacagcgugcugacccugcccgugcccgaguacacccccaccagcauccccgaggugcagcaggagaacaucaucaacccccaggaccugaccgugaaccugguggccaacgugccccaggacggcgaggacgagcaggccuucauccugacccugguggagauccccgccaacgccguggaggaguucaccgacgccaccgcccaguucaugcccaacccccugcugcccgcccccauccuggugaagagcgugaacaccgaggagagaggcgacaugagcaucugccugcccgccaccagcgugggccaggacgccaugggccugagcaucagcggcagagacaacagcaagaagccccccgacaaccuggaccuggugagcagaaagagauuccagugcagacuggacaagaacgaccacaucccccccgccaagaagagaagccugacccugagagacgacugccaggaguacaccaccgaggugcacagcaaggagcugaccaacguguucgaggagaccggcgagagccacaagggccaggacaucuuccugaccagcggcagcacccugaccacccccgagccccagagacagcagguggaggccgccuuccagagcagaggcagcagaagccccgacgccugcauggacaagaacgugccccagcugccccaggacgagaugaucgugagcgacaaggaggagagaaccgacgccgcccccaagagccagcagauggacagcagaaccagcagcagcaaggccagccugagcagacccggcagaagaccccugggcuuccugagccugaucugcagcaagaacagccuggagagcgacgagcccaugcaggugcacagcaagaagagacugaagccccugauccccggccugagaaagaagcugaagagaagcaaccccuucaacgagagccaggagaagaacagagagagcagcgaccugcugcccagccccagcgugaucaccacccagagcgagaacaucagcagcagcgccacccaggugagcugcgaccagccccugcugaaggagggcuacaagagcgcccagaagagagccccccagggcgaggccaccaccgugagcgaguacuucuucaacgacaucuucaucgagguggacgagaccgaguaa

SEQ ID NO: 14185 - RNA, 627 nt, Artificial Sequence
  BEAN1__Homo_sapiens__NP_001184154
augagauacgccugcagcagcagcgaggacuggccccccccccuggacaucagcagcgacggcgacguggacgccaccgugcugagagagcuguaccccgacagcccccccggcgugagccugagcagacugagauggagcgccaugauguacaccggcagcuucaccuacugggugagaagcaugcugagcagacacaagcuggacgccauccugggcagacugggcuacaccgccacccuggagagcgaguucagccuggugcaggccaucagcaaggagaacgugaagcagaugguguucaagaucuuccuggugagagugagcugcgaggccgugcugagaaccgccggcaccagaaugcuggagcccggcaccgagaagcuggccagaacccacagcagacacagcagcgagaagagacuggugaagcccugcagcugccuggagggcgugcagcccggccccggcagcggcggcccccagcagggccccagcgagggcgugggcagcgagaccgcccuggccgagggcaccgccggccagagaagccugcccauggcccugagccccagcgaggugagcaccgcccccaacagccugcccagcggcagccccgugcuguaa

SEQ ID NO: 14186 - RNA, 1782 nt, Artificial Sequence
  BEGAIN__Homo_sapiens__NP_001153003
auggagaagcugagcgcccugcaggagcagaagggcgagcugagaaagagacugagcuacaccacccacaagcuggagaagcuggagaccgaguucgacagcaccagacacuaccuggagaucgagcugagaagagcccaggaggagcuggagaaggugaccgagaagcugagaagaauccagagcaacuacauggcccugcagagaaucaaccaggagcuggaggacaagcuguacagaaugggccagcacuacgaggaggagaagagagcccugagccacgagaucguggcccugaacagccaccugcuggaggccaaggugaccaucgacaagcugagcgaggacaacgagcuguacagaaaggacugcaaccuggccgcccagcugcugcagugcagccagaccuacggcagagugcacaaggugagcgagcugcccagcgacuuccaggagagagugagccugcacauggagaagcacggcugcagccugcccagcccccugugccaccccgccuacgccgacagcgugcccaccugcgugaucgccaaggugcuggagaagcccgaccccgccagccugagcagcagacugagcgacgccagcgccagagaccuggccuucugcgacggcguggagaagcccggccccagaccccccuacaagggcgacaucuacugcagcgacaccgcccuguacugccccgaggagagaagaagagacagaagacccagcguggacgcccccgugaccgacgugggcuuccugagagcccagaacagcaccgacagcgccgccgaggaggaggaggaggccgaggccgccgccuuccccgccggcuuccagcacgaggccuuccccagcuacgccggcagccugcccaccagcagcagcuacagcagcuucagcgccaccagcgaggagaaggagcacgcccaggccagcacccugaccgccagccagcaggccaucuaccugaacagcagagacgagcuguucgacagaaagccccccgccaccaccuacgagggcagccccagauucgccaaggccaccgccgccguggccgccccccuggaggccgagguggcccccggcuucggcagaaccaugagccccuaccccgccgagaccuucagauuccccgccagccccggcccccagcaggcccugaugccccccaaccuguggagccugagagccaagcccggcaccgccagacugcccggcgaggacaugagaggccaguggagaccccugagcguggaggacaucggcgccuacagcuaccccgugagcgccgccggcagagccagccccugcagcuucagcgagagauacuacggcggcgccggcggcagccccggcaagaaggccgacggcagagccagcccccuguacgccagcuacaaggccgacagcuucagcgagggcgacgaccugagccagggccaccuggccgagcccugcuuccugagagccggcggcgaccugagccugagccccggcagaagcgccgacccccugcccggcuacgcccccagcgagggcggcgacggcgacagacugggcgugcagcugugcggcaccgccagcagccccgagcccgagcagggcagcagagacagccuggagcccagcagcauggaggccagccccgagaugcaccccgccgccagacugagcccccagcaggccuuccccagaaccggcggcagcggccugagcagaaaggacagccugaccaaggcccagcuguacggcacccugcugaacuaa

SEQ ID NO: 14187 - RNA, 2487 nt, Artificial Sequence
  BEND3__Homo_sapiens__NP_001073919
augaacagcaccgaguucaccgaggacguggaggaggugcugaagagcaucaccgugaagguggagaccgaggccgaggacgccgcccuggacugcagcgugaacagcagaaccagcgagaagcacagcguggacagcgugcugaccgcccugcaggacagcagcaagagaaagcagcuggugagcgacggccugcuggacagcgugcccggcgugaagagaagaagacugauccccgaggcccugcuggccggcaugagaaacagagagaacagcagccccugccagggcaacggcgagcaggccggcagaggcagaagccugggcaacguguggcccggcgaggaggagcccugcaacgacgccaccacccccagcuacaagaagccccuguacggcaucagccacaagaucauggagaagaagaacccccccagcggcgaccugcugaacguguacgagcuguucgagaaggccaacgccagcaacagccccagcagccugagacugcugaacgagccccagaagagagacugcggcagcaccggcgccggcaccgacaacgaccccaacaucuacuuccugauccagaagauguucuacaugcugaacacccugaccagcaacaugagccagcugcacagcaagguggaccugcugagccuggaggugagcagaaucaagaagcaggugagccccaccgagaugguggccaaguuccagcccccccccgaguaccagcugaccgccgccgagcugaagcagaucguggaccagagccugagcggcggcgaccuggccugcagacugcuggugcagcuguuccccgagcuguucagcgacguggacuucagcagaggcugcagcgccugcggcuucgccgccaagagaaagcuggagagccugcaccugcagcugaucagaaacuacguggagguguacuaccccagcgugaaggacaccgccguguggcaggccgagugccugccccagcugaacgacuucuucagcagauucugggcccagagagagauggaggacagccagcccagcggccagguggccagcuucuucgaggccgagcagguggaccccggccacuuccuggacaacaaggaccaggaggaggcccugagccuggacagaagcagcaccaucgccagcgaccacgugguggacacccaggaccugaccgaguuccuggacgaggccagcagccccggcgaguucgccguguuccugcugcacagacuguuccccgagcuguucgaccacagaaagcugggcgagcaguacagcugcuacggcgacggcggcaagcaggagcuggacccccagagacugcagaucaucagaaacuacaccgagaucuacuuccccgacaugcaggaggaggaggccuggcugcagcagugcgcccagagaaucaacgacgagcuggagggccugggccuggacgccggcagcgagggcgacccccccagagacgacugcuacgacagcagcagccugcccgacgacaucagcguggugaagguggaggacagcuucgagggcgagagacccggcagaagaagcaagaagaucuggcuggugcccaucgacuucgacaagcuggagaucccccagcccgacuucgaggugcccggcgccgacugccugcugagcaaggagcagcugagaagcaucuacgagagcagccugagcaucggcaacuucgccagcagacugcuggugcaccuguuccccgagcuguucacccacgagaaccugagaaagcaguacaacugcagcggcagccugggcaagaagcagcuggaccccagcagaaucaagcugaucagacacuacgugcagcugcuguaccccagagccaagaacgacagaguguggacccuggaguucgugggcaagcuggacgagagaugcagaagaagagacaccgagcagagaagaagcuaccagcagcagagaaaggugcacgugcccggccccgagugcagagaccugaccagcuacgccaucaaccccgagagauucagagaggaguucgagggccccccccugccccccgagagaagcagcaaggacuucugcaagaucccccuggacgagcugguggugcccagccccgacuuccccgugcccagccccuaccugcugagcgacaaggaggugagagagaucgugcagcagagccugagcgugggcaacuucgccgccagacugcuggugagacuguuccccgagcuguucaccgccgagaaccugagacugcaguacaaccacagcggcgccugcaacaagaagcagcuggaccccaccagacugagacugaucagacacuacguggaggccguguaccccguggagaagauggaggagguguggcacuacgagugcauccccagcaucgacgagagaugcagaagacccaacagaaagaagugcgacauccugaagaaggccaagaagguggagaaguaa

SEQ ID NO: 14188 - RNA, 1326 nt, Artificial Sequence
  BEND4__Homo_sapiens__NP_001153019
auggaggaggagaugcagcccgccgaggagggccccagcgugcccaagaucuacaagcagagaagccccuacagcgugcugaagaccuuccccagcaagagacccgcccuggccaagagauacgagagacccacccugguggagcugccccacgugagagcccccccccccccccccccccccuucgccccccacgccgccgugagcaucagcagcagcgagccccccccccagcaguuccaggcccagagcagcuacccccccggccccggcagagccgccgccgccgccagcagcagcagccccagcugcacccccgccaccagccagggccaccugagaacccccgcccagcccccccccgccagccccgccgccagcagcagcagcagcuucgccgccguggugagauacggccccggcgccgccgccgccgccggcaccggcggcaccggcagcgacagcgccagccuggagcugagcgccgagagcagaaugauccuggacgccuucgcccagcagugcagcagagugcugagccugcugaacugcggcggcaagcugcuggacagcaaccacagccagagcaugaucagcugcgugaagcaggagggcagcagcuacaacgagagacaggagcacugccacaucggcaagggcgugcacagccagaccagcgacaacguggacaucgagaugcaguacaugcagagaaagcagcagaccagcgccuuccugagaguguucaccgacagccugcagaacuaccugcugagcggcagcuuccccacccccaaccccagcagcgccagcgaguacggccaccuggccgacguggacccccugagcaccagccccgugcacacccugggcggcuggaccagccccgccaccagcgagagccacggccaccccagcagcagcacccugcccgaggaggaggaggaggaggacgaggagggcuacugccccagaugccaggagcuggagcaggaggugaucagccugcagcaggagaacgaggagcugagaagaaagcuggagagcauccccgugcccugccagaccgugcuggacuaccugaagauggugcugcagcaccacaaccagcugcugaucccccagcccgccgaccagcccaccgagggcagcaagcagcugcugaacaacuaccccguguacaucaccagcaagcagugggacgaggccgugaacagcagcaagaaggacggcagaagacugcugagauaccugaucagauucguguucaccaccgacgagcugaaguacagcugcggccugggcaagagaaagagaauccacuaa

SEQ ID NO: 14189 - RNA, 1815 nt, Artificial Sequence
  BEST1__Homo_sapiens__NP_001132915
auguucgagaagcugacccuguacugcgacagcuacauccagcugauccccaucagcuucgugcugggcuucuacgugacccugguggugaccagaugguggaaccaguacgagaaccugcccuggcccgacagacugaugagccuggugagcggcuucguggagggcaaggacgagcagggcagacugcugagaagaacccugaucagauacgccaaccugggcaacgugcugauccugagaagcgugagcaccgccguguacaagagauuccccagcgcccagcaccuggugcaggccggcuucaugacccccgccgagcacaagcagcuggagaagcugagccugccccacaacauguucugggugcccugggugugguucgccaaccugagcaugaaggccuggcugggcggcagaaucagagaccccauccugcugcagagccugcugaacgagaugaacacccugagaacccagugcggccaccuguacgccuacgacuggaucagcaucccccugguguacacccagguggugaccguggccguguacagcuucuuccugaccugccuggugggcagacaguuccugaaccccgccaaggccuaccccggccacgagcuggaccugguggugcccguguucaccuuccugcaguucuucuucuacgugggcuggcugaagguggccgagcagcugaucaaccccuucggcgaggacgacgacgacuucgagaccaacuggaucguggacagaaaccugcaggugagccugcuggccguggacgagaugcaccaggaccugcccagaauggagcccgacauguacuggaacaagcccgagccccagccccccuacaccgccgccagcgcccaguucagaagagccagcuucaugggcagcaccuucaacaucagccugaacaaggaggagauggaguuccagcccaaccaggaggacgaggaggacgcccacgccggcaucaucggcagauuccugggccugcagagccacgaccaccacccccccagagccaacagcagaaccaagcugcuguggcccaagagagagagccugcugcacgagggccugcccaagaaccacaaggccgccaagcagaacgugagaggccaggaggacaacaaggccuggaagcugaaggccguggacgccuucaagagcgccccccuguaccagagacccggcuacuacagcgccccccagaccccccugagccccacccccauguucuucccccuggagcccagcgcccccagcaagcugcacagcgugaccggcaucgacaccaaggacaagagccugaagaccgugagcagcggcgccaagaagagcuucgagcugcugagcgagagcgacggcgcccugauggagcaccccgaggugagccaggugagaagaaagaccguggaguucaaccugaccgacaugcccgagauccccgagaaccaccugaaggagccccuggagcagagccccaccaacauccacaccacccugaaggaccacauggaccccuacugggcccuggagaacagaagcgugcugcaccugaaccagggccacugcaucgcccugugccccacccccgccagccuggcccugagccugcccuuccugcacaacuuccugggcuuccaccacugccagagcacccuggaccugagacccgcccuggccuggggcaucuaccuggccaccuucaccggcauccugggcaagugcagcggccccuuccugaccagccccugguaccaccccgaggacuuccugggccccggcgagggcagauaa

SEQ ID NO: 14190 - RNA, 1530 nt, Artificial Sequence
  BEST2__Homo_sapiens__XP_005260020
augaccgugaccuacaccgccagaguggccaacgccagauucggcggcuucagccagcugcugcugcuguggagaggcagcaucuacaagcugcuguggagagagcugcugugcuuccugggcuucuacauggcccugagcgccgccuacagauucgugcugaccgagggccagaagagauacuucgagaagcuggugaucuacugcgaccaguacgccagccugauccccgugagcuucgugcugggcuucuacgugacccugguggugaacagaugguggagccaguaccugugcaugccccugcccgacgcccugaugugcgugguggccggcaccgugcacggcagagacgacagaggcagacuguacagaagaacccugaugagauacgccggccugagcgccgugcugauccugagaagcgugagcaccgccguguucaagagauuccccaccaucgaccacgugguggaggccggcuucaugaccagagaggagagaaagaaguucgagaaccugaacagcagcuacaacaaguacugggugcccugcgugugguucagcaaccuggccgcccaggccagaagagagggcagaaucagagacaacagcgcccugaagcugcugcuggaggagcugaacguguucagaggcaagugcggcaugcuguuccacuacgacuggaucagcgugccccugguguacacccagguggugaccaucgcccuguacagcuacuuccuggccugccugaucggcagacaguuccuggaccccgcccagggcuacaaggaccacgaccuggaccugugcgugcccaucuucacccugcugcaguucuucuucuacgccggcuggcugaagguggccgagcagcugaucaaccccuucggcgaggacgacgacgacuucgagaccaacuuccugaucgacagaaacuuccaggugagcaugcuggccguggacgagauguacgacgaccuggccgugcuggagaaggaccuguacugggacgccgccgaggccagagcccccuacaccgccgccaccguguuccagcugagacagcccagcuuccagggcagcaccuucgacaucacccuggccaaggaggacaugcaguuccagagacuggacggccuggacggccccaugggcgaggcccccggcgacuuccugcagagacugcugcccgccggcgccggcaugguggccggcggcccccugggcagaagacugagcuuccugcugagaaagaacagcugcgugagcgaggccagcaccggcgccagcugcagcugcgccguggugcccgagggcgccgcccccgagugcagcugcggcgacccccugcuggaccccggccugcccgagcccgaggcccccccccccgccggccccgagccccugacccugauccccggccccguggagcccuucagcaucgugaccaugcccggccccagaggccccgccccccccuggcugcccagccccaucggcgaggaggaggagaaccuggccuaa

SEQ ID NO: 14191 - RNA, 357 nt, Artificial Sequence
  BET1__Homo_sapiens__NP_005859
augagaagagccggccugggcgagggcgugccccccggcaacuacggcaacuacggcuacgccaacagcggcuacagcgccugcgaggaggagaacgagagacugaccgagagccugagaagcaaggugaccgccaucaagagccugagcaucgagaucggccacgaggugaagacccagaacaagcugcuggccgagauggacagccaguucgacagcaccaccggcuuccugggcaagaccaugggcaagcugaagauccugagcagaggcagccagaccaagcugcugugcuacaugaugcuguucagccuguucguguucuucaucaucuacuggaucaucaagcugagauaa

SEQ ID NO: 14192 - RNA, 336 nt, Artificial Sequence
  BET1L__Homo_sapiens__NP_001092257
auggccgacugggccagagcccagagccccggcgccguggaggagauccuggacagagagaacaagagaauggccgacagccuggccagcaaggugaccagacugaagagccuggcccuggacaucgacagagacgccgaggaccagaacagauaccuggacggcauggacagcgacuucaccagcaugaccagccugcugaccggcagcgugaagagauucagcaccauggccagaagcggccaggacaacagaaagcugcugugcggcauggccgugggccugaucguggccuucuucauccugagcuacuuccugagcagagccagaaccuaa

SEQ ID NO: 14193 - RNA, 378 nt, Artificial Sequence
  BEX1__Homo_sapiens__NP_060946
auggagagcaaggagaagagagccgugaacagccugagcauggagaacgccaaccaggagaacgaggagaaggagcagguggccaacaagggcgagccccuggcccugccccuggacgccggcgaguacugcgugcccagaggcaacagaagaagauucagagugagacagcccauccugcaguacagaugggacaugaugcacagacugggcgagccccaggccagaaugagagaggagaacauggagagaaucggcgaggaggugagacagcugauggagaagcugagagagaagcagcugagccacagccugagagccgugagcaccgaccccccccaccacgaccaccacgacgaguucugccugaugcccuaa

SEQ ID NO: 14194 - RNA, 483 nt, Artificial Sequence
  BEX2__Homo_sapiens__NP_001161871
augcagaagaugguggugugcggcgccaagugcugcggcgacgccccccacguggagaacagagaggaggagaccgccagaaucggccccggcgugauggagagcaaggaggagagagcccugaacaaccugaucguggagaacgugaaccaggagaacgacgagaaggacgagaaggagcagguggccaacaagggcgagccccuggcccugccccugaacgugagcgaguacugcgugcccagaggcaacagaagaagauucagagugagacagcccauccugcaguacagaugggacaucaugcacagacugggcgagccccaggccagaaugagagaggagaacauggagagaaucggcgaggaggugagacagcugauggagaagcugagagagaagcagcugagccacagccugagagccgugagcaccgaccccccccaccacgaccaccacgacgaguucugccugaugcccuaa

SEQ ID NO: 14195 - RNA, 363 nt, Artificial Sequence
  BEX4__Homo_sapiens__NP_001073894
auggagagcaaggaggagcuggccgccaacaaccugaacggcgagaacgcccagcaggagaacgagggcggcgagcaggcccccacccagaacgaggaggagagcagacaccugggcggcggcgagggccagaagcccggcggcaacaucagaagaggcagagugagaagacuggugcccaacuucagaugggccauccccaacagacacaucgagcacaacgaggccagagacgacguggagagauucgugggccagaugauggagaucaagagaaagaccagagagcagcagaugagacacuacaugagauuccagacccccgagcccgacaaccacuacgacuucugccugauccccuaa

SEQ ID NO: 14196 - RNA, 1353 nt, Artificial Sequence
  BFAR__Homo_sapiens__NP_057645
auggaggagccccagaagagcuacgugaacaccauggaccuggagagagacgagccccugaagagcaccggcccccagaucagcgugagcgaguucagcugccacugcugcuacgacauccuggugaaccccaccacccugaacugcggccacagcuucugcagacacugccuggcccuguggugggccagcagcaagaagaccgagugccccgagugcagagagaagugggagggcuuccccaaggugagcauccugcugagagacgccaucgagaagcuguuccccgacgccaucagacugagauucgaggacauccagcagaacaacgacaucgugcagagccuggccgccuuccagaaguacggcaacgaccagaucccccuggcccccaacaccggcagagccaaccagcagaugggcggcggcuucuucagcggcgugcugaccgcccugaccggcguggccguggugcugcugguguaccacuggagcagcagagagagcgagcacgaccugcuggugcacaaggccguggccaaguggaccgccgaggagguggugcuguggcuggagcagcugggccccugggccagccuguacagagagagauuccugagcgagagagugaacggcagacugcugcugacccugaccgaggaggaguucagcaagacccccuacaccaucgagaacagcagccacagaagagccauccugauggagcuggagagagugaaggcccugggcgugaagcccccccagaaccugugggaguacaaggccgugaaccccggcagaagccuguuccugcuguacgcccugaagagcagccccagacugagccugcuguaccuguaccuguucgacuacaccgacaccuuccugcccuucauccacaccaucugcccccugcaggaggacagcagcggcgaggacaucgugaccaagcugcuggaccugaaggagcccaccuggaagcaguggagagaguuccuggugaaguacagcuuccugcccuaccagcugaucgccgaguucgccugggacuggcuggaggugcacuacuggaccagcagauuccugaucaucaacgccaugcugcugagcgugcuggagcuguucagcuucuggagaaucuggagcagaagcgagcugaagaccgugccccagagaauguggagccacuucuggaaggugagcacccagggccuguucguggccauguucuggccccugaucccccaguucgugugcaacugccuguucuacugggcccuguacuucaaccccaucaucaacaucgaccugguggugaaggagcugagaagacuggagacccaggugcuguaa

SEQ ID NO: 14197 - RNA, 1623 nt, Artificial Sequence
  BFSP1__Homo_sapiens__NP_001155177
auguacgagaacgagugcgagugccagcugcugcugaaggagaugcuggagagacugaacaaggaggccgacgaggcccugcugcacaaccugagacugcagcuggaggcccaguuccugcaggacgacaucagcgccgccaaggacagacacaagaagaaccugcuggaggugcagaccuacaucagcauccugcagcagaucauccacaccaccccccccgccagcaucgugaccagcggcaugagagaggagaagcugcugaccgagagagagguggccgcccugagaagccagcuggaggagggcagagaggugcugagccaccugcaggcccagagaguggagcugcaggcccagaccaccacccuggagcaggccaucaagagcgcccacgagugcuacgacgacgagauccagcuguacaacgagcagaucgagacccugagaaaggagaucgaggagaccgagagagugcuggagaagagcagcuacgacugcagacagcuggccguggcccagcagacccugaagaacgagcuggacagauaccacagaaucaucgagaucgagggcaacagacugaccagcgccuucaucgagacccccaucccccuguucacccagagccacggcgugagccugagcaccggcagcggcggcaaggaccugaccagagcccugcaggacaucaccgccgccaagcccagacagaaggcccugcccaagaacgugcccagaagaaaggagaucaucaccaaggacaagaccaacggcgcccuggaggacgccccccugaagggccuggaggacaccaagcuggugcagguggugcugaaggaggagagcgagagcaaguucgagagcgagagcaaggaggugagcccccugacccaggagggcgcccccgaggacgugcccgacggcggccagaucagcaagggcuucggcaagcuguacagaaaggugaaggagaaggugagaagccccaaggagcccgagacccccaccgagcuguacaccaaggagagacacgugcuggugaccggcgacgccaacuacguggaccccagauucuacgugagcagcaucaccgccaagggcggcguggccgugagcguggccgaggacagcgugcuguacgacggccagguggagcccagccccgagagccccaagcccccccuggagaacggccaggugggccugcaggagaaggaggacggccagcccaucgaccagcagcccaucgacaaggagaucgagcccgacggcgccgagcuggagggccccgaggagaagagagagggcgaggagagagacgaggagagcagaagacccugcgccauggugacccccggcgccgaggagcccagcauccccgagccccccaagcccgccgccgaccaggacggcgccgaggugcugggcaccagaagcagaagccugcccgagaagggcccccccaaggcccuggccuacaagaccguggaggugguggagagcaucgagaagaucagcaccgagagcauccagaccuacgaggagaccgccgugaucguggagaccaugaucggcaagaccaagagcgacaagaagaagagcggcgagaagagcagcuaa

SEQ ID NO: 14198 - RNA, 1248 nt, Artificial Sequence
  BFSP2__Homo_sapiens__NP_003562
augagcgagagaagaguggugguggaccugcccaccagcgccagcagcagcaugccccugcagagaagaagagccagcuucagaggccccagaagcagcagcagccuggagagcccccccgccagcagaaccaacgccaugagcggccuggugagagcccccggcguguacgugggcaccgcccccagcggcugcaucggcggccugggcgccagagugaccagaagagcccugggcaucagcagcguguuccugcagggccugagaagcagcggccuggccaccgugcccgcccccggccuggagagagaccacggcgccguggaggaccugggcggcugccugguggaguacauggccaaggugcacgcccuggagcaggugagccaggagcuggagacccagcugagaaugcaccuggagagcaaggccaccagaagcggcaacuggggcgcccugagagccagcugggccagcagcugccagcaggugggcgaggccgugcuggagaacgccagacugaugcugcagaccgagaccauccaggccggcgccgacgacuucaaggagagauacgagaacgagcagcccuucagaaaggccgccgaggaggagaucaacagccuguacaaggugaucgacgaggccaaccugaccaagauggaccuggagagccagaucgagagccugaaggaggagcugggcagccugagcagaaacuacgaggaggacgugaagcugcugcacaagcagcuggccggcugcgagcuggagcagauggacgcccccaucggcaccggccuggacgacauccuggagaccaucagaauccagugggagagagacguggagaagaacagaguggaggccggcgcccugcugcaggccaagcagcaggccgagguggcccacaugagccagacccaggaggagaagcuggccgccgcccugagaguggagcugcacaacaccagcugccaggugcagagccugcaggccgagaccgagagccugagagcccugaagagaggccuggagaacacccugcacgacgccaagcacuggcacgacauggagcugcagaaccugggcgccguggugggcagacuggaggccgagcugagagagaucagagccgaggccgagcagcagcagcaggagagagcccaccugcuggccagaaagugccagcugcagaaggacguggccagcuaccacgcccugcuggacagagaggagagcggcuaa

SEQ ID NO: 14199 - RNA, 303 nt, Artificial Sequence
  BGLAP__Homo_sapiens__NP_954642
augagagcccugacccugcuggcccugcuggcccuggccgcccugugcaucgccggccaggccggcgccaagcccagcggcgccgagagcagcaagggcgccgccuucgugagcaagcaggagggcagcgagguggugaagagacccagaagauaccuguaccaguggcugggcgcccccgugcccuaccccgacccccuggagcccagaagagaggugugcgagcugaaccccgacugcgacgagcuggccgaccacaucggcuuccaggaggccuacagaagauucuacggccccguguaa

SEQ ID NO: 14200 - RNA, 1107 nt, Artificial Sequence
  BGN__Homo_sapiens__NP_001702
auguggccccuguggagacuggugagccugcuggcccugagccaggcccugcccuucgagcagagaggcuucugggacuucacccuggacgacggccccuucaugaugaacgacgaggaggccagcggcgccgacaccagcggcgugcuggaccccgacagcgugacccccaccuacagcgccaugugccccuucggcugccacugccaccugagaguggugcagugcagcgaccugggccugaagagcgugcccaaggagaucagccccgacaccacccugcuggaccugcagaacaacgacaucagcgagcugagaaaggacgacuucaagggccugcagcaccuguacgcccuggugcuggugaacaacaagaucagcaagauccacgagaaggccuucagcccccugagaaagcugcagaagcuguacaucagcaagaaccaccugguggagaucccccccaaccugcccagcagccugguggagcugagaauccacgacaacagaaucagaaaggugcccaagggcguguucagcggccugagaaacaugaacugcaucgagaugggcggcaacccccuggagaacagcggcuucgagcccggcgccuucgacggccugaagcugaacuaccugagaaucagcgaggccaagcugaccggcauccccaaggaccugcccgagacccugaacgagcugcaccuggaccacaacaagauccaggccaucgagcuggaggaccugcugagauacagcaagcuguacagacugggccugggccacaaccagaucagaaugaucgagaacggcagccugagcuuccugcccacccugagagagcugcaccuggacaacaacaagcuggccagagugcccagcggccugcccgaccugaagcugcugcaggugguguaccugcacagcaacaacaucaccaaggugggcgugaacgacuucugccccaugggcuucggcgugaagagagccuacuacaacggcaucagccuguucaacaaccccgugcccuacugggaggugcagcccgccaccuucagaugcgugaccgacagacuggccauccaguucggcaacuacaagaaguaa

SEQ ID NO: 14201 - RNA, 570 nt, Artificial Sequence
  BHLHA15__Homo_sapiens__NP_803238
augaagaccaagaacagaccccccagaagaagagcccccgugcaggacaccgaggccacccccggcgagggcacccccgacggcagccugcccaaccccggccccgagcccgccaagggccugagaagcagacccgccagagccgccgccagagcccccggcgagggcagaagaagaagacccggccccagcggccccggcggcagaagagacagcagcauccagagaagacuggagagcaacgagagagagagacagagaaugcacaagcugaacaacgccuuccaggcccugagagaggugaucccccacgugagagccgacaagaagcugagcaagaucgagacccugacccuggccaagaacuacaucaagagccugaccgccaccauccugaccaugagcagcagcagacugcccggccuggagggccccggccccaagcuguaccagcacuaccagcagcagcagcagguggccggcggcgcccugggcgccaccgaggcccagccccagggccaccugcagagauacagcacccagauccacagcuucagagagggcaccuaa

SEQ ID NO: 14202 - RNA, 708 nt, Artificial Sequence
  BHLHA9__Homo_sapiens__NP_001157877
augcugagaggcgcccccggccugggccugaccgccagaaagggcgccgaggacagcgccgaggaccugggcggccccugccccgagcccggcggcgacagcggcgugcugggcgccaacggcgccagcugcagcagaggcgaggccgaggagcccgccggcagaagaagagccagacccgugagaagcaaggccagaagaauggccgccaacgugagagagagaaagagaauccuggacuacaacgaggccuucaacgcccugagaagagcccugagacacgaccugggcggcaagagacugagcaagaucgccacccugagaagagccauccacagaaucgccgcccugagccuggugcugagagccagccccgcccccagaggccccugcggccaccuggagugccacggccccgccgccagaggcgacaccggcgacaccggcgccagcccccccccccccgccggccccagccuggccagacccgacgccgccagacccagcgugcccagcgcccccagaugcgccagcugccccccccacgccccccuggccagacccagcgccguggccgagggccccggccuggcccaggccagcggcggcagcuggagaagaugccccggcgccagcagcgccggccccccccccuggcccagaggcuaccugagaagcgcccccggcaugggccaccccagaagcuaa

SEQ ID NO: 14203 - RNA, 1644 nt, Artificial Sequence
  BHLHB9__Homo_sapiens__NP_001135999
auggccggcaccaagaacaagaccagagcccaggccaagaccgagaagaaggccgccauccaggccaaggccggcgccgagagagaggccaccggcguggugagacccguggccaagaccagagccaaggccaaggccaagaccggcagcaagaccgacgccguggccgagaugaaggccgugagcaagaacaaggugguggccgagaccaaggagggcgcccugagcgagcccaagacccugggcaaggccaugggcgacuucacccccaaggccggcaacgagagcaccagcagcaccugcaagaacgaggccggcaccgacgccugguucugggccggcgaggaggccaccaucaacagcugguucuggaacggcgaggaggccggcaacagcuucagcaccaagaacgacaagcccgagaucggcgcccaggugugcgccgaggagcuggagcccgccgccggcgccgacugcaagcccagaagcggcgccgaggaggaggaggaggagaacgugaucggcaacugguucugggagggcgacgacaccagcuucgaccccaaccccaagcccgugagcagaaucgugaagccccagcccguguacgagaucaacgagaagaacagacccaaggacuggagcgaggugaccaucuggcccaacgcccccgccgugacccccgccgugcugggcuucagaagccaggcccccagcgaggccagcccccccagcuacaucgugcuggccagcgccgaggagaacgccugcagccugcccguggccaccgccugcagacccagcagaaacaccagaagcugcagccagcccauccccgagugcagauucgacagcgaccccugcauccagaccaucgacgagaucagaagacagaucagaaucagagaggugaacggcaucaagcccuucgccugccccugcaagauggagugcuacauggacagcgaggaguucgagaagcuggugagccugcugaagagcaccaccgacccccugauccacaagaucgccagaaucgccaugggcgugcacaacgugcaccccuucgcccaggaguucaucaacgaggugggcguggugacccugaucgagagccugcugagcuuccccagccccgagaugagaaagaagaccgugaucacccugaacccccccagcggcgacgagagacagagaaagaucgagcugcacgugaagcacaugugcaaggagaccaugagcuucccccugaacagccccggccagcagagcggccugaagauccugggccagcugaccaccgacuucgugcaccacuacaucguggccaacuacuucagcgagcuguuccaccugcugagcagcggcaacugcaagaccagaaaccuggugcugaagcugcugcugaacaugagcgagaaccccaccgccgccagagacaugaucaacaugaaggcccuggccgcccugaagcugaucuucaaccagaaggaggccaaggccaaccuggugagcggcguggccaucuucaucaacaucaaggagcacaucagaaagggcagcaucguggugguggaccaccugagcuacaacacccugauggccaucuucagagaggugaaggagaucaucgagaccauguaa

SEQ ID NO: 14204 - RNA, 1146 nt, Artificial Sequence
  BHLHE22__Homo_sapiens__NP_689627
auggagagaggcaugcaccugggcgccgccgccgccggcgaggacgaccuguuccugcacaagagccugagcgccagcaccagcaagagacuggaggccgccuucagaagcaccccccccggcauggaccugagccuggcccccccccccagagagagacccgccagcagcagcagcagcccccugggcugcuucgagcccgccgaccccgagggcgccggccugcugcugcccccccccggcggcggcggcggcggcagcgccggcagcggcggcggcggcggcggcggcgugggcgugcccggccugcuggugggcagcgccggcgugggcggcgaccccagccugagcagccugcccgccggcgccgcccugugccugaaguacggcgagagcgccagcagaggcagcguggccgagagcagcggcggcgagcagagccccgacgacgacagcgacggcagaugcgagcuggugcugagagccggcguggccgaccccagagccagccccggcgccggcggcggcggcgccaaggccgccgagggcugcagcaacgcccaccugcacggcggcgccagcgugccccccggcggccugggcggcggcggcggcggcggcagcagcagcggcagcagcggcggcggcggcggcagcggcagcggcagcggcggcagcagcagcagcagcagcagcagcagcaagaagagcaaggagcagaaggcccugagacugaacaucaacgccagagagagaagaagaaugcacgaccugaacgacgcccuggacgagcugagagccgugauccccuacgcccacagccccagcgugagaaagcugagcaagaucgccacccugcugcuggccaagaacuacauccugaugcaggcccaggcccuggaggagaugagaagacugguggccuaccugaaccagggccaggccaucagcgccgccagccugcccagcagcgccgccgccgccgccgccgccgccgcccugcaccccgcccugggcgccuacgagcaggccgccggcuaccccuucagcgccggccugccccccgccgccagcugccccgagaagugcgcccuguucaacagcgugagcagcagccugugcaagcagugcaccgagaagcccuaa

SEQ ID NO: 14205 - RNA, 726 nt, Artificial Sequence
  BHLHE23__Homo_sapiens__NP_542173
augagcaucagaccccccggcgagccccccagccccggcggcgccgccauggccgagcugaagagccugagcggcgacgccuaccuggcccugagccacggcuacgccgccgccgccgccggccuggccuacggcgccgccagagagcccgaggccgccagaggcuacggcacccccggccccggcggcgaccugcccgccgcccccgcccccagagcccccgcccaggccgccgagagcagcggcgagcagagcggcgacgaggacgacgccuucgagcagagaagaagaagaagaggccccggcagcgccgccgacggcagaagaagacccagagagcagagaagccugagacugagcaucaacgccagagagagaagaagaaugcacgaccugaacgacgcccuggacggccugagagccgugauccccuacgcccacagccccagcgugagaaagcugagcaagaucgccacccugcugcuggccaagaacuacauccugaugcaggcccaggcccuggacgagaugagaagacugguggccuuccugaaccagggccagggccuggccgcccccgugaacgccgccccccugacccccuucggccaggccaccgugugccccuucagcgccggcgccgcccugggccccugccccgacaagugcgccgccuucagcggcacccccagcgcccugugcaagcacugccacgagaagcccuaa

SEQ ID NO: 14206 - RNA, 1239 nt, Artificial Sequence
  BHLHE40__Homo_sapiens__NP_003661
auggagagaauccccagcgcccagcccccccccgccugccugcccaaggcccccggccuggagcacggcgaccugcccggcauguaccccgcccacauguaccagguguacaagagcagaagaggcaucaagagaagcgaggacagcaaggagaccuacaagcugccccacagacugaucgagaagaagagaagagacagaaucaacgagugcaucgcccagcugaaggaccugcugcccgagcaccugaagcugaccacccugggccaccuggagaaggccguggugcuggagcugacccugaagcacgugaaggcccugaccaaccugaucgaccagcagcagcagaagaucaucgcccugcagagcggccugcaggccggcgagcugagcggcagaaacguggagaccggccaggagauguucugcagcggcuuccagaccugcgccagagaggugcugcaguaccuggccaagcacgagaacaccagagaccugaagagcagccagcuggugacccaccugcacagaguggugagcgagcugcugcagggcggcaccagcagaaagcccagcgaccccgcccccaaggugauggacuucaaggagaagcccagcagccccgccaagggcagcgagggccccggcaagaacugcgugcccgugauccagagaaccuucgcccacagcagcggcgagcagagcggcagcgacaccgacaccgacagcggcuacggcggcgagagcgagaagggcgaccugagaagcgagcagcccugcuucaagagcgaccacggcagaagauucaccaugggcgagagaaucggcgccaucaagcaggagagcgaggagccccccaccaagaagaacagaaugcagcugagcgacgacgagggccacuucaccagcagcgaccugaucagcagccccuuccugggcccccacccccaccagccccccuucugccugcccuucuaccugaucccccccagcgccaccgccuaccugcccaugcuggagaagugcugguaccccaccagcgugcccgugcuguaccccggccugaacgccagcgccgccgcccugagcagcuucaugaaccccgacaagaucagcgccccccugcugaugccccagagacugcccagcccccugcccgcccaccccagcguggacagcagcgugcugcugcaggcccugaagcccauccccccccugaaccuggagaccaaggacuaa

SEQ ID NO: 14207 - RNA, 1449 nt, Artificial Sequence
  BHLHE41__Homo_sapiens__NP_110389
auggacgagggcaucccccaccugcaggagagacagcugcuggagcacagagacuucaucggccuggacuacagcagccuguacaugugcaagcccaagagaagcaugaagagagacgacaccaaggacaccuacaagcugccccacagacugaucgagaagaagagaagagacagaaucaacgagugcaucgcccagcugaaggaccugcugcccgagcaccugaagcugaccacccugggccaccuggagaaggccguggugcuggagcugacccugaagcaccugaaggcccugaccgcccugaccgagcagcagcaccagaagaucaucgcccugcagaacggcgagagaagccugaagagccccauccagagcgaccuggacgccuuccacagcggcuuccagaccugcgccaaggaggugcugcaguaccugagcagauucgagagcuggacccccagagagcccagaugcgugcagcugaucaaccaccugcacgccguggccacccaguuccugcccaccccccagcugcugacccagcaggugccccugagcaagggcaccggcgcccccagcgccgccggcagcgccgccgcccccugccuggagagagccggccagaagcuggagccccuggccuacugcgugcccgugauccagagaacccagcccagcgccgagcuggccgccgagaacgacaccgacaccgacagcggcuacggcggcgaggccgaggccagacccgacagagagaagggcaagggcgccggcgccagcagagugaccaucaagcaggagccccccggcgaggacagccccgcccccaagagaaugaagcuggacagcagaggcggcggcagcggcggcggccccggcggcggcgccgccgccgccgccgccgcccugcugggccccgaccccgccgccgccgccgcccugcugagacccgacgccgcccugcugagcagccugguggccuucggcggcggcggcggcgcccccuucccccagcccgccgccgccgccgcccccuucugccugcccuucugcuuccugagccccagcgccgccgccgccuacgugcagcccuuccuggacaagagcggccuggagaaguaccuguaccccgccgccgccgccgcccccuucccccugcuguaccccggcauccccgcccccgccgccgccgccgccgccgccgccgccgccgccgccgccgccgccgccuuccccugccugagcagcgugcugagccccccccccgagaaggccggcgccgccgccgccacccugcugccccacgagguggccccccugggcgccccccacccccagcacccccacggcagaacccaccugcccuucgccggccccagagagcccggcaaccccgagagcagcgcccaggaggaccccagccagcccggcaaggaggcccccuaa

SEQ ID NO: 14208 - RNA, 900 nt, Artificial Sequence
  BHMT2__Homo_sapiens__NP_001171476
auggcccccgccggcagacccggcgccaagaagggcauccuggagagacuggagagcggcgagguggugaucggcgacggcagcuuccugaucacccuggagaagagaggcuacgugaaggccggccuguggacccccgaggccgugaucgagcaccccgacgccgugagacagcugcacauggaguuccugagagccggcagcaacgugaugcagaccuucaccuucagcgccagcgaggacaacauggagagcaaguacuucgagcacguggaggaggccgugugggccguggaggugcugaaggagagcgacagacccguggccgugaccaugugcaucggccccgagggcgacaugcacgacaucacccccggcgagugcgccgugagacuggugaaggccggcgccagcaucgugggcgugaacugcagauucggccccgacaccagccugaagaccauggagcugaugaaggagggccuggagugggccggccugaaggcccaccugauggugcagccccugggcuuccacgcccccgacugcggcaaggagggcuucguggaccugcccgaguaccccuucggccuggagagcagaguggccaccagaugggacauccagaaguacgccagagaggccuacaaccugggcgugagauacaucggcggcugcugcggcuucgagcccuaccacaucagagccaucgccgaggagcuggcccccgagagaggcuuccugccccccgccagcgagaagcacggcagcuggggcagcggccuggacaugcacaccaagcccuggaucagagccagagccagaagagaguacugggagaaccugcugcccgccagcggcagacccuucugccccagccugagcaagcccgacuucuaa

SEQ ID NO: 14209 - RNA, 1221 nt, Artificial Sequence
  BHMT__Homo_sapiens__NP_001704
augccccccgugggcggcaagaaggccaagaagggcauccuggagagacugaacgccggcgagaucgugaucggcgacggcggcuucguguucgcccuggagaagagaggcuacgugaaggccggccccuggacccccgaggccgccguggagcaccccgaggccgugagacagcugcacagagaguuccugagagccggcagcaacgugaugcagaccuucaccuucuacgccagcgaggacaagcuggagaacagaggcaacuacgugcuggagaagaucagcggccaggaggugaacgaggccgccugcgacaucgccagacagguggccgacgagggcgacgcccugguggccggcggcgugagccagacccccagcuaccugagcugcaagagcgagaccgaggugaagaagguguuccugcagcagcuggagguguucaugaagaagaacguggacuuccugaucgccgaguacuucgagcacguggaggaggccgugugggccguggagacccugaucgccagcggcaagcccguggccgccaccaugugcaucggccccgagggcgaccugcacggcgugccccccggcgagugcgccgugagacuggugaaggccggcgccagcaucaucggcgugaacugccacuucgaccccaccaucagccugaagaccgugaagcugaugaaggagggccuggaggccgccagacugaaggcccaccugaugagccagccccuggccuaccacacccccgacugcaacaagcagggcuucaucgaccugcccgaguuccccuucggccuggagcccagaguggccaccagaugggacauccagaaguacgccagagaggccuacaaccugggcgugagauacaucggcggcugcugcggcuucgagcccuaccacaucagagccaucgccgaggagcuggcccccgagagaggcuuccugccccccgccagcgagaagcacggcagcuggggcagcggccuggacaugcacaccaagcccugggugagagccagagccagaaaggaguacugggagaaccugagaaucgccagcggcagacccuacaaccccagcaugagcaagcccgacggcuggggcgugaccaagggcaccgccgagcugaugcagcagaaggaggccaccaccgagcagcagcugaaggagcuguucgagaagcagaaguucaagagccaguaa

SEQ ID NO: 14210 - RNA, 2925 nt, Artificial Sequence
  BICC1__Homo_sapiens__NP_001073981
auggccgcccagggcgagcccggcuaccuggccgcccagagcgaccccggcagcaacagcgagagaagcaccgacagccccgugcccggcagcgaggacgaccugguggccggcgccacccugcacagccccgaguggagcgaggagagauucagaguggacagaaagaagcuggaggccaugcugcaggccgccgccgagggcaagggcagaagcggcgaggacuucuuccagaagaucauggaggagaccaacacccagaucgccuggcccagcaagcugaagaucggcgccaagagcaagaaggacccccacaucaaggugagcggcaagaaggaggacgugaaggaggccaaggagaugaucaugagcgugcuggacaccaagagcaacagagugacccugaagauggacgugagccacaccgagcacagccacgugaucggcaagggcggcaacaacaucaagaaggugauggaggagaccggcugccacauccacuuccccgacagcaacagaaacaaccaggccgagaagagcaaccaggugagcaucgccggccagcccgccggcguggagagcgccagagugagaaucagagagcugcugccccuggugcugauguucgagcugcccaucgccggcauccugcagcccgugcccgaccccaacagccccagcauccagcacaucagccagaccuacaacaucagcgugagcuucaagcagagaagcagaauguacggcgccaccgugaucgugagaggcagccagaacaacaccagcgccgugaaggagggcaccgccaugcugcuggagcaccuggccggcagccuggccagcgccauccccgugagcacccagcuggacaucgccgcccagcaccaccuguucaugaugggcagaaacggcagcaacaucaagcacaucaugcagagaaccggcgcccagauccacuuccccgaccccagcaacccccagaagaagagcaccguguaccugcagggcaccaucgagagcgugugccuggccagacaguaccugaugggcugccugccccuggugcugauguucgacaugaaggaggagaucgagguggacccccaguucaucgcccagcugauggagcagcuggacguguucaucagcaucaagcccaagcccaagcagcccagcaagagcgugaucgugaagagcguggagagaaacgcccugaacauguacgaggccagaaagugccugcugggccuggagagcagcggcgugaccaucgccaccagccccagccccgccagcugccccgccggccuggccugccccagccuggacauccuggccagcgccggccugggccugaccggccugggccugcugggccccaccacccugagccugaacaccagcaccacccccaacagccugcugaacgcccugaacagcagcgugagcccccugcagagccccagcagcggcacccccagccccacccugugggcccccccccuggccaacaccagcagcgccaccggcuucagcgccaucccccaccugaugauccccagcaccgcccaggccacccugaccaacauccugcugagcggcgugcccaccuacggccacaccgcccccagccccccccccggccugacccccguggacgugcacaucaacagcaugcagaccgagggcaagaagaucagcgccgcccugaacggccacgcccagagccccgacaucaaguacggcgccaucagcaccagcagccugggcgagaaggugcugagcgccaaccacggcgaccccagcauccagaccagcggcagcgagcagaccagccccaagagcagccccaccgagggcugcaacgacgccuucguggaggugggcaugcccagaagccccagccacagcggcaacgccggcgaccugaagcagaugaugugccccagcaaggugagcugcgccaagagacagaccguggagcugcugcagggcaccaagaacagccaccugcacagcaccgacagacugcugagcgaccccgagcugagcgccaccgagagcccccuggccgacaagaaggcccccggcagcgagagagccgccgagagagccgccgccgcccagcagaacagcgagagagcccaccuggcccccagaagcagcuacgugaacaugcaggccuucgacuacgagcagaagaagcugcuggccaccaaggccaugcugaagaagcccguggugaccgaggugagaacccccaccaacaccuggagcggccugggcuucagcaagagcaugcccgccgagaccaucaaggagcugagaagagccaaccacgugagcuacaagcccaccaugaccaccaccuacgagggcagcagcaugagccugagcagaagcaacagcagagagcaccugggcggcggcagcgagagcgacaacuggagagacagaaacggcaucggccccggcagccacagcgaguucgccgccagcaucggcagccccaagagaaagcagaacaagagcaccgagcacuaccugagcagcagcaacuacauggacugcaucagcagccugaccggcagcaacggcugcaaccugaacagcagcuucaagggcagcgaccugcccgagcuguucagcaagcugggccugggcaaguacaccgacguguuccagcagcaggagaucgaccugcagaccuuccugacccugaccgaccaggaccugaaggagcugggcaucaccaccuucggcgccagaagaaagaugcugcuggccaucagcgagcugaacaagaacagaagaaagcuguucgagagccccaacgccagaaccagcuuccuggagggcggcgccagcggcagacugcccagacaguaccacagcgacaucgccagcgugagcggcagaugguaa

SEQ ID NO: 14211 - RNA, 2508 nt, Artificial Sequence
  BICD1__Homo_sapiens__NP_001003398
auggccgccgaggaggugcugcagaccguggaccacuacaagaccgagaucgagagacugaccaaggagcugaccgagaccacccacgagaagauccaggccgccgaguacggccugguggugcuggaggagaagcugacccugaagcagcaguacgacgagcuggaggccgaguacgacagccugaagcaggagcuggagcagcugaaggaggccuucggccagagcuucagcauccacagaaagguggccgaggacggcgagaccagagaggagacccugcugcaggagagcgccagcaaggaggccuacuaccugggcaagauccuggagaugcagaacgagcugaagcagagcagagccguggugaccaacgugcaggccgagaacgagagacugaccgccguggugcaggaccugaaggagaacaacgagaugguggagcugcagagaaucagaaugaaggacgagaucagagaguacaaguucagagaggccagacugcugcaggacuacaccgagcuggaggaggagaacaucacccugcagaagcuggugagcacccugaagcagaaccagguggaguacgagggccugaagcacgagaucaagagauucgaggaggagaccgugcugcugaacagccagcuggaggacgccaucagacugaaggagaucgccgagcaccagcuggaggaggcccuggagacccugaagaacgagagagagcagaagaacaaccugagaaaggagcugagccaguacaucagccugaacgacaaccacaucagcaucagcguggacggccugaaguucgccgaggacggcagcgagcccaacaacgacgacaagaugaacggccacauccacggcccccuggugaagcugaacggcgacuacagaacccccacccugagaaagggcgagagccugaaccccgugagcgaccuguucagcgagcugaacaucagcgagauccagaagcugaagcagcagcugaugcagguggagagagagaaggccauccugcuggccaaccugcaggagagccagacccagcuggagcacaccaagggcgcccugaccgagcagcacgagagagugcacagacugaccgagcacgugaacgccaugagaggccugcagagcagcaaggagcugaaggccgagcuggacggcgagaagggcagagacagcggcgaggaggcccacgacuacgagguggacaucaacggccuggagauccuggagugcaaguacagaguggccgugaccgaggugaucgaccugaaggccgagaucaaggcccugaaggagaaguacaacaagagcguggagaacuacaccgacgagaaggccaaguacgagagcaagauccagauguacgacgagcaggugaccagccuggagaagaccaccaaggagagcggcgagaagauggcccacauggagaaggagcugcagaagaugaccagcaucgccaacgagaaccacagcacccugaacaccgcccaggacgagcuggugaccuucagcgaggagcuggcccagcuguaccaccacgugugccugugcaacaacgagacccccaacagagugaugcuggacuacuacagacagagcagagugaccagaagcggcagccugaagggccccgacgaccccagaggccugcugagccccagacuggccagaagaggcgugagcagccccguggagaccagaaccagcagcgagcccguggccaaggagagcaccgaggccagcaaggagcccagccccaccaagacccccaccaucagccccgugaucaccgccccccccagcagccccgugcuggacaccagcgacaucagaaaggagcccaugaacaucuacaaccugaacgccaucaucagagaccagaucaagcaccugcagaaggccguggacagaagccugcagcugagcagacagagagccgccgccagagagcuggcccccaugaucgacaaggacaaggaggcccugauggaggagauccugaagcugaagagccugcugagcaccaagagagagcagaucgccacccugagagccgugcugaaggccaacaagcagaccgccgagguggcccuggccaaccugaagaacaaguacgagaacgagaaggccauggugaccgagaccaugaccaagcugagaaacgagcugaaggcccugaaggaggacgccgccaccuucagcagccugagagccauguucgccaccagaugcgacgaguacgugacccagcuggacgagaugcagagacagcuggccgccgccgaggacgagaagaagacccugaacacccugcugagaauggccauccagcagaagcuggcccugacccagagacuggaggaccuggaguucgaccacgagcagagcagaagaagcaagggcaagcugggcaagagcaagaucggcagccccaagaucgugagcagccugcugccccccuacagacacagcgcccacaacuaa

SEQ ID NO: 14212 - RNA, 2568 nt, Artificial Sequence
  BICD2__Homo_sapiens__NP_001003800
augagcgcccccagcgaggaggaggaguacgccagacuggugauggaggcccagcccgaguggcugagagccgaggugaagagacugagccacgagcuggccgagaccaccagagagaagauccaggccgccgaguacggccuggccgugcuggaggagaagcaccagcugaagcugcaguucgaggagcuggagguggacuacgaggccaucagaagcgagauggagcagcugaaggaggccuucggccaggcccacaccaaccacaagaagguggccgccgacggcgagagcagagaggagagccugauccaggagagcgccagcaaggagcaguacuacgugagaaaggugcuggagcugcagaccgagcugaagcagcugagaaacgugcugaccaacacccagagcgagaacgagagacuggccagcguggcccaggagcugaaggagaucaaccagaacguggagauccagagaggcagacugagagacgacaucaaggaguacaaguucagagaggccagacugcugcaggacuacagcgagcuggaggaggagaacaucagccugcagaagcaggugagcgugcugagacagaaccagguggaguucgagggccugaagcacgagaucaagagacuggaggaggagaccgaguaccugaacagccagcuggaggacgccaucagacugaaggagaucagcgagagacagcuggaggaggcccuggagacccugaagaccgagagagagcagaagaacagccugagaaaggagcugagccacuacaugagcaucaacgacagcuucuacaccagccaccugcacgugagccuggacggccugaaguucagcgacgacgccgccgagcccaacaacgacgccgaggcccuggugaacggcuucgagcacggcggccuggccaagcugccccuggacaacaagaccagcacccccaagaaggagggccuggccccccccagccccagccuggugagcgaccugcugagcgagcugaacaucagcgagauccagaagcugaagcagcagcugaugcagauggagagagagaaggccggccugcuggccacccugcaggacacccagaagcagcuggagcacaccagaggcagccugagcgagcagcaggagaaggugaccagacugaccgagaaccugagcgcccugagaagacugcaggccagcaaggagagacagaccgcccuggacaacgagaaggacagagacagccacgaggacggcgacuacuacgagguggacaucaacggccccgagauccuggccugcaaguaccacguggccguggccgaggccggcgagcugagagagcagcugaaggcccugagaagcacccacgaggccagagaggcccagcacgccgaggagaagggcagauacgaggccgagggccaggcccugaccgagaaggugagccugcuggagaaggccagcagacaggacagagagcugcuggccagacuggagaaggagcugaagaaggugagcgacguggccggcgagacccagggcagccugagcguggcccaggacgagcuggugaccuucagcgaggagcuggccaaccuguaccaccacgugugcaugugcaacaacgagacccccaacagagugaugcuggacuacuacagagagggccagggcggcgccggcagaaccagccccggcggcagaaccagccccgaggccagaggcagaagaagccccauccugcugcccaagggccugcuggcccccgaggccggcagagccgacggcggcaccggcgacagcagccccagccccggcagcagccugcccagcccccugagcgaccccagaagagagcccaugaacaucuacaaccugaucgccaucaucagagaccagaucaagcaccugcaggccgccguggacagaaccaccgagcugagcagacagagaaucgccagccaggagcugggccccgccguggacaaggacaaggaggcccugauggaggagauccugaagcugaagagccugcugagcaccaagagagagcagaucaccacccugagaaccgugcugaaggccaacaagcagaccgccgagguggcccuggccaaccugaagagcaaguacgagaacgagaaggccauggugaccgagaccaugaugaagcugagaaacgagcugaaggcccugaaggaggacgccgccaccuucagcagccugagagccauguucgccaccagaugcgacgaguacaucacccagcuggacgagaugcagagacagcuggccgccgccgaggacgagaagaagacccugaacagccugcugagaauggccauccagcagaagcuggcccugacccagagacuggagcugcuggagcuggaccacgagcagaccagaagaggcagagccaaggccgcccccaagaccaagcccgccacccccagcgugagccacaccugcgccugcgccagcgacagagccgagggcaccggccuggccaaccagguguucugcagcgagaagcacagcaucuacugcgacuaa

SEQ ID NO: 14213 - RNA, 588 nt, Artificial Sequence
  BID__Homo_sapiens__NP_001187
auggacugcgaggugaacaacggcagcagccugagagacgagugcaucaccaaccugcugguguucggcuuccugcagagcugcagcgacaacagcuucagaagagagcuggacgcccugggccacgagcugcccgugcuggccccccagugggagggcuacgacgagcugcagaccgacggcaacagaagcagccacagcagacugggcagaaucgaggccgacagcgagagccaggaggacaucaucagaaacaucgccagacaccuggcccaggugggcgacagcauggacagaagcaucccccccggccuggugaacggccuggcccugcagcugagaaacaccagcagaagcgaggaggacagaaacagagaccuggccaccgcccuggagcagcugcugcaggccuaccccagagacauggagaaggagaagaccaugcuggugcuggcccugcugcuggccaagaagguggccagccacacccccagccugcugagagacguguuccacaccaccgugaacuucaucaaccagaaccugagaaccuacgugagaagccuggccagaaacggcauggacuaa

SEQ ID NO: 14214 - RNA, 1365 nt, Artificial Sequence
  BIN1__Homo_sapiens__NP_004296
auggccgagaugggcagcaagggcgugaccgccggcaagaucgccagcaacgugcagaagaagcugaccagagcccaggagaaggugcugcagaagcugggcaaggccgacgagaccaaggacgagcaguucgagcagugcgugcagaacuucaacaagcagcugaccgagggcaccagacugcagaaggaccugagaaccuaccuggccagcgugaaggccaugcacgaggccagcaagaagcugaacgagugccugcaggagguguacgagcccgacuggcccggcagagacgaggccaacaagaucgccgagaacaacgaccugcuguggauggacuaccaccagaagcugguggaccaggcccugcugaccauggacaccuaccugggccaguuccccgacaucaagagcagaaucgccaagagaggcagaaagcugguggacuacgacagcgccagacaccacuacgagagccugcagaccgccaagaagaaggacgaggccaagaucgccaaggccgaggaggagcugaucaaggcccagaagguguucgaggagaugaacguggaccugcaggaggagcugcccagccuguggaacagcagagugggcuucuacgugaacaccuuccagagcaucgccggccuggaggagaacuuccacaaggagaugagcaagcugaaccagaaccugaacgacgugcuggugggccuggagaagcagcacggcagcaacaccuucaccgugaaggcccagcccagaaagaagagcaagcuguucagcagacugagaagaaagaagaacagcgacaacgcccccgccaagggcaacaagagccccagcccccccgacggcagccccgccgccacccccgagaucagagugaaccacgagcccgagcccgccggcggcgccacccccggcgccacccugcccaagagccccagccagcccgccgaggccagcgagguggccggcggcacccagcccgccgccggcgcccaggagcccggcgagaccgccgccagcgaggccgccagcagcagccugcccgccguggugguggagaccuuccccgccaccgugaacggcaccguggagggcggcagcggcgccggcagacuggaccugccccccggcuucauguucaaggugcaggcccagcacgacuacaccgccaccgacaccgacgagcugcagcugaaggccggcgacguggugcuggugauccccuuccagaaccccgaggagcaggacgagggcuggcugaugggcgugaaggagagcgacuggaaccagcacaaggagcuggagaagugcagaggcguguuccccgagaacuucaccgagagagugcccuaa

SEQ ID NO: 14215 - RNA, 1620 nt, Artificial Sequence
  BIN2__Homo_sapiens__NP_001276936
auggugcugcagaagcugggcaaggccguggagaccaaggacgagagauucgagcagagcgccagcaacuucuaccagcagcaggccgagggccacaagcuguacaaggaccugaagaacuuccugagcgccgugaaggugaugcacgagagcagcaagagagugagcgagacccugcaggagaucuacagcagcgagugggacggccacgaggagcugaaggccaucguguggaacaacgaccugcugugggaggacuacgaggagaagcuggccgaccaggccgugagaaccauggagaucuacguggcccaguucagcgagaucaaggagagaaucgccaagagaggcagaaagcugguggacuacgacagcgccagacaccaccuggaggccgugcagaacgccaagaagaaggacgaggccaagaccgccaaggccgaggaggaguucaacaaggcccagaccguguucgaggaccugaaccaggagcugcuggaggagcugcccauccuguacaacagcagaaucggcugcuacgugaccaucuuccagaacaucagcaaccugagagacguguucuacagagagaugagcaagcugaaccacaaccuguacgaggugaugagcaagcuggagaagcagcacagcaacaagguguucguggugaagggccugagcagcagcagcagaagaagccuggugaucagcccccccgugagaaccgccaccgugagcagcccccugaccagccccaccagccccagcacccugagccugaagagcgagagcgagagcgugagcgccaccgaggaccuggcccccgacgccgcccagggcgaggacaacagcgagaucaaggagcugcuggaggaggaggagaucgagaaggagggcagcgaggccagcagcagcgaggaggacgagccccugcccgccugcaacggccccgcccaggcccagcccagccccaccaccgagagagccaagagccaggaggaggugcugcccagcagcaccacccccagccccggcggcgcccugagccccagcggccagcccagcagcagcgccaccgagguggugcugagaaccagaaccgccagcgagggcagcgagcagcccaagaagagagccagcauccagagaaccagcgccccccccagcagaccccccccccccagagccaccgccagccccagacccagcagcggcaacauccccagcagccccaccgccagcggcggcggcagccccaccagccccagagccagccugggcaccggcaccgccagccccagaaccagccuggaggugagccccaaccccgagccccccgagaagcccgugagaacccccgaggccaaggagaacgagaacauccacaaccagaaccccgaggagcugugcaccagccccacccugaugaccagccagguggccagcgagcccggcgaggccaagaagauggaggacaaggagaaggacaacaagcugaucagcgccaacagcagcgagggccaggaccagcugcaggugagcauggugcccgagaacaacaaccugaccgcccccgagccccaggaggaggugagcaccagcgagaacccccagcuguaa

SEQ ID NO: 14216 - RNA, 762 nt, Artificial Sequence
  BIN3__Homo_sapiens__NP_061158
augagcuggauccccuucaagaucggccagcccaagaagcagaucgugcccaagaccguggagagagacuucgagagagaguacggcaagcugcagcagcuggaggagcagaccagaagacugcagaaggacaugaagaagagcaccgacgccgaccuggccaugagcaagagcgccgugaagaucagccuggaccugcugagcaacccccugugcgagcaggaccaggaccugcugaacauggugaccgcccuggacaccgccaugaagagaauggacgccuucaaccaggagaaggugaaccagauccagaagaccgugaucgagccccugaagaaguucggcagcguguuccccagccugaacauggccgugaagagaagagagcaggcccugcaggacuacagaagacugcaggccaagguggagaaguacgaggagaaggagaagaccggccccgugcuggccaagcugcaccaggccagagaggagcugagacccgugagagaggacuucgaggccaagaacagacagcugcuggaggagaugcccagauucuacggcagcagacuggacuacuuccagcccagcuucgagagccugaucagagcccaggugguguacuacagcgagaugcacaagaucuucggcgaccugagccaccagcuggaccagcccggccacagcgacgagcagagagagagagagaacgaggccaagcugagcgagcugagagcccugagcaucguggccgacgacuaa

SEQ ID NO: 14217 - RNA, 1857 nt, Artificial Sequence
  BIRC2__Homo_sapiens__NP_001243092
augcacaagaccgccagccagagacuguuccccggccccagcuaccagaacaucaagagcaucauggaggacagcaccauccugagcgacuggaccaacagcaacaagcagaagaugaaguacgacuucagcugcgagcuguacagaaugagcaccuacagcaccuuccccgccggcgugcccgugagcgagagaagccuggccagagccggcuucuacuacaccggcgugaacgacaaggugaagugcuucugcugcggccugaugcuggacaacuggaagcugggcgacagccccauccagaagcacaagcagcuguaccccagcugcagcuucauccagaaccuggugagcgccagccugggcagcaccagcaagaacaccagccccaugagaaacagcuucgcccacagccugagccccacccuggagcacagcagccuguucagcggcagcuacagcagccugagccccaacccccugaacagcagagccguggaggacaucagcagcagcagaaccaaccccuacagcuacgccaugagcaccgaggaggccagauuccugaccuaccacauguggccccugaccuuccugagccccagcgagcuggccagagccggcuucuacuacaucggccccggcgacagaguggccugcuucgccugcggcggcaagcugagcaacugggagcccaaggacgacgccaugagcgagcacagaagacacuuccccaacugccccuuccuggagaacagccuggagacccugagauucagcaucagcaaccugagcaugcagacccacgccgccagaaugagaaccuucauguacuggcccagcagcgugcccgugcagcccgagcagcuggccagcgccggcuucuacuacgugggcagaaacgacgacgugaagugcuucugcugcgacggcggccugagaugcugggagagcggcgacgaccccuggguggagcacgccaagugguuccccagaugcgaguuccugaucagaaugaagggccaggaguucguggacgagauccagggcagauacccccaccugcuggagcagcugcugagcaccagcgacaccaccggcgaggagaacgccgacccccccaucauccacuucggccccggcgagagcagcagcgaggacgccgugaugaugaacacccccguggugaagagcgcccuggagaugggcuucaacagagaccuggugaagcagaccgugcagagcaagauccugaccaccggcgagaacuacaagaccgugaacgacaucgugagcgcccugcugaacgccgaggacgagaagagagaggaggagaaggagaagcaggccgaggagauggccagcgacgaccugagccugaucagaaagaacagaauggcccuguuccagcagcugaccugcgugcugcccauccuggacaaccugcugaaggccaacgugaucaacaagcaggagcacgacaucaucaagcagaagacccagaucccccugcaggccagagagcugaucgacaccauccuggugaagggcaacgccgccgccaacaucuucaagaacugccugaaggagaucgacagcacccuguacaagaaccuguucguggacaagaacaugaaguacauccccaccgaggacgugagcggccugagccuggaggagcagcugagaagacugcaggaggagagaaccugcaaggugugcauggacaaggaggugagcgugguguucauccccugcggccaccugguggugugccaggagugcgcccccagccugagaaagugccccaucugcagaggcaucaucaagggcaccgugagaaccuuccugagcuaa

SEQ ID NO: 14218 - RNA, 1815 nt, Artificial Sequence
  BIRC3__Homo_sapiens__NP_892007
augaacaucguggagaacagcaucuuccugagcaaccugaugaagagcgccaacaccuucgagcugaaguacgaccugagcugcgagcuguacagaaugagcaccuacagcaccuuccccgccggcgugcccgugagcgagagaagccuggccagagccggcuucuacuacaccggcgugaacgacaaggugaagugcuucugcugcggccugaugcuggacaacuggaagagaggcgacagccccaccgagaagcacaagaagcuguaccccagcugcagauucgugcagagccugaacagcgugaacaaccuggaggccaccagccagcccaccuuccccagcagcgugaccaacagcacccacagccugcugcccggcaccgagaacagcggcuacuucagaggcagcuacagcaacagccccagcaaccccgugaacagcagagccaaccaggacuucagcgcccugaugagaagcagcuaccacugcgccaugaacaacgagaacgccagacugcugaccuuccagaccuggccccugaccuuccugagccccaccgaccuggccaaggccggcuucuacuacaucggccccggcgacagaguggccugcuucgccugcggcggcaagcugagcaacugggagcccaaggacaacgccaugagcgagcaccugagacacuuccccaagugccccuucaucgagaaccagcugcaggacaccagcagauacaccgugagcaaccugagcaugcagacccacgccgccagauucaagaccuucuucaacuggcccagcagcgugcuggugaaccccgagcagcuggccagcgccggcuucuacuacgugggcaacagcgacgacgugaagugcuucugcugcgacggcggccugagaugcugggagagcggcgacgaccccugggugcagcacgccaagugguuccccagaugcgaguaccugaucagaaucaagggccaggaguucaucagacaggugcaggccagcuacccccaccugcuggagcagcugcugagcaccagcgacagccccggcgacgagaacgccgagagcagcaucauccacuucgagcccggcgaggaccacagcgaggacgccaucaugaugaacacccccgugaucaacgccgccguggagaugggcuucagcagaagccuggugaagcagaccgugcagagaaagauccuggccaccggcgagaacuacagacuggugaacgaccuggugcuggaccugcugaacgccgaggacgagaucagagaggaggagagagagagagccaccgaggagaaggagagcaacgaccugcugcugaucagaaagaacagaauggcccuguuccagcaccugaccugcgugauccccauccuggacagccugcugaccgccggcaucaucaacgagcaggagcacgacgugaucaagcagaagacccagaccagccugcaggccagagagcugaucgacaccauccuggugaagggcaacaucgccgccaccguguucagaaacagccugcaggaggccgaggccgugcuguacgagcaccuguucgugcagcaggacaucaaguacauccccaccgaggacgugagcgaccugcccguggaggagcagcugagaagacugcaggaggagagaaccugcaaggugugcauggacaaggaggugagcaucguguucauccccugcggccaccugguggugugcaaggacugcgcccccagccugagaaagugccccaucugcagaagcaccaucaagggcaccgugagaaccuuccugagcuaa

SEQ ID NO: 14219 - RNA, 414 nt, Artificial Sequence
  BIRC5__Homo_sapiens__NP_001012270
augggcgcccccacccugccccccgccuggcagcccuuccugaaggaccacagaaucagcaccuucaagaacuggcccuuccuggagggcugcgccugcacccccgagagaauggccgaggccggcuucauccacugccccaccgagaacgagcccgaccuggcccagugcuucuucugcuucaaggagcuggagggcugggagcccgacgacgaccccaugcagagaaagcccaccaucagaagaaagaaccugagaaagcugagaagaaagugcgccgugcccagcagcagcuggcugcccuggaucgaggccagcggcagaagcugccuggugcccgaguggcugcaccacuuccagggccuguuccccggcgccaccagccugcccgugggcccccuggccaugagcuaa

SEQ ID NO: 14220 - RNA, 14574 nt, Artificial Sequence
  BIRC6__Homo_sapiens__NP_057336
auggugaccggcggcggcgccgccccccccggcaccgugaccgagccccugcccagcgugaucgugcugagcgccggcagaaagauggccgccgccgccgccgccgccagcggccccggcugcagcagcgccgccggcgccggcgccgccggcgugagcgaguggcuggugcugagagacggcugcaugcacugcgacgccgacggccugcacagccugagcuaccaccccgcccugaacgccauccuggccgugaccagcagaggcaccaucaaggugaucgacggcaccagcggcgccacccugcaggccagcgcccugagcgccaagcccggcggccaggugaagugccaguacaucagcgccguggacaaggugaucuucguggacgacuacgccgugggcugcagaaaggaccugaacggcauccugcugcuggacaccgcccugcagacccccgugagcaagcaggacgacguggugcagcuggagcugcccgugaccgaggcccagcagcugcugagcgccugccuggagaagguggacaucagcagcaccgagggcuacgaccuguucaucacccagcugaaggacggccugaagaacaccagccacgagaccgccgccaaccacaagguggccaagugggccaccgugaccuuccaccugccccaccacgugcugaagagcaucgccagcgccaucgugaacgagcugaagaagaucaaccagaacguggccgcccugcccguggccagcagcgugauggacagacugagcuaccugcugcccagcgccagacccgagcugggcgugggccccggcagaagcguggacagaagccugauguacagcgaggccaacagaagagagaccuucaccagcuggccccacgugggcuacagaugggcccagcccgaccccauggcccaggccggcuucuaccaccagcccgccagcagcggcgacgacagagccaugugcuucaccugcagcgugugccuggugugcugggagcccaccgacgagcccuggagcgagcacgagagacacagccccaacugccccuucgugaagggcgagcacacccagaacgugccccugagcgugacccuggccaccagccccgcccaguuccccugcaccgacggcaccgacagaaucagcugcuucggcagcggcagcugcccccacuuccuggccgccgccaccaagagaggcaagaucugcaucugggacgugagcaagcugaugaaggugcaccugaaguucgagaucaacgccuacgaccccgccaucgugcagcagcugauccugagcggcgaccccagcagcggcguggacagcagaagacccacccuggccuggcuggaggacagcagcagcugcagcgacauccccaagcuggagggcgacagcgacgaccugcuggaggacagcgacagcgaggagcacagcagaagcgacagcgugaccggccacaccagccagaaggaggccauggaggugagccuggacaucaccgcccugagcauccugcagcagcccgagaagcugcagugggagaucguggccaacgugcuggaggacaccgugaaggaccuggaggagcugggcgccaaccccugccugaccaacagcaagagcgagaagaccaaggagaagcaccaggagcagcacaacauccccuuccccugccugcuggccggcggccugcugaccuacaagagccccgccaccagccccaucagcagcaacagccacagaagccuggacggccugagcagaacccagggcgagagcaucagcgagcagggcagcaccgacaacgagagcugcaccaacagcgagcugaacagcccccuggugagaagaacccugcccgugcugcugcuguacagcaucaaggagagcgacgagaaggccggcaagaucuucagccagaugaacaacaucaugagcaagagccugcacgacgacggcuucaccgugccccagaucaucgagauggagcuggacagccaggagcagcugcugcugcaggacccccccgugaccuacauccagcaguucgccgacgccgccgccaaccugaccagccccgacagcgagaaguggaacagcguguuccccaagcccggcacccuggugcagugccugagacugcccaaguucgccgaggaggagaaccugugcaucgacagcaucacccccugcgccgacggcauccaccugcuggugggccugagaaccugccccguggagagccugagcgccaucaaccagguggaggcccugaacaaccugaacaagcugaacagcgcccugugcaacagaagaaagggcgagcuggagagcaaccuggccguggugaacggcgccaacaucagcgugauccagcacgagagccccgccgacgugcagaccccccugaucauccagcccgagcagagaaacgugagcggcggcuaccuggugcuguacaagaugaacuacgccaccagaaucgugacccuggaggaggagcccaucaagauccagcacaucaaggacccccaggacaccaucaccagccugauccugcugccccccgacauccuggacaacagagaggacgacugcgaggagcccaucgaggacaugcagcugaccagcaagaacggcuucgagagagagaagaccagcgacaucagcacccugggccaccuggugaucaccacccagggcggcuacgugaagauccuggaccugagcaacuucgagauccuggccaagguggagccccccaagaaggagggcaccgaggagcaggacaccuucgugagcgugaucuacugcagcggcaccgacagacugugcgccugcaccaagggcggcgagcugcacuuccugcagaucggcggcaccugcgacgacaucgacgaggccgacauccugguggacggcagccugagcaagggcaucgagcccagcagcgagggcagcaagccccugagcaaccccagcagccccggcaucagcggcguggaccugcugguggaccagcccuucacccuggagauccugaccagccugguggagcugaccagauucgagacccugacccccagauucagcgccaccgugccccccugcuggguggaggugcagcaggagcagcagcagagaagacacccccagcaccugcaccagcagcaccacggcgacgccgcccagcacaccagaaccuggaagcugcagaccgacagcaacagcugggacgagcacguguucgagcuggugcugcccaaggccugcauggugggccacguggacuucaaguucgugcugaacagcaacaucaccaacaucccccagauccaggugacccugcugaagaacaaggcccccggccugggcaaggugaacgcccugaacaucgagguggagcagaacggcaagcccagccugguggaccugaacgaggagaugcagcacauggacguggaggagagccagugccugagacugugccccuuccuggaggaccacaaggaggacauccugugcggccccguguggcuggccagcggccuggaccugagcggccacgccggcaugcugacccugaccagccccaagcuggugaagggcauggccggcggcaaguacagaagcuuccugauccacgugaaggccgugaacgagagaggcaccgaggagaucugcaacggcggcaugagacccguggugagacugcccagccugaagcaccagagcaacaagggcuacagccuggccagccugcuggccaagguggccgccggcaaggagaagagcagcaacgugaagaacgagaacaccagcggcaccagaaagagcgagaaccugagaggcugcgaccugcugcaggaggugagcgugaccaucagaagauucaagaagaccagcaucagcaaggagagagugcagagaugcgccaugcugcaguucagcgaguuccacgagaagcugcugaacacccugugcagaaagaccgacgacggccagaucaccgagcacgcccagagccuggugcuggacacccugugcuggcuggccggcgugcacagcaacggccccggcagcagcaaggagggcaacgagaaccugcugagcaagaccagaaaguuccugagcgacaucgugagagugugcuucuucgaggccggcagaagcaucgcccacaagugcgccagauuccuggcccugugcaucagcaacggcaagugcgaccccugccagcccgccuucggccccgugcugcugaaggcccugcuggacaacaugagcuuccugcccgccgccaccaccggcggcagcguguacugguacuucgugcugcugaacuacgugaaggacgaggaccuggccggcugcagcaccgccugcgccagccugcugaccgccgugagcagacagcugcaggacagacugacccccauggaggcccugcugcagaccagauacggccuguacagcagccccuucgaccccgugcuguucgaccuggagaugagcggcagcagcugcaagaacguguacaacagcagcaucggcgugcagagcgacgagaucgaccugagcgacgugcugagcggcaacggcaaggugagcagcugcaccgccgccgagggcagcuucaccagccugaccggccugcuggagguggagccccugcacuucaccugcgugagcaccagcgacggcaccagaaucgagagagacgacgccaugagcagcuucggcgugacccccgccgugggcggccugagcagcggcaccgugggcgaggccagcaccgcccugagcagcgccgcccagguggcccugcagagccugagccacgccauggccagcgccgagcagcagcugcaggugcugcaggagaagcagcagcagcugcugaagcugcagcagcagaaggccaagcuggaggccaagcugcaccagaccaccgccgccgccgccgccgccgccagcgccgugggccccgugcacaacagcgugcccagcaaccccguggccgcccccggcuucuucauccaccccagcgacgugaucccccccacccccaagaccaccccccuguucaugacccccccccugaccccccccaacgaggccgugagcguggugaucaacgccgagcuggcccagcuguuccccggcagcgugaucgacccccccgccgugaaccuggccgcccacaacaagaacagcaacaagagcagaaugaacccccugggcagcggccuggcccuggccaucagccacgccagccacuuccugcagccccccccccaccagagcaucaucaucgagagaaugcacagcggcgccagaagauucgugacccuggacuucggcagacccauccugcugaccgacgugcugauccccaccugcggcgaccuggccagccugagcaucgacaucuggacccugggcgaggagguggacggcagaagacuggugguggccaccgacaucagcacccacagccugauccugcacgaccugauccccccccccgugugcagauucaugaagaucaccgugaucggcagauacggcagcaccaacgccagagccaagaucccccugggcuucuacuacggccacaccuacauccugcccugggagagcgagcugaagcugaugcacgacccccugaagggcgagggcgagagcgccaaccagcccgagaucgaccagcaccuggccaugaugguggcccugcaggaggacauccagugcagauacaaccuggccugccacagacuggagacccugcugcagagcaucgaccugcccccccugaacagcgccaacaacgcccaguacuuccugagaaagcccgacaaggccguggaggaggacagcagaguguucagcgccuaccaggacugcauccagcugcagcugcagcugaaccuggcccacaacgccgugcagagacugaagguggcccugggcgccagcagaaagaugcugagcgagaccagcaaccccgaggaccugauccagaccagcagcaccgagcagcugagaaccaucaucagauaccugcuggacacccugcugagccugcugcacgccagcaacggccacagcgugcccgccgugcugcagagcaccuuccacgcccaggccugcgaggagcuguucaagcaccugugcaucagcggcacccccaagaucagacugcacaccggccugcugcuggugcagcugugcggcggcgagagaugguggggccaguuccugagcaacgugcugcaggagcuguacaacagcgagcagcugcugaucuucccccaggacagaguguucaugcugcugagcugcaucggccagagaagccugagcaacagcggcgugcuggagagccugcugaaccugcuggacaaccugcugagcccccugcagccccagcugcccaugcacagaagaaccgagggcgugcuggacauccccaugaucagcuggguggugaugcuggugagcagacugcuggacuacguggccaccguggaggacgaggccgccgccgccaagaagccccugaacggcaaccaguggagcuucaucaacaacaaccugcacacccagagccugaacagaagcagcaagggcagcagcagccuggacagacuguacagcagaaagaucagaaagcagcuggugcaccacaagcagcagcugaaccugcugaaggccaagcagaaggcccugguggagcagauggagaaggagaagauccagagcaacaagggcagcagcuacaagcugcugguggagcaggccaagcugaagcaggccaccagcaagcacuucaaggaccugaucagacugagaagaaccgccgaguggagcagaagcaaccuggacaccgaggugaccaccgccaaggagagccccgagaucgagccccugcccuucacccuggcccacgagagaugcaucagcguggugcagaagcuggugcuguuccugcugagcauggacuucaccugccacgccgaccugcugcuguucgugugcaaggugcuggccagaaucgccaacgccaccagacccaccauccaccugugcgagaucgugaacgagccccagcuggagagacugcugcugcugcuggugggcaccgacuucaacagaggcgacaucagcuggggcggcgccugggcccaguacagccugaccugcaugcugcaggacauccuggccggcgagcugcuggcccccguggccgccgaggccauggaggagggcaccgugggcgacgacgugggcgccaccgccggcgacagcgacgacagccugcagcagagcagcgugcagcugcuggagaccaucgacgagccccugacccacgacaucaccggcgcccccccccugagcagccuggagaaggacaaggagaucgaccuggagcugcugcaggaccugauggagguggacaucgacccccuggacaucgaccuggagaaggacccccuggccgccaagguguucaagcccaucagcagcaccugguacgacuacuggggcgccgacuacggcaccuacaacuacaaccccuacaucggcggccugggcauccccguggccaagccccccgccaacaccgagaagaacggcagccagaccgugagcgugagcgugagccaggcccuggacgccagacuggaggugggccuggagcagcaggccgagcugaugcugaagaugaugagcacccuggaggccgacagcauccugcaggcccugaccaacaccagccccacccugagccagagccccaccggcaccgacgacagccugcugggcggccugcaggccgccaaccagaccagccagcugaucauccagcugagcagcgugcccaugcugaacgugugcuucaacaagcuguucagcaugcugcaggugcaccacgugcagcuggagagccugcugcagcuguggcugacccugagccugaacagcagcagcaccggcaacaaggagaacggcgccgacaucuuccuguacaacgccaacagaauccccgugaucagccugaaccaggccagcaucaccagcuuccugaccgugcuggccugguaccccaacacccugcugagaaccuggugccuggugcugcacagccugacccugaugaccaacaugcagcugaacagcggcagcagcagcgccaucggcacccaggagagcaccgcccaccugcuggugagcgaccccaaccugauccacgugcuggugaaguuccugagcggcaccagcccccacggcaccaaccagcacagcccccaggugggccccaccgccacccaggccaugcaggaguuccugaccagacugcaggugcaccugagcagcaccugcccccagaucuucagcgaguuccugcugaagcugauccacauccugagcaccgagagaggcgccuuccagaccggccagggcccccuggacgcccaggugaagcugcuggaguucacccuggagcagaacuucgagguggugagcgugagcaccaucagcgccgugaucgagagcgugaccuuccuggugcaccacuacaucaccugcagcgacaaggugaugagcagaagcggcagcgacagcagcgugggcgccagagccugcuucggcggccuguucgccaaccugaucagacccggcgacgccaaggccgugugcggcgagaugaccagagaccagcugauguucgaccugcugaagcuggugaacauccuggugcagcugccccugagcggcaacagagaguacagcgccagagugagcgugaccaccaacaccaccgacagcgugagcgacgaggagaaggugagcggcggcaaggacggcaacggcagcagcaccagcgugcagggcagccccgccuacguggccgaccuggugcuggccaaccagcagaucaugagccagauccugagcgcccugggccugugcaacagcagcgccauggccaugaucaucggcgccagcggccugcaccugaccaagcacgagaacuuccacggcggccuggacgccaucagcgugggcgacggccuguucaccauccugaccacccugagcaagaaggccagcaccgugcacaugaugcugcagcccauccugaccuacauggccugcggcuacaugggcagacagggcagccuggccaccugccagcugagcgagccccugcugugguucauccugagagugcuggacaccagcgacgcccugaaggccuuccacgacaugggcggcgugcagcugaucugcaacaacauggugaccagcaccagagccaucgugaacaccgccagaagcauggugagcaccaucaugaaguuccuggacagcggccccaacaaggccguggacagcacccugaagaccagaauccuggccagcgagcccgacaacgccgagggcauccacaacuucgccccccugggcaccaucaccagcagcagccccaccgcccagcccgccgaggugcugcugcaggccacccccccccacagaagagccagaagcgccgccuggagcuacaucuuccugcccgaggaggccuggugcgaccugaccauccaccugcccgccgccgugcugcugaaggagauccacauccagccccaccuggccagccuggccaccugccccagcagcgugagcguggaggugagcgccgacggcgugaacaugcugccccugagcacccccguggugaccagcggccugaccuacaucaagauccagcuggugaaggccgagguggccagcgccgugugccugagacugcacagacccagagacgccagcacccugggccugagccagaucaagcugcugggccugaccgccuucggcaccaccagcagcgccaccgugaacaaccccuuccugcccagcgaggaccaggugagcaagaccagcaucggcuggcugagacugcugcaccacugccugacccacaucagcgaccuggagggcaugauggccagcgccgccgcccccaccgccaaccugcugcagaccugcgccgcccugcugaugagccccuacugcggcaugcacagccccaacaucgagguggugcuggugaagaucggccugcagagcaccagaaucggccugaagcugaucgacauccugcugagaaacugcgccgccagcggcagcgaccccaccgaccugaacagcccccugcuguucggcagacugaacggccugagcagcgacagcaccaucgacauccuguaccagcugggcaccacccaggaccccggcaccaaggacagaauccaggcccugcugaagugggugagcgacagcgccagaguggccgccaugaagagaagcggcagaaugaacuacaugugccccaacagcagcaccguggaguacggccugcugaugcccagccccagccaccugcacugcguggccgccauccuguggcacagcuacgagcugcugguggaguacgaccugcccgcccugcuggaccaggagcuguucgagcugcuguucaacuggagcaugagccugcccugcaacauggugcugaagaaggccguggacagccugcugugcagcaugugccacgugcaccccaacuacuucagccugcugaugggcuggaugggcaucacccccccccccgugcagugccaccacagacugagcaugaccgacgacagcaagaagcaggaccugagcagcagccugaccgacgacagcaagaacgcccaggccccccuggcccugaccgagagccaccuggccacccuggccagcagcagccagagccccgaggccaucaagcagcugcuggacagcggccugcccagccugcuggugagaagccuggccagcuucugcuucagccacaucagcagcagcgagagcaucgcccagagcaucgacaucagccaggacaagcugagaagacaccacgugccccagcagugcaacaagaugcccaucaccgccgaccugguggcccccauccugagauuccugaccgaggugggcaacagccacaucaugaaggacuggcugggcggcagcgaggugaacccccuguggaccgcccugcuguuccugcugugccacagcggcagcaccagcggcagccacaaccugggcgcccagcagaccagcgccagaagcgccagccugagcagcgccgccaccaccggccugaccacccagcagagaaccgccaucgagaacgccaccguggccuucuuccugcagugcaucagcugccaccccaacaaccagaagcugauggcccaggugcugugcgagcuguuccagaccagcccccagagaggcaaccugcccaccagcggcaacaucagcggcuucaucagaagacuguuccugcagcugaugcuggaggacgagaaggugaccauguuccugcagagccccugcccccuguacaagggcagaaucaacgccaccagccacgugauccagcaccccauguacggcgccggccacaaguucagaacccugcaccugcccgugagcaccacccugagcgacgugcuggacagagugagcgacacccccagcaucaccgccaagcugaucagcgagcagaaggacgacaaggagaagaagaaccacgaggagaaggagaaggugaaggccgagaacggcuuccaggacaacuacagcguggugguggccagcggccugaagagccagagcaagagagccgugagcgccaccccccccagaccccccagcagaagaggcagaaccauccccgacaagaucggcagcaccagcggcgccgaggccgccaacaagaucaucaccgugcccguguuccaccuguuccacaagcugcuggccggccagccccugcccgccgagaugacccuggcccagcugcugacccugcuguacgacagaaagcugccccagggcuacagaagcaucgaccugaccgugaagcugggcagcagagugaucaccgaccccagccugagcaagaccgacagcuacaagagacugcaccccgagaaggaccacggcgaccugcuggccagcugccccgaggacgaggcccugacccccggcgacgagugcauggacggcauccuggacgagagccugcuggagaccugccccauccagagcccccugcagguguucgccggcaugggcggccuggcccugaucgccgagagacugcccaugcuguaccccgaggugauccagcaggugagcgcccccguggugaccagcaccacccaggagaagcccaaggacagcgaccaguucgagugggugaccaucgagcagagcggcgagcugguguacgaggcccccgagaccguggccgccgagcccccccccaucaagagcgccgugcagaccaugagccccauccccgcccacagccuggccgccuucggccuguuccugagacugcccggcuacgccgaggugcugcugaaggagagaaagcacgcccagugccugcugagacuggugcugggcgugaccgacgacggcgagggcagccacauccugcagagccccagcgccaacgugcugcccacccugcccuuccacgugcugagaagccuguucagcaccaccccccugaccaccgacgacggcgugcugcugagaagaauggcccuggagaucggcgcccugcaccugauccuggugugccugagcgcccugagccaccacagccccagagugcccaacagcagcgugaaccagaccgagccccaggugagcagcagccacaaccccaccagcaccgaggagcagcagcuguacugggccaagggcaccggcuucggcaccggcagcaccgccagcggcugggacguggagcaggcccugaccaagcagagacuggaggaggagcacgugaccugccugcugcaggugcuggccagcuacaucaaccccgugagcagcgccgugaacggcgaggcccagagcagccacgagaccagaggccagaacagcaacgcccugcccagcgugcugcuggagcugcugagccagagcugccugauccccgccaugagcagcuaccugagaaacgacagcgugcuggacauggccagacacgugccccuguacagagcccugcuggagcugcugagagccaucgccagcugcgccgccauggugccccugcugcugccccugagcaccgagaacggcgaggaggaggaggagcagagcgagugccagaccagcgugggcacccugcuggccaagaugaagaccugcguggacaccuacaccaacagacugagaagcaagagagagaacgugaagaccggcgugaagcccgacgccagcgaccaggagcccgagggccugacccugcuggugcccgacauccagaagaccgccgagaucguguacgccgccaccaccagccugagacaggccaaccaggagaagaagcugggcgaguacagcaagaaggccgccaugaagcccaagccccugagcgugcugaagagccuggaggagaaguacguggccgugaugaagaagcugcaguucgacaccuucgagauggugagcgaggacgaggacggcaagcugggcuucaaggugaacuaccacuacaugagccaggugaagaacgccaacgacgccaacagcgccgccagagccagaagacuggcccaggaggccgugacccugagcaccagccugccccugagcagcagcagcagcguguucgugagaugcgacgaggagagacuggacaucaugaaggugcugaucaccggccccgccgacacccccuacgccaacggcugcuucgaguucgacguguacuucccccaggacuaccccagcagccccccccuggugaaccuggagaccaccggcggccacagcgugagauucaaccccaaccuguacaacgacggcaaggugugccugagcauccugaacaccuggcacggcagacccgaggagaaguggaacccccagaccagcagcuuccugcaggugcuggugagcgugcagagccugauccugguggccgagcccuacuucaacgagcccggcuacgagagaagcagaggcacccccagcggcacccagagcagcagagaguacgacggcaacaucagacaggccaccgugaagugggccaugcuggagcagaucagaaaccccagccccugcuucaaggaggugauccacaagcacuucuaccugaagagaguggagaucauggcccagugcgaggaguggaucgccgacauccagcaguacagcagcgacaagagagugggcagaaccaugagccaccacgccgccgcccugaagagacacaccgcccagcugagagaggagcugcugaagcugcccugccccgagggccuggaccccgacaccgacgacgcccccgaggugugcagagccaccaccggcgccgaggagacccugaugcacgaccaggugaagcccagcagcagcaaggagcugcccagcgacuuccagcuguaa

SEQ ID NO: 14221 - RNA, 843 nt, Artificial Sequence
  BIRC7__Homo_sapiens__NP_071444
augggccccaaggacagcgccaagugccugcacagaggcccccagcccagccacugggccgccggcgacggccccacccaggagagaugcggccccagaagccugggcagccccgugcugggccuggacaccugcagagccugggaccacguggacggccagauccugggccagcugagaccccugaccgaggaggaggaggaggagggcgccggcgccacccugagcagaggccccgccuuccccggcaugggcagcgaggagcugagacuggccagcuucuacgacuggccccugaccgccgaggugccccccgagcugcuggccgccgccggcuucuuccacaccggccaccaggacaaggugagaugcuucuucugcuacggcggccugcagagcuggaagagaggcgacgaccccuggaccgagcacgccaagugguuccccagcugccaguuccugcugagaagcaagggcagagacuucgugcacagcgugcaggagacccacagccagcugcugggcagcugggaccccugggaggagcccgaggacgccgcccccguggcccccagcgugcccgccagcggcuaccccgagcugcccacccccagaagagaggugcagagcgagagcgcccaggagcccggcgccagagacguggaggcccagcugagaagacugcaggaggagagaaccugcaaggugugccuggacagagccgugagcaucguguucgugcccugcggccaccuggugugcgccgagugcgcccccggccugcagcugugccccaucugcagagcccccgugagaagcagagugagaaccuuccugagcuaa

SEQ ID NO: 14222 - RNA, 846 nt, Artificial Sequence
  BIVM__Homo_sapiens__NP_001153068
augggcgccggcaaccugccccccaucacccaggaggaggcccugcacauccugggcuuccagccccccuucgaggacaucagauucggccccuucaccggcaacaccacccugaugagaugguucagacagaucaacgaccacuuccacgugaagggcugcagcuacgugcuguacaagccccacggcaagaacaagaccgccggcgagaccgccagcggcgcccugagcaagcugaccagaggccugaaggacgagagccuggccuacaucuaccacugccagaaccacuacuucugccccaucggcuucgaggccacccccgugaaggccaacaaggccuucagcagaggcccccugagcccccaggagguggaguacuggauccugaucggcgagagcagcagaaagcaccccgccauccacugcaagaagugggccgacaucgugaccgaccugaacacccagaaccccgaguaccuggacaucagacaccuggagagaggccugcaguacagaaagaccaagaagcccaccuucuucagcagccaggugggcggcaaccugcacugcaucaucgccuuccagagacugaacuggcagagauucggccuguggaacuuccccuucggcaccaucagacaggagagccagccccccacccacgcccagggcaucgccaagagcgagagcgaggacaacaucagcaagaagcagcacggcagacugggcagaagcuucagcgccagcuuccaccaggacagcgccuggaagaagaugagcagcauccacgagagaagaaacagcggcuaccagggcuacagcgacuacgacggcaacgacuaa

SEQ ID NO: 14223 - RNA, 264 nt, Artificial Sequence
  BLCAP__Homo_sapiens__NP_001161292
auguacugccugcaguggcugcugcccgugcugcugauccccaagccccugaaccccgcccugugguucagccacagcauguucaugggcuucuaccugcugagcuuccugcuggagagaaagcccugcaccaucugcgcccugguguuccuggccgcccuguuccugaucugcuacagcugcuggggcaacugcuuccuguaccacugcagcgacagcccccugcccgagagcgcccacgaccccggcguggugggcaccuaa

SEQ ID NO: 14224 - RNA, 327 nt, Artificial Sequence
  BLID__Homo_sapiens__NP_001001786
auggugacccugcugcccaucgagggccaggagauccacuucuucgagauccuggagagcgagugcgugcuguacaccggcuggaucgagagagccagcggcagcagcaucuaccccgaggccaaggccagacugccccuggaggcccugcugggcagcaacaaggagcccaugcugcccaaggagaccgugcugagccugaagagauacaaccugggcagcagcgccaugaagagaaacgugcccggccacgugcugcagagacccagcuaccugaccagaauccaggugacccugcugugcaacagcagcgccgaggcccuguaa

SEQ ID NO: 14225 - RNA, 1518 nt, Artificial Sequence
  BLK__Homo_sapiens__NP_001706
augggccuggugagcagcaagaagcccgacaaggagaagcccaucaaggagaaggacaagggccaguggagcccccugaaggugagcgcccaggacaaggacgcccccccccugcccccccuggugguguucaaccaccugaccccccccccccccgacgagcaccuggacgaggacaagcacuucgugguggcccuguacgacuacaccgccaugaacgacagagaccugcagaugcugaagggcgagaagcugcaggugcugaagggcaccggcgacugguggcuggccagaagccuggugaccggcagagagggcuacgugcccagcaacuucguggccagaguggagagccuggagauggagagaugguucuucagaagccagggcagaaaggaggccgagagacagcugcuggcccccaucaacaaggccggcagcuuccugaucagagagagcgagaccaacaagggcgccuucagccugagcgugaaggacgugaccacccagggcgagcugaucaagcacuacaagaucagaugccuggacgagggcggcuacuacaucagccccagaaucaccuuccccagccugcaggcccuggugcagcacuacagcaagaagggcgacggccugugccagagacugacccugcccugcgugagacccgccccccagaaccccugggcccaggacgagugggagauccccagacagagccugagacuggugagaaagcugggcagcggccaguucggcgagguguggaugggcuacuacaagaacaacaugaagguggccaucaagacccugaaggagggcaccaugagccccgaggccuuccugggcgaggccaacgugaugaaggcccugcagcacgagagacuggugagacuguacgccguggugaccaaggagcccaucuacaucgugaccgaguacauggccagaggcugccugcuggacuuccugaagaccgacgagggcagcagacugagccugcccagacugaucgacaugagcgcccagaucgccgagggcauggccuacaucgagagaaugaacagcauccacagagaccugagagccgccaacauccuggugagcgaggcccugugcugcaagaucgccgacuucggccuggccagaaucaucgacagcgaguacaccgcccaggagggcgccaaguuccccaucaaguggaccgcccccgaggccauccacuucggcguguucaccaucaaggccgacguguggagcuucggcgugcugcugauggagguggugaccuacggcagagugcccuaccccggcaugagcaaccccgaggugaucagaaaccuggagagaggcuacagaaugcccagacccgacaccugcccccccgagcuguacagaggcgugaucgccgagugcuggagaagcagacccgaggagagacccaccuucgaguuccugcagagcgugcuggaggacuucuacaccgccaccgagagacaguacgagcugcagcccuaa

SEQ ID NO: 14226 - RNA, 1368 nt, Artificial Sequence
  BLMH__Homo_sapiens__NP_000377
augagcagcagcggccugaacagcgagaagguggccgcccugauccagaagcugaacagcgacccccaguucgugcuggcccagaacgugggcaccacccacgaccugcuggacaucugccugaagagagccaccgugcagagagcccagcacguguuccagcacgccgugccccaggagggcaagcccaucaccaaccagaagagcagcggcagaugcuggaucuucagcugccugaacgugaugagacugcccuucaugaagaagcugaacaucgaggaguucgaguucagccagagcuaccuguucuucugggacaagguggagagaugcuacuucuuccugagcgccuucguggacaccgcccagagaaaggagcccgaggacggcagacuggugcaguuccugcugaugaaccccgccaacgacggcggccagugggacaugcuggugaacaucguggagaaguacggcgugauccccaagaagugcuuccccgagagcuacaccaccgaggccaccagaagaaugaacgacauccugaaccacaagaugagagaguucugcaucagacugagaaaccuggugcacagcggcgccaccaagggcgagaucagcgccacccaggacgugaugauggaggagaucuucagaguggugugcaucugccugggcaacccccccgagaccuucaccugggaguacagagacaaggacaagaacuaccagaagaucggccccaucaccccccuggaguucuacagagagcacgugaagccccuguucaacauggaggacaagaucugccuggugaacgaccccagaccccagcacaaguacaacaagcuguacaccguggaguaccugagcaacauggugggcggcagaaagacccuguacaacaaccagcccaucgacuuccugaagaagaugguggccgccagcaucaaggacggcgaggccgugugguucggcugcgacgugggcaagcacuucaacagcaagcugggccugagcgacaugaaccuguacgaccacgagcugguguucggcgugagccugaagaacaugaacaaggccgagagacugaccuucggcgagagccugaugacccacgccaugaccuucaccgccgugagcgagaaggacgaccaggacggcgccuucaccaaguggagaguggagaacagcuggggcgaggaccacggccacaagggcuaccugugcaugaccgacgagugguucagcgaguacguguacgagguggugguggacagaaagcacgugcccgaggaggugcuggccgugcuggagcaggagcccaucauccugcccgccugggaccccaugggcgcccuggccgaguaa

SEQ ID NO: 14227 - RNA, 4254 nt, Artificial Sequence
  BLM__Homo_sapiens__NP_001274175
auggccgccgugccccagaacaaccugcaggagcagcuggagagacacagcgccagaacccugaacaacaagcugagccugagcaagcccaaguucagcggcuucaccuucaagaagaagaccagcagcgacaacaacgugagcgugaccaacgugagcguggccaagacccccgugcugagaaacaaggacgugaacgugaccgaggacuucagcuucagcgagccccugcccaacaccaccaaccagcagagagugaaggacuucuucaagaacgcccccgccggccaggagacccagagaggcggcagcaagagccugcugcccgacuuccugcagacccccaaggagguggugugcaccacccagaacacccccaccgugaagaagagcagagacaccgcccugaagaagcuggaguucagcagcagccccgacagccugagcaccaucaacgacugggacgacauggacgacuucgacaccagcgagaccagcaagagcuucgugacccccccccagagccacuucgugagagugagcaccgcccagaagagcaagaagggcaagagaaacuucuucaaggcccagcuguacaccaccaacaccgugaagaccgaccugcccccccccagcagcgagagcgagcagaucgaccugaccgaggagcagaaggacgacagcgaguggcugagcagcgacgugaucugcaucgacgacggccccaucgccgaggugcacaucaacgaggacgcccaggagagcgacagccugaagacccaccuggaggacgagagagacaacagcgagaagaagaagaaccuggaggaggccgagcugcacagcaccgagaaggugcccugcaucgaguucgacgacgacgacuacgacaccgacuucgugccccccagccccgaggagaucaucagcgccagcagcagcagcagcaagugccugagcacccugaaggaccuggacaccagcgacagaaaggaggacgugcugagcaccagcaaggaccugcugagcaagcccgagaagaugagcaugcaggagcugaaccccgagaccagcaccgacugcgacgccagacagaucagccugcagcagcagcugauccacgugauggagcacaucugcaagcugaucgacaccauccccgacgacaagcugaagcugcuggacugcggcaacgagcugcugcagcagagaaacaucagaagaaagcugcugaccgagguggacuucaacaagagcgacgccagccugcugggcagccuguggagauacagacccgacagccuggacggccccauggagggcgacagcugccccaccggcaacagcaugaaggagcugaacuucagccaccugcccagcaacagcgugagccccggcgacugccugcugaccaccacccugggcaagaccggcuucagcgccaccagaaagaaccuguucgagagaccccuguucaacacccaccugcagaagagcuucgugagcagcaacugggccgagacccccagacugggcaagaagaacgagagcagcuacuuccccggcaacgugcugaccagcaccgccgugaaggaccagaacaagcacaccgccagcaucaacgaccuggagagagagacccagcccagcuacgacaucgacaacuucgacaucgacgacuucgacgacgacgacgacugggaggacaucaugcacaaccuggccgccagcaagagcagcaccgccgccuaccagcccaucaaggagggcagacccaucaagagcgugagcgagagacugagcagcgccaagaccgacugccugcccgugagcagcaccgcccagaacaucaacuucagcgagagcauccagaacuacaccgacaagagcgcccagaaccuggccagcagaaaccugaagcacgagagauuccagagccugagcuucccccacaccaaggagaugaugaagaucuuccacaagaaguucggccugcacaacuucagaaccaaccagcuggaggccaucaacgccgcccugcugggcgaggacugcuucauccugaugcccaccggcggcggcaagagccugugcuaccagcugcccgccugcgugagccccggcgugaccguggugaucagcccccugagaagccugaucguggaccaggugcagaagcugaccagccuggacauccccgccaccuaccugaccggcgacaagaccgacagcgaggccaccaacaucuaccugcagcugagcaagaaggaccccaucaucaagcugcuguacgugacccccgagaagaucugcgccagcaacagacugaucagcacccuggagaaccuguacgagagaaagcugcuggccagauucgugaucgacgaggcccacugcgugagccaguggggccacgacuucagacaggacuacaagagaaugaacaugcugagacagaaguuccccagcgugcccgugauggcccugaccgccaccgccaaccccagagugcagaaggacauccugacccagcugaagauccugagaccccagguguucagcaugagcuucaacagacacaaccugaaguacuacgugcugcccaagaagcccaagaagguggccuucgacugccuggaguggaucagaaagcaccaccccuacgacagcggcaucaucuacugccugagcagaagagagugcgacaccauggccgacacccugcagagagacggccuggccgcccuggccuaccacgccggccugagcgacagcgccagagacgaggugcagcagaaguggaucaaccaggacggcugccaggugaucugcgccaccaucgccuucggcaugggcaucgacaagcccgacgugagauucgugauccacgccagccugcccaagagcguggagggcuacuaccaggagagcggcagagccggcagagacggcgagaucagccacugccugcuguucuacaccuaccacgacgugaccagacugaagagacugaucaugauggagaaggacggcaaccaccacaccagagagacccacuucaacaaccuguacagcauggugcacuacugcgagaacaucaccgagugcagaagaauccagcugcuggccuacuucggcgagaacggcuucaaccccgacuucugcaagaagcaccccgacgugagcugcgacaacugcugcaagaccaaggacuacaagaccagagacgugaccgacgacgugaagagcaucgugagauucgugcaggagcacagcagcagccagggcaugagaaacaucaagcacgugggccccagcggcagauucaccaugaacaugcugguggacaucuuccugggcagcaagagcgccaagauccagagcggcaucuucggcaagggcagcgccuacagcagacacaacgccgagagacuguucaagaagcugauccuggacaagauccuggacgaggaccuguacaucaacgccaacgaccaggccaucgccuacgugaugcugggcaacaaggcccagaccgugcugaacggcaaccugaagguggacuucauggagaccgagaacagcagcagcgugaagaagcagaaggcccugguggccaaggugagccagagagaggagauggugaagaagugccugggcgagcugaccgaggugugcaagagccugggcaagguguucggcgugcacuacuucaacaucuucaacaccgugacccugaagaagcuggccgagagccugagcagcgaccccgaggugcugcugcagaucgacggcgugaccgaggacaagcuggagaaguacggcgccgaggugaucagcgugcugcagaaguacagcgaguggaccagccccgccgaggacagcagccccggcaucagccugagcagcagcagaggccccggcagaagcgccgccgaggagcuggacgaggagauccccgugagcagccacuacuucgccagcaagaccagaaacgagagaaagagaaagaagaugcccgccagccagagaagcaagagaagaaagaccgccagcagcggcagcaaggccaagggcggcagcgccaccugcagaaagaucagcagcaagaccaagagcagcagcaucaucggcagcagcagcgccagccacaccagccaggccaccagcggcgccaacagcaagcugggcaucauggccccccccaagcccaucaacagacccuuccugaagcccagcuacgccuucagcuaa

SEQ ID NO: 14228 - RNA, 1302 nt, Artificial Sequence
  BLNK__Homo_sapiens__NP_001107566
auggacaagcugaacaagaucaccgugcccgccagccagaagcugagacagcugcagaagauggugcacgacaucaagaacaacgagggcggcaucaugaacaagaucaagaagcugaaggugaaggccccccccagcgugcccagaagagacuacgccagcgagagccccgccgacgaggaggagcaguggagcgacgacuucgacagcgacuacgagaaccccgacgagcacagcgacagcgagauguacgugaugcccgccgaggagaacgccgacgacagcuacgagcccccccccguggagcaggagaccagacccgugcaccccgcccugcccuucgccagaggcgaguacaucgacaacagaagcagccagagacacagcccccccuucagcaagacccugcccagcaagcccagcuggcccagcgagaaggccagacugaccagcacccugcccgcccugaccgcccugcagaagccccaggugccccccaagcccaagggccugcuggaggacgaggccgacuacguggugcccguggaggacaacgacgagaacuacauccaccccaccgagagcagcagccccccccccgagaagggcagaaacagcggcgccugggagaccaagagccccccccccgccgcccccagcccccugcccagagccggcaagaagcccaccaccccccugaagaccacccccguggccagccagcagaacgccagcagcgugugcgaggagaagcccauccccgccgagagacacagaggcagcagccacagacaggaggccgugcagagccccguguucccccccgcccagaagcagauccaccagaagcccaucccccugcccagauucaccgagggcggcaaccccaccguggacggcccccugcccagcuucagcagcaacagcaccaucagcgagcaggaggccggcgugcugugcaagcccugguacgccggcgccugcgacagaaagagcgccgaggaggcccugcacagaagcaacaaggacggcagcuuccugaucagaaagagcagcggccacgacagcaagcagcccuacacccuggugguguucuucaacaagagaguguacaacauccccgugagauucaucgaggccaccaagcaguacgcccugggcagaaagaagaacggcgaggaguacuucggcagcguggccgagaucaucagaaaccaccagcacagcccccuggugcugaucgacagccagaacaacaccaaggacagcaccagacugaaguacgccgugaaggugagcuaa

SEQ ID NO: 14229 - RNA, 288 nt, Artificial Sequence
  BLOC1S2__Homo_sapiens__NP_001269365
augagacugcccagaaagagccuggagguggccaccagcgaggacuacaagcugcuggagaacaugaacaagcugaccagccugaaguaccuggagaugaaggacaucgccaucaacaucagcagaaaccugaaggaccugaaccagaaguacgccggccugcagcccuaccuggaccagaucaacgugaucgaggagcagguggccgcccuggagcaggccgccuacaagcuggacgccuacagcaagaagcuggaggccaaguacaagaagcuggagaagagauaa

SEQ ID NO: 14230 - RNA, 609 nt, Artificial Sequence
  BLOC1S3__Homo_sapiens__NP_997715
auggccagccagggcagaagaagaagaccccugagaagacccgagaccguggugcccggcgaggccaccgagaccgacagcgagagaagcgccagcagcagcgaggaggaggagcuguaccugggccccagcggccccaccagaggcagacccaccggccugagaguggccggcgaggccgccgagaccgacagcgagcccgagcccgagcccgagcccaccgccgcccccagagaccugcccccccugguggugcagagagagagcgccgaggaggccuggggcaccgaggaggcccccgcccccgcccccgccagaagccugcugcagcugagacuggccgagagccaggccagacuggaccacgacguggccgccgccgugagcggcguguacagaagagccggcagagacguggccgcccuggccagcagacuggccgccgcccaggccgccggccuggccgccgcccacagcgugagacuggccagaggcgaccugugcgcccuggccgagagacuggacaucguggccggcugcagacugcugcccgacaucagaggcgugcccggcaccgagcccgagaaggaccccggccccagagccuaa

SEQ ID NO: 14231 - RNA, 654 nt, Artificial Sequence
  BLOC1S4__Homo_sapiens__NP_060836
auggagggcagcuucagcgacggcggcgcccugcccgagggccuggccgaggaggccgagccccagggcgccgccuggagcggcgacagcggcaccgugagccagagccacagcagcgccagcggccccugggaggacgagggcgccgaggacggcgcccccggcagagaccugccccugcugagaagagccgccgccggcuacgccgccugccugcugcccggcgccggcgccagacccgagguggaggcccuggacgccagccuggaggaccugcugaccagaguggacgaguucgugggcaugcuggacaugcugagaggcgacagcagccacguggugagcgagggcgugcccagaauccacgccaaggccgccgagaugagaagaaucuacagcagaaucgacagacuggaggccuucgugagaauggugggcggcagaguggccagaauggaggagcaggugaccaaggccgaggccgagcugggcaccuuccccagagccuucaagaagcugcugcacaccaugaacgugcccagccuguucagcaagagcgcccccagcagaccccagcaggccggcuacgaggcccccgugcuguucagaaccgaggacuacuuccccugcugcagcgagagaccccagcuguaa

SEQ ID NO: 14232 - RNA, 372 nt, Artificial Sequence
  BLOC1S5__Homo_sapiens__NP_001186251
auggagaagagaggccugagagagaugagagugcuggagaaccugaagaacaugauccacgagaccaacgagcacacccugcccaagugcagagacaccaugagagacagccugagccaggugcugcagagacugcaggccgccaacgacagcgugugcagacugcagcagagagagcaggagagaaagaagauccacagcgaccaccugguggccagcgagaagcagcacaugcugcagugggacaacuucaugaaggagcagcccaacaagagagccgagguggacgaggagcacagaaaggccauggagagacugaaggagcaguacgccgagauggagaaggaccuggccaaguucagcaccuucuaa

SEQ ID NO: 14233 - RNA, 519 nt, Artificial Sequence
  BLOC1S6__Homo_sapiens__NP_036520
augagcgugcccggccccagcagccccgacggcgcccugaccagaccccccuacugccuggaggccggcgagcccacccccggccugagcgacaccagccccgacgagggccugaucgaggaccugaccaucgaggacaaggccguggagcagcuggccgagggccugcugagccacuaccugcccgaccugcagagaagcaagcaggcccugcaggagcugacccagaaccagguggugcugcuggacacccuggagcaggagaucagcaaguucaaggagugccacagcaugcuggacaucaacgcccuguucgccgaggccaagcacuaccacgccaagcuggugaacaucagaaaggagaugcugaugcugcacgagaagaccagcaagcugaagaagagagcccugaagcugcagcagaagagacagaaggaggagcuggagagagagcagcagagagagaaggaguucgagagagagaagcagcugaccgccagacccgccaagagaauguaa

SEQ ID NO: 14234 - RNA, 891 nt, Artificial Sequence
  BLVRA__Homo_sapiens__XP_011513776
augaacgccgagcccgagagaaaguucggcguggugguggugggcgugggcagagccggcagcgugagaaugagagaccugagaaacccccaccccagcagcgccuuccugaaccugaucggcuucgugagcagaagagagcugggcagcaucgacggcgugcagcagaucagccuggaggacgcccugagcagccaggagguggagguggccuacaucugcagcgagagcagcagccacgaggacuacaucagacaguuccugaacgccggcaagcacgugcugguggaguaccccaugacccugagccuggccgccgcccaggagcugugggagcuggccgagcagaagggcaaggugcugcacgaggagcacguggagcugcugauggaggaguucgccuuccugaagaaggagguggugggcaaggaccugcugaagggcagccugcuguucaccgccggcccccuggaggaggagagauucggcuuccccgccuucagcggcaucagcagacugaccuggcuggugagccuguucggcgagcugagccuggugagcgccacccuggaggagagaaaggaggaccaguacaugaagaugaccgugugccuggagaccgagaagaagagcccccugagcuggaucgaggagaagggccccggccugaagagaaacagauaccugagcuuccacuucaagagcggcagccuggagaacgugcccaacgugggcgugaacaagaacaucuuccugaaggaccagaacaucuucgugcagaagcugcugggccaguucagcgagaaggagcuggccgccgagaagaagagaauccugcacugccugggccuggccgaggagauccagaaguacugcugcagcagaaaguaa

SEQ ID NO: 14235 - RNA, 621 nt, Artificial Sequence
  BLVRB__Homo_sapiens__NP_000704
auggccgugaagaagaucgccaucuucggcgccaccggccagaccggccugaccacccuggcccaggccgugcaggccggcuacgaggugaccgugcuggugagagacagcagcagacugcccagcgagggccccagacccgcccacgugguggugggcgacgugcugcaggccgccgacguggacaagaccguggccggccaggacgccgugaucgugcugcugggcaccagaaacgaccugagccccaccaccgugaugagcgagggcgccagaaacaucguggccgccaugaaggcccacggcguggacaaggugguggccugcaccagcgccuuccugcugugggaccccaccaaggugccccccagacugcaggccgugaccgacgaccacaucagaaugcacaaggugcugagagagagcggccugaaguacguggccgugaugcccccccacaucggcgaccagccccugaccggcgccuacaccgugacccuggacggcagaggccccagcagagugaucagcaagcacgaccugggccacuucaugcugagaugccugaccaccgacgaguacgacggccacagcaccuaccccagccaccaguaccaguaa

SEQ ID NO: 14236 - RNA, 1203 nt, Artificial Sequence
  BLZF1__Homo_sapiens__NP_003657
augaccaccaagaaccuggagaccaaggugaccgugaccagcagccccaucagaggcgccggcgacggcauggagaccgaggagccccccaagagcguggaggugaccagcggcgugcagagcagaaagcaccacagccugcagagccccuggaagaaggccgugcccagcgagagccccggcgugcugcagcugggcaagaugcugaccgagaaggccauggaggugaaggccgugagaauccuggugcccaaggccgccaucacccacgacauccccaacaagaacaccaaggugaagagccugggccaccacaagggcgaguuccugggccagagcgagggcgugaucgagcccaacaaggagcugagcgaggugaagaacgugcuggagaagcugaagaacagcgagagaagacugcugcaggacaaggagggccugagcaaccagcugagagugcagaccgaggugaacagagagcugaagaagcugcugguggccagcgugggcgacgaccugcaguaccacuucgagagacuggccagagagaagaaccagcugauccuggagaacgaggcccugggcagaaacaccgcccagcugagcgagcagcuggagagaaugagcauccagugcgacguguggagaagcaaguuccuggccagcagagugauggccgacgagcugaccaacagcagagccgcccugcagagacagaacagagacgcccacggcgccauccaggaccugcugagcgagagagagcaguucagacaggagaugaucgccacccagaagcugcuggaggagcugcuggugagccugcaguggggcagagagcagaccuacagccccagcgugcagccccacagcaccgccgagcuggcccugaccaaccacaagcuggccaaggccgugaacagccaccugcugggcaacgugggcaucaacaaccagaagaagauccccagcaccguggaguucugcagcacccccgccgagaagauggccgagaccgugcugagaauccuggaccccgugaccugcaaggagagcagccccgacaaccccuucuucgagagcagccccaccacccugcuggccaccaagaagaacaucggcagauuccaccccuacaccagauacgagaacaucaccuucaacugcugcaaccacugcagaggcgagcugaucgcccuguaa

SEQ ID NO: 14237 - RNA, 492 nt, Artificial Sequence
  BMF__Homo_sapiens__NP_001003942
auggagcccagccagugcguggaggagcuggaggacgacguguuccagcccgaggacggcgagcccgugacccagcccggcagccugcugagcgccgaccuguucgcccagagccugcuggacugcccccugagcagacugcagcuguucccccugacccacugcugcggccccggccugagacccaccagccaggaggacaaggccacccagacccugagccccgccagccccagccagggcgugaugcugcccugcggcgugaccgaggagccccagagacuguucuacggcaacgccggcuacagacugccccugcccgccagcuuccccgccgugcugcccaucggcgagcagccccccgagggccaguggcagcaccaggccgagcaccagcagaaccagaacagagugugguggcagauccugcuguuccugcacaaccuggcccugaacggcgaggagaacagaaacggcgccggccccagauaa

SEQ ID NO: 14238 - RNA, 981 nt, Artificial Sequence
  BMI1__Homo_sapiens__NP_005171
augcacagaaccaccagaaucaagaucaccgagcugaacccccaccugaugugcgugcugugcggcggcuacuucaucgacgccaccaccaucaucgagugccugcacagcuucugcaagaccugcaucgugagauaccuggagaccagcaaguacugccccaucugcgacgugcaggugcacaagaccagaccccugcugaacaucagaagcgacaagacccugcaggacaucguguacaagcuggugcccggccuguucaagaacgagaugaagagaagaagagacuucuacgccgcccaccccagcgccgacgccgccaacggcagcaacgaggacagaggcgagguggccgacgaggacaagagaaucaucaccgacgacgagaucaucagccugagcaucgaguucuucgaccagaacagacuggacagaaaggugaacaaggacaaggagaagagcaaggaggaggugaacgacaagagauaccugagaugccccgccgccaugaccgugaugcaccugagaaaguuccugagaagcaagauggacauccccaacaccuuccagaucgacgugauguacgaggaggagccccugaaggacuacuacacccugauggacaucgccuacaucuacaccuggagaagaaacggcccccugccccugaaguacagagugagacccaccugcaagagaaugaagaucagccaccagagagacggccugaccaacgccggcgagcuggagagcgacagcggcagcgacaaggccaacagccccgccggcggcauccccagcaccagcagcugccugcccagccccagcacccccgugcagagcccccacccccaguucccccacaucagcagcaccaugaacggcaccagcaacagccccagcggcaaccaccagagcagcuucgccaacagacccagaaagagcagcgugaacggcagcagcgccaccagcagcggcuaa

SEQ ID NO: 14239 - RNA, 1275 nt, Artificial Sequence
  BMP10__Homo_sapiens__NP_055297
augggcagccuggugcugacccugugcgcccuguucugccuggccgccuaccuggugagcggcagccccaucaugaaccuggagcagagcccccuggaggaggacaugagccuguucggcgacguguucagcgagcaggacggcguggacuucaacacccugcugcagagcaugaaggacgaguuccugaagacccugaaccugagcgacauccccacccaggacagcgccaagguggacccccccgaguacaugcuggagcuguacaacaaguucgccaccgacagaaccagcaugcccagcgccaacaucaucagaagcuucaagaacgaggaccuguucagccagcccgugagcuucaacggccugagaaaguacccccugcuguucaacgugagcaucccccaccacgaggaggugaucauggccgagcugagacuguacacccuggugcagagagacagaaugaucuacgacggcguggacagaaagaucaccaucuucgaggugcuggagagcaagggcgacaacgagggcgagagaaacaugcuggugcuggugagcggcgagaucuacggcaccaacagcgagugggagaccuucgacgugaccgacgccaucagaagauggcagaagagcggcagcagcacccaccagcuggaggugcacaucgagagcaagcacgacgaggccgaggacgccagcagcggcagacuggagaucgacaccagcgcccagaacaagcacaacccccugcugaucguguucagcgacgaccagagcagcgacaaggagagaaaggaggagcugaacgagaugaucagccacgagcagcugcccgagcuggacaaccugggccuggacagcuucagcagcggccccggcgaggaggcccugcugcagaugagaagcaacaucaucuacgacagcaccgccagaaucagaagaaacgccaagggcaacuacugcaagagaaccccccuguacaucgacuucaaggagaucggcugggacagcuggaucaucgccccccccggcuacgaggccuacgagugcagaggcgugugcaacuacccccuggccgagcaccugacccccaccaagcacgccaucauccaggcccuggugcaccugaagaacagccagaaggccagcaaggccugcugcgugcccaccaagcuggagcccaucagcauccuguaccuggacaagggcguggugaccuacaaguucaaguacgagggcauggccgugagcgagugcggcugcagauaa

SEQ ID NO: 14240 - RNA, 1179 nt, Artificial Sequence
  BMP15__Homo_sapiens__NP_005439
auggugcugcugagcauccugagaauccuguuccugugcgagcuggugcuguucauggagcacagagcccagauggccgagggcggccagagcagcaucgcccugcuggccgaggcccccacccugccccugaucgaggagcugcuggaggagagccccggcgagcagcccagaaagcccagacugcugggccacagccugagauacaugcuggagcuguacagaagaagcgccgacagccacggccaccccagagagaacagaaccaucggcgccaccauggugagacuggugaagccccugaccaacguggccagaccccacagaggcaccuggcacauccagauccugggcuucccccugagacccaacagaggccuguaccagcuggugagagccaccgugguguacagacaccaccugcagcugaccagauucaaccugagcugccacguggagcccugggugcagaagaaccccaccaaccacuuccccagcagcgagggcgacagcagcaagcccagccugaugagcaacgccuggaaggagauggacaucacccagcuggugcagcagagauucuggaacaacaagggccacagaauccugagacugagauucaugugccagcagcagaaggacagcggcggccuggagcuguggcacggcaccagcagccuggacaucgccuuccugcugcuguacuucaacgacacccacaagagcaucagaaaggccaaguuccugcccagaggcauggaggaguucauggagagagagagccugcugagaagaaccagacaggccgacggcaucagcgccgaggugaccgccagcagcagcaagcacagcggccccgagaacaaccagugcagccugcaccccuuccagaucagcuucagacagcugggcugggaccacuggaucaucgccccccccuucuacacccccaacuacugcaagggcaccugccugagagugcugagagacggccugaacagccccaaccacgccaucauccagaaccugaucaaccagcugguggaccagagcgugcccagacccagcugcgugcccuacaaguacgugcccaucagcgugcugaugaucgaggccaacggcagcauccuguacaaggaguacgagggcaugaucgccgagagcugcaccugcagauaa

SEQ ID NO: 14241 - RNA, 2193 nt, Artificial Sequence
  BMP1__Homo_sapiens__NP_001190
augcccggcguggccagacugccccugcugcugggccugcugcugcugcccagacccggcagaccccuggaccuggccgacuacaccuacgaccuggccgaggaggacgacagcgagccccugaacuacaaggaccccugcaaggccgccgccuuccugggcgacaucgcccuggacgaggaggaccugagagccuuccaggugcagcaggccguggaccugagaagacacaccgccagaaagagcagcaucaaggccgccgugcccggcaacaccagcacccccagcugccagagcaccaacggccagccccagagaggcgccugcggcagauggagaggcagaagcagaagcagaagagccgccaccagcagacccgagagaguguggcccgacggcgugauccccuucgugaucggcggcaacuucaccggcagccagagagccguguucagacaggccaugagacacugggagaagcacaccugcgugaccuuccuggagagaaccgacgaggacagcuacaucguguucaccuacagacccugcggcugcugcagcuacgugggcagaagaggcggcggcccccaggccaucagcaucggcaagaacugcgacaaguucggcaucguggugcacgagcugggccacguggugggcuucuggcacgagcacaccagacccgacagagacagacacgugagcaucgugagagagaacauccagcccggccaggaguacaacuuccugaagauggagccccaggagguggagagccugggcgagaccuacgacuucgacagcaucaugcacuacgccagaaacaccuucagcagaggcaucuuccuggacaccaucgugcccaaguacgaggugaacggcgugaagccccccaucggccagagaaccagacugagcaagggcgacaucgcccaggccagaaagcuguacaagugccccgccugcggcgagacccugcaggacagcaccggcaacuucagcagccccgaguaccccaacggcuacagcgcccacaugcacugcguguggagaaucagcgugacccccggcgagaagaucauccugaacuucaccagccuggaccuguacagaagcagacugugcugguacgacuacguggaggugagagacggcuucuggagaaaggccccccugagaggcagauucugcggcagcaagcugcccgagcccaucgugagcaccgacagcagacuguggguggaguucagaagcagcagcaacugggugggcaagggcuucuucgccguguacgaggccaucugcggcggcgacgugaagaaggacuacggccacauccagagccccaacuaccccgacgacuacagacccagcaaggugugcaucuggagaauccaggugagcgagggcuuccacgugggccugaccuuccagagcuucgagaucgagagacacgacagcugcgccuacgacuaccuggaggugagagacggccacagcgagagcagcacccugaucggcagauacugcggcuacgagaagcccgacgacaucaagagcaccagcagcagacuguggcugaaguucgugagcgacggcagcaucaacaaggccggcuucgccgugaacuucuucaaggagguggacgagugcagcagacccaacagaggcggcugcgagcagagaugccugaacacccugggcagcuacaagugcagcugcgaccccggcuacgagcuggcccccgacaagagaagaugcgaggccgccugcggcggcuuccugaccaagcugaacggcagcaucaccagccccggcuggcccaaggaguacccccccaacaagaacugcaucuggcagcugguggcccccacccaguacagaaucagccugcaguucgacuucuucgagaccgagggcaacgacgugugcaaguacgacuucguggaggugagaagcggccugaccgccgacagcaagcugcacggcaaguucugcggcagcgagaagcccgaggugaucaccagccaguacaacaacaugagaguggaguucaagagcgacaacaccgugagcaagaagggcuucaaggcccacuucuucagcgagaagagacccgcccugcagccccccagaggcagaccccaccagcugaaguucagagugcagaagagaaacagaaccccccaguaa

SEQ ID NO: 14242 - RNA, 1191 nt, Artificial Sequence
  BMP2__Homo_sapiens__NP_001191
augguggccggcaccagaugccugcuggcccugcugcugccccaggugcugcugggcggcgccgccggccuggugcccgagcugggcagaagaaaguucgccgccgccagcagcggcagacccagcagccagcccagcgacgaggugcugagcgaguucgagcugagacugcugagcauguucggccugaagcagagacccacccccagcagagacgccguggugccccccuacaugcuggaccuguacagaagacacagcggccagcccggcagccccgcccccgaccacagacuggagagagccgccagcagagccaacaccgugagaagcuuccaccacgaggagagccuggaggagcugcccgagaccagcggcaagaccaccagaagauucuucuucaaccugagcagcauccccaccgaggaguucaucaccagcgccgagcugcagguguucagagagcagaugcaggacgcccugggcaacaacagcagcuuccaccacagaaucaacaucuacgagaucaucaagcccgccaccgccaacagcaaguuccccgugaccagacugcuggacaccagacuggugaaccagaacgccagcagaugggagagcuucgacgugacccccgccgugaugagauggaccgcccagggccacgccaaccacggcuucgugguggagguggcccaccuggaggagaagcagggcgugagcaagagacacgugagaaucagcagaagccugcaccaggacgagcacagcuggagccagaucagaccccugcuggugaccuucggccacgacggcaagggccacccccugcacaagagagagaagagacaggccaagcacaagcagagaaagagacugaagagcagcugcaagagacacccccuguacguggacuucagcgacgugggcuggaacgacuggaucguggccccccccggcuaccacgccuucuacugccacggcgagugccccuucccccuggccgaccaccugaacagcaccaaccacgccaucgugcagacccuggugaacagcgugaacagcaagauccccaaggccugcugcgugcccaccgagcugagcgccaucagcaugcuguaccuggacgagaacgagaagguggugcugaagaacuaccaggacauggugguggagggcugcggcugcagauaa

SEQ ID NO: 14243 - RNA, 1989 nt, Artificial Sequence
  BMP2K__Homo_sapiens__NP_060063
augaagaaguucagcagaaugcccaagagcgagggcggcagcggcggcggcgccgccggcggcggcgccggcggcgccggcgccggcgccggcugcggcagcggcggcagcagcgugggcgugagaguguucgccgugggcagacaccaggugacccuggaggagagccuggccgagggcggcuucagcaccguguuccuggugagaacccacggcggcaucagaugcgcccugaagagaauguacgugaacaacaugcccgaccugaacgugugcaagagagagaucaccaucaugaaggagcugagcggccacaagaacaucgugggcuaccuggacugcgccgugaacagcaucagcgacaacgugugggaggugcugauccugauggaguacugcagagccggccagguggugaaccagaugaacaagaagcugcagaccggcuucaccgagcccgaggugcugcagaucuucugcgacaccugcgaggccguggccagacugcaccagugcaagacccccaucauccacagagaccugaagguggagaacauccugcugaacgacggcggcaacuacgugcugugcgacuucggcagcgccaccaacaaguuccugaacccccagaaggacggcgugaacgugguggaggaggagaucaagaaguacaccacccugagcuacagagcccccgagaugaucaaccuguacggcggcaagcccaucaccaccaaggccgacaucugggcccugggcugccugcuguacaagcugugcuucuucacccugcccuucggcgagagccagguggccaucugcgacggcaacuucaccauccccgacaacagcagauacagcagaaacauccacugccugaucagauucaugcuggagcccgaccccgagcacagacccgacaucuuccaggugagcuacuucgccuucaaguucgccaagaaggacugccccgugagcaacaucaacaacagcagcauccccagcgcccugcccgagcccaugaccgccagcgaggccgccgccagaaagagccagaucaaggccagaaucaccgacaccaucggccccaccgagaccagcaucgcccccagacagagacccaaggccaacagcgccaccaccgccacccccagcgugcugaccauccagagcagcgccacccccgugaaggugcuggcccccggcgaguucggcaaccacagacccaagggcgcccugagacccggcaacggccccgagauccugcugggccagggccccccccagcagcccccccagcagcacagagugcugcagcagcugcagcagggcgacuggagacugcagcagcugcaccugcagcacagacacccccaccagcagcagcagcagcagcagcagcagcagcagcagcagcagcagcagcagcagcagcagcagcagcagcagcagcagcagcaccaccaccaccaccaccaccaccugcugcaggacgccuacaugcagcaguaccagcacgccacccagcagcagcagaugcugcagcagcaguuccugaugcacagcguguaccagccccagcccagcgccagccaguaccccaccaugaugccccaguaccagcaggccuucuuccagcagcagaugcuggcccagcaccagcccagccagcagcaggccagccccgaguaccugaccagcccccaggaguucagccccgcccuggugagcuacaccagcagccugcccgcccaggugggcaccaucauggacagcagcuacagcgccaacagaagcguggccgacaaggaggccaucgccaacuucaccaaccagaagaacaucagcaacccccccgacaugagcggcuggaaccccuucggcgaggacaacuucagcaagcugaccgaggaggagcugcuggacagagaguucgaccugcugagaagcagcaagggccaccugaaggccuacuucgccagccaguaa

SEQ ID NO: 14244 - RNA, 1320 nt, Artificial Sequence
  BMP3__Homo_sapiens__XP_006714354
auggccggcgccagcagacugcuguuccuguggcugggcugcuucugcgugagccuggcccagggcgagagacccaagccccccuuccccgagcugagaaaggccgugcccggcgacagaaccgccggcggcggccccgacagcgagcugcagccccaggacaaggugagcgagcacaugcugagacuguacgacagauacagcaccgugcaggccgccagaacccccggcagccuggagggcggcagccagcccuggagacccagacugcugagagagggcaacaccgugagaagcuucagagccgccgccgccgagacccuggagagaaagggccuguacaucuucaaccugaccagccugaccaagagcgagaacauccugagcgccacccuguacuucugcaucggcgagcugggcaacaucagccugagcugccccgugagcggcggcugcagccaccacgcccagagaaagcacauccagaucgaccugagcgccuggacccugaaguucagcagaaaccagagccagcugcugggccaccugagcguggacauggccaagagccacagagacaucaugagcuggcugagcaaggacaucacccagcugcugagaaaggccaaggagaacgaggaguuccugaucggcuucaacaucaccagcaagggcagacagcugcccaagagaagacugcccuuccccgagcccuacauccugguguacgccaacgacgccgccaucagcgagcccgagagcguggugagcagccugcagggccacagaaacuuccccaccggcaccgugcccaagugggacagccacaucagagccgcccugagcaucgagagaagaaagaagagaagcaccggcgugcugcugccccugcagaacaacgagcugcccggcgccgaguaccaguacaagaaggacgaggugugggaggagagaaagcccuacaagacccugcaggcccaggcccccgagaagagcaagaacaagaagaagcagagaaagggcccccacagaaagagccagacccugcaguucgacgagcagacccugaagaaggccagaagaaagcaguggaucgagcccagaaacugcgccagaagauaccugaagagccugaagcccagcaaccacgccaccauccagagcaucgugagagccgugggcguggugcccggcauccccgagcccugcugcgugcccgagaagaugagcagccugagcauccuguucuucgacgagaacaagaacguggugcugaagguguaccccaacaugaccguggagagcugcgccugcagauaa

SEQ ID NO: 14245 - RNA, 1227 nt, Artificial Sequence
  BMP4__Homo_sapiens__NP_001193
augauccccggcaacagaaugcugaugguggugcugcugugccaggugcugcugggcggcgccagccacgccagccugauccccgagaccggcaagaagaagguggccgagauccagggccacgccggcggcagaagaagcggccagagccacgagcugcugagagacuucgaggccacccugcugcagauguucggccugagaagaagaccccagcccagcaagagcgccgugauccccgacuacaugagagaccuguacagacugcagagcggcgaggaggaggaggagcagauccacagcaccggccuggaguaccccgagagacccgccagcagagccaacaccgugagaagcuuccaccacgaggagcaccuggagaacauccccggcaccagcgagaacagcgccuucagauuccuguucaaccugagcagcauccccgagaacgaggugaucagcagcgccgagcugagacuguucagagagcagguggaccagggccccgacugggagagaggcuuccacagaaucaacaucuacgaggugaugaagccccccgccgagguggugcccggccaccugaucaccagacugcuggacaccagacuggugcaccacaacgugaccagaugggagaccuucgacgugagccccgccgugcugagauggaccagagagaagcagcccaacuacggccuggccaucgaggugacccaccugcaccagaccagaacccaccagggccagcacgugagaaucagcagaagccugccccagggcagcggcaacugggcccagcugagaccccugcuggugaccuucggccacgacggcagaggccacgcccugaccagaagaagaagagccaagagaagccccaagcaccacagccagagagccagaaagaagaacaagaacugcagaagacacagccuguacguggacuucagcgacgugggcuggaacgacuggaucguggccccccccggcuaccaggccuucuacugccacggcgacugccccuucccccuggccgaccaccugaacagcaccaaccacgccaucgugcagacccuggugaacagcgugaacagcagcauccccaaggccugcugcgugcccaccgagcugagcgccaucagcaugcuguaccuggacgaguacgacaagguggugcugaagaacuaccaggagauggugguggagggcugcggcugcagauaa

SEQ ID NO: 14246 - RNA, 1365 nt, Artificial Sequence
  BMP5__Homo_sapiens__NP_066551
augcaccugaccguguuccugcugaagggcaucgugggcuuccuguggagcugcugggugcuggugggcuacgccaagggcggccugggcgacaaccacgugcacagcagcuucaucuacagaagacugagaaaccacgagagaagagagauccagagagagauccugagcauccugggccugccccacagacccagacccuucagccccggcaagcaggccagcagcgccccccuguucaugcuggaccuguacaacgccaugaccaacgaggagaaccccgaggagagcgaguacagcgugagagccagccuggccgaggagaccagaggcgccagaaagggcuaccccgccagccccaacggcuaccccagaagaauccagcugagcagaaccaccccccugaccacccagagccccccccuggccagccugcacgacaccaacuuccugaacgacgccgacauggugaugagcuucgugaaccugguggagagagacaaggacuucagccaccagagaagacacuacaaggaguucagauucgaccugacccagaucccccacggcgaggccgugaccgccgccgaguucagaaucuacaaggacagaagcaacaacagauucgagaacgagaccaucaagaucagcaucuaccagaucaucaaggaguacaccaacagagacgccgaccuguuccugcuggacaccagaaaggcccaggcccuggacgugggcuggcugguguucgacaucaccgugaccagcaaccacugggugaucaacccccagaacaaccugggccugcagcugugcgccgagaccggcgacggcagaagcaucaacgugaagagcgccggccuggugggcagacagggcccccagagcaagcagcccuucaugguggccuucuucaaggccagcgaggugcugcugagaagcgugagagccgccaacaagagaaagaaccagaacagaaacaagagcagcagccaccaggacagcagcagaaugagcagcgugggcgacuacaacaccagcgagcagaagcaggccugcaagaagcacgagcuguacgugagcuucagagaccugggcuggcaggacuggaucaucgcccccgagggcuacgccgccuucuacugcgacggcgagugcagcuucccccugaacgcccacaugaacgccaccaaccacgccaucgugcagacccuggugcaccugauguuccccgaccacgugcccaagcccugcugcgcccccaccaagcugaacgccaucagcgugcuguacuucgacgacagcagcaacgugauccugaagaaguacagaaacaugguggugagaagcugcggcugccacuaa

SEQ ID NO: 14247 - RNA, 1542 nt, Artificial Sequence
  BMP6__Homo_sapiens__NP_001709
augcccggccugggcagaagagcccaguggcugugcuggugguggggccugcugugcagcugcugcggcccccccccccugagacccccccugcccgccgccgccgccgccgccgccggcggccagcugcugggcgacggcggcagccccggcagaaccgagcagcccccccccagcccccagagcagcagcggcuuccuguacagaagacugaagacccaggagaagagagagaugcagaaggagauccugagcgugcugggccugccccacagacccagaccccugcacggccugcagcagccccagccccccgcccugagacagcaggaggagcagcagcagcagcagcagcugcccagaggcgagcccccccccggcagacugaagagcgccccccuguucaugcuggaccuguacaacgcccugagcgccgacaacgacgaggacggcgccagcgagggcgagagacagcagagcuggccccacgaggccgccagcagcagccagagaagacagcccccccccggcgccgcccacccccugaacagaaagagccugcuggcccccggcagcggcagcggcggcgccagcccccugaccagcgcccaggacagcgccuuccugaacgacgccgacauggugaugagcuucgugaaccugguggaguacgacaaggaguucagccccagacagagacaccacaaggaguucaaguucaaccugagccagauccccgagggcgagguggugaccgccgccgaguucagaaucuacaaggacugcgugaugggcagcuucaagaaccagaccuuccugaucagcaucuaccaggugcugcaggagcaccagcacagagacagcgaccuguuccugcuggacaccagaguggugugggccagcgaggagggcuggcuggaguucgacaucaccgccaccagcaaccuguggguggugaccccccagcacaacaugggccugcagcugagcguggugaccagagacggcgugcacgugcaccccagagccgccggccuggugggcagagacggccccuacgacaagcagcccuucaugguggccuucuucaaggugagcgaggugcacgugagaaccaccagaagcgccagcagcagaagaagacagcagagcagaaacagaagcacccagagccaggacguggccagagugagcagcgccagcgacuacaacagcagcgagcugaagaccgccugcagaaagcacgagcuguacgugagcuuccaggaccugggcuggcaggacuggaucaucgcccccaagggcuacgccgccaacuacugcgacggcgagugcagcuucccccugaacgcccacaugaacgccaccaaccacgccaucgugcagacccuggugcaccugaugaaccccgaguacgugcccaagcccugcugcgcccccaccaagcugaacgccaucagcgugcuguacuucgacgacaacagcaacgugauccugaagaaguacagaaacaugguggugagagccugcggcugccacuaa

SEQ ID NO: 14248 - RNA, 1296 nt, Artificial Sequence
  BMP7__Homo_sapiens__NP_001710
augcacgugagaagccugagagccgccgccccccacagcuucguggcccugugggccccccuguuccugcugagaagcgcccuggccgacuucagccuggacaacgaggugcacagcagcuucauccacagaagacugagaagccaggagagaagagagaugcagagagagauccugagcauccugggccugccccacagacccagaccccaccugcagggcaagcacaacagcgcccccauguucaugcuggaccuguacaacgccauggccguggaggagggcggcggccccggcggccagggcuucagcuaccccuacaaggccguguucagcacccagggccccccccuggccagccugcaggacagccacuuccugaccgacgccgacauggugaugagcuucgugaaccugguggagcacgacaaggaguucuuccaccccagauaccaccacagagaguucagauucgaccugagcaagauccccgagggcgaggccgugaccgccgccgaguucagaaucuacaaggacuacaucagagagagauucgacaacgagaccuucagaaucagcguguaccaggugcugcaggagcaccugggcagagagagcgaccuguuccugcuggacagcagaacccugugggccagcgaggagggcuggcugguguucgacaucaccgccaccagcaaccacuggguggugaaccccagacacaaccugggccugcagcugagcguggagacccuggacggccagagcaucaaccccaagcuggccggccugaucggcagacacggcccccagaacaagcagcccuucaugguggccuucuucaaggccaccgaggugcacuucagaagcaucagaagcaccggcagcaagcagagaagccagaacagaagcaagacccccaagaaccaggaggcccugagaauggccaacguggccgagaacagcagcagcgaccagagacaggccugcaagaagcacgagcuguacgugagcuucagagaccugggcuggcaggacuggaucaucgcccccgagggcuacgccgccuacuacugcgagggcgagugcgccuucccccugaacagcuacaugaacgccaccaaccacgccaucgugcagacccuggugcacuucaucaaccccgagaccgugcccaagcccugcugcgcccccacccagcugaacgccaucagcgugcuguacuucgacgacagcagcaacgugauccugaagaaguacagaaacaugguggugagagccugcggcugccacuaa

SEQ ID NO: 14249 - RNA, 837 nt, Artificial Sequence
  BMP8B__Homo_sapiens__XP_011540326
augaccgcccugcccggcccccuguggcugcugggccuggcccugugcgcccugggcggcggcggccccggccugagacccccccccggcugcccccagagaagacugggcgccagagagagaagagacgugcagagagagauccuggccgugcugggccugcccggcagacccagacccagagccccccccgccgccagcagacugcccgccagcgccccccuguucaugcuggaccuguaccacgccauggccggcgacgacgacgaggacggcgcccccgccgagagaagacugggcagagccgaccuggugaugagcuucgugaacaugguggagagagacagagcccugggccaccaggagccccacuggaaggaguucagauucgaccugacccagauccccgccggcgaggccgugaccgccgccgaguucagaaucuacaaggugcccagcauccaccugcugaacagaacccugcacgugagcauguuccagguggugcaggagcagagcaacagagagagcgaccuguucuuccuggaccugcagacccugagagccggcgacgagggcuggcuggugcuggacgugaccgccgccagcgacugcuggcugcugaagagacacaaggaccugggccugagacuguacguggagaccgaggacggcgagaccuggaccggcuggggcuggaccaaggacagcagacugcagauguggaagcugagacugagcagaacccccugggugcugagccugcacgcccccggccccgcccaggcccccgccgagagaccccugcugugccugcugcagggccacugccccuaa

SEQ ID NO: 14250 - RNA, 2058 nt, Artificial Sequence
  BMPER__Homo_sapiens__NP_597725
augcugugguucagcggcgugggcgcccuggccgagagauacugcagaagaagccccggcaucaccugcugcgugcugcugcugcugaacugcagcggcgugcccaugagccuggccagcagcuuccugaccggcagcguggccaagugcgagaacgagggcgaggugcugcagauccccuucaucaccgacaaccccugcaucaugugcgugugccugaacaaggaggugaccugcaagagagagaagugccccgugcugagcagagacugcgcccuggccaucaagcagagaggcgccugcugcgagcagugcaagggcugcaccuacgagggcaacaccuacaacagcagcuucaaguggcagagccccgccgagcccugcgugcugagacagugccaggagggcguggugaccgagagcggcgugagaugcguggugcacugcaagaacccccuggagcaccugggcaugugcugccccaccugccccggcugcguguucgagggcgugcaguaccaggagggcgaggaguuccagcccgagggcagcaagugcaccaagugcagcugcaccggcggcagaacccagugcgugagagaggugugccccauccugagcugcccccagcaccugagccacaucccccccggccagugcugccccaagugccugggccagagaaagguguucgaccugcccuucggcagcugccuguucagaagcgacguguacgacaacggcagcagcuuccuguacgacaacugcaccgccugcaccugcagagacagcaccguggugugcaagagaaagugcagccaccccggcggcugcgaccagggccaggagggcugcugcgaggagugccugcugagagugccccccgaggacaucaaggugugcaaguucggcaacaagaucuuccaggacggcgagauguggagcagcaucaacugcaccaucugcgccugcgugaagggcagaaccgagugcagaaacaagcagugcauccccaucagcagcugcccccagggcaagauccugaacagaaagggcugcugccccaucugcaccgagaagcccggcgugugcaccguguucggcgacccccacuacaacaccuucgacggcagaaccuucaacuuccagggcaccugccaguacgugcugaccaaggacugcagcagccccgccagccccuuccaggugcuggugaagaacgacgccagaagaaccagaagcuucagcuggaccaagagcguggagcuggugcugggcgagagcagagugagccugcagcagcaccugaccgugagauggaacggcagcagaaucgcccugcccugcagagccccccacuuccacaucgaccuggacggcuaccugcugaaggugaccaccaaggccggccuggagaucagcugggacggcgacagcuucguggaggugauggccgccccccaccugaagggcaagcugugcggccugugcggcaacuacaacggccacaagagagacgaccugaucggcggcgacggcaacuucaaguucgacguggacgacuucgccgagagcuggagaguggagagcaacgaguucugcaacagaccccagagaaagcccgugcccgagcugugccagggcaccgugaaggugaagcugagagcccacagagagugccagaagcugaagagcugggaguuccagaccugccacagcaccguggacuacgccaccuucuacagaagcugcgugaccgacaugugcgagugccccgugcacaagaacugcuacugcgagagcuuccuggccuacaccagagccugccagagagagggcaucaaggugcacugggagccccagcagaacugcgccgccacccagugcaagcacggcgccguguacgacaccugcggccccggcugcaucaagaccugcgacaacuggaacgagaucggccccugcaacaagcccugcguggccggcugccacugccccgccaaccuggugcugcacaagggcagaugcaucaagcccgugcugugcccccagagauaa

SEQ ID NO: 14251 - RNA, 1599 nt, Artificial Sequence
  BMPR1A__Homo_sapiens__NP_004320
augccccagcuguacaucuacaucagacugcugggcgccuaccuguucaucaucagcagagugcagggccagaaccuggacagcaugcugcacggcaccggcaugaagagcgacagcgaccagaagaagagcgagaacggcgugacccuggcccccgaggacacccugcccuuccugaagugcuacugcagcggccacugccccgacgacgccaucaacaacaccugcaucaccaacggccacugcuucgccaucaucgaggaggacgaccagggcgagaccacccuggccagcggcugcaugaaguacgagggcagcgacuuccagugcaaggacagccccaaggcccagcugagaagaaccaucgagugcugcagaaccaaccugugcaaccaguaccugcagcccacccugccccccguggugaucggccccuucuucgacggcagcaucagauggcuggugcugcugaucagcauggccgugugcaucaucgccaugaucaucuucagcagcugcuucugcuacaagcacuacugcaagagcaucagcagcagaagaagauacaacagagaccuggagcaggacgaggccuucauccccgugggcgagagccugaaggaccugaucgaccagagccagagcagcggcagcggcagcggccugccccugcuggugcagagaaccaucgccaagcagauccagauggugagacaggugggcaagggcagauacggcgagguguggaugggcaaguggagaggcgagaagguggccgugaagguguucuucaccaccgaggaggccagcugguucagagagaccgagaucuaccagaccgugcugaugagacacgagaacauccugggcuucaucgccgccgacaucaagggcaccggcagcuggacccagcuguaccugaucaccgacuaccacgagaacggcagccuguacgacuuccugaagugcgccacccuggacaccagagcccugcugaagcuggccuacagcgccgccugcggccugugccaccugcacaccgagaucuacggcacccagggcaagcccgccaucgcccacagagaccugaagagcaagaacauccugaucaagaagaacggcagcugcugcaucgccgaccugggccuggccgugaaguucaacagcgacaccaacgagguggacgugccccugaacaccagagugggcaccaagagauacauggcccccgaggugcuggacgagagccugaacaagaaccacuuccagcccuacaucauggccgacaucuacagcuucggccugaucaucugggagauggccagaagaugcaucaccggcggcaucguggaggaguaccagcugcccuacuacaacauggugcccagcgaccccagcuacgaggacaugagagagguggugugcgugaagagacugagacccaucgugagcaacagauggaacagcgacgagugccugagagccgugcugaagcugaugagcgagugcugggcccacaaccccgccagcagacugaccgcccugagaaucaagaagacccuggccaagaugguggagagccaggacgugaagaucuaa

SEQ ID NO: 14252 - RNA, 1509 nt, Artificial Sequence
  BMPR1B__Homo_sapiens__NP_001243721
augcugcugagaagcgccggcaagcugaacgugggcaccaagaaggaggacggcgagagcaccgcccccacccccagacccaaggugcugagaugcaagugccaccaccacugccccgaggacagcgugaacaacaucugcagcaccgacggcuacugcuucaccaugaucgaggaggacgacagcggccugcccguggugaccagcggcugccugggccuggagggcagcgacuuccagugcagagacacccccaucccccaccagagaagaagcaucgagugcugcaccgagagaaacgagugcaacaaggaccugcaccccacccugcccccccugaagaacagagacuucguggacggccccauccaccacagagcccugcugaucagcgugaccgugugcagccugcugcuggugcugaucauccuguucugcuacuucagauacaagagacaggagaccagacccagauacagcaucggccuggagcaggacgagaccuacaucccccccggcgagagccugagagaccugaucgagcagagccagagcagcggcagcggcagcggccugccccugcuggugcagagaaccaucgccaagcagauccagauggugaagcagaucggcaagggcagauacggcgagguguggaugggcaaguggagaggcgagaagguggccgugaagguguucuucaccaccgaggaggccagcugguucagagagaccgagaucuaccagaccgugcugaugagacacgagaacauccugggcuucaucgccgccgacaucaagggcaccggcagcuggacccagcuguaccugaucaccgacuaccacgagaacggcagccuguacgacuaccugaagagcaccacccuggacgccaagagcaugcugaagcuggccuacagcagcgugagcggccugugccaccugcacaccgagaucuucagcacccagggcaagcccgccaucgcccacagagaccugaagagcaagaacauccuggugaagaagaacggcaccugcugcaucgccgaccugggccuggccgugaaguucaucagcgacaccaacgagguggacaucccccccaacaccagagugggcaccaagagauacaugccccccgaggugcuggacgagagccugaacagaaaccacuuccagagcuacaucauggccgacauguacagcuucggccugauccugugggagguggccagaagaugcgugagcggcggcaucguggaggaguaccagcugcccuaccacgaccuggugcccagcgaccccagcuacgaggacaugagagagaucgugugcaucaagaagcugagacccagcuuccccaacagauggagcagcgacgagugccugagacagaugggcaagcugaugaccgagugcugggcccacaaccccgccagcagacugaccgcccugagagugaagaagacccuggccaagaugagcgagagccaggacaucaagcuguaa

SEQ ID NO: 14253 - RNA, 3117 nt, Artificial Sequence
  BMPR2__Homo_sapiens__NP_001195
augaccagcagccugcagagacccuggagagugcccuggcugcccuggaccauccugcuggugagcaccgccgccgccagccagaaccaggagagacugugcgccuucaaggaccccuaccagcaggaccugggcaucggcgagagcagaaucagccacgagaacggcaccauccugugcagcaagggcagcaccugcuacggccugugggagaagagcaagggcgacaucaaccuggugaagcagggcugcuggagccacaucggcgacccccaggagugccacuacgaggagugcguggugaccaccaccccccccagcauccagaacggcaccuacagauucugcugcugcagcaccgaccugugcaacgugaacuucaccgagaacuuccccccccccgacaccaccccccugagccccccccacagcuucaacagagacgagaccaucaucaucgcccuggccagcgugagcgugcuggccgugcugaucguggcccugugcuucggcuacagaaugcugaccggcgacagaaagcagggccugcacagcaugaacaugauggaggccgccgccagcgagcccagccuggaccuggacaaccugaagcugcuggagcugaucggcagaggcagauacggcgccguguacaagggcagccuggacgagagacccguggccgugaagguguucagcuucgccaacagacagaacuucaucaacgagaagaacaucuacagagugccccugauggagcacgacaacaucgccagauucaucgugggcgacgagagagugaccgccgacggcagaauggaguaccugcuggugauggaguacuaccccaacggcagccugugcaaguaccugagccugcacaccagcgacugggugagcagcugcagacuggcccacagcgugaccagaggccuggccuaccugcacaccgagcugcccagaggcgaccacuacaagcccgccaucagccacagagaccugaacagcagaaacgugcuggugaagaacgacggcaccugcgugaucagcgacuucggccugagcaugagacugaccggcaacagacuggugagacccggcgaggaggacaacgccgccaucagcgaggugggcaccaucagauacauggcccccgaggugcuggagggcgccgugaaccugagagacugcgagagcgcccugaagcagguggacauguacgcccugggccugaucuacugggagaucuucaugagaugcaccgaccuguuccccggcgagagcgugcccgaguaccagauggccuuccagaccgaggugggcaaccaccccaccuucgaggacaugcaggugcuggugagcagagagaagcagagacccaaguuccccgaggccuggaaggagaacagccuggccgugagaagccugaaggagaccaucgaggacugcugggaccaggacgccgaggccagacugaccgcccagugcgccgaggagagaauggccgagcugaugaugaucugggagagaaacaagagcgugagccccaccgugaaccccaugagcaccgccaugcagaacgagagaaaccugagccacaacagaagagugcccaagaucggccccuaccccgacuacagcagcagcagcuacaucgaggacagcauccaccacaccgacagcaucgugaagaacaucagcagcgagcacagcaugagcagcaccccccugaccaucggcgagaagaacagaaacagcaucaacuacgagagacagcaggcccaggccagaauccccagccccgagaccagcgugaccagccugagcaccaacaccaccaccaccaacaccaccggccugacccccagcaccggcaugaccaccaucagcgagaugcccuaccccgacgagaccaaccugcacaccaccaacguggcccagagcaucggccccacccccgugugccugcagcugaccgaggaggaccuggagaccaacaagcuggaccccaaggagguggacaagaaccugaaggagagcagcgacgagaaccugauggagcacagccugaagcaguucagcggccccgacccccugagcagcaccagcagcagccugcuguacccccugaucaagcuggccguggaggccaccggccagcaggacuucacccagaccgccaacggccaggccugccugauccccgacgugcugcccacccagaucuacccccugcccaagcagcagaaccugcccaagagacccaccagccugccccugaacaccaagaacagcaccaaggagcccagacugaaguucggcagcaagcacaagagcaaccugaagcagguggagaccggcguggccaagaugaacaccaucaacgccgccgagccccacguggugaccgugaccaugaacggcguggccggcagaaaccacagcgugaacagccacgccgccaccacccaguacgccaacggcaccgugcugagcggccagaccaccaacaucgugacccacagagcccaggagaugcugcagaaccaguucaucggcgaggacaccagacugaacaucaacagcagccccgacgagcacgagccccugcugagaagagagcagcaggccggccacgacgagggcgugcuggacagacugguggacagaagagagagaccccuggagggcggcagaaccaacagcaacaacaacaacagcaaccccugcagcgagcaggacgugcuggcccagggcgugcccagcaccgccgccgaccccggccccagcaagcccagaagagcccagagacccaacagccuggaccugagcgccaccaacgugcuggacggcagcagcauccagaucggcgagagcacccaggacggcaagagcggcagcggcgagaagaucaagaagagagugaagacccccuacagccugaagagauggagacccagcaccugggugaucagcaccgagagccuggacugcgaggugaacaacaacggcagcaacagagccgugcacagcaagagcagcaccgccguguaccuggccgagggcggcaccgccaccaccauggugagcaaggacaucggcaugaacugccuguaa

SEQ ID NO: 14254 - RNA, 3849 nt, Artificial Sequence
  BMS1__Homo_sapiens__NP_055568
auggaggccaaggaccagaagaagcacagaaagaagaacagcggccccaaggccgccaagaagaagaagagacugcugcaggaccugcagcugggcgacgaggaggacgccagaaagagaaaccccaaggccuucgccgugcagagcgccgugagaauggccagaagcuuccacagaacccaggaccugaagaccaagaagcaccacauccccgugguggacagaaccccccuggagcccccccccaucguggugguggugaugggcccccccaaggugggcaagagcacccugauccagugccugaucagaaacuucaccagacagaagcugaccgagaucagaggccccgugaccaucgugagcggcaagaagagaagacugaccaucaucgagugcggcugcgacaucaacaugaugaucgaccuggccaagguggccgaccuggugcugaugcugaucgacgccagcuucggcuucgagauggagaccuucgaguuccugaacaucugccaggugcacggcuuccccaagaucaugggcgugcugacccaccuggacagcuucaagcacaacaagcagcugaagaagaccaagaagagacugaagcacagauucuggaccgagguguaccccggcgccaagcuguucuaccugagcggcauggugcacggcgaguaccagaaccaggagauccacaaccugggcagauucaucaccgugaugaaguucagaccccugaccuggcagaccagccaccccuacauccuggccgacagaauggaggaccugaccaaccccgaggacaucagaaccaacaucaagugcgacagaaaggugagccuguacggcuaccugagaggcgcccaccugaagaacaagagccagauccacaugcccggcgugggcgacuucgccgugagcgacaucagcuuccugcccgaccccugcgcccugcccgagcagcagaagaagagaugccugaacgagaaggagaagcugguguacgccccccugagcggcgugggcggcgugcuguacgacaaggacgccguguacguggaccugggcggcagccacguguuccaggacgaggugggccccacccacgagcuggugcagagccugaucagcacccacagcaccaucgacgccaagauggccagcagcagagugacccuguucagcgacagcaagccccugggcagcgaggacaucgacaaccagggccugaugaugcccaaggaggagaagcagauggaccugaacaccggcagaaugagaagaaaggccaucuucggcgacgaggacgagagcggcgacagcgacgacgaggaggacgacgagaugagcgaggacgacggccuggagaacggcagcagcgacgaggaggccgaggaggaggagaacgccgagaugaccgaccaguacauggccgugaagggcaucaagagaagaaagcuggagcuggaggaggacagcgagauggaccugcccgccuucgccgacagcgacgacgaccuggagagaagcagcgccgaggagggcgaggccgaggaggccgacgagagcagcgaggaggaggacugcaccgccggcgagaagggcaucagcggcagcaaggccgccggcgagggcagcaaggccggccugagccccgccaacugccagagcgacagagugaaccuggagaagagccugcugaugaagaaggccgcccugcccaccuucgacagcggccacugcaccgccgaggagguguucgccagcgaggacgagagcgaggagagcagcagccugagcgccgaggaggaggacagcgagaacgaggaggccaucagaaagaagcugagcaagcccagccaggugagcagcggccagaagcugggcccccagaacuucaucgacgagaccagcgacaucgagaaccugcugaaggaggaggaggacuacaaggaggagaacaacgacagcaaggagaccagcggcgcccugaaguggaaggaggaccugagcagaaaggccgccgaggccuuccugagacagcagcaggccgcccccaaccugagaaagcugaucuacggcaccgugaccgaggacaacgaggaggaggacgacgacacccuggaggagcugggcggccuguucagagugaaccagcccgacagagagugcaagcacaaggccgacagccuggacugcagcagauuccugguggaggccccccacgacugggaccuggaggaggugaugaacagcaucagagacugcuucgugaccggcaagugggaggacgacaaggacgccgccaaggugcuggccgaggacgaggagcuguacggcgacuucgaggaccuggagaccggcgacgugcacaagggcaagagcggccccaacacccagaacgaggacaucgagaaggaggugaaggaggagaucgaccccgacgaggaggagagcgccaagaagaagcaccuggacaagaagagaaagcugaaggagauguucgacgccgaguacgacgagggcgagagcaccuacuucgacgaccugaagggcgagaugcagaagcaggcccagcugaacagagccgaguucgaggaccaggacgacgaggccagagugcaguacgagggcuucagacccggcauguacgugagaaucgagaucgagaacgugcccugcgaguucgugcagaacuucgacccccacuaccccaucauccugggcggccugggcaacagcgagggcaacgugggcuacgugcagaugagacugaagaagcacagaugguacaagaagauccugaagagcagagaccccaucaucuucagcgugggcuggagaagauuccagaccaucccccuguacuacaucgaggaccacaacggcagacagagacugcugaaguacaccccccagcacaugcacugcggcgccgccuucuggggccccaucaccccccagggcaccggcuuccuggccauccagagcgugagcggcaucaugcccgacuucagaaucgccgccaccggcguggugcuggaccuggacaagagcaucaagaucgugaagaagcugaagcugaccggcuuccccuacaagaucuucaagaacaccagcuucaucaagggcauguucaacagcgcccuggagguggccaaguucgagggcgccgugaucagaaccgugagcggcaucagaggccagaucaagaaggcccugagagcccccgagggcgccuucagagccagcuucgaggacaagcugcugaugagcgacaucguguucaugagaaccugguaccccgugagcauccccgccuucuacaaccccgugaccagccugcugaagcccgugggcgagaaggacaccuggagcggcaugagaaccaccggccagcugagacuggcccacggcgugagacugaaggccaacaaggacagccuguacaagcccauccugagacagaagaagcacuucaacagccugcacauccccaaggcccugcagaaggcccugcccuucaagaacaagcccaagacccaggccaaggccggcaaggugcccaaggacagaagaagacccgccgugaucagagagccccacgagagaaagauccuggcccugcuggacgcccugagcaccgugcacagccagaagaugaagaaggccaaggagcagagacaccugcacaacaaggagcacuucagagccaagcagaaggaggaggaggagaagcugaagagacagaaggaccugagaaagaagcuguucagaauccagggccagaaggagagaagaaaccagaagagcagccugaagggcgccgagggccagcugcaguaa

SEQ ID NO: 14255 - RNA, 2028 nt, Artificial Sequence
  BMX__Homo_sapiens__NP_001712
auggacaccaagagcauccuggaggagcugcugcugaagagaagccagcagaagaagaagaugagccccaacaacuacaaggagagacuguucgugcugaccaagaccaaccugagcuacuacgaguacgacaagaugaagagaggcagcagaaagggcagcaucgagaucaagaagaucagaugcguggagaaggugaaccuggaggagcagacccccguggagagacaguaccccuuccagaucguguacaaggacggccugcuguacguguacgccagcaacgaggagagcagaagccaguggcugaaggcccugcagaaggagaucagaggcaacccccaccugcuggugaaguaccacagcggcuucuucguggacggcaaguuccugugcugccagcagagcugcaaggccgcccccggcugcacccugugggaggccuacgccaaccugcacaccgccgugaacgaggagaagcacagagugcccaccuuccccgacagagugcugaagauccccagagccgugcccgugcugaagauggacgcccccagcagcagcaccacccuggcccaguacgacaacgagagcaagaagaacuacggcagccagccccccagcagcagcaccagccuggcccaguacgacagcaacagcaagaagaucuacggcagccagcccaacuucaacaugcaguacauccccagagaggacuuccccgacugguggcaggugagaaagcugaagagcagcagcagcagcgaggacguggccagcagcaaccagaaggagagaaacgugaaccacaccaccagcaagaucagcugggaguuccccgagagcagcagcagcgaggaggaggagaaccuggacgacuacgacugguucgccggcaacaucagcagaagccagagcgagcagcugcugagacagaagggcaaggagggcgccuucauggugagaaacagcagccaggugggcauguacaccgugagccuguucagcaaggccgugaacgacaagaagggcaccgugaagcacuaccacgugcacaccaacgccgagaacaagcuguaccuggccgagaacuacugcuucgacagcauccccaagcugauccacuaccaccagcacaacagcgccggcaugaucaccagacugagacaccccgugagcaccaaggccaacaaggugcccgacagcgugagccugggcaacggcaucugggagcugaagagagaggagaucacccugcugaaggagcugggcagcggccaguucggcguggugcagcugggcaaguggaagggccaguacgacguggccgugaagaugaucaaggagggcagcaugagcgaggacgaguucuuccaggaggcccagaccaugaugaagcugagccaccccaagcuggugaaguucuacggcgugugcagcaaggaguaccccaucuacaucgugaccgaguacaucagcaacggcugccugcugaacuaccugagaagccacggcaagggccuggagcccagccagcugcuggagaugugcuacgacgugugcgagggcauggccuuccuggagagccaccaguucauccacagagaccuggccgccagaaacugccugguggacagagaccugugcgugaaggugagcgacuucggcaugaccagauacgugcuggacgaccaguacgugagcagcgugggcaccaaguuccccgugaaguggagcgcccccgagguguuccacuacuucaaguacagcagcaagagcgacgugugggccuucggcauccugaugugggagguguucagccugggcaagcagcccuacgaccuguacgacaacagccagguggugcugaaggugagccagggccacagacuguacagaccccaccuggccagcgacaccaucuaccagaucauguacagcugcuggcacgagcugcccgagaagagacccaccuuccagcagcugcugagcagcaucgagccccugagagagaaggacaagcacuaa

SEQ ID NO: 14256 - RNA, 2964 nt, Artificial Sequence
  BNC1__Homo_sapiens__NP_001288135
augagaugcagaaacauguucuucagcuucaaggccagccugugcggcugcggcgccgccaccgcccccagccugaccgccaucagcugcacccugaacugcagcugccagagcuucaagcccggcaagaucaaccacagacagugcgaccagugcaagcacggcuggguggcccacgcccugagcaagcugagaaucccccccauguaccccaccagccagguggagaucgugcagagcaacgugguguucgacaucagcagccugaugcuguacggcacccaggccauccccgugagacugaagauccugcuggacagacuguucagcgugcugaagcaggacgaggugcugcagauccugcacgcccuggacuggacccugcaggacuacaucagaggcuacgugcugcaggacgccagcggcaaggugcuggaccacuggagcaucaugaccagcgaggaggagguggccacccugcagcaguuccugagauucggcgagaccaagagcaucguggagcugauggccauccaggagaaggaggagcagagcaucaucaucccccccagcaccgccaacguggacaucagagccuucaucgagagcugcagccacagaagcagcagccugcccacccccguggacaagggcaaccccagcagcauccaccccuucgagaaccugaucagcaacaugaccuucaugcugcccuuccaguucuucaacccccugccccccgcccugaucggcagccugcccgagcaguacaugcuggagcagggccacgaccagagccaggaccccaagcaggaggugcacggccccuuccccgacagcagcuuccugaccagcagcagcacccccuuccagguggagaaggaccagugccugaacugccccgacgccaucaccaagaaggaggacagcacccaccugagcgacagcagcagcuacaacaucgugaccaaguucgagagaacccagcugagccccgaggccaaggugaagcccgagagaaacagccugggcaccaagaagggcagaguguucugcaccgccugcgagaagaccuucuacgacaagggcacccugaagauccacuacaacgccgugcaccugaagaucaagcacaagugcaccaucgagggcugcaacaugguguucagcagccugagaagcagaaacagacacagcgccaaccccaaccccagacugcacaugcccaugaacagaaacaacagagacaaggaccugagaaacagccugaaccuggccagcagcgagaacuacaagugccccggcuucaccgugaccagccccgacugcagacccccccccagcuaccccggcagcggcgaggacagcaagggccagcccgccuuccccaacaucggccagaacggcgugcuguuccccaaccugaagaccgugcagcccgugcugcccuucuacagaagccccgccacccccgccgagguggccaacacccccggcauccugcccagccugccccugcugagcagcagcauccccgagcagcugaucagcaacgagaugcccuucgacgcccugcccaagaagaagagcagaaagagcagcaugcccaucaagaucgagaaggaggccguggagaucgccaacgagaagagacacaaccugagcagcgacgaggacaugccccugcagguggugagcgaggacgagcaggaggccugcagcccccagagccacagagugagcgaggagcagcacgugcagagcggcggccugggcaagcccuuccccgagggcgagagacccugccacagagagagcgugaucgagagcagcggcgccaucagccagacccccgagcaggccacccacaacagcgagagagagaccgagcagacccccgcccugaucauggugcccagagagguggaggacggcggccacgagcacuacuucacccccggcauggagccccaggugcccuucagcgacuacauggagcugcagcagagacugcuggccggcggccuguucagcgcccugagcaacagaggcauggccuuccccugccuggaggacagcaaggagcuggagcacgugggccagcacgcccuggccagacagaucgaggagaacagauuccagugcgacaucugcaagaagaccuucaagaacgccugcagcgugaagauccaccacaagaacaugcacgugaaggagaugcacaccugcaccguggagggcugcaacgccaccuuccccagcagaagaagcagagacagacacagcagcaaccugaaccugcaccagaaggcccugagccaggaggcccuggagagcagcgaggaccacuucagagccgccuaccugcugaaggacguggccaaggaggccuaccaggacguggccuucacccagcaggccagccagaccagcgugaucuucaagggcaccagcagaaugggcagccugguguaccccaucacccaggugcacagcgccagccuggagagcuacaacagcggcccccugagcgagggcaccauccuggaccugagcaccaccagcagcaugaagagcgagagcagcagccacagcagcugggacagcgacggcgugagcgaggagggcaccgugcugauggaggacagcgacggcaacugcgagggcagcagccuggugcccggcgaggacgaguaccccaucugcgugcugauggagaaggccgaccagagccuggccagccugcccagcggccugcccaucaccugccaccugugccagaagaccuacagcaacaagggcaccuucagagcccacuacaagaccgugcaccugagacagcugcacaagugcaaggugcccggcugcaacaccauguucagcagcgugagaagcagaaacagacacagccagaaccccaaccugcacaagagccuggccagcagccccagccaccugcaguaa

SEQ ID NO: 14257 - RNA, 3300 nt, Artificial Sequence
  BNC2__Homo_sapiens__NP_060107
auggcccaccugggccccaccccccccccccacagccugaacuacaagagcgaggacagacugagcgagcaggacuggcccgccuacuucaaggugcccugcugcggcguggacaccagccagaucgagagcgaggaggccgagguggacgugagagagagagagacccagagagacagagagcccaagagagccagagaccugacccugagagacagcugcaccgacaacagcaugcaguucggcaccagaaccaccaccgccgagcccggcuucaugggcaccuggcagaacgccgacaccaaccugcuguucagaaugagccagcaggccaucagaugcacccuggugaacugcaccugcgagugcuuccagcccggcaagaucaaccugagaaccugcgaccagugcaagcacggcuggguggcccacgcccuggacaagcugagcacccagcaccuguaccaccccacccagguggagaucgugcagagcaacgugguguucgacaucagcagccugaugcuguacggcacccaggccgugcccgugagacugaagauccugcuggacagacuguucagcgugcugaagcaggaggaggugcugcacauccugcacggccugggcuggacccugagagacuacgugagaggcuacauccugcaggacgccgccggcaaggugcuggacagaugggccaucaugagcagagaggaggagaucaucacccugcagcaguuccugagauucggcgagaccaagagcaucguggagcugauggccauccaggagaaggagggccaggccguggccgugcccagcagcaagaccgacagcgacaucagaaccuucaucgagagcaacaacagaaccagaagccccagccugcuggcccaccuggagaacagcaaccccagcagcauccaccacuucgagaacauccccaacagccuggccuuccugcugcccuuccaguacaucaaccccgugagcgccccccugcugggccugccccccaacggccugcugcuggagcagcccggccugagacugagagagcccagccugagcacccagaacgaguacaacgagagcagcgagagcgaggugagccccacccccuacaagaacgaccagacccccaacagaaacgcccugaccagcaucaccaacguggagcccaagaccgagcccgccugcgugagccccauccagaacagcgcccccgugagcgaccugaccaagaccgagcaccccaagagcagcuucagaauccacagaaugagaagaaugggcagcgccagcagaaagggcagaguguucugcaacgccugcggcaagaccuucuacgacaagggcacccugaagauccacuacaacgccgugcaccugaagaucaagcacagaugcaccaucgagggcugcaacaugguguucagcagccugagaagcagaaacagacacagcgccaaccccaaccccagacugcacaugcccaugcugagaaacaacagagacaaggaccugaucagagccaccagcggcgccgccacccccgugaucgccagcaccaagagcaaccuggcccugaccagccccggcagaccccccaugggcuucaccacccccccccuggaccccgugcugcagaacccccugcccagccagcugguguucagcggccugaagaccgugcagcccgugccccccuucuacagaagccugcugacccccggcgagauggugagcccccccaccagccugcccaccagccccaucauccccaccagcggcaccaucgagcagcacccccccccccccagcgagcccguggugcccgccgugaugauggccacccacgagcccagcgccgaccuggcccccaagaagaagcccagaaagagcagcaugcccgugaagaucgagaaggagaucaucgacaccgccgacgaguucgacgacgaggacgacgaccccaacgacggcggcgccguggugaacgacaugagccacgacaaccacugccacagccaggaggagaugagccccggcaugagcgugaaggacuucagcaagcacaacagaaccagaugcaucagcagaaccgagaucagaagagccgacagcaugaccagcgaggaccaggagcccgagagagacuacgagaacgagagcgagagcagcgagcccaagcugggcgaggagagcauggagggcgacgagcacauccacagcgaggugagcgagaaggugcugaugaacagcgagagacccgacgagaaccacagcgagcccagccaccaggacgugaucaaggugaaggaggaguucaccgaccccaccuacgacauguucuacaugagccaguacggccuguacaacggcggcggcgccagcauggccgcccugcacgagagcuucaccagcagccugaacuacggcagcccccagaaguucagccccgagggcgaccugugcagcagccccgaccccaagaucugcuacgugugcaagaagagcuucaagagcagcuacagcgugaagcugcacuacagaaacgugcaccugaaggagaugcacgugugcaccguggccggcugcaacgccgccuuccccagcagaagaagcagagacagacacagcgccaacaucaaccugcacagaaagcugcugaccaaggagcuggacgacaugggccuggacagcagccagcccagccugagcaaggaccugagagacgaguuccuggugaagaucuacggcgcccagcaccccaugggccuggacgugagagaggacgccagcagccccgccggcaccgaggacagccaccugaacggcuacggcagaggcauggccgaggacuacauggugcuggaccugagcaccaccagcagccugcagagcagcagcagcauccacagcagcagagagagcgacgccggcagcgacgagggcauccugcuggacgacaucgacggcgccagcgacagcggcgagagcgcccacaaggccgaggcccccgcccugcccggcagccugggcgccgaggugagcggcagccugauguucagcagccugagcggcagcaacggcggcaucaugugcaacaucugccacaagauguacagcaacaagggcacccugagagugcacuacaagaccgugcaccugagagagaugcacaagugcaaggugcccggcugcaacaugauguucagcagcgugagaagcagaaacagacacagccagaaccccaaccugcacaagaacauccccuucaccagcguggacuaa

SEQ ID NO: 14258 - RNA, 687 nt, Artificial Sequence
  BNIP1__Homo_sapiens__NP_001196
auggccgccccccaggacgugcacgugagaaucugcaaccaggagaucgugaaguucgaccuggaggugaaggcccugauccaggacaucagagacugcagcggcccccugagcgcccugaccgagcugaacaccaaggugaaggagaaguuccagcagcugagacacagaauccaggaccuggagcagcuggccaaggagcaggacaaggagagcgagaagcagcugcugcugcaggagguggagaaccacaagaagcagaugcugagcaaccaggccagcuggagaaaggccaaccugaccugcaagaucgccaucgacaaccuggagaaggccgagcugcugcagggcggcgaccugcugagacagagaaagaccaccaaggagagccuggcccagaccagcagcaccaucaccgagagccugaugggcaucagcagaaugauggcccagcaggugcagcagagcgaggaggccaugcagagccuggugaccagcagcagaaccauccuggacgccaacgaggaguucaagagcaugagcggcaccauccagcugggcagaaagcugaucaccaaguacaacagaagagagcugaccgacaagcugcugaucuuccuggcccuggcccuguuccuggccaccgugcuguacaucgugaagaagagacuguuccccuuccuguaa

SEQ ID NO: 14259 - RNA, 1308 nt, Artificial Sequence
  BNIP2__Homo_sapiens__NP_004321
augcugugcggcuuccaggaggacgccacccccccccccccccccagacccagaagacugcacagaagacugcccagacccgaggaggugggcaugcugagccugccccccggccugcugaccgugagcggcagcgccgccgccgccgacgccgugccccugagacccggcgacugggccggcgugagcaccgccgacagaggcgagagagccccccugggccccgccuucugcgaccuggccgugagccccaccagccccgccuggagaggcgaggaggacgagggcgccaaggccagcagcggcgacaucggcagccuggacuaccaggaguucgugguggacaucgagagcagacugagaauggagggcguggagcugaaggaggaguggcaggacgaggacuuccccaucccccugcccgaggacgacagcaucgaggccgacauccuggccaucaccggccccgaggaccagcccggcagccuggaggugaacggcaacaaggugagaaagaagcugauggcccccgacaucagccugacccuggaccccagcgacggcagcgugcugagcgacgaccuggacgagagcggcgagaucgaccuggacggccuggacacccccagcgagaacagcaacgaguucgagugggaggacgaccugcccaagcccaagaccaccgaggugaucagaaagggcagcaucaccgaguacaccgccgccgaggagaaggaggacggcagaagauggagaauguucagaaucggcgagcaggaccacagaguggacaugaaggccaucgagcccuacaagaaggugaucagccacggcggcuacuacggcgacggccugaacgccaucgugguguucgccgugugcuucaugcccgagagcagccagcccaacuacagauaccugauggacaaccuguucaaguacgugaucggcacccuggagcugcugguggccgagaacuacaugaucguguaccugaacggcgccaccaccagaagaaagaugcccagccugggcuggcugagaaagugcuaccagcagaucgacagaagacugagaaagaaccugaagagccugaucaucgugcaccccagcugguucaucagaacccugcuggccgugaccagacccuucaucagcagcaaguucagccagaagaucagauacguguucaaccuggccgagcuggccgagcuggugcccauggaguacgugggcauccccgagugcaucaagcagguggaccaggagcugaacggcaagcaggacgagcccaagaacgagcaguaa

SEQ ID NO: 14260 - RNA, 780 nt, Artificial Sequence
  BNIP3__Homo_sapiens__NP_004043
augggcgacgccgccgccgacccccccggccccgcccugcccugcgaguuccugagacccggcugcggcgccccccugagccccggcgcccagcugggcagaggcgcccccaccagcgccuuccccccccccgccgccgaggcccaccccgccgccagaagaggccugagaagcccccagcugcccagcggcgccaugagccagaacggcgcccccggcaugcaggaggagagccugcagggcagcuggguggagcugcacuucagcaacaacggcaacggcggcagcgugcccgccagcgugagcaucuacaacggcgacauggagaagauccugcuggacgcccagcacgagagcggcagaagcagcagcaagagcagccacugcgacagcccccccagaagccagaccccccaggacaccaacagagccagcgagaccgacacccacagcaucggcgagaagaacagcagccagagcgaggaggacgacaucgagagaagaaaggagguggagagcauccugaagaagaacagcgacuggaucugggacuggagcagcagacccgagaacaucccccccaaggaguuccuguucaagcaccccaagagaaccgccacccugagcaugagaaacaccagcgugaugaagaagggcggcaucuucagcgccgaguuccugaagguguuccugcccagccugcugcugagccaccugcuggccaucggccugggcaucuacaucggcagaagacugaccaccagcaccagcaccuucuaa

SEQ ID NO: 14261 - RNA, 660 nt, Artificial Sequence
  BNIP3L__Homo_sapiens__NP_004322
augagcagccaccugguggagcccccccccccccugcacaacaacaacaacaacugcgaggagaacgagcagagccugcccccccccgccggccugaacagcagcuggguggagcugcccaugaacagcagcaacggcaacgacaacggcaacggcaagaacggcggccuggagcacgugcccagcagcagcagcauccacaacggcgacauggagaagauccugcuggacgcccagcacgagagcggccagagcagcagcagaggcagcagccacugcgacagccccagcccccaggaggacggccagaucauguucgacguggagaugcacaccagcagagaccacagcagccagagcgaggaggaggugguggagggcgagaaggagguggaggcccugaagaagagcgccgacugggugagcgacuggagcagcagacccgagaacaucccccccaaggaguuccacuucagacaccccaagagaagcgugagccugagcaugagaaagagcggcgccaugaagaagggcggcaucuucagcgccgaguuccugaagguguucauccccagccuguuccugagccacgugcuggcccugggccugggcaucuacaucggcaagagacugagcacccccagcgccagcaccuacuaa

SEQ ID NO: 14262 - RNA, 1032 nt, Artificial Sequence
  BNIPL__Homo_sapiens__XP_011507538
augggcaccauccaggaggccggcaagaagaccgacgugggcgugagagagaucgccgaggcccccgagcugggcgccgcccugagacacggcgagcuggagcugaaggaggaguggcaggacgaggaguuccccagacugcugcccgaggaggccggcaccagcgaggaccccgaggaccccaagggcgacagccaggccgccgccggcacccccagcacccuggcccugugcggccagagacccaugagaaagagacugagcgcccccgagcugagacugagccugaccaagggccccggcaacgacggcgccagccccacccagagcgcccccagcagccccgacggcagcagcgaccuggagaucgacgagcuggagacccccagcgacagcgagcagcuggacagcggccacgaguucgagugggaggacgagcugcccagagccgagggccugggcaccagcgagaccgccgagagacugggcagaggcugcaugugggacgugaccggcgaggacggccaccacuggagaguguucagaaugggccccagagagcagagaguggacaugaccgugaucgagcccuacaagaaggugcugagccacggcggcuaccacggcgacggccugaacgccgugauccuguucgccagcugcuaccugcccagaagcagcauccccaacuacaccuacgugauggagcaccuguucagauacauggugggcacccuggagcugcugguggccgagaacuaccugcuggugcaccugagcggcggcaccagcagagcccaggugcccccccugagcuggaucagacagugcuacagaacccuggacagaagacugagaaagaaccugagagcccuggugguggugcacgccaccugcagcaaguucaccagaaagaucagauuccuggacagccugggcgagcuggcccagcugaucagccuggaccaggugcacauccccgaggccgugagacagcuggacagagaccugcacggcagcggcggcaccuaa

SEQ ID NO: 14263 - RNA, 3348 nt, Artificial Sequence
  BOC__Homo_sapiens__NP_001288790
augcugagaggcaccaugaccgccuggagaggcaugagacccgaggugacccuggccugccugcugcuggccaccgccggcugcuucgccgaccugaacgaggugccccaggugaccgugcagcccgccagcaccgugcagaagcccggcggcaccgugauccugggcugcgugguggagccccccagaaugaacgugaccuggagacugaacggcaaggagcugaacggcagcgacgacgcccugggcgugcugaucacccacggcacccuggugaucaccgcccugaacaaccacaccgugggcagauaccagugcguggccagaaugcccgccggcgccguggccagcgugcccgccaccgugacccuggccaaccugcaggacuucaagcuggacgugcagcacgugaucgagguggacgagggcaacaccgccgugaucgccugccaccugcccgagagccaccccaaggcccaggugagauacagcgugaagcaggaguggcuggaggccagcagaggcaacuaccugaucaugcccagcggcaaccugcagaucgugaacgccagccaggaggacgagggcauguacaagugcgccgccuacaaccccgugacccaggaggugaagaccagcggcagcagcgacagacugagagugagaagaagcaccgccgaggccgccagaaucaucuacccccccgaggcccagaccaucaucgugaccaagggccagagccugauccuggagugcguggccagcggcauccccccccccagagugaccugggccaaggacggcagcagcgugaccggcuacaacaagaccagauuccugcugagcaaccugcugaucgacaccaccagcgaggaggacagcggcaccuacagaugcauggccgacaacggcgugggccagcccggcgccgccgugauccuguacaacgugcagguguucgagccccccgaggugaccauggagcugagccagcuggugauccccuggggccagagcgccaagcugaccugcgaggugagaggcaaccccccccccagcgugcuguggcugagaaacgccgugccccugaucagcagccagagacugagacugagcagaagagcccugagagugcugagcaugggccccgaggacgagggcguguaccagugcauggccgagaacgaggugggcagcgcccacgccguggugcagcugagaaccagcagacccagcaucacccccagacuguggcaggacgccgagcuggccaccggcaccccccccgugagccccagcaagcugggcaaccccgagcagaugcugagaggccagcccgcccugcccagaccccccaccagcgugggccccgccagcccccagugccccggcgagaagggccagggcgcccccgccgaggcccccaucauccugagcagccccagaaccagcaagaccgacagcuacgagcugguguggagacccagacacgagggcagcggcagagcccccauccuguacuacguggugaagcacagaaagcaggugaccaacagcagcgacgacuggaccaucagcggcauccccgccaaccagcacagacugacccugaccagacuggaccccggcagccuguacgagguggagauggccgccuacaacugcgccggcgagggccagaccgccauggugaccuucagaaccggcagaagacccaagcccgagaucauggccagcaaggagcagcagauccagagagacgaccccggcgccagcccccagagcagcagccagcccgaccacggcagacugagcccccccgaggcccccgacagacccaccaucagcaccgccagcgagaccagcguguacgugaccuggauccccagaggcaacggcggcuuccccauccagagcuucagaguggaguacaagaagcugaagaaggugggcgacuggauccuggccaccagcgccaucccccccagcagacugagcguggagaucaccggccuggagaagggcaccagcuacaaguucagagugagagcccugaacaugcugggcgagagcgagcccagcgcccccagcagacccuacguggugagcggcuacagcggcagaguguacgagagacccguggccggccccuacaucaccuucaccgacgccgugaacgagaccaccaucaugcugaaguggauguacauccccgccagcaacaacaacacccccauccacggcuucuacaucuacuacagacccaccgacagcgacaacgacagcgacuacaagaaggacaugguggagggcgacaaguacuggcacagcaucagccaccugcagcccgagaccagcuacgacaucaagaugcagugcuucaacgagggcggcgagagcgaguucagcaacgugaugaucugcgagaccaaggccagaaagagcagcggccagcccggcagacugcccccccccacccuggcccccccccagcccccccugcccgagaccaucgagagacccgugggcaccggcgccaugguggccagaagcagcgaccugcccuaccugaucgugggcguggugcugggcagcaucgugcugaucaucgugaccuucauccccuucugccuguggagagccuggagcaagcagaagcacaccaccgaccugggcuuccccagaagcgcccugccccccagcugccccuacaccauggugccccugggcggccugcccggccaccaggccagcggccagcccuaccugagcggcaucagcggcagagccugcgccaacggcauccacaugaacagaggcugccccagcgccgccgugggcuaccccggcaugaagccccagcagcacugccccggcgagcugcagcagcagagcgacaccagcagccugcugagacagacccaccugggcaacggcuacgacccccagagccaccagaucaccagaggccccaagagcagccccgacgagggcagcuuccuguacacccugcccgacgacagcacccaccagcugcugcagccccaccacgacugcugccagagacaggagcagcccgccgccgugggccagagcggcgugagaagagcccccgacagccccgugcuggaggccgugugggacccccccuuccacagcggcccccccugcugccugggccuggugcccguggaggagguggacagccccgacagcugccaggugagcggcggcgacuggugcccccagcaccccgugggcgccuacgugggccaggagcccggcaugcagcugagccccggcccccuggugagagugagcuucgagacccccccccugaccaucuaa

SEQ ID NO: 14264 - RNA, 519 nt, Artificial Sequence
  BOD1L2__Homo_sapiens__NP_001244893
auggccgacggcggcggcggcggcagcggcggcgccggccccgccagcaccagagccagcggcggcggcggccccaucaaccccgccagccugccccccggcgacccccagcugaucgccaucaucgugggccagcugaagagcagaggccuguucgacagcuucagaagagacugcaaggccgacguggacaccaagcccgccuaccagaaccugagccagaaggccgacaacuucgugagcacccaccuggacaagcaggaguggaacccccccgccaacgacaaccagcugcacgacggccugagacagagcguggugcagagcggcagaagcgaggccggcguggacagaaucagcagccaggugguggaccccaagcugaaccacaucuucagaccccagaucgagcagaucauccacgaguuccugguggcccagaaggaggccgccgugcccgcccugccccccgagcccgagggccaggacccccccgcccccagccaggacaccagcuaa

SEQ ID NO: 14265 - RNA, 639 nt, Artificial Sequence
  BOK__Homo_sapiens__NP_115904
auggaggugcugagaagaagcagcguguucgccgccgagaucauggacgccuucgacagaagccccaccgacaaggagcugguggcccaggccaaggcccugggcagagaguacgugcacgccagacugcugagagccggccugagcuggagcgcccccgagagagccgcccccgugcccggcagacuggccgaggugugcgccgugcugcugagacugggcgacgagcuggagaugaucagacccagcguguacagaaacguggccagacagcugcacaucagccugcagagcgagcccguggugaccgacgccuuccuggccguggccggccacaucuucagcgccggcaucaccuggggcaagguggugagccuguacgccguggccgccggccuggccguggacugcgugagacaggcccagcccgccauggugcacgcccugguggacugccugggcgaguucgugagaaagacccuggccaccuggcugagaagaagaggcggcuggaccgacgugcugaagugcguggugagcaccgaccccggccugagaagccacuggcugguggccgcccugugcagcuucggcagauuccugaaggccgccuucuucgugcugcugcccgagagauaa

SEQ ID NO: 14266 - RNA, 306 nt, Artificial Sequence
  BOLA3__Homo_sapiens__NP_001030582
auggccgccuggagccccgccgccgccgccccccugcugagaggcaucagaggccugccccugcaccacagaauguucgccacccagaccgagggcgagcugagagugacccagauccugaaggagaaguuccccagagccaccgccaucaaggugaccgacaucagcggcaccaagagaagaaaccagagagacgccuggaucgccgacaucuaccugugcccccagacccugaccacccccuggcugcacagaugcugcugccugagacccuggaugaacuucaccgacaucauccugcccuaa

SEQ ID NO: 14267 - RNA, 525 nt, Artificial Sequence
  BOLL__Homo_sapiens__NP_001271287
augaccgagcuggaguaccccaagggcagcagcaucaugcccgccgccggcaccauguaccugaccaccagcaccggcuaccccuacaccuaccacaacggcguggccuacuuccacacccccgaggugaccagcgugcccccccccuggcccagcagaagcgugugcagcagccccgugaugguggcccagcccaucuaccagcagcccgccuaccacuaccaggccaccacccaguaccugcccggccaguggcaguggagcgugccccagcccagcgccagcagcgcccccuuccuguaccugcagcccagcgaggugaucuaccagcccguggagaucgcccaggacggcggcugcgugccccccccccugagccugauggagaccagcgugcccgagcccuacagcgaccacggcgugcaggccaccuaccaccagguguacgcccccagcgccaucaccaugcccgcccccgugaugcagcccgagcccaucaagaccguguggagcauccacuacuaa

SEQ ID NO: 14268 - RNA, 2241 nt, Artificial Sequence
  BOP1__Homo_sapiens__NP_056016
auggccggcagcagaggcgccggcagaaccgccgcccccagcgugagacccgagaagagaagaagcgagcccgagcuggagcccgagcccgagcccgagcccccccugcugugcaccagcccccugagccacagcaccggcagcgacagcggcgugagcgacagcgaggagagcguguucagcggccuggaggacagcggcagcgacagcagcgaggacgacgacgagggcgacgaggagggcgaggacggcgcccuggacgacgagggccacagcggcaucaagaagaccaccgaggagcaggugcaggccagcacccccugccccagaaccgagauggccagcgccagaaucggcgacgaguacgccgaggacagcagcgacgaggaggacaucagaaacaccgugggcaacgugccccuggagugguacgacgacuucccccacgugggcuacgaccuggacggcagaagaaucuacaagccccugagaaccagagacgagcuggaccaguuccuggacaagauggacgaccccgacuacuggagaaccgugcaggaccccaugaccggcagagaccugagacugaccgacgagcagguggcccuggugagaagacugcagagcggccaguucggcgacgugggcuucaaccccuacgagcccgccguggacuucuucagcggcgacgugaugauccaccccgugaccaacagacccgccgacaagagaagcuucauccccagccugguggagaaggagaaggugagcagaauggugcacgccaucaagaugggcuggauccagcccagaagacccagagaccccacccccagcuucuacgaccugugggcccaggaggaccccaacgccgugcugggcagacacaagaugcacgugcccgcccccaagcuggcccugcccggccacgccgagagcuacaaccccccccccgaguaccugcugagcgaggaggagagacuggccugggagcagcaggagcccggcgagagaaagcugagcuuccugcccagaaaguuccccagccugagagccgugcccgccuacggcagauucauccaggagagauucgagagaugccuggaccuguaccugugccccagacagagaaagaugagagugaacguggaccccgaggaccugauccccaagcugcccagacccagagaccugcagcccuuccccaccugccaggcccugguguacagaggccacagcgaccuggugagaugccugagcgugagccccggcggccaguggcuggugagcggcagcgacgacggcagccugagacugugggagguggccaccgccagaugcgugagaaccgugcccgugggcggcguggugaagagcguggccuggaaccccagccccgccgugugccugguggccgccgccguggaggacagcgugcugcugcugaaccccgcccugggcgacagacugguggccggcagcaccgaccagcugcugagcgccuucgugccccccgaggagcccccccugcagcccgccagauggcuggaggccagcgaggaggagagacaggugggccugagacugagaaucugccacggcaagcccgugacccaggugaccuggcacggcagaggcgacuaccuggccguggugcuggccacccagggccacacccaggugcugauccaccagcugagcagaagaagaagccagagccccuucagaagaagccacggccaggugcagagaguggccuuccaccccgccagacccuuccugcugguggccagccagagaagcgugagacuguaccaccugcugagacaggagcugaccaagaagcugaugcccaacugcaagugggugagcagccuggccgugcaccccgccggcgacaacgugaucugcggcagcuacgacagcaagcuggugugguucgaccuggaccugagcaccaagcccuacagaaugcugagacaccacaagaaggcccugagagccguggccuuccaccccagauacccccuguucgccagcggcagcgacgacggcagcgugaucgugugccacggcaugguguacaacgaccugcugcagaacccccugcuggugcccgugaaggugcugaagggccacgugcugaccagagaccugggcgugcuggacgugaucuuccaccccacccagcccuggguguucagcagcggcgccgacggcaccgugagacuguucaccuaa

SEQ ID NO: 14269 - RNA, 1905 nt, Artificial Sequence
  BORA__Homo_sapiens__NP_001273675
auggagagauuccuguuccccgcccccgaccugcccgccagaagcccccuggugaacggcagcagccagggcgugggcguggaggagagaggcaccagaaagagcggccacgugggccugggcgccaccccccccagccacagcauccagggcagcagacugcaccugaaccugcccgagguggacagcuuccccccccaccccgccaaguucagccugugcgccaugggcgacgugaaggagagcaagaugcagaucacccccgagacccccggcagaauccccgugcugaaccccuucgagagccccagcgacuacagcaaccugcacgagcagacccuggccagccccagcguguucaagagcaccaagcugcccacccccggcaaguucagauggagcaucgaccagcuggccgugaucaaccccguggagaucgaccccgaggacauccacagacaggcccuguaccugagccacagcagaaucgacaaggacguggaggacaagagacagaaggccaucgaggaguucuucaccaaggacgugaucgugcccagccccuggaccgaccacgagggcaagcagcugagccagugccacagcagcaagugcaccaacaucaacagcgacagccccgugggcaagaagcugaccauccacagcgagaagagcgacgccgccugccagacccugcugagccugcccguggacuucaaccuggagaacauccugggcgacuacuucagagccgacgaguucgccgaccagagccccggcaaccugagcagcagcagccugagaagaaagcuguuccuggacggcaacggcagcaucagcgacagccugcccagcgccagccccggcagcccccacagcggcgugcagaccagccuggagauguucuacagcaucgaccugagccccgugaagugcagaagcccccugcagacccccagcagcggccaguucagcagcagccccauccaggccagcgccaagaaguacagccugggcagcaucaccagccccagccccaucagcagccccaccuucagccccaucgaguuccagaucggcgagaccccccugagcgagcagagaaaguucaccgugcacagccccgacgccagcagcggcaccaacagcaacggcaucaccaaccccugcaucagaagccccuacaucgacggcugcagccccaucaagaacuggagccccaugagacugcagauguacagcggcggcacccaguacagaaccagcgugauccagauccccuucacccuggagacccagggcgaggacgaggaggacaaggagaacauccccagcaccgacgugagcagccccgccauggacgccgccggcauccaccugagacaguucagcaacgaggccagcacccacggcacccaccugguggugaccgccaugagcgugacccagaaccagagcagcgccagcgagaaggagcuggcccugcugcaggacguggagagagagaaggacaacaacaccguggacaugguggaccccaucgagaucgccgacgagaccaccuggaucaaggagcccguggacaacggcagccugcccaugaccgacuucgugagcggcaucgccuucagcaucgagaacagccacaugugcaugagcccccuggccgagagcagcgugauccccugcgagagcagcaacauccagauggacagcggcuacaacacccagaacugcggcagcaacaucauggacaccgugggcgccgagagcuacugcaaggagagcgacgcccagaccugcgagguggagagcaagagccaggccuucaacaugaagcaggaccacaccacccagagaugcuggaugaagaccgccagccccuuccagugcagcagccccuaa

SEQ ID NO: 14270 - RNA, 780 nt, Artificial Sequence
  BPGM__Homo_sapiens__NP_001280014
augagcaaguacaagcugaucaugcugagacacggcgagggcgccuggaacaaggagaacagauucugcagcuggguggaccagaagcugaacagcgagggcauggaggaggccagaaacugcggcaagcagcugaaggcccugaacuucgaguucgaccugguguucaccagcgugcugaacagaagcauccacaccgccuggcugauccuggaggagcugggccaggagugggugcccguggagagcagcuggagacugaacgagagacacuacggcgcccugaucggccugaacagagagcagauggcccugaaccacggcgaggagcaggugagacuguggagaagaagcuacaacgugacccccccccccaucgaggagagccaccccuacuaccaggagaucuacaacgacagaagauacaaggugugcgacgugccccuggaccagcugcccagaagcgagagccugaaggacgugcuggagagacugcugcccuacuggaacgagagaaucgcccccgaggugcugagaggcaagaccauccugaucagcgcccacggcaacagcagcagagcccugcugaagcaccuggagggcaucagcgacgaggacaucaucaacaucacccugcccaccggcgugcccauccugcuggagcuggacgagaaccugagagccgugggcccccaccaguuccugggcgaccaggaggccauccaggccgccaucaagaagguggaggaccagggcaaggugaagcaggccaagaaguaa

SEQ ID NO: 14271 - RNA, 771 nt, Artificial Sequence
  BPIFA1__Homo_sapiens__NP_057667
auguuccagaccggcggccugaucguguucuacggccugcuggcccagaccauggcccaguucggcggccugcccgugccccuggaccagacccugccccugaacgugaaccccgcccugccccugagccccaccggccuggccggcagccugaccaacgcccugagcaacggccugcugagcggcggccugcugggcauccuggagaaccugccccugcuggacauccugaagcccggcggcggcaccagcggcggccugcugggcggccugcugggcaaggugaccagcgugauccccggccugaacaacaucaucgacaucaaggugaccgacccccagcugcuggagcugggccuggugcagagccccgacggccacagacuguacgugaccaucccccugggcaucaagcugcaggugaacaccccccuggugggcgccagccugcugagacuggccgugaagcuggacaucaccgccgagauccuggccgugagagacaagcaggagagaauccaccuggugcugggcgacugcacccacagccccggcagccugcagaucagccugcuggacggccugggcccccugcccauccagggccugcuggacagccugaccggcauccugaacaaggugcugcccgagcuggugcagggcaacgugugcccccuggugaacgaggugcugagaggccuggacaucacccuggugcacgacaucgugaacaugcugauccacggccugcaguucgugaucaagguguaa

SEQ ID NO: 14272 - RNA, 750 nt, Artificial Sequence
  BPIFA2__Homo_sapiens__NP_542141
augcugcagcuguggaagcuggugcugcugugcggcgugcugaccggcaccagcgagagccugcuggacaaccugggcaacgaccugagcaacgugguggacaagcuggagcccgugcugcacgagggccuggagaccguggacaacacccugaagggcauccuggagaagcugaagguggaccugggcgugcugcagaagagcagcgccuggcagcuggccaagcagaaggcccaggaggccgagaagcugcugaacaacgugaucagcaagcugcugcccaccaacaccgacaucuucggccugaagaucagcaacagccugauccuggacgugaaggccgagcccaucgacgacggcaagggccugaaccugagcuuccccgugaccgccaacgugaccguggccggccccaucaucggccagaucaucaaccugaaggccagccuggaccugcugaccgccgugaccaucgagaccgacccccagacccaccagcccguggccgugcugggcgagugcgccagcgaccccaccagcaucagccugagccugcuggacaagcacagccagaucaucaacaaguucgugaacagcgugaucaacacccugaagagcaccgugagcagccugcugcagaaggagaucugcccccugaucagaaucuucauccacagccuggacgugaacgugauccagcaggugguggacaacccccagcacaagacccagcugcagacccugaucuaa

SEQ ID NO: 14273 - RNA, 657 nt, Artificial Sequence
  BPIFA3__Homo_sapiens__NP_001035904
augaugugcccccuguggagacugcugaucuuccugggccugcuggcccugccccuggccccccacaagcagcccuggcccggccuggcccaggcccacagagacaacaagagcacccuggccagaaucaucgcccagggccugaucaagcacaacgccgagagcagaauccagaacauccacuucggcgacagacugaacgccagcgcccagguggcccccggccuggugggcuggcugaucagcggcagaaagcaccagcagcagcaggagagcagaagcuucgacaacaacaucgugaagaugugcgcccacaugagcaucgugguggaguucuggcuggagaaggacgaguucggcagaagagaccuggugaucggcaagugcgacgccgagcccagcagcgugcacguggccauccugaccgaggccaucccccccaagaugaaccaguuccuguacaaccugaaggagaaccugcagaaggugcugccccacaugguggagagccaggugugcccccugaucggcgagauccugggccagcuggacgugaagcugcugaagagccugaucgagcaggaggccgcccacgagcccacccaccacgagaccagccagcccagcgccugccaggccggcgagagccccagcuaa

SEQ ID NO: 14274 - RNA, 1455 nt, Artificial Sequence
  BPIFB1__Homo_sapiens__NP_149974
auggccggccccuggaccuucacccugcugugcggccugcuggccgccacccugauccaggccacccugagccccaccgccgugcugauccugggccccaaggugaucaaggagaagcugacccaggagcugaaggaccacaacgccaccagcauccugcagcagcugccccugcugagcgccaugagagagaagcccgccggcggcauccccgugcugggcagccuggugaacaccgugcugaagcacaucaucuggcugaaggugaucaccgccaacauccugcagcugcaggugaagcccagcgccaacgaccaggagcugcuggugaagaucccccuggacaugguggccggcuucaacaccccccuggugaagaccaucguggaguuccacaugaccaccgaggcccaggccaccaucagaauggacaccagcgccagcggccccaccagacuggugcugagcgacugcgccaccagccacggcagccugagaauccagcugcugcacaagcugagcuuccuggugaacgcccuggccaagcaggugaugaaccugcuggugcccagccugcccaaccuggugaagaaccagcugugccccgugaucgaggccagcuucaacggcauguacgccgaccugcugcagcuggugaaggugcccaucagccugagcaucgacagacuggaguucgaccugcuguaccccgccaucaagggcgacaccauccagcuguaccugggcgccaagcugcuggacagccagggcaaggugaccaagugguucaacaacagcgccgccagccugaccaugcccacccuggacaacauccccuucagccugaucgugagccaggacguggugaaggccgccguggccgccgugcugagccccgaggaguucauggugcugcuggacagcgugcugcccgagagcgcccacagacugaagagcagcaucggccugaucaacgagaaggccgccgacaagcugggcagcacccagaucgugaagauccugacccaggacacccccgaguucuucaucgaccagggccacgccaagguggcccagcugaucgugcuggagguguuccccagcagcgaggcccugagaccccuguucacccugggcaucgaggccagcagcgaggcccaguucuacaccaagggcgaccagcugauccugaaccugaacaacaucagcagcgacagaauccagcugaugaacagcggcaucggcugguuccagcccgacgugcugaagaacaucaucaccgagaucauccacagcauccugcugcccaaccagaacggcaagcugagaagcggcgugcccgugagccuggugaaggcccugggcuucgaggccgccgagagcagccugaccaaggacgcccuggugcugacccccgccagccuguggaagcccagcagccccgugagccaguaa

SEQ ID NO: 14275 - RNA, 1377 nt, Artificial Sequence
  BPIFB2__Homo_sapiens__NP_079503
auggccugggccagcagacugggccugcugcuggcccugcugcugcccguggugggcgccagcacccccggcaccguggugagacugaacaaggccgcccugagcuacgugagcgagaucggcaaggccccccugcagagagcccugcaggugaccgugccccacuuccuggacuggagcggcgaggcccugcagcccaccagaaucagaauccugaacgugcacgugcccagacugcaccugaaguucaucgccggcuucggcgugagacugcuggccgccgccaacuucaccuucaagguguucagagcccccgagccccuggagcugacccugcccguggagcugcuggccgacaccagagugacccagagcagcaucagaacccccguggugagcaucagcgccugcagccuguucagcggccacgccaacgaguucgacggcagcaacagcaccagccacgcccugcuggugcuggugcagaagcacaucaaggccgugcugagcaacaagcugugccugagcaucagcaaccuggugcagggcgugaacgugcaccugggcacccugaucggccugaaccccgugggccccgagagccagaucagauacagcauggugagcgugcccaccgugaccagcgacuacaucagccuggaggugaacgccgugcuguuccugcugggcaagcccaucauccugcccaccgacgccacccccuucgugcugcccagacacgugggcaccgagggcagcauggccaccgugggccugagccagcagcuguucgacagcgcccugcugcugcugcagaaggccggcgcccugaaccuggacaucaccggccagcugagaagcgacgacaaccugcugaacaccagcgcccugggcagacugauccccgagguggccagacaguuccccgagcccaugcccguggugcugaaggugagacugggcgccacccccguggccaugcugcacaccaacaacgccacccugagacugcagcccuucguggaggugcuggccaccgccagcaacagcgccuuccagagccuguucagccuggacgugguggugaaccugagacugcagcugagcgugagcaaggugaagcugcagggcaccaccagcgugcugggcgacgugcagcugaccguggccagcagcaacgugggcuucaucgacaccgaccaggugagaacccugaugggcaccguguucgagaagccccugcuggaccaccugaacgcccugcuggccaugggcaucgcccugcccggcguggugaaccugcacuacguggcccccgagaucuucguguacgagggcuacguggugaucagcagcggccuguucuaccagagcuaa

SEQ ID NO: 14276 - RNA, 1524 nt, Artificial Sequence
  BPIFC__Homo_sapiens__NP_777592
augugcaccaagaccauccccgugcuguggggcugcuuccugcuguggaaccuguacgugagcagcagccagaccaucuaccccggcaucaaggccagaaucacccagagagcccuggacuacggcgugcaggccggcaugaagaugaucgagcagaugcugaaggagaagaagcugcccgaccugagcggcagcgagagccuggaguuccugaagguggacuacgugaacuacaacuucagcaacaucaagaucagcgccuucagcuuccccaacaccagccuggccuucgugcccggcgugggcaucaaggcccugaccaaccacggcaccgccaacaucagcaccgacuggggcuucgagagcccccuguuccaggacaccggcggcgccgaccuguuccugagcggcguguacuucaccggcaucaucauccugaccagaaacgacuucggccaccccacccugaagcugcaggacugcuacgcccagcugagccacgcccacgugagcuucagcggcgagcugagcgugcuguacaacagcuucgccgagcccauggagaagcccauccugaagaaccugaacgagaugcugugccccaucaucgccagcgaggugaaggcccugaacgccaaccugagcacccuggaggugcugaccaagaucgacaacuacacccugcuggacuacagccugaucagcagccccgagaucaccgagaacuaccuggaccugaaccugaagggcguguucuacccccuggagaaccugaccgacccccccuucagccccgugcccuucgugcugcccgagagaagcaacagcaugcuguacaucggcaucgccgaguacuucuucaagagcgccagcuucgcccacuucaccgccggcguguucaacgugacccugagcaccgaggagaucagcaaccacuucgugcagaacagccagggccugggcaacgugcugagcagaaucgccgagaucuacauccugagccagcccuucauggugagaaucauggccaccgagccccccaucaucaaccugcagcccggcaacuucacccuggacauccccgccagcaucaugaugcugacccagcccaagaacagcaccguggagaccaucgugagcauggacuucguggccagcaccagcgugggccuggugauccugggccagagacuggugugcagccugagccugaacagauucagacuggcccugcccgagagcaacagaagcaacaucgaggugcugagauucgagaacauccugagcagcauccugcacuucggcgugcugccccuggccaacgccaagcugcagcagggcuucccccugagcaacccccacaaguuccuguucgugaacagcgacaucgaggugcuggagggcuuccugcugaucagcaccgaccugaaguacgagaccagcagcaagcagcagcccagcuuccacgugugggagggccugaaccugaucagcagacaguggagaggcaagagcgcccccuaa

SEQ ID NO: 14277 - RNA, 1464 nt, Artificial Sequence
  BPI__Homo_sapiens__NP_001716
augagagagaacauggccagaggccccugcaacgcccccagaugggccagccugauggugcugguggccaucggcaccgccgugaccgccgccgugaaccccggcgugguggugagaaucagccagaagggccuggacuacgccagccagcagggcaccgccgcccugcagaaggagcugaagagaaucaagauccccgacuacagcgacagcuucaagaucaagcaccugggcaagggccacuacagcuucuacagcauggacaucagagaguuccagcugcccagcagccagaucagcauggugcccaacgugggccugaaguucagcaucagcaacgccaacaucaagaucagcggcaaguggaaggcccagaagagauuccugaagaugagcggcaacuucgaccugagcaucgagggcaugagcaucagcgccgaccugaagcugggcagcaaccccaccagcggcaagcccaccaucaccugcagcagcugcagcagccacaucaacagcgugcacgugcacaucagcaagagcaaggugggcuggcugauccagcuguuccacaagaagaucgagagcgcccugagaaacaagaugaacagccaggugugcgagaaggugaccaacagcgugagcagcgagcugcagcccuacuuccagacccugcccgugaugaccaagaucgacagcguggccggcaucaacuacggccugguggccccccccgccaccaccgccgagacccuggacgugcagaugaagggcgaguucuacagcgagaaccaccacaaccccccccccuucgccccccccgugauggaguuccccgccgcccacgacagaaugguguaccugggccugagcgacuacuucuucaacaccgccggccugguguaccaggaggccggcgugcugaagaugacccugagagacgacaugauccccaaggagagcaaguucagacugaccaccaaguucuucggcaccuuccugcccgagguggccaagaaguuccccaacaugaagauccagauccacgugagcgccagcacccccccccaccugagcgugcagcccaccggccugaccuucuaccccgccguggacgugcaggccuucgccgugcugcccaacagcagccuggccagccuguuccugaucggcaugcacaccaccggcagcauggaggugagcgccgagagcaacagacuggugggcgagcugaagcuggacagacugcugcuggagcugaagcacagcaacaucggccccuuccccguggagcugcugcaggacaucaugaacuacaucgugcccauccuggugcugcccagagugaacgagaagcugcagaagggcuucccccugcccacccccgccagagugcagcuguacaacguggugcugcagccccaccagaacuuccugcuguucggcgccgacgugguguacaaguaa

SEQ ID NO: 14278 - RNA, 762 nt, Artificial Sequence
  BPNT1__Homo_sapiens__NP_001273078
augagcaucugcagcagccuggccagaaaguuccccaagcugaccaucaucggcgaggaggaccugcccagcgaggagguggaccaggagcugaucgaggacagccagugggaggagauccugaagcagcccugccccagccaguacagcgccaucaaggaggaggaccuggugguguggguggacccccuggacggcaccaaggaguacaccgagggccugcuggacaacgugaccgugcugaucggcaucgccuacgagggcaaggccaucgccggcgugaucaaccagcccuacuacaacuacgaggccggccccgacgccgugcugggcagaaccaucuggggcgugcugggccugggcgccuucggcuuccagcugaaggaggugcccgccggcaagcacaucaucaccaccaccagaagccacagcaacaagcuggugaccgacugcguggccgccaugaaccccgacgccgugcugagagugggcggcgccggcaacaagaucauccagcugaucgagggcaaggccagcgccuacguguucgccagccccggcugcaagaagugggacaccugcgcccccgaggugauccugcacgccgugggcggcaagcugaccgacauccacggcaacgugcugcaguaccacaaggacgugaagcacaugaacagcgccggcgugcuggccacccugagaaacuacgacuacuacgccagcagagugcccgagagcaucaagaacgcccuggugcccuaa

SEQ ID NO: 14279 - RNA, 8712 nt, Artificial Sequence
  BPTF__Homo_sapiens__NP_004450
augagaggcagaagaggcagaccccccaagcagcccgccgcccccgccgccgagagaugcgcccccgccccccccccccccccccccccccccaccagcggccccaucggcggccugagaagcagacacagaggcagcagcagaggcagaugggccgccgcccaggccgagguggcccccaagaccagacugagcagccccagaggcggcagcagcagcagaagaaagccccccccccccccccccgccccccccagcaccagcgcccccggcagaggcggcagaggcggcggcggcggcagaaccggcggcggcggcggcggcggccaccuggccagaaccaccgccgccagaagagccgugaacaaggugguguacgacgaccacgagagcgaggaggaggaggaggaggaggacauggugagcgaggaggaggaggaggaggacggcgacgccgaggagacccaggacagcgaggacgacgaggaggacgagauggaggaggacgacgacgacagcgacuaccccgaggagauggaggacgacgacgacgacgccagcuacugcaccgagagcagcuucagaagccacagcaccuacagcagcacccccggcagaagaaagcccagagugcacagacccagaagccccauccuggaggagaaggacauccccccccuggaguuccccaagagcagcgaggaccugauggugcccaacgagcacaucaugaacgugaucgccaucuacgaggugcugagaaacuucggcaccgugcugagacugagccccuucagauucgaggacuucugcgccgcccuggugagccaggagcagugcacccugauggccgagaugcacguggugcugcugaaggccgugcugagagaggaggacaccagcaacaccaccuucggccccgccgaccugaaggacagcgugaacagcacccuguacuucaucgacggcaugaccuggcccgaggugcugagaguguacugcgagagcgacaaggaguaccaccacgugcugcccuaccaggaggccgaggacuaccccuacggccccguggagaacaagaucaaggugcugcaguuccugguggaccaguuccugaccaccaacaucgccagagaggagcugaugagcgagggcgugauccaguacgacgaccacugcagagugugccacaagcugggcgaccugcugugcugcgagaccugcagcgccguguaccaccuggagugcgugaagcccccccuggaggaggugcccgaggacgaguggcagugcgaggugugcguggcccacaaggugcccggcgugaccgacugcguggccgagauccagaagaacaagcccuacaucagacacgagcccaucggcuacgacagaagcagaagaaaguacugguuccugaacagaagacugaucaucgaggaggacaccgagaacgagaacgagaagaagaucugguacuacagcaccaaggugcagcuggccgagcugaucgacugccuggacaaggacuacugggaggccgagcugugcaagauccuggaggagaugagagaggagauccacagacacauggacaucaccgaggaccugaccaacaaggccagaggcagcaacaagagcuuccuggccgccgccaacgaggagauccuggagagcaucagagccaagaagggcgacaucgacaacgugaagagccccgaggagaccgagaaggacaagaacgagaccgagaacgacagcaaggacgccgagaagaacagagaggaguucgaggaccagagccuggagaaggacagcgacgacaagacccccgacgacgaccccgagcagggcaagagcgaggagcccaccgaggugggcgacaagggcaacagcgugagcgccaaccugggcgacaacaccaccaacgccaccagcgaggagaccagccccagcgagggcagaagccccgugggcugccugagcgagacccccgacagcagcaacauggccgagaagaagguggccagcgagcugccccaggacgugcccgaggagcccaacaagaccugcgagagcagcaacaccagcgccaccaccaccagcauccagcccaaccuggagaacagcaacagcagcagcgagcugaacagcagccagagcgagagcgccaaggccgccgacgaccccgagaacggcgagagagagagccacacccccgugagcauccaggaggagaucgugggcgacuucaagagcgagaagagcaacggcgagcugagcgagagccccggcgccggcaagggcgccagcggcagcaccagaaucaucaccagacugagaaaccccgacagcaagcugagccagcugaagagccagcagguggccgccgccgcccacgaggccaacaagcuguucaaggagggcaaggaggugcugguggugaacagccagggcgagaucagcagacugagcaccaagaaggaggugaucaugaagggcaacaucaacaacuacuucaagcugggccaggagggcaaguacagaguguaccacaaccaguacagcaccaacagcuucgcccugaacaagcaccagcacagagaggaccacgacaagagaagacaccuggcccacaaguucugccugacccccgccggcgaguucaaguggaacggcagcgugcacggcagcaaggugcugaccaucagcacccugagacugaccaucacccagcuggagaacaacauccccagcagcuuccugcaccccaacugggccagccacagagccaacuggaucaaggccgugcagaugugcagcaagcccagagaguucgcccuggcccuggccauccuggagugcgccgugaagcccguggugaugcugcccaucuggagagagagccugggccacaccagacugcacagaaugaccagcaucgagagagaggagaaggagaaggugaagaagaaggagaagaagcaggaggaggaggagaccaugcagcaggccaccugggugaaguacaccuuccccgugaagcaccagguguggaagcagaagggcgaggaguacagagugaccggcuacggcggcuggagcuggaucagcaagacccacguguacagauucgugcccaagcugcccggcaacaccaacgugaacuacagaaagagccuggagggcaccaagaacaacauggacgagaacauggacgagagcgacaagagaaagugcagcagaagccccaagaagaucaagaucgagcccgacagcgagaaggacgaggugaagggcagcgacgccgccaagggcgccgaccagaacgagauggacaucagcaagaucaccgagaagaaggaccaggacgugaaggagcugcuggacagcgacagcgacaagcccugcaaggaggagcccauggagguggacgacgacaugaagaccgagagccacgugaacugccaggagagcagccagguggacguggugaacgugagcgagggcuuccaccugagaaccagcuacaagaagaagaccaagagcagcaagcuggacggccugcuggagagaagaaucaagcaguucacccuggaggagaagcagagacuggagaagaucaagcuggagggcggcaucaagggcaucggcaagaccagcaccaacagcagcaagaaccugagcgagagccccgugaucaccaaggccaaggagggcugccagagcgacagcaugagacaggagcagagccccaacgccaacaacgaccagcccgaggaccugauccagggcugcagcgagagcgacagcagcgugcugagaaugagcgaccccagccacaccaccaacaagcuguaccccaaggacagagugcuggacgacgugagcaucagaagccccgagaccaagugccccaagcagaacagcaucgagaacgacaucgaggagaaggugagcgaccuggccagcagaggccaggagcccagcaagagcaagaccaagggcaacgacuucuucaucgacgacagcaagcuggccagcgccgacgacaucggcacccugaucugcaagaacaagaagccccugauccaggaggagagcgacaccaucgugagcagcagcaagagcgcccugcacagcagcgugcccaagagcaccaacgacagagacgccaccccccugagcagagccauggacuucgagggcaagcugggcugcgacagcgagagcaacagcacccuggagaacagcagcgacaccgugagcauccaggacagcagcgaggaggacaugaucgugcagaacagcaacgagagcaucagcgagcaguucagaaccagagagcaggacguggaggugcuggagccccugaagugcgagcuggugagcggcgagagcaccggcaacugcgaggacagacugcccgugaagggcaccgaggccaacggcaagaagcccagccagcagaagaagcuggaggagagacccgugaacaagugcagcgaccagaucaagcugaagaacaccaccgacaagaagaacaacgagaacagagagagcgagaagaagggccagagaaccagcaccuuccagaucaacggcaaggacaacaagcccaagaucuaccugaagggcgagugccugaaggagaucagcgagagcagaguggugagcggcaacguggagcccaaggugaacaacaucaacaagaucauccccgagaacgacaucaagagccugaccgugaaggagagcgccaucagacccuucaucaacggcgacgugaucauggaggacuucaacgagagaaacagcagcgagaccaagagccaccugcugagcagcagcgacgccgagggcaacuacagagacagccuggagacccugcccagcaccaaggagagcgacagcacccagaccaccacccccagcgccagcugccccgagagcaacagcgugaaccagguggaggacauggagaucgagaccagcgaggugaagaaggugaccagcagccccaucaccagcgaggaggagagcaaccugagcaacgacuucaucgacgagaacggccugcccaucaacaagaacgagaacgugaacggcgagagcaagagaaagaccgugaucaccgaggugaccaccaugaccagcaccguggccaccgagagcaagaccgugaucaagguggagaagggcgacaagcagaccguggugagcagcaccgagaacugcgccaagagcaccgugaccaccaccaccaccaccgugaccaagcugagcacccccagcaccggcggcagcguggacaucaucagcgugaaggagcagagcaagaccguggugaccaccaccgugaccgacagccugaccaccaccggcggcacccuggugaccagcaugaccgugagcaaggaguacagcaccagagacaaggugaagcugaugaaguucagcagacccaagaagaccagaagcggcaccgcccugcccagcuacagaaaguucgugaccaagagcagcaagaagagcaucuucgugcugcccaacgacgaccugaagaagcuggccagaaagggcggcaucagagaggugcccuacuucaacuacaacgccaagcccgcccuggacaucuggcccuaccccagccccagacccaccuucggcaucaccuggagauacagacugcagaccgugaagagccuggccggcgugagccugaugcugagacugcugugggccagccugagaugggacgacauggccgccaaggccccccccggcggcggcaccaccagaaccgagaccagcgagaccgagaucaccaccaccgagaucaucaagagaagagacgugggccccuacggcaucagaagcgaguacugcaucagaaagaucaucugccccaucggcgugcccgagacccccaaggagacccccaccccccagagaaagggccugagaagcagcgcccugagacccaagagacccgagacccccaagcagaccggccccgugaucaucgagaccuggguggccgaggaggagcuggagcugugggagaucagagccuucgccgagagaguggagaaggagaaggcccaggccguggagcagcaggccaagaagagacuggagcagcagaagcccaccgugaucgccaccagcaccaccagccccaccagcagcaccaccagcaccaucagccccgcccagaaggugaugguggcccccaucagcggcagcgugaccaccggcaccaagauggugcugaccaccaaggugggcagccccgccaccgugaccuuccagcagaacaagaacuuccaccagaccuucgccaccugggugaagcagggccagagcaacagcggcguggugcaggugcagcagaaggugcugggcaucauccccagcagcaccggcaccagccagcagaccuucaccagcuuccagcccagaaccgccaccgugaccaucagacccaacaccagcggcagcggcggcaccaccagcaacagccaggugaucaccggcccccagaucagacccggcaugaccgugaucagaaccccccugcagcagagcacccugggcaaggccaucaucagaacccccgugauggugcagcccggcgccccccagcaggugaugacccagaucaucagaggccagcccgugagcaccgccgugagcgcccccaacaccgugagcagcacccccggccagaagagccugaccagcgccaccagcaccagcaacauccagagcagcgccagccagccccccagaccccagcagggccaggugaagcugaccauggcccagcugacccagcugacccagggccacggcggcaaccagggccugaccguggugauccagggccagggccagaccaccggccagcugcagcugaucccccagggcgugaccgugcugcccggccccggccagcagcugaugcaggccgccaugcccaacggcaccgugcagagauuccuguucaccccccuggccaccaccgccaccaccgccagcaccaccaccaccaccgugagcaccaccgccgccggcaccggcgagcagagacagagcaagcugagcccccagaugcaggugcaccaggacaagacccugccccccgcccagagcagcagcgugggccccgccgaggcccagccccagaccgcccagcccagcgcccagccccagccccagacccagccccagagccccgcccagcccgaggugcagacccagcccgaggugcagacccagaccaccgugagcagccacgugcccagcgaggcccagcccacccacgcccagagcagcaagccccagguggccgcccagagccagccccagagcaacgugcagggccagagccccgugagagugcagagccccagccagaccagaaucagacccagcacccccagccagcugagccccggccagcagagccaggugcagaccaccaccagccagcccauccccauccagccccacaccagccugcagauccccagccagggccagccccagagccagccccagguggugaugaagcacaacgccgugaucgagcaccugaagcagaagaagagcaugacccccgccgagagagaggagaaccagagaaugaucgugugcaaccaggugaugaaguacauccuggacaagaucgacaaggaggagaagcaggccgccaagaagagaaagagagaggagagcguggagcagaagagaagcaagcagaacgccaccaagcugagcgcccugcuguucaagcacaaggagcagcugagagccgagauccugaagaagagagcccugcuggacaaggaccugcagaucgaggugcaggaggagcugaagagagaccugaagaucaagaaggagaaggaccugaugcagcuggcccaggccaccgccguggccgcccccugcccccccgugacccccgccccccccgccccccccgcccccccccccagccccccccccccccccgccgugcagcacaccggccugcugagcacccccacccugcccgccgccagccagaagagaaagagagaggaggagaaggacagcagcagcaagagcaagaagaagaagaugaucagcaccaccagcaaggagaccaagaaggacaccaagcuguacugcaucugcaagacccccuacgacgagagcaaguucuacaucggcugcgacagaugccagaacugguaccacggcagaugcgugggcauccugcagagcgaggccgagcugaucgacgaguacgugugcccccagugccagagcaccgaggacgccaugaccgugcugaccccccugaccgagaaggacuacgagggccugaagagagugcugagaagccugcaggcccacaagauggccuggcccuuccuggagcccguggaccccaacgacgcccccgacuacuacggcgugaucaaggagcccauggaccuggccaccauggaggagagagugcagagaagauacuacgagaagcugaccgaguucguggccgacaugaccaagaucuucgacaacugcagauacuacaaccccagcgacagccccuucuaccagugcgccgaggugcuggagagcuucuucgugcagaagcugaagggcuucaaggccagcagaagccacaacaacaagcugcagagcaccgccagcuaa

SEQ ID NO: 14280 - RNA, 321 nt, Artificial Sequence
  BPY2__Homo_sapiens__NP_004669
augaugacccuggugcccagagccagaaccagagccggccaggaccacuacagccaccccugccccagauucagccaggugcugcugaccgagggcaucaugaccuacugccugaccaagaaccugagcgacgugaacauccugcacagacugcugaagaacggcaacgugagaaacacccugcugcagagcaaggugggccugcugaccuacuacgugaagcuguaccccggcgaggugacccugcugaccagacccagcauccagaugagacugugcugcaucaccggcagcgugagcagacccagaagccagaaguaa

SEQ ID NO: 14281 - RNA, 2301 nt, Artificial Sequence
  BRAF__Homo_sapiens__NP_004324
auggccgcccugagcggcggcggcggcggcggcgccgagcccggccaggcccuguucaacggcgacauggagcccgaggccggcgccggcgccggcgccgccgccagcagcgccgccgaccccgccauccccgaggagguguggaacaucaagcagaugaucaagcugacccaggagcacaucgaggcccugcuggacaaguucggcggcgagcacaacccccccagcaucuaccuggaggccuacgaggaguacaccagcaagcuggacgcccugcagcagagagagcagcagcugcuggagagccugggcaacggcaccgacuucagcgugagcagcagcgccagcauggacaccgugaccagcagcagcagcagcagccugagcgugcugcccagcagccugagcguguuccagaaccccaccgacguggccagaagcaaccccaagagcccccagaagcccaucgugagaguguuccugcccaacaagcagagaaccguggugcccgccagaugcggcgugaccgugagagacagccugaagaaggcccugaugaugagaggccugauccccgagugcugcgccguguacagaauccaggacggcgagaagaagcccaucggcugggacaccgacaucagcuggcugaccggcgaggagcugcacguggaggugcuggagaacgugccccugaccacccacaacuucgugagaaagaccuucuucacccuggccuucugcgacuucugcagaaagcugcuguuccagggcuucagaugccagaccugcggcuacaaguuccaccagagaugcagcaccgaggugccccugaugugcgugaacuacgaccagcuggaccugcuguucgugagcaaguucuucgagcaccaccccaucccccaggaggaggccagccuggccgagaccgcccugaccagcggcagcagccccagcgcccccgccagcgacagcaucggcccccagauccugaccagccccagccccagcaagagcauccccaucccccagcccuucagacccgccgacgaggaccacagaaaccaguucggccagagagacagaagcagcagcgcccccaacgugcacaucaacaccaucgagcccgugaacaucgacgaccugaucagagaccagggcuucagaggcgacggcggcagcaccaccggccugagcgccaccccccccgccagccugcccggcagccugaccaacgugaaggcccugcagaagagccccggcccccagagagagagaaagagcagcagcagcagcgaggacagaaacagaaugaagacccugggcagaagagacagcagcgacgacugggagauccccgacggccagaucaccgugggccagagaaucggcagcggcagcuucggcaccguguacaagggcaaguggcacggcgacguggccgugaagaugcugaacgugaccgcccccaccccccagcagcugcaggccuucaagaacgaggugggcgugcugagaaagaccagacacgugaacauccugcuguucaugggcuacagcaccaagccccagcuggccaucgugacccaguggugcgagggcagcagccuguaccaccaccugcacaucaucgagaccaaguucgagaugaucaagcugaucgacaucgccagacagaccgcccagggcauggacuaccugcacgccaagagcaucauccacagagaccugaagagcaacaacaucuuccugcacgaggaccugaccgugaagaucggcgacuucggccuggccaccgugaagagcagauggagcggcagccaccaguucgagcagcugagcggcagcauccuguggauggcccccgaggugaucagaaugcaggacaagaaccccuacagcuuccagagcgacguguacgccuucggcaucgugcuguacgagcugaugaccggccagcugcccuacagcaacaucaacaacagagaccagaucaucuucauggugggcagaggcuaccugagccccgaccugagcaaggugagaagcaacugccccaaggccaugaagagacugauggccgagugccugaagaagaagagagacgagagaccccuguucccccagauccuggccagcaucgagcugcuggccagaagccugcccaagauccacagaagcgccagcgagcccagccugaacagagccggcuuccagaccgaggacuucagccuguacgccugcgccagccccaagacccccauccaggccggcggcuacggcgccuuccccgugcacuaa

SEQ ID NO: 14282 - RNA, 1779 nt, Artificial Sequence
  BRAP__Homo_sapiens__NP_006759
augagcgugagccugguggugaucagacuggagcuggccgagcacagccccgugcccgccggcuucggcuucagcgccgccgccggcgagaugagcgacgaggagaucaagaagaccacccuggccagcgccguggccugccuggagggcaagagccccggcgagaagguggccaucauccaccagcaccugggcagaagagagaugaccgacgugaucaucgagaccaugaagagcaaccccgacgagcugaagaccaccguggaggagagaaagagcagcgaggccagccccaccgcccagagaagcaaggaccacagcaaggagugcaucaacgccgcccccgacagccccagcaagcagcugcccgaccagaucagcuucuucagcggcaaccccagcguggagaucgugcacggcaucaugcaccuguacaagaccaacaagaugaccagccugaaggaggacgugagaagaagcgccaugcugugcauccugaccgugcccgccgccaugaccagccacgaccugaugaaguucguggcccccuucaacgaggugaucgagcagaugaagaucaucagagacagcacccccaaccaguacauggugcugaucaaguucagagcccaggccgacgccgacagcuucuacaugaccugcaacggcagacaguucaacagcaucgaggacgacgugugccagcugguguacguggagagagccgaggugcugaagagcgaggacggcgccagccugcccgugauggaccugaccgagcugcccaagugcaccgugugccuggagagaauggacgagagcgugaacggcauccugaccacccugugcaaccacagcuuccacagccagugccugcagagaugggacgacaccaccugccccgugugcagauacugccagacccccgagcccguggaggagaacaagugcuucgagugcggcgugcaggagaaccuguggaucugccugaucugcggccacaucggcugcggcagauacgugagcagacacgccuacaagcacuucgaggagacccagcacaccuacgccaugcagcugaccaaccacagagugugggacuacgccggcgacaacuacgugcacagacugguggccagcaagaccgacggcaagaucgugcaguacgagugcgagggcgacaccugccaggaggagaagaucgacgcccugcagcuggaguacagcuaccugcugaccagccagcuggagagccagagaaucuacugggagaacaagaucgugagaaucgagaaggacaccgccgaggagaucaacaacaugaagaccaaguucaaggagaccaucgagaagugcgacaaccuggagcacaagcugaacgaccugcugaaggagaagcagagcguggagagaaagugcacccagcugaacaccaagguggccaagcugaccaacgagcugaaggaggagcaggagaugaacaagugccugagagccaaccaggugcugcugcagaacaagcugaaggaggaggagagagugcugaaggagaccugcgaccagaaggaccugcagaucaccgagauccaggagcagcugagagacgugauguucuaccuggagacccagcagaagaucaaccaccugcccgccgagaccagacaggagauccaggagggccagaucaacaucgccauggccagcgccagcagccccgccagcagcggcggcagcggcaagcugcccagcagaaagggcagaagcaagagaggcaaguaa

SEQ ID NO: 14283 - RNA, 2466 nt, Artificial Sequence
  BRAT1__Homo_sapiens__NP_689956
auggaccccgagugcgcccagcugcugcccgcccugugcgccgugcugguggaccccagacagcccguggccgacgacaccugccuggagaagcugcuggacugguucaagaccgugaccgagggcgagagcagcguggugcugcugcaggagcaccccugccugguggagcugcugagccacgugcugaaggugcaggaccugagcagcggcgugcugagcuucagccugagacuggccggcaccuucgccgcccaggagaacugcuuccaguaccugcagcagggcgagcugcugcccggccuguucggcgagcccggcccccugggcagagccaccugggccgugcccaccgugagaagcggcuggauccagggccugagaagccuggcccagcaccccagcgcccugagauuccuggccgaccacggcgccguggacaccaucuucagccugcagggcgacagcagccuguucguggccagcgccgccagccagcugcuggugcacgugcuggcccugagcaugagaggcggcgccgagggccagcccugccugcccggcggcgacuggcccgccugcgcccagaagaucauggaccacguggaggagagccugugcagcgccgccacccccaaggugacccaggcccugaacgugcugaccaccaccuucggcagaugccagagccccuggaccgaggcccugugggugagacugagccccagaguggccugccugcuggagagagaccccauccccgccgcccacagcuucguggaccugcugcugugcguggccagaagccccguguucagcagcagcgacggcagccugugggagaccguggccagagcccugagcugccugggccccacccacaugggcccccuggcccugggcauccugaagcuggagcacugcccccaggcccugagaacccaggccuuccaggugcugcugcagccccuggccugcgugcugaaggccaccgugcaggcccccggcccccccggccugcuggacggcaccgccgacgacgccaccaccguggacacccugcuggccagcaagagcagcugcgccggccugcugugcagaacccuggcccaccuggaggagcugcagccccugccccagagacccagccccuggccccaggccagccugcugggcgccaccgugaccgugcugagacugugcgacggcagcgccgcccccgccagcagcgugggcggccaccugugcggcacccuggccggcugcgugagagugcagagagccgcccuggacuuccugggcacccugagccagggcaccggcccccaggagcuggugacccaggcccuggccgugcugcuggagugccuggagagccccggcagcagccccaccgugcugaagaaggccuuccaggccacccugagauggcugcugagcagccccaagacccccggcugcagcgaccugggcccccugaucccccaguuccugagagagcuguuccccgugcugcagaagagacugugccaccccugcugggaggugagagacagcgcccuggaguuccugacccagcugagcagacacuggggcggccaggccgacuucagaugcgcccugcuggccagcgaggugccccagcuggcccugcagcugcugcaggaccccgagagcuacgugagagccagcgccgugaccgccaugggccagcugagcagccagggccugcacgcccccaccagccccgagcacgccgaggccagacagagccuguuccuggagcugcugcacauccugagcguggacagcgagggcuuccccagaagagccgugaugcagguguucaccgaguggcugagagacggccacgccgacgccgcccaggacaccgagcaguucguggccaccgugcugcaggccgccagcagagaccuggacugggaggugagagcccagggccuggagcuggcccugguguuccugggccagacccugggcccccccagaacccacugccccuacgccguggcccugcccgagguggcccccgcccagccccugaccgaggcccugagagcccugugccacgugggccuguucgacuucgccuucugcgcccuguucgacugcgacagacccguggcccagaagagcugcgaccugcugcuguuccugagagacaagaucgccagcuacagcagccugagagaggccagaggcagccccaacaccgccagcgccgaggccacccugcccagauggagagccggcgagcaggcccagccccccggcgaccaggagcccgaggccgugcuggccaugcugagaagccuggaccuggagggccugagaagcacccuggccgagagcagcgaccacguggagaagagcccccagagccugcugcaggacaugcuggccaccggcggcuuccugcagggcgacgaggccgacugcuacuaa

SEQ ID NO: 14284 - RNA, 5592 nt, Artificial Sequence
  BRCA1__Homo_sapiens__NP_009225
auggaccugagcgcccugagaguggaggaggugcagaacgugaucaacgccaugcagaagauccuggagugccccaucugccuggagcugaucaaggagcccgugagcaccaagugcgaccacaucuucugcaaguucugcaugcugaagcugcugaaccagaagaagggccccagccagugcccccugugcaagaacgacaucaccaagagaagccugcaggagagcaccagauucagccagcugguggaggagcugcugaagaucaucugcgccuuccagcuggacaccggccuggaguacgccaacagcuacaacuucgccaagaaggagaacaacagccccgagcaccugaaggacgaggugagcaucauccagagcaugggcuacagaaacagagccaagagacugcugcagagcgagcccgagaaccccagccugcaggagaccagccugagcgugcagcugagcaaccugggcaccgugagaacccugagaaccaagcagagaauccagccccagaagaccagcguguacaucgagcugggcagcgacagcagcgaggacaccgugaacaaggccaccuacugcagcgugggcgaccaggagcugcugcagaucaccccccagggcaccagagacgagaucagccuggacagcgccaagaaggccgccugcgaguucagcgagaccgacgugaccaacaccgagcaccaccagcccagcaacaacgaccugaacaccaccgagaagagagccgccgagagacaccccgagaaguaccagggcagcagcgugagcaaccugcacguggagcccugcggcaccaacacccacgccagcagccugcagcacgagaacagcagccugcugcugaccaaggacagaaugaacguggagaaggccgaguucugcaacaagagcaagcagcccggccuggccagaagccagcacaacagaugggccggcagcaaggagaccugcaacgacagaagaacccccagcaccgagaagaagguggaccugaacgccgacccccugugcgagagaaaggaguggaacaagcagaagcugcccugcagcgagaaccccagagacaccgaggacgugcccuggaucacccugaacagcagcauccagaaggugaacgagugguucagcagaagcgacgagcugcugggcagcgacgacagccacgacggcgagagcgagagcaacgccaagguggccgacgugcuggacgugcugaacgagguggacgaguacagcggcagcagcgagaagaucgaccugcuggccagcgacccccacgaggcccugaucugcaagagcgagagagugcacagcaagagcguggagagcaacaucgaggacaagaucuucggcaagaccuacagaaagaaggccagccugcccaaccugagccacgugaccgagaaccugaucaucggcgccuucgugaccgagccccagaucauccaggagagaccccugaccaacaagcugaagagaaagagaagacccaccagcggccugcaccccgaggacuucaucaagaaggccgaccuggccgugcagaagacccccgagaugaucaaccagggcaccaaccagaccgagcagaacggccaggugaugaacaucaccaacagcggccacgagaacaagaccaagggcgacagcauccagaacgagaagaaccccaaccccaucgagagccuggagaaggagagcgccuucaagaccaaggccgagcccaucagcagcagcaucagcaacauggagcuggagcugaacauccacaacagcaaggcccccaagaagaacagacugagaagaaagagcagcaccagacacauccacgcccuggagcugguggugagcagaaaccugagcccccccaacugcaccgagcugcagaucgacagcugcagcagcagcgaggagaucaagaagaagaaguacaaccagaugcccgugagacacagcagaaaccugcagcugauggagggcaaggagcccgccaccggcgccaagaagagcaacaagcccaacgagcagaccagcaagagacacgacagcgacaccuuccccgagcugaagcugaccaacgcccccggcagcuucaccaagugcagcaacaccagcgagcugaaggaguucgugaaccccagccugcccagagaggagaaggaggagaagcuggagaccgugaaggugagcaacaacgccgaggaccccaaggaccugaugcugagcggcgagagagugcugcagaccgagagaagcguggagagcagcagcaucagccuggugcccggcaccgacuacggcacccaggagagcaucagccugcuggaggugagcacccugggcaaggccaagaccgagcccaacaagugcgugagccagugcgccgccuucgagaaccccaagggccugauccacggcugcagcaaggacaacagaaacgacaccgagggcuucaaguacccccugggccacgaggugaaccacagcagagagaccagcaucgagauggaggagagcgagcuggacgcccaguaccugcagaacaccuucaaggugagcaagagacagagcuucgcccccuucagcaaccccggcaacgccgaggaggagugcgccaccuucagcgcccacagcggcagccugaagaagcagagccccaaggugaccuucgagugcgagcagaaggaggagaaccagggcaagaacgagagcaacaucaagcccgugcagaccgugaacaucaccgccggcuuccccguggugggccagaaggacaagcccguggacaacgccaagugcagcaucaagggcggcagcagauucugccugagcagccaguucagaggcaacgagaccggccugaucacccccaacaagcacggccugcugcagaaccccuacagaauccccccccuguuccccaucaagagcuucgugaagaccaagugcaagaagaaccugcuggaggagaacuucgaggagcacagcaugagccccgagagagagaugggcaacgagaacauccccagcaccgugagcaccaucagcagaaacaacaucagagagaacguguucaaggaggccagcagcagcaacaucaacgaggugggcagcagcaccaacgaggugggcagcagcaucaacgagaucggcagcagcgacgagaacauccaggccgagcugggcagaaacagaggccccaagcugaacgccaugcugagacugggcgugcugcagcccgagguguacaagcagagccugcccggcagcaacugcaagcaccccgagaucaagaagcaggaguacgaggagguggugcagaccgugaacaccgacuucagccccuaccugaucagcgacaaccuggagcagcccaugggcagcagccacgccagccaggugugcagcgagacccccgacgaccugcuggacgacggcgagaucaaggaggacaccagcuucgccgagaacgacaucaaggagagcagcgccguguucagcaagagcgugcagaagggcgagcugagcagaagccccagccccuucacccacacccaccuggcccagggcuacagaagaggcgccaagaagcuggagagcagcgaggagaaccugagcagcgaggacgaggagcugcccugcuuccagcaccugcuguucggcaaggugaacaacauccccagccagagcaccagacacagcaccguggccaccgagugccugagcaagaacaccgaggagaaccugcugagccugaagaacagccugaacgacugcagcaaccaggugauccuggccaaggccagccaggagcaccaccugagcgaggagaccaagugcagcgccagccuguucagcagccagugcagcgagcuggaggaccugaccgccaacaccaacacccaggaccccuuccugaucggcagcagcaagcagaugagacaccagagcgagagccagggcgugggccugagcgacaaggagcuggugagcgacgacgaggagagaggcaccggccuggaggagaacaaccaggaggagcagagcauggacagcaaccugggcgaggccgccagcggcugcgagagcgagaccagcgugagcgaggacugcagcggccugagcagccagagcgacauccugaccacccagcagagagacaccaugcagcacaaccugaucaagcugcagcaggagauggccgagcuggaggccgugcuggagcagcacggcagccagcccagcaacagcuaccccagcaucaucagcgacagcagcgcccuggaggaccugagaaaccccgagcagagcaccagcgagaaggccgugcugaccagccagaagagcagcgaguaccccaucagccagaaccccgagggccugagcgccgacaaguucgaggugagcgccgacagcagcaccagcaagaacaaggagcccggcguggagagaagcagccccagcaagugccccagccuggacgacagaugguacaugcacagcugcagcggcagccugcagaacagaaacuaccccagccaggaggagcugaucaaggugguggacguggaggagcagcagcuggaggagagcggcccccacgaccugaccgagaccagcuaccugcccagacaggaccuggagggcacccccuaccuggagagcggcaucagccuguucagcgacgaccccgagagcgaccccagcgaggacagagcccccgagagcgccagagugggcaacauccccagcagcaccagcgcccugaaggugccccagcugaagguggccgagagcgcccagagccccgccgccgcccacaccaccgacaccgccggcuacaacgccauggaggagagcgugagcagagagaagcccgagcugaccgccagcaccgagagagugaacaagagaaugagcaugguggugagcggccugacccccgaggaguucaugcugguguacaaguucgccagaaagcaccacaucacccugaccaaccugaucaccgaggagaccacccacguggugaugaagaccgacgccgaguucgugugcgagagaacccugaaguacuuccugggcaucgccggcggcaaguggguggugagcuacuucugggugacccagagcaucaaggagagaaagaugcugaacgagcacgacuucgaggugagaggcgacguggugaacggcagaaaccaccagggccccaagagagccagagagagccaggacagaaagaucuucagaggccuggagaucugcugcuacggccccuucaccaacaugcccaccgaccagcuggaguggauggugcagcugugcggcgccagcguggugaaggagcugagcagcuucacccugggcaccggcgugcaccccaucgugguggugcagcccgacgccuggaccgaggacaacggcuuccacgccaucggccagaugugcgaggcccccguggugaccagagagugggugcuggacagcguggcccuguaccagugccaggagcuggacaccuaccugaucccccagaucccccacagccacuacuaa

SEQ ID NO: 14285 - RNA, 10257 nt, Artificial Sequence
  BRCA2__Homo_sapiens__NP_000050
augcccaucggcagcaaggagagacccaccuucuucgagaucuucaagaccagaugcaacaaggccgaccugggccccaucagccugaacugguucgaggagcugagcagcgaggccccccccuacaacagcgagcccgccgaggagagcgagcacaagaacaacaacuacgagcccaaccuguucaagaccccccagagaaagcccagcuacaaccagcuggccagcacccccaucaucuucaaggagcagggccugacccugccccuguaccagagccccgugaaggagcuggacaaguucaagcuggaccugggcagaaacgugcccaacagcagacacaagagccugagaaccgugaagaccaagauggaccaggccgacgacgugagcugcccccugcugaacagcugccugagcgagagccccguggugcugcagugcacccacgugaccccccagagagacaagagcguggugugcggcagccuguuccacacccccaaguucgugaagggcagacagacccccaagcacaucagcgagagccugggcgccgagguggaccccgacaugagcuggagcagcagccuggccaccccccccacccugagcagcaccgugcugaucgugagaaacgaggaggccagcgagaccguguucccccacgacaccaccgccaacgugaagagcuacuucagcaaccacgacgagagccugaagaagaacgacagauucaucgccagcgugaccgacagcgagaacaccaaccagagagaggccgccagccacggcuucggcaagaccagcggcaacagcuucaaggugaacagcugcaaggaccacaucggcaagagcaugcccaacgugcuggaggacgagguguacgagaccgugguggacaccagcgaggaggacagcuucagccugugcuucagcaagugcagaaccaagaaccugcagaaggugagaaccagcaagaccagaaagaagaucuuccacgaggccaacgccgacgagugcgagaagagcaagaaccaggugaaggagaaguacagcuucgugagcgagguggagcccaacgacaccgacccccuggacagcaacguggccaaccagaagcccuucgagagcggcagcgacaagaucagcaaggagguggugcccagccuggccugcgaguggagccagcugacccugagcggccugaacggcgcccagauggagaagaucccccugcugcacaucagcagcugcgaccagaacaucagcgagaaggaccugcuggacaccgagaacaagagaaagaaggacuuccugaccagcgagaacagccugcccagaaucagcagccugcccaagagcgagaagccccugaacgaggagaccguggugaacaagagagacgaggagcagcaccuggagagccacaccgacugcauccuggccgugaagcaggccaucagcggcaccagccccguggccagcagcuuccagggcaucaagaagagcaucuucagaaucagagagagccccaaggagaccuucaacgccagcuucagcggccacaugaccgaccccaacuucaagaaggagaccgaggccagcgagagcggccuggagauccacaccgugugcagccagaaggaggacagccugugccccaaccugaucgacaacggcagcuggcccgccaccaccacccagaacagcguggcccugaagaacgccggccugaucagcacccugaagaagaagaccaacaaguucaucuacgccauccacgacgagaccagcuacaagggcaagaagauccccaaggaccagaagagcgagcugaucaacugcagcgcccaguucgaggccaacgccuucgaggccccccugaccuucgccaacgccgacagcggccugcugcacagcagcgugaagagaagcugcagccagaacgacagcgaggagcccacccugagccugaccagcagcuucggcaccauccugagaaagugcagcagaaacgagaccugcagcaacaacaccgugaucagccaggaccuggacuacaaggaggccaagugcaacaaggagaagcugcagcuguucaucacccccgaggccgacagccugagcugccugcaggagggccagugcgagaacgaccccaagagcaagaaggugagcgacaucaaggaggaggugcuggccgccgccugccaccccgugcagcacagcaagguggaguacagcgacaccgacuuccagagccagaagagccugcuguacgaccacgagaacgccagcacccugauccugacccccaccagcaaggacgugcugagcaaccuggugaugaucagcagaggcaaggagagcuacaagaugagcgacaagcugaagggcaacaacuacgagagcgacguggagcugaccaagaacauccccauggagaagaaccaggacgugugcgcccugaacgagaacuacaagaacguggagcugcugccccccgagaaguacaugagaguggccagccccagcagaaaggugcaguucaaccagaacaccaaccugagagugauccagaagaaccaggaggagaccaccagcaucagcaagaucaccgugaaccccgacagcgaggagcuguucagcgacaacgagaacaacuucguguuccagguggccaacgagagaaacaaccuggcccugggcaacaccaaggagcugcacgagaccgaccugaccugcgugaacgagcccaucuucaagaacagcaccauggugcuguacggcgacaccggcgacaagcaggccacccaggugagcaucaagaaggaccugguguacgugcuggccgaggagaacaagaacagcgugaagcagcacaucaagaugacccugggccaggaccugaagagcgacaucagccugaacaucgacaagauccccgagaagaacaacgacuacaugaacaagugggccggccugcugggccccaucagcaaccacagcuucggcggcagcuucagaaccgccagcaacaaggagaucaagcugagcgagcacaacaucaagaagagcaagauguucuucaaggacaucgaggagcaguaccccaccagccuggccugcguggagaucgugaacacccuggcccuggacaaccagaagaagcugagcaagccccagagcaucaacaccgugagcgcccaccugcagagcagcgugguggugagcgacugcaagaacagccacaucaccccccagaugcuguucagcaagcaggacuucaacagcaaccacaaccugacccccagccagaaggccgagaucaccgagcugagcaccauccuggaggagagcggcagccaguucgaguucacccaguucagaaagcccagcuacauccugcagaagagcaccuucgaggugcccgagaaccagaugaccauccugaagaccaccagcgaggagugcagagacgccgaccugcacgugaucaugaacgcccccagcaucggccagguggacagcagcaagcaguucgagggcaccguggagaucaagagaaaguucgccggccugcugaagaacgacugcaacaagagcgccagcggcuaccugaccgacgagaacgaggugggcuucagaggcuucuacagcgcccacggcaccaagcugaacgugagcaccgaggcccugcagaaggccgugaagcuguucagcgacaucgagaacaucagcgaggagaccagcgccgaggugcaccccaucagccugagcagcagcaagugccacgacagcguggugagcauguucaagaucgagaaccacaacgacaagaccgugagcgagaagaacaacaagugccagcugauccugcagaacaacaucgagaugaccaccggcaccuucguggaggagaucaccgagaacuacaagagaaacaccgagaacgaggacaacaaguacaccgccgccagcagaaacagccacaaccuggaguucgacggcagcgacagcagcaagaacgacaccgugugcauccacaaggacgagaccgaccugcuguucaccgaccagcacaacaucugccugaagcugagcggccaguucaugaaggagggcaacacccagaucaaggaggaccugagcgaccugaccuuccuggagguggccaaggcccaggaggccugccacggcaacaccagcaacaaggagcagcugaccgccaccaagaccgagcagaacaucaaggacuucgagaccagcgacaccuucuuccagaccgccagcggcaagaacaucagcguggccaaggagagcuucaacaagaucgugaacuucuucgaccagaagcccgaggagcugcacaacuucagccugaacagcgagcugcacagcgacaucagaaagaacaagauggacauccugagcuacgaggagaccgacaucgugaagcacaagauccugaaggagagcgugcccgugggcaccggcaaccagcuggugaccuuccagggccagcccgagagagacgagaagaucaaggagcccacccugcugggcuuccacaccgccagcggcaagaaggugaagaucgccaaggagagccuggacaaggugaagaaccuguucgacgagaaggagcagggcaccagcgagaucaccagcuucagccaccagugggccaagacccugaaguacagagaggccugcaaggaccuggagcuggccugcgagaccaucgagaucaccgccgcccccaagugcaaggagaugcagaacagccugaacaacgacaagaaccuggugagcaucgagaccguggugccccccaagcugcugagcgacaaccugugcagacagaccgagaaccugaagaccagcaagagcaucuuccugaaggugaaggugcacgagaacguggagaaggagaccgccaagagccccgccaccugcuacaccaaccagagccccuacagcgugaucgagaacagcgcccuggccuucuacaccagcugcagcagaaagaccagcgugagccagaccagccugcuggaggccaagaaguggcugagagagggcaucuucgacggccagcccgagagaaucaacaccgccgacuacgugggcaacuaccuguacgagaacaacagcaacagcaccaucgccgagaacgacaagaaccaccugagcgagaagcaggacaccuaccugagcaacagcagcaugagcaacagcuacagcuaccacagcgacgagguguacaacgacagcggcuaccugagcaagaacaagcuggacagcggcaucgagcccgugcugaagaacguggaggaccagaagaacaccagcuucagcaaggugaucagcaacgugaaggacgccaacgccuacccccagaccgugaacgaggacaucugcguggaggagcuggugaccagcagcagccccugcaagaacaagaacgccgccaucaagcugagcaucagcaacagcaacaacuucgaggugggcccccccgccuucagaaucgccagcggcaagaucgugugcgugagccacgagaccaucaagaaggugaaggacaucuucaccgacagcuucagcaaggugaucaaggagaacaacgagaacaagagcaagaucugccagaccaagaucauggccggcugcuacgaggcccuggacgacagcgaggacauccugcacaacagccuggacaacgacgagugcagcacccacagccacaagguguucgccgacauccagagcgaggagauccugcagcacaaccagaacaugagcggccuggagaaggugagcaagaucagccccugcgacgugagccuggagaccagcgacaucugcaagugcagcaucggcaagcugcacaagagcgugagcagcgccaacaccugcggcaucuucagcaccgccagcggcaagagcgugcaggugagcgacgccagccugcagaacgccagacagguguucagcgagaucgaggacagcaccaagcagguguucagcaaggugcuguucaagagcaacgagcacagcgaccagcugaccagagaggagaacaccgccaucagaacccccgagcaccugaucagccagaagggcuucagcuacaacguggugaacagcagcgccuucagcggcuucagcaccgccagcggcaagcaggugagcauccuggagagcagccugcacaaggugaagggcgugcuggaggaguucgaccugaucagaaccgagcacagccugcacuacagccccaccagcagacagaacgugagcaagauccugcccagaguggacaagagaaaccccgagcacugcgugaacagcgagauggagaagaccugcagcaaggaguucaagcugagcaacaaccugaacguggagggcggcagcagcgagaacaaccacagcaucaaggugagccccuaccugagccaguuccagcaggacaagcagcagcuggugcugggcaccaaggugagccugguggagaacauccacgugcugggcaaggagcaggccagccccaagaacgugaagauggagaucggcaagaccgagaccuucagcgacgugcccgugaagaccaacaucgaggugugcagcaccuacagcaaggacagcgagaacuacuucgagaccgaggccguggagaucgccaaggccuucauggaggacgacgagcugaccgacagcaagcugcccagccacgccacccacagccuguucaccugccccgagaacgaggagauggugcugagcaacagcagaaucggcaagagaagaggcgagccccugauccuggugggcgagcccagcaucaagagaaaccugcugaacgaguucgacagaaucaucgagaaccaggagaagagccugaaggccagcaagagcacccccgacggcaccaucaaggacagaagacuguucaugcaccacgugagccuggagcccaucaccugcgugcccuucagaaccaccaaggagagacaggagauccagaaccccaacuucaccgcccccggccaggaguuccugagcaagagccaccuguacgagcaccugacccuggagaagagcagcagcaaccuggccgugagcggccaccccuucuaccaggugagcgccaccagaaacgagaagaugagacaccugaucaccaccggcagacccaccaagguguucgugccccccuucaagaccaagagccacuuccacagaguggagcagugcgugagaaacaucaaccuggaggagaacagacagaagcagaacaucgacggccacggcagcgacgacagcaagaacaagaucaacgacaacgagauccaccaguucaacaagaacaacagcaaccaggccgccgccgugaccuucaccaagugcgaggaggagccccuggaccugaucaccagccugcagaacgccagagacauccaggacaugagaaucaagaagaagcagagacagagaguguucccccagcccggcagccuguaccuggccaagaccagcacccugcccagaaucagccugaaggccgccgugggcggccaggugcccagcgccugcagccacaagcagcuguacaccuacggcgugagcaagcacugcaucaagaucaacagcaagaacgccgagagcuuccaguuccacaccgaggacuacuucggcaaggagagccuguggaccggcaagggcauccagcuggccgacggcggcuggcugauccccagcaacgacggcaaggccggcaaggaggaguucuacagagcccugugcgacacccccggcguggaccccaagcugaucagcagaaucuggguguacaaccacuacagauggaucaucuggaagcuggccgccauggagugcgccuuccccaaggaguucgccaacagaugccugagccccgagagagugcugcugcagcugaaguacagauacgacaccgagaucgacagaagcagaagaagcgccaucaagaagaucauggagagagacgacaccgccgccaagacccuggugcugugcgugagcgacaucaucagccugagcgccaacaucagcgagaccagcagcaacaagaccagcagcgccgacacccagaagguggccaucaucgagcugaccgacggcugguacgccgugaaggcccagcuggaccccccccugcuggccgugcugaagaacggcagacugaccgugggccagaagaucauccugcacggcgccgagcuggugggcagccccgacgccugcaccccccuggaggcccccgagagccugaugcugaagaucagcgccaacagcaccagacccgccagaugguacaccaagcugggcuucuuccccgaccccagacccuucccccugccccugagcagccuguucagcgacggcggcaacgugggcugcguggacgugaucauccagagagccuaccccauccaguggauggagaagaccagcagcggccuguacaucuucagaaacgagagagaggaggagaaggaggccgccaaguacguggaggcccagcagaagagacuggaggcccuguucaccaagauccaggaggaguucgaggagcacgaggagaacaccaccaagcccuaccugcccagcagagcccugaccagacagcaggugagagcccugcaggacggcgccgagcuguacgaggccgugaagaacgccgccgaccccgccuaccuggagggcuacuucagcgaggagcagcugagagcccugaacaaccacagacagaugcugaacgacaagaagcaggcccagauccagcuggagaucagaaaggccauggagagcgccgagcagaaggagcagggccugagcagagacgugaccaccguguggaagcugagaaucgugagcuacagcaagaaggagaaggacagcgugauccugagcaucuggagacccagcagcgaccuguacagccugcugaccgagggcaagagauacagaaucuaccaccuggccaccagcaagagcaagagcaagagcgagagagccaacauccagcuggccgccaccaagaagacccaguaccagcagcugcccgugagcgacgagauccuguuccagaucuaccagcccagagagccccugcacuucagcaaguuccuggaccccgacuuccagcccagcugcagcgagguggaccugaucggcuucguggugagcguggugaagaagaccggccuggcccccuucguguaccugagcgacgagugcuacaaccugcuggccaucaaguucuggaucgaccugaacgaggacaucaucaagccccacaugcugaucgccgccagcaaccugcaguggagacccgagagcaagagcggccugcugacccuguucgccggcgacuucagcguguucagcgccagccccaaggagggccacuuccaggagaccuucaacaagaugaagaacaccguggagaacaucgacauccugugcaacgaggccgagaacaagcugaugcacauccugcacgccaacgaccccaaguggagcacccccaccaaggacugcaccagcggccccuacaccgcccagaucauccccggcaccggcaacaagcugcugaugagcagccccaacugcgagaucuacuaccagagcccccugagccugugcauggccaagagaaagagcgugagcacccccgugagcgcccagaugaccagcaagagcugcaagggcgagaaggagaucgacgaccagaagaacugcaagaagagaagagcccuggacuuccugagcagacugccccugcccccccccgugagccccaucugcaccuucgugagccccgccgcccagaaggccuuccagccccccagaagcugcggcaccaaguacgagacccccaucaagaagaaggagcugaacagcccccagaugacccccuucaagaaguucaacgagaucagccugcuggagagcaacagcaucgccgacgaggagcuggcccugaucaacacccaggcccugcugagcggcagcaccggcgagaagcaguucaucagcgugagcgagagcaccagaaccgcccccaccagcagcgaggacuaccugagacugaagagaagaugcaccaccagccugaucaaggagcaggagagcagccaggccagcaccgaggagugcgagaagaacaagcaggacaccaucaccaccaagaaguacaucuaa

SEQ ID NO: 14286 - RNA, 876 nt, Artificial Sequence
  BRCC3__Homo_sapiens__NP_001018065
auggccgugcagguggugcaggccgugcaggccgugcaccuggagagcgacgccuuccuggugugccugaaccacgcccugagcaccgagaaggaggaggugaugggccugugcaucggcgagcugaacgacgacaccagaagcgacagcaaguucgccuacaccggcaccgagaugagaaccguggccgagaagguggacgccgugagaaucgugcacauccacagcgugaucauccugagaagaagcgacaagagaaaggacagaguggagaucagccccgagcagcugagcgccgccagcaccgaggccgagagacuggccgagcugaccggcagacccaugagaguggugggcugguaccacagccacccccacaucaccguguggcccagccacguggacgugagaacccaggccauguaccagaugauggaccagggcuucgugggccugaucuucagcugcuucaucgaggacaagaacaccaagaccggcagagugcuguacaccugcuuccagagcauccaggcccagaagagcagcgaguacgagagaaucgagauccccauccacaucgugccccacgugaccaucggcaaggugugccuggagagcgccguggagcugcccaagauccugugccaggaggagcaggacgccuacagaagaauccacagccugacccaccuggacagcgugaccaagauccacaacggcagcguguucaccaagaaccugugcagccagaugagcgccgugagcggcccccugcugcaguggcuggaggacagacuggagcagaaccagcagcaccugcaggagcugcagcaggagaaggaggagcugaugcaggagcugagcagccuggaguaa

SEQ ID NO: 14287 - RNA, 3570 nt, Artificial Sequence
  BRD1__Homo_sapiens__NP_001291737
augagaagaaagggcagaugccacagaggcagcgccgccagacaccccagcagccccugcagcgugaagcacagccccaccagagagacccugaccuacgcccaggcccagagaaugguggagaucgagaucgagggcagacugcacagaaucagcaucuucgacccccuggagaucauccuggaggacgaccugaccgcccaggagaugagcgagugcaacagcaacaaggagaacagcgagagaccccccgugugccugagaaccaagagacacaagaacaacagagugaagaagaagaacgaggcccugcccagcgcccacggcacccccgccagcgccagcgcccugcccgagcccaaggugagaaucguggaguacagcccccccagcgcccccagaagaccccccguguacuacaaguucaucgagaagagcgccgaggagcuggacaacgagguggaguacgacauggacgaggaggacuacgccuggcuggagaucgugaacgagaagagaaagggcgacugcgugcccgccgugagccagagcauguucgaguuccugauggacagauucgagaaggagagccacugcgagaaccagaagcagggcgagcagcagagccugaucgacgaggacgccgugugcugcaucugcauggacggcgagugccagaacagcaacgugauccuguucugcgacaugugcaaccuggccgugcaccaggagugcuacggcgugcccuacauccccgagggccaguggcugugcagacacugccugcagagcagagccagacccgccgacugcgugcugugccccaacaagggcggcgccuucaagaagaccgacgacgacagauggggccacguggugugcgcccuguggauccccgaggugggcuucgccaacaccguguucaucgagcccaucgacggcgugagaaacaucccccccgccagauggaagcugaccugcuaccugugcaagcagaagggcgugggcgccugcauccagugccacaaggccaacugcuacaccgccuuccacgugaccugcgcccagaaggccggccuguacaugaagauggagcccgugaaggagcugaccggcggcggcaccaccuucagcgugagaaagaccgccuacugcgacgugcacaccccccccggcugcaccagaagaccccugaacaucuacggcgacguggagaugaagaacggcgugugcagaaaggagagcagcgugaagaccgugagaagcaccagcaaggugagaaagaaggccaagaaggccaagaaggcccuggccgagcccugcgccgugcugcccaccgugugcgcccccuacauccccccccagagacugaacagaaucgccaaccagguggccauccagagaaagaagcaguucguggagagagcccacagcuacuggcugcugaagagacugagcagaaacggcgccccccugcugagaagacugcagagcagccugcagagccagagaagcagccagcagagagagaacgacgaggagaugaaggccgccaaggagaagcugaaguacuggcagagacugagacacgaccuggagagagccagacugcugaucgagcugcugagaaagagagagaagcugaagagagagcaggugaagguggagcagguggccauggagcugagacugaccccccugaccgugcugcugagaagcgugcuggaccagcugcaggacaaggaccccgccagaaucuucgcccagcccgugagccugaaggaggugcccgacuaccuggaccacaucaagcaccccauggacuucgccaccaugagaaagagacuggaggcccagggcuacaagaaccugcacgaguucgaggaggacuucgaccugaucaucgacaacugcaugaaguacaacgccagagacaccguguucuacagagccgccgugagacugagagaccagggcggcguggugcugagacaggccagaagagagguggacagcaucggccuggaggaggccagcggcaugcaccugcccgagagacccgccgccgcccccagaagacccuucagcugggaggacguggacagacugcuggaccccgccaacagagcccaccugggccuggaggagcagcugagagagcugcuggacaugcuggaccugaccugcgccaugaagagcagcggcagcagaagcaagagagccaagcugcugaagaaggagaucgcccugcugagaaacaagcugagccagcagcacagccagccccugcccaccggccccggccuggagggcuucgaggaggacggcgccgcccugggccccgaggccggcgaggagggcgacaagagcccccccaagcuggagcccagcgacgcccugccccugcccagcaacagcgagaccaacagcgagccccccacccugaagcccguggagcugaaccccgagcagagcaagcuguucaagagagugaccuucgacaacgagagccacagcgccugcacccagagcgcccuggugagcggcagaccccccgagcccaccagagccagcagcggcgacgugcccgccgccgccgccagcgccguggccgagcccgccagcgacgugaacagaagaaccagcgugcuguucugcaagagcaagagcgugagcccccccaagagcgccaagaacaccgagacccagcccaccagcccccagcugggcaccaagaccuuccugagcguggugcugcccagacuggagacccugcugcagcccagaaagagaagcagaagcaccugcggcgacagcgagguggaggaggagagccccggcaagagacuggacgccggccugaccaacggcuucggcggcgccagaagcgagcaggagcccggcggcggccugggcagaaaggccacccccagaagaagaugcgccagcgagagcagcaucagcagcagcaacagcccccugugcgacagcagcuucaacgcccccaagugcggcagaggcaagcccgcccuggugagaagacacacccuggaggacagaagcgagcugaucagcugcaucgagaacggcaacuacgccaaggccgccagaaucgccgccgaggugggccagagcagcauguggaucagcaccgacgccgccgccagcgugcuggagccccugaagguggugugggccaagugcagcggcuaccccagcuaccccgcccugaucaucgaccccaagaugcccagagugcccggccaccacaacggcgugaccauccccgcccccccccuggacgugcugaagaucggcgagcacaugcagaccaagagcgacgagaagcuguuccuggugcuguucuucgacaacaagagaagcuggcaguggcugcccaagagcaagauggugccccugggcaucgacgagaccaucgacaagcugaagaugauggagggcagaaacagcagcaucagaaaggccgugagaaucgccuucgacagagccaugaaccaccugagcagagugcacggcgagcccaccagcgaccugagcgacaucgacuaa

SEQ ID NO: 14288 - RNA, 2406 nt, Artificial Sequence
  BRD2__Homo_sapiens__NP_001106653
augcugcagaacgugaccccccacaacaagcugcccggcgagggcaacgccggccugcugggccugggccccgaggccgccgcccccggcaagagaaucagaaagcccagccugcuguacgagggcuucgagagccccaccauggccagcgugcccgcccugcagcugacccccgccaacccccccccccccgaggugagcaaccccaagaagcccggcagagugaccaaccagcugcaguaccugcacaagguggugaugaaggcccuguggaagcaccaguucgccuggcccuucagacagcccguggacgccgugaagcugggccugcccgacuaccacaagaucaucaagcagcccauggacaugggcaccaucaagagaagacuggagaacaacuacuacugggccgccagcgagugcaugcaggacuucaacaccauguucaccaacugcuacaucuacaacaagcccaccgacgacaucgugcugauggcccagacccuggagaagaucuuccugcagaagguggccagcaugccccaggaggagcaggagcugguggugaccauccccaagaacagccacaagaagggcgccaagcuggccgcccugcagggcagcgugaccagcgcccaccaggugcccgccgugagcagcgugagccacaccgcccuguacacccccccccccgagauccccaccaccgugcugaacaucccccaccccagcgugaucagcagcccccugcugaagagccugcacagcgccggccccccccugcuggccgugaccgccgccccccccgcccagccccuggccaagaagaagggcgugaagagaaaggccgacaccaccacccccacccccaccgccauccuggcccccggcagccccgccagcccccccggcagccuggagcccaaggccgccagacugccccccaugagaagagagagcggcagacccaucaagccccccagaaaggaccugcccgacagccagcagcagcaccagagcagcaagaagggcaagcugagcgagcagcugaagcacugcaacggcauccugaaggagcugcugagcaagaagcacgccgccuacgccuggcccuucuacaagcccguggacgccagcgcccugggccugcacgacuaccacgacaucaucaagcaccccauggaccugagcaccgugaagagaaagauggagaacagagacuacagagacgcccaggaguucgccgccgacgugagacugauguucagcaacugcuacaaguacaacccccccgaccacgacgugguggccauggccagaaagcugcaggacguguucgaguucagauacgccaagaugcccgacgagccccuggagcccggcccccugcccgugagcaccgccaugccccccggccuggccaagagcagcagcgagagcagcagcgaggagagcagcagcgagagcagcagcgaggaggaggaggaggaggacgaggaggacgaggaggaggaggagagcgagagcagcgacagcgaggaggagagagcccacagacuggccgagcugcaggagcagcugagagccgugcacgagcagcuggccgcccugagccagggccccaucagcaagcccaagagaaagagagagaagaaggagaagaagaagaagagaaaggccgagaagcacagaggcagagccggcgccgacgaggacgacaagggccccagagcccccagacccccccagcccaagaagagcaagaaggccagcggcagcggcggcggcagcgccgcccugggccccagcggcuucggccccagcggcggcagcggcaccaagcugcccaagaaggccaccaagaccgccccccccgcccugcccaccggcuacgacagcgaggaggaggaggagagcagacccaugagcuacgacgagaagagacagcugagccuggacaucaacaagcugcccggcgagaagcugggcagaguggugcacaucauccaggccagagagcccagccugagagacagcaaccccgaggagaucgagaucgacuucgagacccugaagcccagcacccugagagagcuggagagauacgugcugagcugccugagaaagaagcccagaaagcccuacaccaucaagaagcccgugggcaagaccaaggaggagcuggcccuggagaagaagagagagcuggagaagagacugcaggacgugagcggccagcugaacagcaccaagaagccccccaagaaggccaacgagaagaccgagagcagcagcgcccagcagguggccgugagcagacugagcgccagcagcagcagcagcgacagcagcagcagcagcagcagcagcagcagcagcgacaccagcgacagcgacagcggcuaa

SEQ ID NO: 14289 - RNA, 2181 nt, Artificial Sequence
  BRD3__Homo_sapiens__NP_031397
augagcaccgccaccaccguggcccccgccggcauccccgccacccccggccccgugaacccccccccccccgaggugagcaaccccagcaagcccggcagaaagaccaaccagcugcaguacaugcagaacgugguggugaagacccuguggaagcaccaguucgccuggcccuucuaccagcccguggacgccaucaagcugaaccugcccgacuaccacaagaucaucaagaaccccauggacaugggcaccaucaagaagagacuggagaacaacuacuacuggagcgccagcgagugcaugcaggacuucaacaccauguucaccaacugcuacaucuacaacaagcccaccgacgacaucgugcugauggcccaggcccuggagaagaucuuccugcagaagguggcccagaugccccaggaggagguggagcugcugccccccgcccccaagggcaagggcagaaagcccgccgccggcgcccagagcgccggcacccagcagguggccgccgugagcagcgugagccccgccacccccuuccagagcgugccccccaccgugagccagacccccgugaucgccgccacccccgugcccaccaucaccgccaacgugaccagcgugcccgugccccccgccgccgccccccccccccccgccacccccaucgugcccguggugccccccaccccccccguggugaagaagaagggcgugaagagaaaggccgacaccaccacccccaccaccagcgccaucaccgccagcagaagcgagagcccccccccccugagcgaccccaagcaggccaaggugguggccagaagagagagcggcggcagacccaucaagccccccaagaaggaccuggaggacggcgaggugccccagcacgccggcaagaagggcaagcugagcgagcaccugagauacugcgacagcauccugagagagaugcugagcaagaagcacgccgccuacgccuggcccuucuacaagcccguggacgccgaggcccuggagcugcacgacuaccacgacaucaucaagcaccccauggaccugagcaccgugaagagaaagauggacggcagagaguaccccgacgcccagggcuucgccgccgacgugagacugauguucagcaacugcuacaaguacaacccccccgaccacgaggugguggccauggccagaaagcugcaggacguguucgagaugagauucgccaagaugcccgacgagcccguggaggcccccgcccugcccgcccccgccgcccccauggugagcaagggcgccgagagcagcagaagcagcgaggagagcagcagcgacagcggcagcagcgacagcgaggaggagagagccaccagacuggccgagcugcaggagcagcugaaggccgugcacgagcagcuggccgcccugagccaggcccccgugaacaagcccaagaagaagaaggagaagaaggagaaggagaagaagaagaaggacaaggagaaggagaaggagaagcacaaggugaaggccgaggaggagaagaaggccaagguggccccccccgccaagcaggcccagcagaagaaggcccccgccaagaaggccaacagcaccaccaccgccggcagacagcugaagaagggcggcaagcaggccagcgccagcuacgacagcgaggaggaggaggagggccugcccaugagcuacgacgagaagagacagcugagccuggacaucaacagacugcccggcgagaagcugggcagaguggugcacaucauccagagcagagagcccagccugagagacagcaaccccgacgagaucgagaucgacuucgagacccugaagcccaccacccugagagagcuggagagauacgugaagagcugccugcagaagaagcagagaaagcccuucagcgccagcggcaagaagcaggccgccaagagcaaggaggagcuggcccaggagaagaagaaggagcuggagaagagacugcaggacgugagcggccagcugagcagcagcaagaagcccgccagaaaggagaagcccggcagcgcccccagcggcggccccagcagacugagcagcagcagcagcagcgagagcggcagcagcagcagcagcggcagcagcagcgacagcagcgacagcgaguaa

SEQ ID NO: 14290 - RNA, 4089 nt, Artificial Sequence
  BRD4__Homo_sapiens__XP_011526156
augagcgccgagagcggccccggcaccagacugagaaaccugcccgugaugggcgacggccuggagaccagccagaugagcaccacccaggcccaggcccagccccagcccgccaacgccgccagcaccaacccccccccccccgagaccagcaaccccaacaagcccaagagacagaccaaccagcugcaguaccugcugagaguggugcugaagacccuguggaagcaccaguucgccuggcccuuccagcagcccguggacgccgugaagcugaaccugcccgacuacuacaagaucaucaagacccccauggacaugggcaccaucaagaagagacuggagaacaacuacuacuggaacgcccaggagugcauccaggacuucaacaccauguucaccaacugcuacaucuacaacaagcccggcgacgacaucgugcugauggccgaggcccuggagaagcuguuccugcagaagaucaacgagcugcccaccgaggagaccgagaucaugaucgugcaggccaagggcagaggcagaggcagaaaggagaccggcaccgccaagcccggcgugagcaccgugcccaacaccacccaggccagcacccccccccagacccagaccccccagcccaaccccccccccgugcaggccaccccccaccccuuccccgccgugacccccgaccugaucgugcagacccccgugaugaccguggugcccccccagccccugcagacccccccccccgugcccccccagccccagcccccccccgcccccgccccccagcccgugcagagccacccccccaucaucgccgccaccccccagcccgugaagaccaagaagggcgugaagagaaaggccgacaccaccacccccaccaccaucgaccccauccacgagccccccagccugccccccgagcccaagaccaccaagcugggccagagaagagagagcagcagacccgugaagccccccaagaaggacgugcccgacagccagcagcaccccgcccccgagaagagcagcaaggugagcgagcagcugaagugcugcagcggcauccugaaggagauguucgccaagaagcacgccgccuacgccuggcccuucuacaagcccguggacguggaggcccugggccugcacgacuacugcgacaucaucaagcaccccauggacaugagcaccaucaagagcaagcuggaggccagagaguacagagacgcccaggaguucggcgccgacgugagacugauguucagcaacugcuacaaguacaacccccccgaccacgaggugguggccauggccagaaagcugcaggacguguucgagaugagauucgccaagaugcccgacgagcccgaggagcccgugguggccgugagcagccccgccgugcccccccccaccaaggugguggccccccccagcagcagcgacagcagcagcgacagcagcagcgacagcgacagcagcaccgacgacagcgaggaggagagagcccagagacuggccgagcugcaggagcagcugaaggccgugcacgagcagcuggccgcccugagccagccccagcagaacaagcccaagaagaaggagaaggacaagaaggagaagaagaaggagaagcacaagagaaaggaggagguggaggagaacaagaagagcaaggccaaggagcccccccccaagaagaccaagaagaacaacagcagcaacagcaacgugagcaagaaggagcccgcccccaugaagagcaagcccccccccaccuacgagagcgaggaggaggacaagugcaagcccaugagcuacgaggagaagagacagcugagccuggacaucaacaagcugcccggcgagaagcugggcagaguggugcacaucauccagagcagagagcccagccugaagaacagcaaccccgacgagaucgagaucgacuucgagacccugaagcccagcacccugagagagcuggagagauacgugaccagcugccugagaaagaagagaaagccccaggccgagaagguggacgugaucgccggcagcagcaagaugaagggcuucagcagcagcgagagcgagagcagcagcgagagcagcagcagcgacagcgaggacagcgagaccgagauggcccccaagagcaagaagaagggccaccccggcagagagcagaagaagcaccaccaccaccaccaccagcagaugcagcaggcccccgcccccgugccccagcagccccccccccccccccagcagccccccccccccccccccccccagcagcagcagcagccccccccccccccccccccccccagcaugccccagcaggccgcccccgccaugaagagcagccccccccccuucaucgccacccaggugcccgugcuggagccccagcugcccggcagcguguucgaccccaucggccacuucacccagcccauccugcaccugccccagcccgagcugcccccccaccugccccagccccccgagcacagcacccccccccaccugaaccagcacgccguggugagcccccccgcccugcacaacgcccugccccagcagcccagcagacccagcaacagagccgccgcccugccccccaagcccgccagaccccccgccgugagccccgcccugacccagaccccccugcugccccagccccccauggcccagcccccccaggugcugcuggaggacgaggagccccccgcccccccccugaccagcaugcagaugcagcuguaccugcagcagcugcagaaggugcagccccccaccccccugcugcccagcgugaaggugcagagccagcccccccccccccugcccccccccccccaccccagcgugcagcagcagcugcagcagcagccccccccccccccccccccccagccccagccccccccccagcagcagcaccagcccccccccagacccgugcaccugcagcccaugcaguucagcacccacauccagcagcccccccccccccagggccagcagcccccccaccccccccccggccagcagcccccccccccccagcccgccaagccccagcaggugauccagcaccaccacagccccagacaccacaagagcgaccccuacagcaccggccaccugagagaggcccccagcccccugaugauccacagcccccagaugagccaguuccagagccugacccaccagagccccccccagcagaacgugcagcccaagaagcaggagcugagagccgccagcguggugcagccccagccccuggugguggugaaggaggagaagauccacagccccaucaucagaagcgagcccuucagccccagccugagacccgagccccccaagcaccccgagagcaucaaggcccccgugcaccugccccagagacccgagaugaagcccguggacgugggcagacccgugaucagaccccccgagcagaacgcccccccccccggcgcccccgacaaggacaagcagaagcaggagcccaagacccccguggcccccaagaaggaccugaagaucaagaacaugggcagcugggccagccuggugcagaagcaccccaccacccccagcagcaccgccaagagcagcagcgacagcuucgagcaguucagaagagccgccagagagaaggaggagagagagaaggcccugaaggcccaggccgagcacgccgagaaggagaaggagagacugagacaggagagaaugagaagcagagaggacgaggacgcccuggagcaggccagaagagcccacgaggaggccagaagaagacaggagcagcagcagcagcagagacaggagcagcagcagcagcagcagcagcaggccgccgccguggccgccgccgccaccccccaggcccagagcagccagccccagagcaugcuggaccagcagagagagcuggccagaaagagagagcaggagagaagaagaagagaggccauggccgccaccaucgacaugaacuuccagagcgaccugcugagcaucuucgaggagaaccuguucuaa

SEQ ID NO: 14291 - RNA, 1959 nt, Artificial Sequence
  BRD7__Homo_sapiens__NP_001167455
augggcaagaagcacaagaagcacaagagcgacaagcaccuguacgaggaguacguggagaagccccugaagcuggugcugaaggugggcggcaacgaggugaccgagcugagcaccggcagcagcggccacgacagcagccuguucgaggacaagaacgaccacgacaagcacaaggacagaaagagaaagaagagaaagaagggcgagaagcagauccccggcgaggagaagggcagaaagagaagaagagugaaggaggacaagaagaagagagacagagacagaguggagaacgaggccgagaaggaccugcagugccacgcccccgugagacuggaccugccccccgagaagccccugaccagcagccuggccaagcaggaggagguggagcagaccccccugcaggaggcccugaaccagcugaugagacagcugcagagaaaggaccccagcgccuucuucagcuuccccgugaccgacuucaucgcccccggcuacagcaugaucaucaagcaccccauggacuucagcaccaugaaggagaagaucaagaacaacgacuaccagagcaucgaggagcugaaggacaacuucaagcugaugugcaccaacgccaugaucuacaacaagcccgagaccaucuacuacaaggccgccaagaagcugcugcacagcggcaugaagauccugagccaggagagaauccagagccugaagcagagcaucgacuucauggccgaccugcagaagaccagaaagcagaaggacggcaccgacaccagccagagcggcgaggacggcggcugcuggcagagagagagagaggacagcggcgacgccgaggcccacgccuucaagagccccagcaaggagaacaagaagaaggacaaggacaugcuggaggacaaguucaagagcaacaaccuggagagagagcaggagcagcuggacagaaucgugaaggagagcggcggcaagcugaccagaagacuggugaacagccagugcgaguucgagagaagaaagcccgacggcaccaccacccugggccugcugcaccccguggaccccaucgugggcgagcccggcuacugccccgugagacugggcaugaccaccggcagacugcagagcggcgugaacacccugcagggcuucaaggaggacaagagaaacaaggugacccccgugcuguaccugaacuacggccccuacagcagcuacgccccccacuacgacagcaccuucgccaacaucagcaaggacgacagcgaccugaucuacagcaccuacggcgaggacagcgaccugcccagcgacuucagcauccacgaguuccuggccaccugccaggacuaccccuacgugauggccgacagccugcuggacgugcugaccaagggcggccacagcagaacccugcaggagauggagaugagccugcccgaggacgagggccacaccagaacccuggacaccgccaaggagauggagcagaucaccgagguggagccccccggcagacuggacagcagcacccaggacagacugaucgcccugaaggccgugaccaacuucggcgugcccguggagguguucgacagcgaggaggccgagaucuuccagaagaagcuggacgagaccaccagacugcugagagagcugcaggaggcccagaacgagagacugagcaccagacccccccccaacaugaucugccugcugggccccagcuacagagagaugcaccuggccgagcaggugaccaacaaccugaaggagcuggcccagcaggugacccccggcgacaucgugagcaccuacggcgugagaaaggccaugggcaucagcauccccagccccgugauggagaacaacuucguggaccugaccgaggacaccgaggagcccaagaagaccgacguggccgagugcggccccggcggcagcuaa

SEQ ID NO: 14292 - RNA, 2601 nt, Artificial Sequence
  BRD8__Homo_sapiens__NP_001157798
auggccaccggcaccggcaagcacaagcugcugagcaccggccccaccgagcccuggagcaucagagagaagcugugccuggccagcagcgugaugagaagcggcgaccagaacugggugagcgugagcagagccaucaagcccuucgccgagcccggcagaccccccgacugguucagccagaagcacugcgccagccaguacagcgagcugcuggagaccaccgagacccccaagagaaagagaggcgagaagggcgaggugguggagaccguggaggacgugaucgugagaaagcugaccgccgagagaguggaggagcugaagaaggugaucaaggagacccaggagagauacagaagacugaagagagacgccgagcugauccaggccggccacauggacagcagacuggacgagcugugcaacgacaucgccaccaagaagaagcuggaggaggaggaggccgaggugaagagaaaggccaccgacgccgccuaccaggccagacaggccgugaagaccccccccagaagacugcccaccgugauggugagaagccccaucgacagcgccagccccggcggcgacuacccccugggcgaccugacccccaccaccauggaggaggccaccagcggcgugacccccggcacccugcccagcacccccgugaccagcuuccccggcauccccgacacccugccccccggcagcgccccccuggaggcccccaugacccccgugaccgacgacagcccccagaagaagaugcugggccagaaggccacccccccccccagcccccugcugagcgagcugcugaagaagggcagccugcugcccaccagccccagacuggugaacgagagcgagauggccguggccagcggccaccugaacagcaccggcgugcugcuggaggugggcggcgugcugcccaugauccacggcggcgagauccagcagacccccaacaccguggccgccagccccgccgccagcgugagccagcccgacaacugcgugcccauggaggccgugggcgacccccacaccgugaccgugagcauggacagcagcgagaucagcaugaucaucaacagcaucaaggaggagugcuucagaagcggcguggccgaggcccccgugggcagcaaggcccccagcaucgacggcaaggaggagcuggaccuggccgagaagauggacaucgccgugagcuacaccggcgaggagcuggacuucgagaccgugggcgacaucaucgccaucaucgaggacaagguggacgaccaccccgaggugcuggacguggccgccguggaggccgcccugagcuucugcgaggagaacgacgacccccagagccugcccggccccugggagcaccccauccagcaggagagagacaagcccgugccccugcccgcccccgagaugaccgugaagcaggagagacuggacuucgaggagaccgagaacaagggcauccacgagcugguggacaucagagagcccagcgccgagaucaagguggagcccgccgagcccgagcccgugaucagcggcgccgagaucguggccggcguggugcccgccaccagcauggagccccccgagcugagaagccaggaccuggacgaggagcugggcagcaccgccgccggcgagaucguggaggccgacguggccaucggcaagggcgacgagaccccccugaccaacgugaagaccgaggccagccccgagagcaugcugagccccagccacggcagcaaccccaucgaggacccccuggaggccgagacccagcacaaguucgagaugagcgacagccugaaggaggagagcggcaccaucuucggcagccagaucaaggacgcccccggcgaggacgaggaggaggacggcgugagcgaggccgccagccuggaggagcccaaggaggaggaccagggcgagggcuaccugagcgagauggacaacgagccccccgugagcgagagcgacgacggcuucagcauccacaacgccacccugcagagccacacccuggccgacagcauccccagcagccccgccagcagccaguucagcgugugcagcgaggaccaggaggccauccaggcccagaagaucuggaagaaggccaucaugcugguguggagagccgccgccaaccacagauacgccaacguguuccugcagcccgugaccgacgacaucgcccccggcuaccacagcaucgugcagagacccauggaccugagcaccaucaagaagaacaucgagaacggccugaucagaagcaccgccgaguuccagagagacaucaugcugauguuccagaacgccgugauguacaacagcagcgaccacgacguguaccacauggccguggagaugcagagagacgugcuggagcagauccagcaguuccuggccacccagcugaucaugcagaccagcgagagcggcaucagcgccaagagccugagaggcagagacagcaccagaaagcaggacgccagcgagaaggacggcggcaccagaggcagaagaugcgccaucgaggccgacaugaagaugaagaaguaa

SEQ ID NO: 14293 - RNA, 1248 nt, Artificial Sequence
  BRE__Homo_sapiens__NP_004890
augagccccgagguggcccugaacagaaucagccccaugcugagccccuucaucagcagcguggugagaaacggcaaggugggccuggacgccaccaacugccugagaaucaccgaccugaagagcggcugcaccagccugacccccggccccaacugcgacagauucaagcugcacauccccuacgccggcgagacccugaagugggacaucaucuucaacgcccaguaccccgagcugccccccgacuucaucuucggcgaggacgccgaguuccugcccgaccccagcgcccugcagaaccuggccagcuggaaccccagcaaccccgagugccugcugcugguggugaaggagcuggugcagcaguaccaccaguuccagugcagcagacugagagagagcagcagacugauguucgaguaccagacccugcuggaggagccccaguacggcgagaacauggagaucuacgccggcaagaagaacaacuggaccggcgaguucagcgccagauuccugcugaagcugcccguggacuucagcaacauccccaccuaccugcugaaggacgugaacgaggaccccggcgaggacguggcccugcugagcgugagcuucgaggacaccgaggccacccagguguaccccaagcuguaccugagccccagaaucgagcacgcccugggcggcagcagcgcccugcacauccccgccuuccccggcggcggcugccugaucgacuacgugccccaggugugccaccugcugaccaacaaggugcaguacgugauccagggcuaccacaagagaagagaguacaucgccgccuuccugagccacuucggcaccggcgugguggaguacgacgccgagggcuucaccaagcugacccugcugcugauguggaaggacuucugcuuccuggugcacaucgaccugccccuguucuuccccagagaccagcccacccugaccuuccagagcguguaccacuucaccaacagcggccagcuguacagccaggcccagaagaacuaccccuacagccccagaugggacggcaacgagauggccaagagagccaagggcugccagggcagcagagacgccugcagccccugggagcaggugcuggccuucgccguggccaagaccggcugcaagcugcugcagccccagagaaacuggcccagcagcagaggcccccccuggagagccagcgagggcgagagaaccgcccaguaa

SEQ ID NO: 14294 - RNA, 1755 nt, Artificial Sequence
  BRF1__Homo_sapiens__NP_001229715
auggccgugagcagacaccugaccagaggcagaaagauggcccacgugaucgccgccugccuguaccuggugugcagaaccgagggcaccccccacaugcugcuggaccugagcgaccugcugcaggugaacguguacgugcugggcaagaccuuccugcugcuggccagagagcugugcaucaacgcccccgccaucgaccccugccuguacauccccagauucgcccaccugcuggaguucggcgagaagaaccacgaggugagcaugaccgcccugagacugcugcagagaaugaagagagacuggaugcacaccggcagaagacccagcggccugugcggcgccgcccugcugguggccgccagaaugcacgacuucagaagaaccgugaaggaggugaucagcguggugaaggugugcgagagcacccugagaaagagacugaccgaguucgaggacacccccaccagccagcugaccaucgacgaguucaugaagaucgaccuggaggaggagugcgacccccccagcuacaccgccggccagagaaagcugagaaugaagcagcuggagcaggugcugagcaagaagcuggaggagguggagggcgagaucagcagcuaccaggacgccaucgagaucgagcuggagaacagcagacccaaggccaagggcggccuggccagccuggccaaggacggcagcaccgaggacaccgccagcagccugugcggcgaggaggacaccgaggacgaggagcuggaggccgccgccagccaccugaacaaggaccuguacagagagcugcugggcggcgcccccggcagcagcgaggccgccggcagccccgaguggggcggcagaccccccgcccugggcagccugcuggacccccugcccaccgccgccagccugggcaucagcgacagcaucagagagugcaucagcagccagagcagcgaccccaaggacgccagcggcgacggcgagcuggaccugagcggcaucgacgaccuggagaucgacagaagagaccugagcaugcccagaugcgccaaggccaagagccagccccacuuccccgugcuggcccaguacauccugaacgagagcgaggccagagugaaggccgagcuguggaugagagagaacgccgaguaccugagagagcagagagagaaggaggccagaaucgccaaggagaaggagcugggcaucuacaaggagcacaagcccaagaagagcugcaagagaagagagcccauccaggccagcaccgccagagaggccaucgagaagaugcuggagcagaagaagaucagcagcaagaucaacuacagcgugcugagaggccugagcagcgccggcggcggcagcccccacagagaggacgcccagcccgagcacagcgccagcgccagaaagcugagcagaagaagaacccccgccagcagaagcggcgccgaccccgugaccagcgugggcaagagacugagaccccuggugagcacccagcccgccaagaagguggccaccggcgaggcccugcugcccagcagccccacccugggcgccgagcccgccagaccccaggccgugcugguggagagcggccccgugagcuaccacgccgacgaggaggccgacgaggaggagcccgacgaggaggacggcgagcccugcgugagcgcccugcagaugaugggcagcaacgacuacggcugcgacggcgacgaggacgacggcuacuaa

SEQ ID NO: 14295 - RNA, 1260 nt, Artificial Sequence
  BRF2__Homo_sapiens__NP_060780
augcccggcagaggcagaugccccgacugcggcagcaccgagcugguggaggacagccacuacagccagagccagcuggugugcagcgacugcggcugcguggugaccgagggcgugcugaccaccaccuucagcgacgagggcaaccugagagaggugaccuacagcagaagcaccggcgagaacgagcaggugagcagaagccagcagagaggccugagaagagugagagaccugugcagagugcugcagcugccccccaccuucgaggacaccgccguggccuacuaccagcaggccuacagacacagcggcaucagagccgccagacugcagaagaaggaggugcuggugggcugcugcgugcugaucaccugcagacagcacaacuggccccugaccaugggcgccaucugcacccugcuguacgccgaccuggacguguucagcagcaccuacaugcagaucgugaagcugcugggccuggacgugcccagccugugccuggccgagcuggugaagaccuacugcagcagcuucaagcuguuccaggccagccccagcgugcccgccaaguacguggaggacaaggagaagaugcugagcagaaccaugcagcugguggagcuggccaacgagaccuggcuggugaccggcagacacccccugcccgugaucaccgccgccaccuuccuggccuggcagagccugcagcccgccgacagacugagcugcagccuggccagauucugcaagcuggccaacguggaccugcccuaccccgccagcagcagacugcaggagcugcuggccgugcugcugagaauggccgagcagcuggccuggcugagagugcugagacuggacaagagaagcguggugaagcacaucggcgaccugcugcagcacagacagagccuggugagaagcgccuucagagacggcaccgccgagguggagaccagagagaaggagccccccggcuggggccagggccagggcgagggcgaggugggcaacaacagccugggccugccccagggcaagagacccgccagccccgcccugcugcugccccccugcaugcugaagagccccaagagaaucugccccgugccccccgugagcaccgugaccggcgacgagaacaucagcgacagcgagaucgagcaguaccugagaaccccccaggaggugagagacuuccagagagcccaggccgccagacaggccgccaccagcgugcccaacccccccuaa

SEQ ID NO: 14296 - RNA, 756 nt, Artificial Sequence
  BRI3BP__Homo_sapiens__NP_542193
augggcgccagagccagcggcggcccccuggccagagccggccugcugcugcugcugcugcugcugcugcugcugggccugcuggcccccggcgcccagggcgccagaggcagaggcggcgccgagaagaacagcuacagaagaaccgugaacaccuucagccagagcgugagcagccuguucggcgaggacaacgugagagccgcccagaaguuccuggccagacugaccgagagauucgugcugggcguggacauguucguggagacccuguggaagguguggaccgagcugcuggacgugcugggccuggacgugagcaaccugagccaguacuucagccccgccagcgugagcagcagccccgccagagcccugcugcuggugggcguggugcugcuggccuacugguuccugagccugacccugggcuucaccuucagcgugcugcacgugguguucggcagauucuucuggaucgugagaguggugcuguucagcaugagcugcguguacauccugcacaaguacgagggcgagcccgagaacgccgugcugccccugugcuucgugguggccguguacuucaugaccggccccaugggcuucuacuggagaagcagccccagcggccccagcaaccccagcaaccccagcguggaggagaagcuggagcaccuggagaagcaggugagacugcugaacaucagacugaacagagugcuggagagccuggacagaagcaaggacaaguaa

SEQ ID NO: 14297 - RNA, 297 nt, Artificial Sequence
  BRI3__Homo_sapiens__NP_001152963
auggaccacaagccccugcugcaggagagaccccccgccuacaaccuggaggccggccagggcgacuacgccugcggcccccacggcuacggcgccauccccgccgcccccccccccccccccuaccccuaccuggugaccggcauccccacccaccaccccagaguguacaacauccacagcagaaccgugaccagauaccccgccaacagcaucgugguggugggcggcugccccgugugcagacaccagagaagcagcuggcuguacaccuacccccugagagugugcaccuaa

SEQ ID NO: 14298 - RNA, 2286 nt, Artificial Sequence
  BRINP1__Homo_sapiens__NP_055433
augaacuggagauucguggagcugcuguacuuccuguucaucuggggcagaaucagcgugcagcccagccaccaggagcccgccggcaccgaccagcacgugagcaaggaguucgacuggcugaucagcgacagaggccccuuccaccacagcagaagcuaccugagcuucguggagagacacagacagggcuucaccaccagauacaagaucuacagagaguucgccagauggaaggugagaaacaccgccaucgagagaagagaccuggugagacaccccgugccccugaugcccgaguuccagagaagcaucagacugcugggcagaagacccaccacccagcaguucaucgacaccaucaucaagaaguacggcacccaccugcugaucagcgccacccugggcggcgaggaggcccugaccauguacauggacaagagcagacuggacagaaagagcggcaacgccacccagagcguggaggcccugcaccagcuggccagcagcuacuucguggacagagacggcaccaugagaagacugcacgagauccagaucagcaccggcgccaucaaggugaccgagaccagaaccggcccccugggcugcaacagcuacgacaaccuggacagcgugagcagcgugcugcugcagagcaccgagagcaagcugcaccugcagggccugcagaucaucuucccccaguaccugcaggagaaguucgugcagagcgcccugagcuacaucaugugcaacggcgagggcgaguaccugugccagaacagccagugcagaugccagugcgccgaggaguucccccagugcaacugccccaucaccgacauccagaucauggaguacacccuggccaacauggccaagagcugggccgaggccuacaaggaccuggagaacagcgacgaguucaagagcuucaugaagagacugcccagcaaccacuuccugaccaucggcagcauccaccagcacuggggcaacgacugggaccugcagaacagauacaagcugcugcagagcgccaccgaggcccagagacagaagauccagagaaccgccagaaagcuguucggccugagcgugagaugcagacacaaccccaaccaccagcugcccagagagagaaccauccagcaguggcuggccagagugcagagccugcuguacugcaacgagaacggcuucuggggcaccuuccuggagagccagagaagcugcgugugccacggcagcaccacccugugccagagacccauccccugcgugaucggcggcaacaacagcugcgccaugugcagccuggccaacaucagccugugcggcagcugcaacaagggcuacaagcuguacagaggcagaugcgagccccagaacguggacagcgagagaagcgagcaguucaucagcuucgagaccgaccuggacuuccaggaccuggagcugaaguaccugcugcagaagauggacagcagacuguacgugcacaccaccuucaucagcaacgagaucagacuggacaccuucuucgaccccagauggagaaagagaaugagccugacccugaagagcaacaagaacagaauggacuucauccacauggugaucggcaugagcaugagaaucugccagaugagaaacagcagccuggaccccauguucuucguguacgugaaccccuucagcggcagccacagcgagggcuggaacaugcccuucggcgaguucggcuaccccagaugggagaagaucagacugcagaacagccagugcuacaacuggacccugcugcugggcaacagauggaagaccuucuucgagaccgugcacaucuaccugagaagcagaaccagacugcccacccugcugagaaacgagaccggccagggccccguggaccugagcgaccccagcaagagacaguucuacaucaagaucagcgacgugcagguguucggcuacagccugagauucaacgccgaccugcugagaagcgccgugcagcaggugaaccagagcuacacccagggcggccaguucuacagcagcagcagcgugaugcugcugcugcuggacaucagagacagaaucaacagacuggccccccccguggcccccggcaagccccagcuggaccuguucagcugcaugcugaagcacagacugaagcugaccaacagcgagaucaucagagugaaccacgcccuggaccuguacaacaccgagauccugaagcagagcgaccagaugaccgccaagcugugcuaa

SEQ ID NO: 14299 - RNA, 2352 nt, Artificial Sequence
  BRINP2__Homo_sapiens__NP_066988
augagauggcagugcggcaccagauucagaggccugagacccgccguggcccccuggaccgcccugcuggcccugggccugcccggcugggugcuggccgugagcgccaccgccgccgccguggugcccgagcagcacgccagcguggccggccagcacccccuggacuggcugcugaccgacagaggccccuuccacagagcccaggaguacgccgacuucauggagagauacagacagggcuucaccaccagauacagaaucuacagagaguucgccagauggaaggugaacaaccuggcccuggagagaaaggacuucuucagccugccccugccccuggcccccgaguucaucagaaacaucagacugcugggcagaagacccaaccugcagcaggugaccgagaaccugaucaagaaguacggcacccacuuccugcugagcgccacccugggcggcgaggagagccugaccaucuucguggacaagcagaagcugggcagaaagaccgagaccaccggcggcgccagcaucaucggcggcagcggcaacagcaccgccgugagccuggagacccugcaccagcuggccgccagcuacuucaucgacagagagagcacccugagaagacugcaccacauccagaucgccaccggcgccaucaaggugaccgagaccagaaccggcccccugggcugcagcaacuacgacaaccuggacagcgugagcagcgugcuggugcagagccccgagaacaaggugcagcugcugggccugcaggugcugcugcccgaguaccugagagagagauucguggccgccgcccugagcuacaucaccugcagcagcgagggcgagcuggugugcaaggagaacgacugcuggugcaagugcagccccaccuuccccgagugcaacugccccgacgccgacauccaggccauggaggacagccugcugcagauccaggacagcugggccacccacaacagacaguucgaggagagcgaggaguuccaggcccugcugaagagacugcccgacgacagauuccugaacagcaccgccaucagccaguucugggccauggacaccagccugcagcacagauaccagcagcugggcgccggccugaaggugcuguucaagaagacccacagaauccugagaagacuguucaaccugugcaagagaugccacagacagcccagauucagacugcccaaggagagaagccugagcuacugguggaacagaauccagagccugcuguacugcggcgagagcaccuuccccggcaccuuccuggagcagagccacagcugcaccugccccuacgaccagagcagcugccagggccccauccccugcgcccugggcgagggccccgccugcgcccacugcgcccccgacaacagcaccagaugcggcagcugcaaccccggcuacgugcuggcccagggccugugcagacccgagguggccgagagccuggagaacuuccugggccuggagaccgaccugcaggaccuggagcugaaguaccugcugcagaagcaggacagcagaaucgaggugcacagcaucuucaucagcaacgacaugagacugggcagcugguucgaccccagcuggagaaagagaaugcugcugacccugaagagcaacaaguacaagcccggccuggugcacgugaugcuggcccugagccugcagaucugccugaccaagaacagcacccuggagcccgugauggccaucuacgugaaccccuucggcggcagccacagcgagagcugguucaugcccgugaacgagggcagcuuccccgacugggagagaaccaacguggacgccgccgcccagugccagaacuggaccaucacccugggcaacagauggaagaccuucuucgagaccgugcacguguaccugagaagcagaaucaagagccuggacgacagcagcaacgagaccaucuacuacgagccccuggagaugaccgaccccagcaagaaccugggcuacaugaagaucaacacccugcagguguucggcuacagccugcccuucgaccccgacgccaucagagaccugauccugcagcuggacuaccccuacacccagggcagccaggacagcgcccugcugcagcugaucgagcugagagacagagugaaccagcugagcccccccggcaaggugagacuggaccuguucagcugccugcugagacacagacugaagcuggccaacaacgaggugggcagaauccagagcagccugagagccuucaacagcaagcugcccaaccccguggaguacgagaccggcaagcugugcagcuaa

SEQ ID NO: 14300 - RNA, 2301 nt, Artificial Sequence
  BRINP3__Homo_sapiens__NP_950252
augaucuggagaagcagagccggcgccgagcuguucagccugauggcccugugggaguggaucgcccugagccugcacugcugggugcuggccguggccgccgugagcgaccagcacgccaccagccccuucgacuggcugcugagcgacaagggccccuuccacagaagccaggaguacaccgacuucguggacagaagcagacagggcuucagcaccagauacaagaucuacagagaguucggcagauggaaggugaacaaccuggccguggagagaagaaacuuccugggcagcccccugccccuggcccccgaguucuucagaaacaucagacugcugggcagaagacccacccugcagcagaucaccgagaaccugaucaagaaguacggcacccacuuccugcugagcgccacccugggcggcgaggagagccugaccaucuucguggacaagagaaagcugagcaagagagccgagggcagcgacagcaccaccaacagcagcagcgugacccuggagacccugcaccagcuggccgccagcuacuucaucgacagagacagcacccugagaagacugcaccacauccagaucgccagcaccgccaucaaggugaccgagaccagaaccggcccccugggcugcagcaacuacgacaaccuggacagcgugagcagcgugcuggugcagagccccgagaacaagauccagcugcagggccugcaggugcugcugcccgacuaccugcaggagagauucgugcaggccgcccugagcuacaucgccugcaacagcgagggcgaguucaucugcaaggagaacgacugcuggugccacugcggccccaaguuccccgagugcaacugccccagcauggacauccaggccauggaggagaaccugcugagaaucaccgagaccuggaaggccuacaacagcgacuucgaggagagcgacgaguucaagcuguucaugaagagacugcccaugaacuacuuccugaacaccagcaccaucaugcaccuguggaccauggacagcaacuuccagagaagauacgagcagcuggagaacagcaugaagcagcuguuccugaaggcccagaagaucgugcacaagcuguucagccugagcaagagaugccacaagcagccccugaucagccugcccagacagagaaccagcaccuacuggcugaccagaauccagagcuuccuguacugcaacgagaacggccugcugggcagcuucagcgaggagacccacagcugcaccugccccaacgaccagguggugugcaccgccuuccugcccugcaccgugggcgacgccagcgccugccugaccugcgcccccgacaacagaaccagaugcggcaccugcaacaccggcuacaugcugagccagggccugugcaagcccgagguggccgagagcaccgaccacuacaucggcuucgagaccgaccugcaggaccuggagaugaaguaccugcugcagaagaccgacagaagaaucgaggugcacgccaucuucaucagcaacgacaugagacugaacagcugguucgaccccagcuggagaaagagaaugcugcugacccugaagagcaacaaguacaagagcagccuggugcacaugauccugggccugagccugcagaucugccugaccaagaacagcacccuggagcccgugcuggccguguacgugaaccccuucggcggcagccacagcgagagcugguucaugcccgugaacgagaacagcuuccccgacugggagagaaccaagcuggaccugccccugcagugcuacaacuggacccugacccugggcaacaaguggaagaccuucuucgagaccgugcacaucuaccugagaagcagaaucaagagcaacggccccaacggcaacgagagcaucuacuacgagccccuggaguucaucgaccccagcagaaaccugggcuacaugaagaucaacaacauccagguguucggcuacagcaugcacuucgaccccgaggccaucagagaccugauccugcagcuggacuaccccuacacccagggcagccaggacagcgcccugcugcagcugcuggagaucagagacagagugaacaagcugagcccccccggccagagaagacuggaccuguucagcugccugcugagacacagacugaagcugagcaccagcgagguggugagaauccagagcgcccugcaggccuucaacgccaagcugcccaacaccauggacuacgacaccaccaagcugugcagcuaa

SEQ ID NO: 14301 - RNA, 3750 nt, Artificial Sequence
  BRIP1__Homo_sapiens__NP_114432
augagcagcauguggagcgaguacaccaucggcggcgugaagaucuacuuccccuacaaggccuaccccagccagcuggccaugaugaacagcauccugagaggccugaacagcaagcagcacugccugcuggagagccccaccggcagcggcaagagccuggcccugcugugcagcgcccuggccuggcagcagagccugagcggcaagcccgccgacgagggcgugagcgagaaggccgaggugcagcugagcugcugcugcgccugccacagcaaggacuucaccaacaacgacaugaaccagggcaccagcagacacuucaacuaccccagcaccccccccagcgagagaaacggcaccagcagcaccugccaggacagccccgagaagaccacccuggccgccaagcugagcgccaagaagcaggccagcaucuacagagacgagaacgacgacuuccagguggagaagaagagaaucagaccccuggagaccacccagcagaucagaaagagacacugcuucggcaccgaggugcacaaccuggacgccaagguggacagcggcaagaccgugaagcugaacagcccccuggagaagaucaacagcuucagcccccagaagccccccggccacugcagcagaugcugcugcagcaccaagcagggcaacagccaggagagcagcaacaccaucaagaaggaccacaccggcaagagcaagauccccaagaucuacuucggcaccagaacccacaagcagaucgcccagaucaccagagagcugagaagaaccgccuacagcggcgugcccaugaccauccugagcagcagagaccacaccugcgugcaccccgagguggugggcaacuucaacagaaacgagaagugcauggagcugcuggacggcaagaacggcaagagcugcuacuucuaccacggcgugcacaagaucagcgaccagcacacccugcagaccuuccagggcaugugcaaggccugggacaucgaggagcuggugagccugggcaagaagcugaaggccugccccuacuacaccgccagagagcugauccaggacgccgacaucaucuucugccccuacaacuaccugcuggacgcccagaucagagagagcauggaccugaaccugaaggagcagguggugauccuggacgaggcccacaacaucgaggacugcgccagagagagcgccagcuacagcgugaccgaggugcagcugagauucgccagagacgagcuggacagcauggugaacaacaacaucagaaagaaggaccacgagccccugagagccgugugcugcagccugaucaacuggcuggaggccaacgccgaguaccugguggagagagacuacgagagcgccugcaagaucuggagcggcaacgagaugcugcugacccugcacaagaugggcaucaccaccgccaccuuccccauccugcagggccacuucagcgccgugcugcagaaggaggagaagaucagccccaucuacggcaaggaggaggccagagaggugcccgugaucagcgccagcacccagaucaugcugaagggccuguucauggugcuggacuaccuguucagacagaacagcagauucgccgacgacuacaagaucgccauccagcagaccuacagcuggaccaaccagaucgacaucagcgacaagaacggccugcuggugcugcccaagaacaagaagagaagcagacagaagaccgccgugcacgugcugaacuucuggugccugaaccccgccguggccuucagcgacaucaacggcaaggugcagaccaucgugcugaccagcggcacccugagccccaugaagagcuucagcagcgagcugggcgugaccuucaccauccagcuggaggccaaccacaucaucaagaacagccaggugugggugggcaccaucggcagcggccccaagggcagaaaccugugcgccaccuuccagaacaccgagaccuucgaguuccaggacgaggugggcgcccugcugcugagcgugugccagaccgugagccagggcauccugugcuuccugcccagcuacaagcugcuggagaagcugaaggagagauggcugagcaccggccuguggcacaaccuggagcuggugaagaccgugaucguggagccccagggcggcgagaagaccaacuucgacgagcugcugcagguguacuacgacgccaucaaguacaagggcgagaaggacggcgcccugcugguggccgugugcagaggcaaggugagcgagggccuggacuucagcgacgacaacgccagagccgugaucaccaucggcauccccuuccccaacgugaaggaccugcagguggagcugaagagacaguacaacgaccaccacagcaagcugagaggccugcugcccggcagacagugguacgagauccaggccuacagagcccugaaccaggcccugggcagaugcaucagacacagaaacgacuggggcgcccugauccugguggacgacagauucagaaacaaccccagcagauacaucagcggccugagcaagugggugagacagcagauccagcaccacagcaccuucgagagcgcccuggagagccuggccgaguucagcaagaagcaccagaaggugcugaacgugagcaucaaggacagaaccaacauccaggacaacgagagcacccuggaggugaccagccugaaguacagcaccagccccuaccugcuggaggccgccagccaccugagccccgagaacuucguggaggacgaggccaagaucugcgugcaggagcugcagugccccaagaucaucaccaagaacagcccccugcccagcagcaucaucagcagaaaggagaagaacgaccccguguuccuggaggaggccggcaaggccgagaagaucgugaucagcagaagcaccagccccaccuucaacaagcagaccaagagagugagcuggagcagcuucaacagccugggccaguacuucaccggcaagauccccaaggccacccccgagcugggcagcagcgagaacagcgccagcagcccccccagauucaagaccgagaagauggagagcaagaccgugcugcccuucaccgacaagugcgagagcagcaaccugaccgugaacaccagcuucggcagcugcccccagagcgagaccaucaucagcagccugaagaucgacgccacccugaccagaaagaaccacagcgagcacccccugugcagcgaggaggcccuggaccccgacaucgagcugagccuggugagcgaggaggacaagcagagcaccagcaacagagacuucgagaccgaggccgaggacgagagcaucuacuucacccccgagcuguacgaccccgaggacaccgacgaggagaagaacgaccuggccgagaccgacagaggcaacagacuggccaacaacagcgacugcauccuggccaaggaccuguucgagaucagaaccaucaaggagguggacagcgccagagaggugaaggccgaggacugcaucgacaccaagcugaacggcauccugcacaucgaggagagcaagaucgacgacaucgacggcaacgugaagaccaccuggaucaacgagcuggagcugggcaagacccacgagaucgagaucaagaacuucaagcccagccccagcaagaacaagggcauguuccccggcuucaaguaa

SEQ ID NO: 14302 - RNA, 228 nt, Artificial Sequence
  BRK1__Homo_sapiens__NP_060932
auggccggccaggaggaccccgugcagagagagauccaccaggacugggccaacagagaguacaucgagaucaucaccagcagcaucaagaagaucgccgacuuccugaacagcuucgacaugagcugcagaagcagacuggccacccugaacgagaagcugaccgcccuggagagaagaaucgaguacaucgaggccagagugaccaagggcgagacccugaccuaa

SEQ ID NO: 14303 - RNA, 873 nt, Artificial Sequence
  BRMS1__Homo_sapiens__NP_001020128
augcccgugcagccccccagcaaggacaccgaggagauggaggccgagggcgacagcgccgccgagaugaacggcgaggaggaggagagcgaggaggagagaagcggcagccagaccgagagcgaggaggagagcagcgagauggacgacgaggacuacgagagaagaagaagcgagugcgugagcgagaugcuggaccuggagaagcaguucagcgagcugaaggagaagcuguucagagagagacugagccagcugagacugagacuggaggaggugggcgccgagagagcccccgaguacaccgagccccugggcggccugcagagaagccugaagaucagaauccagguggccggcaucuacaagggcuucugccuggacgugaucagaaacaaguacgagugcgagcugcagggcgccaagcagcaccuggagagcgagaagcugcugcuguacgacacccugcagggcgagcugcaggagagaauccagagacuggaggaggacagacagagccuggaccugagcagcgaguggugggacgacaagcugcacgccagaggcagcagcagaagcugggacagccugccccccagcaagagaaagaaggccccccuggugagcggccccuacaucguguacaugcugcaggagaucgacauccuggaggacuggaccgccaucaagaaggccagagccgccgugagcccccagaagagaaagagcgacgacagaagaacccacagaccccugagagugugccccgccagacugcuguggugcugcugggcccugccccugcaccuggcccuggccuggacccccccccugcccagcagcagacccgcccagcuguggcccuggagcuaa

SEQ ID NO: 14304 - RNA, 972 nt, Artificial Sequence
  BRMS1L__Homo_sapiens__NP_115728
augcccgugcacagcagaggcgacaagaaggagaccaaccaccacgacgagauggagguggacuacgccgagaacgagggcagcagcagcgaggacgaggacaccgagagcagcagcgugagcgaggacggcgacagcagcgagauggacgacgaggacugcgagagaagaagaauggagugccuggacgagaugagcaaccuggagaagcaguucaccgaccugaaggaccagcuguacaaggagagacugagccagguggacgccaagcugcaggaggugaucgccggcaaggcccccgaguaccuggagccccuggccacccugcaggagaacaugcagaucagaaccaagguggccggcaucuacagagagcugugccuggagagcgugaagaacaaguacgagugcgagauccaggccagcagacagcacugcgagagcgagaagcugcugcuguacgacaccgugcagagcgagcuggaggagaagaucagaagacuggaggaggacagacacagcaucgacaucaccagcgagcuguggaacgacgagcugcagagcagaaagaagagaaaggaccccuucagccccgacaagaagaagcccgugguggugagcggccccuacaucguguacaugcugcaggaccuggacauccuggaggacuggaccaccaucagaaaggccauggccacccugggcccccacagagugaagaccgagccccccgugaagcuggagaagcaccugcacagcgccagaagcgaggagggcagacuguacuacgacggcgagugguacaucagaggccagaccaucugcaucgacaagaaggacgagugccccaccagcgccgugaucaccaccaucaaccacgacgaggugugguucaagagacccgacggcagcaagagcaagcuguacaucagccagcugcagaagggcaaguacagcaucaagcacagcuaa

SEQ ID NO: 14305 - RNA, 1200 nt, Artificial Sequence
  BRS3__Homo_sapiens__NP_001718
auggcccagagacagccccacagccccaaccagacccugaucagcaucaccaacgacaccgagagcagcagcagcguggugagcaacgacaacaccaacaagggcuggagcggcgacaacagccccggcaucgaggcccugugcgccaucuacaucaccuacgccgugaucaucagcgugggcauccugggcaacgccauccugaucaagguguucuucaagaccaagagcaugcagaccgugcccaacaucuucaucaccagccuggccuucggcgaccugcugcugcugcugaccugcgugcccguggacgccacccacuaccuggccgagggcuggcuguucggcagaaucggcugcaaggugcugagcuucaucagacugaccagcgugggcgugagcguguucacccugaccauccugagcgccgacagauacaaggccguggugaagccccuggagagacagcccagcaacgccauccugaagaccugcgugaaggccggcugcguguggaucgugagcaugaucuucgcccugcccgaggccaucuucagcaacguguacaccuucagagaccccaacaagaacaugaccuucgagagcugcaccagcuaccccgugagcaagaagcugcugcaggagauccacagccugcugugcuuccugguguucuacaucaucccccugagcaucaucagcguguacuacagccugaucgccagaacccuguacaagagcacccugaacauccccaccgaggagcagagccacgccagaaagcagaucgagagcagaaagagaaucgccagaaccgugcuggugcugguggcccuguucgcccugugcuggcugcccaaccaccugcuguaccuguaccacagcuucaccagccagaccuacguggaccccagcgccaugcacuucaucuucaccaucuucagcagagugcuggccuucagcaacagcugcgugaaccccuucgcccuguacuggcugagcaagagcuuccagaagcacuucaaggcccagcuguucugcugcaaggccgagagacccgagccccccguggccgacaccagccugaccacccuggccgugaugggcaccgugcccggcaccggcagcauccagaugagcgagaucagcgugaccagcuucaccggcugcagcgugaagcaggccgaggacagauucuaa

SEQ ID NO: 14306 - RNA, 2337 nt, Artificial Sequence
  BRSK1__Homo_sapiens__NP_115806
augagcagcggcgccaaggagggcggcggcggcagccccgccuaccaccugccccacccccacccccaccccccccagcacgcccaguacgugggccccuacagacuggagaagacccugggcaagggccagaccggccuggugaagcugggcgugcacugcaucaccggccagaagguggccaucaagaucgugaacagagagaagcugagcgagagcgugcugaugaagguggagagagagaucgccauccugaagcugaucgagcacccccacgugcugaagcugcacgacguguacgagaacaagaaguaccuguaccuggugcuggagcacgugagcggcggcgagcuguucgacuaccuggugaagaagggcagacugacccccaaggaggccagaaaguucuucagacagaucgugagcgcccuggacuucugccacagcuacagcaucugccacagagaccugaagcccgagaaccugcugcuggacgagaagaacaacaucagaaucgccgacuucggcauggccagccugcaggugggcgacagccugcuggagaccagcugcggcagcccccacuacgccugccccgaggugaucaagggcgagaaguacgacggcagaagagccgacauguggagcugcggcgugauccuguucgcccugcuggugggcgcccugcccuucgacgacgacaaccugagacagcugcuggagaaggugaagagaggcguguuccacaugccccacuucaucccccccgacugccagagccugcugagaggcaugaucgagguggagcccgagaagagacugagccuggagcagauccagaagcaccccugguaccugggcggcaagcacgagcccgaccccugccuggagcccgcccccggcagaagaguggccaugagaagccugcccagcaacggcgagcuggaccccgacgugcuggagagcauggccagccugggcugcuucagagacagagagagacugcacagagagcugagaagcgaggaggagaaccaggagaagaugaucuacuaccugcugcuggacagaaaggagagauaccccagcugcgaggaccaggaccugccccccagaaacgacguggacccccccagaaagagaguggacagccccaugcugagcagacacggcaagagaagacccgagagaaagagcauggaggugcugagcaucaccgacgccggcggcggcggcagccccgugcccaccagaagagcccuggagauggcccagcacagccagagaagcagaagcgugagcggcgccagcaccggccugagcagcagcccccugagcagccccagaagccccguguucagcuucagccccgagcccggcgccggcgacgaggccagaggcggcggcagccccaccagcaagacccagacccugcccagcagaggccccagaggcggcggcgccggcgagcagccccccccccccagcgccagaagcaccccccugcccggcccccccggcagccccagaagcagcggcggcaccccccugcacagcccccugcacacccccagagccagccccaccggcacccccggcaccacccccccccccagccccggcggcggcgugggcggcgccgccuggagaagcagacugaacagcaucagaaacagcuuccugggcagccccagauuccacagaagaaagaugcaggugcccaccgccgaggagaugagcagccugacccccgagagcagccccgagcuggccaagagaagcugguucggcaacuucaucagccuggacaaggaggagcagaucuuccuggugcugaaggacaagccccugagcagcaucaaggccgacaucgugcacgccuuccugagcauccccagccugagccacagcgugcugagccagaccagcuucagagccgaguacaaggccagcggcggccccagcguguuccagaagcccgugagauuccagguggacaucagcagcagcgagggccccgagcccagccccagaagagacggcagcggcggcggcggcaucuacagcgugaccuucacccugaucagcggccccagcagaagauucaagagagugguggagaccauccaggcccagcugcugagcacccacgaccagcccagcgugcaggcccuggccgacgagaagaacggcgcccagaccagacccgccggcgccccccccagaagccugcagcccccccccggcagacccgaccccgagcugagcagcagccccagaagaggcccccccaaggacaagaagcugcuggccaccaacggcaccccccugcccuaa

SEQ ID NO: 14307 - RNA, 2211 nt, Artificial Sequence
  BRSK2__Homo_sapiens__NP_001243556
augaccagcaccggcaaggacggcggcgcccagcacgcccaguacgugggccccuacagacuggagaagacccugggcaagggccagaccggccuggugaagcugggcgugcacugcgugaccugccagaagguggccaucaagaucgugaacagagagaagcugagcgagagcgugcugaugaagguggagagagagaucgccauccugaagcugaucgagcacccccacgugcugaagcugcacgacguguacgagaacaagaaguaccuguaccuggugcuggagcacgugagcggcggcgagcuguucgacuaccuggugaagaagggcagacugacccccaaggaggccagaaaguucuucagacagaucaucagcgcccuggacuucugccacagccacagcaucugccacagagaccugaagcccgagaaccugcugcuggacgagaagaacaacaucagaaucgccgacuucggcauggccagccugcaggugggcgacagccugcuggagaccagcugcggcagcccccacuacgccugccccgaggugaucagaggcgagaaguacgacggcagaaaggccgacguguggagcugcggcgugauccuguucgcccugcuggugggcgcccugcccuucgacgacgacaaccugagacagcugcuggagaaggugaagagaggcguguuccacaugccccacuucaucccccccgacugccagagccugcugagaggcaugaucgagguggacgccgccagaagacugacccuggagcacauccagaagcacaucugguacaucggcggcaagaacgagcccgagcccgagcagcccauccccagaaaggugcagaucagaagccugcccagccuggaggacaucgaccccgacgugcuggacagcaugcacagccugggcugcuucagagacagaaacaagcugcugcaggaccugcugagcgaggaggagaaccaggagaagaugaucuacuuccugcugcuggacagaaaggagagauaccccagccaggaggacgaggaccugccccccagaaacgagaucgacccccccagaaagagaguggacagccccaugcugaacagacacggcaagagaagacccgagagaaagagcauggaggugcugagcgugaccgacggcggcagccccgugcccgccagaagagccaucgagauggcccagcacggccagagaagcagaagcaucagcggcgccagcagcggccugagcaccagcccccugagcagccccagagugaccccccaccccagccccagaggcagcccccugcccacccccaagggcacccccgugcacacccccaaggagagccccgccggcacccccaaccccaccccccccagcagccccagcgugggcggcgugcccuggagagccagacugaacagcaucaagaacagcuuccugggcagccccagauuccacagaagaaagcugcaggugcccacccccgaggagaugagcaaccugacccccgagagcagccccgagcuggccaagaagagcugguucggcaacuucaucagccuggagaaggaggagcagaucuucguggugaucaaggacaagccccugagcagcaucaaggccgacaucgugcacgccuuccugagcauccccagccugagccacagcgugaucagccagaccagcuucagagccgaguacaaggccaccggcggccccgccguguuccagaagcccgugaaguuccagguggacaucaccuacaccgagggcggcgaggcccagaaggagaacggcaucuacagcgugaccuucacccugcugagcggccccagcagaagauucaagagagugguggagaccauccaggcccagcugcugagcacccacgacccccccgccgcccagcaccugagcgacaccaccaacugcauggagaugaugaccggcagacugagcaagugcggcagcccccugagcaacuucuucgacgugaucaagcagcuguucagcgacgagaagaacggccaggccgcccaggcccccagcacccccgccaagagaagcgcccacggcccccugggcgacagcgccgccgccggccccggccccggcggcgacgccgaguaccccaccggcaaggacaccgccaagaugggcccccccaccgccagaagagagcagcccuaa

SEQ ID NO: 14308 - RNA, 363 nt, Artificial Sequence
  BRWD1__Homo_sapiens__NP_001007247
auggccgagcccagcagcgccagaagacccgugccccugaucgagagcgagcuguacuuccugaucgccagauaccugagcgccggccccugcagaagagccgcccaggugcuggugcaggagcuggagcaguaccagcugcugcccaagagacuggacugggagggcaacgagcacaacagaagcuacgaggagcuggugcugagcaacaagcacguggcccccgaccaccugcugcagaucugccagagaaucggccccaugcuggacaaggagaucccccccagcaucagcagagugaccagccugcugggcgccggcagacagagccugcugagaaccgccaagggcacccugaucuaa

SEQ ID NO: 14309 - RNA, 5409 nt, Artificial Sequence
  BRWD3__Homo_sapiens__NP_694984
auggccgccgcccccacccagaucgaggccgagcuguacuaccugaucgccagauuccugcagagcggccccugcaacaagagcgcccaggugcuggugcaggagcuggaggagcaccagcugauccccagaagacuggacugggagggcaaggagcacagaagaagcuucgaggaccugguggccgccaacgcccacaucccccccgacuaccugcugaagaucugcgagagaaucggcccccugcuggacaaggagaucccccagagcgugcccggcgugcagacccugcugggcgugggcagacagagccugcugagagacgccaaggacugcaagagcacccuguggaacggcagcgccuucgccgcccugcacagaggcagaccccccgagcugcccgugaacuacgugaagccccccaacguggugaacaucaccagcgccagacagcugaccggcugcagcagauucggccacaucuuccccagcagcgccuaccagcacaucaagaugcacaagagaauccugggccaccugagcagcguguacugcguggccuucgacagaagcggcagaagaaucuucaccggcagcgacgacugccuggugaagaucugggccaccgacgacggcagacugcuggccacccugagaggccacagcgccgagaucagcgacauggccgugaacuacgagaacacccugaucgccgccggcagcugcgacaagguggugagaguguggugccugagaaccugcgcccccguggccgugcugcagggccacagcgccagcaucaccagcauccaguucugccccagcaccaagggcaccaacagauaccugaccagcaccggcgccgacggcaccaucugcuucuggcaguggcacgugaagaccaugaaguucagagacagacccgugaaguucaccgagagaagcagacccggcgugcagaucagcugcagcagcuucagcagcggcggcauguucaucaccaccggcagcaccgaccacgugaucagaaucuacuaccugggcagcgaggugcccgagaagaucgccgagcuggagagccacaccgacaaggugguggccgugcaguucugcaacaacggcgacagccugagauucgugagcggcagcagagacggcaccgccagaaucuggcaguaccagcagcaggaguggaagagcaucgugcuggacauggccaccaagaugaccggcaacaaccugcccagcggcgaggacaagaucaccaagcugaaggugaccaugguggccugggacagauacgacaccaccgugaucaccgccgugaacaacuuccugcugaagguguggaacagcaucaccggccagcugcugcacacccugagcggccacgacgacgagguguucgugcuggaggcccaccccuucgaccagagaaucauccugagcgccggccacgacggcaacaucuucaucugggaccuggacagaggcaccaagaucagaaacuacuucaacaugaucgagggccagggccacggcgccguguucgacugcaaguucagccccgacggcaaccacuucgccugcaccgacagccacggccaccugcugcuguucggcuucggcugcagcaaguacuacgagaagauccccgaccagauguucuuccacaccgacuacagaccccugaucagagacgccaacaacuacgugcuggacgagcagacccagcaggccccccaccugaugcccccccccuuccugguggacguggacggcaacccccaccccaccaaguuccagagacuggugcccggcagagagaacugcaaggacgagcagcugaucccccagcugggcuacguggccaacggcgacggcgaggugguggagcaggugaucggccagcagaccaacgaccaggacgagagcauccuggacggcaucaucagagagcugcagagagagcaggaccugagacugaucaacgagggcgacgugccccaccugcccgugaacagagccuacagcgugaacggcgcccugagaagccccaacauggacaucagcagcagccccaacaucagacugagaagacacagcagccagaucgagggcgugagacagaugcacaacaacgcccccagaagccagauggccaccgagagagaccugauggccuggagcagaagagugguggugaacgagcugaacaacggcgugagcagagugcaggaggagugcagaaccgccaagggcgacaucgagaucagccuguacaccguggagaagaagaagaagcccagcuacaccacccagagaaacgacuacgagcccagcugcggcagaagccugagaagaacccagagaaagagacagcacaccuaccagaccagaagcaacaucgagcacaacagccaggccagcugccagaacagcggcgugcaggaggacagcgacagcagcagcgaggaggacgagaccgugggcaccagcgacgccagcguggaggaccccgugguggaguggcagagcgagagcagcagcagcgacagcagcagcgaguacagcgacuggaccgccgacgccggcaucaaccugcagccccccaagagacagaccagacagaccaccagaaagaucugcagcagcagcgacgaggagaaccugaagagccuggaggagagacagaagaagcccaagcagaccagaaagaagaagggcggccuggugagcaucgccggcgagcccaacgaggagugguucgccccccaguggauccuggacaccauccccagaagaagccccuucgugccccagaugggcgacgagcugaucuacuucagacagggccacgaggccuacgugagagccgugagaaagagcaagaucuacagcgugaaccugcagaagcagcccuggaacaagauggaccugagagagcaggaguucgugaagaucgugggcaucaaguacgaggugggcccccccacccugugcugccugaagcuggccuuccuggaccccaucagcggcaagaugaccggcgagagcuucagcaucaaguaccacgacaugcccgacgugaucgacuuccuggugcugcaccaguucuacaacgaggccaaggagagaaacuggcagaucggcgacagauucagaagcaucaucgacgacgccuggugguucggcaccguggagagccagcagcccuuccagcccgaguaccccgacagcagcuuccagugcuacagcgugcacugggacaacaacgagagagagaagaugagccccugggacauggagcccauccccgagggcaccgccuuccccgacgaggugggcgccggcgugcccgugagccaggaggagcugaccgcccugcuguacaagccccaggagggcgaguggggcgcccacagcagagacgaggagugcgagagagugauccagggcaucaaccaccugcugagccuggacuucgccagccccuucgccgugcccguggaccugagcgccuacccccuguacugcaccgugguggccuaccccaccgaccugaacaccaucagaagaagacuggagaacagauucuacagaagaaucagcgcccugaugugggaggugagauacaucgagcacaacgccagaaccuucaacgagcccgacagccccaucgugaaggccgccaagaucgugaccgacgugcugcugagauucaucggcgaccagagcugcaccgacauccuggacaccuacaacaagaucaaggccgaggagagaaacagcaccgacgccgaggaggacaccgagaucguggaccuggacagcgacggccccggcaccagcagcggcagaagagugaagugcagaggcagaagacagagccugaagugcaaccccgacgccuggaagaagcagugcaaggagcugcugagccugaucuacgagagagaggacagcgagcccuucagacagcccgccgaccugcugagcuaccccggccaccaggagcaggagggcgagagcagcgagagcguggugcccgagagacagcaggacagcagccugagcgaggacuaccaggacgugaucgacacccccguggacuucagcaccgugaaggagacccuggaggccggcaacuacggcagcccccuggaguucuacaaggacgugagacagaucuucaacaacagcaaggccuacaccagcaacaagaagagcagaaucuacagcaugaugcugagacugagcgcccuguucgagagccacaucaagaacaucaucagcgaguacaagagcgccauccagagccagaagagaagaagacccagauacagaaagagacugagaagcagcagcagcagccugagcagcagcggcgcccccagccccaagggcaagcagaagcagaugaagcugcagcccaagaacgaccagaacaccagcgugagccacgccagaaccagcagccccuucagcagccccgugagcgacgccgccgagggccugagccuguaccugcuggacgacgagcccgacggccccuucagcagcagcagcuucggcggcuacagcagaagcggcaacagccacgaccccggcaaggccaagagcuucagaaacagagugcugcccgugaagcaggaccacagccuggacggcccccugaccaacggcgacggcagagagcccagaaccggcaucaagagaaagcugcugagcgccagcgaggaggacgagaacaugggcggcgaggacaaggagaagaaggagaccaaggagaagagccaccugagcaccagcgagagcggcgagcugggcagcagccugagcagcgagagcaccugcggcagcgacagcgacagcgagagcaccagcagaaccgaccaggacuacguggacggcgaccacgacuacagcaaguucauccagaccagacccaagagaaagcugagaaagcagcacggcaacggcaagagaaacuggaagaccagaggcaccggcggcagaggcagauggggcagauggggcagauggagcagaggcggcagaggcagaggcggcagaggcagaggcagcagaggcagaggcggcggcggcaccagaggcagaggcagaggcagaggcggcagaggcgccagcagaggcgccaccagagccaagagagccagaaucgccgacgacgaguucgacaccauguucagcggcagauucagcagacugcccagaaucaagaccagaaaccagggcagaagaaccgugcuguacaacgacgacagcgacaacgacaacuucgugagcaccgaggacccccugaaccugggcaccagcagaagcggcagagugagaaagaugaccgagaaggccagagugagccaccugaugggcuggaacuacuaa

SEQ ID NO: 14310 - RNA, 1389 nt, Artificial Sequence
  BSCL2__Homo_sapiens__NP_001116427
augagcaccgagaagguggaccagaaggaggaggccggcgagaaggaggugugcggcgaccagaucaagggccccgacaaggaggaggagccccccgccgccgccagccacggccagggcuggagacccggcggcagagccgccagaaacgccagacccgagcccggcgccagacaccccgcccugcccgccauggugaacgacccccccgugcccgcccugcugugggcccaggaggugggccaggugcuggccggcagagccagaagacugcugcugcaguucggcgugcuguucugcaccauccugcugcugcugugggugagcguguuccuguacggcagcuucuacuacagcuacaugcccaccgugagccaccugagccccgugcacuucuacuacagaaccgacugcgacagcagcaccaccagccugugcagcuuccccguggccaacgugagccugaccaagggcggcagagacagagugcugauguacggccagcccuacagagugacccuggagcuggagcugcccgagagccccgugaaccaggaccugggcauguuccuggugaccaucagcugcuacaccagaggcggcagaaucaucagcaccagcagcagaagcgugaugcugcacuacagaagcgaccugcugcagaugcuggacacccugguguucagcagccugcugcuguucggcuucgccgagcagaagcagcugcuggagguggagcuguacgccgacuacagagagaacagcuacgugcccaccaccggcgccaucaucgagauccacagcaagagaauccagcuguacggcgccuaccugagaauccacgcccacuucaccggccugagauaccugcuguacaacuuccccaugaccugcgccuucaucggcguggccagcaacuucaccuuccugagcgugaucgugcuguucagcuacaugcaguggguguggggcggcaucuggcccagacacagauucagccugcaggugaacaucagaaagagagacaacagcagaaaggaggugcagagaagaaucagcgcccaccagcccggccccgagggccaggaggagagcaccccccagagcgacgugaccgaggacggcgagagccccgaggaccccagcggcaccgagggccagcugagcgaggaggagaagcccgaccagcagccccugagcggcgaggaggagcuggagcccgaggccagcgacggcagcggcagcugggaggacgccgcccugcugaccgaggccaaccugcccgcccccgcccccgccagcgccagcgcccccgugcuggagacccugggcagcagcgagcccgccggcggcgcccugagacagagacccaccugcagcagcagcuaa

SEQ ID NO: 14311 - RNA, 1158 nt, Artificial Sequence
  BSG__Homo_sapiens__NP_001719
auggccgccgcccuguucgugcugcugggcuucgcccugcugggcacccacggcgccagcggcgccgccggcuucgugcaggccccccugagccagcagagaugggugggcggcagcguggagcugcacugcgaggccgugggcagccccgugcccgagauccaguggugguucgagggccagggccccaacgacaccugcagccagcugugggacggcgccagacuggacagagugcacauccacgccaccuaccaccagcacgccgccagcaccaucagcaucgacacccugguggaggaggacaccggcaccuacgagugcagagccagcaacgaccccgacagaaaccaccugaccagagcccccagagugaagugggugagagcccaggccguggugcuggugcuggagcccggcaccguguucaccaccguggaggaccugggcagcaagauccugcugaccugcagccugaacgacagcgccaccgaggugaccggccacagauggcugaagggcggcguggugcugaaggaggacgcccugcccggccagaagaccgaguucaagguggacagcgacgaccaguggggcgaguacagcugcguguuccugcccgagcccaugggcaccgccaacauccagcugcacggcccccccagagugaaggccgugaagagcagcgagcacaucaacgagggcgagaccgccaugcuggugugcaagagcgagagcgugccccccgugaccgacugggccugguacaagaucaccgacagcgaggacaaggcccugaugaacggcagcgagagcagauucuucgugagcagcagccagggcagaagcgagcugcacaucgagaaccugaacauggaggccgaccccggccaguacagaugcaacggcaccagcagcaagggcagcgaccaggccaucaucacccugagagugagaagccaccuggccgcccuguggcccuuccugggcaucguggccgaggugcuggugcuggugaccaucaucuucaucuacgagaagagaagaaagcccgaggacgugcuggacgacgacgacgccggcagcgccccccugaagagcagcggccagcaccagaacgacaagggcaagaacgugagacagagaaacagcagcuaa

SEQ ID NO: 14312 - RNA, 11781 nt, Artificial Sequence
  BSN__Homo_sapiens__NP_003449
augggcaacgaggugagccuggagggcggcgccggcgacggcccccugccccccggcggcgccggccccggccccggccccggccccggccccggcgccggcaagccccccagcgcccccgccggcggcggccagcugcccgccgccggcgccgccagaagcaccgccgugccccccgugcccggccccggccccggccccggccccggccccggccccggcagcaccagcagaagacuggaccccaaggagccccugggcaaccagagagccgccagccccacccccaagcaggccagcgccaccacccccggccacgagagccccagagagaccagagcccagggccccgccggccaggaggccgacggccccagaagaacccugcagguggacagcagaacccagagaagcggcagaagccccagcgugagccccgacagaggcagcacccccaccagccccuacagcgugccccagaucgccccccugcccagcagcacccugugccccaucugcaagaccagcgaccugaccagcacccccagccagcccaacuucaacaccugcacccagugccacaacaaggugugcaaccagugcggcuucaaccccaacccccaccugacccaggugaaggaguggcugugccugaacugccagaugcagagagcccugggcauggacaugaccaccgcccccagaagcaagagccagcagcagcugcacagccccgcccugagccccgcccacagccccgccaagcagccccugggcaagcccgaccaggagagaagcagaggccccggcggcccccagcccggcagcagacaggccgagaccgccagagccaccagcgugcccggccccgcccaggccgccgccccccccgaggugggcagagugagcccccagcccccccagcccaccaagcccagcaccgccgagcccagaccccccgccggcgaggcccccgccaagagcgccaccgccgugcccgccggccugggcgccaccgagcagacccaggagggccugaccggcaagcuguucggccugggcgccagccugcugacccaggccagcacccugaugagcgugcagcccgaggccgacacccagggccagcccgcccccagcaagggcacccccaagaucguguucaacgacgccagcaaggaggccggccccaagccccugggcagcggccccggccccggccccgcccccggcgccaagaccgagcccggcgccagaaugggccccggcagcggccccggcgcccugcccaagaccggcggcaccaccagccccaagcacggcagagccgagcaccaggccgccagcaaggccgccgccaagcccaagaccaugcccaaggagagagccaucugcccccugugccaggccgagcugaacgugggcagcaagagccccgccaacuacaacaccugcaccaccugcagacugcaggugugcaaccugugcggcuucaaccccaccccccaccugguggagaagaccgaguggcugugccugaacugccagaccaagagacugcuggagggcagccugggcgagcccaccccccugcccccccccaccagccagcagccccccgugggcgccccccacagagccagcggcaccagcccccugaagcagaagggcccccagggccugggccagcccagcggcccccugcccgccaaggccagcccccugagcaccaaggccagcccccugcccagcaaggccagcccccaggccaagccccugagagccagcgagcccagcaagacccccagcagcgugcaggagaagaagaccagagugcccaccaaggccgagcccaugcccaagcccccccccgagaccacccccacccccgccacccccaaggugaagagcggcgugagaagagccgagcccgccacccccguggugaaggccgugcccgaggcccccaagggcggcgaggccgaggaccuggugggcaagcccuacagccaggacgccagcagaagcccccagagccugagcgacaccggcuacagcagcgacggcaucagcagcagccagagcgagaucaccggcguggugcagcaggagguggagcagcuggacagcgccggcgugaccggcccccacccccccagccccagcgagauccacaaggugggcagcagcaugagaccccugcugcaggcccagggccuggcccccagcgagagaagcaagccccugagcagcggcaccggcgaggagcagaagcagagaccccacagccugagcaucacccccgaggccuucgacagcgacgaggagcuggaggacauccuggaggaggacgaggacagcgccgaguggagaagaagaagagagcagcaggacaccgccgagagcagcgacgacuucggcagccagcugagacacgacuacguggaggacagcagcgagggcggccugagcccccugcccccccagccccccgccagagccgccgagcugaccgacgaggacuucaugagaagacagauccuggagaugagcgccgaggaggacaaccuggaggaggacgacaccgccaccagcggcagaggccuggccaagcacggcacccagaagggcggccccagacccagacccgagcccagccaggagcccgccgcccugcccaagagaagacugccccacaacgccaccaccggcuacgaggagcugcugcccgagggcggcagcgccgaggccaccgacggcagcggcacccugcagggcggccugagaagauucaagaccaucgagcugaacagcaccggcagcuacggccacgagcuggaccugggccagggccccgaccccagccuggacagagagcccgagcuggagauggagagccugaccggcagccccgaggacagaagcagaggcgagcacagcagcacccugcccgccagcacccccagcuacaccagcggcaccagccccaccagccugagcagccuggaggaggacagcgacagcagccccagcagaagacagagacuggaggaggccaagcagcagagaaaggccagacacagaagccacggcccccugcugcccaccaucgaggacagcagcgaggaggaggagcugagagaggaggaggagcugcugagagagcaggagaagaugagagagguggagcagcagagaaucagaagcaccgccagaaagaccagaagagacaaggaggagcugagagcccagagaagaagagagagaagcaagaccccccccagcaaccugagccccaucgaggacgccagccccaccgaggagcugagacaggccgccgagauggaggagcugcacagaagcagcugcagcgaguacagccccagccccagccuggacagcgaggccgaggcccuggacggcggccccagcagacuguacaagagcggcagcgaguacaaccugcccaccuucaugagccuguacagccccaccgagacccccagcggcagcagcaccacccccagcagcggcagaccccugaagagcgccgaggaggccuacgaggagaugaugagaaaggccgagcugcugcagagacagcagggccaggccgccggcgccagaggcccccacggcggccccagccagcccaccggccccagaggccugggcagcuucgaguaccaggacaccaccgacagagaguacggccaggccgcccagcccgccgccgagggcacccccgccagccugggcgccgccguguacgaggagauccugcagaccagccagagcaucgugagaaugagacaggccagcagcagagaccuggccuucgccgaggacaagaagaaggagaagcaguuccugaacgccgagagcgccuacauggaccccaugaagcagaacggcggcccccugacccccggcaccagccccacccagcuggccgcccccgugagcuucagcacccccaccagcagcgacagcagcggcggcagagugauccccgacgugagagugacccagcacuucgccaaggagacccaggacccccugaagcugcacagcagccccgccagccccagcagcgccagcaaggagaucggcaugcccuucagccagggccccggcacccccgccaccaccgccguggcccccugccccgccggccugcccagaggcuacaugacccccgccagccccgccggcagcgagagaagccccagccccagcagcaccgcccacagcuacggccacagccccaccaccgccaacuacggcagccagaccgaggaccugccccaggcccccagcggccuggccgccgccggcagagccgccagagagaagccccugagcgccagcgacggcgagggcggcaccccccagcccagcagagccuacagcuacuucgccagcagcagccccccccugagccccagcagccccagcgagagccccaccuucagccccggcaagaugggccccagagccaccgccgaguucagcacccagacccccagccccgcccccgccagcgacaugcccagaagccccggcgcccccacccccagccccaugguggcccagggcacccagaccccccacagacccagcacccccagacugguguggcaggagagcagccaggaggcccccuucauggugaucacccuggccagcgacgccagcagccagaccagaauggugcacgccagcgccagcaccagcccccugugcagccccaccgagacccagcccaccacccacggcuacagccagaccaccccccccagcgugagccagcugccccccgagccccccggcccccccggcuuccccagagugcccagcgccggcgccgacggcccccuggcccuguacggcuggggcgcccugcccgccgagaacaucagccugugcagaaucagcagcgugcccggcaccagcagaguggagcccggccccagaacccccggcaccgccgugguggaccugagaaccgccgugaagcccacccccaucauccugaccgaccagggcauggaccugaccagccuggccguggaggccagaaaguacggccuggcccuggaccccauccccggcagacagagcaccgccgugcagccccuggugaucaaccugaacgcccaggagcacaccuuccuggccaccgccaccaccgugagcaucaccauggccagcagcguguucauggcccagcagaagcagcccgugguguacggcgaccccuaccagagcagacuggacuucggccagggcggcggcagccccgugugccuggcccaggugaagcagguggagcaggccgugcagaccgcccccuacagaagcggccccagaggcagacccagagaggccaaguucgccagauacaaccugcccaaccagguggccccccuggccagaagagacgugcugaucacccagaugggcaccgcccagagcaucggccugaagcccggccccgugcccgagcccggcgccgagccccacagagccacccccgccgagcugagaagccacgcccugcccggcgccagaaagccccacaccgugguggugcagaugggcgagggcaccgccggcaccgugaccacccugcugcccgaggagcccgccggcgcccuggaccugaccggcaugagacccgagagccagcuggccugcugcgacaugguguacaagcugcccuucggcagcagcugcaccggcaccuuccaccccgcccccagcgugcccgagaagagcauggccgacgccgccccccccggccagagcagcagccccuucuacggccccagagaccccgagccccccgagccccccaccuacagagcccagggcguggugggccccggcccccacgaggagcagagacccuacccccagggccugcccggcagacuguacagcagcaugagcgacaccaaccuggccgaggccggccugaacuaccacgcccagagaaucggccagcuguuccagggccccggcagagacagcgccauggaccugagcagccugaagcacagcuacagccugggcuucgccgacggcagauaccugggccagggccugcaguacggcagcgugaccgaccugagacaccccaccgaccugcuggcccacccccugcccaugagaagauacagcagcgugagcaacaucuacagcgaccacagauacggccccagaggcgacgccgugggcuuccaggaggccagccuggcccaguacagcgccaccaccgccagagagaucagcagaaugugcgccgcccugaacagcauggaccaguacggcggcagacacggcagcggcggcggcggccccgaccuggugcaguaccagccccagcacggccccggccugagcgccccccagagccuggugccccugagacccggccugcugggcaaccccaccuuccccgagggccaccccagccccggcaaccuggcccaguacggccccgccgccggccagggcaccgccgugagacagcugcugcccagcaccgccaccgugagagccgccgacggcaugaucuacagcaccaucaacacccccaucgccgccacccugcccaucaccacccagcccgccagcgugcugagacccauggugagaggcggcauguacagacccuacgccagcggcggcaucaccgccgugccccugaccagccugaccagagugcccaugaucgcccccagagugccccugggccccaccggccuguacagauaccccgcccccagcagauuccccaucgccagcagcgugccccccgccgagggccccguguaccugggcaagcccgccgccgccaaggcccccggcgccggcggccccagcagacccgagaugcccgugggcgccgccagagaggagccccugcccaccaccacccccgccgccaucaaggaggccgccggcgcccccgcccccgccccccuggccggccagaagccccccgccgacgccgcccccggcggcggcagcggcgcccugagcagacccggcuucgagaaggaggaggccagccaggaggagagacagagaaagcagcaggagcagcugcugcagcuggagagagagagaguggagcuggagaagcugagacagcugagacugcaggaggagcuggagagagagagaguggagcugcagagacacagagaggaggagcagcugcuggugcagagagagcugcaggagcugcagaccaucaagcaccacgugcugcagcagcagcaggaggagagacaggcccaguucgcccugcagagagagcagcuggcccagcagagacugcagcuggagcagauccagcagcugcagcagcagcugcagcagcagcuggaggagcagaagcagagacagaaggcccccuuccccgccgccugcgaggcccccggcagaggccccccccuggccgccgccgagcuggcccagaacggccaguacuggcccccccugacccacgccgccuucaucgccauggccggccccgagggccugggccagcccagagagcccgugcugcacagaggccugcccagcagcgccagcgacaugagccugcagaccgaggagcagugggaggccagcagaagcggcaucaagaagagacacagcaugcccagacugagagacgccugcgagcuggagagcggcaccgagcccugcguggugagaagaaucgccgacagcagcgugcagaccgacgacgaggacggcgagagcagauaccugcugagcagaagaagaagagccagaagaagcgccgacugcagcgugcagaccgacgacgaggacagcgccgagugggagcagcccgugagaagaagaagaagcagacugcccagacacagcgacagcggcagcgacagcaagcacgacgccaccgccagcagcagcagcgccgccgccaccgugagagccaugagcagcgugggcauccagaccaucagcgacugcagcgugcagaccgagcccgaccagcugcccagagugagccccgccauccacaucaccgccgccaccgaccccaagguggagaucgugagauacaucagcgcccccgagaagaccggcagaggcgagagccuggccugccagaccgagcccgacggccaggcccagggcguggccggcccccagcuggugggccccaccgccaucagccccuaccugcccggcauccagaucgugacccccggcccccugggcagauucgagaagaagaagcccgacccccuggagaucggcuaccaggcccaccugccccccgagagccugagccagcuggugagcagacagccccccaagagcccccaggugcuguacagccccgugagcccccugagcccccacagacugcuggacaccagcuucgccagcagcgagagacugaacaaggcccacgugagcccccagaagcacuucaccgccgacagcgcccugagacagcagacccugcccagacccaugaagacccugcagagaagccugagcgaccccaagccccugagccccaccgccgaggagagcgccaaggagagauucagccuguaccagcaccagggcggccugggcagccaggugagcgcccugccccccaacagccuggugagaaaggugaagagaacccugcccagccccccccccgaggaggcccaccugccccuggccggccaggccagcccccagcuguacgccgccagccugcugcagagaggccugaccggccccaccaccgugcccgccaccaaggccagccugcugagagagcuggacagagaccugagacugguggagcacgagagcaccaagcugagaaagaagcaggccgagcuggacgaggaggagaaggagaucgacgccaagcugaaguaccuggagcugggcaucacccagagaaaggagagccuggccaaggacagaggcggcagagacuaccccccccugagaggccugggcgagcacagagacuaccugagcgacagcgagcugaaccagcugagacugcagggcugcaccacccccgccggccaguucguggacuuccccgccaccgccgccgcccccgccacccccagcggccccaccgccuuccagcagcccagauuccagccccccgccccccaguacagcgccggcagcggcggccccacccagaacggcuuccccgcccaccaggcccccaccuaccccggccccagcaccuaccccgcccccgccuucccccccggcgccagcuaccccgccgagcccggccugcccaaccagcaggccuucagacccaccggccacuacgccggccagacccccaugcccaccacccagagcacccuguuccccgugcccgccgacagcagagccccccugcagaagcccagacagaccagccuggccgaccuggagcagaaggugcccaccaacuacgaggugaucgccagccccguggugcccaugagcagcgcccccagcgagaccagcuacagcggccccgccgugagcagcggcuacgagcagggcaaggugcccgaggugcccagagccggcgacagaggcagcgugagccagagccccgcccccaccuaccccagcgacagccacuacaccagccuggagcagaacgugcccagaaacuacgugaugaucgacgacaucagcgagcugaccaaggacagcaccagcaccgcccccgacagccagagacuggagccccugggccccggcagcagcggcagacccggcaaggagcccggcgagcccggcgugcuggacggccccacccugcccugcugcuacgccagaggcgaggaggagagcgaggaggacagcuacgaccccagaggcaagggcggccaccugagaagcauggagagcaacggcagacccgccagcacccacuacuacggcgacagcgacuacagacacggcgccagaguggagaaguacggccccggccccaugggccccaagcaccccagcaagagccuggcccccgccgccaucagcagcaagagaagcaagcacagaaagcagggcauggagcagaagaucagcaaguucagccccaucgaggaggccaaggacguggagagcgaccuggccagcuaccccccccccgccgugagcagcagccuggugagcagaggcagaaaguuccaggacgagaucaccuacggccugaagaagaacguguacgagcagcagaaguacuacggcaugagcagcagagacgccguggaggacgacagaaucuacggcggcagcagcagaagcagagcccccagcgccuacagcggcgagaagcugagcagccacgacuucagcggcuggggcaagggcuacgagagagagagagaggccguggagagacugcagaaggccggccccaagcccagcagccugagcauggcccacagcagagugagaccccccaugagaagccaggccagcgaggaggagagccccgugagcccccugggcagacccagacccgccggcggcccccugccccccggcggcgacaccugcccccaguucugcagcagccacagcaugcccgacgugcaggagcacgugaaggacggccccagagcccacgccuacaagagagaggagggcuacauccuggacgacagccacugcguggugagcgacagcgaggccuaccaccugggccaggaggagaccgacugguucgacaagcccagagacgccagaagcgacagauucagacaccacggcggccacgccgugagcagcagcagccagaagagaggccccgccagacacagcuaccacgacuacgacgagccccccgaggagggccuguggccccacgacgagggcggccccggcagacacgccagcgccaaggagcacagacacggcgaccacggcagacacagcggcagacacaccggcgaggagcccggcagaagagccgccaagccccacgccagagaccugggcagacacgaggccagaccccacagccagcccagcagcgcccccgccaugcccaagaagggccagcccggcuaccccagcagcgccgaguacagccagcccagcagagccagcagcgccuaccaccacgccagcgacagcaagaagggcagcagacaggcccacagcggccccgccgcccugcagagcaaggccgagccccaggcccagccccagcugcagggcagacaggccgcccccggcccccagcagagccagagccccagcagcagacagauccccagcggcgccgccagcagacagccccagacccagcagcagcagcagggccugggccugcagcccccccagcaggcccugacccaggccagacugcagcagcagagccagcccaccaccagaggcagcgcccccgccgccagccagcccgccggcaagccccagcccggccccagcaccgccaccggcccccagcccgccggcccccccagagccgagcagaccaacggcagcaagggcaccgccaaggccccccagcagggcagagccccccaggcccagcccgcccccggccccggccccgccggcgugaaggccggcgccagacccggcggcacccccggcgcccccgccggccagcccggcgccgacggcgagagcguguucagcaagauccugcccggcggcgccgccgagcaggccggcaagcugaccgaggccgugagcgccuucggcaagaaguucagcagcuucugguaa

SEQ ID NO: 14313 - RNA, 399 nt, Artificial Sequence
  BSPH1__Homo_sapiens__NP_001121798
augggcagccugaugcugcuguucguggagaccaccagaaacagcagcgccugcaucuuccccgugauccugaacgagcugagcagcaccguggagaccaucacccacuuccccgaggugaccgacggcgagugcguguuccccuuccacuacaagaacggcaccuacuacgacugcaucaagagcaaggccagacacaaguggugcagccugaacaagaccuacgagggcuacuggaaguucugcagcgccgaggacuucgccaacugcguguuccccuucugguacagaagacugaucuacugggagugcaccgacgacggcgaggccuucggcaagaaguggugcagccugaccaagaacuucaacaaggacagaaucuggaaguacugcgaguaa

SEQ ID NO: 14314 - RNA, 1209 nt, Artificial Sequence
  BSPRY__Homo_sapiens__NP_060158
augagcgccgagggcgccgagcccggccccggcagcggcagcggccccggccccggcccccugugccccgagcacggccaggcccugagcugguucugcggcagcgagagaagacccgugugcgccgccugcgccggccugggcggcagaugcagaggccacagaaucagaagagccgaggagagagccgaggagcugagaaacaagaucguggaccagugcgagagacugcagcugcagagcgccgccaucaccaaguacguggccgacgugcugcccggcaagaaccagagagccgugagcauggccagcgccgccagagagcuggugauccagagacugagccuggugagaagccugugcgagagcgaggagcagagacugcuggagcaggugcacggcgaggaggagagagcccaccagagcauccugacccagagagugcacugggccgaggcccugcagaagcuggacaccaucagaaccggccuggugggcaugcugacccaccuggacgaccugcagcugauccagaaggagcaggagaucuucgagagaaccgaggaggccgagggcauccuggacccccaggagagcgagaugcugaacuucaacgagaagugcaccagaagcccccugcugacccagcugugggccaccgccgugcugggcagccugagcggcaccgaggacaucagaaucgacgagagaaccgugagccccuuccugcagcugagcgacgacagaaagacccugaccuucagcaccaagaagagcaaggccugcgccgacggccccgagagauucgaccacuggcccaacgcccuggccgccaccagcuuccagaacggccugcacgccuggauggugaacgugcagaacagcugcgccuacaaggugggcguggccagcggccaccugcccagaaagggcagcggcagcgacugcagacugggccacaacgccuucagcuggguguucagcagauacgaccaggaguucagauucagccacaacggccagcacgagccccugggccugcugagaggccccgcccagcugggcguggugcuggaccugcaggugcaggagcugcuguucuacgagcccgccagcggcaccgugcugugcgcccaccacgugagcuuccccggcccccuguuccccguguucgccguggccgaccagaccaucagcaucgugagauaa

SEQ ID NO: 14315 - RNA, 957 nt, Artificial Sequence
  BST1__Homo_sapiens__NP_004325
auggccgcccagggcugcgccgccagcagacugcugcagcugcugcugcagcugcugcugcugcugcugcugcuggccgccggcggcgccagagccagauggagaggcgagggcaccagcgcccaccugagagacaucuuccugggcagaugcgccgaguacagagcccugcugagccccgagcagagaaacaagaacugcaccgccaucugggaggccuucaagguggcccuggacaaggaccccugcagcgugcugcccagcgacuacgaccuguucaucaaccugagcagacacagcauccccagagacaagagccuguucugggagaacagccaccugcuggugaacagcuucgccgacaacaccagaagauucaugccccugagcgacgugcuguacggcagaguggccgacuuccugagcuggugcagacagaagaacgacagcggccuggacuaccagagcugccccaccagcgaggacugcgagaacaaccccguggacagcuucuggaagagagccagcauccaguacagcaaggacagcagcggcgugauccacgugaugcugaacggcagcgagcccaccggcgccuaccccaucaagggcuucuucgccgacuacgagauccccaaccugcagaaggagaagaucaccagaaucgagaucugggugaugcacgagaucggcggccccaacguggagagcugcggcgagggcagcaugaaggugcuggagaagagacugaaggacaugggcuuccaguacagcugcaucaacgacuacagacccgugaagcugcugcagugcguggaccacagcacccaccccgacugcgcccugaagagcgccgccgccgccacccagagaaaggcccccagccuguacaccgagcagagagccggccugaucaucccccuguuccuggugcuggccagcagaacccagcuguaa

SEQ ID NO: 14316 - RNA, 543 nt, Artificial Sequence
  BST2__Homo_sapiens__NP_004326
auggccagcaccagcuacgacuacugcagagugcccauggaggacggcgacaagagaugcaagcugcugcugggcaucggcauccuggugcugcugaucaucgugauccugggcgugccccugaucaucuucaccaucaaggccaacagcgaggccugcagagacggccugagagccgugauggagugcagaaacgugacccaccugcugcagcaggagcugaccgaggcccagaagggcuuccaggacguggaggcccaggccgccaccugcaaccacaccgugauggcccugauggccagccuggacgccgagaaggcccagggccagaagaagguggaggagcuggagggcgagaucaccacccugaaccacaagcugcaggacgccagcgccgagguggagagacugagaagagagaaccaggugcugagcgugagaaucgccgacaagaaguacuaccccagcagccaggacagcagcagcgccgccgccccccagcugcugaucgugcugcugggccugagcgcccugcugcaguaa

SEQ ID NO: 14317 - RNA, 702 nt, Artificial Sequence
  BSX__Homo_sapiens__NP_001091639
augaaccugaacuucaccagcccccugcaccccgccagcagccagagacccaccagcuucuucaucgaggacauccugcugcacaagcccaagccccugagagagguggcccccgaccacuucgccagcagccuggccagcagagugccccugcuggacuacggcuacccccugaugcccacccccacccugcuggccccccacgcccaccacccccugcacaagggcgaccaccaccaccccuacuuccugaccaccagcggcaugcccgugcccgcccuguucccccacccccagcacgccgagcugcccggcaagcacugcagaagaagaaaggccagaaccguguucagcgacagccagcugagcggccuggagaagagauucgagauccagagauaccugagcacccccgagagaguggagcuggccaccgcccugagccugagcgagacccaggugaagaccugguuccagaacagaagaaugaagcacaagaagcagcugagaaagagccaggacgagcccaaggcccccgacggccccgagagccccgagggcagccccagaggcagcgaggccgccaccgccgccgaggccagacugagccugcccgccggccccuucgugcugaccgagcccgaggacgagguggacaucggcgacgagggcgagcugggcagcggcccccacgugcuguaa

SEQ ID NO: 14318 - RNA, 1428 nt, Artificial Sequence
  BTBD10__Homo_sapiens__XP_011518706
auggccggcagaccccaccccuacgacggcaacagcagcgaccccgagaacugggacagaaagcugcacagcagacccagaaagcuguacaagcacagcagcaccagcagcagaaucgccaagggcggcguggaccacaccaagaugagccugcacggcgccagcggcggccacgagagaagcagagacagaagaagaagcagcgacagaagcagagacagcagccacgagagaaccgagagccagcugacccccugcaucagaaacgugaccagccccaccagacagcaccacguggagagagagaaggaccacagcagcagcagacccagcagccccagaccccagaaggccagccccaacggcagcaucagcagcgccggcaacagcagcagaaacagcagccagagcagcagcgacggcagcugcaagaccgccggcgagaugguguucguguacgagaacgccaaggagggcgccagaaacaucagaaccagcgagagagugacccugaucguggacaacaccagauucgugguggaccccagcaucuucaccgcccagcccaacaccaugcugggcagaauguucggcagcggcagagagcacaacuucaccagacccaacgagaagggcgaguacgagguggccgagggcaucggcagcaccguguucagagccauccuggacuacuacaagaccggcaucaucagaugccccgacggcaucagcauccccgagcugagagaggccugcgacuaccugugcaucagcuucgaguacagcaccaucaagugcagagaccugagcgcccugaugcacgagcugagcaacgacggcgccagaagacaguucgaguucuaccuggaggagaugauccugccccugaugguggccagcgcccagagcggcgagagagagugccacaucguggugcugaccgacgacgacgugguggacugggacgaggaguaccccccccagaugggcgaggaguacagccagaucaucuacagcaccaagcuguacagauucuucaaguacaucgagaacagagacguggccaagagcgugcugaaggagagaggccugaagaagaucagacugggcaucgagggcuaccccaccuacaaggagaaggugaagaagagacccggcggcagacccgaggugaucuacaacuacgugcagagacccuucaucagaaugagcugggagaaggaggagggcaagagcagacacguggacuuccagugcgugaagagcaagagcaucaccaaccuggccgccgccgccgccgacaucccccaggaccagcugguggugaugcaccccaccccccagguggacgagcuggacauccugcccauccacccccccagcggcaacagcgaccuggaccccgacgcccagaaccccaugcuguaa

SEQ ID NO: 14319 - RNA, 1926 nt, Artificial Sequence
  BTBD11__Homo_sapiens__NP_001017523
augagaaagcugagacccaaggacagcagagagcccgcccccggcagccccgugagaagcggcugccugcagagacugagccacuacagcggcauccagagacccuuccuggugcugcccccccugauggaguggaucagaguggccguggcccacgccggccacagaagaagcuucagcauggacagcgacgacgugagacaggccgccagacugcugcugcccggcguggacugcgagcccagacagcugagagccgacgacugcuucugcgccagcagaaagcuggacgccguggccaucgaggccaaguucaagcaggaccugggcuucagaaugcugaacugcggcagaaccgaccuggugaagcaggccgugagccugcugggccccgacggcaucaacaccaugagcgagcagggcaugaccccccugauguacgccugcgugagaggcgacgaggccauggugcagaugcugcuggacgccggcgccgaccugaacguggagguggugagcaccccccacaaguaccccagcgugcaccccgagaccagacacuggaccgcccugaccuucgccgugcugcacggccacauccccguggugcagcugcugcuggacgccggcgccaagguggagggcagcguggagcacggcgaggagaacuacagcgagaccccccugcagcuggccgccgccgugggcaacuucgagcuggugagccugcugcuggagagaggcgccgacccccugaucggcaccauguacagaaacggcaucagcaccaccccccagggcgacaugaacagcuucagccaggccgccgcccacggccacagaaacguguucagaaagcugcuggcccagcccgagaaggagaagagcgacauccugagccuggaggagauccuggccgagggcaccgaccuggccgagaccgccccccccccccugugcgccagcagaaacagcaaggccaagcugagagcccugagagaggccauguaccacagcgccgagcacggcuacguggacgugaccaucgacaucagaagcaucggcgugcccuggacccugcacaccuggcuggagagccugagaaucgccuuccagcagcacagaagaccccugauccagugccugcugaaggaguucaagaccauccaggaggaggaguacaccgaggagcuggugacccagggccugccccugauguucgagauccugaaggccagcaagaacgaggugaucagccagcagcugugcgugaucuucacccacugcuacggccccuaccccauccccaagcugaccgagaucaagagaaagcagaccagcagacuggacccccacuuccugaacaacaaggagaugagcgacgugaccuuccugguggagggcagacccuucuacgcccacaaggugcugcuguucaccgccagccccagauucaaggcccugcugagcagcaagcccaccaacgacggcaccugcaucgagaucggcuacgugaaguacagcaucuuccagcuggugaugcaguaccuguacuacggcggccccgagagccugcugaucaagaacaacgagaucauggagcugcugagcgccgccaaguucuuccagcuggaggcccugcagagacacugcgagaucaucugcgccaagagcaucaacaccgacaacugcguggacaucuacaaccacgccaaguuccugggcgugaccgagcugagcgccuacugcgagggcuacuuccugaagaacaugauggugcugaucgagaacgaggccuucaagcagcugcuguacgacaagaacggcgagggcaccggccaggacgugcugcaggaccugcagagaacccuggccaucagaauccagagcauccaccugagcagcagcaagggcagcgugguguaa

SEQ ID NO: 14320 - RNA, 1521 nt, Artificial Sequence
  BTBD16__Homo_sapiens__NP_653188
augaucaugagcaacacccacaaggccagacuggagagaagagugaccggcagcaccaacagauggagacugcccaagcagcccuucagcggcgaccugcugagccugagccagaugugcaaggcccugagcaucgacuucgaggaggcccugagaaaccccgacagacugugcaucagccagauccagaaguucuucuucgagaacuucaagaacaaggacauccagagcggcgaggccgacgugauccuggagugccugggcuucaagugggagcugcaccagccccagcuguuccagagcgagacccuggccaagcuguaccugaaggcccuggcccagggcaccacccacccccugagagagcuggaggagcugcugagagcccagagccccaagaagaccaaggagaagagccccgccaagagaaucaucaucagccugaagaucaacgacccccuggugaccaagguggccuucgccaccgcccugaagaaccuguacaugagcgagguggagaucaaccuggaggaccugcugggcgugcuggccagcgcccacauccugcaguucagcggccuguuccagagaugcguggacgugaugaucgccagacugaagcccagcaccaucaagaaguucuacgaggccggcugcaaguacaaggaggagcagcugaccaccggcugcgagaaguggcuggagaugaaccuggugccccugggcggcacccagauccaccugcacaagaucccccaggaccugcugcacaaggugcugaagagccccagacuguucaccuucagcgaguuccaccugcugaagaccaugcugcuguggguguuccugcagcugaacuacaagauccaggccauccccaccuacgagaccgugaugaccuucuucaagagcuuccccgagaacugcugcuuccuggacagagacaucggcagaagccugagaccccuguuccugugccugagacugcacggcaucaccaagggcaaggaccuggaggugcugagacaccugaacuucuuccccgagagcuggcuggaccaggugaccgugaaccacuaccacgcccuggagaacggcggcgacauggugcaccugaaggaccugaacacccaggccgugagauucggccugcuguucaaccaggagaacaccaccuacagcaagaccaucgcccuguacggcuucuucuucaagaucaagggccugaagcacgacaccaccagcuacagcuucuacaugcagagaaucaagcacaccgaccuggagagccccagcgccguguacgagcacaaccacgugagccugagagccgccagacuggugaaguacgagaucagagccgaggcccugguggacggcaaguggcaggaguucagaaccaaccagaucaagcagaaguucggccugaccaccagcagcugcaagagccacacccugaagauccagaccgugggcauccccaucuacgugagcuucgccuucaucuuccccgccagcuaa

SEQ ID NO: 14321 - RNA, 1158 nt, Artificial Sequence
  BTBD1__Homo_sapiens__NP_001011885
auggccagccugggccccgccgccgccggcgagcaggccagcggcgccgaggccgagcccggccccgccggccccccccccccccccagccccagcagccugggcccccugcugccccugcagagagagccccuguacaacuggcaggccaccaaggccagccugaaggagagauucgccuuccuguucaacagcgagcugcugagcgacgugagauucgugcugggcaagggcagaggcgccgccgccgccggcggcccccagagaauccccgcccacagauucgugcuggccgccggcagcgccguguucgacgccauguucaacggcggcauggccaccaccagcgccgagaucgagcugcccgacguggagcccgccgccuuccuggcccugcugagauuccuguacagcgacgaggugcagaucggccccgagaccgugaugaccacccuguacaccgccaagaaguacgccgugcccgcccuggaggcccacugcguggaguuccugaccaagcaccugagagccgacaacgccuucaugcugcugacccaggccagacuguucgacgagccccagcuggccagccugugccuggacaccaucgacaagagcaccauggacgccaucagcgccgagggcuucaccgacaucgacaucgacacccugugcgccgugcuggagagagacacccugagcaucagagagagcagacuguucggcgccguggugagaugggccgaggccgagugccagagacagcagcugcccgugaccuucggcaacaagcagaaggugcugggcaaggcccugagccugaucagauucccccugaugaccaucgaggaguucgccgccggccccgcccagagcggcauccugagcgacagagagguggugaaccuguuccugcacuucaccgugaaccccaagcccagaguggaguacaucgacagacccagaugcugccugagaggcaaggagugcugcaucaacagauuccagcagguggagagcagauggggcuacagcggcaccagcgacagaaucagaagccugaacaugagaaagagcaagcccugggacagaaugauccccgcccugguggugaugggccagcugacccacagcggcagcugcagcagaaaccccuaa

SEQ ID NO: 14322 - RNA, 1578 nt, Artificial Sequence
  BTBD2__Homo_sapiens__NP_060267
auggccgccggcggcagcggcggcagagccagcugcccccccggcgugggcgugggccccggcaccggcggcagccccggccccagcgccaacgccgccgccacccccgcccccggcaacgccgccgccgccgccgccgccgccgccgccgccgccgccgcccccggccccaccccccccgccccccccggccccggcaccgacgcccaggccgccggcgccgagagagccgaggaggccgccggccccggcgccgccgcccugcagagagaggccgccuacaacuggcaggccagcaagcccaccgugcaggagagauucgccuuccuguucaacaacgaggugcugugcgacgugcacuuccuggugggcaagggccugagcagccagagaauccccgcccacagauucgugcuggccgugggcagcgccguguucgacgccauguucaacggcggcauggccaccaccagcaccgagaucgagcugcccgacguggagcccgccgccuuccuggcccugcugaaguuccuguacagcgacgaggugcagaucggccccgagaccgugaugaccacccuguacaccgccaagaaguacgccgugcccgcccuggaggcccacugcguggaguuccugaagaagaaccugagagccgacaacgccuucaugcugcugacccaggccagacuguucgacgagccccagcuggccagccugugccuggagaacaucgacaagaacaccgccgacgccaucaccgccgagggcuucaccgacaucgaccuggacacccugguggccgugcuggagagagacacccugggcaucagagaggugagacuguucaacgccguggugagauggagcgaggccgagugccagagacagcagcugcaggugacccccgagaacagaagaaaggugcugggcaaggcccugggccugaucagauucccccugaugaccaucgaggaguucgccgccggccccgcccagagcggcauccugguggacagagagguggugagccuguuccugcacuucaccgugaaccccaagcccagaguggaguucaucgacagacccagaugcugccugagaggcaaggagugcagcaucaacagauuccagcagguggagagcagauggggcuacagcggcaccagcgacagaaucagauucagcgugaacaagagaaucuucguggugggcuucggccuguacggcagcauccacggccccaccgacuaccaggugaacauccagaucauccacaccgacagcaacaccgugcugggccagaacgacaccggcuucagcugcgacggcagcgccagcaccuucagagugauguucaaggagcccguggaggugcugcccaacgugaacuacaccgccugcgccacccugaagggccccgacagccacuacggcaccaagggccugagaaaggugacccacgagagccccaccaccggcgccaagaccugcuucaccuucugcuacgccgccggcaacaacaacggcaccagcguggaggacggccagauccccgaggugaucuucuacaccuaa

SEQ ID NO: 14323 - RNA, 1386 nt, Artificial Sequence
  BTBD3__Homo_sapiens__NP_001269480
auggccgccgacaucuuccccagaaagaagcccgccaacagcagcagcaccagcgugcagcaguaccaccagcagaaccugagcaacaacaaccugauccccgcccccaacuggcagggccuguaccccaccaucagagagagaaacgccaugauguucaacaacgaccugauggccgacgugcacuucguggugggcccccccggcggcacccagagacugcccggccacaaguacgugcuggccgugggcagcagcguguuccacgccauguucuacggcgagcuggccgaggacaaggacgagaucagaauccccgacguggagcccgccgccuuccuggccaugcugaaguacaucuacugcgacgagaucgaccuggccgccgacaccgugcuggccacccuguacgccgccaagaaguacaucgugccccaccuggccagagccugcgugaacuuccuggagaccagccugagcgccaagaacgccugcgugcugcugagccagagcugccuguucgaggagcccgaccugacccagagaugcugggaggugaucgacgcccaggccgagcuggcccugaagagcgagggcuucugcgacaucgacuuccagacccuggagagcauccugagaagagagacccugaacgccaaggagaucgugguguucgaggccgcccugaacugggccgagguggagugccagagacaggaccuggcccugagcaucgagaacaagagaaaggugcugggcaaggcccuguaccugaucagaauccccaccauggcccuggacgacuucgccaacggcgccgcccagagcggcgugcugacccugaacgagaccaacgacaucuuccugugguacaccgccgccaagaagcccgagcugcaguucgugagcaaggccagaaagggccuggugccccagagaugccacagauuccagagcugcgccuacagaagcaaccaguggagauacagaggcagaugcgacagcauccaguucgccguggacaagagaguguucaucgccggcuucggccuguacggcagcagcugcggcagcgccgaguacagcgccaagaucgagcugaagagacagggcguggugcugggccagaaccugagcaaguacuucagcgacggcagcagcaacaccuuccccgugugguucgaguaccccgugcagaucgagcccgacaccuucuacaccgccagcgugauccuggacggcaacgagcugagcuacuucggccaggagggcaugaccgaggugcagugcggcaaggugaccgugcaguuccagugcagcagcgacagcaccaacggcaccggcgugcagggcggccagauccccgagcugaucuucuacgccuaa

SEQ ID NO: 14324 - RNA, 1749 nt, Artificial Sequence
  BTBD9__Homo_sapiens__NP_001165889
augugcagagcccugcuguacggcggcaugagagagagccagcccgaggccgagaucccccugcaggacaccaccgccgaggccuucaccaugcugcugaaguacaucuacaccggcagagccacccugaccgacgagaaggaggaggugcugcuggacuuccugagccuggcccacaaguacggcuuccccgagcuggaggacagcaccagcgaguaccugugcaccauccugaacauccagaacgugugcaugaccuucgacguggccagccuguacagccugcccaagcugaccugcaugugcugcauguucauggacagaaacgcccaggaggugcugagcagcgagggcuuccugagccugagcaagaccgcccugcugaacaucgugcugagagacagcuucgccgcccccgagaaggacaucuuccuggcccugcugaacuggugcaagcacaacagcaaggagaaccacgccgagaucaugcaggccgugagacugccccugaugagccugaccgagcugcugaacguggugagacccagcggccugcugagccccgacgccauccuggacgccaucaaggugagaagcgagagcagagacauggaccugaacuacagaggcaugcugauccccgaggagaacaucgccaccaugaaguacggcgcccagguggugaagggcgagcugaagagcgcccugcuggacggcgacacccagaacuacgaccuggaccacggcuucagcagacaccccaucgacgacgacugcagaagcggcaucgagaucaagcugggccagcccagcaucaucaaccacaucagaauccugcugugggacagagacagcagaagcuacagcuacuucaucgaggugagcauggacgagcuggacugggugagagugaucgaccacagccaguaccugugcagaagcuggcagaagcuguacuuccccgccagagugugcagcggcgacggcgugagccuguggugcccccuguggagcagaacccccgagcugaagcagagcagccugcugggccugcccaagugcagauacaucagaaucgugggcacccacaacaccgugaacaagaucuuccacaucguggccuucgagugcauguucaccaacaagaccuucacccuggagaagggccugaucgugcccauggagaacguggccaccaucgccgacugcgccagcgugaucgagggcgugagcagaagcagaaacgcccugcugaacggcgacaccaagaacuacgacugggacagcggcuacaccugccaccagcugggcagcggcgccaucguggugcagcuggcccagcccuacaugaucggcagcaucagacugcugcugugggacugcgacgacagaagcuacagcuacuacguggaggugagcaccaaccagcagcaguggaccaugguggccgacagaaccaaggugagcugcaagagcuggcagagcgugaccuucgagagacagcccgccagcuucaucagaaucgugggcacccacaacaccgccaacgagguguuccacugcgugcacuucgagugccccgagcagcagagcagccagaaggaggagaacagcgaggagagcggcaccggcgacaccagccuggccggccagcagcuggacagccacgcccugagagcccccagcggcagcagccugcccagcagccccggcagcaacagcagaagccccaacagacagcaccaguaa

SEQ ID NO: 14325 - RNA, 537 nt, Artificial Sequence
  BTC__Homo_sapiens__NP_001720
auggacagagccgccagaugcagcggcgccagcagccugccccugcugcuggcccuggcccugggccuggugauccugcacugcgugguggccgacggcaacagcaccagaagccccgagaccaacggccugcugugcggcgaccccgaggagaacugcgccgccaccaccacccagagcaagagaaagggccacuucagcagaugccccaagcaguacaagcacuacugcaucaagggcagaugcagauucgugguggccgagcagacccccagcugcgugugcgacgagggcuacaucggcgccagaugcgagagaguggaccuguucuaccugagaggcgacagaggccagauccuggugaucugccugaucgccgugauggugguguucaucauccuggugaucggcgugugcaccugcugccacccccugagaaagagaagaaagagaaagaagaaggaggaggagauggagacccugggcaaggacaucacccccaucaacgaggacaucgaggagaccaacaucgccuaa

SEQ ID NO: 14326 - RNA, 1632 nt, Artificial Sequence
  BTD__Homo_sapiens__NP_000051
auggcccacgcccacauccagggcggcagaagagccaagagcagauucguggugugcaucaugagcggcgccagaagcaagcuggcccuguuccugugcggcugcuacgugguggcccugggcgcccacaccggcgaggagagcguggccgaccaccacgaggccgaguacuacguggccgccguguacgagcaccccagcauccugagccugaacccccuggcccugaucagcagacaggaggcccuggagcugaugaaccagaaccuggacaucuacgagcagcaggugaugaccgccgcccagaaggacgugcagaucaucguguuccccgaggacggcauccacggcuucaacuucaccagaaccagcaucuaccccuuccuggacuucaugcccagcccccagguggugagauggaaccccugccuggagccccacagauucaacgacaccgaggugcugcagagacugagcugcauggccaucagaggcgacauguuccugguggccaaccugggcaccaaggagcccugccacagcagcgaccccagaugccccaaggacggcagauaccaguucaacaccaacgugguguucagcaacaacggcacccugguggacagauacagaaagcacaaccuguacuucgaggccgccuucgacgugccccugaagguggaccugaucaccuucgacacccccuucgccggcagauucggcaucuucaccugcuucgacauccuguucuucgaccccgccaucagagugcugagagacuacaaggugaagcacgugguguaccccaccgccuggaugaaccagcugccccugcuggccgccaucgagauccagaaggccuucgccguggccuucggcaucaacgugcuggccgccaacgugcaccaccccgugcugggcaugaccggcagcggcauccacaccccccuggagagcuucugguaccacgacauggagaaccccaagagccaccugaucaucgcccagguggccaagaaccccgugggccugaucggcgccgagaacgccaccggcgagaccgaccccagccacagcaaguuccugaagauccugagcggcgaccccuacugcgagaaggacgcccaggaggugcacugcgacgaggccaccaaguggaacgugaacgccccccccaccuuccacagcgagaugauguacgacaacuucacccuggugcccguguggggcaaggagggcuaccugcacgugugcagcaacggccugugcugcuaccugcuguacgagagacccacccugagcaaggagcuguacgcccugggcguguucgacggccugcacaccgugcacggcaccuacuacauccaggugugcgcccuggugagaugcggcggccugggcuucgacaccugcggccaggagaucaccgaggccaccggcaucuucgaguuccaccuguggggcaacuucagcaccagcuacaucuucccccuguuccugaccagcggcaugacccuggaggugcccgaccagcugggcugggagaacgaccacuacuuccugagaaagagcagacugagcagcggccuggugaccgccgcccuguacggcagacuguacgagagagacuaa

SEQ ID NO: 14327 - RNA, 621 nt, Artificial Sequence
  BTF3__Homo_sapiens__NP_001032726
augagaagaaccggcgcccccgcccaggccgacagcagaggcagaggcagagccagaggcggcugccccggcggcgaggccacccugagccagcccccccccagaggcggcaccagaggccaggagccccagaugaaggagaccaucaugaaccaggagaagcuggccaagcugcaggcccaggugagaaucggcggcaagggcaccgccagaagaaagaagaagguggugcacagaaccgccaccgccgacgacaagaagcugcaguucagccugaagaagcugggcgugaacaacaucagcggcaucgaggaggugaacauguucaccaaccagggcaccgugauccacuucaacaaccccaaggugcaggccagccuggccgccaacaccuucaccaucaccggccacgccgagaccaagcagcugaccgagaugcugcccagcauccugaaccagcugggcgccgacagccugaccagccugagaagacuggccgaggcccugcccaagcagagcguggacggcaaggccccccuggccaccggcgaggacgacgacgacgaggugcccgaccugguggagaacuucgacgaggccagcaagaacgaggccaacuaa

SEQ ID NO: 14328 - RNA, 516 nt, Artificial Sequence
  BTG1__Homo_sapiens__NP_001722
augcaccccuucuacaccagagccgccaccaugaucggcgagaucgccgccgccgugagcuucaucagcaaguuccugagaaccaagggccugaccagcgagagacagcugcagaccuucagccagagccugcaggagcugcuggccgagcacuacaagcaccacugguuccccgagaagcccugcaagggcagcggcuacagaugcaucagaaucaaccacaagauggacccccugaucggccaggccgcccagagaaucggccugagcagccaggagcuguucagacugcugcccagcgagcugacccuguggguggaccccuacgaggugagcuacagaaucggcgaggacggcagcaucugcgugcuguacgaggccagccccgccggcggcagcacccagaacagcaccaacgugcagaugguggacagcagaaucagcugcaaggaggagcugcugcugggcagaaccagccccagcaagaacuacaacaugaugaccgugagcggcuaa

SEQ ID NO: 14329 - RNA, 477 nt, Artificial Sequence
  BTG2__Homo_sapiens__NP_006754
augagccacggcaagggcaccgacaugcugcccgagaucgccgccgccgugggcuuccugagcagccugcugagaaccagaggcugcgugagcgagcagagacugaagguguucagcggcgcccugcaggaggcccugaccgagcacuacaagcaccacugguuccccgagaagcccagcaagggcagcggcuacagaugcaucagaaucaaccacaagauggaccccaucaucagcagaguggccagccagaucggccugagccagccccagcugcaccagcugcugcccagcgagcugacccuguggguggaccccuacgaggugagcuacagaaucggcgaggacggcagcaucugcgugcuguacgaggaggccccccuggccgccagcugcggccugcugaccugcaagaaccaggugcugcugggcagaagcagccccagcaagaacuacgugauggccgugagcagcuaa

SEQ ID NO: 14330 - RNA, 891 nt, Artificial Sequence
  BTG3__Homo_sapiens__NP_001124386
augaagaacgagaucgccgccgugguguucuucuucaccagacuggugagaaagcacgacaagcugaagaaggaggccguggagagauucgccgagaagcugacccugauccugcaggagaaguacaagaaccacugguaccccgagaagcccagcaagggccaggccuacagaugcaucagagugaacaaguuccagagaguggaccccgacgugcugaaggccugcgagaacagcugcauccuguacagcgaccugggccugcccaaggagcugacccuguggguggaccccugcgaggugugcugcagaagagacggcgugagccccugcuggcccgacugcagccagacccccgaccuggugaucagaccccccuggccccccaaggcccuggacuacagaagagagccccugagacccgccagcagcuuccugaucauguacggcgagaagaacaacgccuucaucguggccagcuucgagaacaaggacgagaacaaggacgagaucagcagaaaggugaccagagcccuggacaaggugaccagcgacuaccacagcggcagcagcagcagcgacgaggagaccagcaaggagauggaggugaagcccagcagcgugaccgccgccgccagccccguguaccagaucagcgagcugaucuuccccccccugcccauguggcacccccugcccagaaagaagcccggcauguacagaggcaacggccaccagaaccacuaccccccccccgugcccuucggcuaccccaaccagggcagaaagaacaagcccuacagacccauccccgugaccugggugcccccccccggcaugcacugcgacagaaaccacuggaucaacccccacaugcuggccccccacuaa

SEQ ID NO: 14331 - RNA, 672 nt, Artificial Sequence
  BTG4__Homo_sapiens__NP_060059
augagagacgagaucgccaccaccguguucuucgugaccagacuggugaagaagcacgacaagcugagcaagcagcagaucgaggacuucgccgagaagcugaugaccauccuguucgagaccuacagaagccacuggcacagcgacugccccagcaagggccaggccuucagaugcaucagaaucaacaacaaccagaacaaggaccccauccuggagagagccugcguggagagcaacguggacuucagccaccugggccugcccaaggagaugaccaucuggguggaccccuucgaggugugcugcagauacggcgagaagaaccaccccuucaccguggccagcuucaagggcagaugggaggagugggagcuguaccagcagaucagcuacgccgugagcagagccagcagcgacgugagcagcggcaccagcugcgacgaggagagcugcagcaaggagcccagagugauccccaaggugagcaaccccaagagcaucuaccagguggagaaccugaagcagcccuuccagagcuggcugcagauccccagaaagaagaacgugguggacggcagagugggccugcugggcaacaccuaccacggcagccagaagcaccccaagugcuacagacccgccaugcacagacuggacagaauccuguaa

SEQ ID NO: 14332 - RNA, 1980 nt, Artificial Sequence
  BTK__Homo_sapiens__NP_000052
auggccgccgugauccuggagagcaucuuccugaagagaagccagcagaagaagaagaccagcccccugaacuucaagaagagacuguuccugcugaccgugcacaagcugagcuacuacgaguacgacuucgagagaggcagaagaggcagcaagaagggcagcaucgacguggagaagaucaccugcguggagaccguggugcccgagaagaaccccccccccgagagacagauccccagaagaggcgaggagagcagcgagauggagcagaucagcaucaucgagagauuccccuaccccuuccaggugguguacgacgagggcccccuguacguguucagccccaccgaggagcugagaaagagauggauccaccagcugaagaacgugaucagauacaacagcgaccuggugcagaaguaccaccccugcuucuggaucgacggccaguaccugugcugcagccagaccgccaagaacgccaugggcugccagauccuggagaacagaaacggcagccugaagcccggcagcagccacagaaagaccaagaagccccugccccccacccccgaggaggaccagauccugaagaagccccugccccccgagcccgccgccgcccccgugagcaccagcgagcugaagaaggugguggcccuguacgacuacaugcccaugaacgccaacgaccugcagcugagaaagggcgacgaguacuucauccuggaggagagcaaccugcccugguggagagccagagacaagaacggccaggagggcuacauccccagcaacuacgugaccgaggccgaggacagcaucgagauguacgagugguacagcaagcacaugaccagaagccaggccgagcagcugcugaagcaggagggcaaggagggcggcuucaucgugagagacagcagcaaggccggcaaguacaccgugagcguguucgccaagagcaccggcgacccccagggcgugaucagacacuacguggugugcagcaccccccagagccaguacuaccuggccgagaagcaccuguucagcaccauccccgagcugaucaacuaccaccagcacaacagcgccggccugaucagcagacugaaguaccccgugagccagcagaacaagaacgcccccagcaccgccggccugggcuacggcagcugggagaucgaccccaaggaccugaccuuccugaaggagcugggcaccggccaguucggcguggugaaguacggcaaguggagaggccaguacgacguggccaucaagaugaucaaggagggcagcaugagcgaggacgaguucaucgaggaggccaaggugaugaugaaccugagccacgagaagcuggugcagcuguacggcgugugcaccaagcagagacccaucuucaucaucaccgaguacauggccaacggcugccugcugaacuaccugagagagaugagacacagauuccagacccagcagcugcuggagaugugcaaggacgugugcgaggccauggaguaccuggagagcaagcaguuccugcacagagaccuggccgccagaaacugccuggugaacgaccagggcguggugaaggugagcgacuucggccugagcagauacgugcuggacgacgaguacaccagcagcgugggcagcaaguuccccgugagauggagcccccccgaggugcugauguacagcaaguucagcagcaagagcgacaucugggccuucggcgugcugaugugggagaucuacagccugggcaagaugcccuacgagagauucaccaacagcgagaccgccgagcacaucgcccagggccugagacuguacagaccccaccuggccagcgagaagguguacaccaucauguacagcugcuggcacgagaaggccgacgagagacccaccuucaagauccugcugagcaacauccuggacgugauggacgaggagagcuaa

SEQ ID NO: 14333 - RNA, 726 nt, Artificial Sequence
  BTLA__Homo_sapiens__NP_001078826
augaagacccugcccgccaugcugggcaccggcaagcuguucuggguguucuuccugauccccuaccuggacaucuggaacauccacggcaaggagagcugcgacgugcagcuguacaucaagagacagagcgagcacagcauccuggccggcgaccccuucgagcuggagugccccgugaaguacugcgccaacagaccccacgugaccuggugcaagcugaacggcaccaccugcgugaagcuggaggacagacagaccagcuggaaggaggagaagaacaucagcuucuucauccugcacuucgagcccgugcugcccaacgacaacggcagcuacagaugcagcgccaacuuccagagcaaccugaucgagagccacagcaccacccuguacgugaccggcaagcagaacgagcugagcgacaccgccggcagagagaucaaccugguggacgcccaccugaagagcgagcagaccgaggccagcaccagacagaacagccaggugcugcugagcgagaccggcaucuacgacaacgaccccgaccugugcuucagaaugcaggagggcagcgagguguacagcaaccccugccuggaggagaacaagcccggcaucguguacgccagccugaaccacagcgugaucggccccaacagcagacuggccagaaacgugaaggaggcccccaccgaguacgccagcaucugcgugagaagcuaa

SEQ ID NO: 14334 - RNA, 1581 nt, Artificial Sequence
  BTN1A1__Homo_sapiens__NP_001723
auggccguguuccccagcagcggccugcccagaugccugcugacccugauccugcugcagcugcccaagcuggacagcgcccccuucgacgugaucggcccccccgagcccauccuggccguggugggcgaggacgccgagcugcccugcagacugagccccaacgccagcgccgagcaccuggagcugagaugguucagaaagaaggugagccccgccgugcuggugcacagagacggcagagagcaggaggccgagcagaugcccgaguacagaggcagagccacccuggugcaggacggcaucgccaagggcagaguggcccugagaaucagaggcgugagagugagcgacgacggcgaguacaccugcuucuucagagaggacggcagcuacgaggaggcccuggugcaccugaagguggccgcccugggcagcgacccccacaucagcaugcaggugcaggagaacggcgagaucugccuggagugcaccagcgugggcugguaccccgagccccaggugcaguggagaaccagcaagggcgagaaguuccccagcaccagcgagagcagaaaccccgacgaggagggccuguucaccguggccgccagcgugaucaucagagacaccagcgccaagaacgugagcugcuacauccagaaccugcugcugggccaggagaagaagguggagaucagcauccccgccagcagccugcccagacugacccccuggaucguggccguggccgugauccugauggugcugggccugcugaccaucggcagcaucuucuucaccuggagacuguacaacgagagacccagagagagaagaaacgaguucagcagcaaggagagacugcuggaggagcugaaguggaagaaggccacccugcacgccguggacgugacccuggaccccgacaccgcccacccccaccuguuccuguacgaggacagcaagagcgugagacuggaggacagcagacagaagcugcccgagaagaccgagagauucgacagcuggcccugcgugcugggcagagagaccuucaccagcggcagacacuacugggagguggaggugggcgacagaaccgacugggccaucggcgugugcagagagaacgugaugaagaagggcuucgaccccaugacccccgagaacggcuucugggccguggagcuguacggcaacggcuacugggcccugaccccccugagaaccccccugccccuggccggcccccccagaagagugggcaucuuccuggacuacgagagcggcgacaucagcuucuacaacaugaacgacggcagcgacaucuacaccuucagcaacgugaccuucagcggcccccugagacccuucuucugccuguggagcagcggcaagaagccccugaccaucugccccaucgccgacggccccgagagagugaccgugaucgccaacgcccaggaccugagcaaggagaucccccugagccccaugggcgaggacagcgcccccagagacgccgacacccugcacagcaagcugauccccacccagcccagccagggcgcccccuaa

SEQ ID NO: 14335 - RNA, 1401 nt, Artificial Sequence
  BTN2A1__Homo_sapiens__NP_001184162
auggaggugagaugguucagaagccaguucagccccgccguguucguguacaagggcggcagagagagaaccgaggagcagauggaggaguacagaggcagaaccaccuucgugagcaaggacaucagcagaggcagcguggcccuggugauccacaacaucaccgcccaggagaacggcaccuacagaugcuacuuccaggagggcagaagcuacgacgaggccauccugcaccuggugguggccggccugggcagcaagccccugaucagcaugagaggccacgaggacggcggcaucagacuggagugcaucagcagaggcugguaccccaagccccugaccguguggagagaccccuacggcggcguggcccccgcccugaaggaggugagcaugcccgacgccgacggccuguucauggugaccaccgccgugaucaucagagacaagagcgugagaaacaugagcugcagcaucaacaacacccugcugggccagaagaaggagagcgugaucuucauccccgagagcuucaugcccagcgugagccccugcgccguggcccugcccaucaucguggugauccugaugauccccaucgccgugugcaucuacuggaucaacaagcugcagaaggagaagaagauccugagcggcgagaaggaguucgagagagagaccagagagaucgcccugaaggagcuggagaaggagagagugcagaaggaggaggagcugcaggugaaggagaagcugcaggaggagcugagauggagaagaaccuuccugcacgccguggacguggugcuggaccccgacaccgcccaccccgaccuguuccugagcgaggacagaagaagcgugagaagaugccccuucagacaccugggcgagagcgugcccgacaaccccgagagauucgacagccagcccugcgugcugggcagagagagcuucgccagcggcaagcacuacugggagguggagguggagaacgugaucgaguggaccgugggcgugugcagagacagcguggagagaaagggcgaggugcugcugaucccccagaacggcuucuggacccuggagaugcacaagggccaguacagagccgugagcagccccgacagaauccugccccugaaggagagccugugcagagugggcguguuccuggacuacgaggccggcgacgugagcuucuacaacaugagagacagaagccacaucuacaccugccccagaagcgccuucagcgugcccgugagacccuucuucagacugggcugcgaggacagccccaucuucaucugccccgcccugaccggcgccaacggcgugaccgugcccgaggagggccugacccugcacagagugggcacccaccagagccuguaa

SEQ ID NO: 14336 - RNA, 1572 nt, Artificial Sequence
  BTN2A2__Homo_sapiens__NP_001184166
auggagcccgccgccgcccugcacuucagccugcccgccagccugcugcugcugcugcugcugcugcugcugagccugugcgcccuggugagcgcccaguucaccguggugggccccgccaaccccauccuggccauggugggcgagaacaccacccugagaugccaccugagccccgagaagaacgccgaggacauggaggugagaugguucagaagccaguucagccccgccguguucguguacaagggcggcagagagagaaccgaggagcagauggaggaguacagaggcagaaucaccuucgugagcaaggacaucaacagaggcagcguggcccuggugauccacaacgugaccgcccaggagaacggcaucuacagaugcuacuuccaggagggcagaagcuacgacgaggccauccugagacuggugguggccggccugggcagcaagccccugaucgagaucaaggcccaggaggacggcagcaucuggcuggagugcaucagcggcggcugguaccccgagccccugaccguguggagagaccccuacggcgagguggugcccgcccugaaggaggugagcaucgccgacgccgacggccuguucauggugaccaccgccgugaucaucagagacaaguacgugagaaacgugagcugcagcgugaacaacacccugcugggccaggagaaggagaccgugaucuucauccccgagagcuucaugcccagcgccagccccuggaugguggcccuggccgugauccugaccgccagccccuggauggugagcaugaccgugauccuggccguguucaucaucuucauggccgugagcaucugcugcaucaagaagcugcagagagagaagaagauccugagcggcgagaagaagguggagcaggaggagaaggagaucgcccagcagcugcaggaggagcugagauggagaagaaccuuccugcacgccgccgacguggugcuggaccccgacaccgcccaccccgagcuguuccugagcgaggacagaagaagcgugagaagaggccccuacagacagagagugcccgacaaccccgagagauucgacagccagcccugcgugcugggcugggagagcuucgccagcggcaagcacuacugggagguggagguggagaacgugaugguguggaccgugggcgugugcagacacagcguggagagaaagggcgaggugcugcugaucccccagaacggcuucuggacccuggagauguucggcaaccaguacagagcccugagcagccccgagagaauccugccccugaaggagagccugugcagagugggcguguuccuggacuacgaggccggcgacgugagcuucuacaacaugagagacagaagccacaucuacaccugccccagaagcgccuucaccgugcccgugagacccuucuucagacugggcagcgacgacagccccaucuucaucugccccgcccugaccggcgccagcggcgugauggugcccgaggagggccugaagcugcacagagugggcacccaccagagccuguaa

SEQ ID NO: 14337 - RNA, 1386 nt, Artificial Sequence
  BTN3A1__Homo_sapiens__NP_001138480
augaagauggccagcuuccuggccuuccugcugcugaacuucagagugugccugcugcugcugcagcugcugaugccccacagcgcccaguucagcgugcugggccccagcggccccauccuggccauggugggcgaggacgccgaccugcccugccaccuguuccccaccaugagcgccgagaccauggagcugaagugggugagcagcagccugagacagguggugaacguguacgccgacggcaaggagguggaggacagacagagcgcccccuacagaggcagaaccagcauccugagagacggcaucaccgccggcaaggccgcccugagaauccacaacgugaccgccagcgacagcggcaaguaccugugcuacuuccaggacggcgacuucuacgagaaggcccugguggagcugaagguggccgacggcgugggccuguacgccguggccgccagcgugaucaugagaggcagcagcggcgagggcgugagcugcaccaucagaagcagccugcugggccuggagaagaccgccagcaucagcaucgccgaccccuucuucagaagcgcccagagauggaucgccgcccuggccggcacccugcccgugcugcugcugcugcugggcggcgccggcuacuuccuguggcagcagcaggaggagaagaagacccaguucagaaagaagaagagagagcaggagcugagagagauggccuggagcaccaugaagcaggagcagagcaccagagugaagcugcuggaggagcugagauggagaagcauccaguacgccagcagaggcgagagacacagcgccuacaacgaguggaagaaggcccuguucaagcccgccgacgugauccuggaccccaagaccgccaaccccauccugcuggugagcgaggaccagagaagcgugcagagagccaaggagccccaggaccugcccgacaaccccgagagauucaacuggcacuacugcgugcugggcugcgagagcuucaucagcggcagacacuacugggagguggaggugggcgacagaaaggaguggcacaucggcgugugcagcaagaacgugcagagaaagggcugggugaagaugacccccgagaacggcuucuggaccaugggccugaccgacggcaacaaguacagaacccugaccgagcccagaaccaaccugaagcugcccaagccccccaagaaggugggcguguuccuggacuacgagaccggcgacaucagcuucuacaacgccguggacggcagccacauccacaccuuccuggacgugagcuucagcgaggcccuguaccccguguucagaauccugacccuggagcccaccgcccugaccaucugccccgccuaa

SEQ ID NO: 14338 - RNA, 1005 nt, Artificial Sequence
  BTN3A2__Homo_sapiens__NP_001184175
augaagauggccagcagccuggccuuccugcugcugaacuuccacgugagccugcugcuggugcagcugcugacccccugcagcgcccaguucagcgugcugggccccagcggccccauccuggccauggugggcgaggacgccgaccugcccugccaccuguuccccaccaugagcgccgagaccauggagcugaagugggugagcagcagccugagacagguggugaacguguacgccgacggcaaggagguggaggacagacagagcgcccccuacagaggcagaaccagcauccugagagacggcaucaccgccggcaaggccgcccugagaauccacaacgugaccgccagcgacagcggcaaguaccugugcuacuuccaggacggcgacuucuacgagaaggcccugguggagcugaagguggccgcccugggcagcaaccugcacguggaggugaagggcuacgaggacggcggcauccaccuggagugcagaagcaccggcugguacccccagccccagauccaguggagcaacgccaagggcgagaacauccccgccguggaggcccccgugguggccgacggcgugggccuguacgagguggccgccagcgugaucaugagaggcggcagcggcgagggcgugagcugcaucaucagaaacagccugcugggccuggagaagaccgccagcaucagcaucgccgaccccuucuucagaagcgcccagcccuggaucgccgcccuggccggcacccugcccauccugcugcugcugcuggccggcgccagcuacuuccuguggagacagcagaaggagaucaccgcccugagcagcgagaucgagagcgagcaggagaugaaggagaugggcuacgccgccaccgagagagagaucagccugagagagagccugcaggaggagcugaagagaaagaagauccaguaccugaccagaggcgaggagagcagcagcgacaccaacaagagcgccuaa

SEQ ID NO: 14339 - RNA, 1755 nt, Artificial Sequence
  BTN3A3__Homo_sapiens__NP_008925
augaagauggccagcagccuggccuuccugcugcugaacuuccacgugagccuguuccuggugcagcugcugacccccugcagcgcccaguucagcgugcugggccccagcggccccauccuggccauggugggcgaggacgccgaccugcccugccaccuguuccccaccaugagcgccgagaccauggagcugagaugggugagcagcagccugagacagguggugaacguguacgccgacggcaaggagguggaggacagacagagcgcccccuacagaggcagaaccagcauccugagagacggcaucaccgccggcaaggccgcccugagaauccacaacgugaccgccagcgacagcggcaaguaccugugcuacuuccaggacggcgacuucuacgagaaggcccugguggagcugaagguggccgcccugggcagcgaccugcacaucgaggugaagggcuacgaggacggcggcauccaccuggagugcagaagcaccggcugguacccccagccccagaucaaguggagcgacaccaagggcgagaacauccccgccguggaggcccccgugguggccgacggcgugggccuguacgccguggccgccagcgugaucaugagaggcagcagcggcggcggcgugagcugcaucaucagaaacagccugcugggccuggagaagaccgccagcaucagcaucgccgaccccuucuucagaagcgcccagcccuggaucgccgcccuggccggcacccugcccaucagccugcugcugcuggccggcgccagcuacuuccuguggagacagcagaaggagaagaucgcccugagcagagagaccgagagagagagagagaugaaggagaugggcuacgccgccaccgagcaggagaucagccugagagagaagcugcaggaggagcugaaguggagaaagauccaguacauggccagaggcgagaagagccuggccuaccacgaguggaagauggcccuguucaagcccgccgacgugauccuggaccccgacaccgccaacgccauccugcuggugagcgaggaccagagaagcgugcagagagccgaggagcccagagaccugcccgacaaccccgagagauucgaguggagauacugcgugcugggcugcgagaacuucaccagcggcagacacuacugggagguggaggugggcgacagaaaggaguggcacaucggcgugugcagcaagaacguggagagaaagaagggcugggugaagaugacccccgagaacggcuacuggaccaugggccugaccgacggcaacaaguacagagcccugaccgagcccagaaccaaccugaagcugcccgagccccccagaaaggugggcaucuuccuggacuacgagaccggcgagaucagcuucuacaacgccaccgacggcagccacaucuacaccuucccccacgccagcuucagcgagccccuguaccccguguucagaauccugacccuggagcccaccgcccugaccaucugccccauccccaaggagguggagagcagccccgaccccgaccuggugcccgaccacagccuggagaccccccugacccccggccuggccaacgagagcggcgagccccaggccgaggugaccagccugcugcugcccgcccaccccggcgccgaggugagccccagcgccaccaccaaccagaaccacaagcugcaggccagaaccgaggcccuguacuaa

SEQ ID NO: 14340 - RNA, 1449 nt, Artificial Sequence
  BTNL2__Homo_sapiens__NP_001291490
augguggacuuccccggcuacaaccugagcggcgccguggccagcuuccuguucauccugcugaccaugaagcagagcgaggacuucagagugaucggccccgcccaccccauccuggccggcgugggcgaggacgcccugcugaccugccagcugcugcccaagagaaccaccaugcacguggaggugagaugguacagaagcgagcccagcacccccguguucgugcacagagacggcguggaggugaccgagaugcagauggaggaguacagaggcuggguggaguggaucgagaacggcaucgccaagggcaacguggcccugaagauccacaacauccagcccagcgacaacggccaguacuggugccacuuccaggacggcaacuacugcggcgagaccagccugcugcugaagguggccggccugggcagcgcccccagcauccacauggagggccccggcgagagcggcgugcagcuggugugcaccgccagaggcugguuccccgagccccagguguacugggaggacaucagaggcgagaagcugcuggccgugagcgagcacagaauccaggacaaggacggccuguucuacgccgaggccacccugguggugagaaacgccagcgccgagagcgugagcugccuggugcacaaccccgugcugaccgaggagaagggcagcgugaucagccugcccgagaagcugcagaccgagcuggccagccugaaggugaacggccccagccagcccauccuggugagagugggcgaggacauccagcugaccugcuaccugagccccaaggccaacgcccagagcauggaggugagaugggacagaagccacagauaccccgccgugcacguguacauggacggcgaccacguggccggcgagcagauggccgaguacagaggcagaaccgugcuggugagcgacgccaucgacgagggcagacugacccugcagauccugagcgccagacccagcgacgacggccaguacagaugccuguucgagaaggacgacguguaccaggaggccagccuggaccugaagguggugagccugggcagcagcccccugaucaccguggagggccaggaggacggcgagaugcagcccaugugcagcagcgacggcugguucccccagccccacgugcccuggagagacauggagggcaagaccauccccagcagcagccaggcccugacccagggcagccacggccuguuccacgugcagacccugcugagagugaccaacaucagcgccguggacgugaccugcagcaucagcauccccuuccugggcgaggagaagaucgccaccuucagccugagcgagagcagaaugaccuuccuguggaagacccugcugguguggggccugcugcuggccguggccgugggccugcccagaaagagaagcuaa

SEQ ID NO: 14341 - RNA, 1740 nt, Artificial Sequence
  BTRC__Homo_sapiens__NP_001243785
auggaccccgccgaggccgugcugcaggagaaggcccugaaguucaugugcagcaugcccagaagccuguggcugggcugcagcagccuggccgacagcaugcccagccugagaugccuguacaaccccggcaccggcgcccugaccgccuuccagaccuacaacagcugcgccagacugugccugaaccaggagaccgugugccuggccagcaccgccaugaagaccgagaacugcguggccaagaccaagcuggccaacggcaccagcagcaugaucgugcccaagcagagaaagcugagcgccagcuacgagaaggagaaggagcugugcgugaaguacuucgagcaguggagcgagagcgaccagguggaguucguggagcaccugaucagccagaugugccacuaccagcacggccacaucaacagcuaccugaagcccaugcugcagagagacuucaucaccgcccugcccgccagaggccuggaccacaucgccgagaacauccugagcuaccuggacgccaagagccugugcgccgccgagcuggugugcaaggagugguacagagugaccagcgacggcaugcuguggaagaagcugaucgagagaauggugagaaccgacagccuguggagaggccuggccgagagaagaggcuggggccaguaccuguucaagaacaagccccccgacggcaacgccccccccaacagcuucuacagagcccuguaccccaagaucauccaggacaucgagaccaucgagagcaacuggagaugcggcagacacagccugcagagaauccacugcagaagcgagaccagcaagggcguguacugccugcaguacgacgaccagaagaucgugagcggccugagagacaacaccaucaagaucugggacaagaacacccuggagugcaagagaauccugaccggccacaccggcagcgugcugugccugcaguacgacgagagagugaucaucaccggcagcagcgacagcaccgugagagugugggacgugaacaccggcgagaugcugaacacccugauccaccacugcgaggccgugcugcaccugagauucaacaacggcaugauggugaccugcagcaaggacagaagcaucgccgugugggacauggccagccccaccgacaucacccugagaagagugcuggugggccacagagccgccgugaacgugguggacuucgacgacaaguacaucgugagcgccagcggcgacagaaccaucaagguguggaacaccagcaccugcgaguucgugagaacccugaacggccacaagagaggcaucgccugccugcaguacagagacagacugguggugagcggcagcagcgacaacaccaucagacugugggacaucgagugcggcgccugccugagagugcuggagggccacgaggagcuggugagaugcaucagauucgacaacaagagaaucgugagcggcgccuacgacggcaagaucaaggugugggaccugguggccgcccuggaccccagagcccccgccggcacccugugccugagaacccugguggagcacagcggcagaguguucagacugcaguucgacgaguuccagaucgugagcagcagccacgacgacaccauccugaucugggacuuccugaacgaccccgccgcccaggccgagccccccagaagccccagcagaaccuacaccuacaucagcagauaa

SEQ ID NO: 14342 - RNA, 3153 nt, Artificial Sequence
  BUB1B__Homo_sapiens__NP_001202
auggccgccgugaagaaggagggcggcgcccugagcgaggccaugagccuggagggcgacgagugggagcugagcaaggagaacgugcagccccugagacagggcagaaucaugagcacccugcagggcgcccuggcccaggagagcgccugcaacaacacccugcagcagcagaagagagccuucgaguacgagaucagauucuacaccggcaacgacccccuggacgugugggacagauacaucagcuggaccgagcagaacuacccccagggcggcaaggagagcaacaugagcacccugcuggagagagccguggaggcccugcagggcgagaagagauacuacagcgaccccagauuccugaaccuguggcugaagcugggcagacugugcaacgagccccuggacauguacagcuaccugcacaaccagggcaucggcgugagccuggcccaguucuacaucagcugggccgaggaguacgaggccagagagaacuucagaaaggccgacgccaucuuccaggagggcauccagcagaaggccgagccccuggagagacugcagagccagcacagacaguuccaggccagagugagcagacagacccugcuggcccuggagaaggaggaggaggaggagguguucgagagcagcgugccccagagaagcacccuggccgagcugaagagcaagggcaagaagaccgccagagcccccaucaucagagugggcggcgcccugaaggcccccagccagaacagaggccugcagaaccccuucccccagcagaugcagaacaacagcagaaucaccguguucgacgagaacgccgacgaggccagcaccgccgagcugagcaagcccaccgugcagcccuggaucgccccccccaugcccagagccaaggagaacgagcugcaggccggccccuggaacaccggcagaagccuggagcacagacccagaggcaacaccgccagccugaucgccgugcccgccgugcugcccagcuucacccccuacguggaggagaccgcccagcagcccgugaugacccccugcaagaucgagcccagcaucaaccacauccugagcaccagaaagcccggcaaggaggagggcgacccccugcagagagugcagagccaccagcaggccagcgaggagaagaaggagaagaugauguacugcaaggagaagaucuacgccggcgugggcgaguucagcuucgaggagaucagagccgagguguucagaaagaagcugaaggagcagagagaggccgagcugcugaccagcgccgagaagagagccgagaugcagaagcagaucgaggagauggagaagaagcugaaggagauccagaccacccagcaggagagaaccggcgaccagcaggaggagaccaugcccaccaaggagaccaccaagcugcagaucgccagcgagagccagaagauccccggcaugacccugagcagcagcgugugccaggugaacugcugcgccagagagaccagccuggccgagaacaucuggcaggagcagccccacagcaagggccccagcgugcccuucagcaucuucgacgaguuccugcugagcgagaagaagaacaagagcccccccgccgacccccccagagugcuggcccagagaagaccccuggccgugcugaagaccagcgagagcaucaccagcaacgaggacgugagccccgacgugugcgacgaguucaccggcaucgagccccugagcgaggacgccaucaucaccggcuucagaaacgugaccaucugccccaaccccgaggacaccugcgacuucgccagagccgccagauucgugagcacccccuuccacgagaucaugagccugaaggaccugcccagcgaccccgagagacugcugcccgaggaggaccuggacgugaagaccagcgaggaccagcagaccgccugcggcaccaucuacagccagacccugagcaucaagaagcugagccccaucaucgaggacagcagagaggccacccacagcagcggcuucagcggcagcagcgccagcguggccagcaccagcagcaucaagugccugcagauccccgagaagcuggagcugaccaacgagaccagcgagaaccccacccagagccccuggugcagccaguacagaagacagcugcugaagagccugcccgagcugagcgccagcgccgagcugugcaucgaggacagacccaugcccaagcuggagaucgagaaggagaucgagcugggcaacgaggacuacugcaucaagagagaguaccugaucugcgaggacuacaagcuguucuggguggcccccagaaacagcgccgagcugaccgugaucaaggugagcagccagcccgugcccugggacuucuacaucaaccugaagcugaaggagagacugaacgaggacuucgaccacuucugcagcugcuaccaguaccaggacggcugcaucguguggcaccaguacaucaacugcuucacccugcaggaccugcugcagcacagcgaguacaucacccacgagaucaccgugcugaucaucuacaaccugcugaccaucguggagaugcugcacaaggccgagaucgugcacggcgaccugagccccagaugccugauccugagaaacagaauccacgaccccuacgacugcaacaagaacaaccaggcccugaagaucguggacuucagcuacagcguggaccugagagugcagcuggacguguucacccugagcggcuucagaaccgugcagauccuggagggccagaagauccuggccaacugcagcagccccuaccagguggaccuguucggcaucgccgaccuggcccaccugcugcuguucaaggagcaccugcagguguucugggacggcagcuucuggaagcugagccagaacaucagcgagcugaaggacggcgagcuguggaacaaguucuucgugagaauccugaacgccaacgacgaggccaccgugagcgugcugggcgagcuggccgccgagaugaacggcguguucgacaccaccuuccagagccaccugaacaaggcccuguggaaggugggcaagcugaccagccccggcgcccugcuguuccaguaa

SEQ ID NO: 14343 - RNA, 3198 nt, Artificial Sequence
  BUB1__Homo_sapiens__NP_001265545
auggacacccccgagaacgugcugcaguacauccaguggguggaggagaacuuccccgagaacaaggaguaccugaucacccugcuggagcaccugaugaaggaguuccuggacaagaagaaguaccacaacgaccccagauucaucagcuacugccugaaguucgccgaguacaacagcgaccugcaccaguucuucgaguuccuguacaaccacggcaucggcacccugagcagcccccuguacaucgccugggccggccaccuggaggcccagggcgagcugcagcacgccagcgccgugcugcagagaggcauccagaaccaggccgagcccagagaguuccugcagcagcaguacagacuguuccagaccagacugaccgagacccaccugcccgcccaggccagaaccagcgagccccugcacaacgugcaggugcugaaccagaugaucaccagcaagagcaaccccggcaacaacauggccugcaucagcaagaaccagggcagcgagcugagcggcgugaucagcagcgccugcgacaaggagagcaacauggagagaagagugaucaccaucagcaagagcgaguacagcgugcacagcagccuggccagcaagguggacguggagcagguggugauguacugcaaggagaagcugaucagaggcgagagcgaguucagcuucgaggagcugagagcccagaaguacaaccagagaagaaagcacgagcagugggugaacgaggacagacacuacaugaagagaaaggaggccaacgccuucgaggagcagcugcugaagcagaagauggacgagcugcacaagaagcugcaccaggugguggagaccagccacgaggaccugcccgccagccaggagagaagcgaggugaaccccgccagaaugggccccagcgugggcagccagcaggagcugagagcccccugccugcccgugaccuaccagcagacccccgugaacauggagaagaaccccagagaggccccccccguggugcccccccuggccaacgccaucagcgccgcccuggugagccccgccaccagccagagcaucgccccccccgugccccugaaggcccagaccgugaccgacagcauguucgccguggccagcaaggacgccggcugcgugaacaagagcacccacgaguucaagccccagagcggcgccgagaucaaggagggcugcgagacccacaagguggccaacaccagcagcuuccacaccacccccaacaccagccugggcauggugcaggccacccccagcaaggugcagcccagccccaccgugcacaccaaggaggcccugggcuucaucaugaacauguuccaggcccccacccugcccgacaucagcgacgacaaggacgaguggcagagccuggaccagaacgaggacgccuucgaggcccaguuccagaagaacgugagaagcagcggcgccuggggcgugaacaagaucaucagcagccugagcagcgccuuccacguguucgaggacggcaacaaggagaacuacggccugccccagcccaagaacaagcccaccggcgccagaaccuucggcgagagaagcgugagcagacugcccagcaagcccaaggaggaggugccccacgccgaggaguuccuggacgacagcaccguguggggcaucagaugcaacaagacccuggcccccagccccaagagccccggcgacuucaccagcgccgcccagcuggccagcacccccuuccacaagcugcccguggagagcgugcacauccuggaggacaaggagaacgugguggccaagcagugcacccaggccacccuggacagcugcgaggagaacaugguggugcccagcagagacggcaaguucagccccauccaggagaagagccccaagcaggcccugagcagccacauguacagcgccagccugcugagacugagccagcccgccgccggcggcgugcugaccugcgaggccgagcugggcguggaggccugcagacugaccgacaccgacgccgccaucgccgaggacccccccgacgccaucgccggccugcaggccgaguggaugcagaugagcagccugggcaccguggacgcccccaacuucaucgugggcaaccccugggacgacaagcugaucuucaagcugcugagcggccugagcaagcccgugagcagcuaccccaacaccuucgaguggcagugcaagcugcccgccaucaagcccaagaccgaguuccagcugggcagcaagcugguguacgugcaccaccugcugggcgagggcgccuucgcccagguguacgaggccacccagggcgaccugaacgacgccaagaacaagcagaaguucgugcugaaggugcagaagcccgccaaccccugggaguucuacaucggcacccagcugauggagagacugaagcccagcaugcagcacauguucaugaaguucuacagcgcccaccuguuccagaacggcagcgugcuggugggcgagcuguacagcuacggcacccugcugaacgccaucaaccuguacaagaacacccccgagaaggugaugccccagggccuggugaucagcuucgccaugagaaugcuguacaugaucgagcaggugcacgacugcgagaucauccacggcgacaucaagcccgacaacuucauccugggcaacggcuuccuggagcaggacgacgaggacgaccugagcgccggccuggcccugaucgaccugggccagagcaucgacaugaagcuguuccccaagggcaccaucuucaccgccaagugcgagaccagcggcuuccagugcguggagaugcugagcaacaagcccuggaacuaccagaucgacuacuucggcguggccgccaccguguacugcaugcuguucggcaccuacaugaaggugaagaacgagggcggcgagugcaagcccgagggccuguucagaagacugccccaccuggacauguggaacgaguucuuccacgugaugcugaacauccccgacugccaccaccugcccagccuggaccugcugagacagaagcugaagaagguguuccagcagcacuacaccaacaagaucagagcccugagaaacagacugaucgugcugcugcuggagugcaagagaagcagaaaguaa

SEQ ID NO: 14344 - RNA, 981 nt, Artificial Sequence
  BUB3__Homo_sapiens__NP_001007794
augaccggcagcaacgaguucaagcugaaccagccccccgaggacggcaucagcagcgugaaguucagccccaacaccagccaguuccugcuggugagcagcugggacaccagcgugagacuguacgacgugcccgccaacagcaugagacugaaguaccagcacaccggcgccgugcuggacugcgccuucuacgaccccacccacgccuggagcggcggccuggaccaccagcugaagaugcacgaccugaacaccgaccaggagaaccuggugggcacccacgacgcccccaucagaugcguggaguacugccccgaggugaacgugauggugaccggcagcugggaccagaccgugaagcugugggaccccagaacccccugcaacgccggcaccuucagccagcccgagaagguguacacccugagcgugagcggcgacagacugaucgugggcaccgccggcagaagagugcuggugugggaccugagaaacaugggcuacgugcagcagagaagagagagcagccugaaguaccagaccagaugcaucagagccuuccccaacaagcagggcuacgugcugagcagcaucgagggcagaguggccguggaguaccuggaccccagccccgaggugcagaagaagaaguacgccuucaagugccacagacugaaggagaacaacaucgagcagaucuaccccgugaacgccaucagcuuccacaacauccacaacaccuucgccaccggcggcagcgacggcuucgugaacaucugggaccccuucaacaagaagagacugugccaguuccacagauaccccaccagcaucgccagccuggccuucagcaacgacggcaccacccuggccaucgccagcagcuacauguacgagauggacgacaccgagcaccccgaggacggcaucuucaucagacaggugaccgacgccgagaccaagcccaagagcaccuaa

SEQ ID NO: 14345 - RNA, 1458 nt, Artificial Sequence
  BUD13__Homo_sapiens__NP_001153208
auggccgccgcccccccccugagcaaggccgaguaccugaagagauaccugagcggcgccgacgccggcguggacagaggcagcgagagcggcagaaagagaagaaagaagagacccaagcccggcggcgccggcggcaagggcaugagaaucguggacgacgacgugagcuggaccgccaucagcaccaccaagcuggagaaggaggaggaggaggacgacggcgaccugcccgugguggccgaguucguggacgagagacccgaggaggugaagcagauggaggccuucagaagcagcgccaaguggaagcugcugggcggccacaacgaggaccugcccagcaacagacacuucagacacgacacccccgacagcagccccagaagagugagacacggcacccccgaccccagccccagaaaggacagacacgacacccccgaccccagccccagaagagccagacacgacacccccgaccccagcccccugagaggcgccagacacgacagcgacaccagcccccccagaagaaucagacacgacagcagcgacaccagcccccccagaagagccagacacgacagccccgaccccagcccccccagaagaccccagcacaacagcagcggcgacugccagaaggccaccgacagcgaccugagcagccccagacacaagcagagccccggccaccaggacagcgacagcgaccugagcccccccagaaacagacccagacacagaagcagcgacagcgaccugagcccccccagaagaagacagagaaccaagagcagcgacagcgaccugagcccccccagaagaagccagccccccggcaagaaggccgcccacauguacagcggcgccaagaccggccuggugcugaccgacauccagagagagcagcaggagcugaaggagcaggaccaggagaccauggccuucgaggccgaguuccaguacgccgagaccguguucagagacaagagcggcagaaagagaaaccugaagcuggagagacuggagcagagaagaaaggccgagaaggacagcgagagagacgagcuguacgcccaguggggcaagggccuggcccagagcagacagcagcagcagaacguggaggacgccaugaaggagaugcagaagccccuggccagauacaucgacgacgaggaccuggacagaaugcugagagagcaggagagagagggcgaccccauggccaacuucaucaagaagaacaaggccaaggagaacaagaacaagaaggugagacccagauacagcggccccgcccccccccccaacagauucaacaucuggcccggcuacagaugggacggcguggacagaagcaacggcuucgagcagaagagauucgccagacuggccagcaagaaggccguggaggagcuggccuacaaguggagcguggaggacauguaa

SEQ ID NO: 14346 - RNA, 435 nt, Artificial Sequence
  BUD31__Homo_sapiens__NP_003901
augcccaaggugaagagaagcagaaaggccccccccgacggcugggagcugaucgagcccacccuggacgagcuggaccagaagaugagagaggccgagaccgagccccacgagggcaagagaaagguggagagccuguggcccaucuucagaauccaccaccagaagaccagauacaucuucgaccuguucuacaagagaaaggccaucagcagagagcuguacgaguacugcaucaaggagggcuacgccgacaagaaccugaucgccaaguggaagaagcagggcuacgagaaccugugcugccugagaugcauccagaccagagacaccaacuucggcaccaacugcaucugcagagugcccaagagcaagcuggaggugggcagaaucaucgagugcacccacugcggcugcagaggcugcagcggcuaa

SEQ ID NO: 14347 - RNA, 1083 nt, Artificial Sequence
  BVES__Homo_sapiens__XP_011533700
augaacuacaccgagagcagcccccugagagagagcaccgccaucggcuucacccccgagcuggagagcaucauccccgugcccagcaacaagaccaccugcgagaacuggagagagauccaccaccugguguuccacguggccaacaucugcuucgccgugggccuggugauccccaccacccugcaccugcacaugaucuuccugagaggcaugcugacccugggcugcacccuguacaucgugugggccacccuguacagaugcgcccuggacaucaugaucuggaacagcguguuccugggcgugaacauccugcaccugagcuaccugcuguacaagaagagacccgugaagaucgagaaggagcugagcggcauguacagaagacuguucgagccccugagagugccccccgaccuguucagaagacugaccggccaguucugcaugauccagacccugaagaagggccagaccuacgccgccgaggacaagaccagcguggacgacagacugagcauccugcugaagggcaagaugaaggugagcuacagaggccacuuccugcacaacaucuaccccugcgccuucaucgacagccccgaguucagaagcacccagaugcacaagggcgagaaguuccaggugaccaucaucgccgacgacaacugcagauuccugugcuggagcagagagagacugaccuacuuccuggagagcgagcccuuccuguacgagaucuucagauaccugaucggcaaggacaucaccaacaagcuguacagccugaacgaccccacccugaacgacaagaaggccaagaagcuggagcaccagcugagccugugcacccagaucagcaugcuggagaugagaaacagcaucgccagcagcagcgacagcgacgacggccugcaccaguuccugagaggcaccagcagcaugagcagccugcacgugagcagcccccaccagagagccagcgccaagaugaagcccaucgaggagggcgccgaggacgacgacgacguguucgagcccgccagccccaacacccugaaggugcaccagcugcccuaa

SEQ ID NO: 14348 - RNA, 1314 nt, Artificial Sequence
  BYSL__Homo_sapiens__NP_004044
augcccaaguucaaggccgccagaggcgugggcggccaggagaagcacgccccccuggccgaccagauccuggccggcaacgccgugagagccggcgugagagagaagagaagaggcagaggcaccggcgaggccgaggaggaguacgugggccccagacugagcagaagaauccugcagcaggccagacagcagcaggaggagcuggaggccgagcacggcaccggcgacaagcccgccgcccccagagagagaaccaccagacugggccccagaaugccccaggacggcagcgacgacgaggacgaggaguggcccacccuggagaaggccgccaccaugaccgccgccggccaccacgccgagguggugguggaccccgaggacgagagagccaucgagauguucaugaacaagaacccccccgccagaagaacccuggccgacaucaucauggagaagcugaccgagaagcagaccgagguggagaccgugaugagcgaggugagcggcuuccccaugccccagcuggaccccagagugcuggagguguacagaggcgugagagaggugcugagcaaguacagaagcggcaagcugcccaaggccuucaagaucauccccgcccugagcaacugggagcagauccuguacgugaccgagcccgaggccuggaccgccgccgccauguaccaggccaccagaaucuucgccagcaaccugaaggagagaauggcccagagauucuacaaccuggugcugcugcccagagugagagacgacguggccgaguacaagagacugaacuuccaccuguacauggcccugaagaaggcccuguucaagcccggcgccugguucaagggcauccugaucccccugugcgagagcggcaccugcacccugagagaggccaucaucgugggcagcaucaucaccaagugcagcauccccgugcugcacagcagcgccgccaugcugaagaucgccgagauggaguacagcggcgccaacagcaucuuccugagacugcugcuggacaagaaguacgcccugcccuacagagugcuggacgcccugguguuccacuuccugggcuucagaaccgagaagagagagcugcccgugcuguggcaccagugccugcugacccuggugcagagauacaaggccgaccuggccaccgaccagaaggaggcccugcuggagcugcugagacugcagccccacccccagcugagccccgagaucagaagagagcugcagagcgccgugcccagagacguggaggacgugcccaucaccguggaguaa

SEQ ID NO: 14349 - RNA, 5547 nt, Artificial Sequence
  BZRAP1__Homo_sapiens__NP_001248764
auggagcagcugaccacccugcccagacccggcgaccccggcgccauggagcccugggcccugcccaccuggcacagcuggacccccggcagaggcggcgagcccagcagcgccgcccccagcaucgccgacaccccccccgccgcccugcagcugcaggagcugagaagcgaggagagcagcaagcccaagggcgacggcagcagcagacccgugggcggcaccgaccccgagggcgccgaggccugccugcccagccugggccagcaggccagcagcagcggccccgccugccagagacccgaggacgaggagguggaggccuuccugaaggccaagcugaacaugagcuucggcgacagacccaaccuggagcugcugagagcccugggcgagcugagacagagaugcgccauccugaaggaggagaaccagaugcugagaaagagcagcuuccccgagaccgaggagaaggugagaagacugaagagaaagaacgccgagcuggccgugaucgccaagagacuggaggagagagccagaaagcugcaggagaccaaccugagaguggugagcgccccccugcccagacccggcaccagccuggagcugugcagaaaggcccuggccagacagagagccagagaccugagcgagaccgccagcgcccugcuggccaaggacaagcagaucgccgcccugcagagagagugcagagagcugcaggccagacugacccuggugggcaaggagggcccccaguggcugcacgugagagacuucgacagacugcugagagagagccagagagaggugcugagacugcagagacagaucgcccugagaaaccagagagagacccugccccugccccccagcuggccccccggccccgcccugcaggccagagccggcgcccccgcccccggcgcccccggcgaggccaccccccaggaggacgccgacaaccugcccgugauccugggcgagcccgagaaggagcagagagugcagcagcuggagagcgagcugagcaagaagagaaagaagugcgagagccuggagcaggaggccagaaagaagcagagaagaugcgaggagcuggagcugcagcugagacaggcccagaacgagaacgccagacugguggaggagaacagcagacugagcggcagagccaccgagaaggagcagguggagugggagaacgccgagcugagaggccagcugcugggcgugacccaggagagagacagcgcccugagaaagagccagggccugcagagcaagcuggagagccuggagcaggugcugaagcacaugagagagguggcccagagaagacagcagcuggagguggagcacgagcaggccagacugagccugagagagaagcaggaggaggugagaagacugcagcaggcccaggccgaggcccagagagagcacgagggcgccgugcagcugcuggagagcacccuggacagcaugcaggccagagugagagagcuggaggagcagugcagaagccagaccgagcaguucagccugcuggcccaggagcugcaggccuucagacugcaccccggcccccuggaccugcugaccagcgcccuggacugcggcagccugggcgacugcccccccccccccugcugcugcagcaucccccagcccugcagaggcagcggccccaaggaccuggaccugccccccggcagccccggcagaugcacccccaagagcagcgagcccgcccccgccacccugaccggcgugcccagaagaaccgccaagaaggccgagagccugagcaacagcagccacagcgagagcauccacaacagccccaagagcugccccacccccgagguggacaccgccagcgagguggaggagcuggaggccgacagcgugagccugcugcccgccgcccccgagggcagcagaggcggcgccagaauccagguguuccuggccagauacagcuacaaccccuucgagggccccaacgagaaccccgaggccgagcugccccugaccgccggcgaguacaucuacaucuacggcaacauggacgaggacggcuucuucgagggcgagcugauggacggcagaagaggccuggugcccagcaacuucguggagagagugagcgacgacgaccugcugaccagccugccccccgagcuggccgaccugagccacagcagcggccccgagcugagcuuccugagcgugggcggcggcggcagcagcagcggcggccagagcagcgugggcagaagccagcccagacccgaggaggaggacgccggcgacgagcugagccugagccccagccccgagggccugggcgagccccccgccgugcccuaccccagaagacugguggugcugaagcagcuggcccacagcguggugcuggccugggagcccccccccgagcagguggagcugcacggcuuccacaucugcgugaacggcgagcugagacaggcccugggccccggcgccccccccaaggccgugcuggagaaccuggaccugugggccggcccccugcacaucagcgugcaggcccugaccagcagaggcagcagcgacccccugagaugcugccuggccgugggcgccagagccggcguggugcccagccagcugagagugcacagacugaccgccaccagcgccgagaucaccugggugcccggcaacagcaaccuggcccacgccaucuaccugaacggcgaggagugcccccccgccagccccagcaccuacugggccaccuucugccaccugagacccggcacccccuaccaggcccagguggaggcccagcugcccccccagggccccugggagcccggcugggagagacuggagcagagagccgccacccugcaguucaccacccugcccgccggcccccccgacgccccccuggacgugcagaucgagcccggccccagccccggcauccugaucaucagcuggcugcccgugaccaucgacgccgccggcaccagcaacggcgugagagugaccggcuacgccaucuacgccgacggccagaagaucauggagguggccagccccaccgccggcagcgugcugguggagcugagccagcugcagcugcugcaggugugcagagaggugguggugagaaccaugagcccccacggcgagagcgccgacagcauccccgcccccaucacccccgcccuggcccccgccagccugcccgccagagugagcugccccagcccccaccccagccccgaggccagagccccccuggccagcgccagccccggccccggcgaccccagcagcccccugcagcaccccgccccccugggcacccaggagccccccggcgccccccccgccagccccagcagagagauggccaagggcagccacgaggacccccccgcccccugcagccaggaggaggccggcgccgccgugcugggcaccagcgaggagagaaccgccagcaccagcacccugggcgagaaggaccccggccccgccgcccccagccuggccaagcaggaggccgaguggaccgccggcgaggccugccccgccagcagcagcacccagggcgccagagcccagcaggcccccaacaccgagaugugccagggcggcgaccccggcagcggccugagacccagagccgagaaggaggacaccgccgagcugggcgugcaccuggugaacagccugguggaccacggcagaaacagcgaccugagcgacauccaggaggaggaggaggaggaggaggaggaggaggaggaggagcugggcagcagaaccugcagcuuccagaagcagguggccggcaacagcaucagagagaacggcgccaagagccagcccgaccccuucugcgagaccgacagcgacgaggagauccuggagcagauccuggagcugccccugcagcaguucugcagcaagaagcuguucagcauccccgaggaggaggaggaggaggaggaggacgaggaggaggagaagagcggcgccggcugcagcagcagagaccccggcccccccgagcccgcccugcugggccugggcugcgacagcggccagcccagaagacccggccagugcccccugagccccgagagcagcagagccggcgacugccuggaggacaugcccggccuggugggcggcagcagcagaagaagaggcggcggcagccccgagaagccccccagcagaagaagaccccccgaccccagagagcacugcagcagacugcugagcaacaacggcccccaggccagcggcagacugggccccaccagagagagaggcggccugcccgugaucgagggccccagaaccggccuggaggccagcggcagaggcagacugggccccagcagaagaugcagcagaggcagagcccuggagcccggccuggccagcugccugagccccaagugccuggagaucagcaucgaguacgacagcgaggacgagcaggaggccggcagcggcggcaucagcaucaccagcagcugcuaccccggcgacggcgaggccuggggcaccgccaccgugggcagacccagaggcccccccaaggccaacagcggccccaagcccuaccccagacugcccgccugggagaagggcgagcccgagagaagaggcagaagcgccaccggcagagccaaggagccccugagcagagccaccgagaccggcgaggccagaggccaggacggcagcggcagaagaggcccccagaagagaggcgugagagugcugagacccagcaccgccgagcuggugcccgccagaagccccagcgagacccuggccuaccagcaccugcccgugagaaucuucguggcccuguucgacuacgaccccgugagcaugagccccaaccccgacgccggcgaggaggagcugcccuucagagagggccagauccugaagguguucggcgacaaggacgccgacggcuucuaccagggcgagggcggcggcagaaccggcuacauccccugcaacaugguggccgagguggccguggacagccccgccggcagacagcagcugcugcagagaggcuaccugagccccgacauccugcuggagggcagcgcccacaccaccggccccccccccaagcccagaagaagcaagaaggccgagagcgagggccccgcccagcccugccccggcccccccaagcuggugcccagcgccgaccugaaggccccccacagcaugguggccgccuucgacuacaacccccaggagagcagccccaacauggacguggaggccgagcugcccuucagagccggcgacgugaucaccguguucggcggcauggacgacgacggcuucuacuacggcgagcugaacggccagagaggccuggugcccagcaacuuccuggagggccccggccccgaggccggcggccuggacagagagcccagaaccccccaggccgagagccagagaaccagaagaagaagagugcagugcuaa

SEQ ID NO: 14350 - RNA, 1260 nt, Artificial Sequence
  BZW1__Homo_sapiens__NP_001193996
augaacaaccagaagcagcagaagcccacccugagcggccagagauucaagaccagaaagagagacgagaaggagagauucgaccccacccaguuccaggacugcaucauccagggccugaccgagaccggcaccgaccuggaggccguggccaaguuccuggacgccagcggcgccaagcuggacuacagaagauacgccgagacccuguucgacauccugguggccggcggcaugcuggcccccggcggcacccuggccgacgacaugaugagaaccgacgugugcguguucgccgcccaggaggaccuggagaccaugcaggccuucgcccagguguucaacaagcugaucagaagauacaaguaccuggagaagggcuucgaggacgaggugaagaagcugcugcuguuccugaagggcuucagcgagagcgagagaaacaagcuggccaugcugaccggcgugcugcuggccaacggcacccugaacgccagcauccugaacagccuguacaacgagaaccuggugaaggagggcgugagcgccgccuucgccgugaagcuguucaagagcuggaucaacgagaaggacaucaacgccguggccgccagccugagaaaggugagcauggacaacagacugauggagcuguuccccgccaacaagcagagcguggagcacuucaccaaguacuucaccgaggccggccugaaggagcugagcgaguacgugagaaaccagcagaccaucggcgccagaaaggagcugcagaaggagcugcaggagcagaugagcagaggcgaccccuucaaggacaucauccuguacgugaaggaggagaugaagaagaacaacauccccgagcccguggugaucggcaucguguggagcagcgugaugagcaccguggaguggaacaagaaggaggagcugguggccgagcaggccaucaagcaccugaagcaguacagcccccugcuggccgccuucaccacccagggccagagcgagcugacccugcugcugaagauccaggaguacugcuacgacaacauccacuucaugaaggccuuccagaagaucguggugcuguucuacaaggccgaggugcugagcgaggagcccauccugaagugguacaaggacgcccacguggccaagggcaagagcguguuccuggagcagaugaagaaguucguggaguggcugaagaacgccgaggaggagagcgagagcgaggccgaggagggcgacuaa

SEQ ID NO: 14351 - RNA, 627 nt, Artificial Sequence
  C10orf107__Homo_sapiens__XP_005269657
auggacuucagcaucauccaguacagcaaguucaugacccugcuggccaugagccugcagaaccugaagacccugcacaugagccuggaggagagcaucaaguggcugggcgaggugauggccgagaucggccccacccacagccagaagagcgaggacuggaacaucuucgacgugaagcaggccaacgccaucaucgacuaccugaagaucagccuguuccagcacuacaagcuguacgaguucauguucuacagcgccagagaggagaucgugaucggcaccgagcaggugaucgagguggugaagagcgccugcggccccuuccccaacccccuggaggagggcaucagcuucgacaucuacagcaccuucaucgagccccccaccauccuggacaccgagaugaagagacuggaccaggagcagggccccgaggagagccagcccgagaccgacaccagcgacauggacccccuggugggcuucaccaucgaggacgugaagagcgugcuggaccaggugaccgacgacauccugaucggcauccagaccgagaucaacgagaagcugcagauccaggaggaggccuucaacgccagaaucgagaagcugaagaaggccuaa

SEQ ID NO: 14352 - RNA, 639 nt, Artificial Sequence
  C10orf10__Homo_sapiens__NP_008952
augagaagcagacugcugcugagcguggcccaccugcccaccaucagagagaccaccgaggagaugcugcugggcggccccggccaggagcccccccccagccccagccuggacgacuacgugagaagcaucagcagacuggcccagcccaccagcgugcuggacaaggccaccgcccagggccagcccagacccccccacagacccgcccaggccugcagaaagggcagacccgccgugagccugagagacaucaccgccagauucagcggccagcagcccacccugcccauggccgacaccguggacccccuggacuggcuguucggcgagagccaggagaagcagcccagccagagagaccugcccagaagaaccggccccagcgccggccuguggggcccccacagacagauggacagcagcaagcccaugggcgcccccagaggcagacugugcgaggccagaaugcccggccacagccuggccagacccccccaggacggccagcagagcagcgaccugagaagcuggaccuucggccagagcgcccaggccauggccagcagacacagacccagacccagcagcgugcugagaacccuguacagccaccugcccgugauccacgagcuguaa

SEQ ID NO: 14353 - RNA, 468 nt, Artificial Sequence
  C10orf113__Homo_sapiens__NP_001010896
auggccaagagcgagagaagaaucuacagcauggagagcauggcccccgagaucagcgaggacaucggcugcccccuggccuacaugagagagagcgugugcgcccugcugaucaaccagagcuucuucagcugcguggccgagauguacauccccgacaugaacagacccggcaaggccgagagaagagccgagaagggccugagaccccccagaaagcuggugggcgagaccagaagacugcagagcuggcccacccuggccagauggcugagaagagugagcuucagccuguacaagccccccauccaggccgcccccgagcccgaccccggcaacugggccaagagccccagacugagccugggccccgagggcaucaccaagggcaagcacggcuucaaguuccagggcaucaaggagaaguucaacgugagcaagaaggugcugaagaugaccuuccuguaa

SEQ ID NO: 14354 - RNA, 597 nt, Artificial Sequence
  C10orf11__Homo_sapiens__NP_114413
auggagaaguaccugagccugagcggcaaccacagcagcaacaagagaagccuggagggccugagcgccuucagaagccuggaggagcugauccuggacaacaaccagcugggcgacgaccuggugcugcccggccugcccagacugcacacccugacccugaacaagaacagaaucaccgaccuggagaaccugcuggaccaccuggccgaggugacccccgcccuggaguaccugagccugcugggcaacguggccugccccaacgagcuggugagccuggagaaggacgaggaggacuacaagagauacagaugcuucgugcuguacaagcugcccaaccugaaguuccuggacgcccagaaggugaccagacaggagagagaggaggcccuggugagaggcguguucaugaagguggugaagcccaaggccagcagcgaggacguggccagcagccccgagagacacuacaccccccugcccagcgccagcagagagcugaccagccaccagggcgugcugggcaagugcagauacguguacuacggcaagaacagcgagggcaacagauucaucagagacgaccagcuguaa

SEQ ID NO: 14355 - RNA, 1749 nt, Artificial Sequence
  C10orf2__Homo_sapiens__NP_001157284
augugggugcugcugagaagcggcuacccccugagaauccugcugccccugagaggcgaguggaugggcagaagaggccugcccagaaaccuggcccccggcccccccagaagaagauacagaaaggagacccugcaggcccuggacaugcccgugcugcccgugaccgccaccgagaucagacaguaccugagaggccacggcauccccuuccaggacggccacagcugccugagagcccugagccccuucgccgagagcagccagcugaagggccagaccggcgugaccaccagcuucagccuguucaucgacaagaccaccggccacuuccugugcaugaccagccuggccgagggcagcugggaggacuuccaggccagcguggagggcagaggcgacggcgccagagagggcuuccugcugagcaaggcccccgaguucgaggacagcgaggaggugagaagaaucuggaacagagccaucccccugugggagcugcccgaccaggaggaggugcagcuggccgacaccauguucggccugaccaaggugaccgacgacacccugaagagauucagcgugagauaccugagacccgccagaagccugguguuccccugguucagccccggcggcagcggccugagaggccugaagcugcuggaggccaagugccagggcgacggcgugagcuacgaggagaccaccauccccagacccagcgccuaccacaaccuguucggccugccccugaucagcagaagagacgccgagguggugcugaccagcagagagcuggacagccuggcccugaaccagagcaccggccugcccacccugacccugcccagaggcaccaccugccugccccccgcccugcugcccuaccuggagcaguucagaagaaucguguucuggcugggcgacgaccugagaagcugggaggccgccaagcuguucgccagaaagcugaaccccaagagaugcuuccuggugagacccggcgaccagcagcccagaccccuggaggcccugaacggcggcuucaaccugagcagaauccugagaaccgcccugcccgccuggcacaagagcaucgugagcuucagacagcugagagaggaggugcugggcgagcugagcaacguggagcaggccgccggccugagauggagcagauuccccgaccugaacagaauccugaagggccacagaaagggcgagcugaccguguucaccggccccaccggcagcggcaagaccaccuucaucagcgaguacgcccuggaccugugcagccagggcgugaacacccuguggggcagcuucgagaucagcaacgugagacuggccagagugaugcugacccaguucgccgagggcagacuggaggaccagcuggacaaguacgaccacugggccgacagauucgaggaccugccccuguacuucaugaccuuccacggccagcagagcaucagaaccgugaucgacaccaugcagcacgccguguacguguacgacaucugccacgugaucaucgacaaccugcaguucaugaugggccacgagcagcugagcaccgacagaaucgccgcccaggacuacaucaucggcguguucagaaaguucgccaccgacaacaacugccacgugacccuggugauccaccccagaaaggaggacgacgacaaggagcugcagaccgccagcaucuucggcagcgccaaggugagcggccuguaa

SEQ ID NO: 14356 - RNA, 321 nt, Artificial Sequence
  C10orf32__Homo_sapiens__NP_001129672
augauggccaccggcacccccgagagccaggccagauucggccagagcgugaagggccugcugaccgagaaggugaccaccugcggcaccgacgugaucgcccugaccaagcaggugcugaagggcagcagaagcagcgagcugcugggccaggccgccagaaacauggugcugcaggaggacgccauccugcacagcgaggacagccugagaaagauggccaucaucaccacccaccugcaguaccagcaggaggccauccagaagaacguggagcagagcagcgaccugcaggaccagcugaaccaccugcugaaguaa

SEQ ID NO: 14357 - RNA, 366 nt, Artificial Sequence
  C10orf35__Homo_sapiens__NP_660349
auggugagaauccuggccaacggcgagaucgugcaggacgacgaccccagagugagaaccaccacccagccccccagaggcagcauccccagacagagcuucuucaacagaggccacggcgccccccccggcggccccggccccagacagcagcaggccggcgccagacugggcgccgcccagagccccuucaacgaccugaacagacagcuggugaacaugggcuucccccaguggcaccugggcaaccacgccguggagcccgugaccagcauccugcugcuguuccugcugaugaugcugggcgugagaggccugcugcuggugggccugguguaccuggugagccaccugagccagagauaa

SEQ ID NO: 14358 - RNA, 936 nt, Artificial Sequence
  C10orf54__Homo_sapiens__NP_071436
augggcgugcccaccgcccuggaggccggcagcuggagauggggcagccugcuguucgcccuguuccuggccgccagccugggccccguggccgccuucaagguggccacccccuacagccuguacgugugccccgagggccagaacgugacccugaccugcagacugcugggccccguggacaagggccacgacgugaccuucuacaagaccugguacagaagcagcagaggcgaggugcagaccugcagcgagagaagacccaucagaaaccugaccuuccaggaccugcaccugcaccacggcggccaccaggccgccaacaccagccacgaccuggcccagagacacggccuggagagcgccagcgaccaccacggcaacuucagcaucaccaugagaaaccugacccugcuggacagcggccuguacugcugccuggugguggagaucagacaccaccacagcgagcacagagugcacggcgccauggagcugcaggugcagaccggcaaggacgcccccagcaacugcgugguguaccccagcagcagccaggacagcgagaacaucaccgccgccgcccuggccaccggcgccugcaucgugggcauccugugccugccccugauccugcugcugguguacaagcagagacaggccgccagcaacagaagagcccaggagcuggugagaauggacagcaacauccagggcaucgagaaccccggcuucgaggccagcccccccgcccagggcauccccgaggccaaggugagacacccccugagcuacguggcccagagacagcccagcgagagcggcagacaccugcugagcgagcccagcaccccccugagcccccccggccccggcgacguguucuuccccagccuggaccccgugcccgacagccccaacuucgaggugaucuaa

SEQ ID NO: 14359 - RNA, 558 nt, Artificial Sequence
  C10orf67__Homo_sapiens__NP_714925
augauggcccuggugagagacagaagagcccacuacgugaugagcaucgugaucagaugggugcacugcuucagcagcagccugagaggcaccuucggcaccagaugggaggccaugaaggccaaggccaccgagcugagagugugcugcgccagaagaaagagagaggccagagaguucaagcccccccagaugagaggcagcaccagacugaacaucagcgacgaccugaagaucggcuucuucagcaccgaccacgccacccagaccgacagcagcgagauccugagcgugaaggagcugagcagcagcacccagaagcuggcccagaugaugaagagccugcagguggacuucggcuuccugaagcagcugcugcagcugaaguucgaggacagacugaaggaggagagccugagccuguucaccauccugcacgacagaauccuggagaucgagaagcacuaccagcagaacgaggacaagaugagaaagagcuucaaccagcagcuggccgacgccaucgccgugaucaagggcauguaccagccccuguaa

SEQ ID NO: 14360 - RNA, 465 nt, Artificial Sequence
  C10orf82__Homo_sapiens__NP_653262
auggagcccagcaagaccuucaugagaaaccugcccaucacccccggcuacagcggcuucgugcccuuccugagcugccagggcaugagcaaggaggacgacaugaaccacugcgugaagaccuuccaggagaagacccagagauacaaggagcagcugagagagcugugcugcgccguggccaccgcccccaagcugaagcccgugaacagcgaggagaccgugcugcaggcccugcaccaguacaaccugcaguaccacccccugauccuggagugcaaguacgugaagaagccccugcaggagccccccauccccggcugggccggcuaccugcccagagccaaggugaccgaguucggcugcggcaccagauacaccgugauggccaagaacugcuacaaggacuuccuggagaucaccgagagagccaagaaggcccaccugaagcccuacgaggaguaa

SEQ ID NO: 14361 - RNA, 1338 nt, Artificial Sequence
  C10orf88__Homo_sapiens__NP_079218
auggagaccagaaccgaggacggcggccugaccagaagacccacccuggccagcagcugggacguggccggcggcgcccugacccacagccugcugcugaccagagccggccugggccccggcgacuucgacugggaggagcugcuggccccccccgcccccggccaggaccuggugauccugaagagaaaccacaacaacaaggacgagaaccccugcuuccuguaccugagaugcggccccgacggcggcgaggagaucgccagcaucggcauccugagcagcgccagaaacauggagguguaccugggcgaggaguacugcggcaccagcagaggcaagaacgugugcaccgugcuggacgacagcgagcacgagaagaucauccuguacaagaagaaccugaagcuggagagcagcacccacgccugcaagaucaagcugcugagcuucggcgagagacagugcguguucaucagcaaggugguggugcacaugagaagcguguucgccaacagcagcaccagcagccccgcccugggcagcagaaucgaccuggacaaggugcagaccaucauggagagcaugggcagcaagcugagccccggcgcccagcagcugauggacauggugagaugccagcagagaaacugcauccccaucggcgagcagcugcagagcgugcugggcaacagcggcuacaagcacaugaucggccugcagagcagcagcacccugggcacccugaacaagagcagcagcacccccuuccccuucagaaccggccugaccagcggcaacgugaccgagaaccugcagaccuacaucgacaagagcacccagcugcccggcggcgagaacagcaccaagcuggacgagugcaaggugaugccccagaaccacagcuuccuggagaacgaccugaagaacgccauggccagcuuccugcccaagaaggugagcgacaacagcaacauccccaacagcgagcugcugcccuuccugcagaaccugugcagccaggugaaccaccugcacgugggcaacaagaccgagugccaggagaacaucaccaagcacggcgagagaauccugggcgugggcauggaggagcagagcaucugcagcuaccuggagaagauccugagcaagaacauggagcugauggagaagaagcugauggacuacaucgaccagagaauccacgagcugcaggagcacaucgacgacaagaucgcccugcugcuggaccugcugcagaaccccaacagcccccccaccggcaucccccugagacacuacgacagcggcgagagacugagcaacggcgagagauaa

SEQ ID NO: 14362 - RNA, 2100 nt, Artificial Sequence
  C10orf90__Homo_sapiens__NP_001004298
augcugaagcugagcggcgagggccugagagacagcuaccacagcagaagagaccagaucgcccugaagaaccugcagagcgacgugaccgaggccaagagcgacuucaccaaggagacccuggccagccagaacaccaagaugaucagcagcaucgugaucagccagaugaucgacgagaacaagagcagagagaacagagccagccugccccugcccugcgccaucgcccagagcagagcccaccacgccaagcagagccuggccaacagaagcggcgugaacauccacagagccuucgcccugcugcccggcagacugggcauccccgcccccagcgacgagagaggccccgaggccgagcugccccccaaggaggagagacccugcggcggccccagaagaggcuucgccagcaucaccaucaccgccagaagagugggcccccccgccagagcccugguguggggcaccgccggcgacagccugugccccaagugcagagccgaggacacccuguuccaggccccccccgcccuggccaacggcgcccaccccggcagacaccagagaagcuucgccugcaccgaguucagcagaaacagcagcguggugagacugaaggugcccgaggcccacaccggccugugcgagagaagaaaguacugggugacccacgccgacgacaaggagaccagcuucagccccgacaccccccugagcggcaagagcccccugguguucagcagcugcgugcaccugagagugagccagcagugccccgacagcaucuacuacguggacaagagccugagcgugcccaucgagcccccccagaucgccagccccaagaugcacagaagcgugcugagccugaaccugaacugcagcagccacagacugaccgccgacggcguggacggccuggugaacagagagcccaucagcgaggcccugaagcaggagcugcuggagggcgaccaggaccuggugggccagagauggaaccccggccugcaggagagccaccugaaggagacccccagccugagaagagugcaccugggcaccggcgccugccccuggagcggcagcuucccccuggagaacaccgagcuggccaacgugggcgccaaccaggugaccgugagaaagggcgagaaggaccacaccacccacugccacgccagcgaccacgccaaccagcugagcauccacauccccggcuggagcuacagagccgugcacaccaagguguucagcggcagcagcaagagacagcagggcgaggugugcaugaccgugagcgccccccccguggagcagaagcccaccagacacuuccugcccaucggcgacagcagccccagcgacgacugccugagcagagaccugagcgagcccaccgagagaagacaccagagcuuccugaagcccagaauccuguuccccggcuuccugugcccccugcaggacgugugcgccagccugcaggaggacaacggcgugcagaucgagagcaaguuccccaagggcgacuacaccugcugcgaccugguggugaagaucaaggagugcaagaagagcgaggaccccaccacccccgagcccagccccgccgcccccagccccgcccccagagacggcgccggcagccccggccugagcgaggacugcagcgagagccagcagacccccgccagaagccugacccugcaggaggcccuggaggugagaaagccccaguucaucagcagaagccaggagagacugaagaagcuggagcacauggugcagcagagaaaggcccagagaaaggaggaccugagacagaagcagagccugcugcccaucagaaccagcaagaagcaguucaccaucccccacccccugagcgacaaccuguucaagcccaaggagagaugcaucagcgagaaggagaugcacaugagaagcaagagaaucuacgacaaccugcccgaggugaagaagaagaaggaggagcagagaaagagagugauccugcagagcaacagacugagagccgagguguucaagaagcagcugcuggaccagcugcugcagagaaacgccguguaa

SEQ ID NO: 14363 - RNA, 537 nt, Artificial Sequence
  C11orf21__Homo_sapiens__NP_001136418
auggccagcuuccugguguggccccugagaaccgcccugagaggcggcaagagcugggccggccccggcgugggcugcggcggcgacggcgccagaggcggcggcgagcugagccugagcaaccuggaccugcccggcgccggcgaggccggccuggagcaccacccccugcugggccaccuguucaucagcgccgugcccagauggccccaccugagcagccagagcggcguggagccccccgacagauggaccggcacccccggcuggcccagcagagaccaggaggcccccggcagcaugaugccccccgccgccgcccagcccagcgcccacggcgcccuggugccccccgccaccgcccacgagcccguggaccaccccgcccugcacuggcuggccugcugcugcugccugagccugcccggccagcugccccuggccaucagacugggcugggaccuggaccuggaggccggccccagcagcggcaagcugugccccagagccagaagauggcagccccugcccagcuaa

SEQ ID NO: 14364 - RNA, 3969 nt, Artificial Sequence
  C11orf30__Homo_sapiens__NP_064578
augcccgugguguggcccacccugcuggaccugagcagagacgagugcaagagaauccugagaaagcuggagcuggaggccuacgccggcgugaucagcgcccugagagcccagggcgaccugaccaaggagaagaaggaccugcugggcgagcugagcaaggugcugagcaucagcaccgagagacacagagccgaggugagaagagccgugaacgacgagagacugaccaccaucgcccacaacaugagcggccccaacagcagcagcgaguggagcaucgagggcagaagacuggugccccugaugcccagacuggugccccagaccgccuucaccgugaccgccaacgccguggccaacgccgccauccagcacaacgccagccugcccgugcccgccgagaccggcagcaaggagguggugugcuacagcuacaccagcaccaccagcacccccaccagcacccccgugcccagcggcagcaucgccaccgugaagagccccagacccgccagccccgccagcaacgugguggugcugcccagcggcagcaccguguacgugaagagcgugagcugcagcgacgaggacgagaagcccagaaagagaagaagaaccaacagcagcagcagcagccccguggugcugaaggaggugcccaaggccguggugcccgugagcaagaccaucaccgugcccgugagcggcagccccaagaugagcaacaucaugcagagcaucgccaacagccugcccccccacaugagccccgugaagaucaccuucaccaagcccagcacccagaccaccaacaccaccacccagaaggugaucaucgugaccaccagccccagcagcaccuucgugcccaacauccugagcaagagccacaacuacgccgccgugaccaagcuggugcccaccagcgugaucgccagcaccacccagaagccccccguggugaucaccgccagccagagcagccuggugagcaacagcagcagcggcagcagcagcagcacccccagccccauccccaacaccguggccgugaccgccguggugagcagcacccccagcguggugaugagcaccguggcccagggcgugagcaccagcgccaucaagauggccagcaccagacugcccagccccaagagccuggugagcgcccccacccagauccuggcccaguuccccaagcagcaccagcagagccccaagcagcagcuguaccaggugcagcagcagacccagcagcagguggcccagcccagccccgugagccaccagcagcagccccagcagagcccccugccccccggcaucaagcccaccauccagaucaagcaggagagcggcgugaagaucaucacccagcaggugcagcccagcaagauccugcccaagcccgugaccgccacccugcccaccagcagcaacagccccaucaugguggugagcagcaacggcgccaucaugaccaccaagcuggugaccacccccaccggcacccaggccaccuacaccagacccaccgugagccccagcaucggcagaauggccgccacccccggcgccgccaccuacgugaagaccaccagcggcagcaucaucaccguggugcccaagagccuggccacccugggcggcaagaucaucagcagcaacaucgugagcggcaccaccaccaagaucaccaccauccccaugaccagcaagcccaacgugaucguggugcagaagaccaccggcaagggcaccaccauccagggccugcccggcaagaacguggugaccacccugcugaacgccggcggcgagaagaccauccagaccgugcccaccggcgccaagcccgccauccugaccgccaccagacccaucaccaagaugaucgugacccagcccaagggcaucggcagcaccgugcagcccgccgccaagaucauccccaccaagaucguguacggccagcagggcaagacccaggugcugaucaagcccaagcccgugaccuuccaggccaccguggugagcgagcagaccagacagcuggugaccgagacccugcagcaggccagcagaguggccgaggccggcaacagcagcauccaggagggcaaggaggagccccagaacuacaccgacagcagcagcagcagcaccgagagcagccagagcagccaggacagccagcccguggugcacgugaucgccagcagaagacaggacuggagcgagcacgagaucgccauggagaccagccccaccaucaucuaccaggacgugagcagcgagagccagagcgccaccagcaccaucaaggcccugcuggagcugcagcagaccaccgugaaggagaagcuggagagcaagcccagacagcccaccaucgaccugagccagauggccgugcccauccagaugacccaggagaagagacacagccccgagagccccagcaucgccgugguggagagcgagcugguggccgaguacaucaccaccgagagaaccgacgagggcaccgagguggccuucccccugcuggugagccacagaagccagccccagcagcccagccagccccagagaacccugcugcagcacguggcccagagccagaccgccacccagaccagcgugguggugaagagcauccccgccagcagccccggcgccaucacccacaucaugcagcaggcccugagcagccacaccgccuucaccaagcacagcgaggagcugggcaccgaggagggcgagguggaggagauggacacccuggacccccagaccggccuguucuacagaagcgcccugacccagagccagagcgccaagcagcagaagcugagccagcccccccuggagcagacccagcugcaggugaagacccugcagugcuuccagaccaagcagaagcagaccauccaccugcaggccgaccagcugcagcacaagcugccccagaugccccagcugagcaucagacaccagaagcugaccccccugcagcaggagcaggcccagcccaagcccgacgugcagcacacccagcaccccaugguggccaaggacagacagcugcccacccugauggcccagcccccccagaccguggugcaggugcuggccgugaagaccacccagcagcugcccaagcugcagcaggcccccaaccagcccaagaucuacgugcagccccagaccccccagagccagaugagccugcccgccagcagcgagaagcagaccgccagccagguggagcagcccaucaucacccagggcagcagcgugaccaagaucaccuucgagggcagacagccccccaccgugaccaagaucaccggcggcagcagcgugcccaagcugaccagccccgugaccagcaucagccccauccaggccagcgagaagaccgccgugagcgacauccugaagaugagccugauggaggcccagaucgacaccaacguggagcacaugaucguggacccccccaagaaggcccuggccaccagcaugcugaccggcgaggccggcagccugcccagcacccacauggugguggccggcauggccaacagcaccccccagcagcagaagugcagagagagcugcagcagccccagcaccgugggcagcagccugaccaccagaaagaucgacccccccgccgugcccgccaccggccaguucaugagaauccagaacgugggccagaagaaggccgaggagagccccgccgagaucaucauccaggccaucccccaguacgccauccccugccacagcagcagcaacguggugguggagcccagcggccugcuggagcugaacaacuucaccagccagcagcuggacgacgaggagaccgccauggagcaggacaucgacagcagcaccgaggacggcaccgagcccagccccagccagagcagcgccgagagaagcuaa

SEQ ID NO: 14365 - RNA, 711 nt, Artificial Sequence
  C11orf53__Homo_sapiens__NP_940900
augcccggcagccccgugaccagcggcuacuacggcgugagaagaagcuuccugagcgacagcgacuuccacaacagcaagcaguucagcaacgacguguacaccagcagcgugggcaagcccuuccccugcgagagcagcgccggccagagccacgccgcccugcuggagcccuacuucccccaggagcccuacggcgacuacagaccccccgcccugacccccaacgccggcagccuguucagcgccagcccccugcccccccugcugcccccccccuuccccggcgaccccgcccacuuccuguucagagacagcugggagcagacccugcccgacggccugagccagcccgaccccgugagcgccgacgcccugcugacccugccccccagcaccagcugccugagccagcuggagagcggcagcaucgcccagcacagaggcagcagcuggggcagcagccuggccggcgcccagagcuacagccugcacgcccuggaggaccugcaccacacccccggcuaccccacccccccccccuaccccuucacccccuucaugaccgugagcaacgaccugccccccaaggugggcccccugagccccgacgaggaggccgacaccggcagccugcacgaccccagccccugggugaaggaggacggcagcaucgccuggggcagcuacgagugcagaagagccuacuaa

SEQ ID NO: 14366 - RNA, 942 nt, Artificial Sequence
  C11orf65__Homo_sapiens__NP_689800
augcccuggaaggaggagagcgaguucaccaagcaggacaaggccgccagagugauccagcaggccuggaagagcuuccugaacguggccaucuuccagcacuucaagagccugaucgaccugagaagacagggcgagcccagacagaucgugaaguacaucaaccccaaggaggccgagcugcuggacgccgccgccggcauccacgugagauucagacugggcggcgugaaguucccccccgacaucuacuacaagaucuucacccacagacccaucgaggaccugugcgccaacagccccagaaacuacgccaagcugcccgccaagcacaccagccacaacaagaacgaccaccugcaggaggaggaccacagcggcugguaccacagaaucgagaacaacggcuggagacccgugagcgacaccuucuggcugagcaccgacggcauggugguggaggacaagaaggagagcgaguuccacuucagcaagcugaagagaagacaggaccuggagaagaagagaaagcugagaaagaucgaguggaugagacagauguacuacagcggcagccuggaggccaagagcacccaccacgagacccugggccugauccacaccgccaccaagggccugaucagagccuucgaggacggcggcaucgacagcgugauggagugggagguggacgaggugcugaacuggaccaacacccugaacuucgacgaguacaucgccagcuggaaggagaucgccaccagcaacagcagcgccaacuucaagggcuucagauucaaccaggcccagaagaacaucuacaacuacggcggcgacaucagcaagaugcagaugggcauccccgacgacaccuacuacgagaacguguaccaggagcccaacgugaccagacugacccccgacagcaccuacggccuguaa

SEQ ID NO: 14367 - RNA, 882 nt, Artificial Sequence
  C11orf68__Homo_sapiens__NP_001129107
auggccgccgccgccgccgccgccguggccggcgugggcagaggcggcggcggcgccgagcccagacaggagagaagcagagccagaggcugggccggcguggagagaagcgagggcagaagcagaauggagcccggcgaggagcuggaggaggagggcagccccggcggcagagaggacggcuucaccgccgagcaccuggccgccgaggccauggccgccgacauggaccccuggcugguguucgacgccagaaccacccccgccaccgagcuggacgccuggcuggccaaguacccccccagccaggugaccagauacggcgaccccggcagccccaacagcgagcccgugggcuggaucgccguguacggccagggcuacagccccaacagcggcgacgugcagggccugcaggccgccugggaggcccugcagaccagcggcagacccaucacccccggcacccugagacagcuggccaucacccaccacgugcugagcggcaaguggcugaugcaccuggcccccggcuucaagcuggaccacgccugggccggcaucgccagagccgugguggagggccagcugcagguggccaaggugagccccagagccaaggagggcggcagacaggugaucugcguguacaccgacgacuucaccgacagacugggcgugcuggaggccgacagcgccaucagagccgccggcaucaagugccugcugaccuacaagcccgacguguacaccuaccugggcaucuacagagccaacagauggcaccugugccccacccuguacgagagcagauuccagcugggcggcagcgccagaggcagcagagugcuggacagagccaacaacguggagcugaccuaa

SEQ ID NO: 14368 - RNA, 594 nt, Artificial Sequence
  C11orf73__Homo_sapiens__NP_057485
auguucggcugccugguggccggcagacuggugcagaccgccgcccagcagguggccgaggacaaguucguguucgaccugcccgacuacgagagcaucaaccacguggugguguucaugcugggcaccauccccuuccccgagggcaugggcggcagcguguacuucagcuaccccgacagcaacggcaugcccguguggcagcugcugggcuucgugaccaacggcaagcccagcgccaucuucaagaucagcggccugaagagcggcgagggcagccagcaccccuucggcgccaugaacaucgugagaacccccagcguggcccagaucggcaucagcguggagcugcuggacagcauggcccagcagacccccgugggcaacgccgccgugagcagcguggacagcuucacccaguucacccagaagaugcuggacaacuucuacaacuucgccagcagcuucgccgugagccaggcccagaugacccccagccccagcgagauguucauccccgccaacguggugcugaagugguacgagaacuuccagagaagacuggcccagaacccccuguucuggaagaccuaa

SEQ ID NO: 14369 - RNA, 444 nt, Artificial Sequence
  C11orf74__Homo_sapiens__NP_001263656
augagcgcccacaugagcggccuggagaucauggacgaggaccagcugaucaaggacgugcuggacaaguuccugaacugccacgagcagaccuacgacgaggaguuccugaacaccuucacccaccugagccaggaccugcugcugcugcccggcgagguggagcaggacgugagcaccagcauccccagcugcauccccuucguggcccagccccccaccugcgaggugaagcccaagcccagcgugaagagaauggacaagcagaccgaggagauccugggcgacgaggugcagcuguucagccuggacgaggaguucgacuacgacaacgugaugcugaccagcaaguucagccccgccgagaucgagaacaucaaggagcugugcaagcagcagaagagaaaggacaccagccccgaccuggagaagagcugcgacuaa

SEQ ID NO: 14370 - RNA, 1536 nt, Artificial Sequence
  C11orf80__Homo_sapiens__NP_001289013
auggugcugaagaaguuccugaaggagauccagagcauccugcccggcaucagcgccaagcugaccuggaccagcgaggagggcagcuacagccaggacaugaccggcgugacccccuuccagaugaucuucgagguggacgagaagcccagaacccugaugaccgacugccuggugaucaagcacuuccugagaaagaucaucauggugcaccccaaggugagauuccacuucagcgugaaggugaacggcauccugagcaccgagaucuucggcguggagaacgagcccacccugaaccugggcaacggcaucgcccugcugguggacagccagcacuacgugagcagacccaacuucggcaccaucgagagccacugcagcagaauccaccccgugcugggccaccccgugaugcuguucauccccgaggacguggccggcauggaccugcugggcgagcugauccugacccccgccgccgcccugugccccagccccaaggugagcagcaaccagcugaacagaaucagcagcgugagcaucuuccuguacggcccccugggccugccccugauccugagcaccugggagcagcccaugaccaccuucuucaaggacaccagcagccugguggacuggaagaaguaccaccugugcaugauccccaaccuggaccugaaccuggacagagaccuggugcugcccgacgugagcuaccagguggagagcagcgaggaggaccagagccagaccauggacccccagggccagacccugcugcuguuccuguucguggacuuccacagcgccuuccccgugcagcagauggagaucuggggcguguacacccugcugaccacccaccugaacgccauccugguggagagccacagcguggugcagggcagcauccaguucaccguggacaaggugcuggagcagcaccaccaggccgccaaggcccagcagaagcugcaggccagccugagcguggccgugaacagcaucaugagcauccugaccggcagcaccagaagcagcuucagaaagaugugccugcagacccugcaggccgccgacacccaggaguucagaaccaagcugcacaagguguucagagagaucacccagcaccaguuccugcaccacugcagcugcgaggugaagcagcugacccuggagaagaaggacagcgcccagggcaccgaggacgcccccgacaacagcagccuggagcugcuggccgacaccagcggccaggccgagaacaagagacugaagagaggcagccccagaaucgaggagaugagagcccugagaagcgccagagcccccagccccagcgaggccgcccccagaagacccgaggccaccgccgccccccugacccccagaggcagagagcacagagaggcccacggcagagcccuggcccccggcagagccagccugggcagcagacuggaggacgugcuguggcugcaggaggugagcaaccugagcgaguggcugagccccagccccggccccuaa

SEQ ID NO: 14371 - RNA, 1035 nt, Artificial Sequence
  C11orf87__Homo_sapiens__XP_011541119
augggccccaagggcagcgacgccgugcagggcggcagaguguggaccggcagagagagaaagggcggccugagaaccagaagccccagaggcggccccgagugggugcugggcagagugggcagcagaagaagacaccagcccagaggcagaagaaaggaggagagcagaagaagcggcaaccuggugccccugcagagaaagggcgagagaggcgacguguucgagguggugagcgccagaaucagcagagccccccugacccccuggagccccugccugcccgccguggccccccuggugcugggcagccuggcccacccccugccccugcagggcgccgugcugggcggcgugggcagcgugcuguuccuggccggcagaaacggcgugcccaagagaggcagccuggugggccuggccccccccagccccgcccccaugagcgccagagcccccaaggagcugagacuggcccugccccccugccugcugaacagaaccuucgccagccccaacgccagcggcagcggcaacaccggcgccagaggccccggcgccgugggcagcggcaccugcaucacccaggugggccagcagcuguuccagagcuucagcagcacccuggugcugaucgugcuggugacccugaucuucugccugaucgugcugagccugagcaccuuccacauccacaagagaagaaugaagaagagaaagaugcagagagcccaggaggaguacgagagagaccacugcagcggcagcagaggcggcggcggccugcccagacccggcagacaggcccccacccacgccaaggagaccagacuggagagacagcccagagacagccccuucugcgcccccagcaacgccagcagccugagcagcagcagccccggccugcccugccagggccccugcgccccccccccccccccccccgccagcagcccccagggcgcccacgccgccagcagcugccuggacaccgccggcgagggccugcugcagaccguggugcugagcuaa

SEQ ID NO: 14372 - RNA, 2037 nt, Artificial Sequence
  C11orf95__Homo_sapiens__NP_001138408
auggagcccggcggcgaccacagaagcagaagcagcggcggcagaggcggccccggccccgccguggccagcgccagaggcagaagacugccccccgccggcagcagcggcagcgccgagcccgaggaggacgagggcggccaggaccugcagcuggagggcggcgcccugggcagcuggggcagcgccccccugcccagcagcagagccagaggccccgccagcagcggcagaaaguacagcgaccacugcgaggccagagccagcagacccggcaagagcagaauccccggcagagaccacagaagauacuaccacgaccacuggagacuggaguaccugauggacuucaaccccgccagacacggcauggugugcauggugugcggcagcagccuggccacccugaagcugagcaccaucaagagacacaucagacagaagcaccccuacagccugcacuggagccccagagagaaggaggugaucagcaacagcugggacgcccaccugggccugggcgccugcggcgaggccgagggccugggcgugcagggcgccgaggaggaggaggaggaggaggaggaggaggaggaggagggcgccggcgugcccgccugcccccccaagggccccggcaaggcccccgccggcggcggcugcagaagacagagaagaggcggccccguggcccccagagccagaagacugagacugagcgccagcagaagagccggcggcagcagaggccugggcgccagaagacuggagagaagacugaaggagagccugcagaacugguucagagccgagugccugauggacuacgaccccagaggcaacagacuggugugcauggccugcggcagagcccugcccagccugcaccuggacgacaucagagcccacgugcuggaggugcaccccggcagccugggccugagcggcccccagagaagcgcccugcugcaggccuggggcggccagcccgaggcccugagcgagcugacccagagcccccccggcgacgaccuggccccccaggaccugaccggcaagagcagagacagcgccagcgccgccggcgcccccagcagccaggaccugagcccccccgacgugaaggaggaggccggcugggugcccgagagacccggccccgccgaggaggaggaggagcuggaggagggcgagggcgagagagccggcgugcccggcagaagccccagaggcagagcccacagaagacacccccaggagagauggagacuggaguaccugauggagcuggacggcggcagaagaggccuggugugcggcgugugcggcggcgcccuggccagccugaagaugagcaccaucgagagacacaucagaagaagacaccccggcagcaccagacugggcggccccgugcaggcccugaucgccagagaguggagcgagaaggccgcccaccugcuggcccugggcccccccagacccgagagcccccagggccccaucccccccggcaccgccgccgccagcgacgagggcggcggcgacgaggaggaggagcccgaggaggaggaggaggaguggggcgacgugccccugagccccggcgccccccuggagagacccgccgaggaggaggaggacgaggaggacggccaggagcccggcggccuggcccugccccccccccccccccccccccccccccccccccccagaagcagagagcagagaagaaacuaccagcccagauggagaggcgaguaccugauggacuacgacggcagcagaagaggccuggugugcauggugugcggcggcgcccuggccacccugaaggugagcaccaucaagagacacauccugcaggugcaccccuucagcauggacuucacccccgaggagagacagaccauccuggaggccuacgaggaggccgcccugagaugcuacggccacgagggcuucggcccccccgcccccgcccccagagacggcggcgccgaccugaagagcggcgccgugugcagagccuaa

SEQ ID NO: 14373 - RNA, 1131 nt, Artificial Sequence
  C12orf10__Homo_sapiens__NP_067653
augggccaccaguuccugagaggccugcugacccugcugcugcccccccccccccuguacaccagacacagaaugcugggccccgagagcgugcccccccccaagagaagcagaagcaagcugauggccccccccagaaucggcacccacaacggcaccuuccacugcgacgaggcccuggccugcgcccugcugagacugcugcccgaguacagagacgccgagaucgugagaaccagagaccccgagaagcuggccagcugcgacaucgugguggacgugggcggcgaguacgaccccagaagacacagauacgaccaccaccagagaagcuucaccgagaccaugagcagccugagccccggcaagcccuggcagaccaagcugagcagcgccggccugaucuaccugcacuucggccacaagcugcuggcccagcugcugggcaccagcgaggaggacagcauggugggcacccuguacgacaagauguacgagaacuucguggaggagguggacgccguggacaacggcaucagccagugggccgagggcgagcccagauacgcccugaccaccacccugagcgccagaguggccagacugaaccccaccuggaaccaccccgaccaggacaccgaggccggcuucaagagagccauggaccuggugcaggaggaguuccugcagagacuggacuucuaccagcacagcuggcugcccgccagagcccugguggaggaggcccuggcccagagauuccagguggaccccagcggcgagaucguggagcuggccaagggcgccugccccuggaaggagcaccuguaccaccuggagagcggccugagcccccccguggccaucuucuucgugaucuacaccgaccaggccggccaguggagaauccagugcgugcccaaggagccccacagcuuccagagcagacugccccugcccgagcccuggagaggccugagagacgaggcccuggaccaggugagcggcauccccggcugcaucuucgugcacgccagcggcuucaucggcggccaccacaccagagagggcgcccugagcauggccagagccacccuggcccagagaagcuaccugccccagaucagcuaa

SEQ ID NO: 14374 - RNA, 1083 nt, Artificial Sequence
  C12orf42__Homo_sapiens__NP_940923
augagcaccgugaucugcaugaagcagagagaggaggaguuccugcugaccaucagacccuucgccaacagaaugcagaagagccccugcuacauccccaucgugagcagcgccacccugugggacagaagcacccccagcgccaagcacauccccugcuacgagagaaccagcgugcccugcagcagauucaucaaccacaugaagaacuucagcgagagccccaaguucagaagccugcacuuccugaacuuccccguguuccccgagagaacccagaacagcauggccugcaagagacugcugcacaccugccaguacaucgugcccagaugcagcgugagcaccgugagcuucgacgaggagagcuacgaggaguucagaagcagccccgcccccagcagcgagaccgacgaggccccccugaucuucaccgccagaggcgagaccgaggagagagccagaggcgcccccaagcaggccuggaacagcagcuuccuggagcagcuggugaagaagcccaacugggcccacagcgugaaccccgugcaccuggaggcccagggcauccacaucagcagacacaccagacccaagggccagccccugagcagccccaagaagaacagcggcagcgccgccagacccagcaccgccaucggccugugcagaagaagccagacccccggcgcccugcagagcaccggccccagcaacaccgagcuggagcccgaggagagaauggccgugcccgccggcgcccaggcccaccccgacgacauccagagcagacugcugggcgccagcggcaaccccgugggcaagggcgccguggccauggcccccgagaugcugcccaagcacccccacacccccagagacagaagaccccaggccgacaccagccugcacggcaaccuggccggcgccccccugccccugcuggccggcgccagcacccacuuccccagcaagagacugaucaaggugugcagcagcgccccccccagacccaccagaagauuccacaccgugugcagccaggcccugagcagacccguggugaacgcccaccugcacuaa

SEQ ID NO: 14375 - RNA, 666 nt, Artificial Sequence
  C12orf43__Homo_sapiens__NP_001273127
auguucugccagaaccccggcgccgccaacagccagcugagcaccagccagcccagccugagacacaaggugaacgagcacgagcaggacggcaacgagcugcagaccacccccgaguucagagcccacguggccaagaagcugggcgcccugcuggacagcuucaucaccaucagcgaggccgccaaggagcccgccaaggccaaggugcagaagguggcccuggaggacgacggcuucagacuguucuucaccagcgugcccggcggcagagagaaggaggagagcccccagcccagaagaaagagacagcccagcagcagcagcagcgaggacagcgacgaggaguggagaagaugcagagaggccgccgugagcgccagcgacauccugcaggagagcgccauccacagccccggcaccguggagaaggaggccaagaagaagagaaagcugaagaagaaggccaagaagguggccagcguggacagcgccguggccgccaccacccccaccagcauggccaccgugcagaagcagaagagcggcgagcugaacggcgaccaggugagccugggcaccaagaagaagaagaaggccaagaaggccagcgagaccagccccuucccccccgccaagagcgccaccgccauccccgccaacuaa

SEQ ID NO: 14376 - RNA, 1245 nt, Artificial Sequence
  C12orf50__Homo_sapiens__NP_689802
auggagaugcagcagaacugcagcaucagcugcuucugggagacccagccccugggcugcgugaagaucagcugcaucuucuaccacagcaagcccagaaacaucaacggccuguuccugccccccagcagcaacaucacccugcagaaggagauccaggagggcaucccccugcagagccagagccaggagccccugaagccccaggagaacaucagcagacccauccaccacccccuggugcugaagaccaacuucgaggaggaggaggagguggacgagcagaacgacgccagcagccuguggaccaagacccccgaggagaucgaggagaagagagccaucaaggagaugugcuacaagagcggcgaguacuacagauuccacaccccccccgacauccugagcagcaagagcaugacccccaccgccgagaagcagcuggagaagccccuggagaacggcagcgagcugcaggagggcgacagccugaccgugcccaccaagcugagccaguacgagagacagggcgagaucaagaccagccugcacggcaagcccaagaccgacaucgccgccuucgagaacggcggcggcgacugcuacgugccccagagagugaucuuccugggcguggacgagagcgaggcccugaccgaggagaaggagaucaccaucagcaagugcagcaacaccaaggacaacaaggacagcccccaccccaagcacagccugaccaccagacuggugcccaccacccacgugcugaacgccaccgagaacaucagcaugaagugcagagaggaccccagcagcaugaacgacgugcagcccgugaagaagccccacuucaagggcgugaagaagagaaaguggaucuacgacgagccccagaacuuccccaacagcggcaugcagagagccgugcaggcccccagaccccagaacaagaugagcuaccacagaaacaacaagaacagaaacgccgagaacgccagcuacauccacgugcagagagacgccgugagaaccguggcccugaacgcccccagcagaagcagacccacccacggcagcuacaacaaggugcacgccaacagagagcccaagcccaaccugagccccgacaaguacaccagcaccagcuacaacgacagcgccuggagaaagagaauccccuucagcaagaccuacagcaagagcgagaagaucuaccccgagcccagaagaaacggcagcaaguaa

SEQ ID NO: 14377 - RNA, 381 nt, Artificial Sequence
  C12orf57__Homo_sapiens__NP_001288763
auggccagcgccagcacccagcccgccgcccugagcgccgagcaggccaagguggugcuggccgaggugauccaggccuucagcgcccccgagaacgccgugagaauggacgaggccagagacaacgccugcaacgacaugggcaagaugcugcaguucgugcugcccguggccacccagauccagcaggaggugaucaaggccuacggcuucagcugcgacggcgagggcgugcugaaguucgccagacuggugaagagcuacgaggcccaggaccccgagaucgccagccugagcggcaagcugaaggcccuguuccugccccccaugacccugcccccccacggccccgccgccggcggcagcguggccgccagcuaa

SEQ ID NO: 14378 - RNA, 813 nt, Artificial Sequence
  C12orf5__Homo_sapiens__NP_065108
auggccagauucgcccugaccguggugagacacggcgagaccagauucaacaaggagaagaucauccagggccagggcguggacgagccccugagcgagaccggcuucaagcaggccgccgccgccggcaucuuccugaacaacgugaaguucacccacgccuucagcagcgaccugaugagaaccaagcagaccaugcacggcauccuggagagaagcaaguucugcaaggacaugaccgugaaguacgacagcagacugagagagagaaaguacggcgugguggagggcaaggcccugagcgagcugagagccauggccaaggccgccagagaggagugccccguguucaccccccccggcggcgagacccuggaccaggugaagaugagaggcaucgacuucuucgaguuccugugccagcugauccugaaggaggccgaccagaaggagcaguucagccagggcagccccagcaacugccuggagaccagccuggccgagaucuucccccugggcaagaaccacagcagcaaggugaacagcgacagcggcauccccggccuggccgccagcgugcugguggugagccacggcgccuacaugagaagccuguucgacuacuuccugaccgaccugaagugcagccugcccgccacccugagcagaagcgagcugaugagcgugacccccaacaccggcaugagccuguucaucaucaacuucgaggagggcagagaggugaagcccaccgugcagugcaucugcaugaaccugcaggaccaccugaacggccugaccgagaccagauaa

SEQ ID NO: 14379 - RNA, 501 nt, Artificial Sequence
  C12orf65__Homo_sapiens__NP_001181924
augagcaccgugggccuguuccacuuccccaccccccugaccagaaucugccccgcccccuggggccugagacugugggagaagcugacccugcugagccccggcaucgccgugacccccgugcagauggccggcaagaaggacuaccccgcccugcugagccuggacgagaacgagcuggaggagcaguucgugaagggccacggccccggcggccaggccaccaacaagaccagcaacugcguggugcugaagcacauccccagcggcaucguggugaagugccaccagaccagaagcguggaccagaacagaaagcuggccagaaagauccugcaggagaagguggacguguucuacaacggcgagaacagccccgugcacaaggagaagagagaggccgccaagaagaagcaggagagaaagaagagagccaaggagacccuggagaagaagaagcugcugaaggagcugugggagagcagcaagaaggugcacuaa

SEQ ID NO: 14380 - RNA, 1407 nt, Artificial Sequence
  C12orf66__Homo_sapiens__NP_001287869
augggcgagagcaucccccuggccgcccccgugcccguggagcaggccgugcuggagaccuucuucagccaccugggcaucuucagcuacgacaaggccaaggacaacguggagaaggagagagaggccaacaagagcgccggcggcagcuggcugagccugcuggccgcccuggcccaccuggccgccgccgagaagguguaccacagccugaccuaccugggccagaagcugggcggccagagcuucuucagcagaaaggacagcaucagaaccaucuacaccagccugcacaacgagcugaagaagguggugaccggcagaggcgcccugggcggcaccgccccccacguggaggagcugcugagccaccugagcgagcagcugugcuucuucgugcaggccagaauggagaucgccgacuucuacgagaagauguacacccugagcacccagaaguucaucaacgccgaggagcuggugggccugcuggacgccaucaugaagaaguacagcagcagauuccaccaccccauccugagcccccuggagagcagcuuccagcuggagguggacgugcugugccaccugcugaaggcccaggcccaggugagcgaguggaaguuccugcccagccuggugaaccugcacagcgcccacaccaagcugcagaccuggggccagaucuucgagaagcagagagagaccaagaagcaccuguucggcggccagagccagaaggccgugcagcccccccaccuguuccuguggcugaugaagcugaagaacaugcugcuggccaaguucagcuucuacuuccacgaggcccugagcagacagaccaccgccagcgagaugaagacccugaccgccaaggccaaccccgacuucuucggcaagaucagcagcuucaucagaaaguacgacgccgccaacgugagccugaucuucgacaacagaggcagcgagagcuuccagggccacggcuaccaccacccccacagcuacagagaggcccccaagggcguggaccaguaccccgccguggugagccugcccagcgacagacccgugaugcacuggcccaacgugaucaugaucaugaccgacagaaccagcgaccugaacagccuggagaagguggugcacuucuacgacgacaaggugcagagcaccuacuuccugaccagacccgagccccacuucaccaucgugaucaucuucgagagcaagaagagcgagagagacagccacuucaucagcuuccugaacgaggugagccuggcccugaagaaccccaagguguucgccagccugaagcccggcagcaagggcagcugcuaccagugcaacuacuucguggccuucugccugaacuacagcaagcugcugcugcagagaaaguaa

SEQ ID NO: 14381 - RNA, 192 nt, Artificial Sequence
  C12orf75__Homo_sapiens__NP_001138671
augggcugcggcaacagcaccgccaccagcgccggcgccggccagggccccgccggcgccgccaaggacgugaccgaggagagcgugaccgaggacgacaagagaagaaacuacggcggcguguacgugggccugcccagcgaggccgugaacauggugagcagccagaccaagaccgugagaaagaacuaa

SEQ ID NO: 14382 - RNA, 438 nt, Artificial Sequence
  C12orf77__Homo_sapiens__NP_001094809
augauccccaagcuggccacccccagagacaucagccugcuggugaucaaggaggccagcagcagagccagaaacaacauccagauccuggacccccuggaccacaucgccagacugaccaacuacacccugaccagcugcuucagcagcaacaaggugcccaccaugcccggcagccugcccaccggcagcaagcagggcaacgugcagacccuggacagcaucagauggaugcccgccacccccgugcccgcccccgagugccaccagaaguacgccaucagcaccgagaccgccuuccccacccugagcaccuucaugaacaccgagaagagcgugaagggcagcaacgccgacuucaccaagagaaaccccagauggagauuccuguucggcaucuacugcagccugcaccacgccaugaccaucuucaucuaa

SEQ ID NO: 14383 - RNA, 735 nt, Artificial Sequence
  C14orf166__Homo_sapiens__NP_057123
auguucagaagaaagcugaccgcccuggacuaccacaaccccgccggcuucaacugcaaggacgagaccgaguucagaaacuucaucguguggcuggaggaccagaagaucagacacuacaagaucgaggacagaggcaaccugagaaacauccacagcagcgacuggcccaaguucuucgagaaguaccugagagacgugaacugccccuucaagauccaggacagacaggaggccaucgacuggcugcugggccuggccgugagacuggaguacggcgacaacgccgagaaguacaaggaccuggugcccgacaacagcaagaccgccgacaacgccaccaagaacgccgagccccugaucaaccuggacgugaacaaccccgacuucaaggccggcgugauggcccuggccaaccugcugcagauccagagacacgacgacuaccuggugaugcugaaggccaucagaauccuggugcaggagagacugacccaggacgccguggccaaggccaaccagaccaaggagggccugcccguggcccuggacaagcacauccugggcuucgacaccggcgacgccgugcugaacgaggccgcccagauccugagacugcugcacaucgaggagcugagagagcugcagaccaagaucaacgaggccaucguggccgugcaggccaucaucgccgaccccaagaccgaccacagacugggcaaggugggcagauaa

SEQ ID NO: 14384 - RNA, 378 nt, Artificial Sequence
  C14orf177__Homo_sapiens__NP_872366
augcacagaaaggagcccggcgccagacuggaggccaccagaggcgccgccagaccccacaagcagggcaccaagcccaugaucaccagacccagcgugagccagcugggcgagggcaagugccccagcagccagcaccugcagagccugagacacaacaagcagcacgcccugacccugaccaaggccagaugcugcggcgagugcagcaccugcuucugcaccgaggagaagagcgagugccagagacacgaggagaccagccccggcagcugcaaccaccagaucaugagcgccagcaccaucagcgccuucugcgccacccccagauucaagcagcuguucaagggcaccguggagcagaugagccagauguaa

SEQ ID NO: 14385 - RNA, 423 nt, Artificial Sequence
  C14orf1__Homo_sapiens__NP_009107
augagcagauuccugaacgugcugagaagcuggcuggugauggugagcaucaucgccaugggcaacacccugcagagcuucagagaccacaccuuccuguacgagaagcuguacaccggcaagcccaaccuggugaacggccugcaggccagaaccuucggcaucuggacccugcugagcagcgugaucagaugccugugcgccaucgacauccacaacaagacccuguaccacaucacccuguggaccuuccugcuggcccugggccacuuccugagcgagcuguucguguacggcaccgccgcccccaccaucggcgugcuggccccccugaugguggccagcuucagcauccugggcaugcuggugggccugagauaccuggagguggagcccgugagcagacagaagaagagaaacuaa

SEQ ID NO: 14386 - RNA, 537 nt, Artificial Sequence
  C15orf32__Homo_sapiens__NP_694585
augaacaagagaaccagcguggacgccagcaaggaggaccugcaccccgccgacccccagagcggcgagggcgugccccccaacagaaagaacaccaagaccagccccagaggcgagggcaccgccccccccuucagcgccagacccugcguguggacccugugcgagaugcugagcauccuggcccuggugggcgugcugcaccccuucuacagaagcaacaaccagguguaccagaagcugaagacccaccugagaugccagagcagcagaguggacggccugaugcugaagcccacccugcugacccccagccagcugaagagccccgagggccaccugauccugcccaccuucaaccaccuggugaucagacacauccuggaccccaagcagaucuucugcguggccgacgugugcaccgacugcaaguucaacugcggcagcaucgagagacaccagaagagacaccugaugagagugagccaggacugggagcaccugaucagauacagaaaccagaucugccugagcuaa

SEQ ID NO: 14387 - RNA, 846 nt, Artificial Sequence
  C15orf41__Homo_sapiens__XP_011520412
augauccugaccaaggcccaguacgacgagaucgcccagugccuggugagcgugccccccaccagacagagccugagaaagcugaagcagagauuccccagccagagccaggccacccugcugagcaucuucagccaggaguaccagaagcacaucaagagaacccacgccaagcaccacaccagcgaggccaucgagagcuacuaccagagauaccugaacggcguggugaagaacggcgccgcccccgugcugcuggaccuggccaacgagguggacuacgcccccagccugauggccagacugauccuggagagauuccugcaggagcacgaggagaccccccccagcaagagcaucaucaacagcaugcugagagaccccagccagauccccgacggcgugcuggccaaccagguguaccagugcaucgugaacgacugcugcuacggcccccugguggacugcaucaagcacgccaucggccacgagcacgaggugcugcugagagaccugcugcuggagaagaaccugagcuuccuggacgaggaccagcugagagccaagggcuacgacaagacccccgacuucauccugcaggugcccguggccguggagggccacaucauccacuggaucgagagcaaggccagcuucggcgacgagugcagccaccacgccuaccugcacgaccaguucuggagcuacuggaacagauucggccccggccuggugaucuacugguacggcuucauccaggagcuggacugcaacagagagagaggcauccugcugaaggccugcuuccccaccaacaucgugacccugugccacagcaucgccuaa

SEQ ID NO: 14388 - RNA, 252 nt, Artificial Sequence
  C15orf48__Homo_sapiens__NP_922946
augagcuucuuccagcugcugaugaagagaaaggagcugaucccccuggugguguucaugaccguggccgccggcggcgccagcagcuucgccguguacagccuguggaagaccgacgugauccuggacagaaagaagaaccccgagcccugggagaccguggaccccaccgugccccagaagcugaucaccaucaaccagcaguggaagcccaucgaggagcugcagaacgugcagagagugaccaaguaa

SEQ ID NO: 14389 - RNA, 540 nt, Artificial Sequence
  C15orf53__Homo_sapiens__NP_997327
auggagcugcagggcgcccaggaggaccugggcaucagccugagcagccccagaagaaaccacgagaccagacccggcagcaaggccaagggcagaagcagcaucugccugcaggccagcguguggauggccggcggcaagcugagacugagagccagcgagcaccugacccagggccaccagcaggagcugagagacuggaaccugggcgaggacgccagccugcuguucagcaagagccccuucggcgccggcaagcugauccaggcccccgcccacguguucagacagugcugggugcagggcaacgccuggaucagcugcaucaccaaguucgacagcaagagaagccccgagguggccagcagccccagcuaccugaccgugcccagaagaagcccccugcccguguuccugagacccagcgacagaugcgugugcggcggcugcuaccugggcaagagcaccagaagaagagccugccagagccugcugagcgacccccugggcgugaccuuccccacccagaccagacccuaa

SEQ ID NO: 14390 - RNA, 882 nt, Artificial Sequence
  C15orf59__Homo_sapiens__XP_005254426
augaacaucagaggcgcccccgaccugggccagcccagcgacgaccccagcagcggcggcgagagagagagaaucagacagagaaugaagauggugaucggccagcuggagggcauccugagagagcugaaggagguggccaaggagcugagagagguggugagccagaucgacaagcugaccagcgacuucgacuucgagcuggagcccgacgacuggaccaccgccaccgugagcagcaccagcagcagcgacaaggccggcaugggcggccccuucgaccugggccaccuggacuucaugaccgccgacauccugagcgacagcugggaguucugcagcuuccuggacgugagcacccccagcgacagcguggacggccccgagagcaccagacccggcgccggccccgacuacagacugaugaacggcggcacccccauccccaacggccccagaguggagacccccgacagcagcagcgaggaggccuucggcgccggccccaccgugaagagccagcugccccagagaacccccggcaccagagagagagugagauucagcgacaaggugcuguaccacgcccugugcugcgacgacgaggagggcgacggcgagcaggagguggaggaggaggaggugggccugccccccgagcccgcccacaccgaggcccacgccggcccccacaagcccagccccgcccccuacaagagcagaagaagcccccugaccagcagacacagcggcagcacccuggcccccgagcagaccagaagagugaccagaaacagcagcacccagaccgugagcgacaagagcacccagaccgugcugcccuacaccgccaccagacagaaggccagaggcaagaacuaa

SEQ ID NO: 14391 - RNA, 828 nt, Artificial Sequence
  C16orf72__Homo_sapiens__NP_054836
auggaggagagaaaggaggagggcgaggccgagauccaggagcacggccccgagcacugguucagcaagugggagagacagugccuggccgaggccgagcaggacgagcagcugccccccgagcugcaggaggaggccgccgccgccgcccagcccgagcacaagcagcagaagcuguggcaccuguuccagaacagcgccaccgccguggcccagcuguacaaggacagagugugccagcagcccggccugagccugugggugcccuuccagaacgccgccaccgccgugaccaaccuguacaaggagagcguggacacccaccagagaagcuucgacaucggcauccagaucggcuaccagagaagaaacaaggacgugcuggccugggugaagaagagaagaagaaccaucagaagagaggaccugaucagcuuccugugcggcaaggugcccccccccagaaacagcagagccccccccagacugaccguggugagccccaacagagccaccagcaccgagaccagcagcagcguggagaccgaccugcagcccuucagagaggccaucgcccugcacggccugagcggcgccauggccagcaucagcgugagaagcagcacccccggcagccccacccacgugagcagcggcagcaacgccagcagaagaagaaacggccugcacgacguggaccugaacaccuucaucagcgaggagauggcccugcaccuggacaacggcggcaccagaaagagaaccagcgcccagugcggcgacgugaucaccgacagccccacccacaagagaaacagaaugaucuaa

SEQ ID NO: 14392 - RNA, 231 nt, Artificial Sequence
  C16orf74__Homo_sapiens__NP_996850
augggccugaagaugagcugccugaagggcuuccagaugugcgugagcagcagcagcagcagccacgacgaggcccccgugcugaacgacaagcaccuggacgugcccgacaucaucaucaccccccccacccccaccggcaugaugcugcccagagaccugggcagcaccguguggcuggacgagaccggcagcugccccgacgacggcgagaucgaccccgaggccuaa

SEQ ID NO: 14393 - RNA, 798 nt, Artificial Sequence
  C16orf78__Homo_sapiens__NP_653203
augagcgagcagcagauggaccugaaggaccugaugcccaccaagagaaaguacauguggaagaccgccgaggacagaagaaugagcgaccugaccugcgugcuggaguggcuggagagaagacagggcaagaagaagcaggcccccgagaagcagaagcccaagguggugaccgugcugaagagaaacaagaagaaggaggagaagaagggcaagggccugaugaccgccagaggcggcaacagaagagacaccgagaccagccagcaggcccugggcaagagauucagaaaggacgccgccagcuacagaagccuguacggcguggagcagaagggcaagcaccugagcauggugcccggcagcuacaucaaggacggccccaagaagagcgacaccgacaucaaggacgccguggaccccgagagcacccagagacccaaccccuucagaagacagagcaucgugcuggaccccaugcugcaggagggcaccuucaacagccagagagccaccuucaucagagacuggagcaacaagaugcccgacauggccuacgagagaaagcugaagagccugauggagaagagcaccgagcccaagauggagaccaugagaaugcugaagcccgaggaggugcugagcugcagauaccugagacugagcaaggagaacaucagaacccugcugaagcugugcaaggacgccggcaugaacguggacauccacccccacaugguggaggaggacaucgacgccaagaagguguucaccggcauccccagcauggcccuguaa

SEQ ID NO: 14394 - RNA, 720 nt, Artificial Sequence
  C16orf95__Homo_sapiens__NP_001182053
augagagccagcagaagcccccccagccccagaagaugccaccaccaccacgaggccaccggcgccgccagcggcgccgccgccggcggccccggcgccggcugcgugggccugugcagacuggcccugacccccagcgcccaggacggcagaaacagcaccuuccagaccuacaagaaggaggugugccugcccagacacagcaugcaccccggccccugggccaucugcugcgagugccagaccagauucggcggcagacugcccgugagcagaguggaggccgcccugcccuacugggugccccugagccugagacccagaaagcagagccagaagaccgugcaguuccccaucccccagaccgccaagaugugccccugccugugccacagauucggcggcagacugcccaugcccagagaccaggccgugaugcccuacugggugccccaggugcugagaagccagcagcagaucgugagaagacagcagagccugaagggcauccaggccccccugcuggacgccugcugcuggcacaacugcuggagaaucugcggcgacgagugccugcugagcaaguuccagcagcugcaggcccccuaccaggaccagcugcccgcccccgccgccagacugcugccccugggccugcugacccugcugcaggccauccccagagugaucauggccaucagacagugcuucggcguguaa

SEQ ID NO: 14395 - RNA, 666 nt, Artificial Sequence
  C17orf51__Homo_sapiens__NP_001106905
augggcgagaagagcagaagaaagggccccgcccccagacacgccgacggcaagcugggcagaaccugcgaccaccccuacgcccccuggagcuucacccccagcagcagagcccccaccgccugggugagaccccccugccccgugugggccagcagacugcaggagcacagccccgagcccagaagagccagagccccccccaccagaagagcccaggccgcccuguacgcccccgcccugagacugagagaccaccuggacagauucagcauccugaugaccagcugcaccagcuggcugcaggccccccaggcccccggccugugcagagacgagcagagcagcagaaucagcgugccccagcugagcggcgcccccauccugcugcccgaccuggagggcaccaagcugagcaacuuccaggagagcagcccccugccccacaagcacgagagaaaggacaagagaagcacccccgaggaggagggcagaagcgcccccgagaagaucauccagagccugaagcugugccccggcggccacagacccgccagccugagcagcggcugccccgccggcugcagacugagcuucaaccugccccccagcaugcugcugagcgugcagaagugcugcaugcccagcagccugaagaccugcuaa

SEQ ID NO: 14396 - RNA, 1944 nt, Artificial Sequence
  C17orf53__Homo_sapiens__NP_076937
auggccugcagccugcagaagcuguucgccguggaggaggaguucgaggacgaggacuuccugagcgccguggaggacgccgagaacagauucaccggcagccugcccgugaacgccggcagacugagacccgugagcagcagaccccaggagaccgugcaggcccagagcagcagacugcugcugcugcaccccaccgcccccagcgaggcccugggccugcccgaccuggaccugugccugcccgccagcagcacccccagcgccgacagcagacccagcugcaucggcgccgccccccugagacccgugagcaccagcagcagcuggaucggcaaccagagaagagugaccgugaccgaggugcugagagagaccgccagaccccagagcagcgcccugcacccccugcugaccuucgagagccagcagcagcaggugggcggcuucgagggccccgagcaggacgaguucgacaaggugcuggccagcauggagcuggaggagcccggcauggagcuggagugcggcgugagcagcgaggccauccccauccugcccgcccagcagagagagggcagcgugcuggccaagaaggccagagugguggaccugagcggcagcugccagaagggccccgugcccgccauccacaaggccggcaucaugagcgcccaggacgagagccuggaccccgugauccagugcagaacccccagacccccccugagacccggcgccgugggccaccugcccgugcccaccgcccugaccgugcccacccagcagcugcacugggaggugugcccccagagaagccccgugcaggcccugcagccccugcaggccgccagaggcaccauccagagcagcccccagaacagauuccccugccagcccuuccagagccccagcagcuggcugagcggcaaggcccaccugcccagacccagaacccccaacagcagcugcagcacccccagcagaaccagcagcggccuguuccccagaaucccccugcagccccaggcccccgugagcagcaucggcagccccgugggcacccccaagggcccccagggcgcccugcagacccccaucgugaccaaccaccuggugcagcuggugaccgccgccagcagaaccccccagcagcccacccaccccagcaccagagccaagaccagaagauuccccggccccgccggcauccugccccaccagcagagcggcagaagccuggaggacaucauggugagcgccccccagacccccacccacggcgcccuggccaaguuccagaccgagaucguggccagcagccaggccagcguggaggaggacuucggcagaggccccuggcugaccaugaagagcacccugggccuggacgagagagaccccagcugcuuccugugcaccuacagcaucgugauggugcugagaaagcaggccgcccugaagcagcugcccagaaacaaggugcccaacauggccgugaugaucaagagccugaccagaagcaccauggacgccagcgugguguucaaggaccccaccggcgagaugcagggcaccgugcacagacugcugcuggagaccugccagaacgagcugaagcccggcagcgugcugcugcugaagcagaucggcguguucagccccagccugagaaaccacuaccugaacgugacccccaacaaccuggugcacaucuacagccccgacagcggcgacggcagcuuccugaagcccagccagcccuuccccaaggacagcggcagcuuccagcacgacguggccgccaagcccgaggagggcuucagaaccgcccagaaccuggaggccgaggccagccccgaggaggagcugcccgaggccgacgaccuggacggccugcugagcgagcugcccgaggacuucuucugcggcaccagcagcuaa

SEQ ID NO: 14397 - RNA, 711 nt, Artificial Sequence
  C17orf64__Homo_sapiens__NP_859058
auggaggccagcgacggccagggcggcgagggcgacaagccccuggagcaggugaccaacgugagcugccuggagaccagcagcagcgccagccccgccagagacagccugaugagacacgccaagggccuggaccaggacaccuucaagaccugcaaggaguaccugagaccccugaagaaguuccugagaaagcugcaccugcccagagaccugccccagaagaagaagcugaaguacaugaagcagagccugguggugcugggcgaccacaucaacaccuuccugcagcacuacugccaggccugggagaucaagcacuggagaaagaugcuguggagauucaucagccuguucagcgagcuggaggccaagcagcugagaagacuguacaaguacaccaagagcagccagcccgccaaguuccuggugaccuucugcgccagcgacgcccccgagagaagccugcuggccgacagagaggacagccugcccaagcugugccacgccuggggccugcacagcaacaucagcggcaugaaggagagacugagcaacaugcagacccccggccagggcagcccccugcccggccagcccagaagccaggaccacgugaagaaggacagccugagagagcugagccagaagcccaagcugaagagaaagagaaucaaggaggcccccgagacccccgagaccgagcccuaa

SEQ ID NO: 14398 - RNA, 1140 nt, Artificial Sequence
  C17orf96__Homo_sapiens__NP_001124149
auggagacccugugccccgcccccagacuggccgugcccgccagccccagaggcagccccugcagccccacccccagaaagcccugcagaggcacccaggaguucagcccccugugccugagagcccuggccuucugcgcccuggccaagcccagagccagcagccugggccccggccccggcgagcuggccgccagaagccccgugcugagaggcccccaggccccccugagacccggcggcugggcccccgacggccugaagcaccugugggcccccaccggcagacccggcgugcccaacaccgccgccggcgaggacgccgacguggccgccugccccagaagaggcgaggaggaggagggcggcggcggcuucccccacuucggcgugagaagcugcgccccccccggcagaugccccgcccccccccaccccagagagagcaccaccagcuucgccagcgccccccccagacccgcccccggccuggagccccagagaggccccgccgccagccccccccaggagcccagcagcagaccccccagcccccccgccggccugagcaccgagcccgccggccccggcaccgcccccagacccuuccugcccggccagcccgccgagguggacggcaaccccccccccgccgcccccgaggcccccgccgccagccccagcaccgccagccccgcccccgccgcccccggcgaccugagacaggagcacuucgacagacugaucagaagaagcaagcuguggugcuacgccaagggcuucgcccuggacacccccagccugagaagaggccccgagagaccccccgccaagggccccgccagaggcgccgccaagaagagaagacugcccgcccccccccccagaaccgcccagcccagaagacccgcccccacccugcccaccaccagcaccuucagccugcugaacugcuuccccugcccccccgcccugguggugggcgaggacggcgaccugaagcccgccagcagccugagacugcagggcgacagcaagcccccccccgcccacccccuguggagauggcagaugggcggccccgccgugcccgagccccccggccugaaguucuggggcaucaacauggacgagagcuaa

SEQ ID NO: 14399 - RNA, 1602 nt, Artificial Sequence
  C18orf54__Homo_sapiens__NP_001275909
auggccaagagcaagaccaagcacagacugugcagccaggagagcagcgugagcgcccugcuggccagcugcacccugagcggcagcaacagcagcaacagcgacggcagcuuccacuacaaggacaagcuguacagaagcgccagccaggcccugcaggccuacaucgacgacuucgaccugggccagaucuaccccggcgccagcaccggcaagaucaacaucgacgaggacuucaccaacaugagccaguucugcaacuacaucuacaagcccaacaacgccuucgagaaccuggaccacaagaagcacagcaacuucaucagcugcagaagacacaccgugaacgacaucgacagcaugagccugaccaccgacgaccugcugagacugcccgccgacggcagcuucagcuacaccuacgugggccccagccacagaaccagcaagaagaacaagaagugcagaggcagacugggcagccuggacaucgagaagaacccccacuuccagggccccuacaccagcaugggcaaggacaacuucgugacccccgugaucagaagcaacaucaacggcaagcagugcggcagacugaagaaccccaagcugaugaacagaaccaacaacugcaucagcgagagcagccugagcuuccccaagaagagcagcuucaaggacagcagcgagcacagccuggagaagaacuaccccagauggcugaccagccagaagagcgaccugaacgugagcggcaucaccagcauccccgacuucaaguaccccguguggcugcacaaccaggaccugcugcccgacgccaacagccagagaguguaccagaucuucaaggacgaccagugcagccccagacacagccaccaggcccagggcaccagcagacugaucaacaagcuggacugcuucgaguacgccuucgagcccagcaacuucagcaacagccugagcgacgacaaggagcuggugaacgaguacaagugcgacuucgagcacagccagugccagugcgagaacccccugcugcccggccagagcaccaagcccuucagcggcgacaagaucgagcugcugauccugaaggccaagagaaaccuggagcagugcaccgaggagcugcccaagagcaugaagaaggacgacagccccugcagccuggacaagcuggaggccgacagaagcugggagaacauccccgugaccuucaagagccccgugcccgugaacagcgacgacagcccccagcagaccagcagagccaagagcgccaagggcgugcuggaggacuuccugaacaacgacaaccagagcugcacccugagcggcggcaagcaccacggccccguggaggcccugaagcagaugcuguucaaccugcaggccgugcaggagagauucaaccagaacaagaccaccgaccccaaggaggagaucaagcaggugagcgaggacgacuucagcaagcugcagcugaaggagagcaugauccccaucaccagaagccugcagaaggcccugcaccaccugagcagacugagagaccugguggacgacaccaacggcgagagaagccccaagauguaa

SEQ ID NO: 14400 - RNA, 1686 nt, Artificial Sequence
  C18orf8__Homo_sapiens__NP_001263271
augggcgaggaggacuacuaccuggagcugugcgagagacccgugcaguucgagaaggccaaccccgugaacugcguguucuucgacgaggccaacaagcagguguucgccgugagaagcggcggcgccaccggcgugguggugaagggccccgacgacagaaaccccaucagcuucagaauggacgacaagggcgaggugaagugcaucaaguucagccuggagaacaagauccuggccgugcagagaaccagcaagaccguggugcugcccgagaagagaagccugaagcugcugaagagccacaaccugaacgugaacugguacauguacugccccgagagcgccgugauccugcugagcaccaccgugcuggagaacgugcugcagcccuuccacuucagagccggcaccaugagcaagcugcccaaguucgagaucgagcugcccgccgcccccaagagcaccaagcccagccugagcgagagagacaucgccauggccaccaucuacggccagcuguacgugcuguuccugagacaccacagcagaaccagcaacagcaccggcgccgagguggugcuguaccaccugcccagagagggcgccugcaagaagaugcacauccugaagcugaacagaaccggcaaguucgcccugaacgugguggacaaccuggugguggugcaccaccaggacaccgagaccagcgugaucuucgacaucaagcugagaggcgaguucgacggcagcgugaccuuccaccaccccgugcugcccgccagaagcauccagcccuaccagauccccaucaccggccccgccgccgugaccagccagagccccgugcccugcaagcuguacagcagcagcuggaucguguuccagcccgacaucaucaucagcgccagccagggcuaccuguggaaccugcaggugaagcuggagcccaucgugaaccugcugcccgacaagggcagacugauggacuuccugcugcagagaaaggagugcaagauggugauccugagcgugugcagccagaugcugagcgagagcgacagagccagccugcccgugaucgccaccguguucgacaagcugaaccacgaguacaagaaguaccuggacgccgagcagagcuacgccauggccguggaggccggccagagcagaagcagcccccugcugaagagacccgugagaacccaggccgugcuggaccagagcgacguguacacccacgugcugagcgccuucguggagaagaaggagaugccccacaaguucgugaucgccgugcugauggaguacaucagaagccugaaccaguuccagaucgccgugcagcacuaccugcacgagcuggugaucaagacccuggugcagcacaaccuguucuacaugcugcaccaguuccugcaguaccacgugcugagcgacagcaagccccuggccugccugcugcugagccuggagagcuucuacccccccgcccaccagcugagccuggacaugcugaagaugcugcagagcagacugaagaccaccugcuucagcauccaguacagcgccuuccugaacagcgagaccagcgugugcgagggcgcccccaucagccaccagggcaacaccgugaagaacaugcugcuguucagcaacagauuccuggagaccaagcuguaa

SEQ ID NO: 14401 - RNA, 459 nt, Artificial Sequence
  C19orf12__Homo_sapiens__NP_001026896
auggagagacugaagagccacaagcccgccaccaugaccaucaugguggaggacaucaugaagcugcugugcagccugagcggcgagagaaagaugaaggccgccgugaagcacagcggcaagggcgcccuggugaccggcgccauggccuucgugggcggccuggugggcggcccccccggccuggccgugggcggcgccgugggcggccugcugggcgccuggaugaccagcggccaguucaagcccgugccccagauccugauggagcugccccccgccgagcagcagagacuguucaacgaggccgccgccaucaucagacaccuggaguggaccgacgccgugcagcugaccgcccuggugaugggcagcgaggcccugcagcagcagcugcuggccaugcuggugaacuacgugaccaaggagcugagagccgagauccaguacgacgacuaa

SEQ ID NO: 14402 - RNA, 648 nt, Artificial Sequence
  C19orf18__Homo_sapiens__NP_689687
auggacaaggugcagagcggcuuccugauccuguuccuguuccugauggagugccagcugcaccugugccugcccuacgccgacggccugcaccccaccggcaacaucaccggccugcccggcagcaagagaagccagccccccagaaacaucaccaaggagcccaagguguucuuccacaagacccagcugcccggcauccagggcgccgccagcagaagcaccgccgccagccccaccaaccccaugaaguuccugagaaacaaggccaucaucagacacagacccgcccuggugaaggugauccugaucagcagcguggccuucagcaucgcccugaucugcggcauggccaucagcuacaugaucuacagacuggcccaggccgaggagagacagcagcuggagagccuguacaagaaccugagaaucccccugcugggcgacgaggaggagggcagcgaggacgagggcgagagcacccaccugcugcccgagaacgagaacgagcuggagaaguucauccacagcgugaucaucagcaagagaagcaagaacaucaagaagaagcugaaggaggagcagaacagcgugaccgagaacaagaccaagaacgccagccacaacggcaagauggaggaccuguaa

SEQ ID NO: 14403 - RNA, 399 nt, Artificial Sequence
  C19orf24__Homo_sapiens__NP_060384
augggccccagagugcugcagcccccccugcugcugcugcugcuggcccugcugcuggccgcccugcccugcggcgccgaggaggccagcccccugagacccgcccaggugacccugagccccccccccgccgugaccaacggcagccagcccggcgccccccacaacagcacccacaccagaccccccggcgccagcggcagcgcccugaccagaagcuucuacgugauccugggcuucugcggccugaccgcccuguacuuccugaucagagccuucagacugaagaagccccagagaagaagauacggccugcuggccaacaccgaggaccccaccgagauggccagccuggacagcgacgaggagaccguguucgagagcagaaaccugagauaa

SEQ ID NO: 14404 - RNA, 1362 nt, Artificial Sequence
  C19orf26__Homo_sapiens__NP_689982
augcagcccaccgccaccauggccaccgccgccaccaccaccaccaccaccaccgccaccguggcccugaccaccagcugggacaacgccaccggcagacccaccgccgagcccgaccccauccuggacaacuacgugcugcuggugguggugaugagccuguucgugggcggcacccugguggugcugagcggcgugcugcugcugugcaagagaugcugggacgugcaccagagacugaacagagccauggaggaggccgagaagaccaccaccaccuaccuggacaacggcacccaccccgcccaggaccccgacuucagaggcgaggaccccgagugccaggacgccgagaccgagagauuccugagcaccagcagcaccggcagaagagugagcuucaacgaggccgcccuguucgagcagagcagaaagacccaggacaagggcagaagauacacccugaccgagggcgacuuccaccaccugaagaacgccagacugacccaccugcaccugcccccccugaagaucgugaccauccacgagugcgacagcggcgaggccagcagcgccaccaccccccaccccgccaccagccccaaggccacccuggccaucuuccagccccccggcaaggcccugaccggcagaagcgugggccccagcagcgcccugcccggcgaccccuacaacagcgccgccggcgccaccgacuucgccgagaucagccccagcgccagcagcgacagcggcgagggcaccagccuggacgccggcaccagaagcaccaaggccggcggccccggcgccgccgccggccccggcgaggccggccccggcagcggcgccggcaccgugcugcaguuccugaccagacugagaagacacgccagccuggacggcgccagccccuacuucaaggugaagaaguggaagcuggagcccagccagagagccgccagccuggacaccagaggcagccccaagagacaccacuuccagagacagagagccgccagcgagagcaccgagcaggaggagggcgacgccccccaggaggacuucauccaguacaucgccagagccggcgacgccguggccuucccccaccccagacccuuccuggccagccccccccccgcccugggcagauacuucagcguggacggcggcgccagaggcggccccgugggccccugcccccccagccccccccccagaagacccagagagagaagccccggccccguggacaccagaagccccgccagcagcggcaaggccccccccagaggcggccugaccggcgccaccagccccgccuggaccagaggcggcaagcagggcgagaccggcuaa

SEQ ID NO: 14405 - RNA, 321 nt, Artificial Sequence
  C19orf33__Homo_sapiens__NP_277055
auggaguucgaccugggcgccgcccuggagcccaccagccagaagcccggcgugggcgccggccacggcggcgaccccaagcugagcccccacaaggugcagggcagaagcgaggccggcgccggccccggccccaagcagggccaccacagcagcagcgacagcagcagcagcagcagcgacagcgacaccgacgugaagagccacgccgccggcagcaagcagcacgagagcauccccggcaaggccaagaagcccaaggugaagaagaaggagaagggcaagaaggagaagggcaagaagaaggaggccccccacuaa

SEQ ID NO: 14406 - RNA, 648 nt, Artificial Sequence
  C19orf40__Homo_sapiens__NP_689479
auggagaagaacccccccgacgacaccggccccgugcacgugccccugggccacaucguggccaacgagaaguggagaggcagccagcuggcccaggagaugcagggcaagaucaagcugaucuucgaggacggccugacccccgacuucuaccugagcaacagaugcugcauccuguacgugaccgaggccgaccugguggccggcaacggcuacagaaagagacuggugagagugagaaacagcaacaaccugaagggcaucguggugguggagaagaccagaaugagcgagcaguacuuccccgcccugcagaaguucaccgugcuggaccugggcauggugcugcugcccguggccagccagauggaggccagcugccuggugauccagcuggugcaggagcagaccaaggagcccagcaagaacccccugcugggcaagaagagagcccugcugcugagcgagcccagccugcugagaaccgugcagcagauccccggcgugggcaaggugaaggccccccugcugcugcagaaguuccccagcauccagcagcugagcaacgccagcaucggcgagcuggagcagguggugggccaggccguggcccagcagauccacgccuucuucacccagcccagauaa

SEQ ID NO: 14407 - RNA, 1518 nt, Artificial Sequence
  C19orf45__Homo_sapiens__XP_011526294
auggccaccggcgcccugcugcccugcagcagacccugccccaugagcagacuggacuuccugaaggccagccacuucagccugggccccgaccugagacugcacgagggcaccaugagaaccaccagccacagagacuucgccuaccccgccgccaccagagagccccccagccugcagcccccccccgcccugcuguuccccauggaccccagaugggacagagaggagagagugagcgaggcccacagagccuuccccccccccagcaccccccccugggagcugcugcaggcccaggccagagagagaacccuggccaugcaggccggcaaccugcaccugcacgaggacgcccacgccggcaucggccugagcaacgcccacgccgccuacggcuggcccgagcugcccgccagaaccagagagagaaucagaggcgccagacugaucuucgacagagacagccugccccccggcgacagagacaagcugagaaucccccccaccacccaccaggcccuguuccccccccacgacgccagaccccagcccagagcccccagcugccaccugggcggccccaacacccugaagugggacuacaccagacaggacggcaccagcuaccagagacaguuccaggcccugcccggcccccccgcccugagaugcaagagagccagcagcggcguggagcugggcgacugcaagaucagcuacggcagcaccugcagcgagcagaagcaggccuacagaccccaggaccugcccgaggacagauacgacaaggcccaggccaccgcccacauccacugcgugaacaucagacccggcgacggccuguucagagacagaaccaccaaggccgagcacuucuacgccagagagcccgagcccuucgugcugcaccacgaccagacccccgagagccacauccugaagggcaacuggugccccggccccggcagccuggacaccuucaugcaguacuucuacggccagccccccccccccacccagccccccagcagacacgugccccacgagaagcugcagagccacgugacccugggcgagcccaagcugcugaagagauucuucaagaccaccaugggcagcgacuacugccccagcgaguggagacaggugcagaaggcccccaaccugcaccugcagcagagcuaccugcccagaggcaccggcgaguucgacuuccugaccaugaaccagaagaugcugaagccccacagaaccccccccgcccccgugaccgaggagaugcugcagagaugcaaguacagccacauggagcccccccugggcggccugagauucuucagcacccaguacaaggacgaguuccccuucaaguaccagggccccgccgcccugagacugaagaacccccaggagggcuucgugccccugggcaccccccaccagagaggcugcagagagaagaucgacccccuggugccccagccccccauguaccugugccccagccagcaguaa

SEQ ID NO: 14408 - RNA, 354 nt, Artificial Sequence
  C19orf48__Homo_sapiens__NP_001277083
augaccgugcuggaggccgugcuggagauccaggccaucaccggcagcagacugcugagcauggugcccggccccgccagaccccccggcagcugcugggaccccacccagugcaccagaaccuggcugcugagccacacccccagaagaagauggaucagcggccugcccagagccagcugcagacugggcgaggagccccccccccugcccuacugcgaccaggccuacggcgaggagcugagcaucagacacagagagaccugggccuggcugagcagaaccgacaccgccuggcccggcgcccccggcgugaagcaggccagaauccugggcgagcugcugcugguguaa

SEQ ID NO: 14409 - RNA, 1914 nt, Artificial Sequence
  C19orf57__Homo_sapiens__NP_077299
augaccaagagaaagaagcugagaaccagcggcgagggccugugcccccccaagccccugaagaaccccagacugggcgacuucuacggcgacccccagagcagcaugcugggcugccugcaccaccccgaggagcccgagggcaagcugggccccgugcccagcacccagcagcacggcgaggagcccggcaaggccgugagcagcagccccgacgaggagaccggcagccccugcagacugcugagacagcccgagaaggagcccgccccccugccccccagccagaacagcuucggcagauucgugccccaguucgccaagagcagaaagaccgugaccagaaaggaggagaugaaggacgaggacagaggcagcggcgccuucagccuggagaccaucgccgagagcagcgcccagagccccggcugccagcugcugguggagacccugggcgugccccugcaggaggccaccgagcugggcgaccccacccaggccgacagcgccagacccgagcagagcagccagagccccgugcaggccgugcccggcagcggcgacagccagcccgacgacccccccgacagaggcaccggccugagcgccagccagagagccagccaggaccaccugagcgagcagggcgccgacgacagcaagcccgagaccgacagagugcccggcgacggcggccagaaggagcaccugcccagcaucgacagcgagggcgagaagcccgacagaggcgccccccaggagggcggcgcccagagaaccgccggcgccggccugcccggcggcccccaggaggagggcgacggcgugcccugcacccccgccagcgcccccaccagcggccccgcccccggccugggccccgccagcuggugccuggagcccggcagcguggcccagggcagccccgacccccagcagacccccagcagaaugggcagagagggcgagggcacccacagcagccugggcugcagcagccugggcaugguggugaucgccgaccugagcaccgaccccaccgagcuggaggagagagcccuggagguggccggccccgacggccaggccagcgccaucagccccgccagccccagaagaaaggccgccgacggcggccacagaagagcccugcccggcugcaccagccugaccggcgagaccaccggcgagagcggcgaggccggccaggacggcaagccccccggcgacgugcuggugggccccaccgccagccuggcccuggcccccggcagcggcgagagcaugaugggcgccggcgacagcggccacgccagccccgacaccggccccugcgugaaccagaagcaggagcccggccccgcccaggaggaggccgagcugggcggccagaaccuggagagagaccuggagggcuucagagugagcccccaggccagcguggugcuggagcacagagagaucgccgacgacccccugcaggagcccggcgcccagcagggcauccccgacaccaccagcgagcuggccggccagagagaccaccugccccacagcgccgaccagggcaccugggccgacagccuggccguggagcuggacuuccugcuggacagccagauccaggacgcccuggacgccagcgacuucgaggccccccccgagcagcuguuccccagcggcaacaagcccggccccugcuggcccggccccagcagccacgccaacggcgaccccguggccguggccaaggcccagcccagcagacugaucaugggcacccacagagaccuggaggccuucaagagacugaacuacagaaagaccaagcugggcggcaaggccccccugcccuaccccagcaagggccccggcaacauccccagaggcgacccccccuggagagagcuguaa

SEQ ID NO: 14410 - RNA, 2763 nt, Artificial Sequence
  C19orf68__Homo_sapiens__NP_955373
auggagagacccgagcccccccccggcaccgccgccggccaggaggagcaggagcugagagagagagccuucuucagcugggccgaguucagcagauucuucgacgccuggugccagcagagacuggcccuguucuucgugaagagcagcaugcaccuggccagaugcagaugggccagcgcccccccccuguacacccugaucgacgugcugaaguacagcuacgugagacuggugugcaaggacgugagagcccccagcagacccgccgugggccccccccagcccggcugccccgccuucaucaucgugaagcugagcccccugagagacagacugguggugaccgagugccagcugacccacagccaccccgccugcccccuggaguucgccuacuacuucagacccggccaccugcuggccaacgccugccugcccgugagaaccaccaacaagaucagcaagcaguucguggcccccgccgacgugagaagacugcugagcuacugcaagggcagagaccacggcgugcuggacgcccugcacgugcuggagggccuguucagaaccgaccccgaggccaaggugaagcugguguucguggaggaccaggccgugguggagaccguguucuuccugaccagcagaaccagagcccugcugagaagauuccccagaaugcugcugguggacagacugcccggccugcagggcgcccuggaccugcuggccgugcugugcguggacggcagcggcagagccagacaggccgccugcugcguggccagacccggcacccccagccugcugagauucgcccuggccagccugcugcagagcgcccccgacgugaagggcagagugagaugccugaccgccggccccgagguggccgcccagcugcccgccgugagacagcugcugcccugcgccagagugcagaucugcagagcccagggccuggagacccuguucagcaaggcccaggagcugggcggcgccggcagagaggaccccggccuguggagcagacugugcagacuggccggcgccagcagccccgccgccuacgacgaggcccuggccgagcugcacgcccacggccccgccgccuucguggacuacuucgagagaaacugggagcccagaagagacaugugggugagauucagagccuucgaggccgccagagaccuggacgccugcgcccuggugagaggccacagaagaagacugcugagaagacugagccccagcagaggcguggcccagugccugagagaccugguggccaugcagugggccgacgccgccggcgaggccgugcccgagggccccgacggcggcggccccuggcuggaggacgagcccggcagaggcgcccagggcgagaacgagagagugagaggccuggagaccggcgacuggggcggcgcccccaaggagggcagcaucuggagaggcgcccagauggagaaggagugggccagagcccuggagaccagagacuggggcggcgcccaguucgagggcgagaagggcagagcccugcagaucagagacuggagaggcggcagacuggagaaccagaagcccagaggccuggagggcggcgugcugagaggcagcaagcuggagaagggccaccugagaggccccgagaucagagacuggagaggcccccagcuggagggcgagaaggacuggggccuggagggcuacguguggagaggcagccagcuggaggaccaggcccugagaggccuggagggcuacaccuggagaguggcccagcuggaggacagaagaagcaccaccgaccugagaggcacccaguucgacuacgagagagugagaagccuggagggcagccccuggagaggcgcccagcugcacgacgagagagccggcggccugagaaccgccgaguggaagggcccccagagcgagguggagaagggcagaggccuggaggugagaaaccugagaggcaucccccuggagaagagccuggagcuggcccccgagaacggcgaccagagaggcccccagugggaggacgagagaagaagaggccccgagaucgccgaggagagaggcgccagagugggcgugaagagaagaagaggccuggaggacaucgugcuggugcagcugggcgacaccagagugaccggcauggagaacggcgacggcggcggcgccagaagcgugggccccaagagcagagccggcagaggcauggaguggggcgacgccggcggcagaugccugggccugggcaacggcguggugagcggcacccccgugggcaccgugcuggagggcagccccgagugggccgccgccagaagcgagcaccuggccgccggcgacggccugcaggagggcggcgaggacggccccagagagcccaagagacugugcagaccccccggcgaggaggagguggacugggagccccuggccaaguucagagccgccugcggccccgagcuggccgaccugguggccgaggagcuggccuucgccagacagcacggcaccagaggcuuccacuggaccggcgccggcuucgcccugaaggacggcaccagcgacuucuuccuggacggcgcccugaccagaugcagcugcagcauccacgccgccagaagacugcccugcagacaccuguucgccgccagacugcugaccggcgccgcccuguuccacauggaccugcugagagacugcuggggcagagcccccgagcccuaa

SEQ ID NO: 14411 - RNA, 426 nt, Artificial Sequence
  C1D__Homo_sapiens__NP_775269
auggccggcgaggagaucaacgaggacuaccccguggagauccacgaguaccugagcgccuucgagaacagcaucggcgccguggacgagaugcugaagaccaugaugagcgugagcagaaacgagcugcugcagaagcuggacccccuggagcaggccaagguggaccuggugagcgccuacacccugaacagcauguucuggguguaccuggccacccagggcgugaaccccaaggagcaccccgugaagcaggagcuggagagaaucagaguguacaugaacagagugaaggagaucaccgacaagaagaaggccggcaagcuggacagaggcgccgccagcagauucgugaagaacgcccugugggagcccaagagcaagaacgccagcaagguggccaacaagggcaagagcaagagcuaa

SEQ ID NO: 14412 - RNA, 957 nt, Artificial Sequence
  C1GALT1C1__Homo_sapiens__NP_689905
augcugagcgagagcagcagcuuccugaagggcgugaugcugggcagcaucuucugcgcccugaucaccaugcugggccacaucagaaucggccacggcaacagaaugcaccaccacgagcaccaccaccugcaggcccccaacaaggaggacauccugaagaucagcgaggacgagagaauggagcugagcaagagcuucagaguguacugcaucauccuggugaagcccaaggacgugagccugugggccgccgugaaggagaccuggaccaagcacugcgacaaggccgaguucuucagcagcgagaacgugaagguguucgagagcaucaacauggacaccaacgacauguggcugaugaugagaaaggccuacaaguacgccuucgacaaguacagagaccaguacaacugguucuuccuggccagacccaccaccuucgccaucaucgagaaccugaaguacuuccugcugaagaaggaccccagccagcccuucuaccugggccacaccaucaagagcggcgaccuggaguacgugggcauggagggcggcaucgugcugagcguggagagcaugaagagacugaacagccugcugaacauccccgagaagugccccgagcagggcggcaugaucuggaagaucagcgaggacaagcagcuggccgugugccugaaguacgccggcguguucgccgagaacgccgaggacgccgacggcaaggacguguucaacaccaagagcgugggccugagcaucaaggaggccaugaccuaccaccccaaccaggugguggagggcugcugcagcgacauggccgugaccuucaacggccugacccccaaccagaugcacgugaugauguacggcguguacagacugagagccuucggccacaucuucaacgacgcccugguguuccugccccccaacggcagcgacaacgacuaa

SEQ ID NO: 14413 - RNA, 1116 nt, Artificial Sequence
  C1GALT1__Homo_sapiens__XP_005249869
augagcgagauccacuucagagagauggccagcaagagcuggcugaacuuccugaccuuccugugcggcagcgccaucggcuuccugcugugcagccagcuguucagcauccugcugggcgagaagguggacacccagcccaacgugcugcacaacgacccccacgccagacacagcgacgacaacggccagaaccaccuggagggccagaugaacuucaacgccgacagcagccagcacaaggacgagaacaccgacaucgccgagaaccuguaccagaaggugagaauccugugcugggugaugaccggcccccagaaccuggagaagaaggccaagcacgugaaggccaccugggcccagagaugcaacaaggugcuguucaugagcagcgaggagaacaaggacuuccccgccgugggccugaagaccaaggagggcagagaccagcuguacuggaagaccaucaaggccuuccaguacgugcacgagcacuaccuggaggacgccgacugguuccugaaggccgacgacgacaccuacgugauccuggacaaccugagauggcugcugagcaaguacgaccccgaggagcccaucuacuucggcagaagauucaagcccuacgugaagcagggcuacaugagcggcggcgccggcuacgugcugagcaaggaggcccugaagagauucguggacgccuucaagaccgacaagugcacccacagcagcagcaucgaggaccuggcccugggcagaugcauggagaucaugaacguggaggccggcgacagcagagacaccaucggcaaggagaccuuccaccccuucgugcccgagcaccaccugaucaagggcuaccugcccagaaccuucugguacuggaacuacaacuacuacccccccguggagggccccggcugcugcagcgaccuggccgugagcuuccacuacguggacagcaccaccauguacgagcuggaguaccugguguaccaccugagacccuacggcuaccuguacagauaccagcccacccugcccgagagaauccugaaggagaucagccaggccaacaagaacgaggacaccaaggugaagcugggcaaccccuaa

SEQ ID NO: 14414 - RNA, 1737 nt, Artificial Sequence
  C1orf106__Homo_sapiens__NP_001136041
auggagagcaaggacgaggugagcgacaccgacagcggcaucauccugcagagcggccccgacagccccgugagccccaugaaggagcugacccacgccgugcacaagcagcagagagcccuggaggccagacuggaggccugccuggaggagcugagaagacugugccugagagaggccgagcugaccggcacccugcccgccgaguacccccugaagcccggcgagaaggcccccaaggugagaagaagaaucggcgccgccuacaagcuggacgacugggcccugcacagagaggacccccugagcagccuggagagacagcuggcccugcagcugcagaucaccgaggccgccagaagacugugccuggaggagaaccugagcagacaggccagaagacagagaaagcacagcaugcugcaggaggagaagaagcugcaggagcugcagagaugccugguggagagaagaagaaacagcgagcccccccccgccgccgcccugccccugggcagagagcugagcgccagcgacgacagcagccugagcgacggccugcugcuggaggaggaggagagccaggugcccaagcccccccccgagagccccgccccccccagcagaccccugcccccccagacccuggagggccugcagcccaccggccccgaggccggcagccccgagagagcccccgugcagaacagccccuggaaggagaccagccuggaccaccccuacgagaagcccagaaagagcagcgagcccuggagcgagagcagcagccccgccaccaccccccaggacggccccagcgccagcagccuguggcugcuggagcccgccagcuaccacguggugcccaucagaggcgugcccggccaguggcagggcagaaccagcgcccccgccacccccgagauccagggcagaagaggccagagccagagccugagaguggacagcuucagagccggccccgagggcagaggcagaagcgccuuccccagaagaagacccacccacuacaccgugaccgugcccgacagcugcuuccccgccaccaagcccccccugccccacgccgccugccacagcugcagcgaggacagcggcagcgacgugagcagcaucagccaccccaccagccccggcagcagcagccccgacaucagcuuccugcagccccugagcccccccaagacccacagacacagaggcgccugggugcccgccggcagcagagagcugguggcccaccaccccaagcugcugcugccccccggcuacuuccccgccggcagauacguggugguggccgagagcccccugccccccggcgagugggagcugagaagagccgcccccggccccgccuacgaggaggagggcaccccccugagauaccagagacuggugcccagcagaagcagaaucgugagaacccccagccugaaggacagccccgccggcagaggccugagcaaggccgccgugagcgaggagcugaagugguggcacgagagagccagacugagaagcaccagaccccacagccuggacagacagggcgccuucagagugagaagccugccccugggcagagagggcuucggcagagcccugggccccagagcccaggugcccaccgugugcgugcugagaagaagccccgacggcgcccccgugcagguguucgugcccgagaagggcgagaucaucagccagguguaa

SEQ ID NO: 14415 - RNA, 798 nt, Artificial Sequence
  C1orf109__Homo_sapiens__NP_001289959
augagcgagaagagaagaagacuggacgccagaaacccccugaagcaggagaccgcccugagcagacugcccuuccccagaggcaaccagggccugcugcagaaggccgaggccggcagagccagauggcugacccccgugauccccgcccuguggaagaccgaggccggcggcagccccgagaagaugacccaggacagaccccugcuggccgugcaggaggcccugaagaagugcuuccccgugguggaggagcagcagggccuguggcagagcgcccugagagacugccagccccugcugagcagccugagcaaccuggccgagcagcugcaggccgcccagaaccugagauucgaggacgugcccgcccugagagccuuccccgaccugaaggagagacugagaagaaagcagcugguggccggcgacaucgugcuggacaagcugggcgagagacuggccauccugcugaaggugagagacauggugagcagccacguggagagaguguuccagaucuacgagcagcacgccgacaccgugggcaucgacgccgugcugcagcccagcgccgugagccccagcguggccgacaugcuggaguggcugcaggacaucgagagacacuacagaaagagcuaccugaagagaaaguaccugcugagcagcauccaguggggcgaccuggccaacauccaggcccugcccaaggccugggacagaaucagcaaggacgagcaccaggaccuggugcaggacauccugcugaacgugagcuucuuccuggaggaguaa

SEQ ID NO: 14416 - RNA, 909 nt, Artificial Sequence
  C1orf110__Homo_sapiens__NP_848645
auggagagacacauggugagaggccagcuguacaagcacuucgaccuggagagaaagaacgccaagcaggccgaggccagacuggaccagagacugcagagacugaaggugaucugccuguaccacgugaagcugcugaccugggagcagagacagcugcagaaggagcugcagagacugcagcaggccgagaccaugaagaagaaguucagcagcuaccugggcaacggcuuccagaagagacccgaggacgugcugguguucagcccccagggcagacagaagcacagagccccccaggccaagaagaugagagcccuggccaccagaauggcccaggacaccugcaagagcaagagccaggugccccccagccacgacgccggccugaaggaccccaugaagagcaagaagcagccccugagccagaacaacagaaccgccugcuucaucaaggagcagccccaggcccaggagaaggacagcgugaaccccagcaaggacguggaccccagcaagggcaucagcgugcccugccagaaccaggaggugagcaccaacaccaucgagcagggccccagcagcagccccgccagcgacagcggcauggccugcgccgacgagaccagaagcaaggacguggcccugaagcccgacggcaacaccggcaagcagaucccccccaagcacauggagugcgccggcagcuucgagggcgaguucaccaagcccaccuuccuggagcugcugagcaaggccagaaacgcccacuaccugagacacagagugccccccgagagcgagagacugcugagcaucggcgagaucuucggccacggcgagagcagcagcagcagagccggcaaggagugcgagaacagagugcccagcaaguuccugccccuguaa

SEQ ID NO: 14417 - RNA, 2736 nt, Artificial Sequence
  C1orf112__Homo_sapiens__XP_005245374
augagccaggagggcgccgugcccgccagcgccgugccccuggaggagcugagcagcuggcccgaggagcugugcagaagagagcugcccagcgugcugcccagacugcugagccugagccagcacagcgacagcuggaucgagcacauccagauccugaagaucaucguggagauguuccugccccacaugaaccaccugacccuggagcagaccuucuucagccaggugcugcccaagaccgugaagcuguucgacgacaugauguacgagcugaccagccaggccagaggccugagcagccagaaccuggagauccagaccacccugagaaacauccugcagaccauggugcagcugcugggcgcccugaccggcugcgugcagcacaucugcgccacccaggagagcaucauccuggagaacauccagagccugcccagcagcgugcugcacaucaucaagagcaccuucgugcacugcaagaacagcgagagcguguacagcggcugccugcaccuggugagcgaccugcugcaggcccuguucaaggaggccuacagccugcagaagcagcugauggagcugcuggacauggugugcauggacccccugguggacgacaacgacgacauccugaacauggugaucgugauccacagccugcuggacaucugcagcgugaucagcagcauggaccacgccuuccacgccaacaccuggaaguucaucaucaagcagagccugaagcaccagagcaucaucaagagccagcugaagcacaaggacaucaucaccagccugugcgaggacauccuguucagcuuccacagcugccugcagcuggccgagcagaugacccagagcgacgcccaggacaacgccgacuacagacuguuccagaagacccugaagcugugcagauucuucgccaacagccugcugcacuacgccaaggaguuccugcccuuccugagcgacagcugcugcacccugcaccagcuguaccugcagauccacagcaaguucccccccagccuguacgccaccagaaucagcaaggcccaccaggaggagaucgccggcgccuuccuggugacccuggacccccugaucagccagcugcugaccuuccagcccuucaugcagguggugcuggacagcaagcuggaccugcccugcgagcugcaguucccccagugccugcugcuggugguggugauggacaagcugcccagccagcccaaggaggugcagacccuguggugcaccgacagccaggugagcgagaccaccaccagaaucagccugcugaaggccguguucuacagcuucgagcagugcagcggcgagcugagccugcccgugcaccugcagggccugaagagcaagggcaaggccgagguggccgugacccuguaccagcacgugugcgugcaccugugcaccuucaucaccagcuuccaccccagccuguucgccgagcuggacgccgcccugcugaacgccgugcugagcgccaacaugaucaccagccugcuggccauggacgccuggugcuuccuggccagauacggcaccgccgagcugugcgcccaccacgugaccaucguggcccaccugaucaagagcugccccggcgagugcuaccagcugaucaaccugagcauccugcugaagagacuguucuucuucauggcccccccccaccagcuggaguucauccagaaguucagccccaaggaggccgagaaccugccccuguggcagcacaucagcuuccaggcccugccccccgagcugagagagcagaccgugcacgaggugaccaccgugggcaccgccgagugcagaaaguggcugagcagaagcagaacccugggcgagcuggagagccugaacaccgugcugagcgcccugcuggccgugugcaacagcgccggcgaggcccuggacaccggcaagcagaccgccaucaucgagguggugagccagcugugggccuuccugaacaucaagcagguggccgaccagcccuacgugcagcagaccuucagccugcugcugccccugcugggcuucuucauccagacccuggaccccaagcugauccugcaggccgugacccugcagaccagccugcugaagcuggagcugcccgacuacgugagacuggccaugcuggacuucgugagcagccugggcaagcuguucauccccgaggccauccaggacagaauccugcccaaccugagcugcauguucgcccugcugcuggccgacagaagcuggcugcuggagcagcacacccuggaggccuucacccaguucgccgagggcaccaaccacgaggagaucgugccccagugccugagcagcgaggagaccaagaacaagguggugagcuuccuggagaagaccggcuucguggacgagaccgaggccgccaagguggagagagugaagcaggagaagggcaucuucugggagcccuucgccaacgugaccguggaggaggccaagagaagcagccugcagcccuacgccaagagagccagacaggaguuccccugggaggaggaguacagaagcgcccugcacaccaucgccggcgcccuggaggccaccgagagccugcugcagaagggccccgcccccgccuggcugagcauggagauggaggcccugcaggagagaauggacaagcugaagagauacauccacacccugggcuaa

SEQ ID NO: 14418 - RNA, 429 nt, Artificial Sequence
  C1orf115__Homo_sapiens__NP_078985
augaccgugggcgccagacugagaagcaaggccgagagcagccugcugagaagaggccccagaggcagaggcagaaccgagggcgacgaggaggccgccgccauccuggagcaccuggaguacgccgacgaggccgaggccgccgccgagagcggcaccagcgccgccgacgagagaggccccggcaccagaggcgccagaagagugcacuucgcccugcugcccgagagauacgagccccuggaggagcccgcccccagcgagcagcccagaaagagauacagaagaaagcugaagaaguacggcaagaacgugggcaaggugaucaucaagggcugcagauacguggugaucggccugcagggcuucgccgccgccuacagcgcccccuucgccguggccaccagcguggugagcuucgugagauaa

SEQ ID NO: 14419 - RNA, 1929 nt, Artificial Sequence
  C1orf127__Homo_sapiens__XP_011539059
augagcaccuuccccaccagcagccacagcggccuguucagccccagcagcggccaccugaucccccugugccugauccccccccugcugagcagcgugcccacccuggccaugagauucagaaacgccagagacaaggagaaguucgccuucgccggcagaugcugggugagcuuccagcccgagagcgaggugcuggugcacauccccaagcagagacugggccuggugaagagaggcagcuacaucgaggagacccugagccugagauuccugagagugcaccagagcaacaucuucauggugaccgagaacaaggacuucgugguggugagcauccccgccgccggcgugcugcaggugcagagaugccaggaggugggcggcacccccggcacccaggccuucuacagaguggaccugagccuggaguucgccgagauggccgcccccgugcuguggaccguggagagcuucuuccagugcgugggcagcggcaccgagagccccgccagcaccgccgcccugagaaccacccccagcccccccagccccggccccgagaccccccccgccggcgugccccccgccgccagcagccaggugugggccgccggccccgccgcccaggaguggcugagcagagaccugcugcacagacccagcgacgcccuggccaaggccagacuguggcugcacccccugcccauggugagcagcaaggagagcggcccccaggaggugagcaagggccugggccccuuccugcagaccgccaagcccgccagaagaggccagaccagcgccagcauccugcccagaguggugcaggcccagagaggcccccagcccccccccggcgaggccggcauccccggccaccccaccccccccgccacccugcccagcgagcccguggagggcgugcaggccagccccuggagacccagacccgugcugcccacccaccccgcccugacccugcccgugagcagcgacgccagcagccccagcccccccgcccccagacccgagagacccgagagccugcuggugagcggccccagcgugacccugaccgagggccugggcaccgugagacccgagcaggaccccgccaagagccccggcagcccccugcugcugagaggccugagcagcggcgacguggccgcccccgagcccaucaugggcgagcccggccaggccagcgaggaguuccagccccuggccagacccuggagagccacccuggccgccgaggagcuggugagccacagaagccccggcgagccccaggagaccugcagcggcaccgagguggagagacccagacagaccggccccggccugcccagagagggcgccagaggccacauggaccugagcagcagcgagcccagccaggacaucgagggccccggccugagcauccugcccgccagagacgccaccuucagcacccccagcgugagacagcccgaccccagcgccuggcugagcagcggccccgagcugaccggcaugcccagagugagacuggccgccccccuggccgugcugcccauggagccccugccccccgagcccgugagacccgccgcccugcugacccccgaggccagcagcgugggcggccccgaccaggccagauaccuggagagcgcccccggcuggcccgugggccaggaggaguggggcguggcccacaccagcagcccccccagcacccagacccugagccugugggcccccaccggcgugcugcugcccagccugguggagcuggaguaccccuuccaggccggcagaggcgccagccugcagcaggagcugaccgagcccacccuggcccugagcgccgagagccacagaccccccgagcugcaggacagcguggagggccugagcgagagacccagcagauaa

SEQ ID NO: 14420 - RNA, 1416 nt, Artificial Sequence
  C1orf141__Homo_sapiens__XP_011539768
auggccgagaagauccuggagaagcuggacgugcuggacaagcaggccgagaucauccuggccagaagaaccaagaucaacagacugcagagcgagggcagaaagaccaccauggccaucccccugaccuucgacuuccagcuggaguucgaggaggcccuggccaccagcgccagcaaggccaucagcaagaucaaggaggacaagagcugcagcaucaccaagagcaagaugcacgugagcuucaagugcgagcccgagcccagaaagagcaacuucgagaagagcaaccugagacccuucuucauccagaccaacgugaagaacaaggagagcgagagcaccgagcccguggaggagcaccugaagagcagaagcaucagacccuaccuguaccugaaggacaccaccgagauggagaacgccggcccccugaacgugcuguacagccagcacagacaggccugcagaagaagccugggcagcaccgacuucagccccauguucaacauccagagcaacgcccacaagaaggagaaggacagcacccuguucaccgcccagaucgagaagaagcccagaaagccccuggacagcgugggccugcuggagggcgacagaaacaagagaaagaagagcccccagaugaacgacuucaacaucaaggagaacaagagcgugagaaacuaccagcugagcaaguacagaagcgugagaaagaagagccugcugccccugugcuucgaggacgagcugaagaacccccacgccaagaucgugaacgugagccccaccaagaccgugaccagccacauggagcagaaggacaccaaccccaucaucuuccacgacaccgaguacgugagaaugcugcugcugaccaagaacagauucagcagccacccccuggagaacgagaacaucuacccccacaagagaaccaacuucauccuggagagaaacugcgagauccugaagagcaucaucggcaaccagagcaucagccuguucaagccccagaagaccaugcccaccgugcagagaaaggacauccagauccccaugagcuucaaggccggccacaccaccguggacgacaagcugaagaagaagaccaacaagcagacccuggagaacagaagcuggaacacccuguacaacuucagccagaacuucagcagccugaccaagcaguucgugggcuaccuggacaaggccgugauccacgagaugagcgcccagaccggcaaguucgagagaauguucagcgccggcaagcccaccagcauccccaccagcagcgcccugcccgugaagugcuacagcaagcccuucaaguacaucuacgagcugaacaacgugaccccccuggacaaccugcugaaccugagcaacgagauccugaacgccagcuaa

SEQ ID NO: 14421 - RNA, 4485 nt, Artificial Sequence
  C1orf167__Homo_sapiens__XP_011539574
augaagagaagacugagcggcgugagaaccagacagaacaagggcgaccagcugggcggcggcagagcccaccugaucaagcagaccagaccccugaccguggaguggaccaaggacacccccgugcccgagcccauggagcugagaagcgacgccagccacaaggagaacgugagccccaagcccgccgcccugcccaagcccgagcagagaagauucagaagaagccugggcaucggccugagcggcagacacgaccagugggugcccggcugccagguggagagaggcggccccgccgccacccccagccccggcgccgugcuggaccaggagcccugcagagugcagaccaaccuggccagccccggccccagacugggccuggcccugaaggacaccaccggccagcuggugaacagcagcuucuggcagcagagcaaccugcagagccuggccagaagaagacagggcaaggccagagaguucgccauccagcagagcaaccugagcaucaacgagaccagcagcccccaccugugccccgagcccggcggcagcagcggcccccacaagcugcccuggggcccccugcugagccaggagccccuggccagacccagcagcugccugagacagagcggccugcccgcccccggcacccccagcggcgacuucagacccaccgaggccuucgccccccuggacggccacacccagcccggccugagaagcuggggcggccugggcagcuggagaagcagacuggugggcgagccccugacccuggaggaccuggccgugcccagccagaaccagacccaggcccccagcagagccgccgugcaccagcugcuggccagcgugcacugccuggcccaggaggccgccagacugagaugccaggccccccaggagccccccggcgccgugcagcaggaccuguggaccggcggcggccagcccuucagcgcccacccccagcccagccagcccgugcuggccagcagcgacggcagaagaagaagacugagaggccacagagagaccgccgccuuccuggagacccccgccagccugagcgacagcugggcccagagcaagcugaugagccccgagaccacccugggcaccagaaccaaggacagccugaaccccgagcagggccugccccccgcccacccccugggcagcggcgacagcugcagccccuggagccaggacggcagagcccagagaggcgaccccagccugcccagaggcgugggcagcagaggcaccgaccccugcagcagcgccuucagcaacaccgccuggggcgugagccccaagcagaagggcgaggagggcgcccccagagagagagugcacagagaggaggagagaaccgccuuccaccugagcgacaccgugcccgccagcagcgccagcaagaacaaggcccagaacaucaccgcccccgagagcgaggccaucugcuggcagcugcugagcagaugcuucagaagcuggagacaccuggugaagagacagagagagcccgccgccgccgccguggcccugggcagauggcagcugcugagaaagugccugcaggcccuguggcugagagaggcccagcuggaggccgccuggggccaguacaccaaggugcugcuggugagaagcuucagagaguggagaaaccuggcccugcagcagaagcaggugcagccccacaugcaggccggccccggcagcccccccagcagaagagcccagggcaagggccugagccugggcagaagcaccgugguggaccccgcccagagaagcagacuggagcacaccagccccggcagccugagagaggaggagaucgcccagagacugcugagccaccccagacagagaaccgacagcagacacgagagagugcagauccugcaggcccugcagcuggccguguucuuccuguggugccagcagaagaagagagccagacaggagagagagacccugagaaaggccaccagagccacccagagaaccggcagcuucccccaggccuggcacagcaccgccgccggcguggccuggguggccccccugagcccccagcaccagagagccuggcugugcagaugcuucggcgccuggcagcaguucgugcagagaggcagcagauacagagaccaccuggccgacagaagaaccggcacccugagaaagugccuggagcagugggugagaaugaagcagcugagagagagcgacggcgccaaggugacccagcugagccugugcagacagaaggccggcagagaggccguguacaccgccggccccggcgccugcggccugggcgccgugggccaggcccagggccagcaggagcagggcagaggcagccugcaggacgccugcuggacccuggcccugugcugggcccugcugcuguggaagaugagacuguuccagagacagugggccaacagcuucuuccagggccugcagcagagaaugcugcagagaagccugagaugguggcaccugagagcccugggccccgacgccaccagcagcugcaccaagacccccagcgcccuggagccccugagcagcagcacccugcaggacagccuggagaaggugcccagagcccccacccugcccgacacccugcagggcagccugcugugggccgccggccagagacagcagggccagugccugcugcuguggcaggccagagcccagcaguuccagggcaccgccagaugguaccagcacaccagacagagaagaaucuuccugagcuggagcagaugggccaccgcccagugggccuggagagagcuggccagccacagagccugggacagaaccugcagagccgugcugggccuguggagacagagacugcugcagagcagacugguggaguggugggcccaggagagaggcuggagacuggccagagacgcccugugccacuggcacagcugcuggcagggccagcaguuccugcacgagaagugccagaccugggugcaggugcaccugcagggccugcagaaggugguguucagaagcuggcagcaggccgccgcccaccagagaugcaccgugaccagacccgagcagcugcugcugcagagcuacuuccaggccuggugcgagguggugagagacaccggcgugcugagagcccagcaccaggccuuccaggacggccugagaagaagagcccugggcgccguguucgccaccuggagagaggcccaggagguggccgccggcgcccaggagcagagaguggcccaggccagccuggccagauggagaagcugcggccagcagggccaggaggacggccagcagaagaaggccagagccccccaggccuuccccgccuggcccguggcccccggcaugcaccacgaggcccagcagcaggccggcgagagcgccggcgcccaggccgcccagugcuggaccuggugcugggcccugugggugcacgagagcugcagaggccaggugagcagagcccacgccagcuggaagcccagagccugggugcuggaggccagcgugcagagcgccgugagaggcggcgugcagagagccauccugacccagcugagacccgccgagcugagaagauuccugagaaccgugcagcugagagugagacugggccugcccggcgccggcaagaccagaagcugcuggacccaggccaccgagcuggugccccccgcccccagccugcagugcagccugggcggcagaagaaagcccagaggcaccgccugggcccagagaugcagagagcacagccugugccccgccuuccagcuguggccccaguggcccggccagagcagcugggugcccggccugccccuguggaccagagaccagggccccagagcccacagcagccccgagcccagagccugcaaggcccagagcaaggcccacaagagaagacugagagccagaagcugcagaauccuggagaagcaggcccaggcccacggcagcgcccugcugcuggcccugaagggccacgacgcccugggccaccaggaggaggugcccgccgcccccgugcccagaggcaccgccagcagagccgccggcuuccccgccggccaggugcccggcagcggcauggccgcccugggcggcugccccagaggcagagccgccggcgccgaccccgcccagggcguggcccccgagaugggccuggccgacgugguggccgccgaccccgccaccgccagcggcagcgccgugaccgccgccggcagaugggccuucaagaaguggcaccagagacuggccgccagaagccccagaagaggcgccgccagcagccccagacccuggagcaagcccggccccaagggccccgagagcggccaggaggccgccagagcccccagaggcuggggccugggcgccgagcacggcgcccagcugcagcuguaa

SEQ ID NO: 14422 - RNA, 708 nt, Artificial Sequence
  C1orf204__Homo_sapiens__NP_001127705
augggcaugcuggcccccggcccccugcagggcagaagacccagaaagggccacaagggccaggaggacgccguggcccccggcugcaaggccagcggcagaggcagcagagugacccaccugcugggcuaccccacccagaacgugagcagaagccugagaagaaaguacgcccccccccccugcggcggccccgaggacguggcccuggcccccugcaccgccgccgccgccugcgaggccggccccagccccguguacgugaaggugaagagcgccgagcccgccgacugcgccgagggccccgugcagugcaagaacggccugcuggugagcagcccccacugcgaggagcccugcgcccacagcugcgcccaccccggccugcccccccaccuggugcacaagcugccccugagcuaccugcagacccaggacaccgacgccgccagcagaagaaucaacgccccccuggccgccggcuggagcuggcugagacuguggcuggugacccuggccagcggcguggacuucccccaggugagcgccuggaugagagcccugcccagccccgacugccccggccugagaaccaccggcgagcagaugcagaagcugcugcugaaggagaacaaggugaagaccagaaagagcaagagaagaagcggcgagggcagccaccugaccaccagcauccuggagcaguaa

SEQ ID NO: 14423 - RNA, 819 nt, Artificial Sequence
  C1orf226__Homo_sapiens__NP_001078844
auguucgagaaccugaacaccgcccugacccccaagcugcaggccagcagaagcuucccccaccugagcaagcccguggcccccggcagcgccccccugggcagcggcgagcccggcggccccggccugugggugggcagcagccagcaccugaagaaccugggcaaggccaugggcgccaaggugaacgacuuccugagaagaaaggagcccagcagccugggcagcgugggcgugaccgagaucaacaagaccgccggcgcccagcuggccagcggcaccgacgccgcccccgaggccuggcuggaggacgagagaagcgugcugcaggagaccuuccccagacuggacccccccccccccaucaccagaaagagaacccccagagcccugaagaccacccaggacaugcugaucagcagccagcccgugcugagcagccuggaguacggcaccgagcccagccccggccaggcccaggacagcgcccccaccgcccagcccgacgugcccgccgacgccagccagcccgaggccaccauggagagagaggagagaggcaaggugcugcccaacggcgaggugagccugagcgugcccgaccugauccacaaggacagccaggacgagagcaagcugaagaugaccgagugcagaagagccagcagccccagccugaucgagagaaacggcuucaagcugagccugagccccaucagccuggccgagagcugggaggacggcagcccccccccccaggccagaaccagcagccuggacaacgagggcccccaccccgaccugcugagcuucgaguaa

SEQ ID NO: 14424 - RNA, 1323 nt, Artificial Sequence
  C1orf228__Homo_sapiens__XP_011539646
augaccagcaucaaggagcaggccgccaucagcagacugcugagcuuccugcaggagugggacaacgccggcaagguggccagaagccacauccuggacaaguucaucgagaccaaccagggcaagaccgcccccgagcuggagcaggaguucagccagggcgccagccuguuccuggugagacugaccaccagccugagaaucaccuacaugaccgacagcugccuggagaagcugcugagaagcaucggcaucuuccugagcgccgugagcagcaacagauaccugaucgaguuccuggaggugggcggcgugcugacccugcuggagauccugggccuggagaagaucaaggaggaggccaagaaggagagcgugaagcugcugcaggugaucgccaacagcggcagaaccuacaaggagcugaucugcgagagcuacggcgugagaagcaucgccgaguuccuggccaagagcaagagcgaggagacccaggaggaggugcaggugcugcuggacagccuggugcacggcaaccccaaguaccagaaccagguguacaagggccugaucgcccugcugcccugcgagagccccaaggcccagcagcugagccugcagacccugagaaccgcccagcccaucaucggcaccacccaccccagcaucguggacugcgugcugaaggugcugggcaccaugcaccuggaggugcaguacgaggccaucgagcugaucaaggaccuggugggcuacgacgugagacaggcccugcugaagggccugguggcccugcugauccccagcgugaaggagaucagcaagcugcaggccaagauccugagcgaccccagcgugcugcagcugacccccagccugcccauguuccugcagcaggccgccgccgccaaggccaucggcgugcuggccagaaacgacaugagcaucgccgaggagcugcuguaccugagaguggugagaggccugauggccgccaugggcaacaccgaccacagcaacagccagagacuggccagccugacccuggagugcuucgugcagauguucccccugguggccgagcacgugagaaagugcaugggcgaggagcuguaccagcuguuccugagcaacgccgaggaccuguacaugaagaucgacagcauccaggccgacauccuggccgccaacaccgugaacgugaccaaggcccugugccugcacggcagcagcuacagcaugaacacccuguacggcagcagagacagcgcccagauggccuaccugacccacuucgaggaggacguggagagcaaggaguaa

SEQ ID NO: 14425 - RNA, 1296 nt, Artificial Sequence
  C1orf27__Homo_sapiens__NP_001157717
augggcagaaccuacaucguggaggagaccgugggccaguaccugagcaacaucaaccugcagggcaaggccuucgugagcggccugcugaucggccagugcagcagccagaaggacuacgugauccuggccaccagaaccccccccaaggaggagcagagcgagaaccugaagcaccccaaggccaagcuggacaaccuggacgaggagugggccaccgagcacgccugccaggugagcagaaugcugcccggcggccugcuggugcugggcguguucaucaucaccacccuggagcuggccaacgacuuccagaacgcccugagaagacugauguucgccguggagaagagcaucaacagaaagagacuguggaacuucaccgaggaggaggugagcgagagagugacccugcacaucugcgccagcaccaagaagaucuucugcagaaccuacgacauccacgaccccaagagcagcgccagacccgccgacuggaaguaccagagcggccugagcagcagcuggcugagccuggagugcaccgugcacaucaacauccacaucccccugagcgccaccagcgugagcuacacccuggagaagaacaccaagaacggccugaccagaugggccaaggagaucgagaacggcguguaccugaucaacggccaggugaaggacgaggacugcgaccugcuggagggccagcugcugaacagcgaccacagaagcaccgccaccgugcagaucugcagcggcagcgugaaccugaagggcgccgugaagugcagagccuacauccacagcagcaagcccaaggugaaggacgccgugcaggccgugaagagagacauccugaacaccguggccgacagaugcgagaugcuguucgaggaccugcugcugaacgagauccccgagaagaaggacagcgagaaggaguuccacgugcugcccuacagaguguucgugccccugcccggcagcaccgugaugcugugcgacuacaaguucgacgacgagagcgccgaggagaucagagaccacuucauggagaugcuggaccacaccauccagaucgaggaccuggagaucgccgaggagaccaacaccgccugcaugagcagcagcaugaacagccaggccagccuggacaacaccgacgacgagcagcccaagcagcccaucaagaccaccaugcugcugaagauccagcagaacaucggcgugaucgccgccuucaccguggccgugcuggccgccggcaucagcuuccacuacuucagcgacuaa

SEQ ID NO: 14426 - RNA, 330 nt, Artificial Sequence
  C1orf61__Homo_sapiens__NP_001307383
augggcacccugggcagcaucuucagccccggcgccggcggcuucugcaccacccugccccccagcuuccugagaguggacgacagagccaccagcagcaccaccgacagcagcagagcccccagcagccccagaccccccggcagcaccagccacugcggcaucagcaccagaugcaccgagagaugccugugcgugcugccccugagaaccagccaggugcccgacgugauggccccccagcacgaccaggagcccaagagaagaauguacuucaucuggcugggcuggauccccagcgacaagcccagccagcugaccgagagauaa

SEQ ID NO: 14427 - RNA, 588 nt, Artificial Sequence
  C1orf86__Homo_sapiens__XP_011539224
auggaggccgccagaagacccagacugggccugagcagaagaagacccagacccgccggcggccccagcggcggcagacccugguuccugcugggcggcgacgagagagagagacugugggccgagcugcugagaaccgugagccccgagcugauccuggaccacgaggugcccagccugcccgccuuccccggccaggagcccagaugcggccccgagcccaccgagguguucaccgugggccccaagaccuucagcuggacccccuucccccccgaccuguggggccccggcagaagcuacagacugcugcacggcgccggcggccaccuggagagccccgccagaagccugccccagagacccgcccccgaccccugcagagcccccagaguggagcagcagcccagcguggagggcgccgccgcccugagaagcugccccaugugccagaaggaguucgcccccagaagcaagaacagcagcggcaugagaagacacagaagccccaagcuggccgccaacaacaacaacaacaagagaaagggcagagccagauggcugacccccgugauccccgcccuguaa

SEQ ID NO: 14428 - RNA, 762 nt, Artificial Sequence
  C1QB__Homo_sapiens__XP_011540361
augaugaugaagauccccuggggcagcauccccgugcugaugcugcugcugcugcugggccugaucgacaucagccaggcccagcugagcugcaccggcccccccgccauccccggcauccccggcauccccggcacccccggccccgacggccagcccggcacccccggcaucaagggcgagaagggccugcccggccuggccggcgaccacggcgaguucggcgagaagggcgaccccggcauccccggcaaccccggcaaggugggccccaagggccccaugggccccaagggcggccccggcgcccccggcgcccccggccccaagggcgagagcggcgacuacaaggccacccagaagaucgccuucagcgccaccagaaccaucaacgugccccugagaagagaccagaccaucagauucgaccacgugaucaccaacaugaacaacaacuacgagcccagaagcggcaaguucaccugcaaggugcccggccuguacuacuucaccuaccacgccagcagcagaggcaaccugugcgugaaccugaugagaggcagagagagagcccagaagguggugaccuucugcgacuacgccuacaacaccuuccaggugaccaccggcggcauggugcugaagcuggagcagggcgagaacguguuccugcaggccaccgacaagaacagccugcugggcauggagggcgccaacagcaucuucagcggcuuccugcuguuccccgacauggaggccuaa

SEQ ID NO: 14429 - RNA, 849 nt, Artificial Sequence
  C1QBP__Homo_sapiens__NP_001203
augcugccccugcugagaugcgugcccagagugcugggcagcagcguggccggccugagagccgccgcccccgccagccccuucagacagcugcugcagcccgcccccagacugugcaccagacccuucggccugcugagcgugagagccggcagcgagagaagacccggccugcugagacccagaggccccugcgccugcggcugcggcugcggcagccugcacaccgacggcgacaaggccuucguggacuuccugagcgacgagaucaaggaggagagaaagauccagaagcacaagacccugcccaagaugagcggcggcugggagcuggagcugaacggcaccgaggccaagcuggugagaaagguggccggcgagaagaucaccgugaccuucaacaucaacaacagcaucccccccaccuucgacggcgaggaggagcccagccagggccagaagguggaggagcaggagcccgagcugaccagcacccccaacuucgugguggaggugaucaagaacgacgacggcaagaaggcccuggugcuggacugccacuaccccgaggacgaggugggccaggaggacgaggccgagagcgacaucuucagcaucagagaggugagcuuccagagcaccggcgagagcgaguggaaggacaccaacuacacccugaacaccgacagccuggacugggcccuguacgaccaccugauggacuuccuggccgacagaggcguggacaacaccuucgccgacgagcugguggagcugagcaccgcccuggagcaccaggaguacaucaccuuccuggaggaccugaagagcuucgugaagagccaguaa

SEQ ID NO: 14430 - RNA, 777 nt, Artificial Sequence
  C1QL1__Homo_sapiens__NP_006679
augcugcuggugcugguggugcugauccccgugcuggugagcagcggcggccccgagggccacuacgagaugcugggcaccugcagaauggugugcgaccccuaccccgccagaggccccggcgccggcgccagaaccgacggcggcgacgcccugagcgagcagagcggcgcccccccccccagcacccuggugcagggcccccagggcaagcccggcagaaccggcaagcccggcccccccggcccccccggcgaccccggcccccccggccccgugggcccccccggcgagaagggcgagcccggcaagcccggcccccccggccugcccggcgccggcggcagcggcgccaucagcaccgccaccuacaccaccgugcccagaguggccuucuacgccggccugaagaacccccacgagggcuacgaggugcugaaguucgacgacguggugaccaaccugggcaacaacuacgacgccgccagcggcaaguucaccugcaacauccccggcaccuacuucuucaccuaccacgugcugaugagaggcggcgacggcaccagcaugugggccgaccugugcaagaacggccaggugagagccagcgccaucgcccaggacgccgaccagaacuacgacuacgccagcaacagcgugauccugcaccuggacgccggcgacgagguguucaucaagcuggacggcggcaaggcccacggcggcaacagcaacaaguacagcaccuucagcggcuucaucaucuacagcgacuaa

SEQ ID NO: 14431 - RNA, 768 nt, Artificial Sequence
  C1QL3__Homo_sapiens__NP_001010908
auggugcugcugcuggugauccugauccccgugcuggugagcagcgccggcaccagcgcccacuacgagaugcugggcaccugcagaauggugugcgaccccuacggcggcaccaaggcccccagcaccgccgccacccccgacagaggccugaugcagagccugcccaccuucauccagggccccaagggcgaggccggcagacccggcaaggccggccccagaggcccccccggcgagcccggcccccccggccccaugggcccccccggcgagaagggcgagcccggcagacagggccugcccggcccccccggcgcccccggccugaacgccgccggcgccaucagcgccgccaccuacagcaccgugcccaagaucgccuucuacgccggccugaagagacagcacgagggcuacgaggugcugaaguucgacgacguggugaccaaccugggcaaccacuacgaccccaccaccggcaaguucaccugcagcauccccggcaucuacuucuucaccuaccacgugcugaugagaggcggcgacggcaccagcaugugggccgaccugugcaagaacaaccaggugagagccagcgccaucgcccaggacgccgaccagaacuacgacuacgccagcaacagcguggugcugcaccuggagcccggcgacgagguguacaucaagcuggacggcggcaaggcccacggcggcaacaacaacaaguacagcaccuucagcggcuucaucaucuacgccgacuaa

SEQ ID NO: 14432 - RNA, 846 nt, Artificial Sequence
  C1QTNF1__Homo_sapiens__NP_112230
augggcagcagaggccagggccugcugcuggccuacugccugcugcuggccuucgccagcggccuggugcugagcagagugccccacgugcagggcgagcagcaggagugggagggcaccgaggagcugcccagcccccccgaccacgccgagagagccgaggagcagcacgagaaguacagacccagccaggaccagggccugcccgccagcagaugccugagaugcugcgaccccggcaccagcauguaccccgccaccgccgugccccagaucaacaucaccauccugaagggcgagaagggcgacagaggcgacagaggccugcagggcaaguacggcaagaccggcagcgccggcgccagaggccacaccggccccaagggccagaagggcagcaugggcgcccccggcgagagaugcaagagccacuacgccgccuucagcgugggcagaaagaagcccaugcacagcaaccacuacuaccagaccgugaucuucgacaccgaguucgugaaccuguacgaccacuucaacauguucaccggcaaguucuacugcuacgugcccggccuguacuucuucagccugaacgugcacaccuggaaccagaaggagaccuaccugcacaucaugaagaacgaggaggagguggugauccuguucgcccaggugggcgacagaagcaucaugcagagccagagccugaugcuggagcugagagagcaggaccaggugugggugagacuguacaagggcgagagagagaacgccaucuucagcgaggagcuggacaccuacaucaccuucagcggcuaccuggugaagcacgccaccgagcccuaa

SEQ ID NO: 14433 - RNA, 741 nt, Artificial Sequence
  C1QTNF3__Homo_sapiens__NP_112207
augcuguggagacagcugaucuacuggcagcugcuggcccuguucuuccugcccuucugccugugccaggacgaguacauggagagcccccagaccggcggccugccccccgacugcagcaagugcugccacggcgacuacagcuucagaggcuaccagggcccccccggcccccccggcccccccggcauccccggcaaccacggcaacaacggcaacaacggcgccaccggccacgagggcgccaagggcgagaagggcgacaagggcgaccugggccccagaggcgagagaggccagcacggccccaagggcgagaagggcuaccccggcaucccccccgagcugcagaucgccuucauggccagccuggccacccacuucagcaaccagaacagcggcaucaucuucagcagcguggagaccaacaucggcaacuucuucgacgugaugaccggcagauucggcgcccccgugagcggcguguacuucuucaccuucagcaugaugaagcacgaggacguggaggagguguacguguaccugaugcacaacggcaacaccguguucagcauguacagcuacgagaugaagggcaagagcgacaccagcagcaaccacgccgugcugaagcuggccaagggcgacgagguguggcugagaaugggcaacggcgcccugcacggcgaccaccagagauucagcaccuucgccggcuuccugcuguucgagaccaaguaa

SEQ ID NO: 14434 - RNA, 732 nt, Artificial Sequence
  C1QTNF5__Homo_sapiens__NP_001265360
augagaccccugcuggugcugcugcugcugggccuggccgccggcagccccccccuggacgacaacaagauccccagccugugccccggccaccccggccugcccggcacccccggccaccacggcagccagggccugcccggcagagacggcagagacggcagagacggcgcccccggcgcccccggcgagaagggcgagggcggcagacccggccugcccggccccagaggcgaccccggccccagaggcgaggccggccccgccggccccaccggccccgccggcgagugcagcgugccccccagaagcgccuucagcgccaagagaagcgagagcagagugcccccccccagcgacgccccccugcccuucgacagagugcuggugaacgagcagggccacuacgacgccgugaccggcaaguucaccugccaggugcccggcguguacuacuucgccgugcacgccaccguguacagagccagccugcaguucgaccuggugaagaacggcgagagcaucgccagcuucuuccaguucuucggcggcuggcccaagcccgccagccugagcggcggcgccauggugagacuggagcccgaggaccaggugugggugcaggugggcgugggcgacuacaucggcaucuacgccagcaucaagaccgacagcaccuucagcggcuuccugguguacagcgacuggcacagcagccccguguucgccuaa

SEQ ID NO: 14435 - RNA, 837 nt, Artificial Sequence
  C1QTNF6__Homo_sapiens__NP_872292
augcaguggcugagagugagagagagccccggcgaggccaccggccacagagugaccaugggcaccgccgcccugggccccgugugggccgcccugcugcuguuccugcugaugugcgagauccccaugguggagcugaccuucgacagagccguggccagcggcugccagagaugcugcgacagcgaggacccccuggaccccgcccacgugagcagcgccagcagcagcggcagaccccacgcccugcccgagaucagacccuacaucaacaucaccauccugaagggcgacaagggcgaccccggccccaugggccugcccggcuacaugggcagagagggcccccagggcgagcccggcccccagggcagcaagggcgacaagggcgagaugggcagccccggcgcccccugccagaagagauucuucgccuucagcgugggcagaaagaccgcccugcacagcggcgaggacuuccagacccugcuguucgagagaguguucgugaaccuggacggcugcuucgacauggccaccggccaguucgccgccccccugagaggcaucuacuucuucagccugaacgugcacagcuggaacuacaaggagaccuacgugcacaucaugcacaaccagaaggaggccgugauccuguacgcccagcccagcgagagaagcaucaugcagagccagagcgugaugcuggaccuggccuacggcgacagagugugggugagacuguucaagagacagagagagaacgccaucuacagcaacgacuucgacaccuacaucaccuucagcggccaccugaucaaggccgaggacgacuaa

SEQ ID NO: 14436 - RNA, 891 nt, Artificial Sequence
  C1QTNF7__Homo_sapiens__NP_001128642
augagcagacaggagcccaagauguucgugcugcuguacgugaccagcuucgccaucugcgccagcggccagcccagaggcaaccagcugaagggcgagaacuacagccccagauacaucugcagcauccccggccugcccggcccccccggcccccccggcgccaacggcagccccggcccccacggcagaaucggccugcccggcagagacggcagagacggcagaaagggcgagaagggcgagaagggcaccgccggccugagaggcaagaccggcccccugggccuggccggcgagaagggcgaccagggcgagaccggcaagaagggccccaucggccccgagggcgagaagggcgaggugggccccaucggcccccccggccccaagggcgacagaggcgagcagggcgaccccggccugcccggcgugugcagaugcggcagcaucgugcugaagagcgccuucagcgugggcaucaccaccagcuaccccgaggagagacugcccaucaucuucaacaaggugcuguucaacgagggcgagcacuacaaccccgccaccggcaaguucaucugcgccuuccccggcaucuacuacuucagcuacgacaucacccuggccaacaagcaccuggccaucggccuggugcacaacggccaguacagaaucaagaccuucgacgccaacaccggcaaccacgacguggccagcggcagcaccgugaucuaccugcagcccgaggacgagguguggcuggagaucuucuucaccgaccagaacggccuguucagcgaccccggcugggccgacagccuguucagcggcuuccugcuguacguggacaccgacuaccuggacagcaucagcgaggacgacgagcuguaa

SEQ ID NO: 14437 - RNA, 324 nt, Artificial Sequence
  C1QTNF9B-AS1__Homo_sapiens__NP_001014442
auguggauccugagcaaccugaugggcaccagcgaggagggcaaccugcugagcaccgugagccccaccgugaaggcccuguucggcaagaccagagugagccccaucuuccccuucagccccagaagccccuuccagccccugauccccagaacccccggcagccccuggggccccgugggccccgccagcccccugggccccggcuuccccaucggccccaugggccccggcaagcccgugggccccaagggccccaugcugccccugggccccagcggccccgugggccccaccagcccccuguuccccuucugccccuaa

SEQ ID NO: 14438 - RNA, 2118 nt, Artificial Sequence
  C1R__Homo_sapiens__NP_001724
auguggcugcuguaccugcuggugcccgcccuguucugcagagccggcggcagcauccccaucccccagaagcuguucggcgaggugaccagcccccuguuccccaagcccuaccccaacaacuucgagaccaccaccgugaucaccgugcccaccggcuacagagugaagcugguguuccagcaguucgaccuggagcccagcgagggcugcuucuacgacuacgugaagaucagcgccgacaagaagagccugggcagauucugcggccagcugggcagcccccugggcaacccccccggcaagaaggaguucaugagccagggcaacaagaugcugcugaccuuccacaccgacuucagcaacgaggagaacggcaccaucauguucuacaagggcuuccuggccuacuaccaggccguggaccuggacgagugcgccagcagaagcaagcugggcgaggaggacccccagccccagugccagcaccugugccacaacuacgugggcggcuacuucugcagcugcagacccggcuacgagcugcaggaggacagacacagcugccaggccgagugcagcagcgagcuguacaccgaggccagcggcuacaucagcagccuggaguaccccagaagcuacccccccgaccugagaugcaacuacagcaucagaguggagagaggccugacccugcaccugaaguuccuggagcccuucgacaucgacgaccaccagcaggugcacugccccuacgaccagcugcagaucuacgccaacggcaagaacaucggcgaguucugcggcaagcagagaccccccgaccuggacaccagcagcaacgccguggaccugcuguucuucaccgacgagagcggcgacagcagaggcuggaagcugagauacaccaccgagaucaucaagugcccccagcccaagacccuggacgaguucaccaucauccagaaccugcagccccaguaccaguucagagacuacuucaucgccaccugcaagcagggcuaccagcugaucgagggcaaccaggugcugcacagcuucaccgccgugugccaggacgacggcaccuggcacagagccaugcccagaugcaagaucaaggacugcggccagcccagaaaccugcccaacggcgacuucagauacaccaccaccaugggcgugaacaccuacaaggccagaauccaguacuacugccacgagcccuacuacaagaugcagaccagagccggcagcagagagagcgagcagggcguguacaccugcaccgcccagggcaucuggaagaacgagcagaagggcgagaagauccccagaugccugcccgugugcggcaagcccgugaaccccguggagcagagacagagaaucaucggcggccagaaggccaagaugggcaacuuccccuggcagguguucaccaacauccacggcagaggcggcggcgcccugcugggcgacagauggauccugaccgccgcccacacccuguaccccaaggagcacgaggcccagagcaacgccagccuggacguguuccugggccacaccaacguggaggagcugaugaagcugggcaaccaccccaucagaagagugagcgugcaccccgacuacagacaggacgagagcuacaacuucgagggcgacaucgcccugcuggagcuggagaacagcgugacccugggccccaaccugcugcccaucugccugcccgacaacgacaccuucuacgaccugggccugaugggcuacgugagcggcuucggcgugauggaggagaagaucgcccacgaccugagauucgugagacugcccguggccaacccccaggccugcgagaacuggcugagaggcaagaacagaauggacguguucagccagaacauguucugcgccggccaccccagccugaagcaggacgccugccagggcgacagcggcggcguguucgccgugagagaccccaacaccgacagauggguggccaccggcaucgugagcuggggcaucggcugcagcagaggcuacggcuucuacaccaaggugcugaacuacguggacuggaucaagaaggagauggaggaggaggacuaa

SEQ ID NO: 14439 - RNA, 564 nt, Artificial Sequence
  C1RL__Homo_sapiens__NP_001284572
augcccggccccagaguguggggcaaguaccuguggagaagcccccacagcaagggcugccccggcgccaugugguggcugcugcuguggggcgugcugcaggccugccccaccagaggcagcgugcugcuggcccaggagcugccccagcagcugaccagccccggcuaccccgagcccuacggcaagggccaggagagcagcaccgacaucaaggcccccgagggcuucgccgugagacugguguuccaggacuucgaccuggagcccagccaggacugcgccggcgacagcgugaccaucagcuucgugggcagcgaccccagccaguucugcggccagcagggcagcccccugggcagaccccccggccagagagaguucgugagcagcggcagaagccugagacugaccuucagaacccagcccagcagcgagaacaagaccgcccaccugcacaagggcuuccuggcccuguaccagaccgugggcgagugccccagcuggggcugcagagagggcgccagcgugcccagccacgaccccggcaucuucaagcccuaa

SEQ ID NO: 14440 - RNA, 2067 nt, Artificial Sequence
  C1S__Homo_sapiens__XP_005253817
auguggugcaucgugcuguucagccugcuggccuggguguacgccgagcccaccauguacggcgagauccugagccccaacuacccccaggccuaccccagcgagguggagaagagcugggacaucgaggugcccgagggcuacggcauccaccuguacuucacccaccuggacaucgagcugagcgagaacugcgccuacgacagcgugcagaucaucagcggcgacaccgaggagggcagacugugcggccagagaagcagcaacaacccccacagccccaucguggaggaguuccaggugcccuacaacaagcugcaggugaucuucaagagcgacuucagcaacgaggagagauucaccggcuucgccgccuacuacguggccaccgacaucaacgagugcaccgacuucguggacgugcccugcagccacuucugcaacaacuucaucggcggcuacuucugcagcugcccccccgaguacuuccugcacgacgacaugaagaacugcggcgugaacugcagcggcgacguguucaccgcccugaucggcgagaucgccagccccaacuaccccaagcccuaccccgagaacagcagaugcgaguaccagaucagacuggagaagggcuuccaggugguggugacccugagaagagaggacuucgacguggaggccgccgacagcgccggcaacugccuggacagccugguguucguggccggcgacagacaguucggccccuacugcggccacggcuuccccggcccccugaacaucgagaccaagagcaacgcccuggacaucaucuuccagaccgaccugaccggccagaagaagggcuggaagcugagauaccacggcgaccccaugcccugccccaaggaggacacccccaacagcgugugggagcccgccaaggccaaguacguguucagagacguggugcagaucaccugccuggacggcuucgaggugguggagggcagagugggcgccaccagcuucuacagcaccugccagagcaacggcaaguggagcaacagcaagcugaagugccagcccguggacugcggcauccccgagagcaucgagaacggcaagguggaggaccccgagagcacccuguucggcagcgugaucagauacaccugcgaggagcccuacuacuacauggagaacggcggcggcggcgaguaccacugcgccggcaacggcagcugggugaacgaggugcugggccccgagcugcccaagugcgugcccgugugcggcgugcccagagagcccuucgaggagaagcagagaaucaucggcggcagcgacgccgacaucaagaacuuccccuggcagguguucuucgacaaccccugggccggcggcgcccugaucaacgaguacugggugcugaccgccgcccacgugguggagggcaacagagagcccaccauguacgugggcagcaccagcgugcagaccagcagacuggccaagagcaagaugcugacccccgagcacguguucauccaccccggcuggaagcugcuggaggugcccgagggcagaaccaacuucgacaacgacaucgcccuggugagacugaaggaccccgugaagaugggccccaccgugagccccaucugccugcccggcaccagcagcgacuacaaccugauggacggcgaccugggccugaucagcggcuggggcagaaccgagaagagagacagagccgugagacugaaggccgccagacugcccguggccccccugagaaagugcaaggaggugaagguggagaagcccaccgccgacgccgaggccuacguguucacccccaacaugaucugcgccggcggcgagaagggcauggacagcugcaagggcgacagcggcggcgccuucgccgugcaggaccccaacgacaagaccaaguucuacgccgccggccuggugagcuggggcccccagugcggcaccuacggccuguacaccagagugaagaacuacguggacuggaucaugaagaccaugcaggagaacagcacccccagagaggacuaa

SEQ ID NO: 14441 - RNA, 3534 nt, Artificial Sequence
  C20orf194__Homo_sapiens__NP_001009984
auggacguguacccccccagaagacagggccugcccagagccagaagccccggcggcagcagcagaggcagccccagcgugagcugcagcagacugagacaggugcagagcauccugacccagagcagcaagagcagacccgacggcauccugugcauccugggcaucgacagcagauacaacgagggcugcagagagcuggccaacuaccugcuguucggccuguacaaccagaacaccagcgacuucgagaagaccggcuucagcgaggaggugcuggacgacgugaucauccugaucaagagcgacagcgugcaccuguacugcaaccccgugaacuucagauaccugcugcccuacguggcccacuggagaaaccugcacuuccacugcaugaccgagaacgaguacgaggacgaggaggccgccgaggaguucaagaucaccagcuucguggacauggugagagacugcagcagaaucggcauccccuacagcagccagggccaccugcagaucuucgacauguucgugguggagaaguggcccaucgugcaggccuucgcccuggagggcaucggcggcgacggcuucuucaccaugaaguacgagcugcaggacgugagccugaaccuguggaacguguacagcaagauggaccccaugagccuggagagccugcugagcgacgaccugguggccuucgagcaccaguggaccagcuucuucgccaacuucgacaccgagauccccuuccugcuggagcugagcgagagccaggccggcgagcccuucagaagcuacuucagccacggcaugaucagcagccacaucaccgagaacagccccaacagacagcccuucgugcuguucggcaaccacagcaccagagagaaccugaacgccggcaacuucaacuuccccagcgagggccaccuggugagaagcaccggccccggcggcagcuucgccaagcacaugguggcccagugcgugagccccaagggcccccuggccugcagcagaaccuacuucuucggcgccacccacgugcccuaccugggcggcgacagcaagcugcccaagaagaccgagcagaucagacugcugagccagaucuacgccgccgugaucgaggccgugcuggccggcaucgccugcuacgccaagaccagcagccugaccaaggccaaggagguggccgagcagacccugggcagcggccuggacagcuucgagcugauccccuucaaggccgcccugagaagcaagaugaccuuccacauccacgccgugaacaaccagggcagaaucgugccccuggacagcgaggacagccugagcuucgugaagaccgccugcauggccguguacgacauccccgaccugcugggcggcaacggcugccugggcagcgugguguucagcgagagcuuccugaccagccagauccuggugaaggagaaggacggcaccgugaccaccgagaccagcagcguggugcugaccgccgccgugcccagauucugcagcuggcugguggaggacaacgaggugaagcugagcgagaagacccagcaggccgugagaggcgacgagagcuuccugggcaccuaccugaccggcggcgagggcgccuaccuguacagcagcaaccugcagagcuggcccgaggagggcaacgugcacuucuucagcagcggccugcuguucagccacugcagacacagaagcaucaucaucagcaaggaccacaugaacagcaucagcuucuacgacggcgacagcaccagcaccguggccgcccugcugaucgacuucaagagcagccugcugccccaccugcccgugcacuuccacggcagcagcaacuuccugaugaucgcccuguuccccaagagcaagaucuaccaggccuucuacagcgagguguucagccuguggaagcagcaggacaacagcggcaucagccugaaggugauccaggaggacggccugagcguggagcagaagagacugcacagcagcgcccagaagcuguucagcgcccugagccagcccgccggcgagaagagaagcagccugaagcugcugagcgccaagcugcccgagcuggacugguuccugcagcacuucgccaucagcagcaucagccaggagcccgugaugagaacccaccugcccgugcugcugcagcaggccgagaucaacaccacccacagaaucgagagcgacaaggugaucaucagcaucgugaccggccugcccggcugccacgccagcgagcugugcgccuuccuggugacccugcacaaggagugcggcagauggaugguguacagacagaucauggacagcagcgagugcuuccacgccgcccacuuccagagauaccugagcagcgcccuggaggcccagcagaacagaagcgccagacagagcgccuacaucagaaagaagaccagacugcugguggugcugcagggcuacaccgacgugaucgacguggugcaggcccugcagacccaccccgacagcaacgugaaggccagcuucaccaucggcgccaucaccgccugcguggagcccaugagcugcuacauggagcacagauuccuguuccccaagugccuggaccagugcagccagggccuggugagcaacgugguguucaccagccacaccaccgagcagagacacccccugcuggugcagcugcagagccugaucagagccgccaaccccgccgccgccuucauccuggccgagaacggcaucgugaccagaaacgaggacaucgagcugauccugagcgagaacagcuucagcagccccgagaugcugagaagcagauaccugauguaccccggcugguacgagggcaagcugaacgccggcagcguguacccccugauggugcagaucugcgugugguucggcagaccccuggagaagaccagauucguggccaagugcaaggccauccagagcagcaucaagcccagccccuucagcggcaacaucuaccacauccugggcaaggugaaguucagcgacagcgagagaaccauggaggugugcuacaacacccuggccaacagccugagcaucaugcccgugcuggagggccccacccccccccccgacagcaagagcgugagccaggacagcagcggccagcaggagugcuaccugguguucaucggcugcagccugaaggaggacagcaucaaggacuggcugagacagagcgccaagcagaagccccagagaaaggcccugaagaccagaggcaugcugacccagcaggagaucagaagcauccacgugaagagacaccuggagccccugcccgccggcuacuucuacaacggcacccaguucgugaacuucuucggcgacaagaccgacuuccacccccugauggaccaguucaugaacgacuacguggaggaggccaacagagagaucgagaaguacaaccaggagcuggagcagcaggaguaccacgaccuguucgagcugaagcccuaa

SEQ ID NO: 14442 - RNA, 618 nt, Artificial Sequence
  C20orf196__Homo_sapiens__NP_001290406
auggccgccagagacgccaccagcggcagccugagcgaggagagcagcgcccuggaccugcccagcgccugcgacaucagagacuacgugcugcagggccccagccaggaggccaacagcgaggccuucagcagccuggaguuccacagcuuccccuacagcagcgacguggaccccgacaccagcaaccugaacaucgagcagaacaacagcuggaccgccgagaacuucuggcuggaccccgccgugaagggccagagcgagaaggaggaggacgacggccugagaaagagccuggacagauucuacgagauguucggccacccccagcccggcagcgccaacagccugagcgccagcgugugcaagugccugagccagaagaucacccagcugagaggccaggagagccagaaguacgcccugagaagcuuccagauggccagagugaucuucaacagagacggcugcagcgugcugcagagacacagcagagacacccacuucuacccccuggaggagggcagcaccagccuggacgacgagaagcccaaccccggccugagcaaggacaucacccacuuccugcugcagcagaacgugaugaaggaccuguaa

SEQ ID NO: 14443 - RNA, 600 nt, Artificial Sequence
  C20orf27__Homo_sapiens__NP_001034229
auggccgccgccaacaagggcaagugccugcccggcguggugggccuggcccaggcccugcccgugggccccggcagaagagccaucgccgccggcaacaagcccagagugagaagcaucagauucgccgccggccacgacgccgagggcagccacagccacgugcacuucgacgagaagcugcacgacagcguggugauggugacccaggagagcgacagcagcuuccuggugaaggugggcuuccugaagauccugcacagauacgagaucaccuucacccugccccccgugcacagacugagcaaggacgugagagaggcccccgugcccagccugcaccugaagcugcugagcguggugcccgugcccgagggcuacagcgugaagugcgaguacagcgcccacaaggagggcgugcugaaggaggagauccugcuggccugcgagggcggcaccggcaccugcgugagagugaccgugcaggccagagugauggacagacaccacggcacccccaugcugcuggacggcgugaagugcgugggcgccgagcuggaguacgacagcgagcacagcgacuggcacggcuucgacuaa

SEQ ID NO: 14444 - RNA, 414 nt, Artificial Sequence
  C20orf85__Homo_sapiens__NP_848551
auggcccagaagccccugagcaccgccgccgccgagagaaugaaccuggugggccaggacgagaucuggaaguacagacugaaggccgagagcgaggccagacagaacuggccccagaacuggggcuuccugaccacccccuucgaggagcugaucaagugcgaggaggaccugcccacccccaagcccaagaucgagcugcccgagagauucagaaucagacccgugacccccguggagaaguacaucaagguguuccccagcccccccgugccccagaccacccagggcuucaucggcuggagaagcgccgugcccggccugaacaagugccuggagcuggacgacgccaucagaagcugcaagggcgccuucgccagagagcugugcuggcccaagcagggcgugcacuaa

SEQ ID NO: 14445 - RNA, 768 nt, Artificial Sequence
  C21orf2__Homo_sapiens__NP_001258369
augaagcugaccagaaagauggugcugaccagagccaaggccagcgagcugcacagcgugagaaagcugaacugcuggggcagcagacugaccgacaucagcaucugccaggagaugcccagccuggaggugaucacccugagcgugaacagcaucagcacccuggagcccgugagcagaugccagagacugagcgagcuguaccugagaagaaacagaauccccagccuggccgagcuguucuaccugaagggccugcccagacugagagugcuguggcuggccgagaaccccugcugcggcaccagcccccacagauacagaaugaccgugcugagaacccugcccagacugcagaagcuggacaaccaggccgugaccgaggaggagcugagcagagcccugagcgagggcgaggagaucaccgccgcccccgagagagagggcaccggccacggcggccccaagcugugcugcacccugagcagccugagcagcgccgccgagaccggcagagacccccuggacagcgaggaggaggccaccggcgcccaggacgagagaggccugaagccccccagcagaggccaguuccccagccugagcgccagagacgccagcagcagccacagaggcagaaacgugcugaccgccauccugcugcugcugagagagcuggacgccgagggccuggaggccgugcagcagaccgugggcagcagacugcaggcccugagaggcgaggaggugcaggagcacgccgaguaa

SEQ ID NO: 14446 - RNA, 807 nt, Artificial Sequence
  C21orf33__Homo_sapiens__NP_004640
auggccgccgugagagugcugguggccagcagacuggccgccgccagcgccuucaccagccugagccccggcggcagaacccccagccagagagccgcccugcaccugagcgugcccagacccgccgccagaguggcccuggugcugagcggcugcggcguguacgacggcaccgagauccacgaggccagcgccauccuggugcaccugagcagaggcggcgccgaggugcagaucuucgcccccgacgugccccagaugcacgugaucgaccacaccaagggccagcccagcgagggcgagagcagaaacgugcugaccgagagcgccagaaucgccagaggcaagaucaccgaccuggccaaccugagcgccgccaaccacgacgccgccaucuuccccggcggcuucggcgccgccaagaaccugagcaccuucgccguggacggcaaggacugcaaggugaacaaggagguggagagagugcugaaggaguuccaccaggccggcaagcccaucggccugugcugcaucgcccccgugcuggccgccaaggugcugagaggcguggaggugaccgugggccacgagcaggaggagggcggcaaguggcccuacgccggcaccgccgaggccaucaaggcccugggcgccaagcacugcgugaaggaggugguggaggcccacguggaccagaagaacaagguggugaccacccccgccuucaugugcgagaccgcccugcacuacauccacgacggcaucggcgccauggugagaaaggugcuggagcugaccggcaaguaa

SEQ ID NO: 14447 - RNA, 873 nt, Artificial Sequence
  C21orf59__Homo_sapiens__NP_067077
auggugcugcugcacgugaagagaggcgacgagagccaguuccugcugcaggcccccggcagcaccgagcuggaggagcugaccgugcagguggccagaguguacaacggcagacugaaggugcagagacugugcagcgagauggaggagcuggccgagcacggcaucuuccugccccccaacaugcagggccugaccgacgaccagaucgaggagcugaagcugaaggacgaguggggcgagaagugcgugcccagcggcggcgccguguucaagaaggacgacaucggcagaagaaacggccaggcccccaacgagaagaugaagcaggugcugaagaagaccaucgaggaggccaaggccaucaucagcaagaagcagguggaggccggcgugugcgugaccauggagauggugaaggacgcccuggaccagcugagaggcgccgugaugaucguguaccccaugggccugccccccuacgaccccaucagaauggaguucgagaacaaggaggaccugagcggcacccaggccggccugaacgugaucaaggaggccgaggcccagcuguggugggccgccaaggagcugagaagaaccaagaagcugagcgacuacgugggcaagaacgagaagaccaagaucaucgccaagauccagcagagaggccagggcgcccccgccagagagcccaucaucagcagcgaggagcagaagcagcugaugcuguacuaccacagaagacaggaggagcugaagagacuggaggagaacgacgacgacgccuaccugaacagccccugggccgacaacaccgcccugaagagacacuuccacggcgugaaggacaucaaguggagacccagauaa

SEQ ID NO: 14448 - RNA, 660 nt, Artificial Sequence
  C21orf62__Homo_sapiens__XP_011545334
auggccccccccagcagacacugccugcugcugaucagcacccugggcguguucgcccugaacugcuucaccaagggccagaagaacagcacccugaucuucaccagagagaacaccaucagaaacugcagcugcagcgccgacaucagagacugcgacuacagccuggccaaccugaugugcaacugcaagaccgugcugccccuggccguggagagaaccagcuacaacggccaccugaccaucugguucaccgacaccagcgcccugggccaccugcugaacuucacccuggugcaggaccugaagcugagccugugcagcaccaacacccugcccaccgaguaccuggccaucugcggccugaagagacugagaaucaacauggaggccaagcaccccuuccccgagcagagccugcugauccacagcggcggcgacagcgacagcagagagaagcccauguggcugcacaagggcuggcagcccugcauguacaucagcuuccuggacauggcccuguucaacagagacagcgcccugaagagcuacagcaucgagaacgugaccagcaucgccaacaacuuccccgacuucagcuacuucagaaccuuccccaugcccagcaacaagagcuacguggugaccuucaucuacuaa

SEQ ID NO: 14449 - RNA, 894 nt, Artificial Sequence
  C21orf91__Homo_sapiens__NP_001093890
augaacgaggaggagcaguucgugaacaucgaccugaacgacgacaacaucugcagcgugugcaagcugggcaccgacaaggagacccugagcuucugccacaucugcuucgagcugaacaucgagggcgugcccaagagcgaccugcugcacaccaagagccugagaggccacaaggacugcuucgagaaguaccaccugaucgccaaccagggcugccccagaagcaagcugagcaagagcaccuacgaggaggugaagaccauccugagcaagaagaucaacuggaucgugcaguacgcccagaacaaggaccuggacagcgacagcgagugcagcaagaacccccagcaccaccuguucaacuucagacacaagcccgaggagaagcugcugccccaguucgacagccaggugcccaaguacagcgccaaguggaucgacggcagcgccggcggcaucagcaacugcacccagagaauccuggagcagagagagaacaccgacuucggccugagcaugcugcaggacagcggcgccacccugugcagaaacagcgugcuguggccccacagccacaaccaggcccagaagaaggaggagaccaucagcagccccgaggccaacgugcagacccagcacccccacuacagcagagaggagcugaacagcaugacccugggcgagguggagcagcugaacgccaagcugcugcagcagauccaggagguguucgaggagcugacccaccaggugcaggagaaggacagccuggccagccagcugcacgugagacacguggccaucgagcagcugcugaagaacugcagcaagcugcccugccugcaggugggcagaaccggcaugaagagccaccugcccaucaacaacuaa

SEQ ID NO: 14450 - RNA, 1095 nt, Artificial Sequence
  C22orf29__Homo_sapiens__NP_078903
augcccagaggcagaugcagacagcagggccccagaauccccaucugggccgccgccaacuacgccaacgcccaccccuggcagcagauggacaaggccagccccggcguggccuacaccccccugguggaccccuggaucgagagacccugcugcggcgacaccgugugcgugagaaccaccauggagcagaagagcaccgccagcggcaccugcggcggcaagcccgccgagagaggcccccuggccggccacaugcccagcagcagaccccacagaguggacuucugcugggugcccggcagcgaccccggcaccuucgacggcagccccuggcugcuggacagauuccuggcccagcugggcgacuacaugagcuuccacuucgagcacuaccaggacaacaucagcagagugugcgagauccugagaagacugaccggcagagcccaggccugggccgcccccuaccuggacggcgaccugccccugcccgacgacuacgagcuguucugccaggaccugaaggagguggugcaggaccccaacagcuucgccgaguaccacgccguggugaccugcccccugccccuggccagcagccagcugcccguggccccccagcugcccguggugagacaguaccuggccagauuccuggagggccuggcccuggacaugggcaccgcccccagaagccugcccgccgccauggccacccccgccgugagcggcagcaacagcgugagcagaagcgcccuguucgagcagcagcugaccaaggagagcacccccggccccaaggagccccccgugcugcccagcagcaccugcagcagcaagcccggccccguggagcccgccagcagccagcccgaggaggccgcccccacccccgugcccagacugagcgagagcgccaacccccccgcccagagacccgaccccgcccaccccggcggccccaagccccagaagaccgaggaggaggugcuggagaccgagggcgaccaggaggugagccugggcaccccccaggaggugguggaggcccccgagacccccggcgagcccccccugagccccggcuucuaa

SEQ ID NO: 14451 - RNA, 7062 nt, Artificial Sequence
  C2CD3__Homo_sapiens__NP_001273506
augaagcagagaaagggccagggcagcggcggcagcagaggcagaaagaagagaggccugagcgacaucagccccagcaccagccugcccccccugguggagggccagcugagaugcuuccugaagcugaccgugaacagagugaucuggaagaucgccaagccccccaccugcgugcuggugagagugagaugguggggcgagaccagcgacggcacccuguucugccccagagacgcccugcagaccgagcccaaggccgugagaaccaccaccagauacgccaucagaugcggccccaagcaguucaccagcuaccugaccgacauggccgugcuggugcuggaggugaucaccaagcuggacggccugcccaucggcagagugcagaucaacggccuggcccagcugagccccacccaccagaucaacggcuucuucaccaucgugagcagcaccagcaagaagcugggcgagcugcaggugagccuggcccuggagccccugagcgagaccuacgacagcuaccacccccugcccaccaccgacaugaccgagaacgugcugcugagcaagcagggcuucagagagaacaccgagcccagcagcacccaguuccaggugcccagcagacccagagacauccacaccaucaagaucgacggcaaggagcuggccgccaacagcagcagaagcaccacccccagaggcaaggaccacgugugcuucgccgagaaccccgacaccaucaaggacagcagcuucggccugcagcacagccugaacagcggccagagccuggagagcgugacccugaagggcagagcccccagaaagcagaugagccugcugaacagcagcgaguuccagccccagaucagaaccguggccaagagccacagcgacagcugcauccugagcagcaacaaccugcccaccaaggaccugcugagcgcccugcuggagcagggcaacaagcugagaaacgccauggugaucagcgccaugaagagcagccccgagaccagcaugcugcuggaccaggugcacccccccaucaacgaggacagccugagagccagcacccagaucagagccuucagcagaaacagauucaaggaccacaucgaggaccaccugcugcccagcaccgagaacaccuucuggagacacgacaccaaggccgacaccagagccauccagcugcugcugggcagcgccgagcugagccagggcaacuucugggacggccugggcagcccccccgacagccccagccccggcagcgacguguacugcaucagcgagcugaacgacccccaguacgaccagagccugcuggagaaccuguucuacaccgcccccaagagcgacaccagcaucagcgacuuccugagcgaggaggacgacaucgugcccagcaagaagaucagccagagcaccgcccuggccagaagcagcaaggugcuggagagcagcgaccacaagcugaagaagagaagcgccggcaagagaaacagaaaccugguggagcagcagaugcugagcgagacccccgaggacgcccagaccaugacccugagcguggacagacuggcccugcugggcagaacccacagcgugagaaucaucaucgagaccaugggcgugccccccgacagcccccagaugacccccggcaagaagagcuacgccggccccccccccaaggugaccaccgccaagaagagaaccuucuucguggaguaccacuuccccgugggcuucagcgagagcggccugggcaagaccgcccugaucaccgagguggugagacuggccagcagcaagaucaccgacggcaaggugaaguuccagcagagauucguguuccccgugcaguucggcggccccaugaucgagcacugguggaacagcaaccugaccuuccagaucuacgugaagaagaccccccagaagaagcccgaggugaucggcagcgugagccugagccugagagccgugauccagagcgagcugcugagcuucagcgaccagcugcccgugcagcaggagaacggccagagccccuucggcccccugaaggugaccauggagcugaucaccgacaacaaggacuucaccggcaucaacaccaagcugagcggcaacacccacuacaccccccugugcgcccccaccagccccaacaaggcccugcccgagcugaaccaggacaugaccugcaccaagaacccccagaaccugaaccagauccacgaggagaccgccaagaaggcccagaaccuggugcugcccaacagaaagagccccagccccguggccccccaccccagcaccuucguggccacccccgccagccacaaccuggugaaccagaccaacggcaccaccaaggagagcgcccugcugcugcacgugcugcugauggugcccgacggcaaggacuucaucagcggcgagagcgagaagcagagccccugcaacguguaccugaacugcaagcuguucagcaccgaggaggugaccagaagcgugaucgccuggggcaccacccagcccguguucaacuucagccaggugauccccgugagccugagcagcaaguaccuggagagacugaagaacaacgugauggugaucgagaccuggaacaaggugagaagccccggccaggacaagcugcugggccuggugaagcugccccugcaccaguucuacaugagcuucaaggacgccaagaucagcagacugcugcuggacgcccaguaccccgugguggccguggacagcuacaugcccgugaucgacguguucagcggccaccagaacggcagccugagaguguuccuggccaugggcagcagcaaccagaucauggcccugcagagacugaagaacgaggagggcacccugccccccuucagccccagacccgcccacuuccuggaccagcccaccgccgccagcguggccauggccgaggacagaggcaacggccugauggagcacugcuucgagauccacaucgagauggugaagggccuggccccccugcaggccaccguguggggcgaggccgacugcuacgugcaguacuacuuccccgugcagcacagccagagcagcgugcugaagggccccgaguuccuggagaacggcaucacccugaagcccuucagaaccgccaccacccugugcgugcccgaccccaucuucaacagcgagcaccaccacagccugcugcugcccgccgaggugcccgugcagagacugcugcugagcgccuucagcgcccagggccuggugcccggcggcggcgugcaguucgagaucuggugcagauacuacuaccccaacgugagagaccagaagguggccaagggcacccugccccugagcagaaucugcgccauggugaccacccagcacagagaggacgugggcauccagaccuucaaccugccccugacccccagaaucgagaacagaaaggagcugagaaaccagagcagcggccugcuggacgugggccugagauacagaagaagccccagaaccgccgagggcgugcuggccgccagaaccgugagcaucagcgugcagaucaucagagccugcggccugcaggccgccgccaaggcccuggccgagagagagcccgcccugcaguucagcgccaccgugggcgugaacgccagcgugaccacccaccugagcuuccugccccagggcgagcagagaagaacccaccccguggccugcagcuucugccccgaguucagccaccacguggaguucaccugcaaccuggugacccagcacugcagcggcgaggccugcuuccuggccgagcugcuggaguucgccgaggugaucuucgccguguaccacgagaacaccaagagcgccagcgacaucaucagcaucgagagcugcaaggaguaccugcugggcguggugaaggugcccaccaaggagcugcugaucaagagaagcggcaucaccggcugguaccccaucauccugcccgaggacggcggccugccccacggccuggagcugaugcagaagaucgugggcggccuggagcugagcaucagcuucacccacagaggcgacagagagagagugcuggaggccgccgagcaccugggcuggagcuucgagaacagccugaaggacuucgugagaauggacgagggcgagcccgccaccgugaccaucagcacccccagacuguggcugcccauccacugcgugcugcuggccggccacaaccacauccacaagaacaccuacugcuaccugagauacaaguucuacgaccacgaggccuucuggaccccccugaagaagcccaaggagagcgugaacaagaagcagaucauggugaccuucaaggccagcaagagagccgaggugaccagaggccccagccugcugugguacuucagagaggagagacuggagauccagguguggagagccuacggcaacgacagcguggagagaccccaccagaccgacagcuggaucggcagcgccuacguggaccuggccagacugggcgagagaagcgccagaacccugaccgugagcggcguguacccccuguucggcagaaacgccagcaaccugagcggcgccgcccugagagugcacguggugcugagcagccugagcagccaccuggagcccacccacgagcuggacagcauggacugcagcagccacagcgagagcgagcagcugcccagaagaaacgacgaggugcagcugagcccccccgaggugaucagcugccaccagaagagccccgccagcacccaggugcccugcagcagcaccaccgccgaggugagacugacccaggagggccccgccgaccuggacggcaccuucgccgugagcauccugguggagagagccaugcaccugagccugaagggcagcccccugaccgagagaaaggugagcauccccagcugcugcgugagcuucgccaccgccgacgagagcagccccguguacacccaggugguggagaacaccgacagccccaucuggaacuuccagcagcagagcagacugagcaaggagcugcugcuggacccccagcagacccugguguucaagguguggcacaagggcgacgaggagagagugaucggcuucgccagcguggaccugagcccccugcugagcggcuuccaguucgugugcggcugguacaacaucaccgacuucagcggcgagugccagggccagaucaagguggccgugagcccccuggagagccugauccacuucaaggaggagagacaggccagaagaggcguggagaccagcaagagccugauccccaucuacagccccuucagcuuccccgccagcgacaccuacgccgccuucagcagccacauggccagacagacccuggaccagcuggcccacgccagcagcaaggagcuggacuucagcagccccggcagaagcgacaccaccagaagccaggccagcagacacgaggagcacgugcagaacaucagaagauuccacgagagccugcaccugcagggcgaggccccccugcccugcgacgacaagcugaccaccagcccccugagcagccagaccagcauccugaccagccugagaaagaaccugagcgagcuggaccagauccagagauacuucagacagaagcugaccaagcccuuccugccccugagcccccagacccagaccgccaucagccagcaccaggagagcugcagagaccaccugggccccggcgccagcagccuggaccccggcagccagugcauccuggagaagagcagcaaccuggugcugcaggugagcagccugaucaccgaccugcagaccaucaccagagacagccaggccgcccugagcagccacagagccagaagcagaagcaacaaggccaccacccugcccgacgcccaggacaccgaggcccugcaggagagaugcaccaugcccgacgagccccuggugagagcccccgacaagggcaccgacagccccagcccccccccccuggaggagaccagcaacggcggcagaaugcugcacgagagccugagacacgccgugcccaucaccagaaugcagagcagcgaggacaccgaggccggccccgccuacagcgacgaggacuacgaggaggacaucaucgagcccagaacccugaacgagaucaccaccgugaccgacaagaccagccccuggagcagcgugaucagcgacaccagcgaggugaucagcccccagcccgacgaggugcagagagagggccccagcugccccagccccggccccuucugcagagaggagcugauggugaagagcagcuuccugagcagccccgagagagccgugaacccccaccugcccagacagggcagccccagccagagccugguggccugcgagugcgaggccagcaaggccagagugggcggcgagagcgccagcgccaacccccagcccauccccugccccacccugagcggcgcccagcagagcagcaccuucgugggcuggagcagcccccagaccgaccagaacaaggagcccaagagcgaggcccccgccgagaacgaggccgccaccagcgagcugggcgacagcgccgacagcuucaagaagcugccccugaaccuggccagccagagcagaagagagaaccacaagggcccccccaucgacagcagcgacaucagacagagacaggugaccaccggcagcgagaccagcaccaagcagagccugcugcugcccggccccaucguggugcccaacuucuuccugcccccccagcagcuggaggccagccugagaaugcugagccugagcgccacccugccccccgccgccaccaccgaccaggacaagagcgaggccaccagaggcgcccugagccagagacccugcagacccagacccaacagccugccccugaaccugcccgaggaggagacccugagaaucgccagaaucuucagcagccaguacagccagaaggacuaa

SEQ ID NO: 14452 - RNA, 1110 nt, Artificial Sequence
  C2CD4A__Homo_sapiens__NP_997205
auguggugccuggagagacugagacugggccccgagugccugagaagaagcggcgacuggcugcugcccggcagagccagaggcgccaagagcagaaccaccgccgccugcgccaacgugcugacccccgacagaauccccgaguucugcaucccccccagacugaugcccagacuggcccuggccgcccugagaaacagcuggguggaggaggccggcauggacgagggcgccggcagaaccgacugggaccccagaagccaggccgcccugagccugccccaccugcccagagugagaaccgccuacggcuucugcgcccugcuggagagcccccacaccagaagaaaggagagccugcugcugggcggcccccccgcccccagacccagagcccacaccuacggcggcggcggcggccccgacgcccugcugggcacccugagagugcccagagcccccggccccgccacccccgccgcccccggcugccccagacccccccaggacgcccuggccagaagacccagaggcugcagacugcugagagugcccgacggccugcugagcagagcccugagagccggcagaagcagaagacugaccagagugagaagcgugagcagcggcaacgaggacaaggagagaagagccggcagccagagccccgccagagcccccagcaccagcccccccagcagcagagugcccuuccccgagagacuggaggccgagggcaccguggcccugggcagagccggcgacgcccugagacuggccgccgaguacugccccggcaccggcagacugagacugagacugcugagagccgagagccccgccggcggcgcccccggccccagagccgugagcugcagacugagccuggugcugagaccccccggcaccgcccugagacagugcagcaccguggugggcagaagcagaaaggccagcuucgaccaggacuucugcuucgacggccugagcgaggacgaggugagaagacuggccgugagagugaaggccagagacgagggcagaggcagagagagaggcagacugcugggccagggcgagcugagccugggcgcccugcugcugcuguaa

SEQ ID NO: 14453 - RNA, 1095 nt, Artificial Sequence
  C2CD4B__Homo_sapiens__NP_001007596
augagacugcuggagaagcugugcagcagcgccgccggcagcagcgcccccaagcccgccuucgccaaggugcugacccccaacagaauccccgaguucugcaucccccccagacugcccgcccccugcacccuggagagccccaucagagccgccgccgugcccagaagaugcgccgccgagagcgaccuguggcccagagccgccgacgaggacgccggcagaaccgacugggaccccagaagccaggccgcccugagccugccccaccugcccagagugagaaccaccuacggcuucugcgcccugcuggagagcccccacaccagaagaaaggagagccugcugcugggcggcccccccgcccccagacccagagcccacagcugcggcggcggcggcggccccgacgccccccugggcacccugugcggccccagaggccccggccccgccacccccgccgcccccggcggccccagacugccccaggacgcccuggccgccggccccagaagaugcagacugcugagagugcccgacggccugcugagcagagcccugagagccggcagaagcagaagacuggccagagugagaagcgugagcagcggcaacgaggacgaggagagaagagccggcagcgagagccccgccagagcccccagcagcagcccccugagcagcagagccccccugcccgagagacuggaggccaagggcaccguggcccugggcagagccggcgacgcccugagacuggccgccgaguacugccccggcaccagaagacugagacugagacugcugagagccgagagccuguucggcggcgcccccggccccagagccgugagaugcagacugagccuggugcugagaccccccggcaccgccagauggcagugcagcgccguggugggcagaagcagaaaggccagcuucgaccaggacuucugcuucgacggccugagcgaggacgaggugagaagacuggccgugagagugaaggccagagacgagggcagaggcagagacagaggcagacugcugggccagggcgagcugagccugggcgcccugcugcugcuguaa

SEQ ID NO: 14454 - RNA, 3165 nt, Artificial Sequence
  C2CD5__Homo_sapiens__NP_001273104
augcccggcaagcugaaggugaagaucguggccggcagacaccugcccgugauggacagagccagcgaccugaccgacgccuucguggaggugaaguucggcaacaccaccuucaagaccgacguguaccugaagagccugaacccccaguggaacagcgagugguucaaguucgagguggacgacgaggaccugcaggacgagccccugcagaucaccgugcuggaccacgacaccuacagcgccaacgacgccaucggcaagguguacaucgacaucgacccccugcuguacagcgaggccgccaccgugaucagcggcugguuccccaucuacgacaccauccacggcaucagaggcgagaucaacgugguggugaagguggaccuguucaacgaccugaacagauucagacagagcagcugcggcgugaaguucuucugcaccaccagcauccccaagugcuacagagccgugaucauccacggcuucguggaggagcugguggugaacgaggaccccgaguaccaguggaucgacagaaucagaacccccagagccagcaacgaggccagacagagacugaucagccugaugagcggcgagcugcagagaaagaucggccugaaggugcuggagaugagaggcaacgccguggugggcuaccugcagugcuucgaccuggagggcgagagcggccugguggugagagccaucggcaccgccugcacccuggacaagcugagcagccccgccgccuuccugcccgccugcaacagccccagcaaggagaugaaggagagcccccuggugcacccccccagccacggcugcagaagcacccacaacagccccauccacaccgccaccggcagcagacugacccagaacuucagcgugagcgugcccacccugaucuacaccggcaugggcagcggcagcgccggcaaggagggcggccccuucaaggcccugcugagacagcagacccagagcgcccuggagcagagagaguuccccuucuucacccugaccgccuucccccccggcuuccuggugcacgugggcggcguggugagcgccagaagcgugaagcugcuggacagaauccacaaccccgccuucgugggcaucaugggcaacaccagaagcuacaagcugcuggacuggaacagcuucaacagcgacgagcccgagaccagagacgccuggugggccgagaucagacaggagaucaagagccacgccaaggcccugggcugccacgccguggugggcuacagcgagagcaccagcaucugcgaggaggugugcauccugagcgccagcggcaccgccgccgugcugaaccccagauuccugcaggacggcaccguggagggcugccuggagcagagacuggaggagaaccugcccaccagaugcggcuucugccacauccccuacgacgagcugaacaugcccuuccccgcccaccugaccuacugcuacaacugcagaaagcagaaggugcccgacgugcuguucaccaccaucgaccugcccaccgacgccaccgugaucggcaagggcugccugauccaggccagacugugcagacugaagaagaaggcccaggccgaggccaacgccaccgccaucagcaaccugcugcccuucauggaguacgaggugcacacccagcugaugaacaagcugaagcugaagggcaugaacgcccuguucggccugagaauccagaucaccgugggcgagaacaugcugaugggccuggccagcgccaccggcguguaccuggccgcccugcccacccccggcggcauccagaucgccggcaagacccccaacgacggcagcuacgagcagcacaucagccacaugcagaagaagaucaacgacaccaucgccaagaacaaggagcuguacgagaucaacccccccgagaucagcgaggagaucaucggcagccccauccccgagcccagacagagaagcagacugcugagaagccagagcgagagcagcgacgaggugaccgagcuggaccugagccacggcaagaaggacgccuucgugcuggagaucgacgacaccgacgccauggaggacgugcacagccugcugaccgacgugcccccccccagcggcuucuacagcugcaacaccgagaucaugcccggcaucaacaacuggaccagcgagauccagauguucaccagcgugagagugaucagacugagcagccugaaccugaccaaccaggcccugaacaagaacuucaacgaccugugcgagaaccugcugaagagccuguacuucaagcugagaagcaugauccccugcugccugugccacgugaacuucaccgugagccugcccgaggacgagcugauccaggugaccgugaccgccguggccaucaccuucgacaagaaccaggcccugcagaccaccaagacccccguggagaagagccugcagagagccagcaccgacaacgaggagcugcugcaguucccccuggagcugugcagcgacagccugcccagccaccccuucccccccgccaaggagcaccuggagagcgccagcagcaacagcggcauccccgccgcccagagagacagaugcagcagcuggaucgagcugaucaagcugaaggcccagaccaucagaagaggcagcaucaagaccaccaugaccguggagaaggccagccccgugggcgacggcaacuucagaaacagaagcgccccccccugcgccaacagcaccgugggcguggugaagaugaccccccugagcuucauccccggcgccaagaucaccaaguaccugggcaucaucaacauguucuucaucagagagaccaccagccugagagaggagggcggcgugagcggcuuccugcacgccuucaucgccgagguguucgccauggugagagcccacguggccgcccugggcggcaacgccguggugagcuacaucaugaagcagugcguguucauggagaaccccaacaagaaccaggcccagugccugaucaacgugagcggcgacgccgugguguucgugagagagagcgaccuggagguggugagcagccagcagcccaccaccaacugccagagcagcugcaccgagggcgaggugaccaccuaa

SEQ ID NO: 14455 - RNA, 2259 nt, Artificial Sequence
  C2__Homo_sapiens__NP_000054
augggcccccugauggugcuguucugccugcuguuccuguaccccggccuggccgacagcgcccccagcugcccccagaacgugaacaucagcggcggcaccuucacccugagccacggcugggcccccggcagccugcugaccuacagcugcccccagggccuguaccccagccccgccagcagacugugcaagagcagcggccaguggcagacccccggcgccaccagaagccugagcaaggccgugugcaagcccgugagaugccccgcccccgugagcuucgagaacggcaucuacacccccagacugggcagcuaccccgugggcggcaacgugagcuucgagugcgaggacggcuucauccugagaggcagccccgugagacagugcagacccaacggcaugugggacggcgagaccgccgugugcgacaacggcgccggccacugccccaaccccggcaucagccugggcgccgugagaaccggcuucagauucggccacggcgacaaggugagauacagaugcagcagcaaccuggugcugaccggcagcagcgagagagagugccagggcaacggcguguggagcggcaccgagcccaucugcagacagcccuacagcuacgacuuccccgaggacguggcccccgcccugggcaccagcuucagccacaugcugggcgccaccaaccccacccagaagaccaaggagagccugggcagaaagauccagauccagagaagcggccaccugaaccuguaccugcugcuggacugcagccagagcgugagcgagaacgacuuccugaucuucaaggagagcgccagccugaugguggacagaaucuucagcuucgagaucaacgugagcguggccaucaucaccuucgccagcgagcccaaggugcugaugagcgugcugaacgacaacagcagagacaugaccgaggugaucagcagccuggagaacgccaacuacaaggaccacgagaacggcaccggcaccaacaccuacgccgcccugaacagcguguaccugaugaugaacaaccagaugagacugcugggcauggagaccauggccuggcaggagaucagacacgccaucauccugcugaccgacggcaagagcaacaugggcggcagccccaagaccgccguggaccacaucagagagauccugaacaucaaccagaagagaaacgacuaccuggacaucuacgccaucggcgugggcaagcuggacguggacuggagagagcugaacgagcugggcagcaagaaggacggcgagagacacgccuucauccugcaggacaccaaggcccugcaccagguguucgagcacaugcuggacgugagcaagcugaccgacaccaucugcggcgugggcaacaugagcgccaacgccagcgaccaggagagaacccccuggcacgugaccaucaagcccaagagccaggagaccugcagaggcgcccugaucagcgaccagugggugcugaccgccgcccacugcuucagagacggcaacgaccacagccuguggagagugaacgugggcgaccccaagagccaguggggcaaggaguuccugaucgagaaggccgugaucagccccggcuucgacguguucgccaagaagaaccagggcauccuggaguucuacggcgacgacaucgcccugcugaagcuggcccagaaggugaagaugagcacccacgccagacccaucugccugcccugcaccauggaggccaaccuggcccugagaagaccccagggcagcaccugcagagaccacgagaacgagcugcugaacaagcagagcgugcccgcccacuucguggcccugaacggcagcaagcugaacaucaaccugaagaugggcguggaguggaccagcugcgccgagguggugagccaggagaagaccauguuccccaaccugaccgacgugagagagguggugaccgaccaguuccugugcagcggcacccaggaggacgagagccccugcaagggcgagagcggcggcgccguguuccuggagagaagauucagauucuuccaggugggccuggugagcuggggccuguacaaccccugccugggcagcgccgacaagaacagcagaaagagagcccccagaagcaaggugcccccccccagagacuuccacaucaaccuguucagaaugcagcccuggcugagacagcaccugggcgacgugcugaacuuccugccccuguaa

SEQ ID NO: 14456 - RNA, 5955 nt, Artificial Sequence
  C2orf16__Homo_sapiens__NP_115642
auggagcugacccccggcgcccagcagcagggcaucaacuaccaggagcugaccagcggcuggcaggacgugaagagcaugaugcuggugcccgagcccaccagaaaguuccccagcggcccccugcugaccagcgugagauucagcaaccugagccccgagagccagcagcaggacgugaagagccuggaguucaccguggagcccaagcugcagagcgugaagcacgugaagcugagcagcgugagccugcagcagaccaucaagagcguggagcuggcccccggcagccugccccagagagugaaguacggcgagcagacccccagaaccaacuaccagaucauggagagcagcgagcugauccccagacccggccaccaguucgccaaguacgccgagaugaucccccagcccaaguaccagauccccaagagcgccaaccugaucagcauccccaucuaccacgccaccgagagcagcgagauggcccagggccuggccuacaagggcaucgacaccguggagaagagcgugggccugacccccaagcugaccggcagagccaaggagagccugggcaugcugcugcagcccgaccugcaggugcccaaguucguggaccugacccccauggugagagaccagggcagcaaguuccugggccugacccccgagaagagcuaccagauccuggagaccauggagcugcugagccagagcagacccagagugaaggacgugggcgagcuguacaugaagccccugcagcagaccguggaguacgagggcaucacccccgagcugaagcacuacuucaccgaggccaugggccugaccgccgaggccagaauccaggccaacgaguucuucggcaugacccccaagcccaccagccaggccaccggcuucgccgagagaagccccagacugugcccccagaaccuggagugcguggaggugaucagcgagaagagacugcagggcgaggagagcguggugcugauccccaagagccugcaccacgugcccgacagcgccagcggcaugacccccggccugggccacagagugcccgagagcguggagcugaccagcaagagcggcgugcagguggagaagacccugcagcugacccccaagccccagcaccacgugggcagccccggcaucaucagcggccugggccaccaggugcccgagagcgugaaccugaccugcaagcaguggcugcagauggaggagagccuggaggugccccugaagcagaccagccaggugaucggccacgaggagagcguggagcugaccagcgaggccagacagcacagagaggugagcaugggccugaccaagagcaagaaccagagcaugaagagccccggcaccacccccggcccccugggcagaaucguggaguucaugagaaucagccccgagccccuggaccaggugaccgagagcgccagaacccagcugcagguggcccagagcgaggaggugauccugaucgacgugcccaagguggugcagagcgugaaggugacccccggcccccccuuccagaucgugaagagcgugaccauccccagacccaccccccagaugguggaguacaucgagcugacccccaagcugcaguacgugagacccagcgagcaccacaccggccccugccugcaggacgugaagagcaccaagcugaucaccaagcccaagcaccagauccuggagaccguggagcugaccggcuuccagaucgugaagaccaugcugauccccggccccagccugcagaucgugaagagcgaggagcuggcccccggccccaucccccaggugguggagcccaucggcguggcccuggagagcggcaucgaggccaucaacugcguggaccugcugcccagaccccaccugcaggagcugaucgugcccgccgagcugacccccagccccugcacccaggugaagagcgccgagcugaccagcccccagaccagccccuucgaggagcacaccauccugacccacaagcagggccugcaggccgugaagagcaccgugaucaagaccgagccccccaaggugauggagaccgaggaccugaaccugggccacgugugccagaacagagacugccagaagcugaccagcgaggagcugcaggugggcaccgacuucagcagauuccugcagagcagcagcaccacccugaucagcagcagcgugagaaccgccagcgagcugggcggccugugggacagcggcauccaggaggugagcagagcccuggacaucaagaaccccggcaccgacauccugcagcccgaggagaccuacaucgaccccaccaugauccagagccugaccuucccccuggcccugcacaaccagagcagcgacaagaccgccaacaucguggagaaccccugccccgagauccugggcguggacgugaucagcaaggagaccaccaagagaaagcagauggaggagcuggagaacagccugcagagacaccugccccagagcuggagaagcagaagcagaaccuuccaggccgagagcggcgugcagaagggccugaucaagagcuuccccggcagacagcacaacgugugggagagccacgccuggagacagagacugcccagaaaguaccugagcaccaugcugaugcugggcaacauccugggcaccaccauggagagaaagcugugcagccagaccagccuggccgagagagccaccgccgacaccugccagagcauccagaaccuguucggcauccccgccgagcugauggagcccagccagagccugcccgagaagggccccgugaccaucagccagcccagcguggugaagaacuacauccagagacacaccuucuaccacggccacaagaagagaauggcccugagaaucuggaccagaggcagcaccagcagcaucauccagcaguacagcggcaccagagugagaaucaagaagaccaacagcaccuucaacggcaucagccaggaggugauccagcacaugcccgugagcugcgccggcggccagcugcccgugcuggugaagagcgagagcagccugagcaucuucuacgacagagaggaccuggugcccauggaggagagcgaggacagccagagcgacagccagaccagaaucagcgagagccagcacagccugaagcccaacuaccugagccaggccaagaccgacuucagcgagcaguuccagcugcuggaggaccugcagcugaagaucgccgccaagcugcugagaagccagaucccccccgacgugccccccccccuggccagcggccuggugcugaaguaccccaucugccugcagugcggcagaugcagcggccugaacugccaccacaagcugcagaccaccagcggccccuaccugcugaucuacccccagcugcaccuggugagaacccccgagggccacggcgaggugagacugcaccugggcuucagacugagaaucggcaagagaagccagaucagcaaguacagagagagagacagacccgugaucagaagaagccccaucagccccagccagagaaaggccaagaucuacacccaggccagcaagagccccaccagcaccaucgaccugcagagcggccccagccagagccccgcccccgugcagguguacaucagaagaggccagagaagcagacccgaccugguggagaagaccaagaccagagcccccggccacuacgaguucacccaggugcacaaccugcccgagagcgacagcgagagcacccagaacgagaagagagccaaggugagaaccaagaagaccagcgacagcaaguaccccaugaagagaaucaccaagagacugagaaagcacagaaaguucuacaccaacagcagaaccaccaucgagagccccagcagagagcuggccgcccaccugagaagaaagagaaucggcgccacccagaccagcaccgccagccugaagagacagcccaagaagcccagccagcccaaguucaugcagcugcuguuccagagccugaagagagccuuccagaccgcccacagagugaucgccagcgugggcagaaagcccguggacggcaccagacccgacaaccugugggccagcaagaacuacuaccccaagcagaacgccagagacuacugccugcccagcagcaucaagagagacaagagaagcgccgacaagcugacccccgccggcagcaccaucaagcaggaggacauccuguggggcggcaccgugcagugcagaagcgcccagcagcccagaagagccuacagcuuccagcccagaccccugagacugcccaagcccaccgacagccagagcggcaucgccuuccagaccgccagcgugggccagccccugagaaccgugcagaaggacagcagcagcagaagcaagaagaacuucuacagaaacgagaccagcagccaggagagcaagaaccugagcacccccggcaccagagugcaggccagaggcagaauccugcccggcagccccgugaagagaaccuggcacagacaccugaaggacaagcugacccacaaggagcacaaccaccccagcuucuacagagagagaacccccagaggccccagcgagagaaccagacacaaccccagcuggagaaaccacagaagccccagcgagagaagccagagaagcagccuggagagaagacaccacagccccagccagagaagccacugcagccccagcagaaagaaccacagcagccccagcgagagaagcuggagaagccccagccagagaaaccacugcagcccccccgagagaagcugccacagccugagcgagagaggccugcacagccccagccagagaagccacagaggccccagccagagaagacaccacagccccagcgagagaagccacagaagccccagcgagagaagccacagaagcagcagcgagagaagacacagaagccccagccagagaagccacagaggccccagcgagagaagccacugcagccccagcgagagaagacacagaagccccagccagagaagccacagaggccccagcgagagaagacaccacagccccagcaagagaagccacagaagccccgccagaagaagccacagaagccccagcgagagaagccaccacagccccagcgagagaagccaccacagccccagcgagagaagacaccacagccccagcgagagaagccacugcagccccagcgagagaagccacugcagccccagcgagagaagacacagaagccccagcgagagaagacaccacagccccagcgagaagagccaccacagccccagcgagagaagccaccacagccccagcgagagaagaagacacagcccccuggagagaagcagacacagccugcuggagagaagccacagaagccccagcgagagaagaagccacagaagcuucgagagaagccacagaagaaucagcgagagaagccacagccccagcgagaagagccaccugagcccccuggagagaagcagaugcagccccagcgagagaagaggccacagcagcagcggcaagaccugccacagccccagcgagagaagccacagaagccccagcggcaugagacagggcagaaccagcgagagaagccacagaagcagcugcgagagaaccagacacagccccagcgagaugagacccggcagacccagcggcagaaaccacugcagccccagcgagagaagcagaagaagcccccugaaggagggccugaaguacagcuuccccggcgagagacccagccacagccugagcagagacuucaagaaccagaccacccugcugggcaccacccacaagaaccccaaggccggccagguguggagacccgaggccaccagauaa

SEQ ID NO: 14457 - RNA, 447 nt, Artificial Sequence
  C2orf40__Homo_sapiens__NP_115787
auggccgccagccccgccagacccgccgugcuggcccugaccggccuggcccugcugcugcugcugugcuggggccccggcggcaucagcggcaacaagcugaagcugaugcugcagaagagagaggcccccgugcccaccaagaccaagguggccguggacgagaacaaggccaaggaguuccugggcagccugaagagacagaagagacagcugugggacagaaccagacccgaggugcagcagugguaccagcaguuccuguacaugggcuucgacgaggccaaguucgaggacgacaucaccuacuggcugaacagagacagaaacggccacgaguacuacggcgacuacuaccagagacacuacgacgaggacagcgccaucggccccagaagccccuacggcuucagacacggcgccagcgugaacuacgacgacuacuaa

SEQ ID NO: 14458 - RNA, 834 nt, Artificial Sequence
  C2orf43__Homo_sapiens__NP_001269649
auggacagcgagcugaaggaggagauccccgugcacgaggaguucauccugugcggcggcgccgagacccaggugcugaagugcggccccuggaccgaccuguuccacgaccagagcgugaagagacccaagcugcugaucuucaucauccccgacagcaacgcccaggagaucaaggacaucuacggccugaacggccagaucgagcacaagcuggccuuccugagaacccacgugcccaaggacaugaagcuggugcugaucggccacagcaucggcagcuacuucacccugcagaugcugaagagagugcccgagcugcccgugaucagagccuuccugcuguuccccaccaucgagagaaugagcgagagccccaacggcagaaucgccaccccccugcugugcugguucagauacgugcuguacgugaccggcuaccugcugcugaagcccugccccgagaccaucaagagccugcugaucagaagaggccugcaggugaugaaccuggagaacgaguucagcccccugaacauccuggagcccuucugccuggccaacgccgccuaccugggcggccaggagaugauggagguggugaagagagacgacgagaccaucaaggagcaccugugcaagcugaccuucuacuacggcaccaucgaccccuggugccccaaggaguacuacgaggacaucaagaaggacuuccccgagggcgacaucagacugugcgagaagaacaucccccacgccuucaucacccacuucaaccaggagauggccgacaugaucgccgacagccugaaggacgaccugagcaagauguaa

SEQ ID NO: 14459 - RNA, 876 nt, Artificial Sequence
  C2orf47__Homo_sapiens__NP_078796
auggcccuggccgccagacugcugccccaguuccugcacagcagaagccugcccugcggcgccgugagacugagaacccccgccguggccgaggugagacugcccagcgccacccugugcuacuucugcagaugcagacugggccugggcgccgcccuguuccccagaagcgccagagcccuggccgccagcgcccugcccgcccagggcagcagauggcccgugcugagcagccccggccugcccgccgccuucgccagcuuccccgccugcccccagagaagcuacagcaccgaggagaagccccagcagcaccagaagaccaagaugaucgugcugggcuucagcaaccccaucaacugggugagaaccagaaucaaggccuuccugaucugggccuacuucgacaaggaguucagcaucaccgaguucagcgagggcgccaagcaggccuucgcccacgugagcaagcugcugagccagugcaaguucgaccugcuggaggagcugguggccaaggaggugcugcacgcccugaaggagaaggugaccagccugcccgacaaccacaagaacgcccuggccgccaacaucgacgagaucguguucaccagcaccggcgacaucagcaucuacuacgacgagaagggcagaaaguucgugaacauccugaugugcuucugguaccugaccagcgccaacauccccagcgagacccugagaggcgccagcguguuccaggugaagcugggcaaccagaacguggagaccaagcagcugcugagcgccagcuacgaguuccagagagaguucacccagggcgugaagcccgacuggaccaucgccagaaucgagcacagcaagcugcuggaguaa

SEQ ID NO: 14460 - RNA, 1188 nt, Artificial Sequence
  C2orf57__Homo_sapiens__NP_689827
auggcccugcccggcuacccccugggcaacguggacgacagcagaagcaaggacagccccgccggcgagccccagggccaggugccccugaccgccgacgugcuggccgugagcagcagcguggccagcaccgacuggcaggacaucgaccaggccagcuucaagaccgccacccccagagccaucagcaccagcggcgacaaggacaagagcgccguggugcccgagcacggccagaagacccccagaaagaucaccccccugcugcccagccagaaccccagcccccugcaggugagcaugagccugcagaaccccgccugggacagacaggugcaggacgccagaaccagccagagccuggugguguuccccagccaccugcugggcaaggacaagaugagccagauggccagcgugcccgagagagagcccgagagcgcccccagcgcccccagcgccgagcugcagagcacccagcacauggaggcccagcccguggagagcgacgccgaccacgugaccgccggcgccaacggccagcacggcccccaggccgccagcaccaccaagagcgccgaggagaaggccgagcaccccaaggccccccaccccgaggccgaggcccugcccagcgacgagagccccguggccaugggcgccaacgugguggacagccugggcgaccugcagaccugguucuucccccccccccccgccggcagcgugagccccagccccggcccccacgagguggcccugggcagaagaccccuggacagcagccuguacaccgccagcgaggagaacagcuacaugagaagcaugaccagccugcuggacagaggcgagggcagcaucagcagccuggccgacauccugguguggagcgagaccaccaugggcauggccaucgccaccggcuuccuggacagcggccacagcaccguggccgaccugcugcacagcagcggccccagccugagaagcgugcccagccuggugggcagcgugagcagcgccuucagcagcggccuggugagcggcaccagcagcgcccugagaaccaucaccagagugcuggagaccguggagcagagaaccguggagggcaucagaagcgccaugagauaccugaccagccaccugacccccagacaggcccaggccgaccccaacuacgacuaa

SEQ ID NO: 14461 - RNA, 747 nt, Artificial Sequence
  C2orf61__Homo_sapiens__NP_001157033
auggaccagcccgccguggccaccgccagcaccagcaucagagaggaccuggugggcggcgagagcuucaucaccgccagcaagcccgcccagaagaccagcagcuucgagagagagggcugguggagaaucgcccugaccgacacccccauccccggcaccuaccaccugaagaccuucaucgaggagagccugcugaaccccgugaucgccaccuacaacuucaagaacgagggcagaaagaagcccccccuggugcagagaaacaaccccgugcugaacgaccugccccaguacaugccccccgacuuccuggaccugcugaagaagcagguggccaccuacagcuucaaggacaagcccagacccagccccagcacccugguggacaaggaccagagccugcagcugagccccggccaguacaacgugcugcccgcccccgugcccaaguacgccagcagaagcugcguguucagaagcaccgugcagagauuccccaccaccuacuucaucccccacgagggccccggccccggccacuacaacgugaagaugccccccaccagcagcgugaccagcugcuuccagagcagagugcccagauuccugcccagcugcagcaagacccccggccccggcgccuacaccacccugagacaguuccccaagcagagccccaccaucgccaagaugggccaggagcacagccuguucuucaacaacaacaacuggcugcugaaguaa

SEQ ID NO: 14462 - RNA, 1449 nt, Artificial Sequence
  C3AR1__Homo_sapiens__NP_004045
auggccagcuucagcgccgagaccaacagcaccgaccugcugagccagcccuggaacgagccccccgugauccugagcauggugauccugagccugaccuuccugcugggccugcccggcaacggccuggugcuguggguggccggccugaagaugcagagaaccgugaacaccaucugguuccugcaccugacccuggccgaccugcugugcugccugagccugcccuucagccuggcccaccuggcccugcagggccaguggcccuacggcagauuccugugcaagcugauccccagcaucaucgugcugaacauguucgccagcguguuccugcugaccgccaucagccuggacagaugccuggugguguucaagcccaucuggugccagaaccacagaaacgugggcauggccugcagcaucugcggcugcaucugggugguggccuucgugaugugcauccccguguucguguacagagagaucuucaccaccgacaaccacaacagaugcggcuacaaguucggccugagcagcagccuggacuaccccgacuucuacggcgacccccuggagaacagaagccuggagaacaucgugcagccccccggcgagaugaacgacagacuggaccccagcagcuuccagaccaacgaccaccccuggaccgugcccaccguguuccagccccagaccuuccagagacccagcgccgacagccugcccagaggcagcgccagacugaccagccagaaccuguacagcaacguguucaagcccgccgacguggugagccccaagauccccagcggcuuccccaucgaggaccacgagaccagcccccuggacaacagcgacgccuuccugagcacccaccugaagcuguuccccagcgccagcagcaacagcuucuacgagagcgagcugccccagggcuuccaggacuacuacaaccugggccaguucaccgacgacgaccaggugcccaccccccugguggccaucaccaucaccagacugguggugggcuuccugcugcccagcgugaucaugaucgccugcuacagcuucaucguguucagaaugcagagaggcagauucgccaagagccagagcaagaccuucagaguggccgugguggugguggccguguuccuggugugcuggacccccuaccacaucuucggcgugcugagccugcugaccgaccccgagaccccccugggcaagacccugaugagcugggaccacgugugcaucgcccuggccagcgccaacagcugcuucaaccccuuccuguacgcccugcugggcaaggacuucagaaagaaggccagacagagcauccagggcauccuggaggccgccuucagcgaggagcugaccagaagcacccacugccccagcaacaacgugaucagcgagagaaacagcaccaccguguaa

SEQ ID NO: 14463 - RNA, 4992 nt, Artificial Sequence
  C3__Homo_sapiens__NP_000055
augggccccaccagcggccccagccugcugcugcugcugcugacccaccugccccuggcccugggcagccccauguacagcaucaucacccccaacauccugagacuggagagcgaggagaccauggugcuggaggcccacgacgcccagggcgacgugcccgugaccgugaccgugcacgacuuccccggcaagaagcuggugcugagcagcgagaagaccgugcugacccccgccaccaaccacaugggcaacgugaccuucaccauccccgccaacagagaguucaagagcgagaagggcagaaacaaguucgugaccgugcaggccaccuucggcacccaggugguggagaagguggugcuggugagccugcagagcggcuaccuguucauccagaccgacaagaccaucuacacccccggcagcaccgugcuguacagaaucuucaccgugaaccacaagcugcugcccgugggcagaaccgugauggugaacaucgagaaccccgagggcauccccgugaagcaggacagccugagcagccagaaccagcugggcgugcugccccugagcugggacauccccgagcuggugaacaugggccaguggaagaucagagccuacuacgagaacagcccccagcagguguucagcaccgaguucgaggugaaggaguacgugcugcccagcuucgaggugaucguggagcccaccgagaaguucuacuacaucuacaacgagaagggccuggaggugaccaucaccgccagauuccuguacggcaagaagguggagggcaccgccuucgugaucuucggcauccaggacggcgagcagagaaucagccugcccgagagccugaagagaauccccaucgaggacggcagcggcgagguggugcugagcagaaaggugcugcuggacggcgugcagaaccccagagccgaggaccuggugggcaagagccuguacgugagcgccaccgugauccugcacagcggcagcgacauggugcaggccgagagaagcggcauccccaucgugaccagccccuaccagauccacuucaccaagacccccaaguacuucaagcccggcaugcccuucgaccugaugguguucgugaccaaccccgacggcagccccgccuacagagugcccguggccgugcagggcgaggacaccgugcagagccugacccagggcgacggcguggccaagcugagcaucaacacccaccccagccagaagccccugagcaucaccgugagaaccaagaagcaggagcugagcgaggccgagcaggccaccagaaccaugcaggcccugcccuacagcaccgugggcaacagcaacaacuaccugcaccugagcgugcugagaaccgagcugagacccggcgagacccugaacgugaacuuccugcugagaauggacagagcccacgaggccaagaucagauacuacaccuaccugaucaugaacaagggcagacugcugaaggccggcagacaggugagagagcccggccaggaccugguggugcugccccugagcaucaccaccgacuucauccccagcuucagacugguggccuacuacacccugaucggcgccagcggccagagagaggugguggccgacagcguguggguggacgugaaggacagcugcgugggcagccugguggugaagagcggccagagcgaggacagacagcccgugcccggccagcagaugacccugaagaucgagggcgaccacggcgccagaguggugcugguggccguggacaagggcguguucgugcugaacaagaagaacaagcugacccagagcaagaucugggacgugguggagaaggccgacaucggcugcacccccggcagcggcaaggacuacgccggcguguucagcgacgccggccugaccuucaccagcagcagcggccagcagaccgcccagagagccgagcugcagugcccccagcccgccgccagaagaagaagaagcgugcagcugaccgagaagagaauggacaaggugggcaaguaccccaaggagcugagaaagugcugcgaggacggcaugagagagaaccccaugagauucagcugccagagaagaaccagauucaucagccugggcgaggccugcaagaagguguuccuggacugcugcaacuacaucaccgagcugagaagacagcacgccagagccagccaccugggccuggccagaagcaaccuggacgaggacaucaucgccgaggagaacaucgugagcagaagcgaguuccccgagagcuggcuguggaacguggaggaccugaaggagccccccaagaacggcaucagcaccaagcugaugaacaucuuccugaaggacagcaucaccaccugggagauccuggccgugagcaugagcgacaagaagggcaucugcguggccgaccccuucgaggugaccgugaugcaggacuucuucaucgaccugagacugcccuacagcguggugagaaacgagcagguggagaucagagccgugcuguacaacuacagacagaaccaggagcugaaggugagaguggagcugcugcacaaccccgccuucugcagccuggccaccaccaagagaagacaccagcagaccgugaccaucccccccaagagcagccugagcgugcccuacgugaucgugccccugaagaccggccugcaggagguggaggugaaggccgccguguaccaccacuucaucagcgacggcgugagaaagagccugaagguggugcccgagggcaucagaaugaacaagaccguggccgugagaacccuggaccccgagagacugggcagagagggcgugcagaaggaggacaucccccccgccgaccugagcgaccaggugcccgacaccgagagcgagaccagaauccugcugcagggcacccccguggcccagaugaccgaggacgccguggacgccgagagacugaagcaccugaucgugacccccagcggcugcggcgagcagaacaugaucggcaugacccccaccgugaucgccgugcacuaccuggacgagaccgagcagugggagaaguucggccuggagaagagacagggcgcccuggagcugaucaagaagggcuacacccagcagcuggccuucagacagcccagcagcgccuucgccgccuucgugaagagagcccccagcaccuggcugaccgccuacguggugaagguguucagccuggccgugaaccugaucgccaucgacagccaggugcugugcggcgccgugaaguggcugauccuggagaagcagaagcccgacggcguguuccaggaggacgcccccgugauccaccaggagaugaucggcggccugagaaacaacaacgagaaggacauggcccugaccgccuucgugcugaucagccugcaggaggccaaggacaucugcgaggagcaggugaacagccugcccggcagcaucaccaaggccggcgacuuccuggaggccaacuacaugaaccugcagagaagcuacaccguggccaucgccggcuacgcccuggcccagaugggcagacugaagggcccccugcugaacaaguuccugaccaccgccaaggacaagaacagaugggaggaccccggcaagcagcuguacaacguggaggccaccagcuacgcccugcuggcccugcugcagcugaaggacuucgacuucgugccccccguggugagauggcugaacgagcagagauacuacggcggcggcuacggcagcacccaggccaccuucaugguguuccaggcccuggcccaguaccagaaggacgcccccgaccaccaggagcugaaccuggacgugagccugcagcugcccagcagaagcagcaagaucacccacagaauccacugggagagcgccagccugcugagaagcgaggagaccaaggagaacgagggcuucaccgugaccgccgagggcaagggccagggcacccugagcguggugaccauguaccacgccaaggccaaggaccagcugaccugcaacaaguucgaccugaaggugaccaucaagcccgcccccgagaccgagaagagaccccaggacgccaagaacaccaugauccuggagaucugcaccagauacagaggcgaccaggacgccaccaugagcauccuggacaucagcaugaugaccggcuucgcccccgacaccgacgaccugaagcagcuggccaacggcguggacagauacaucagcaaguacgagcuggacaaggccuucagcgacagaaacacccugaucaucuaccuggacaaggugagccacagcgaggacgacugccuggccuucaaggugcaccaguacuucaacguggagcugauccagcccggcgccgugaagguguacgccuacuacaaccuggaggagagcugcaccagauucuaccaccccgagaaggaggacggcaagcugaacaagcugugcagagacgagcugugcagaugcgccgaggagaacugcuucauccagaagagcgacgacaaggugacccuggaggagagacuggacaaggccugcgagcccggcguggacuacguguacaagaccagacuggugaaggugcagcugagcaacgacuucgacgaguacaucauggccaucgagcagaccaucaagagcggcagcgacgaggugcaggugggccagcagagaaccuucaucagccccaucaagugcagagaggcccugaagcuggaggagaagaagcacuaccugauguggggccugagcagcgacuucuggggcgagaagcccaaccugagcuacaucaucggcaaggacaccuggguggagcacuggcccgaggaggacgagugccaggacgaggagaaccagaagcagugccaggaccugggcgccuucaccgagagcauggugguguucggcugccccaacuaa

SEQ ID NO: 14464 - RNA, 1704 nt, Artificial Sequence
  C3orf17__Homo_sapiens__NP_056227
augauggccgccgugccccccggccuggagcccuggaacagagugagaauccccaaggccggcaacagaagcgccgugaccgugcagaaccccggcgccgcccuggaccugugcaucgccgccgugaucaaggagugccaccuggugauccugagccugaagagccagacccuggacgccgagaccgacgugcugugcgccgugcuguacagcaaccacaacagaaugggcagacacaagccccaccuggcccugaagcagguggagcagugccugaagagacugaagaacaugaaccuggagggcagcauccaggaccuguucgagcuguucagcagcaacgagaaccagccccugaccaccaaggugugcguggugcccagccagcccgugguggagcuggugcugaugaaggugcugggcgccugcaagcugcugcugagacugcuggacugcugcugcaagaccuuccugcugaccgugaagcaccugggccugcaggaguucaucauccugaaccuggugauggugggccuggugagcagacugugggugcuguacaagggcgugcugaagagacugauccugcuguacgagccccuguucggccugcugcaggagguggccagaauccagcccaugcccuacuucaaggacuucaccuuccccagcgacaucaccgaguuccugggccagcccuacuucgaggccuucaagaagaagaugcccaucgccuucgccgccaagggcaucaacaagcugcugaacaagcuguuccugaucaacgagcagagccccagagccagcgaggagacccugcugggcaucagcaagaaggccaagcagaugaagaucaacgugcagaacaacguggaccugggccagcccgugaagaacaagagaguguucaaggaggagagcagcgaguucgacgugagagccuucugcaaccagcugaagcacaaggccacccaggagaccagcuucgacuucaagugcagccagagcagacugaagaccaccaaguacagcagccagaaggugaucggcaccccccacgccaagagcuucgugcagagauucagagaggccgagagcuucacccagcugagcgaggagauccagauggccgugguguggugcagaagcaagaagcugaaggcccaggccaucuuccugggcaacaagcugcugaagagcaacagacugaagcaccuggaggcccagggcaccagccugcccaagaagcuggagugcaucaagaccagcaucugcaaccaccugcugagaggcagcggcaucaagaccagcaagcaccaccugagacagagaagaagccagaacaaguuccugagaagacagagaaagccccagagaaagcugcagagcacccugcugagagagauccagcaguucagccagggcaccagaaagagcgccaccgacaccagcgccaaguggagacugagccacugcaccgugcacagaaccgaccuguaccccaacagcaagcagcugcugaacagcggcgugagcaugcccgugauccagaccaaggagaagaugauccacgagaaccugagaggcauccacgagaacgagaccgacagcuggaccgugaugcagaucaacaagaacagcaccagcggcaccaucaaggagaccgacgacaucgacgacaucuucgcccugaugggcguguaa

SEQ ID NO: 14465 - RNA, 489 nt, Artificial Sequence
  C3orf18__Homo_sapiens__NP_001165212
augaacagcagaaccgccagcgccagaggcugguucagcagcagaccccccaccagcgagagcgaccuggagcccgccaccgacggccccgccagcgagaccaccacccugagccccgaggccaccaccuucaacgacaccagaauccccgacgccgccggcggcaccgccggcgugggcaccaugcugcugagcuucggcaucaucaccgugaucggccuggccguggcccuggugcuguacaucagaaagaagaagagacuggagaagcugagacaccagcugaugcccauguacaacuucgaccccaccgaggagcaggacgagcuggagcaggagcugcuggagcacggcagagacgccgccagcgugcaggccgccaccagcgugcaggccaugcagggcaagaccacccugcccagccagggcccccugcagagacccagcagacugguguucaccgacguggccaacgccauccacgccuaa

SEQ ID NO: 14466 - RNA, 2349 nt, Artificial Sequence
  C3orf20__Homo_sapiens__NP_001171887
auggccagacaggugagaacccaccaggagacccugaacagauuccagcagcagagcauccaccugcugaccgagcugcugagacugaagaugaaggccaugguggagagcaugagcgugggcgccaacccccuggacaucaccagaagauucguggaggccagccagcugcugcaccugaacgccaaggagauggccuucaacugccugaucagcaccgccggcagaagcggcuacagcagcggccagcuguggaaggagagccuggccaacaugagcgccaucggcgugaacagccccuaccagcugaucuaccacagcagcaccgccugccugagcuucagccugagcgccggcaaggaggccaagaagaagaucggcaagagcagaaccaccgaggacgugagcaugcccccccugcacagaggcgugggcacccccgccaacagccuggaguucagcgaccccugccccgaggccagagagaagcugcaggagcugugcagacacaucgaggccgagagagccaccuggaagggcagaaacaucagcuaccccaugauccugagaaacuacaaggccaagaugcccagccaccugaugcuggccagaaagggcgacagccagacccccggccugcacuacccccccaccgccggcgcccagacccugagccccaccagccaccccagcagcgccaaccaccacuucagccagcacugccaggagggcaaggcccccaagaaggccuucaaguuccacuacaccuucuacgacggcagcagcuucguguacuaccccagcggcaacguggccgugugccagauccccaccugcugcagaggcagaaccaucaccugccuguucaacgacauccccggcuucagccugcuggcccuguucaacaccgagggccagggcugcgugcacuacaaccugaagaccagcugccccuacgugcugauccuggacgaggagggcggcaccaccaacgaccagcagggcuacguggugcacaaguggagcuggaccagcagaaccgagacccugcugagccuggaguacaaggugaacgaggagaugaagcugaaggugcugggccaggacagcaucaccgugaccuucaccagccugaacgagaccgugacccugaccgugagcgccaacaacugcccccacggcauggccuacgacaagagacugaacagaagaaucagcaacauggacgacaagguguacaagaugagcagagcccuggccgagaucaagaagagauuccagaagaccgugacccaguucaucaacagcauccugcuggccgccggccuguucaccaucgaguaccccaccaagaaggaggaggaggaguucgugagauucaagaugagaagcagaacccaccccgagagacugcccaagcugagccuguacagcggcgagagccugcugagaagccagagcggccaccuggagagcagcaucgccgagacccugaaggacgagcccgagagcgcccccgugagccccgugagaaagaccaccaagauccacaccaaggccaaggugaccagcagaggcaaggccagagagggcagaagccccaccagaugggccgcccugcccagcgacugcccccuggugcugagaaagcugaugcugaaggaggacaccagagccggcugcaagugccuggugaaggccccccuggugagcgacguggagcuggagagauuccugcuggcccccagagaccccagccaggugcugguguucggcaucaucagcagccagaacuacaccagcaccggccagcugcaguggcugcugaacacccuguacaaccaccagcagagaggcagaggcagccccugcauccagugcagauacgacagcuacagacugcugcaguacgaccuggacagcccccugcaggaggaccccccccugauggugaagaagaacagcguggugcagggcaugauccugauguucgccggcggcaagcugaucuucggcggcagagugcugaacggcuacggccugagcaagcagaaccugcugaagcagaucuucagaagccagcaggacuacaagaugggcuacuuccugcccgacgacuacaaguucagcgugcccaacagcgugcugagccuggaggacagcgagagcgugaagaaggccgagagcgaggacauccagggcagcagcagcagccuggcccuggaggacuacguggagaaggagcugagccuggaggccgagaagaccagagagcccgagguggagcugcacccccugagcagagacagcaagaucaccagcuggaagaagcaggccagcaagaaguaa

SEQ ID NO: 14467 - RNA, 513 nt, Artificial Sequence
  C3orf35__Homo_sapiens__NP_848029
augaagaccauggccaccagaaagagaugcaagcugagcagaaccggccccgaguucgagaacgugaucaagagacugcugugcgccagaaccuuccacaccagaaucggcggcgaccugacccacggcaucaucaacagaggcagaagagccaacgccgagcagaugggccugcagggcagcgcccagcacuucaacaucuucccccuggaccuguggacccagggcaagaagaccgaggugcagaagagagagggcaccgacagcauccccgccgccggcagaagcggcaccgccaaccagcccagcaucgccccccacagaugccuguucagcagaggcaucaccgcccuggacggccugaagagaggcagaggcugcaacggcgccgcccaccuggugagaggcgacgccuggaagaccaagcugggcgagcccugggugagcaucgcccuggcccuggccggccccggcgccauccugauccuggagcugagcugguuccugggcuaa

SEQ ID NO: 14468 - RNA, 729 nt, Artificial Sequence
  C3orf56__Homo_sapiens__NP_001007535
augggcaccggcgccagcgagaagcaggccgagcagaaggugagaagagccuucgaggccagcgaggaggcccacggcacccuggccgccagcacccccuggguggccaugggcagcgccuacggcagcugcaccugccugggcgcccagcccgugaccgaccuggcccuguggcccgugaucuacagcugcaugggcuucagcccccaggccuaccccgccuucugggccuaccccugggugcuguacggcggcuaccuguggaugggcuaccccccccccgccgcccuggugcccagcguguggcuguacuggagaggcgccagcagcuucgacccccugaucggcagccccuaccuggccgcccuggcccccaaccuguuccccuuccccaugaaguucccccccaccuacagccuggccagccccacccugggcggcgccaccagcagccacugcccccaggugggcugcuggacccccgccagcagcgcccccagagccgccguggagggccccagcagaggcgcccccuaccugaagaccugcaaggccccccccagcgagugggccagcagauucggcaucugggccccccugcccugcugcagcagcgagcugagaccccugccccccagccccaucgaggacagccagcuggaccccggcugcagcagaagcagcagcagaagccccugcagagccagaagaagacuguucgagugcuaa

SEQ ID NO: 14469 - RNA, 666 nt, Artificial Sequence
  C3orf58__Homo_sapiens__NP_001127942
augaagagcgagaacggcaccguggugggcagcuuccccagcgacgagggcuggcccuucgccaaguaccugggcgccugcggcagaaugguggccgugaacuacgugggcgaggagcuguggagcuacuucaacgcccccugggagaagagaguggaccuggccuggcagcugauggagaucgccgagcagcugaccaacaacgacuucgaguucgcccuguaccugcuggacgugagcuucgacaacuucgccgugggccccagagacggcaaggugaucaucguggacgccgagaacgugcugguggccgacaagagacugaucagacagaacaagcccgagaacugggacgugugguacgagagcaaguucgacgacugcgacaaggaggccugccugagcuucagcaaggagauccugugcgccagagccaccguggaccacaacuacuacgccgugugccagaaccugcugagcagacacgccaccuggagaggcaccagcggcggccugcugcacgacccccccagcgagaucgccaaggacggcagacuggaggcccugcuggacgagugcgccaaccccaagaagagauacggcagauuccaggccgccaaggagcugagagaguaccuggcccagcugagcaacaacgugagauaa

SEQ ID NO: 14470 - RNA, 1692 nt, Artificial Sequence
  C3orf67__Homo_sapiens__NP_940865
augaucaagagaaagaucuggugcaaccugugcaucgaccugguggccuucaccagcgagaucuucaagggcgccguguuccagagccuggacggcaucguggugagcgccaacugcaagcugagaaagaucuucacccugaagagcaagccccaggacaccgccgacaaggacgccguguacggcgugcccuucagcaccgacgagcccaccgacaucauccccagaagcugccagcugaugaccgacgugccccacgugacccagcugcugaacaugaccaagcugagacagaccgagaucaaguucggcggccacccccugagaagcgccgagagcgaccaguucaucaacagaggcaccagcaucaccagaaacagcaagaaccaggacgugugccacaucgccuucggcagcaaggugcugggcccccccccccugagcggcagaagaaacaacaugaagaucagcagcgagaccgugagaagcgugggcagcaagaacaacagaagcugccagcccagcaccguggagaagugcgugaacggcaccgagaugagcgcccugcugauccccgagagcgaggagcagggcaacaaggagaacauccaccagaucaagcagaccgugcccauccacgccgccaaccugcacaucaugcacccccaccccccccaggagcccagcgccgacaagaacaacaacagaagaagacugagacugaagagcaccagcagagagagaaccgagacccccagcggcagcagcagcggcaacaacagaaucgaggacaaggccagcaccauccugaccaccgugagccagcagggcgccgagcugcugaacagcggcacccugggcccccagagccccgaccagagcgacgaguggaucuuccccgagaacgccgaccacaucagcuaccuggccagcagcagacagagccugcugcugggcgacgacagcugcaaccccagccaccuguggcuggaggccagcaaggagagcgagcacgaccagcaggccgaggagagccagagcgugcccaaggacaucuucaccuucagcagcagacccagaagcgccccccacggcaagacccagaccaugagccccgaggagcugagcuucauccuggaccugaaggaggacaacagcgugaccagcagagacacccagagcgaggacgacuucuacggcggcgacagcagcgaggaggaguacgacuggagaaacuaccagcccagccagaugagcgagagcgagcugcagaugcuggccagccugagauggcagcagaacgaggagcuggaggacgccggcaccagccacggccugagcgccagccagguggacaacugcaacgugagcaucagcaccagcagcgacgacaccaccaccuggaacagcugccugcccccccccgugaaccagggcagacacuaccagaaggagaugaacccccccagccccagcaaccccagagacuggcugaacaugcugagcccccccaucgugccccccagccagcagcccgccgagcagagacccgacagcugcgagagccugagcgugcagggcgaggaggaccugagcguggaggaggacgaggaggugcugacccugcuguacgaccccugccugaacugcuacuucgacccccagaccggcaaguacuacgagcugguguaa

SEQ ID NO: 14471 - RNA, 303 nt, Artificial Sequence
  C3orf79__Homo_sapiens__NP_001094807
augcacgugugcgaccugcagaagcuggugagaauccagcuggccuucaccaccuuccccuggauguucagcugccaccugcugcccacccccgagcugagcagcaagagaaaccagugccugcuguacaagaccagcggcugccugacccagaugcccauccuguacggccaccccgccacccugcugaaggacuacauccugcaggccauccugcagcccggcaagaagauccagggcggcaccgagauccagagaggcagcuucgccaaccaguaccagaccgacgccagccaccuguaa

SEQ ID NO: 14472 - RNA, 5097 nt, Artificial Sequence
  C4A__Homo_sapiens__NP_001239133
augagacugcuguggggccugaucugggccagcagcuucuucacccugagccugcagaagcccagacugcugcuguucagccccagcguggugcaccugggcgugccccugagcgugggcgugcagcugcaggacgugcccagaggccagguggugaagggcagcguguuccugagaaaccccagcagaaacaacgugcccugcagccccaagguggacuucacccugagcagcgagagagacuucgcccugcugagccugcaggugccccugaaggacgccaagagcugcggccugcaccagcugcugagaggccccgaggugcagcugguggcccacagccccuggcugaaggacagccugagcagaaccaccaacauccagggcaucaaccugcuguucagcagcagaagaggccaccuguuccugcagaccgaccagcccaucuacaaccccggccagagagugagauacagaguguucgcccuggaccagaagaugagacccagcaccgacaccaucaccgugaugguggagaacagccacggccugagagugagaaagaaggagguguacaugcccagcagcaucuuccaggacgacuucgugauccccgacaucagcgagcccggcaccuggaagaucagcgccagauucagcgacggccuggagagcaacagcagcacccaguucgaggugaagaaguacgugcugcccaacuucgaggugaagaucacccccggcaagcccuacauccugaccgugcccggccaccuggacgagaugcagcuggacauccaggccagauacaucuacggcaagcccgugcagggcguggccuacgugagauucggccugcuggacgaggacggcaagaagaccuucuucagaggccuggagagccagaccaagcuggugaacggccagagccacaucagccugagcaaggccgaguuccaggacgcccuggagaagcugaacaugggcaucaccgaccugcagggccugagacuguacguggccgccgccaucaucgagagccccggcggcgagauggaggaggccgagcugaccagcugguacuucgugagcagccccuucagccuggaccugagcaagaccaagagacaccuggugcccggcgcccccuuccugcugcaggcccuggugagagagaugagcggcagccccgccagcggcauccccgugaaggugagcgccaccgugagcagccccggcagcgugcccgaggugcaggacauccagcagaacaccgacggcagcggccaggugagcauccccaucaucaucccccagaccaucagcgagcugcagcugagcgugagcgccggcagcccccaccccgccaucgccagacugaccguggccgccccccccagcggcggccccggcuuccugagcaucgagagacccgacagcagaccccccagagugggcgacacccugaaccugaaccugagagccgugggcagcggcgccaccuucagccacuacuacuacaugauccugagcagaggccagaucguguucaugaacagagagcccaagagaacccugaccagcgugagcguguucguggaccaccaccuggcccccagcuucuacuucguggccuucuacuaccacggcgaccaccccguggccaacagccugagaguggacgugcaggccggcgccugcgagggcaagcuggagcugagcguggacggcgccaagcaguacagaaacggcgagagcgugaagcugcaccuggagaccgacagccuggcccugguggcccugggcgcccuggacaccgcccuguacgccgccggcagcaagagccacaagccccugaacaugggcaagguguucgaggccaugaacagcuacgaccugggcugcggccccggcggcggcgacagcgcccugcagguguuccaggccgccggccuggccuucagcgacggcgaccaguggacccugagcagaaagagacugagcugccccaaggagaagaccaccagaaagaagagaaacgugaacuuccagaaggccaucaacgagaagcugggccaguacgccagccccaccgccaagagaugcugccaggacggcgugaccagacugcccaugaugagaagcugcgagcagagagccgccagagugcagcagcccgacugcagagagcccuuccugagcugcugccaguucgccgagagccugagaaagaagagcagagacaagggccaggccggccugcagagagcccuggagauccugcaggaggaggaccugaucgacgaggacgacauccccgugagaagcuucuuccccgagaacuggcuguggagaguggagaccguggacagauuccagauccugacccuguggcugcccgacagccugaccaccugggagauccacggccugagccugagcaagaccaagggccugugcguggccacccccgugcagcugagaguguucagagaguuccaccugcaccugagacugcccaugagcgugagaagauucgagcagcuggagcugagacccgugcuguacaacuaccuggacaagaaccugaccgugagcgugcacgugagccccguggagggccugugccuggccggcggcggcggccuggcccagcaggugcuggugcccgccggcagcgccagacccguggccuucagcguggugcccaccgccgccgccgccgugagccugaaggugguggccagaggcagcuucgaguuccccgugggcgacgccgugagcaaggugcugcagaucgagaaggagggcgccauccacagagaggagcugguguacgagcugaacccccuggaccacagaggcagaacccuggagauccccggcaacagcgaccccaacaugauccccgacggcgacuucaacagcuacgugagagugaccgccagcgacccccuggacacccugggcagcgagggcgcccugagccccggcggcguggccagccugcugagacugcccagaggcugcggcgagcagaccaugaucuaccuggcccccacccuggccgccagcagauaccuggacaagaccgagcaguggagcacccugccccccgagaccaaggaccacgccguggaccugauccagaagggcuacaugagaauccagcaguucagaaaggccgacggcagcuacgccgccuggcugagcagagacagcagcaccuggcugaccgccuucgugcugaaggugcugagccuggcccaggagcaggugggcggcagccccgagaagcugcaggagaccagcaacuggcugcugagccagcagcaggccgacggcagcuuccaggaccccugccccgugcuggacagaagcaugcagggcggccuggugggcaacgacgagaccguggcccugaccgccuucgugaccaucgcccugcaccacggccuggccguguuccaggacgagggcgccgagccccugaagcagagaguggaggccagcaucagcaaggccaacagcuuccugggcgagaaggccagcgccggccugcugggcgcccacgccgccgccaucaccgccuacgcccugacccugaccaaggcccccguggaccugcugggcguggcccacaacaaccugauggccauggcccaggagaccggcgacaaccuguacuggggcagcgugaccggcagccagagcaacgccgugagccccacccccgcccccagaaaccccagcgaccccaugccccaggcccccgcccuguggaucgagaccaccgccuacgcccugcugcaccugcugcugcacgagggcaaggccgagauggccgaccaggccagcgccuggcugaccagacagggcagcuuccagggcggcuucagaagcacccaggacaccgugaucgcccuggacgcccugagcgccuacuggaucgccagccacaccaccgaggagagaggccugaacgugacccugagcagcaccggcagaaacggcuucaagagccacgcccugcagcugaacaacagacagaucagaggccuggaggaggagcugcaguucagccugggcagcaagaucaacgugaaggugggcggcaacagcaagggcacccugaaggugcugagaaccuacaacgugcuggacaugaagaacaccaccugccaggaccugcagaucgaggugaccgugaagggccacguggaguacaccauggaggccaacgaggacuacgaggacuacgaguacgacgagcugcccgccaaggacgaccccgacgccccccugcagcccgugaccccccugcagcuguucgagggcagaagaaacagaagaagaagagaggcccccaagcugaccagccugagcgacagauacgugagccacuucgagaccgagggcccccacgugcugcuguacuucgacagcgugcccaccagcagagagugcgugggcuucgaggccgugcaggaggugcccgugggccuggugcagcccgccagcgccacccuguacgacuacuacaaccccgagagaagaugcagcguguucuacggcgcccccagcaagagcagacugcuggccacccugugcagcgccgaggugugccagugcgccgagggcaagugccccagacagagaagagcccuggagagaggccugcaggacgaggacggcuacagaaugaaguucgccugcuacuaccccagaguggaguacggcuuccaggugaaggugcugagagaggacagcagagccgccuucagacuguucgagaccaagaucacccaggugcugcacuucaccaaggacgugaaggccgccgccaaccagaugagaaacuuccuggugagagccagcugcagacugagacuggagcccggcaaggaguaccugaucaugggccuggacggcgccaccuacgaccuggagggccacccccaguaccugcuggacagcaacagcuggaucgaggagaugcccagcgagagacugugcagaagcaccagacagagagccgccugcgcccagcugaacgacuuccugcaggaguacggcacccagggcugccagguguaa

SEQ ID NO: 14473 - RNA, 5235 nt, Artificial Sequence
  C4B_2__Homo_sapiens__NP_001229752
augagacugcuguggggccugaucugggccagcagcuucuucacccugagccugcagaagcccagacugcugcuguucagccccagcguggugcaccugggcgugccccugagcgugggcgugcagcugcaggacgugcccagaggccagguggugaagggcagcguguuccugagaaaccccagcagaaacaacgugcccugcagccccaagguggacuucacccugagcagcgagagagacuucgcccugcugagccugcaggugccccugaaggacgccaagagcugcggccugcaccagcugcugagaggccccgaggugcagcugguggcccacagccccuggcugaaggacagccugagcagaaccaccaacauccagggcaucaaccugcuguucagcagcagaagaggccaccuguuccugcagaccgaccagcccaucuacaaccccggccagagagugagauacagaguguucgcccuggaccagaagaugagacccagcaccgacaccaucaccgugaugguggagaacagccacggccugagagugagaaagaaggagguguacaugcccagcagcaucuuccaggacgacuucgugauccccgacaucagcgagcccggcaccuggaagaucagcgccagauucagcgacggccuggagagcaacagcagcacccaguucgaggugaagaaguacgugcugcccaacuucgaggugaagaucacccccggcaagcccuacauccugaccgugcccggccaccuggacgagaugcagcuggacauccaggccagauacaucuacggcaagcccgugcagggcguggccuacgugagauucggccugcuggacgaggacggcaagaagaccuucuucagaggccuggagagccagaccaagcuggugaacggccagagccacaucagccugagcaaggccgaguuccaggacgcccuggagaagcugaacaugggcaucaccgaccugcagggccugagacuguacguggccgccgccaucaucgaguaccccggcggcgagauggaggaggccgagcugaccagcugguacuucgugagcagccccuucagccuggaccugagcaagaccaagagacaccuggugcccggcgcccccuuccugcugcaggcccuggugagagagaugagcggcagccccgccagcggcauccccgugaaggugagcgccaccgugagcagccccggcagcgugcccgaggugcaggacauccagcagaacaccgacggcagcggccaggugagcauccccaucaucaucccccagaccaucagcgagcugcagcugagcgugagcgccggcagcccccaccccgccaucgccagacugaccguggccgccccccccagcggcggccccggcuuccugagcaucgagagacccgacagcagaccccccagagugggcgacacccugaaccugaaccugagagccgugggcagcggcgccaccuucagccacuacuacuacaugauccugagcagaggccagaucguguucaugaacagagagcccaagagaacccugaccagcgugagcguguucguggaccaccaccuggcccccagcuucuacuucguggccuucuacuaccacggcgaccaccccguggccaacagccugagaguggacgugcaggccggcgccugcgagggcaagcuggagcugagcguggacggcgccaagcaguacagaaacggcgagagcgugaagcugcaccuggagaccgacagccuggcccugguggcccugggcgcccuggacaccgcccuguacgccgccggcagcaagagccacaagccccugaacaugggcaagguguucgaggccaugaacagcuacgaccugggcugcggccccggcggcggcgacagcgcccugcagguguuccaggccgccggccuggccuucagcgacggcgaccaguggacccugagcagaaagagacugagcugccccaaggagaagaccaccagaaagaagagaaacgugaacuuccagaaggccaucaacgagaagcugggccaguacgccagccccaccgccaagagaugcugccaggacggcgugaccagacugcccaugaugagaagcugcgagcagagagccgccagagugcagcagcccgacugcagagagcccuuccugagcugcugccaguucgccgagagccugagaaagaagagcagagacaagggccaggccggccugcagagagcccuggagauccugcaggaggaggaccugaucgacgaggacgacauccccgugagaagcuucuuccccgagaacuggcuguggagaguggagaccguggacagauuccagauccugacccuguggcugcccgacagccugaccaccugggagauccacggccugagccugagcaagaccaagggccugugcguggccacccccgugcagcugagaguguucagagaguuccaccugcaccugagacugcccaugagcgugagaagauucgagcagcuggagcugagacccgugcuguacaacuaccuggacaagaaccugaccgugagcgugcacgugagccccguggagggccugugccuggccggcggcggcggccuggcccagcaggugcuggugcccgccggcagcgccagacccguggccuucagcguggugcccaccgccgccgccgccgugagccugaaggugguggccagaggcagcuucgaguuccccgugggcgacgccgugagcaaggugcugcagaucgagaaggagggcgccauccacagagaggagcugguguacgagcugaacccccuggaccacagaggcagaacccuggagauccccggcaacagcgaccccaacaugauccccgacggcgacuucaacagcuacgugagagugaccgccagcgacccccuggacacccugggcagcgagggcgcccugagccccggcggcguggccagccugcugagacugcccagaggcugcggcgagcagaccaugaucuaccuggcccccacccuggccgccagcagauaccuggacaagaccgagcaguggagcacccugccccccgagaccaaggaccacgccguggaccugauccagaagggcuacaugagaauccagcaguucagaaaggccgacggcagcuacgccgccuggcugagcagaggcagcagcaccuggcugaccgccuucgugcugaaggugcugagccuggcccaggagcaggugggcggcagccccgagaagcugcaggagaccagcaacuggcugcugagccagcagcaggccgacggcagcuuccaggaccugagccccgugauccacagaagcaugcagggcggccuggugggcaacgacgagaccguggcccugaccgccuucgugaccaucgcccugcaccacggccuggccguguuccaggacgagggcgccgagccccugaagcagagaguggaggccagcaucagcaaggccagcagcuuccugggcgagaaggccagcgccggccugcugggcgcccacgccgccgccaucaccgccuacgcccugacccugaccaaggcccccgccgaccugagaggcguggcccacaacaaccugauggccauggcccaggagaccggcgacaaccuguacuggggcagcgugaccggcagccagagcaacgccgugagccccacccccgcccccagaaaccccagcgaccccaugccccaggcccccgcccuguggaucgagaccaccgccuacgcccugcugcaccugcugcugcacgagggcaaggccgagauggccgaccaggccgccgccuggcugaccagacagggcagcuuccagggcggcuucagaagcacccaggacaccgugaucgcccuggacgcccugagcgccuacuggaucgccagccacaccaccgaggagagaggccugaacgugacccugagcagcaccggcagaaacggcuucaagagccacgcccugcagcugaacaacagacagaucagaggccuggaggaggagcugcaguucagccugggcagcaagaucaacgugaaggugggcggcaacagcaagggcacccugaaggugcugagaaccuacaacgugcuggacaugaagaacaccaccugccaggaccugcagaucgaggugaccgugaagggccacguggaguacaccauggaggccaacgaggacuacgaggacuacgaguacgacgagcugcccgccaaggacgaccccgacgccccccugcagcccgugaccccccugcagcuguucgagggcagaagaaacagaagaagaagagaggcccccaaggugguggaggagcaggagagcagagugcacuacaccgugugcaucuggagaaacggcaaggugggccugagcggcauggccaucgccgacgugacccugcugagcggcuuccacgcccugagagccgaccuggagaagcugaccagccugagcgacagauacgugagccacuucgagaccgagggcccccacgugcugcuguacuucgacagcgugcccaccagcagagagugcgugggcuucgaggccgugcaggaggugcccgugggccuggugcagcccgccagcgccacccuguacgacuacuacaaccccgagagaagaugcagcguguucuacggcgcccccagcaagagcagacugcuggccacccugugcagcgccgaggugugccagugcgccgagggcaagugccccagacagagaagagcccuggagagaggccugcaggacgaggacggcuacagaaugaaguucgccugcuacuaccccagaguggaguacggcuuccaggugaaggugcugagagaggacagcagagccgccuucagacuguucgagaccaagaucacccaggugcugcacuucaccaaggacgugaaggccgccgccaaccagaugagaaacuuccuggugagagccagcugcagacugagacuggagcccggcaaggaguaccugaucaugggccuggacggcgccaccuacgaccuggagggccacccccaguaccugcuggacagcaacagcuggaucgaggagaugcccagcgagagacugugcagaagcaccagacagagagccgccugcgcccagcugaacgacuuccugcaggaguacggcacccagggcugccagguguaa

SEQ ID NO: 14474 - RNA, 5235 nt, Artificial Sequence
  C4B__Homo_sapiens__NP_001002029
augagacugcuguggggccugaucugggccagcagcuucuucacccugagccugcagaagcccagacugcugcuguucagccccagcguggugcaccugggcgugccccugagcgugggcgugcagcugcaggacgugcccagaggccagguggugaagggcagcguguuccugagaaaccccagcagaaacaacgugcccugcagccccaagguggacuucacccugagcagcgagagagacuucgcccugcugagccugcaggugccccugaaggacgccaagagcugcggccugcaccagcugcugagaggccccgaggugcagcugguggcccacagccccuggcugaaggacagccugagcagaaccaccaacauccagggcaucaaccugcuguucagcagcagaagaggccaccuguuccugcagaccgaccagcccaucuacaaccccggccagagagugagauacagaguguucgcccuggaccagaagaugagacccagcaccgacaccaucaccgugaugguggagaacagccacggccugagagugagaaagaaggagguguacaugcccagcagcaucuuccaggacgacuucgugauccccgacaucagcgagcccggcaccuggaagaucagcgccagauucagcgacggccuggagagcaacagcagcacccaguucgaggugaagaaguacgugcugcccaacuucgaggugaagaucacccccggcaagcccuacauccugaccgugcccggccaccuggacgagaugcagcuggacauccaggccagauacaucuacggcaagcccgugcagggcguggccuacgugagauucggccugcuggacgaggacggcaagaagaccuucuucagaggccuggagagccagaccaagcuggugaacggccagagccacaucagccugagcaaggccgaguuccaggacgcccuggagaagcugaacaugggcaucaccgaccugcagggccugagacuguacguggccgccgccaucaucgagagccccggcggcgagauggaggaggccgagcugaccagcugguacuucgugagcagccccuucagccuggaccugagcaagaccaagagacaccuggugcccggcgcccccuuccugcugcaggcccuggugagagagaugagcggcagccccgccagcggcauccccgugaaggugagcgccaccgugagcagccccggcagcgugcccgaggugcaggacauccagcagaacaccgacggcagcggccaggugagcauccccaucaucaucccccagaccaucagcgagcugcagcugagcgugagcgccggcagcccccaccccgccaucgccagacugaccguggccgccccccccagcggcggccccggcuuccugagcaucgagagacccgacagcagaccccccagagugggcgacacccugaaccugaaccugagagccgugggcagcggcgccaccuucagccacuacuacuacaugauccugagcagaggccagaucguguucaugaacagagagcccaagagaacccugaccagcgugagcguguucguggaccaccaccuggcccccagcuucuacuucguggccuucuacuaccacggcgaccaccccguggccaacagccugagaguggacgugcaggccggcgccugcgagggcaagcuggagcugagcguggacggcgccaagcaguacagaaacggcgagagcgugaagcugcaccuggagaccgacagccuggcccugguggcccugggcgcccuggacaccgcccuguacgccgccggcagcaagagccacaagccccugaacaugggcaagguguucgaggccaugaacagcuacgaccugggcugcggccccggcggcggcgacagcgcccugcagguguuccaggccgccggccuggccuucagcgacggcgaccaguggacccugagcagaaagagacugagcugccccaaggagaagaccaccagaaagaagagaaacgugaacuuccagaaggccaucaacgagaagcugggccaguacgccagccccaccgccaagagaugcugccaggacggcgugaccagacugcccaugaugagaagcugcgagcagagagccgccagagugcagcagcccgacugcagagagcccuuccugagcugcugccaguucgccgagagccugagaaagaagagcagagacaagggccaggccggccugcagagagcccuggagauccugcaggaggaggaccugaucgacgaggacgacauccccgugagaagcuucuuccccgagaacuggcuguggagaguggagaccguggacagauuccagauccugacccuguggcugcccgacagccugaccaccugggagauccacggccugagccugagcaagaccaagggccugugcguggccacccccgugcagcugagaguguucagagaguuccaccugcaccugagacugcccaugagcgugagaagauucgagcagcuggagcugagacccgugcuguacaacuaccuggacaagaaccugaccgugagcgugcacgugagccccguggagggccugugccuggccggcggcggcggccuggcccagcaggugcuggugcccgccggcagcgccagacccguggccuucagcguggugcccaccgccgccaccgccgugagccugaaggugguggccagaggcagcuucgaguuccccgugggcgacgccgugagcaaggugcugcagaucgagaaggagggcgccauccacagagaggagcugguguacgagcugaacccccuggaccacagaggcagaacccuggagauccccggcaacagcgaccccaacaugauccccgacggcgacuucaacagcuacgugagagugaccgccagcgacccccuggacacccugggcagcgagggcgcccugagccccggcggcguggccagccugcugagacugcccagaggcugcggcgagcagaccaugaucuaccuggcccccacccuggccgccagcagauaccuggacaagaccgagcaguggagcacccugccccccgagaccaaggaccacgccguggaccugauccagaagggcuacaugagaauccagcaguucagaaaggccgacggcagcuacgccgccuggcugagcagaggcagcagcaccuggcugaccgccuucgugcugaaggugcugagccuggcccaggagcaggugggcggcagccccgagaagcugcaggagaccagcaacuggcugcugagccagcagcaggccgacggcagcuuccaggaccugagccccgugauccacagaagcaugcagggcggccuggugggcaacgacgagaccguggcccugaccgccuucgugaccaucgcccugcaccacggccuggccguguuccaggacgagggcgccgagccccugaagcagagaguggaggccagcaucagcaaggccagcagcuuccugggcgagaaggccagcgccggccugcugggcgcccacgccgccgccaucaccgccuacgcccugacccugaccaaggcccccgccgaccugagaggcguggcccacaacaaccugauggccauggcccaggagaccggcgacaaccuguacuggggcagcgugaccggcagccagagcaacgccgugagccccacccccgcccccagaaaccccagcgaccccaugccccaggcccccgcccuguggaucgagaccaccgccuacgcccugcugcaccugcugcugcacgagggcaaggccgagauggccgaccaggccgccgccuggcugaccagacagggcagcuuccagggcggcuucagaagcacccaggacaccgugaucgcccuggacgcccugagcgccuacuggaucgccagccacaccaccgaggagagaggccugaacgugacccugagcagcaccggcagaaacggcuucaagagccacgcccugcagcugaacaacagacagaucagaggccuggaggaggagcugcaguucagccugggcagcaagaucaacgugaaggugggcggcaacagcaagggcacccugaaggugcugagaaccuacaacgugcuggacaugaagaacaccaccugccaggaccugcagaucgaggugaccgugaagggccacguggaguacaccauggaggccaacgaggacuacgaggacuacgaguacgacgagcugcccgccaaggacgaccccgacgccccccugcagcccgugaccccccugcagcuguucgagggcagaagaaacagaagaagaagagaggcccccaaggugguggaggagcaggagagcagagugcacuacaccgugugcaucuggagaaacggcaaggugggccugagcggcauggccaucgccgacgugacccugcugagcggcuuccacgcccugagagccgaccuggagaagcugaccagccugagcgacagauacgugagccacuucgagaccgagggcccccacgugcugcuguacuucgacagcgugcccaccagcagagagugcgugggcuucgaggccgugcaggaggugcccgugggccuggugcagcccgccagcgccacccuguacgacuacuacaaccccgagagaagaugcagcguguucuacggcgcccccagcaagagcagacugcuggccacccugugcagcgccgaggugugccagugcgccgagggcaagugccccagacagagaagagcccuggagagaggccugcaggacgaggacggcuacagaaugaaguucgccugcuacuaccccagaguggaguacggcuuccaggugaaggugcugagagaggacagcagagccgccuucagacuguucgagaccaagaucacccaggugcugcacuucaccaaggacgugaaggccgccgccaaccagaugagaaacuuccuggugagagccagcugcagacugagacuggagcccggcaaggaguaccugaucaugggccuggacggcgccaccuacgaccuggagggccacccccaguaccugcuggacagcaacagcuggaucgaggagaugcccagcgagagacugugcagaagcaccagacagagagccgccugcgcccagcugaacgacuuccugcaggaguacggcacccagggcugccagguguaa

SEQ ID NO: 14475 - RNA, 1794 nt, Artificial Sequence
  C4BPA__Homo_sapiens__XP_005273308
augcacccccccaagacccccagcggcgcccugcacagaaagagaaagauggccgccuggcccuucagcagacuguggaaggugagcgaccccauccuguuccagaugacccugaucgccgcccugcugcccgccgugcugggcaacugcggccccccccccacccugagcuucgccgcccccauggacaucacccugaccgagaccagauucaagaccggcaccacccugaaguacaccugccugcccggcuacgugagaagccacagcacccagacccugaccugcaacagcgacggcgaguggguguacaacaccuucugcaucuacaagagaugcagacaccccggcgagcugagaaacggccagguggagaucaagaccgaccugagcuucggcagccagaucgaguucagcugcagcgagggcuucuuccugaucggcagcaccaccagcagaugcgaggugcaggacagaggcgugggcuggagccacccccugccccagugcgagaucgugaagugcaagcccccccccgacaucagaaacggcagacacagcggcgaggagaacuucuacgccuacggcuucagcgugaccuacagcugcgaccccagauucagccugcugggccacgccagcaucagcugcaccguggagaacgagaccaucggcguguggagacccagcccccccaccugcgagaagaucaccugcagaaagcccgacgugagccacggcgagauggugagcggcuucggccccaucuacaacuacaaggacaccaucguguucaagugccagaagggcuucgugcugagaggcagcagcgugauccacugcgacgccgacagcaaguggaaccccagcccccccgccugcgagcccaacagcugcaucaaccugcccgacaucccccacgccagcugggagaccuaccccagacccaccaaggaggacguguacguggugggcaccgugcugagauacagaugccaccccggcuacaagcccaccaccgacgagcccaccaccgugaucugccagaagaaccugagauggacccccuaccagggcugcgaggcccugugcugccccgagcccaagcugaacaacggcgagaucacccagcacagaaagagcagacccgccaaccacugcguguacuucuacggcgacgagaucagcuucagcugccacgagaccagcagauucagcgccaucugccagggcgacggcaccuggagccccagaacccccagcugcggcgacaucugcaacuucccccccaagaucgcccacggccacuacaagcagagcagcagcuacagcuucuucaaggaggagaucaucuacgagugcgacaagggcuacauccuggugggccaggccaagcugagcugcagcuacagccacuggagcgcccccgccccccagugcaaggcccugugcagaaagcccgagcuggugaacggcagacugagcguggacaaggaccaguacguggagcccgagaacgugaccauccagugcgacagcggcuacggcguggugggcccccagagcaucaccugcagcggcaacagaaccugguaccccgaggugcccaagugcgagugggagacccccgagggcugcgagcaggugcugaccggcaagagacugaugcagugccugcccaaccccgaggacgugaagauggcccuggagguguacaagcugagccuggagaucgagcagcuggagcugcagagagacagcgccagacagagcacccuggacaaggagcuguaa

SEQ ID NO: 14476 - RNA, 759 nt, Artificial Sequence
  C4BPB__Homo_sapiens__NP_001017365
auguucuucuggugcgccugcugccugaugguggccuggagagugagcgccagcgacgccgagcacugccccgagcugccccccguggacaacagcaucuucguggccaaggagguggagggccagauccugggcaccuacgugugcaucaagggcuaccaccuggugggcaagaagacccuguucugcaacgccagcaaggagugggacaacaccaccaccgagugcagacugggccacugccccgaccccgugcuggugaacggcgaguucagcagcagcggccccgugaacgugagcgacaagaucaccuucaugugcaacgaccacuacauccugaagggcagcaacagaagccagugccuggaggaccacaccugggccccccccuuccccaucugcaagagcagagacugcgacccccccggcaaccccgugcacggcuacuucgagggcaacaacuucacccugggcagcaccaucagcuacuacugcgaggacagauacuaccuggugggcgugcaggagcagcagugcguggacggcgaguggagcagcgcccugcccgugugcaagcugauccaggaggcccccaagcccgagugcgagaaggcccugcuggccuuccaggagagcaagaaccugugcgaggccauggagaacuucaugcagcagcugaaggagagcggcaugaccauggaggagcugaaguacagccuggagcugaagaaggccgagcugaaggccaagcugcuguaa

SEQ ID NO: 14477 - RNA, 753 nt, Artificial Sequence
  C4orf22__Homo_sapiens__NP_001193926
auggaccaggaggagggccugaaggcccuggacaacaucgugacccaguucaacgccuacgaggacuuccuggacagccagaucaccaccguggaccuguacuaccuggaggacgagacccuggccagacagcugguggagcugggcuacagaggcaccggcgagagagugaagagagaggacuucgaggccagaaaggccgccaucgagaucgccagacuggccgagagagcccagcagaagacccugaccagcgccggcaaggaccugcaggacaacuuccugaccgcccuggccaugagagaggaggacaacagaagcggcaagcugagccugaaccagcaggagaccgacgccgcccacauccugaagaagcagcuggccagcgugaucuucaucagagacagaaacagccacggccaggagaucagcggcuacaucgacuacgcccacagacugaagaccgaggacuucgagguguacuucaccggcaagaagagacugcugcccagacccaccgacaucagcuucuacaacugggacgccgacaucgccgugagcaacagcagccccaacuaccaggugaucgccgacaaccccgagggccugcuguucagauacaagagagacagaaagauccugaacguggaccccaaggcccagcccggcgacaacagcaccagaaucaccauccugaccgagcuguacgugcaggccgugaucuucgaccacaucagcagaagaaagaccuaa

SEQ ID NO: 14478 - RNA, 531 nt, Artificial Sequence
  C4orf26__Homo_sapiens__NP_001193910
auggccagaagacacugcuucagcuacuggcugcuggugugcuggcugguggugaccguggccgaggcccugagcaccuucuaccugcagcagcacaucaaccugcacauggacaagaagagauaccugagacugcuggagauccacaagaucaugagaacccugcccaccgccagaagccugcacagcccccugcaccugcccagaggcgugagaagccagggccccagccccagccagagacaccccggcgugcccagcaucuucuuccacgagggccccgagagcauccugggcuuccagaccgaccugagcagccugcagggcgugaccaccguguuccacagcagccacuucaucggccacaccgugacccugcugaucggcaucagccccgaggaggacagcagagaggaggcccaccugagaaaggccgagagagaggagaagcccaagcacaccgaggccaagaagagccugagcuucagaaagaagcagcagaaggacuucugcuucaucuucagaaacuaa

SEQ ID NO: 14479 - RNA, 1041 nt, Artificial Sequence
  C4orf27__Homo_sapiens__NP_060337
auggugggcggcggcggcaagagaagacccggcggcgagggcccccagugcgagaagaccaccgacgugaagaagagcaaguucugcgaggccgacgugagcagcgaccugagaaaggagguggagaaccacuacaagcugagccugcccgaggacuucuaccacuucuggaaguucugcgaggagcuggaccccgagaagcccagcgacagccugagcgccagccugggccugcagcuggugggccccuacgacauccuggccggcaagcacaagaccaagaagaagagcaccggccugaacuucaaccugcacuggagauucuacuacgacccccccgaguuccagaccaucaucaucggcgacaacaagacccaguaccacaugggcuacuucagagacagccccgacgaguuccccguguacgugggcaucaacgaggccaagaagaacugcaucaucgugcccaacggcgacaacguguucgccgccgugaagcuguuccugaccaagaagcugagagagaucaccgacaagaagaagaucaaccugcugaagaacaucgacgagaagcugaccgaggccgccagagagcugggcuacagccuggagcagagaaccgugaagaugaagcagagagacaagaagguggugaccaagaccuuccacggcgccggccugguggugcccguggacaagaacgacgugggcuacagagagcugcccgagaccgacgccgaccugaagagaaucugcaagaccaucguggaggccgccagcgacgaggagagacugaaggccuucgcccccauccaggagaugaugaccuucgugcaguucgccaacgacgagugcgacuacggcaugggccuggagcugggcauggaccuguucugcuacggcagccacuacuuccacaagguggccggccagcugcugccccuggccuacaaccugcugaagagaaaccuguucgccgagaucaucgaggagcaccuggccaacagaagccaggagaacaucgaccagcuggccgccuaa

SEQ ID NO: 14480 - RNA, 399 nt, Artificial Sequence
  C4orf32__Homo_sapiens__NP_689613
augugcagcgccggcgagcugcugagaggcggcgacggcggcgagagagacgaggacggcgacgcccuggccgagagagaggccgccggcaccgagugggaccccggcgccagccccagaagaagaggccagagacccaaggagagcgagcaggacguggaggacagccagaaccacaccggcgagcccgugggcgacgacuacaagaagaugggcacccuguucggcgagcugaacaagaaccugaucaacaugggcuucaccagaauguacuucggcgagagaaucguggagcccgugaucgugaucuucuucugggugaugcugugguuccugggccugcaggcccugggccugguggccgugcugugccuggugaucaucuacgugcagcaguaa

SEQ ID NO: 14481 - RNA, 600 nt, Artificial Sequence
  C4orf33__Homo_sapiens__NP_001093253
auggacuucaagaucgagcacaccugggacggcuuccccgugaagcacgagcccguguucaucagacugaaccccggcgacagaggcgugaugauggacaucagcgcccccuucuucagagacccccccgccccccugggcgagcccggcaagcccuucaacgagcugugggacuacgaggugguggaggccuucuuccugaacgacaucaccgagcaguaccuggagguggagcugugcccccacggccagcaccuggugcugcugcugagcggcagaagaaacguguggaagcaggagcugccccugagcuucagaaugagcagaggcgagaccaagugggagggcaaggccuaccugcccuggagcuacuucccccccaacgugaccaaguucaacagcuucgccauccacggcagcaaggacaagagaagcuacgaggcccuguaccccgugccccagcacgagcugcagcagggccagaagcccgacuuccacugccuggaguacuucaagagcuucaacuucaacacccugcugggcgaggaguggaagcagcccgagagcgaccuguggcugaucgagaagugcgacaucuaa

SEQ ID NO: 14482 - RNA, 354 nt, Artificial Sequence
  C4orf36__Homo_sapiens__XP_011529917
auggccuacggcgugcccagaaagaacaccgugaagaccauccugagaggcagcugcuacaacgugcaggagcccugggacaucgcccugcuggccaagaccuggagcaccaaccuggccaacaucaagcugcccuuccuggaggagaucagcuucggcggcagcgugcagcugaccaagugcaccaccaucaaggacggccugcugcccagcgccgagagcaucaagcuggagagagaguacgaggugaagagacugugcaagcugaagugccaggagaacaccagcaaggagauccagcugcugcugagagagagacccgccggccugagaagaccccugcccagcaaguaa

SEQ ID NO: 14483 - RNA, 288 nt, Artificial Sequence
  C4orf48__Homo_sapiens__NP_001135408
auggcccccccccccgccugcagaagccccaugagccccccccccccccugcugcugcugcugcugcugagccuggcccugcugggcgccagagccagagccgagcccgccggcagcgccgugcccgcccagagcagacccugcguggacugccacgccuucgaguucaugcagagagcccugcaggaccugagaaagaccgccugcagccuggacgccagaaccgagacccugcugcugcaggccgagagaagagcccugugcgccugcuggcccgccggccacuaa

SEQ ID NO: 14484 - RNA, 609 nt, Artificial Sequence
  C4orf51__Homo_sapiens__XP_011530499
augagccacuacuucuaccugaccccccagauccugcugcccuucagcccccugaccagccaggaguucgaccugaucagaagaaaggccggcgccagcuggcaggacgagaccagauggagcgacagcagcgugaccaccuacaccggcagcuacagaaagaagcagcuggacaagagcaugugcagccaguucagcuucagagccggccagcacgagcccgagugcaagcagaugagccugaccaacagcagcgccugccaccugcugugcugggccggcacccaggagaccaccgacaucaagggccuguuccccgacaucaccagacccuucaagaagagcuucgacgugaagcacggcguggcccaccagaucugggacuucggcgacugcuuccccaccccccccaacuacggcaaguacugcgugagacccaagaagcccgcccaggaggcccugaucaacuacagcagaagaggcaagggcgugcugaagcaccugcacggcagaugcgacagcgagagcaaggugugcagcagcgaggacagcgaggccgacagauacagcgacuacggcuggggcggccccagcagccccuucaacuaa

SEQ ID NO: 14485 - RNA, 1053 nt, Artificial Sequence
  C5AR1__Homo_sapiens__NP_001727
augaacagcuucaacuacaccacccccgacuacggccacuacgacgacaaggacacccuggaccugaacacccccguggacaagaccagcaacacccugagagugcccgacauccuggcccuggugaucuucgccgugguguuccuggugggcgugcugggcaacgcccugguggugugggugaccgccuucgaggccaagagaaccaucaacgccaucugguuccugaaccuggccguggccgacuuccugagcugccuggcccugcccauccuguucaccagcaucgugcagcaccaccacuggcccuucggcggcgccgccugcagcauccugcccagccugauccugcugaacauguacgccagcauccugcugcuggccaccaucagcgccgacagauuccugcugguguucaagcccaucuggugccagaacuucagaggcgccggccuggccuggaucgccugcgccguggccuggggccuggcccugcugcugaccauccccagcuuccuguacagaguggugagagaggaguacuucccccccaaggugcugugcggcguggacuacagccacgacaagagaagagagagagccguggccaucgugagacuggugcugggcuuccuguggccccugcugacccugaccaucugcuacaccuucauccugcugagaaccuggagcagaagagccaccagaagcaccaagacccugaagguggugguggccgugguggccagcuucuucaucuucuggcugcccuaccaggugaccggcaucaugaugagcuuccuggagcccagcagccccaccuuccugcugcugaacaagcuggacagccugugcgugagcuucgccuacaucaacugcugcaucaaccccaucaucuacgugguggccggccagggcuuccagggcagacugagaaagagccugcccagccugcugagaaacgugcugaccgaggagagcguggugagagagagcaagagcuucaccagaagcaccguggacaccauggcccagaagacccaggccguguaa

SEQ ID NO: 14486 - RNA, 1014 nt, Artificial Sequence
  C5AR2__Homo_sapiens__NP_001258679
augggcaacgacagcgugagcuacgaguacggcgacuacagcgaccugagcgacagacccguggacugccuggacggcgccugccuggccaucgacccccugagaguggccccccugccccuguacgccgccaucuuccuggugggcgugcccggcaacgccaugguggccuggguggccggcaagguggccagaagaagagugggcgccaccuggcugcugcaccuggccguggccgaccugcugugcugccugagccugcccauccuggccgugcccaucgccagaggcggccacuggcccuacggcgccgugggcugcagagcccugcccagcaucauccugcugaccauguacgccagcgugcugcugcuggccgcccugagcgccgaccugugcuuccuggcccugggccccgccugguggagcaccgugcagagagccugcggcgugcagguggccugcggcgccgccuggacccuggcccugcugcugaccgugcccagcgccaucuacagaagacugcaccaggagcacuuccccgccagacugcagugcgugguggacuacggcggcagcagcagcaccgagaacgccgugaccgccaucagauuccuguucggcuuccugggcccccugguggccguggccagcugccacagcgcccugcugugcugggccgccagaagaugcagaccccugggcaccgccaucguggugggcuucuucgugugcugggcccccuaccaccugcugggccuggugcugaccguggccgcccccaacagcgcccugcuggccagagcccugagagccgagccccugaucgugggccuggcccuggcccacagcugccugaaccccaugcuguuccuguacuucggcagagcccagcugagaagaagccugcccgccgccugccacugggcccugagagagagccagggccaggacgagagcguggacagcaagaagagcaccagccacgaccuggugagcgagauggagguguaa

SEQ ID NO: 14487 - RNA, 5031 nt, Artificial Sequence
  C5__Homo_sapiens__NP_001726
augggccugcugggcauccugugcuuccugaucuuccugggcaagaccuggggccaggagcagaccuacgugaucagcgcccccaagaucuucagagugggcgccagcgagaacaucgugauccagguguacggcuacaccgaggccuucgacgccaccaucagcaucaagagcuaccccgacaagaaguucagcuacagcagcggccacgugcaccugagcagcgagaacaaguuccagaacagcgccauccugaccauccagcccaagcagcugcccggcggccagaaccccgugagcuacguguaccuggagguggugagcaagcacuucagcaagagcaagagaaugcccaucaccuacgacaacggcuuccuguucauccacaccgacaagcccguguacacccccgaccagagcgugaaggugagaguguacagccugaacgacgaccugaagcccgccaagagagagaccgugcugaccuucaucgaccccgagggcagcgagguggacaugguggaggagaucgaccacaucggcaucaucagcuuccccgacuucaagauccccagcaaccccagauacggcauguggaccaucaaggccaaguacaaggaggacuucagcaccaccggcaccgccuacuucgaggugaaggaguacgugcugccccacuucagcgugagcaucgagcccgaguacaacuucaucggcuacaagaacuucaagaacuucgagaucaccaucaaggccagauacuucuacaacaagguggugaccgaggccgacguguacaucaccuucggcaucagagaggaccugaaggacgaccagaaggagaugaugcagaccgccaugcagaacaccaugcugaucaacggcaucgcccaggugaccuucgacagcgagaccgccgugaaggagcugagcuacuacagccuggaggaccugaacaacaaguaccuguacaucgccgugaccgugaucgagagcaccggcggcuucagcgaggaggccgagauccccggcaucaaguacgugcugagccccuacaagcugaaccugguggccaccccccuguuccugaagcccggcauccccuaccccaucaaggugcaggugaaggacagccuggaccagcuggugggcggcgugcccgugacccugaacgcccagaccaucgacgugaaccaggagaccagcgaccuggaccccagcaagagcgugaccagaguggacgacggcguggccagcuucgugcugaaccugcccagcggcgugaccgugcuggaguucaacgugaagaccgacgcccccgaccugcccgaggagaaccaggccagagagggcuacagagccaucgccuacagcagccugagccagagcuaccuguacaucgacuggaccgacaaccacaaggcccugcuggugggcgagcaccugaacaucaucgugacccccaagagccccuacaucgacaagaucacccacuacaacuaccugauccugagcaagggcaagaucauccacuucggcaccagagagaaguucagcgacgccagcuaccagagcaucaacauccccgugacccagaacauggugcccagcagcagacugcugguguacuacaucgugaccggcgagcagaccgccgagcuggugagcgacagcguguggcugaacaucgaggagaagugcggcaaccagcugcaggugcaccugagccccgacgccgacgccuacagccccggccagaccgugagccugaacauggccaccggcauggacagcuggguggcccuggccgccguggacagcgccguguacggcgugcagagaggcgccaagaagccccuggagagaguguuccaguuccuggagaagagcgaccugggcugcggcgccggcggcggccugaacaacgccaacguguuccaccuggccggccugaccuuccugaccaacgccaacgccgacgacagccaggagaacgacgagcccugcaaggagauccugagacccagaagaacccugcagaagaagaucgaggagaucgccgccaaguacaagcacagcguggugaagaagugcugcuacgacggcgccugcgugaacaacgacgagaccugcgagcagagagccgccagaaucagccugggccccagaugcaucaaggccuucaccgagugcugcgugguggccagccagcugagagccaacaucagccacaaggacaugcagcugggcagacugcacaugaagacccugcugcccgugagcaagcccgagaucagaagcuacuuccccgagagcuggcugugggaggugcaccuggugcccagaagaaagcagcugcaguucgcccugcccgacagccugaccaccugggagauccagggcgugggcaucagcaacaccggcaucugcguggccgacaccgugaaggccaagguguucaaggacguguuccuggagaugaacauccccuacagcguggugagaggcgagcagauccagcugaagggcaccguguacaacuacagaaccagcggcaugcaguucugcgugaagaugagcgccguggagggcaucugcaccagcgagagccccgugaucgaccaccagggcaccaagagcagcaagugcgugagacagaagguggagggcagcagcagccaccuggugaccuucaccgugcugccccuggagaucggccugcacaacaucaacuucagccuggagaccugguucggcaaggagauccuggugaagacccugagaguggugcccgagggcgugaagagagagagcuacagcggcgugacccuggaccccagaggcaucuacggcaccaucagcagaagaaaggaguuccccuacagaaucccccuggaccuggugcccaagaccgagaucaagagaauccugagcgugaagggccugcuggugggcgagauccugagcgccgugcugagccaggagggcaucaacauccugacccaccugcccaagggcagcgccgaggccgagcugaugagcguggugcccguguucuacguguuccacuaccuggagaccggcaaccacuggaacaucuuccacagcgacccccugaucgagaagcagaagcugaagaagaagcugaaggagggcaugcugagcaucaugagcuacagaaacgccgacuacagcuacagcguguggaagggcggcagcgccagcaccuggcugaccgccuucgcccugagagugcugggccaggugaacaaguacguggagcagaaccagaacagcaucugcaacagccugcuguggcugguggagaacuaccagcuggacaacggcagcuucaaggagaacagccaguaccagcccaucaagcugcagggcacccugcccguggaggccagagagaacagccuguaccugaccgccuucaccgugaucggcaucagaaaggccuucgacaucugcccccuggugaagaucgacaccgcccugaucaaggccgacaacuuccugcuggagaacacccugcccgcccagagcaccuucacccuggccaucagcgccuacgcccugagccugggcgacaagacccacccccaguucagaagcaucgugagcgcccugaagagagaggcccuggugaagggcaacccccccaucuacagauucuggaaggacaaccugcagcacaaggacagcagcgugcccaacaccggcaccgccagaaugguggagaccaccgccuacgcccugcugaccagccugaaccugaaggacaucaacuacgugaaccccgugaucaaguggcugagcgaggagcagagauacggcggcggcuucuacagcacccaggacaccaucaacgccaucgagggccugaccgaguacagccugcuggugaagcagcugagacugagcauggacaucgacgugagcuacaagcacaagggcgcccugcacaacuacaagaugaccgacaagaacuuccugggcagacccguggaggugcugcugaacgacgaccugaucgugagcaccggcuucggcagcggccuggccaccgugcacgugaccaccguggugcacaagaccagcaccagcgaggaggugugcagcuucuaccugaagaucgacacccaggacaucgaggccagccacuacagaggcuacggcaacagcgacuacaagagaaucguggccugcgccagcuacaagcccagcagagaggagagcagcagcggcagcagccacgccgugauggacaucagccugcccaccggcaucagcgccaacgaggaggaccugaaggcccugguggagggcguggaccagcuguucaccgacuaccagaucaaggacggccacgugauccugcagcugaacagcauccccagcagcgacuuccugugcgugagauucagaaucuucgagcuguucgaggugggcuuccugagccccgccaccuucaccguguacgaguaccacagacccgacaagcagugcaccauguucuacagcaccagcaacaucaagauccagaaggugugcgagggcgccgccugcaagugcguggaggccgacugcggccagaugcaggaggagcuggaccugaccaucagcgccgagaccagaaagcagaccgccugcaagcccgagaucgccuacgccuacaaggugagcaucaccagcaucaccguggagaacguguucgugaaguacaaggccacccugcuggacaucuacaagaccggcgaggccguggccgagaaggacagcgagaucaccuucaucaagaaggugaccugcaccaacgccgagcuggugaagggcagacaguaccugaucaugggcaaggaggcccugcagaucaaguacaacuucagcuucagauacaucuacccccuggacagccugaccuggaucgaguacuggcccagagacaccaccugcagcagcugccaggccuuccuggccaaccuggacgaguucgccgaggacaucuuccugaacggcugcuaa

SEQ ID NO: 14488 - RNA, 1329 nt, Artificial Sequence
  C5orf22__Homo_sapiens__NP_060826
augagcgacagcgccggcggcagagccggccugagaagauaccccaagcugcccgugugggugguggaggaccaccaggaggugcugcccuucaucuacagagccaucggcagcaagcaccugcccgccagcaacgugagcuuccugcacuucgacagccaccccgaccugcugauccccgugaacaugcccgccgacaccguguucgacaaggagacccuguucggcgagcugagcaucgagaacuggaucaugcccgccguguacgccggccacuucagccacgugaucugguuccaccccaccugggcccagcagaucagagagggcagacaccacuuccuggugggcaaggacaccagcaccaccaccaucagagugaccagcaccgaccacuacuuccugagcgacggccuguacgugcccgaggaccagcuggagaaccagaagccccugcagcuggacgugaucauggugaagcccuacaagcugugcaacaaccaggaggagaacgacgccgugagcagcgccaagaagcccaagcuggcccuggaggacagcgagaacaccgccagcaccaacugcgacagcagcagcgagggccuggagaaggacaccgccacccagagaagcgaccagaccugccuggagcccagcugcagcugcagcagcgagaaccaggagugccagaccgccgccagcaccggcgagauccuggagauccugaagaagggcaaggccuucgugcuggacaucgaccuggacuucuucagcgugaagaaccccuucaaggagauguucacccaggaggaguacaagauccugcaggagcuguaccaguucaagaagcccggcaccaaccugaccgaggaggaccugguggacaucguggacaccagaauccaccagcuggaggaccuggaggccaccuucgccgaccugugcgacggcgacgacgaggagaccgugcagagaugggccagcaaccccggcauggagagccuggugccccuggugcagagccugaagaagagaauggaggugcccgacuacgagauggugcaccaggccggccugaccugcgacuacagcgagcugccccaccacaucagcaccgagcaggagaucgagugccugauccagagcgugcacuaccugcugaagaaccugcccaaccccacccuggugaccaucgccagaagcagccuggacgacuacugccccagcgaccagguggacaccauccaggagaaggugcugaacaugcugagagcccuguacggcaaccuggaccugcagguguacgccgccgagagcccccccagcuaa

SEQ ID NO: 14489 - RNA, 621 nt, Artificial Sequence
  C5orf30__Homo_sapiens__NP_149988
auggagguggacaucaacggcgagagcagaagcacccugaccacccugcccuuccccggcgccgaggccaacagccccggcaaggccgaggccgagaagcccagaugcagcagcacccccugcagccccaugagaagaaccgugagcggcuaccagauccugcacauggacagcaacuaccuggugggcuucaccaccggcgaggagcugcugaagcuggcccagaagugcaccggcggcgaggagagcaaggccgaggccaugcccagccugagaagcaagcagcuggacgccggccuggccagaagcagcagacuguacaagaccagaagcagauacuaccagcccuacgagauccccgccgugaacggcagaagaagaagaagaaugcccagcagcggcgacaagugcaccaagagccugcccuacgagcccuacaaggcccugcacggcccccugccccugugccugcugaagggcaagagagcccacagcaagagccuggacuaccugaaccuggacaagaugaucaaggagcccgccgacaccgaggugcugcaguaccagcugcagcaccugacccugagaggcgacagaguguucgccagaaacaacaccuaa

SEQ ID NO: 14490 - RNA, 1917 nt, Artificial Sequence
  C5orf34__Homo_sapiens__NP_940968
auggccgccgagcugagaaugauccuguacgaggacgacagcgugcaggugcaguacguggacggcagcacccugcagcugagccccugcggcagcgaguuccuguucgagaagagcccccccgugagcgcccacccccuggagcagcccgagagaaucagacagagaacccacuucgugaucagcaccuacagagagcagcugcagagagcccuggacuucagaaacagcagcgccaccugccccuuccugagcgagaccaucauccccagcgagagaaagaagcacaucuucaucgacaucaccgaggugagauggcccagccuggacaccgacggcaccaugaucuacauggagagcggcaucgugaagaucaccagccuggacggccacgccuaccugugccugcccagaagccagcacgaguucaccgugcacuuccugugcaaggugagccagaagagcgacagcagcgccgugcugagcgagaccaacaacaaggcccccaaggacaagcugguggagaagaccggcaagaucugcaucagaggcaaccugcccggccagagacugaagaacaaggagaacgaguuccacugccagaucaugaagagcaaggagacccugaagaagaugagcugcgugaacggcaccgagggcagagaggagcugcccagccccggcaccaagcacaccugcguguacaccugggugaagcagugcuggagcguggccgccugccccgaggaguggaaguacccccugagccuggcccugcacuuccacaacaagaucagcaacaugagcaagaucgacgcccacaucacccagagcagauuccugaccagcgacaucagcgaggagagaggcaagguggugagcgugcugcccagagcccugagccugagcugccccgugccccaccugcacagauggaacuucugcgacagccugcugcagagacagagcgacgaguacagcuaccccgagcuggugaagauggugugguacaagggcgugaccuacagacugacccaccagaacaugaacagcaucgagaucuacagcggcgacggcagcguguucaagagcgagggcgccuacuucggcaacuacuucaccuacuacagcauccaggagggcagcggcaagagagaggagaagaccuacagcgugaacaaccugccccccgacagacccggcagccccuucaccgugggcagccugaucaagcaggccaccagaauccugcagcacugcgugaagaugagacugagccugagccacaacuacagaaucugcugcuggaagauggugcccggcaucaacgacagcaacauccugccccuggugcugaaggagagccugauccccagcgugggcagauuccuggccuacagcgacgacaaggugcacgccaucuuccuggacggcaucacccugacccugaacuggaacuucagcagccccaucgagaagagacaggugaaccagggccugaaccugggcuggugcaagcugaccuuccccgacggccaggagcagcugauccagaucgagcaccccgagcccuacgagagauacgugaccaccgugaccagcuggugcagaagacugacccagaccagccccagagagaugcccacccacagcagcagcagcgugcugcaggagaacuggagcguggccagcgagcuggagaagauccagaaguucaaccugcugcuggagaacagcggcauccugaaccagaucagcaacaagaagaacgagcagcagagcuucgaccacuacaagcccggcagcagcgagacccugcugggcgaggugaacgagaacagagugagcaucgcccugaagaagaccagcgagauccugcacgacaucgacugccugcugagcaacagcaagaaguaa

SEQ ID NO: 14491 - RNA, 213 nt, Artificial Sequence
  C5orf38__Homo_sapiens__NP_001281266
augguggcccccgccgccagaguguuccugagagccgugagagccgcccugaccagcaccgugcccgaccugcugugccugcuggccagaggcagccccagaggccuggccagcggcagacugccccuggccgugcacagcgcccagcacggccccggcagcggcgcccccuggcugagaaucgccagaagagcccugagccagagaaucuaa

SEQ ID NO: 14492 - RNA, 9594 nt, Artificial Sequence
  C5orf42__Homo_sapiens__NP_075561
auggagaucagacuggagauccugaccagcaccggcaucaagcagaagaagcccuggcccagagugagcuggcugggcaaggagaaggaggccguguuccugcuggacgacaaguucaucaacgagaucaaccugcugagcggcaagaucaagaagaagauccccagccugcagcccuuccugaaggacgugaucgugcugaccaccagcagcaacgacgccuggcuggccggcgugcugaccaccggcgagcuguuccuguggaacaaggaccaggacugccugaagaccauccccaucaccgagaagcccaaggagaugaucaaggccaccguggccagcagccugagacuguaccuguacgugagcggcaacggcaagagaaucgugcugaucacccccagcggcugcaucuuccugugggaguaccuggagcugaagaacauccugagcagcaagagccugagccuggccggcagauggagccaggugauccccgaggaggccgugcugcugcccagcaccgaggacaaggaggccguggugaacgccguguucaucaagaacgagcuguucggcgacugcugccugugcagcuucaccuucuacagcggcgagugccugaagcugaccuuccuggccaucagauggcacgagaacguguucaccagcgugagaagccugcccuaccacgugcacugggcccagcaggacugccaccugugcagccugauccccaagugcgagagcgugaagagcagaggcgcccugaucagcgccuucagcagagacggccugacccuggccgugacccugaaccagaaggaccccaaggccacccaggugcuguucaucaacacccugaacuucgugacccugugcggcagccugaagggcugcagcaacaagagccccguggugcccgccacccugaucagaagcuacugggugggcgacaucagcuggacccacgacagccuguuccuggccugcaugcugaagagaggcagccuggugcugcugaccugccagggcgagcugcugacccugaucaccuucggcugcagcaucgaguucggccccgccgaguucaucccccugcacccccugaucaccuacagaccccagcaguucaccuuccaggacagcaacaacagcguggacagcagcgccagcgacagcgaccccaugagacagagauucagcaucaaggcccacagcagacugcccuaccuggugaucagcgacggcuacauggugaccacccugagauuccuggacagccugagccccagcgugcacaugagaagccugcugcuggacagcacccagagacuggagaagaucuaccagagcgugauccugagcaagcccaagggcaagggccugaaccugagaagccugaacagccugagaagcagccugcuggagcaccagggcaacgagagcagcgccgacuucaccgugcccaaguuccugcaggccgaggagaccaucaacgagaacgccgccgacuuccaggacuucgaggccgaggagaccaacgagggcagacacuuccccgacaaccugugccccuucuggaacaagagagacgacgugcugugcagcagcaugaaggagggcagacuggaguucgccagcauguucgacaccauccacgccaaggacgacagcgaggagaccgacagaaccaucaccgagcugcacagcauccagaagagccugcuggccgccuggaccaucggcaucagcaagaccgugaccgagaagaaccugaugcugaacuacaucguggugugcaucacccacuucuucuacauccugcaguucaucaagugccccuuccccaagcuggaccuggugcugagcaagagcagcagacacaacgccuggauccugugcaucuuccagcuguuccaccagugccugagcauccacuacugggacaucagauacaagcaggacgugggccaccugaucaagcugaccagcaacaccgugaagcugcugcugacccagcagcagaagggccagcuguucagcgagaagcugcuggccugcuucuaccugcugaagaugguggccgacaaccugaacggcguguacauccugcagcccgaggugaucagcgccagcgccgacggcagcaagaucaccgcccaggacagccugguggugcccaucuuccagauguuccaggacagcggcuuccagaagaacuggagcuggaacagcuucuucaagauccacccccagguggugaaccccgugcagcagcccggccacagacugcugauccuguggagaauccuguacaagaagacccugugguaccaggcccagcugaacagaagagugcccgaggccgacagccagcugaccgagaagaugacccacgaggccagcaccgugaagagccugcugugccaccugcaggccaaccugcagagcaccggcgacugccugaaccagacccuggagcugaagagcaucaacggcgaggagugcuuccugcugggcagcuacgagaagagcgugcagcuguggaagaaggcccugcaggagaucgaggagaagggcggcagaagaaccuacuuccugcagaucagauacuaccugagccugcuguacugccaccuguacagcuacaaccugaacgacgcccagggccugugcgaccagcuggccagagagauccugagauggagccagcugcccgugaaggagaacaaggacuucagcggcgccgccaagagccacuucgagugcggcauggugggcggcgugcaccccgaggccgccgugagaguggugcagagcauggccagauucauggccgccuacuucaccaaccagcagcugugcauccugcccccccaccacgugaacgugcugcccccccugcacaucaagaccgagcagagcuucagacugaucccccugcagcacagcaagguggccagcguggugagagaccagaaccugagcaacguguggaccguggaguacgcccuggagcugcuguucaucggcggccuggugcccgaggccguguggcuggccuacaagcugggcgacuggaagaccagcgugagcaucggcguggccuuccagcuguucugcaagagagacagcaacuucaugagaagcaagaagaagagccugaaccugccccugagaaugacccccgcccagaucuuccaggagaagcugcagugcgugcugggccagcccgccagccuggaggccaagaacgagaugggcagcaaguacaagcaguucaccgaccccaucgaggaggaggacgccaaccugcuguucggcagcgugcaggaggugcugaaggccagcgugauggccgacgccgacauccugagcgagaccuuccagcugcugaucgacagcgccaaggacuucagcaagagacuguggggccuggugcccuucggccuguaccugcccgcccccccccuguacugcccccagcccgccauccugagcgaggaggacggcgacgaccugcugcugaaggccgagaagaacaacagacagaaggugagcggcauccugcagagagugcugcugcuguucagagccgcccagugcagcuuccccguggcccagugguacauccugcagcugagaugggccagaaaggugaugcagaagaucagaaugaagggcagccugcccagccugagccccuucccccagagccugcugaacuacugcaagggcggcaucgccuucuucagacccggcgccgccggcgaccacaagcuggacgaggugagcaucagagccaucggcugcuucagagagcugugcgcccugugcuggaugcugcacgugagagacaagcugagcuacagcugcagacaguaccagaaggccagagagaacgugaagggcgagaaggaccuggagguggaguucgacagcugcaugaucgagcacugccugagcgccguggagugggccuacagaaugcugcccuucagcagauucuucaacauggaggagcugauccaggacaucauccugagccugaucggcgagcugccccccaucagaaagguggccgagaucuucgugaaggccuuccccuaccccgaggacgugagagugccccugagagacaaguaccacagccugcaccagagacugagacacugcguggugaagggcccccagaccgaggagaugaugagcguggugaugcacagcauccagaaggugagagugaaggcccugaagagagugcagagaaacaucggcagcuucgaggugaacaucugggagcccaucgaggaggagaagcccgacgaggcccccggcguggacagauacagccugggcaccagccugagcagaagcacccugaccgagcugggcgacagcguggugcacagcgacgccgacaccuucagcgaggcccugagcguggaggagaagagcagaaucaacaucuaccagagaaacgcccccaaccacauggagcugaccagcauccacaagcccaccgacaagagaaagaugugcaaccagaaggagaaccccaccaagaaggaggaccacgagaagcugagccagaacacccugcccgugaucggcgugugggaguucgagagagacgacgacgaguacaucaaguuccuggaccuguuccugagcuacauccuggagagagaccugcccuacagcagagacgccgacauccccuuccugaccagcuucagcggcaagcugagagagcacgagcugaacagccugcuguucgacgugcacaccacccugaagagacaccagagcaagaccaagagccagaacguguucagagccggcagcugcuucgugguggcccccgagagcuacgagagcgagaagagcagcagccugaacgacgaguacggcaugcaccuggagaaccagaagcugagcagcagcgugcuggugaaccagggcaucaagcccuuccugcaguaccccagcaacgaggugaacaagaacgagggcaugagcggccuguucggccugaagcagagaagcaucuacaagauccaggacgacaccagagagaagugccugauccagagaagcagcaaccacaucuucuggacccccaagagcaucaagaccagaagaugcaucuucaaggccauccagugcaacgacaucaacccccaggaggaccugccccuggcccugaacaccuucggcagcaucggcagacugcuggaguggaugaucagauggagcaacagaagacugcugugcgacagcggcaucaccgagagcagcagcgaguacagccccgugaucagagugaagaccagcaccgccgccauccugaccagccuguggcugcuggagcagcccuacuucgccaccuacaaggccaagaacgccaucaucaagaugguggagaacagagacaccggcugccagaucggccccaacaucgagagagagagcaagagcgacgccggcggcagcguggccguggccacccccggcggcaccgaggagagaaacggccagaacaagagcugccagaacauccugaacagaaugcccaccgaggccaagaaccccgacaucaaggagaucaacgacgacaucaucagcaucacccacaacaccaagaaggaguucaucgacaucgacgagaaccugcuggagguggaggccuucaccgaggaggagauggacaugcacaucagcgacuacgaggaggacaucgaggagagcgugggcggcuucagaagccccagccuggccaucugcaugaugacccugccccagcagcuggaggaggaguucaccgaggaggugcagugccagagagaggagccccuggagaccaucauggaggagaagagcaccgagcagaagggcaugaucgaggccuucagccaccccggccacaccaccccccagagcaugcagguggacaccagcagcgagaucagcagcgcccagaucagcaccuacaaggagaagagcagcagcgugccccugcugaucagcaacggcgugaacguggccagccagccccccgcccccaccccccagaagacccagagaaacgaguucaccgcccagcugcccgacugcagcgagagcgugagacagaugcugcaggacgagauguucaagcuggugcagcugcagcagaucaacuucaugagccugaugcagaucgugggcagcagcuucgccaaccugcccgacacccagcagcuggugcagcagagccagagcgugcaccugggcgagagccaggagagcaaccugagaggcugcggcgacguggaggacagcaacaagaaccugaaggagagauucuucaucaagccccagagcaugggcgagaacgccagagagcccagaaagaacagcccccacugccacgagggcaccauccccagcggccagaacagcaccggcaacgugcagaacgugccccacggcagcaucccccugugccagcugaacggccagcccagaaagaagggccccauccccagcagccagaaccugcccagcaccagcuucuaccccgcccccgccggcaacacccaccuguaccugcugagcacccccagcguggugcagaaggcccccagacugaucccccacgccaagaccuucagccccggcgacggcuucccccugcugcaguucaagagcaagcaggaguuccagccccuguuccugcacaccggcagcaucccccaggugcccuucagaccccugccccagcccagagaggccuggggccugagcgacagcuuccagcccgcccugccccagagagccgcccagaccacccccgccagccaccugaacgugagccaguacaacaccgaggccagaaagaaggagguggagcagaagaccugggccgagaccgugaucaccgagauccccaaccacgugaaccuggaccaguacgugggccaggagaaccugaccccccagcaggacagcagcguguucaucaagcccgagaagcuguucgacgugaagcccggcacccuggagaucagcccccaccacagcuucggccugccccugcuguaccugccccugaagccccccaacauguuccccagcaccagcagagccagcaucaccgugcccagcacccccauccagcccaucgccgaggagagaaaguaccccagacugagccugcugcacagccaccugagccccgagaacagaugcaagaagacccagcugaucccccuggagaaccugaucgccuucaagcagagccagcagaagcugacccacaaccuguucgagcagggcgacgccggccaccugcagcugcugaaggugaagaucgagccccccgaggugagacagggcaaggacagcaagaagagacagagaagaagagccgagaaggagcugcaggagaagagaugcgagaagcugagaagaaagcccaacgugaccuucagacccgagaacagcaucaucaacaacgacgacagcgagaucaucaagaagcccaaggagcagcaggagcacugcggcagccacccccuggacgacuucgacgugcccuucgagaugcugcaggacgacaacaccagcgccggccugcacuucauggccagcgugaagaagaaggccaucggcagccaggacgccagcaccaacaccgaccccgagcacgagccccugaccgccccccagcugcuggugcccgacguguaccugaaccugaagcugagcagcgagaugagcgagaagcccuggagccccagcaucccccacaccgugaccaaccuggagcugcccgugagagaggagcccagcaacgacaacgugaucaagcagcagagcgaccaccuggccgugcccagcagcgccgagcugcacuacauggccgccagcgugaccaacgccgugcccccccacaacuucaagagccagggccugcccaagcccgaguucagauucaagggccagagcaccaagagcgacagcgccgaggacuaccugcuguggaagagacugcagggcgugagcgccgccugccccgcccccagcagcgccgcccaccagcuggagcaccugagcgccaagcugcagaagaucgacgagcagcugcuggccauccagaacaucgccgagaacaucgagcaggacuuccccaagcccgagaugcuggaccugcacugcgacaagaucggccccguggaccacaucgaguucagcagcggccccgaguucaagaagacccuggccagcaagaccaucagcaucagcgaggaggugagauuccugacccacauggacgaggaggaccagagcgacaagaaggagaccagcgagcccgaguucagcaucaccgagaacuacagcggccagaagaccugcguguuccccaccgccgacagcgccgugagccugagcagcagcagcgaccagaacaccaccagccccggcaugaacagcagcgacgagcugugcgagagcgugagcgugcacccccugcagaugaccggccugaccgacaucgccgacaucaucgacgaccugaucaucaaggacggcgugagcagcgaggagcugggccugaccgagcaggccaugggcaccagcagaauccagcacuacagcggcagacacagccagagaaccgacaaggagagaagagagauccaggccuggaugaagagaaagagaaaggagagaauggccaaguaccugaacgagcuggccgagaagagaggccaggagcacgaccccuucugccccagaagcaacccccuguacaugaccagcagagagaucagacugagacagaagaugaagcacgagaaggacagacugcugcugagcgagcacuacagcagaagaaucagccaggccuacggccugaugaacgagcugcugagcgagagcgugcagcugcccacccugccccagaagccccugcccaacaagcccagccccacccagagcagcagcugccagcacugccccagccccagaggcgagaaccagcacggccacagcuuccugaucaacagacccggcaaggugaaguacaugagcaagcccagcuacauccacaagagaaagagcuucggccagccccagggcagccccuggccccacggcaccgccaccuucaccauccagaagaaggccggcggcgccaaggccgccgugagaaaggccacccagagccccgugaccuuccagaagggcagcaacgcccccugccacagccugcagcacaccaagaagcacggcagcgccggccuggccccccagaccaagcaggugugcguggaguacgagagagaggagaccguggugagccccuggaccauccccagcgagauccacaagauccugcacgagagccacaacagccugcugcaggaccugagccccaccgaggaggaggagcccgagcaccccuucggcgugggcggcguggacagcgugagcgagagcaccggcagcauccugagcaagcuggacuggaacgccaucgaggacaugguggccagcguggaggaccagggccugagcgugcacugggcccuggaccuguaa

SEQ ID NO: 14493 - RNA, 348 nt, Artificial Sequence
  C5orf63__Homo_sapiens__NP_001157950
augcugugguuccagggcaacagcaugcagcuggccagaagcagcuucggccuguuccugagaaacugcagcgccagcaagaccacccugcccgugcugacccuguucaccaaggaccccugcccccugugcgacgaggccaaggaggugcugaagcccuacgagaacagauucauccugcaggaggugaacaucacccugcccgagaacagcgugugguacgagagauacaaguucgacauccccguguuccaccugaacggccaguuccugaugaugcacagagugaacaccagcaagcuggagaagcagcugcugaagcuggagcagcagagcaccggcggcuaa

SEQ ID NO: 14494 - RNA, 2805 nt, Artificial Sequence
  C6__Homo_sapiens__NP_000056
auggccagaagaagcgugcuguacuucauccugcugaacgcccugaucaacaagggccaggccugcuucugcgaccacuacgccuggacccaguggaccagcugcagcaagaccugcaacagcggcacccagagcagacacagacagaucgugguggacaaguacuaccaggagaacuucugcgagcagaucugcagcaagcaggagaccagagagugcaacuggcagagaugccccaucaacugccugcugggcgacuucggccccuggagcgacugcgaccccugcaucgagaagcagagcaaggugagaagcgugcugagacccagccaguucggcggccagcccugcaccgccccccugguggccuuccagcccugcauccccagcaagcugugcaagaucgaggaggccgacugcaagaacaaguucagaugcgacagcggcagaugcaucgccagaaagcuggagugcaacggcgagaacgacugcggcgacaacagcgacgagagagacugcggcagaaccaaggccgugugcaccagaaaguacaaccccauccccagcgugcagcugaugggcaacggcuuccacuuccuggccggcgagcccagaggcgaggugcuggacaacagcuucaccggcggcaucugcaagaccgugaagagcagcagaaccagcaaccccuacagagugcccgccaaccuggagaacgugggcuucgaggugcagaccgccgaggacgaccugaagaccgacuucuacaaggaccugaccagccugggccacaacgagaaccagcagggcagcuucagcagccagggcggcagcagcuucagcgugcccaucuucuacagcagcaagagaagcgagaacaucaaccacaacagcgccuucaagcaggccauccaggccagccacaagaaggacagcagcuucaucagaauccacaaggugaugaaggugcugaacuucaccaccaaggccaaggaccugcaccugagcgacguguuccugaaggcccugaaccaccugccccuggaguacaacagcgcccuguacagcagaaucuucgacgacuucggcacccacuacuucaccagcggcagccugggcggcguguacgaccugcuguaccaguucagcagcgaggagcugaagaacagcggccugaccgaggaggaggccaagcacugcgugagaaucgagaccaagaagagagugcuguucgccaagaagaccaagguggagcacagaugcaccaccaacaagcugagcgagaagcacgagggcagcuucauccagggcgccgagaagagcaucagccugaucagaggcggcagaagcgaguacggcgccgcccuggccugggagaagggcagcagcggccuggaggagaagaccuucagcgaguggcuggagagcgugaaggagaaccccgccgugaucgacuucgagcuggcccccaucguggaccuggugagaaacauccccugcgccgugaccaagagaaacaaccugagaaaggcccugcaggaguacgccgccaaguucgaccccugccagugcgcccccugccccaacaacggcagacccacccugagcggcaccgagugccugugcgugugccagagcggcaccuacggcgagaacugcgagaagcagagccccgacuacaagagcaacgccguggacggccaguggggcugcuggagcagcuggagcaccugcgacgccaccuacaagagaagcagaaccagagagugcaacaaccccgccccccagagaggcggcaagagaugcgagggcgagaagagacaggaggaggacugcaccuucagcaucauggagaacaacggccagcccugcaucaacgacgacgaggagaugaaggagguggaccugcccgagaucgaggccgacagcggcugcccccagcccgugccccccgagaacggcuucaucagaaacgagaagcagcuguaccuggugggcgaggacguggagaucagcugccugaccggcuucgagaccgugggcuaccaguacuucagaugccugcccgacggcaccuggagacagggcgacguggagugccagagaaccgagugcaucaagcccguggugcaggaggugcugaccaucacccccuuccagagacuguacagaaucggcgagagcaucgagcugaccugccccaagggcuucgugguggccggccccagcagauacaccugccagggcaacagcuggaccccccccaucagcaacagccugaccugcgagaaggacacccugaccaagcugaagggccacugccagcugggccagaagcagagcggcagcgagugcaucugcaugagccccgaggaggacugcagccaccacagcgaggaccugugcguguucgacaccgacagcaacgacuacuucaccagccccgccugcaaguuccuggccgagaagugccugaacaaccagcagcugcacuuccugcacaucggcagcugccaggacggcagacagcuggaguggggccuggagagaaccagacugagcagcaacagcaccaagaaggagagcugcggcuacgacaccugcuacgacugggagaagugcagcgccagcaccagcaagugcgugugccugcugcccccccagugcuucaagggcggcaaccagcuguacugcgugaagaugggcagcagcaccagcgagaagacccugaacaucugcgaggugggcaccaucagaugcgccaacagaaagauggagauccugcaccccggcaagugccuggccuaa

SEQ ID NO: 14495 - RNA, 699 nt, Artificial Sequence
  C6orf106__Homo_sapiens__NP_073595
auggagggcauggacguggaccuggaccccgagcugaugcagaaguucagcugccugggcaccaccgacaaggacgugcugaucagcgaguuccagagacugcugggcuuccagcugaaccccgccggcugcgccuucuuccuggacaugaccaacuggaaccugcaggccgccaucggcgccuacuacgacuucgagagccccaacaucagcgugcccagcaugagcuucguggaggacgugaccaucggcgagggcgagagcaucccccccgacacccaguucgugaagaccuggagaauccagaacagcgacgugaucugggugauccugagcguggaggugggcggccugcugggcgugacccagcagcugagcagcuucgagaccgaguucaacacccagccccacagaaagguggagggcaacuucaaccccuucgccagcccccagaagaacagacagagcgacgagaacaaccugaaggaccccggcggcagcgaguucgacagcaucagcaagaacaccugggcccccgcccccgacaccugggcccccgcccccgaccagaccgagcaggaccagaacagacugagccagaacagcgugaaccugagccccagcagccacgccaacaaccugagcguggugaccuacagcaagggccugcacggccccuaccccuucggccagagcuaa

SEQ ID NO: 14496 - RNA, 1692 nt, Artificial Sequence
  C6orf10__Homo_sapiens__XP_011512542
augaccgugcuggagaucacccuggccgugauccugacccugcugggccuggccauccuggccauccugcugaccagaugggccagaugcaagcagagcgagauguacaucagcagauacagcagcgagcagagcgccagacugcuggacuacgaggacggcagaggcagcagacacgccuacagcacccagagcgacaccagcuacgacaacagagagagaagcaagagagacuacacccccagcaccaacagccuggugagcauggccagcaaguucagccugggccagaccgagcugauccugcugcugaugugcuucauccuggcccugagcagaagcagcaucggcagcaucaagugccugcagaccaccgaggagccccccagcagaaccgccggcgccaugaugcaguucaccgcccccauccccggcgccaccggccccaucaagcugagccagaagaccaucgugcagacccccggccccaucgugcaguaccccggcagcaacgccggcccccccagcgcccccagaggcccccccauggcccccaucaucaucagccagagaaccgccagaaucccccaggugcacaccauggacagcagcggcaagaucacccugacccccguggugauccugaccggcuacauggacgaggagcuggccaagaagagcugcagcaagauccagauccugaagugcggcggcaccgccagaagccagaacagcagagaggagaacaaggaggcccugaagaacgacaucaucuucaccaacagcguggagagccugaagagcgcccacaucaaggagcccgagagagagggcaagggcaccgaccuggagaaggacaagaucggcauggaggugaagguggacagcgacgccggcauccccaagagacaggagacccagcugaagaucagcgagaugagcaucccccagggccagggcgcccagaucaagaagagcgugagcgacgugcccagaggccaggagagccaggugaagaagagcgagagcggcgugcccaagggccaggaggcccaggugaccaagagcggccugguggugcugaagggccaggaggcccagguggagaagagcgagaugggcgugcccagaagacaggagagccaggugaagaagagccagagcggcgugagcaagggccaggaggcccaggugaagaagagagagagcguggugcugaagggccaggaggcccagguggagaagagcgagcugaaggugcccaagggccaggagggccagguggagaagaccgaggccgacgugcccaaggagcaggaggugcaggagaagaagagcgaggccggcgugcugaagggccccgagagccaggugaagaacaccgaggugagcgugcccgagacccuggagagccaggugaagaagagcgagagcggcgugcugaagggccaggaggcccaggagaagaaggagagcuucgaggacaagggcaacaacgacaaggagaaggagagagacgccgagaaggaccccaacaagaaggagaagggcgacaagaacaccaagggcgacaagggcaaggacaaggugaagggcaagagagagagcgagaucaacggcgagaagagcaagggcagcaagagagccaaggccaacaccggcagaaaguacaacaagaagguggaggaguaa

SEQ ID NO: 14497 - RNA, 978 nt, Artificial Sequence
  C6orf15__Homo_sapiens__NP_054789
augcagggcagaguggccggcagcugcgccccccugggccugcugcuggugugccugcaccugcccggccuguucgccagaagcaucggcgugguggaggagaaggugagccagaaccugggcaccaaccugccccagcugggccagcccagcagcaccggccccagcaacagcgagcacccccagcccgcccuggaccccagaagcaacgaccuggccagagugccccugaagcugagcgugcccgccagcgacggcuucccccccgccggcggcagcgccgugcagagauggccccccagcuggggccugcccgccauggacagcuggccccccgaggaccccuggcagaugauggccgccgccgccgaggacagacugggcgaggcccugcccgaggagcugagcuaccugagcagcgccgccgcccuggcccccggcagcggcccccugcccggcgagagcagccccgacgccaccggccugagccccaaggccagccugcugcaccaggacagcgagagcagaagacugcccagaagcaacagccugggcgccggcggcaagauccugagccagagaccccccuggagccugauccacagagugcugcccgaccaccccuggggcacccugaaccccagcgugagcuggggcggcggcggccccggcaccggcuggggcaccagacccaugccccaccccgagggcaucuggggcaucaacaaccagccccccggcaccagcuggggcaacaucaacagauaccccggcggcagcuggggcaacaucaacagauaccccggcggcagcuggggcaacaucaacagauaccccggcggcagcuggggcaacauccaccuguaccccggcaucaacaaccccuucccccccggcgugcugagaccccccggcagcagcuggaacauccccgccggcuuccccaacccccccagccccagacugcaguggggcuaa

SEQ ID NO: 14498 - RNA, 714 nt, Artificial Sequence
  C6orf25__Homo_sapiens__NP_079536
auggccguguuccugcagcugcugccccugcugcugagcagagcccagggcaaccccggcgccagccuggacggcagacccggcgacagagugaaccugagcugcggcggcgugagccaccccaucagaugggugugggcccccagcuuccccgccugcaagggccugagcaagggcagaagacccauccugugggccagcagcagcggcacccccaccgugcccccccugcagcccuucgugggcagacugagaagccuggacagcggcaucagaagacuggagcugcugcugagcgccggcgacagcggcaccuucuucugcaagggcagacacgaggacgagagcagaaccgugcugcacgugcugggcgacagaaccuacugcaaggcccccggccccacccacggcagcguguacccccagcugcugaucccccugcugggcgccggccuggugcugggccugggcgcccugggccuggugugguggcugcacagaagacugcccccccagcccaucagaccccugcccagauucgcccugagccccccccacagcagcaccugcgagaacagagcccccgaggccagcaagggcggcagagcccaggacagcagaggccccggccccggcaccgagcccgcccugugcggcagcggccccagcagcccccagcaggccccccccgccgugcacagcggccccugcuaa

SEQ ID NO: 14499 - RNA, 885 nt, Artificial Sequence
  C6orf47__Homo_sapiens__NP_067007
auguuccugagaagacugggcggcuggcugcccagacccuggggcagaagaaagcccaugagacccgacccccccuaccccgagcccagaagaguggacagcagcagcgagaacagcggcagcgacugggacagcgcccccgagaccauggaggacgugggccaccccaagaccaaggacagcggcgcccugagagugagcggcgccgccagcgagcccagcaaggaggagccccagguggagcagcugggcagcaagagaauggacagccugaagugggaccagcccaucagcagcacccaggagagcggcagacuggaggccggcggcgccagccccaagcugagaugggaccacguggacagcggcggcaccagaagacccggcgugagccccgagggcggccugagcgugcccggccccggcgccccccuggagaagcccggcagaagagagaagcugcugggcuggcugagaggcgagcccggcgcccccagcagauaccugggcggccccgaggagugccugcagaucagcaccaaccugacccugcaccugcuggagcugcuggccagcgcccugcuggcccugugcagcagaccccugagagccgcccuggacacccugggccugagaggcccccugggccuguggcugcacggccugcugagcuuccuggccgcccugcacggccugcacgccgugcugagccugcugaccgcccacccccugcacuucgccugccuguucggccugcugcaggcccuggugcuggccgugagccugagagagcccaacggcgacgaggccgccaccgacugggagagcgagggccuggagagagagggcgaggagcagagaggcgaccccggcaagggccuguaa

SEQ ID NO: 14500 - RNA, 228 nt, Artificial Sequence
  C6orf48__Homo_sapiens__NP_001274413
auggagagaagcuucguguggcugagcugccuggacagcgacagcugcaaccugaccuucagacugggcgagguggagagccacgccugcagccccagccugcuguggaaccugcugacccaguaccugccccccggcgccggccacauccugagaaccuacaacuuccccgugcugagcugcgugagcagcugccaccugaucggcggcaagaugcccgagaacuaa

SEQ ID NO: 14501 - RNA, 1044 nt, Artificial Sequence
  C6orf89__Homo_sapiens__NP_001273564
auggaccuggccgccaacgagaucagcaucuacgacaagcugagcgagaccguggaccuggugagacagaccggccaccagugcggcaugagcgagaaggccaucgagaaguucaucagacagcugcuggagaagaacgagccccagagaccccccccccaguacccccugcugaucgugguguacaaggugcuggccacccugggccugauccugcugaccgccuacuucgugauccagcccuucagcccccuggcccccgagcccgugcugagcggcgcccacaccuggagaagccugauccaccacaucagacugaugagccugcccaucgccaagaaguacaugagcgagaacaagggcgugccccugcacggcggcgacgaggacagacccuuccccgacuucgaccccugguggaccaacgacugcgagcagaacgagagcgagcccauccccgccaacugcaccggcugcgcccagaagcaccugaaggugaugcugcuggaggacgcccccagaaaguucgagagacugcacccccuggugaucaagaccggcaagccccugcuggaggaggagauccagcacuuccugugccaguaccccgaggccaccgagggcuucagcgagggcuucuucgccaagugguggagaugcuuccccgagagaugguuccccuuccccuaccccuggagaagaccccugaacagaagccagaugcugagagagcuguuccccguguucacccaccugcccuuccccaaggacgccagccugaacaagugcagcuuccugcaccccgagcccguggugggcagcaagaugcacaagaugcccgaccuguucaucaucggcagcggcgaggccaugcugcagcugaucccccccuuccagugcagaagacacugccagagcguggccaugcccaucgagcccggcgacaucggcuacguggacaccacccacuggaagguguacgugaucgccagaggcgugcagccccuggugaucugcgacggcaccgccuucagcgagcuguaa

SEQ ID NO: 14502 - RNA, 2532 nt, Artificial Sequence
  C7__Homo_sapiens__NP_000578
augaaggugaucagccuguucauccuggugggcuucaucggcgaguuccagagcuucagcagcgccagcagccccgugaacugccagugggacuucuacgcccccuggagcgagugcaacggcugcaccaagacccagaccagaagaagaagcguggccguguacggccaguacggcggccagcccugcgugggcaacgccuucgagacccagagcugcgagcccaccagaggcugccccaccgaggagggcugcggcgagagauucagaugcuucagcggccagugcaucagcaagagccuggugugcaacggcgacagcgacugcgacgaggacagcgccgacgaggacagaugcgaggacagcgagagaagacccagcugcgacaucgacaagcccccccccaacaucgagcugaccggcaacggcuacaacgagcugaccggccaguucagaaacagagugaucaacaccaagagcuucggcggccagugcagaaagguguucagcggcgacggcaaggacuucuacagacugagcggcaacgugcugagcuacaccuuccaggugaagaucaacaacgacuucaacuacgaguucuacaacagcaccuggagcuacgugaagcacaccagcaccgagcacaccagcagcagcagaaagagaagcuucuucagaagcagcagcagcagcagcagaagcuacaccagccacaccaacgagauccacaagggcaagagcuaccagcugcuggugguggagaacaccguggagguggcccaguucaucaacaacaaccccgaguuccugcagcuggccgagcccuucuggaaggagcugagccaccugcccagccuguacgacuacagcgccuacagaagacugaucgaccaguacggcacccacuaccugcagagcggcagccugggcggcgaguacagagugcuguucuacguggacagcgagaagcugaagcagaacgacuucaacagcguggaggagaagaagugcaagagcagcggcuggcacuucguggugaaguucagcagccacggcugcaaggagcuggagaacgcccugaaggccgccagcggcacccagaacaacgugcugagaggcgagcccuucaucagaggcggcggcgccggcuucaucagcggccugagcuaccuggagcuggacaaccccgccggcaacaagagaagauacagcgccugggccgagagcgugaccaaccugccccaggugaucaagcagaagcugaccccccuguacgagcuggugaaggaggugcccugcgccagcgugaagaagcuguaccugaagugggcccuggaggaguaccuggacgaguucgaccccugccacugcagacccugccagaacggcggccuggccaccguggagggcacccacugccugugccacugcaagcccuacaccuucggcgccgccugcgagcagggcgugcuggugggcaaccaggccggcggcguggacggcggcuggagcugcuggagcagcuggagccccugcgugcagggcaagaagaccagaagcagagagugcaacaaccccccccccagcggcggcggcagaagcugcgugggcgagaccaccgagagcacccagugcgaggacgaggagcuggagcaccugagacugcuggagccccacugcuucccccugagccuggugcccaccgaguucugccccagcccccccgcccugaaggacggcuucgugcaggacgagggcaccauguuccccgugggcaagaacgugguguacaccugcaacgagggcuacagccugaucggcaaccccguggccagaugcggcgaggaccugagauggcuggugggcgagaugcacugccagaagaucgccugcgugcugcccgugcugauggacggcauccagagccacccccagaagcccuucuacaccgugggcgagaaggugaccgugagcugcagcggcggcaugagccuggagggccccagcgccuuccugugcggcagcagccugaaguggagccccgagaugaagaacgccagaugcgugcagaaggagaacccccugacccaggccgugcccaagugccagagaugggagaagcugcagaacagcagaugcgugugcaagaugcccuacgagugcggccccagccuggacgugugcgcccaggacgagagaagcaagagaauccugccccugaccgugugcaagaugcacgugcugcacugccagggcagaaacuacacccugaccggcagagacagcugcacccugcccgccagcgccgagaaggccugcggcgccugcccccuguggggcaagugcgacgccgagagcagcaagugcgugugcagagaggccagcgagugcgaggaggagggcuucagcaucugcguggaggugaacggcaaggagcagaccaugagcgagugcgaggccggcgcccugagaugcagaggccagagcaucagcgugaccagcaucagacccugcgccgccgagacccaguaa

SEQ ID NO: 14503 - RNA, 309 nt, Artificial Sequence
  C7orf49__Homo_sapiens__NP_001230683
augaacgaggccgagaucguggacguggcccugggcauccugaucgagagcagaaagcaggagaaggccugcgagcagcccgcccuggccggcgccgacaaccccgagcacagcccccccugcagcgugagcccccacaccagcagcggcagcagcagcgaggaggaggacagcggcaagcaggcccuggcccccggccugagccccagccagagacccggcggcagcagcagcgccugcagcagaagccccgaggaggaggaggaggaggacgugcugaaguacgugagagagaucuucuucagcuaa

SEQ ID NO: 14504 - RNA, 462 nt, Artificial Sequence
  C7orf57__Homo_sapiens__NP_001254795
augcccgacuacauggugcacgaggaguucaaccccgaccaggccaacggcagcuacgccagcagaagaggccccuucgacuucgacaugaagaccguguggcagagagaggccgaggagcuggagaaggagaagaagaagcugagacugcccgccaucgacagcaaguaccugagcaaggccggcaccccccugggccccaagaaccccgccggcagcagacugagcuucccccccgugaacggcuacaaggacgaguggcugcagcagcagcagagagccgacagcgacaagagaacccccaagaccagcagagccagcgugcugagccagagccccagagaccuggagggcccccaggacgccgccagacugcaggacgccgaggccagcgagggccccgaggacacccccggccccgaggagagcgugagcgccagcacccccgccgagcugaaguaa

SEQ ID NO: 14505 - RNA, 1218 nt, Artificial Sequence
  C7orf60__Homo_sapiens__NP_689769
auggagcccggcgccggcggcagaaacaccgccagagcccagagagccggcagccccaacacccccccccccagagagcaggagagaaagcuggagcaggagaagcugagcggcguggugaagagcgugcacagaagacugagaaagaaguacagagaggugggcgacuucgacaagaucuggagagagcacugcgaggacgaggagacccugugcgaguacgccguggccaugaagaaccuggccgacaaccacugggccaagaccugcgagggcgagggcagaaucgaguggugcugcagcgugugcagagaguacuuccagaacggcggcaagagaaaggcccuggagaaggacgagaagagagccgugcuggccaccaagaccacccccgcccugaacaugcacgagagcagccagcuggagggccaccugaccaaccugagcuucaccaaccccgaguucaucaccgagcugcugcaggccagcggcaagaucagacugcuggacgugggcagcugcuucaaccccuuccugaaguucgaggaguuccugaccgugggcaucgacaucgugcccgccguggagagcguguacaagugcgacuuccugaaccugcagcugcagcagccccugcagcuggcccaggacgccaucgacgccuuccugaagcagcugaagaaccccaucgacagccugcccggcgagcuguuccacguggugguguucagccugcugcugagcuacuuccccagccccuaccagagauggaucugcugcaagaaggcccacgagcugcuggugcugaacggccugcugcugaucaucacccccgacagcagccaccagaacagacacgccaugaugaugaagagcuggaagaucgccaucgagagccugggcuucaagagauucaaguacagcaaguucagccacaugcaccugauggccuucagaaagaucagccugaagaccaccagcgaccuggugagcagaaacuaccccggcaugcuguacaucccccaggacuucaacagcaucgaggacgaggaguacagcaaccccagcugcuacgugagaagcgacaucgaggacgagcagcuggccuacggcuucaccgagcugcccgacgcccccuacgacagcgacagcggcgagagccaggccagcagcauccccuucuacgagcuggaggaccccauccugcugcugagcuaa

SEQ ID NO: 14506 - RNA, 762 nt, Artificial Sequence
  C7orf62__Homo_sapiens__XP_011514206
augagcuucagcgugcacaaccagaagggcagcaagagaccccugccccuggagccccugcuguuccugcaggugcccagaagcaacuaccugcacuuccaggaggagaagcagagacugcaccugaagaaguuccugcuggacagaauguuccugguggccaagauccaggccaacguggagagaaaggacguggccgacuacuacgagcagauguuccagagcgugcugaagcaccaccugggcgaggccgugaccggccugcugcugaucuaccccaccagcauccugcacauccuggagagcagcagcgacacccuguacaaggugcugcuggacuacaucggccacgugaaggacgagaccguguucuucauccagcagaugaagaucaucgugaucagccacaacauccccaugagacuguucaugcaguggcacgugagcgugaucaaggugcccgugauguaccuggacgacgugacccagagccagagccugaaggaggugaucaccgacuuccugacccagacccacaagcugagccuguaccugugccagaccaugaaggugggcaccaagggccccggcgacaaccugcaccagguggcccccgaccugcugcugcccgagcagaucaucaaguaccugugcaagagcgaggaguucauggaccccgccaccuucaucaacauguacaacagacccauccacaucacccuggacagcgaggugguguggcccgcccccagcagauucuaa

SEQ ID NO: 14507 - RNA, 456 nt, Artificial Sequence
  C7orf65__Homo_sapiens__NP_001116537
augagaauggcccccaccgagagcaccgagggcagaagacuguggcccggccccagagagggcggcagcggcaaggagaccaccagcgagaagcugagcaaccugcccagaccccacagcuacagccccaagagagccgacgccgagagcuucagaggcgugcccgccgccuucaagaagugcagagagguguucagagccugcuggggcagcagagagcugcuguuccuguucaaggccaucagcgaggccggccccgcccagaacagcugcggcaucacccuggagaaggccggcggccuggaggacaccggcagccacuggcugagcugggccagaugcaaggugcuguacaucaacggcuucaccgaccccuggaaggacgcccaggccuggauccugaucgugagcugcaagaagggcaagggcacccccgagagagagggcagaaacuaa

SEQ ID NO: 14508 - RNA, 369 nt, Artificial Sequence
  C7orf69__Homo_sapiens__NP_079307
augggcuuccacuucugcaucuggaucaucuuccugcugcccccccccugcaagaagugccugagcccccccaccaugaaccugagaccccccaagagcugcggcaacguguucuacugggugcuggugcugaacagcggccugcuguacaaguucugccagaccaucaagugcagagccaacuggagacccgccagagcccccagaggcuggaacgaggccaccgagagacaccaggagagaagaacccagauggagaccgagaugggcggcaucagcaccaccuacuggcacagacugugcaccugcaccgacagaagagccgagaagcuggugauggacggcaacaacugcugguuccacaaguaa

SEQ ID NO: 14509 - RNA, 1317 nt, Artificial Sequence
  C7orf72__Homo_sapiens__NP_001155306
auggacguggagauccaggacacccccggcaagaucagcaucagcaagagaagcauccugagcggcaccguggagaacaucgacuacccccacuacugcgaccugcugagaaagaugaacaugcccuucgugaagggccuggagaacagacacaacuacggcagauucgagaagaagugcaaccccgccuuccugaaguuccaccccuacccccccagcgugcugcccgacuaccaccugcacgaccccuaccccccccccuacggcccccacuacccccuguucccccugagagacgacgugacccugggcgacagcugcagcggcuucaugagccccggcggcgacgccgaccugaaccccggcaucggcagaaccauccccacccugguggacuucagcgacgugaagccccagcacagagugcccagacccgacaccggcuuccagaccaccaucaagagacagaagauccugagcgaggagcugcagcagaacagaagauggaacagcagagaggugcccgacaucagcaucagagccagacugggcggcuggaccagcccccugaaggugaccccccugcagccccaccacgagggcagaagccugagccacaucuucaccuucgacgaggaggccaccugcaccgacgagggcgagccccuggugcagaccaacaagaagugcaacgccaaggacagcuucuacaagagcagcacccagaaggccuacgaggacgugcccugggacaagaugcugccccccaagcuggugcccgaggagaccacccuggagaaggccgccgaccccaucagccagugcuucacccugaagagauacaagggcgugcccgccaucacccagauggugggcgagcugugggacagauuccagaccagaagcuuccuggcccccgugaagcccaucaacuucgugagcagcagcagcagaagcaaguacaucccccuguacaccggccacgugcagagcaccaacgccgacgacguggacaacccccugggcgacaucgccagccuggccaagcagagauacagcaagccccuguacaccaacaccagcagagccgccaacauccccggcuacaccggcaaggugcacuucaccgccacccaccccgccaacagcaacauccccagcaccacccccagccccgacagcgagcugcacagaguguuccagaaggagauggccguggaccuguucagacaccaggccccccugagcagacuggugaccaccgugagacccuacaaccccuucaacaagaaggacaaggagaccaucgacuacuaa

SEQ ID NO: 14510 - RNA, 1122 nt, Artificial Sequence
  C8orf34__Homo_sapiens__NP_001182568
augagcagcccccuggccagcgagcugagcgagcuggccgcccugagacccggcuucagacugagcgccccccacgccagaguggcccccagagccgccacccacgccagaggcagaggcagagccagccacgccggccagcccagacugagaagcagcugccccggccccagccccggcaagagaagaguggugcccagcggcggcgcccagcccagagugcugcccgcccugagcagcagaagccaccuguuccccauggccagccacccccagaccagaauccaggccuaccuggagaagaacaagaucggcccccuguucgaggagcugaugaccaagcugaucaccgagacccccgaccagcccauccccuuccugaucgaccaccugcagagcaagcagggcaacagaggccagcugcagagaacccugagcggcagcgccgcccugugggccgagagcgagaagagcgagagcaagggcaccagaagagacuucagaagcuacgacaagcccuggcagcugaacgccaagaagcccaagaagagcaagagcgaccuggccgugagcaacaucagcccccccagccccgacagcaagagccugcccagaagcguggagcaccccaaguggaacuggagaaccaagccccagagcagagacuucgacgagcugaaccacauccugcaggagagcaagaagcugggcaaggcccuggagaaccugagcagaagcaucgccaucagcgacgagcuggacaaggagaccgugaccuucaacagcagccugcugagacccagagugaucggcgaguggaucggcagagaggagaacgacgccgacccccuggccgccgagaugcugcagccccccauccccagaagcaagaacgaccagugggagagcgaggacagcggcagcagccccgccggcagccugaagauggagcccaagaacaagggccugaagcagcagcagcagcagcacaagaagcugcuggccgccaugcugagccaggacagcuucgagagcauccacagccccacccccagcgugaccgaggaggacaucgacaacgaggacgacgccauggagcugcugggcaacuucaagaacuaa

SEQ ID NO: 14511 - RNA, 624 nt, Artificial Sequence
  C8orf37__Homo_sapiens__NP_808880
auggccgaggaccuggacgagcugcuggacgagguggagagcaaguucugcacccccgaccugcugagaagaggcaugguggagcagcccaagggcugcggcggcggcacccacagcagcgacagaaaccaggccaaggccaaggagacccugagaagcaccgagaccuucaagaaggaggacgaccuggacagccugaucaacgagauccuggaggagcccaaccuggacaagaagcccagcaagcugaagagcaagagcagcggcaacaccagcgugagagccagcaucgagggccugggcaagagcugcagccccguguaccugggcggcagcagcauccccugcggcaucggcaccaacaucagcuggagagccugcgaccaccugagaugcaucgccugcgacuuccugguggugagcuacgacgacuacaugugggacaagagcugcgacuaccuguucuucagaaacaacaugcccgaguuccacaagcugaaggccaagcugaucaagaagaagggcaccagagccuacgccugccagugcagcuggagaaccaucgaggaggugaccgaccugcagaccgaccaccagcugagaugggugugcggcaagcacuaa

SEQ ID NO: 14512 - RNA, 624 nt, Artificial Sequence
  C8orf46__Homo_sapiens__NP_689978
augaugcaccagaucuacagcugcagcgacgagaacaucgagguguucaccaccgugauccccagcaaggugagcagccccgccagaagaagagccaagagcagccagcaccugcugaccaagaacguggugaucgagagcgaccuguacacccaccagccccuggagcugcugccccacagaggcgacagaagagaccccggcgacagaagaagauucggcagacugcagaccgccagaccccccaccgcccaccccgccaaggccagcgccagacccgugggcaucagcgagcccaagaccagcaaccugugcggcaacagagccuacggcaagagccugaucccccccgugcccagaaucagcgugaagaccagcgccagcgccagccuggaggccaccgccaugggcaccgagaagggcgccgugcugaugagaggcagcagacaccugaagaagaugaccgaggaguaccccgcccugccccagggcgccgaggccagccugccccugaccggcagcgccagcugcggcgugcccggcauccugagaaagauguggaccagacacaagaagaagagcgaguacgugggcgccaccaacagcgccuucgaggccgacuaa

SEQ ID NO: 14513 - RNA, 960 nt, Artificial Sequence
  C8orf48__Homo_sapiens__NP_001007091
auggccaucugccccgagcuggcccagaccgacaagagcgcccuggccaaccugagcgacgagaccgagacccugaagaacuucaccgacgaggugcagaccagcagcagcuucagcagcagcggcggcagacagagcagcccccugaccagcggcagcaagcuggagagagagaagcagacccccagccuggagcagggcgacacccagagcgagcugcuggacuacaagaacuacgagaagaagcugagcaagaaguggaucaacuaccugaagcugaaggacagcaacuucgagagacaccagcccgacaccaagcugcccaccgagaucaccagagugagcgacgaggagcugaacgcccugcagagcuacugcaccaugaagaucaaccugauccacagaagaggcgacagcaagaagaagaccagcagcagacacaagaagcugcaccugggccuggacguggaggccagcgagagagacgccuucagcugcaccgugcccgacgagcugcugaacagaaucuacuucaagaacaugagaaccacccccaagcaggaggccgccgccaagcagcacaucagcuaccagugccccuacugcaacagaaagagagccgagcuggcccugagcgccuuccugaagcagaagaagacccugcuggagagcuuccugcugcaggagagaaucgacgagcaccugcacaccaaggacuuccugaccagaaucggcgaggcccaccaggacuuccccagacugagcgacgaccccagaaucaucuggaagagacugaccgagaagagccacaucagauacagcggcuucgagagaagcgagaccgagcagaagaugcagagagacggcaacagcgccugccaccugcccuucagccugcccuuccugaagagacugacccugaucaagcccgagcuggugaucgugaacgacaacguguaa

SEQ ID NO: 14514 - RNA, 321 nt, Artificial Sequence
  C8orf4__Homo_sapiens__NP_064515
augaaggccaagagaagccaccaggccaucaucaugagcaccagccugagagugagccccagcauccacggcuaccacuucgacaccgccagcagaaagaaggccgugggcaacaucuucgagaacaccgaccaggagagccuggagagacuguucagaaacagcggcgacaagaaggccgaggagagagccaagaucaucuucgccaucgaccaggacguggaggagaagaccagagcccugauggcccugaagaagagaaccaaggacaagcuguuccaguuccugaagcugagaaaguacagcaucaaggugcacuaa

SEQ ID NO: 14515 - RNA, 672 nt, Artificial Sequence
  C8orf86__Homo_sapiens__NP_997295
augagaccccugggcaagggccugcugcccgccgaggagcugaucagaagcaaccugggcgugggcagaagccugagagacugccugagccagagcggcaagcuggccgaggagcugggcagcaagagacugaagcccgccaaguucggcaccgagggcaaggagagaguggagcagagaaccgagagacagagaaccggcagcagcaaggagcccagaaugcagaucaucugcagaagaagauggagagagcccccccccagacugcuguggggcugccugaugcccagagcccagccccugcugcacgugaccgccuacgagaacaccggccacugggagagacuggccagcguggugagcagcaagacccagcagcccaccgugaucagccacagcagcaucagcaucaccuucagccacuacccccccgccacccuggacagcuuccuggugcuggagcccaucaagcuguuccccgugagcagccugagaagcccccugugccugaacugcggcagcugcagagagagcaucagaaucagcggcgagcugaucggcaacgcccacagccccgccccccccagaacccccgagcuggagacccugggcugggacaagcaggccgugcugagcggcgcccaggugauccuggugugcgccgagguguaa

SEQ ID NO: 14516 - RNA, 1680 nt, Artificial Sequence
  C9__Homo_sapiens__NP_001728
augagcgccugcagaagcuucgccguggccaucugcauccuggagaucagcauccugaccgcccaguacaccaccagcuacgaccccgagcugaccgagagcagcggcagcgccagccacaucgacugcagaaugagccccuggagcgaguggagccagugcgaccccugccugagacagauguucagaagcagaagcaucgagguguucggccaguucaacggcaagagaugcaccgacgccgugggcgacagaagacagugcgugcccaccgagcccugcgaggacgccgaggacgacugcggcaacgacuuccagugcagcaccggcagaugcaucaagaugagacugagaugcaacggcgacaacgacugcggcgacuucagcgacgaggacgacugcgagagcgagcccagaccccccugcagagacagagugguggaggagagcgagcuggccagaaccgccggcuacggcaucaacauccugggcauggacccccugagcacccccuucgacaacgaguucuacaacggccugugcaacagagacagagacggcaacacccugaccuacuacagaagacccuggaacguggccagccugaucuacgagaccaagggcgagaagaacuucagaaccgagcacuacgaggagcagaucgaggccuucaagagcaucauccaggagaagaccagcaacuucaacgccgccaucagccugaaguucacccccaccgagaccaacaaggccgagcagugcugcgaggagaccgccagcagcaucagccugcacggcaagggcagcuucagauucagcuacagcaagaacgagaccuaccagcuguuccugagcuacagcagcaagaaggagaagauguuccugcacgugaagggcgagauccaccugggcagauucgugaugagaaacagagacguggugcugaccaccaccuucguggacgacaucaaggcccugcccaccaccuacgagaagggcgaguacuucgccuuccuggagaccuacggcacccacuacagcagcagcggcagccugggcggccuguacgagcugaucuacgugcuggacaaggccagcaugaagagaaagggcguggagcugaaggacaucaagagaugccugggcuaccaccuggacgugagccuggccuucagcgagaucagcgugggcgccgaguucaacaaggacgacugcgugaagagaggcgagggcagagccgugaacaucaccagcgagaaccugaucgacgacguggugagccugaucagaggcggcaccagaaaguacgccuucgagcugaaggagaagcugcugagaggcaccgugaucgacgugaccgacuucgugaacugggccagcagcaucaacgacgcccccgugcugaucagccagaagcugagccccaucuacaaccuggugcccgugaagaugaagaacgcccaccugaagaagcagaaccuggagagagccaucgaggacuacaucaacgaguucagcgugagaaagugccacaccugccagaacggcggcaccgugauccugauggacggcaagugccugugcgccugccccuucaaguucgagggcaucgccugcgagaucagcaagcagaagaucagcgagggccugcccgcccuggaguuccccaacgagaaguaa

SEQ ID NO: 14517 - RNA, 699 nt, Artificial Sequence
  C9orf106__Homo_sapiens__NP_001012733
auggccuacguggcccugagcgacaagccccaccugagcggcgaggugggcgaggaggccugcagcagcuggaaccccccccuguucagccccagaccccugcccagacuguggccccugcccggcacccccuuccugcccaucagagcccugcccuucagcgccagcagcagcggcaagagcagccuggugcccagccccagcagcagcgcccacagcggcuucagaacccccugccugggccccgacugccugcugugcacccagggcugcgagcugcacgagggcagaaaccacauggccgugcacagcugcguggccagagccuggcccggcgacccccaggaggugagacaccugaacccccugcugugcgaccccggcagccagguggagcccagcuggcccuggcaccccggccuggagcaggccgccgccagcugggugggcaaccacgugagccccgcccacagacaggcccugagaggccacagccugggcagcgcccugagagcccugaugcccggcggccacugcccccugugcgugcccugcaagagaggcugcaaccugagaggcggcagaggcaagcacggccccagacccugcugcccccugcugagaaaguuccccgugcugcccgugcaccccuggcccuuccccugcgccgugugggacagcggcuggagcugcagauaa

SEQ ID NO: 14518 - RNA, 690 nt, Artificial Sequence
  C9orf135__Homo_sapiens__NP_001010940
auggacagccuggacagaagcugccaggacuggugcgacagaaagcagcacuggcuggagaucggcccccccgaccugguggagagaaagggcagccugacccugagaagccaccacaagaaguacagcaagcccgugcugguguacagcuggcacagagacagagaggccuuccccaagggcuacgacaucgagggccccgagaaggugaagaagcugugcaacagcaccuacagaagacugggcaccgacgagagccccaucuggaccagcgagacccacgagaagcugagccagaugugccugaacaccgaguggguggagaugaagagcaaggcccugcugaacgaggagaccgugagcagcggcaucaucgagagagugaccggccugcccgccaccggcuucggcgccguguuccccagacacccccccgacuggagcaagaugugcgcccugaccaccuacagcgaggacuacgugccccccuacgacuaccagccccacgccuaccccugccaggacgacuacagcaucgugcacagaaagugcagaagccaguucaccgaccugaacggcagcaagagauucggcaucaacaccuggcacgacgagagcggcaucuacgccaacagcgacgugaagcagaagcuguacccccugaccagcggccccaucgugcccaucuaa

SEQ ID NO: 14519 - RNA, 720 nt, Artificial Sequence
  C9orf152__Homo_sapiens__NP_001013011
auggagggccugcccugccccugccccgcccugccccacuucuggcagcugagaagccaccugauggccgagggcagcagaacccaggcccccggcaagggccccccccugagcauccaguuccugagagcccaguacgagggccugaagagacagcagagaacccaggcccaccugcuggugcugcccaagggcggcaacacccccgcccccgccgagagcauggugaacgccguguggaucaacaaggagagaagaagcagccugagccuggaggaggccgacagcgagguggagggcagacuggaggaggccgcccagggcugccugcaggcccccaagagccccuggcacacccaccuggagaugcacugccuggugcagaccagcccccaggacaccagccaccaggugcaccacagaggcaagcuggugggcagcgaccagagacugccccccgagggcgacacccaccuguucgagaccaaccagaugacccagcagggcaccggcauccccgaggccgcccagcugcccugccaggugggcaacacccagaccaaggccguggagagcggccugaaguucagcacccagugcccccugagcaucaagaacccccacagaagcggcaagcccgccuacuaccccuucccccagagaaagacccccagaaucagccaggccgccagaaaccugggccuguacggcagcgccuaa

SEQ ID NO: 14520 - RNA, 1326 nt, Artificial Sequence
  C9orf156__Homo_sapiens__NP_057565
augagaggccuggaggagagcggccccagacccaccgccacccccugcggcugcgugaagcccgcccuggagaccggcaaccugcugaccgagcccgugggcuaccuggagagcugcuucagcgccaagaacggcacccccagacagcccagcaucugcagcuacagcagagccugccugagaaucagaaagagaaucuucaacaaccccgagcacagccugaugggccuggagcaguucagccacguguggauccuguucguguuccacaagaacggccaccugagcugcaaggccaaggugcagccccccagacugaacggcgccaagaccggcguguucagcaccagaagcccccacagacccaacgccaucggccugacccuggccaagcuggagaagguggagggcggcgccaucuaccugagcggcaucgacaugauccacggcacccccgugcuggacaucaagcccuacaucgccgaguacgacagcccccagaacgugauggagccccuggccgacuucaaccugcagaacaaccagcacacccccaacaccgugagccagagcgacagcaagaccgacagcugcgaccagagacagcugagcggcugcgacgagccccagccccaccacagcaccaagagaaagcccaagugccccgaggacagaaccagcgaggagaacuaccugacccacagcgacaccgccagaauccagcaggccuuccccaugcacagagagaucgccguggacuucggccuggagagcagaagagaccagagcagcagcguggccgaggagcagaucggccccuacugccccgagaagagcuucagcgagaagggcaccgacaagaagcuggagagaguggagggcgccgccgugcugcagggcagcagagccgagacccagcccauggccccccacugccccgccggcagagccgacggcgcccccagaagcguggugcccgccugggugaccgaggcccccguggccacccuggaggugagauucaccccccacgccgagauggaccugggccagcugagcagccaggacgugggccaggccagcuucaaguacuuccagagcgccgaggaggccaagagagccaucgaggccgugcugagcgccgaccccagaagcguguacagaagaaagcugugccaggacagacuguucuacuucaccguggacaucgcccacgugaccugcugguucggcgacggcuucgccgaggugcugagaaucaagcccgccagcgagcccgugcacaugaccggccccgugggcagccuggugagccugggcagcuaa

SEQ ID NO: 14521 - RNA, 366 nt, Artificial Sequence
  C9orf170__Homo_sapiens__NP_001001709
auguggagcagaagaggccugggcgugagcagagccccccugcaccugcugcugggcguguggggccccagcggcagaaccggcggccagagaaagggcgccagccuggccagacccggcagaggcggccuggccagcugcagcgugggcgccaacggcaagagagacgugcuguuccugagaaagacccugaccaacaccguggaggacauccagaucgacaacuucagaagaaagagcgaccugggcgugggcagccccgacuggaagaaccugcugaucgacgugaccagagaggaccacgagaacagccagaacaacagcaagagaagaugcaaggugaacugcgagaccgaccagagauaa

SEQ ID NO: 14522 - RNA, 855 nt, Artificial Sequence
  C9orf171__Homo_sapiens__NP_001269886
augcccgaggccagaagcagcggccccgaccugaccagauggagaaagcagcagcagcccgugagaagaaccgugagccaggugugccccccccccagaagaccccugaccguggccgacaucagaagcggcauggagaacgagagacugggcguggugagagacagcauguuccagaacccccugaucgugaaggccgagcugggcaagcccagagagagaagcuacagccugcccggcaucaacuucaacuacggccuguacaucagaggccuggacggcggcgugcccgaggccaucggcagauggaacguguucaagcagcagcccaccugcccccacgagcugaccagaaacuacaucgccaugaacagaggcgccgugaaggccggccuggugaccgccagagagaaccugcuguacagacagcugaacgacaucagaaucagcgaccaggacgacagaagaaugaagaaggagccccccccccugccccccaacaugaccuucggcaucagagccagacccagcacccccuucuucgaccugcugcagcacagauaccugcagcugugggugcaggagcagaaggccacccagaaggccaucaagcuggagaagaagcagaagguggugcugggcaagcuguacgagaccagaagcagccagcugagaaaguacaagccccccgugaagcuggacacccuguggcacaugccccacuuccagaaggugggcagacaccuggacaccuuccccaccgaggccgacagacagagagcccugaaggcccacagagaggagugcgccgugagacagggcacccugagaaugggcaacuacacccaccccuaa

SEQ ID NO: 14523 - RNA, 1701 nt, Artificial Sequence
  C9orf3__Homo_sapiens__NP_001180260
auggacauccagcuggaccccgccagagacgaccugccccugauggccaacaccagccacauccuggugaagcacuacgugcuggaccuggacguggacuucgagagccaggugaucgagggcaccaucgugcuguuccuggaggacggcaacagauucaagaagcagaacagcagcaucgaggaggccugccagagcgagagcaacaaggccugcaaguucggcaugcccgagcccugccacauccccgugaccaacgccagaaccuucagcagcgagauggaguacaacgacuucgccaucugcagcaagggcgagaaggacaccagcgacaaggacggcaaccacgacaaccaggagcacgccagcggcaucagcagcagcaaguacugcugcgacaccggcaaccacggcagcgaggacuuccugcuggugcuggacugcugcgaccugagcgugcugaagguggaggagguggacguggccgccgugcccggccuggagaaguucaccagaagccccgagcugaccguggugagcgaggaguucagaaaccagaucgugagagagcuggugacccugcccgccaacagauggagagagcagcuggacuacuacgccagaugcagccaggcccccggcugcggcgagcugcuguucgacaccgacaccuggagccugcagaucagaaagaccggcgcccagaccgccaccgacuucccccacgccaucagaaucugguacaagaccaagcccgagggcagaagcgugaccuggaccagcgaccagagcggcagacccugcguguacaccgugggcagccccaucaacaacagagcccuguuccccugccaggagccccccguggccaugagcaccuggcaggccaccgugagagccgccgccagcuucguggugcugaugagcggcgagaacagcgccaagcccacccagcugugggaggagugcagcagcugguacuacuacgugaccaugcccaugcccgccagcaccuucaccaucgccgugggcugcuggaccgagaugaagauggagaccuggagcagcaacgaccuggccaccgagagacccuucagccccagcgaggccaacuucagacacgugggcgugugcagccacauggaguaccccugcagauuccagaacgccagcgccaccacccaggagaucaucccccacagaguguucgcccccgugugccugaccggcgccugccaggagacccugcugagacugaucccccccugccugagcgccgcccacagcgugcugggcgcccaccccuucagcagacuggacgugcugaucgugcccgccaacuuccccagccugggcauggccagcccccacaucauguuccugagccagagcauccugaccggcggcaaccaccugugcggcaccagacugugccacgagaucgcccacgccugguucggccuggccaucggcgccagagacuggaccgaggaguggcugagcgagggcuucgccacccaccuggaggacguguucugggccaccgcccagcagcuggcccccuacgaggccagagagcagcaggagcugagagccugccugagauggagaagacugcaggacgagaugcagugcagccccgaggagaugcaggugcugagauucccccacgugggcggcugcagcggcagcuucagcuaa

SEQ ID NO: 14524 - RNA, 1386 nt, Artificial Sequence
  C9orf43__Homo_sapiens__NP_001265558
auggaccugcccgacgagagccagugggacgagaccaccugcggccuggccgugugccagcacccccagugcugggccaccaucagaagaaucgagagaggccaccccagaauccugggcagcagcugcaagaccccccuggacgccgaggacaagcugcccgugcugaccgugguggacauccuggacagcggcuucgccgcccaccaccugcccgagugcaccuucaccaaggcccacagccugcugagccagagcagcaaguucuacagcaaguuccacggcagaccccccaagggccugcccgacaagagccugaucaacugcaccaacagacugcccaaguuccccgugcugaaccugaacgagacccagcugcccugccccgaggacgugagaaacaugguggugcuguggauccccgaggagaccgagauccacgugagccagcacggcaagaagaagagaaagaacagcgccgugaagagcaagagcuuccugggccugagcggcaaccagagcgccggcaccagagugggcacccccggcaugaucgugcccccccccacccccgugcagcugagcgagcaguucagcagcgacuuccugccccugugggcccagagcgaggcccugccccaggaccugcugaaggagcugcugcccggcggcaagcagaccaugcugugccccgagaugaagaucaagcuggccaugaugaagaagaaccugccccuggagaagaacagacccgacagcgugaucagcagcaagauguuccugagcauccacagacugacccuggagagacccgcccugagauaccccgagagacugaagaagcugcacaaccugaagaccgagggcuacagaaagcagcagcagagacagcagcagcagcagcagcagcagaagaaggugaagacccccaucaagaagcaggaggccaagaagaaggccaagagcgaccccggcauccagagcaccagccacaagcaccccgugaccaccgugcacgacagacuguacggcuacagaacccugcccggccagaacagcgacaugaagcagcagcagcagauggagaagggcaccaccagcaagcaggacagcaccgagagacccaagaugaacuacuacgaccacgccgacuuccaccacagcgugaagagccccgagcuguacgagaccgagcccaccaacaaggacaucagcgcccccguggacgccgugcccgaggcccaggccgccagacagaagaagaucagcuucaacuucagcgagaucauggccagcaccggcuggaacagcgagcugaagcugcugagaauccugcaggacaccgacgacgaggacgaggaggaccagagcagcggcgccgaguaa

SEQ ID NO: 14525 - RNA, 888 nt, Artificial Sequence
  C9orf66__Homo_sapiens__NP_689782
augagacacagcguggccagacccaccagacugcccagaagacugagccccuucugggaccccgccaccugcaagaaccuggagggcggcgccggcgagguggugagaggcagagaccccagaagacugagaaccagcagaagcaccgagauccugggcgaggaccuggccggccccagcgccggcgccgccgccagacccgccgccccccccccccagcccagagagcccggcgcccccggccugagaagagccccccccagaaccagaauggacagcagcggccugggccccugcagcgaggccccccugcacaccagcgccggccugagcggcagaaaccugagagccgccggcggcgugcugcccguggaccuggagagagagagagccgcccugugcgccagacagagcggccacggcccccccgccgugagauggcugcugggcagcagaggcgccgagagcggcggccuggccagaagaagaguggccgccgagcacgcccagcccagcgccaaccuggugugcagaagcgcccuggagaccagcgccuucccccccagcaagcccaagagccccagaggcagagugagagccagaagcagcgacggcagacugagacaccccgccuggagagccggcagcggcggcagaggcggcagaggccccagcgccgagcuggccagcagauacuggggcagaagaagagcccugcccggcgccgccgaccugagacccaagggcgccagagccgacgacagaagaccccugagagccggcagaaagcugcaccugcccgaggccgccagacugcccggcaacgugggcaagagcggcgagccccacaaggccggcgaggugggcaaccaccccagagacagcuaa

SEQ ID NO: 14526 - RNA, 1446 nt, Artificial Sequence
  C9orf72__Homo_sapiens__NP_060795
augagcacccugugccccccccccagccccgccguggccaagaccgagaucgcccugagcggcaagagcccccugcuggccgccaccuucgccuacugggacaacauccugggccccagagugagacacaucugggcccccaagaccgagcaggugcugcugagcgacggcgagaucaccuuccuggccaaccacacccugaacggcgagauccugagaaacgccgagagcggcgccaucgacgugaaguucuucgugcugagcgagaagggcgugaucaucgugagccugaucuucgacggcaacuggaacggcgacagaagcaccuacggccugagcaucauccugccccagaccgagcugagcuucuaccugccccugcacagagugugcguggacagacugacccacaucaucagaaagggcagaaucuggaugcacaaggagagacaggagaacgugcagaagaucauccuggagggcaccgagagaauggaggaccagggccagagcaucauccccaugcugaccggcgaggugauccccgugauggagcugcugagcagcaugaagagccacagcgugcccgaggagaucgacaucgccgacaccgugcugaacgacgacgacaucggcgacagcugccacgagggcuuccugcugaacgccaucagcagccaccugcagaccugcggcugcagcgugguggugggcagcagcgccgagaaggugaacaagaucgugagaacccugugccuguuccugacccccgccgagagaaagugcagcagacugugcgaggccgagagcagcuucaaguacgagagcggccuguucgugcagggccugcugaaggacagcaccggcagcuucgugcugcccuucagacaggugauguacgcccccuaccccaccacccacaucgacguggacgugaacaccgugaagcagaugccccccugccacgagcacaucuacaaccagagaagauacaugagaagcgagcugaccgccuucuggagagccaccagcgaggaggacauggcccaggacaccaucaucuacaccgacgagagcuucacccccgaccugaacaucuuccaggacgugcugcacagagacacccuggugaaggccuuccuggaccagguguuccagcugaagcccggccugagccugagaagcaccuuccuggcccaguuccugcuggugcugcacagaaaggcccugacccugaucaaguacaucgaggacgacacccagaagggcaagaagcccuucaagagccugagaaaccugaagaucgaccuggaccugaccgccgagggcgaccugaacaucaucauggcccuggccgagaagaucaagcccggccugcacagcuucaucuucggcagacccuucuacaccagcgugcaggagagagacgugcugaugaccuucuaa

SEQ ID NO: 14527 - RNA, 474 nt, Artificial Sequence
  C9orf85__Homo_sapiens__NP_872311
augagcagccagaagggcaacguggccagaagcagaccccagaagcaccagaacaccuucagcuucaagaacgacaaguucgacaagagcgugcagaccaagaagaucaacgccaagcugcacgacggcgugugccagagaugcaaggaggugcuggaguggagagugaaguacagcaaguacaagccccugagcaagcccaagaagugcgugaagugccugcagaagaccgugaaggacagcuaccacaucaugugcagacccugcgccugcgagcuggaggugugcgccaagugcggcaagaaggaggacaucgugaucccccugaacaaggagaccgagaagaucgagcacaccgagaacaaccugagcagcaaccacagaagaagcugcagaagaaacgaggagagcgacgacgaccuggacuucgacaucgaccuggaggacaccggcggcgaccaccagaugaacuaa

SEQ ID NO: 14528 - RNA, 1029 nt, Artificial Sequence
  C9orf91__Homo_sapiens__NP_694590
auggccugcgagccccagguggaccccggcgccaccggcccccugccccccagcagccccggcuggagcgcccugcccggcggcagcccccccggcuggggccaggagcugcacaacggccaggugcugaccgugcugagaaucgacaacaccugcgcccccaucagcuucgaccugggcgccgccgaggagcagcugcagaccuggggcauccaggugcccgccgaccaguacagaagccuggccgagagcgcccugcuggagccccaggugagaagauacaucaucuacaacagcagacccaugagacuggccuucgccgugguguucuacgugguggugugggccaacaucuacagcaccagccagauguucgcccugggcaaccacugggccggcaugcugcuggugacccuggccgccgugagccugacccugacccuggugcugguguucgagagacaccagaagaaggccaacaccaacaccgaccugagacuggccgccgccaacggcgcccugcugagacacagagugcugcugggcgugaccgacaccguggagggcugccagagcgugauccagcugugguucguguacuucgaccuggagaacugcgugcaguuccugagcgaccacgugcaggagaugaagaccagccaggagagccugcugagaagcagacugagccagcugugcguggugauggagaccggcgugagccccgccaccgccgagggccccgagaaccuggaggacgccccccugcugcccggcaacagcugccccaacgagagaccccugaugcagaccgagcugcaccagcuggugcccgaggccgagcccgaggagauggccagacagcugcuggccguguucggcggcuacuacaucagacugcuggugaccagccagcugccccaggccaugggcaccagacacaccaacagccccagaauccccugccccugccagcugaucgaggccuacauccugggcaccggcugcugccccuuccuggccagauaa

SEQ ID NO: 14529 - RNA, 507 nt, Artificial Sequence
  C9orf9__Homo_sapiens__NP_061829
augaacgaggugaaggagagccugagaagcaucgagcagaaguacaagcuguuccagcagcagcagcugaccuucaccgccgcccuggagcacugcagagagaacgcccacgacaagaucagacccaucagcagcaucggccaggugcagagcuacauggagcacuacugcaacagcagcaccgacagaagagugcugcugauguuccuggacaucugcagcgagcugaacaagcugugccagcacuucgaggccgugcacagcggcacccccgugaccaacaaccugcuggagaagugcaagacccuggugagccagagcaacgaccugagcagccugagagccaaguacccccacgacguggugaaccaccugagcugcgacgaggccagaaaccacuacggcggcguggugagccugaucccccugauccuggaccugaugaaggaguggaucgcccacagcgagaagcugcccagaaaggugcugcagcacggcaccaccuaa

SEQ ID NO: 14530 - RNA, 987 nt, Artificial Sequence
  CA10__Homo_sapiens__NP_001076003
auggagaucgugugggaggugcuguuccugcugcaggccaacuucaucgugugcaucagcgcccagcagaacagccccaagauccacgagggcuggugggccuacaaggagguggugcagggcagcuucgugcccgugcccagcuucuggggccuggugaacagcgccuggaaccugugcagcgugggcaagagacagagccccgugaacaucgagaccagccacaugaucuucgaccccuuccugaccccccugagaaucaacaccggcggcagaaaggugagcggcaccauguacaacaccggcagacacgugagccugagacuggacaaggagcaccuggugaacaucagcggcggccccaugaccuacagccacagacuggaggagaucagacugcacuucggcagcgaggacagccagggcagcgagcaccugcugaacggccaggccuucagcggcgaggugcagcugauccacuacaaccacgagcuguacaccaacgugaccgaggccgccaagagccccaacggccuggugguggugagcaucuucaucaaggugagcgacagcagcaaccccuuccugaacagaaugcugaacagagacaccaucaccagaaucaccuacaagaacgacgccuaccugcugcagggccugaacaucgaggagcuguaccccgagaccagcagcuucaucaccuacgacggcagcaugaccaucccccccugcuacgagaccgccagcuggaucaucaugaacaagcccguguacaucaccagaaugcagaugcacagccugagacugcugagccagaaccagcccagccagaucuuccugagcaugagcgacaacuucagacccgugcagccccugaacaacagaugcaucagaaccaacaucaacuucagccugcagggcaaggacugccccaacaacagagcccagaagcugcaguacagagugaacgaguggcugcugaaguaa

SEQ ID NO: 14531 - RNA, 987 nt, Artificial Sequence
  CA11__Homo_sapiens__NP_001208
augggcgccgccgccagacugagcgcccccagagcccuggugcugugggccgcccugggcgccgccgcccacaucggccccgcccccgaccccgaggacugguggagcuacaaggacaaccugcagggcaacuucgugcccggcccccccuucuggggccuggugaacgccgccuggagccugugcgccgugggcaagagacagagccccguggacguggagcugaagagagugcuguacgaccccuuccugcccccccugagacugagcaccggcggcgagaagcugagaggcacccuguacaacaccggcagacacgugagcuuccugcccgcccccagacccguggugaacgugagcggcggcccccugcuguacagccacagacugagcgagcugagacugcuguucggcgccagagacggcgccggcagcgagcaccagaucaaccaccagggcuucagcgccgaggugcagcugauccacuucaaccaggagcuguacggcaacuucagcgccgccagcagaggccccaacggccuggccauccugagccuguucgugaacguggccagcaccagcaaccccuuccugagcagacugcugaacagagacaccaucaccagaaucagcuacaagaacgacgccuacuuccugcaggaccugagccuggagcugcuguuccccgagagcuucggcuucaucaccuaccagggcagccugagcaccccccccugcagcgagaccgugaccuggauccugaucgacagagcccugaacaucaccagccugcagaugcacagccugagacugcugagccagaacccccccagccagaucuuccagagccugagcggcaacagcagaccccugcagccccuggcccacagagcccugagaggcaacagagaccccagacaccccgagagaagaugcagaggccccaacuacagacugcacguggacggcgugccccacggcagauaa

SEQ ID NO: 14532 - RNA, 1065 nt, Artificial Sequence
  CA12__Homo_sapiens__NP_001209
augcccagaagaagccugcacgccgccgccgugcugcugcuggugauccugaaggagcagcccagcagccccgcccccgugaacggcagcaaguggaccuacuucggccccgacggcgagaacagcuggagcaagaaguaccccagcugcggcggccugcugcagagccccaucgaccugcacagcgacauccugcaguacgacgccagccugaccccccuggaguuccagggcuacaaccugagcgccaacaagcaguuccugcugaccaacaacggccacagcgugaagcugaaccugcccagcgacaugcacauccagggccugcagagcagauacagcgccacccagcugcaccugcacuggggcaaccccaacgacccccacggcagcgagcacaccgugagcggccagcacuucgccgccgagcugcacaucgugcacuacaacagcgaccuguaccccgacgccagcaccgccagcaacaagagcgagggccuggccgugcuggccgugcugaucgagaugggcagcuucaaccccagcuacgacaagaucuucagccaccugcagcacgugaaguacaagggccaggaggccuucgugcccggcuucaacaucgaggagcugcugcccgagagaaccgccgaguacuacagauacagaggcagccugaccaccccccccugcaaccccaccgugcuguggaccguguucagaaaccccgugcagaucagccaggagcagcugcuggcccuggagaccgcccuguacugcacccacauggacgaccccagccccagagagaugaucaacaacuucagacaggugcagaaguucgacgagagacugguguacaccagcuucagccaggugcaggugugcaccgccgccggccugagccugggcaucauccugagccuggcccuggccggcauccugggcaucugcaucguggugguggugagcaucuggcuguucagaagaaagagcaucaagaagggcgacaacaagggcgugaucuacaagcccgccaccaagauggagaccgaggcccacgccuaa

SEQ ID NO: 14533 - RNA, 789 nt, Artificial Sequence
  CA13__Homo_sapiens__NP_940986
augagcagacugagcuggggcuacagagagcacaacggccccauccacuggaaggaguucuuccccaucgccgacggcgaccagcagagccccaucgagaucaagaccaaggaggugaaguacgacagcagccugagaccccugagcaucaaguacgaccccagcagcgccaagaucaucagcaacagcggccacagcuucaacguggacuucgacgacaccgagaacaagagcgugcugagaggcggcccccugaccggcagcuacagacugagacaggugcaccugcacuggggcagcgccgacgaccacggcagcgagcacaucguggacggcgugagcuacgccgccgagcugcacguggugcacuggaacagcgacaaguaccccagcuucguggaggccgcccacgagcccgacggccuggccgugcugggcguguuccugcagaucggcgagcccaacagccagcugcagaagaucaccgacacccuggacagcaucaaggagaagggcaagcagaccagauucaccaacuucgaccugcugagccugcugccccccagcugggacuacuggaccuaccccggcagccugaccgugcccccccugcuggagagcgugaccuggaucgugcugaagcagcccaucaacaucagcagccagcagcuggccaaguucagaagccugcugugcaccgccgagggcgaggccgccgccuuccuggugagcaaccacagacccccccagccccugaagggcagaaaggugagagccagcuuccacuaa

SEQ ID NO: 14534 - RNA, 786 nt, Artificial Sequence
  CA1__Homo_sapiens__XP_011515886
auggccagccccgacuggggcuacgacgacaagaacggccccgagcaguggagcaagcuguaccccaucgccaacggcaacaaccagagccccguggacaucaagaccagcgagaccaagcacgacaccagccugaagcccaucagcgugagcuacaaccccgccaccgccaaggagaucaucaacgugggccacagcuuccacgugaacuucgaggacaacgacaacagaagcgugcugaagggcggccccuucagcgacagcuacagacuguuccaguuccacuuccacuggggcagcaccaacgagcacggcagcgagcacaccguggacggcgugaaguacagcgccgagcugcacguggcccacuggaacagcgccaaguacagcagccuggccgaggccgccagcaaggccgacggccuggccgugaucggcgugcugaugaaggugggcgaggccaaccccaagcugcagaaggugcuggacgcccugcaggccaucaagaccaagggcaagagagcccccuucaccaacuucgaccccagcacccugcugcccagcagccuggacuucuggaccuaccccggcagccugacccaccccccccuguacgagagcgugaccuggaucaucugcaaggagagcaucagcgugagcagcgagcagcuggcccaguucagaagccugcugagcaacguggagggcgacaacgccgugcccaugcagcacaacaacagacccacccagccccugaagggcagaaccgugagagccagcuucuaa

SEQ ID NO: 14535 - RNA, 783 nt, Artificial Sequence
  CA2__Homo_sapiens__NP_000058
augagccaccacuggggcuacggcaagcacaacggccccgagcacuggcacaaggacuuccccaucgccaagggcgagagacagagccccguggacaucgacacccacaccgccaaguacgaccccagccugaagccccugagcgugagcuacgaccaggccaccagccugagaauccugaacaacggccacgccuucaacguggaguucgacgacagccaggacaaggccgugcugaagggcggcccccuggacggcaccuacagacugauccaguuccacuuccacuggggcagccuggacggccagggcagcgagcacaccguggacaagaagaaguacgccgccgagcugcaccuggugcacuggaacaccaaguacggcgacuucggcaaggccgugcagcagcccgacggccuggccgugcugggcaucuuccugaaggugggcagcgccaagcccggccugcagaaggugguggacgugcuggacagcaucaagaccaagggcaagagcgccgacuucaccaacuucgaccccagaggccugcugcccgagagccuggacuacuggaccuaccccggcagccugaccacccccccccugcuggagugcgugaccuggaucgugcugaaggagcccaucagcgugagcagcgagcaggugcugaaguucagaaagcugaacuucaacggcgagggcgagcccgaggagcugaugguggacaacuggagacccgcccagccccugaagaacagacagaucaaggccagcuucaaguaa

SEQ ID NO: 14536 - RNA, 783 nt, Artificial Sequence
  CA3__Homo_sapiens__NP_005172
auggccaaggaguggggcuacgccagccacaacggccccgaccacuggcacgagcuguuccccaacgccaagggcgagaaccagagccccguggagcugcacaccaaggacaucagacacgaccccagccugcagcccuggagcgugagcuacgacggcggcagcgccaagaccauccugaacaacggcaagaccugcagagugguguucgacgacaccuacgacagaagcaugcugagaggcggcccccugcccggccccuacagacugagacaguuccaccugcacuggggcagcagcgacgaccacggcagcgagcacaccguggacggcgugaaguacgccgccgagcugcaccuggugcacuggaaccccaaguacaacaccuucaaggaggcccugaagcagagagacggcaucgccgugaucggcaucuuccugaagaucggccacgagaacggcgaguuccagaucuuccuggacgcccuggacaagaucaagaccaagggcaaggaggcccccuucaccaaguucgaccccagcugccuguuccccgccugcagagacuacuggaccuaccagggcagcuucaccaccccccccugcgaggagugcaucguguggcugcugcugaaggagcccaugaccgugagcagcgaccagauggccaagcugagaagccugcugagcagcgccgagaacgagccccccgugccccuggugagcaacuggagacccccccagcccaucaacaacagaguggugagagccagcuucaaguaa

SEQ ID NO: 14537 - RNA, 939 nt, Artificial Sequence
  CA4__Homo_sapiens__NP_000708
augagaaugcugcuggcccugcuggcccugagcgccgccagacccagcgccagcgccgagagccacuggugcuacgaggugcaggccgagagcagcaacuaccccugccuggugcccgugaaguggggcggcaacugccagaaggacagacagagccccaucaacaucgugaccaccaaggccaagguggacaagaagcugggcagauucuucuucagcggcuacgacaagaagcagaccuggaccgugcagaacaacggccacagcgugaugaugcugcuggagaacaaggccagcaucagcggcggcggccugcccgcccccuaccaggccaagcagcugcaccugcacuggagcgaccugcccuacaagggcagcgagcacagccuggacggcgagcacuucgccauggagaugcacaucgugcacgagaaggagaagggcaccagcagaaacgugaaggaggcccaggaccccgaggacgagaucgccgugcuggccuuccugguggaggccggcacccaggugaacgagggcuuccagccccugguggaggcccugagcaacauccccaagcccgagaugagcaccaccauggccgagagcagccugcuggaccugcugcccaaggaggagaagcugagacacuacuucagauaccugggcagccugaccacccccaccugcgacgagaaggugguguggaccguguucagagagcccauccagcugcacagagagcagauccuggccuucagccagaagcuguacuacgacaaggagcagaccgugagcaugaaggacaacgugagaccccugcagcagcugggccagagaaccgugaucaagagcggcgcccccggcagaccccugcccugggcccugcccgcccugcugggccccaugcuggccugccugcuggccggcuuccugagauaa

SEQ ID NO: 14538 - RNA, 918 nt, Artificial Sequence
  CA5A__Homo_sapiens__NP_001730
augcugggcagaaacaccuggaagaccagcgccuucagcuuccugguggagcagaugugggccccccuguggagcagaagcaugagacccggcagauggugcagccagagaagcugcgccuggcagaccagcaacaacacccugcacccccuguggaccgugcccgugagcgugcccggcggcaccagacagagccccaucaacauccaguggagagacagcguguacgacccccagcugaagccccugagagugagcuacgaggccgccagcugccuguacaucuggaacaccggcuaccuguuccagguggaguucgacgacgccaccgaggccagcggcaucagcggcggcccccuggagaaccacuacagacugaagcaguuccacuuccacuggggcgccgugaacgagggcggcagcgagcacaccguggacggccacgccuaccccgccgagcugcaccuggugcacuggaacagcgugaaguaccagaacuacaaggaggccguggugggcgagaacggccuggccgugaucggcguguuccugaagcugggcgcccaccaccagacccugcagagacugguggacauccugcccgagaucaagcacaaggacgccagagccgccaugagacccuucgaccccagcacccugcugcccaccugcugggacuacuggaccuacgccggcagccugaccacccccccccugaccgagagcgugaccuggaucauccagaaggagcccguggagguggcccccagccagcugagcgccuucagaacccugcuguucagcgcccugggcgaggaggagaagaugauggugaacaacuacagaccccugcagccccugaugaacagaaaggugugggccagcuuccaggccaccaacgagggcaccagaagcuaa

SEQ ID NO: 14539 - RNA, 885 nt, Artificial Sequence
  CA6__Homo_sapiens__XP_011540385
augugcagcaccaugagagcccuggugcugcugcugagccuguuccugcugggcggccaggcccagcacgugagcgacuggaccuacagcgagggcgcccuggacgaggcccacuggccccagcacuaccccgccugcggcggccagagacagagccccaucaaccugcagagaaccaaggugagauacaaccccagccugaagggccugaacaugaccggcuacgagacccaggccggcgaguuccccauggugaacaacggccacaccgugcagaucagccugcccagcaccaugagaaugaccguggccgacggcaccguguacaucgcccagcagaugcacuuccacuggggcggcgccagcagcgagaucagcggcagcgagcacaccguggacggcaucagacacgugaucgagauccacaucgugcacuacaacagcaaguacaagagcuacgacaucgcccaggacgcccccgacggccuggccgugcuggccgccuucguggaggugaagaacuaccccgagaacaccuacuacagcaacuucaucagccaccuggccaacaucaaguaccccggccagagaaccacccugaccggccuggacgugcaggacaugcugcccagaaaccugcagcacuacuacaccuaccacggcagccugaccaccccccccugcaccgagaacgugcacugguucgugcuggccgacuucgugaagcugagcagaacccagguguggaagcuggagaacagccugcuggaccacagaaacaagaccauccacaacgacuacagaagaacccagccccugaaccacagagugguggagagcaacuuccccaaccaggagaacugcauccccgccggccugaucuaa

SEQ ID NO: 14540 - RNA, 873 nt, Artificial Sequence
  CA8__Homo_sapiens__NP_004047
auggccgaccugagcuucaucgaggacaccguggccuuccccgagaaggaggaggacgaggaggaggaggaggagggcguggaguggggcuacgaggagggcguggaguggggccugguguuccccgacgccaacggcgaguaccagagccccaucaaccugaacagcagagaggccagauacgaccccagccugcuggacgugagacugagccccaacuacguggugugcagagacugcgaggugaccaacgacggccacaccauccaggugauccugaagagcaagagcgugcugagcggcggcccccugccccagggccacgaguucgagcuguacgaggugagauuccacuggggcagagagaaccagagaggcagcgagcacaccgugaacuucaaggccuuccccauggagcugcaccugauccacuggaacagcacccuguucggcagcaucgacgaggccgugggcaagccccacggcaucgccaucaucgcccuguucgugcagaucggcaaggagcacgugggccugaaggccgugaccgagauccugcaggacauccaguacaagggcaagagcaagaccauccccugcuucaaccccaacacccugcugcccgacccccugcugagagacuacuggguguacgagggcagccugaccaucccccccugcagcgagggcgugaccuggauccuguucagauacccccugaccaucagccagcugcagaucgaggaguucagaagacugagaacccacgugaagggcgccgagcugguggagggcugcgacggcauccugggcgacaacuucagacccacccagccccugagcgacagagugaucagagccgccuuccaguaa

SEQ ID NO: 14541 - RNA, 1026 nt, Artificial Sequence
  CAB39__Homo_sapiens__NP_001124322
augcccuuccccuucggcaagagccacaagagccccgccgacaucgugaagaaccugaaggagagcauggccgugcuggagaagcaggacaucagcgacaagaaggccgagaaggccaccgaggaggugagcaagaaccugguggccaugaaggagauccuguacggcaccaacgagaaggagccccagaccgaggccguggcccagcuggcccaggagcuguacaacagcggccugcugagcacccugguggccgaccugcagcugaucgacuucgagggcaagaaggacguggcccagaucuucaacaacauccugagaagacagaucggcaccagaacccccaccguggaguacaucugcacccagcagaacauccuguucaugcugcugaagggcuacgagagccccgagaucgcccugaacugcggcaucaugcugagagagugcaucagacacgagccccuggccaagaucauccuguggagcgagcaguucuacgacuucuucagauacguggagaugagcaccuucgacaucgccagcgacgccuucgccaccuucaaggaccugcugaccagacacaagcugcugagcgccgaguuccuggagcagcacuacgacagauucuucagcgaguacgagaagcugcugcacagcgagaacuacgugaccaagagacagagccugaagcugcugggcgagcugcugcuggacagacacaacuucaccaucaugaccaaguacaucagcaagcccgagaaccugaagcugaugaugaaccugcugagagacaagagcagaaacauccaguucgaggccuuccacguguucaagguguucguggccaaccccaacaagacccagcccauccuggacauccugcugaagaaccaggccaagcugaucgaguuccugagcaaguuccagaacgacagaaccgaggacgagcaguucaacgacgagaagaccuaccuggugaagcagaucagagaccugaagagacccgcccagcaggaggccuaa

SEQ ID NO: 14542 - RNA, 1014 nt, Artificial Sequence
  CAB39L__Homo_sapiens__NP_001274268
augaagaagaugccccuguucagcaagagccacaagaaccccgccgagaucgugaagauccugaaggacaaccuggccauccuggagaagcaggacaagaagaccgacaaggccagcgaggaggugagcaagagccugcaggccaugaaggagauccugugcggcaccaacgagaaggagccccccaccgaggccguggcccagcuggcccaggagcuguacagcagcggccugcuggugacccugaucgccgaccugcagcugaucgacuucgagggcaagaaggacgugacccagaucuucaacaacauccugagaagacagaucggcaccagaagccccaccguggaguacaucagcgcccacccccacauccuguucaugcugcugaagggcuacgaggccccccagaucgcccugagaugcggcaucaugcugagagagugcaucagacacgagccccuggccaagaucauccuguucagcaaccaguucagagacuucuucaaguacguggagcugagcaccuucgacaucgccagcgacgccuucgccaccuucaaggaccugcugaccagacacaaggugcugguggccgacuuccuggagcagaacuacgacaccaucuucgaggacuacgagaagcugcugcagagcgagaacuacgugaccaagagacagagccugaagcugcugggcgagcugauccuggacagacacaacuucgccaucaugaccaaguacaucagcaagcccgagaaccugaagcugaugaugaaccugcugagagacaagagccccaacauccaguucgaggccuuccacguguucaagguguucguggccagcccccacaagacccagcccaucguggagauccugcugaagaaccagcccaagcugaucgaguuccugagcagcuuccagaaggagagaaccgacgacgagcaguucgccgacgagaagaacuaccugaucaagcagaucagagaccugaagaagaccgcccccuaa

SEQ ID NO: 14543 - RNA, 6663 nt, Artificial Sequence
  CABIN1__Homo_sapiens__NP_036427
augaucagaaucgccgcccugaacgccagcagcaccaucgaggacgaccacgagggcagcuucaagagccacaagacccagaccaaggaggcccaggaggccgaggccuucgcccuguaccacaaggcccuggaccugcagaagcacgacagauucgaggagagcgccaaggccuaccacgagcugcuggaggccagccugcugagagaggccgugagcagcggcgacgagaaggagggccugaagcaccccggccugauccugaaguacagcaccuacaagaaccuggcccagcuggccgcccagagagaggaccuggagaccgccauggaguucuaccuggaggccgugaugcuggacagcaccgacgugaaccugugguacaagaucggccacguggcccugagacugaucagaaucccccuggccagacacgccuucgaggagggccugagaugcaaccccgaccacuggcccugccuggacaaccugaucaccgugcuguacacccugagcgacuacaccaccugccuguacuucaucugcaaggcccuggagaaggacugcagauacagcaagggccuggugcugaaggagaagaucuucgaggagcagcccugccugagaaaggacagccugagaauguuccugaagugcgacaugagcauccacgacgugagcgugagcgccgccgagacccaggccaucguggacgaggcccugggccugagaaagaagagacaggcccugaucgugagagagaaggagcccgaccugaagcuggugcagcccauccccuucuucaccuggaagugccugggcgagagccugcuggccauguacaaccaccugaccaccugcgagccccccagacccagccugggcaagagaaucgaccugagcgacuaccaggaccccagccagccccuggagagcagcaugguggugacccccgugaacgugauccagcccagcaccgugagcaccaaccccgccguggccguggccgagcccguggugagcuacaccagcguggccaccaccagcuucccccugcacagccccggccugcuggagaccggcgcccccgugggcgacaucagcggcggcgacaagagcaagaagggcgugaagagaaagaagaucagcgaggagagcggcgagaccgccaagagaagaagcgccagagugagaaacaccaagugcaagaaggaggagaagguggacuuccaggagcugcugaugaaguuccugcccagcagacugagaaagcuggaccccgaggaggaggacgacagcuucaacaacuacgaggugcagagcgaggccaagcuggagagcuuccccagcaucggcccccagagacugagcuucgacagcgccaccuucauggagagcgagaagcaggacgugcacgaguuccugcuggagaaccugaccaacggcggcauccuggagcugaugaugagauaccugaaggccaugggccacaaguuccuggugagauggccccccggccuggccgagguggugcugagcguguaccacagcuggagaagacacagcaccagccugcccaacccccugcugagagacugcagcaacaagcacaucaaggacaugaugcugaugagccugagcugcauggagcugcagcuggaccaguggcugcugaccaagggcagaagcagcgccgugagccccagaaacugccccgccggcauggugaacggcagauucggccccgacuuccccggcacccacugccugggcgaccugcugcagcugagcuucgccagcagccagagagaccuguucgaggacggcuggcuggaguucguggugagaguguacuggcugaaggccagauuccuggcccugcagggcgacauggagcaggcccuggagaacuacgacaucugcaccgagaugcugcagagcagcaccgccauccagguggaggccggcgccgagagaagagacaucgugaucagacugcccaaccugcacaacgacagcguggugagccuggaggagaucgacaagaaccugaagagccuggagagaugccagagccuggaggagauccagagacuguacgaggccggcgacuacaaggccguggugcaccugcugagacccacccugugcaccagcggcuucgacagagccaagcaccuggaguucaugaccagcauccccgagagacccgcccagcugcugcugcugcaggacagccugcugagacugaaggacuacagacagugcuucgagugcagcgacguggcccugaacgaggccgugcagcagauggugaacagcggcgaggccgccgccaaggaggaguggguggccaccgugacccagcugcugaugggcaucgagcaggcccugagcgccgacagcagcggcagcauccugaaggugagcagcagcaccaccggccuggugagacugaccaacaaccugauccaggugaucgacugcagcauggccgugcaggaggaggccaaggagccccacgugagcagcgugcugcccuggaucauccugcacagaaucaucuggcaggaggaggacaccuuccacagccugugccaccagcagcagcugcagaaccccgccgaggagggcaugagcgagacccccaugcugcccagcagccugaugcugcugaacaccgcccacgaguaccugggcagaagaagcuggugcugcaacagcgacggcgcccugcugagauucuacgugagagugcugcagaaggagcuggccgccagcaccagcgaggacacccaccccuacaaggaggagcuggagaccgcccuggagcagugcuucuacugccuguacagcuuccccagcaagaagagcaaggccagauaccuggaggagcacagcgcccagcagguggaccugaucugggaggacgcccuguucauguucgaguacuucaagcccaagacccugcccgaguucgacagcuacaagaccagcaccgugagcgccgaccuggccaaccugcugaagagaaucgccaccaucgugcccagaaccgagagacccgcccugagccuggacaaggugagcgccuacaucgagggcaccagcaccgaggugcccugccugcccgagggcgccgaccccagcccccccguggugaacgagcuguacuaccugcuggccgacuaccacuucaagaacaaggagcagagcaaggccaucaaguucuacaugcacgacaucugcaucugccccaacagauucgacagcugggccggcauggcccuggccagagccagcagaauccaggacaagcugaacagcaacgagcugaagagcgacggccccaucuggaagcacgccacccccgugcugaacugcuucagaagagcccuggagaucgacagcagcaaccugagccuguggaucgaguacggcaccaugagcuacgcccugcacagcuucgccagcagacagcugaagcaguggagaggcgagcugccccccgagcuggugcagcagauggagggcagaagagacagcaugcuggagaccgccaagcacugcuucaccagcgccgccagaugcgagggcgacggcgacgaggaggaguggcugauccacuacaugcugggcaagguggccgagaagcagcagcagccccccaccguguaccugcugcacuacagacaggccggccacuaccugcacgaggaggccgccagauaccccaagaagauccacuaccacaacccccccgagcuggccauggaggcccuggagguguacuucagacugcacgccagcauccugaagcugcugggcaagcccgacagcggcgugggcgccgaggugcuggugaacuucaugaaggaggccgccgagggccccuucgccagaggcgaggagaagaacacccccaaggccagcgagaaggagaaggccugccugguggacgaggacagccacagcagcgccggcacccugcccggccccggcgccagccugcccagcagcagcggccccggccugaccagcccccccuacaccgccacccccaucgaccacgacuacgugaagugcaagaagccccaccagcaggccacccccgacgacagaagccaggacagcaccgccguggcccugagcgacagcagcagcacccaggacuucuucaacgagcccaccagccugcuggagggcagcagaaagagcuacaccgagaagagacugcccauccugagcagccaggccggcgccaccggcaaggaccugcagggcgccaccgaggagagaggcaagaacgaggagagccuggagagcaccgagggcuucagagccgccgagcagggcgugcagaagcccgccgccgagacccccgccagcgccugcauccccggcaagcccagcgccagcacccccacccugugggacggcaagaagagaggcgaccugcccggcgagcccguggccuucccccagggccugcccgccggcgccgaggagcagagacaguuccugaccgagcagugcaucgccagcuucagacugugccugagcagauucccccagcacuacaagagccuguacagacuggccuuccuguacaccuacagcaagacccacagaaaccugcagugggccagagacgugcugcugggcagcagcauccccuggcagcagcugcagcacaugcccgcccagggccuguucugcgagagaaacaagaccaacuucuucaacggcaucuggagaauccccguggacgagaucgacagacccggcagcuucgccuggcacaugaacagaagcaucgugcugcugcugaaggugcuggcccagcugagagaccacagcacccugcugaaggugagcagcaugcugcagagaacccccgaccagggcaagaaguaccugagagacgccgacagacaggugcuggcccagagagccuucauccugaccgugaaggugcuggaggacacccugagcgagcuggccgagggcagcgagagacccggccccaaggugugcggccugcccggcgccagaaugaccaccgacgugagccacaaggccagccccgaggacggccaggagggccugccccagcccaagaagcccccccuggccgacggcagcggccccggccccgagcccggcggcaaggugggccugcugaaccacagacccguggccauggacgccggcgacagcgccgaccagagcggcgagagaaaggacaaggagagccccagagccggccccaccgagcccauggacaccagcgaggccaccgugugccacagcgaccuggagagaacccccccccugcugcccggcagacccgccagagacagaggccccgagagcagacccaccgagcugagccuggaggagcugagcaucagcgccagacagcagcccaccccccugacccccgcccagcccgcccccgcccccgcccccgccaccaccaccggcaccagagccggcggccaccccgaggagccccugagcagacugagcagaaagagaaagcugcuggaggacaccgagagcggcaagacccugcugcuggacgccuacagaguguggcagcagggccagaagggcguggccuacgaccugggcagaguggagagaaucaugagcgagaccuacaugcugaucaagcagguggacgaggaggccgcccuggagcaggccgugaaguucugccaggugcaccugggcgccgccgcccagagacaggccagcggcgacacccccaccacccccaagcaccccaaggacagcagagagaacuucuuccccgugaccguggugcccaccgcccccgaccccgugcccgccgacagcgugcagagacccagcgacgcccacaccaagcccagacccgcccuggccgccgccaccaccaucaucaccugcccccccagcgccagcgccagcacccuggaccagagcaaggaccccggcccccccagaccccacagacccgaggccacccccagcauggccagccugggccccgagggcgaggagcuggccagaguggccgagggcaccagcuuccccccccaggagcccagacacagcccccaggugaagauggcccccaccagcagccccgccgagccccacugcuggcccgccgaggccgcccugggcaccggcgccgagcccaccugcagccaggagggcaagcugagacccgagcccagaagagacggcgaggcccaggaggccgccagcgagacccagccccugagcagcccccccaccgccgccagcagcaaggcccccagcagcggcagcgcccagccccccgagggccaccccggcaagcccgagcccagcagagccaagagcagaccccugcccaacaugcccaagcuggugauccccagcgccgccaccaaguucccccccgagaucaccgugaccccccccacccccacccugcugagccccaagggcagcaucagcgaggagaccaagcagaagcugaagagcgccauccugagcgcccagagcgccgccaacgugagaaaggagagccugugccagcccgcccuggaggugcuggagaccagcagccaggagagcagccuggagagcgagaccgacgaggacgacgacuacauggacaucuaa

SEQ ID NO: 14544 - RNA, 1902 nt, Artificial Sequence
  CABLES1__Homo_sapiens__NP_001094089
auggccgccgccgccgccgccgccaccaccgccgccugcagcagcggcagcgccggcaccgacgccgccggcgccagcggccugcagcagccccccccccagccccagccccagcccgccgccgccgcccccgcccagcccccccccgagccccccagaaagcccagaauggaccccagaagaagacaggccgcccugagcuuccugaccaacaucagccuggacggcagacugcccccccaggacgccgaguggggcggcggcgaggagggcggcgccgccaagcccggcgccggcggcgccugcggcgccagaaccagauucagccugcuggccgccgccgagagaggcggcugcaucgcccuggccgcccccggcacccccgccgccggccuggccgccggcagcggccccugccugccccagcccagcagccugcccccccugauccccggcggccacgccaccgugagcggccccggcguggccagaggcuucgccagcccccugggcgccggcagagccagcggcgagcaguggcagccccccagacccgccccccuggccgccugcgcccagcugcagcugcuggacggcagcggcgccgccggccaggaggagcuggaggaggacgacgccuucaucagcgugcaggugcccgccgccgccuuccugggcagcggcacccccggcagcggcagcggcagcagaggcagacugaacagcuucacccagggcauccugcccaucgccuucagcagacccaccagccagaacuacugcagccuggagcagcccggccagggcggcagcaccagcgccuucgagcagcugcagagaagcagaagaagacugaucagccagagaagcagccuggagacccuggaggacaucgaggagaacgccccccugagaagaugcagaacccugagcggcagccccagacccaagaacuucaagaagauccacuucaucaagaacaugagacagcacgacaccagaaacggcagaaucgugcugaucagcggcagaagaagcuucugcagcaucuucagcgugcugcccuacagagacagcacccaggugggcgaccugaagcuggacggcggcagacagagcaccggcgccgugagccugaaggagaucaucggccuggagggcguggagcugggcgccgacggcaagaccgugagcuacacccaguuccugcugcccaccaacgccuucggcgccagaagaaacaccaucgacagcaccagcagcuucagccaguucagaaaccugagccacagaagccugagcaucggcagagccagcggcacccagggcagccuggacaccggcagcgaccugggcgacuucauggacuacgaccccaaccugcuggacgacccccaguggcccugcggcaagcacaagagagugcugaucuuccccagcuacaugaccaccgugaucgacuacgugaagcccagcgaccugaagaaggacaugaacgagaccuucaaggagaaguucccccacaucaagcugacccugagcaagaucagaagccugaagagagagaugagaaagcuggcccaggaggacugcggccuggaggagcccaccguggccauggccuucguguacuucgagaagcuggcccugaagggcaagcugaacaagcagaacagaaagcugugcgccggcgccugcgugcugcuggccgccaagaucggcagcgaccugaagaagcacgaggugaagcaccugaucgacaagcuggaggagaaguucagacugaacagaagagagcugaucgccuucgaguuccccgugcugguggcccuggaguucgcccugcaccugcccgagcacgaggugaugccccacuacagaagacuggugcagagcagcuaa

SEQ ID NO: 14545 - RNA, 663 nt, Artificial Sequence
  CABP2__Homo_sapiens__NP_057450
augggcaacugcgccaagagacccuggagaagaggccccaaggacccccugcaguggcugggcagcccccccagaggcagcugccccagccccagcagcagccccaaggagcagggcgaccccgcccccggcgugcagggcuacagcgugcugaacagccuggugggccccgccugcaucuuccugagacccagcaucgccgccacccagcuggacagagagcugagacccgaggagaucgaggagcugcagguggccuuccaggaguucgacagagacagagacggcuacaucggcugcagagagcugggcgccugcaugagaacccugggcuacaugcccaccgagauggagcugaucgagaucagccagcagaucagcggcggcaagguggacuucgaggacuucguggagcugaugggccccaagcugcuggccgagaccgccgacaugaucggcgugagagagcugagagacgccuucagagaguucgacaccaacggcgacggcagaaucagcgugggcgagcugagagccgcccugaaggcccugcugggcgagagacugagccagagagagguggacgagauccugcaggacguggaccugaacggcgacggccugguggacuucgaggaguucgugagaaugaugagcagauaa

SEQ ID NO: 14546 - RNA, 513 nt, Artificial Sequence
  CABP4__Homo_sapiens__NP_001287824
augaccgagcccuggcuggcccugggcaccagcuggacccugccccugcaggacagagagcugggccccgaggagcuggacgagcugcaggccgccuucgaggaguucgacaccgacagagacggcuacaucagccacagagagcugggcgacugcaugagaacccugggcuacaugcccaccgagauggagcugcuggaggugagccagcacaucaagaugagaaugggcggcagaguggacuucgaggaguucguggagcugaucggccccaagcugagagaggagaccgcccacaugcugggcgugagagagcugagaaucgccuucagagaguucgacagagacagagacggcagaaucaccguggccgagcugagagaggccgugcccgcccugcugggcgagccccuggccggccccgagcuggacgagaugcugagagagguggaccugaacggcgacggcaccguggacuucgacgaguucgugaugaugcugagcagacacuaa

SEQ ID NO: 14547 - RNA, 1188 nt, Artificial Sequence
  CABS1__Homo_sapiens__NP_149113
auggccgaggacggccugcccaagaucuacagccacccccccaccgagagcagcaagacccccaccgccgccaccaucuucuucggcgccgacaacgccauccccaagagcgagaccaccaucaccagcgagggcgaccacgugaccagcgugaacgaguacaugcuggagagcgacuucagcaccaccaccgacaacaagcugaccgccaagaaggagaagcugaagagcgaggacgacaugggcaccgacuucaucaagagcaccacccaccugcagaaggagaucaccagccugaccggcaccaccaacagcaucaccagagacagcaucaccgagcacuucaugcccgugaagaucggcaacaucagcagccccgugaccaccgugagccugaucgacuucagcaccgacaucgccaaggaggacauccugcuggccaccaucgacaccggcgacgccgagaucagcaucaccagcgaggugagcggcacccugaaggacagcagcgccggcguggccgacgcccccgccuuccccagaaagaaggacgaggccgacaugagcaacuacaacagcagcaucaagagcaacgugcccgccgacgaggccgugcaggugaccgacagcaccauccccgaggccgagaucccccccgcccccgaggagagcuucaccaccauccccgacaucaccgcccuggaggaggagaagaucaccgagaucgaccugagcgugcuggaggacgacaccagcgccguggccacccugaccgacagcgacgagaaguucaucaccguguucgagcugaccaccagcgccgagaaggacaaggacaagagagaggacacccugcugaccgacgaggagaccaccgagggcgccagcaucuggauggagagagacaccgccaacgaggccgagacccacagcgugcugcugaccgccguggagagcagauacgacuucguggugcccgccagcaucgccaccaaccugguggaggagagcagcaccgaggaggaccugagcgagaccgacaacaccgagaccgugcccaagaucaccgagcccuucagcggcaccaccagcgugcuggacacccccgacuacaaggaggacaccagcaccaccgagaccgacaucuucgagcugcugaaggaggagcccgacgaguucaugaucuaa

SEQ ID NO: 14548 - RNA, 1482 nt, Artificial Sequence
  CABYR__Homo_sapiens__NP_036321
augaucagcagcaagcccagacugguggugcccuacggccugaagacccugcuggagggcaucagcagagccgugcugaagaccaaccccagcaacaucaaccaguucgccgccgccuacuuccaggagcugaccauguacagaggcaacaccaccauggacaucaaggaccuggugaagcaguuccaccagaucaagguggagaaguggagcgagggcaccaccccccagaagaagcuggagugccugaaggagcccggcaagaccagcguggagagcaaggugcccacccagauggagaagagcaccgacaccgacgaggacaacgugaccagaaccgaguacagcgacaagaccacccaguuccccagcguguacgccgugcccggcaccgagcagaccgaggccgugggcggccugagcagcaagcccgccacccccaagaccaccaccccccccagcagccccccccccaccgccgugagccccgaguucgccuacgugcccgccgaccccgcccagcuggccgcccagaugcugggcaaggugagcagcauccacagcgaccagagcgacgugcugaugguggacguggccaccagcaugcccguggugaucaaggaggugcccagcagcgaggccgccgaggacgugaugguggccgccccccuggugugcagcggcaaggugcuggaggugcagguggugaaccagaccagcgugcacguggaccugggcagccagcccaaggagaacgaggccgagcccagcaccgccagcagcgugccccugcaggacgagcaggagccccccgccuacgaccaggcccccgaggugacccugcaggccgacaucgaggugaugagcaccgugcacaucagcagcguguacaacgacgugcccgugaccgagggcgugguguacaucgagcagcugcccgagcagaucgugauccccuucaccgaccagguggccugccugaaggagaacgagcagagcaaggagaacgagcagagccccagagugagccccaagagcgugguggagaagaccaccagcggcaugagcaagaagagcguggagagcgugaagcuggcccagcuggaggagaacgccaaguacagcagcguguacauggaggccgaggccaccgcccugcugagcgacaccagccugaagggccagcccgaggugcccgcccagcugcuggacgccgagggcgccaucaagaucggcagcgagaagagccugcaccuggagguggagaucaccagcaucgugagcgacaacaccggccaggaggagagcggcgagaacagcgugccccaggagauggagggcaagcccgugcugagcggcgaggccgccgaggccgugcacagcggcaccagcgugaagagcagcagcggccccuucccccccgcccccgagggccugaccgcccccgagaucgagcccgagggcgagagcaccgccgaguaa

SEQ ID NO: 14549 - RNA, 6786 nt, Artificial Sequence
  CACNA1A__Homo_sapiens__NP_001120693
auggccagauucggcgacgagaugcccgccagauacggcggcggcggcagcggcgccgccgccggcgugguggugggcagcggcggcggcagaggcgccggcggcagcagacagggcggccagcccggcgcccagagaauguacaagcagagcauggcccagagagccagaaccauggcccuguacaaccccauccccgugagacagaacugccugaccgugaacagaagccuguuccuguucagcgaggacaacguggugagaaaguacgccaagaagaucaccgaguggccccccuucgaguacaugauccuggccaccaucaucgccaacugcaucgugcuggcccuggagcagcaccugcccgacgacgacaagacccccaugagcgagagacuggacgacaccgagcccuacuucaucggcaucuucugcuucgaggccggcaucaagaucaucgcccugggcuucgccuuccacaagggcagcuaccugagaaacggcuggaacgugauggacuucgugguggugcugaccggcauccuggccaccgugggcaccgaguucgaccugagaacccugagagccgugagagugcugagaccccugaagcuggugagcggcauccccagccugcagguggugcugaagagcaucaugaaggccaugaucccccugcugcagaucggccugcugcuguucuucgccauccugaucuucgccaucaucggccuggaguucuacaugggcaaguuccacaccaccugcuucgaggagggcaccgacgacauccagggcgagagccccgcccccugcggcaccgaggagcccgccagaaccugccccaacggcaccaagugccagcccuacugggagggccccaacaacggcaucacccaguucgacaacauccuguucgccgugcugaccguguuccagugcaucaccauggagggcuggaccgaccugcuguacaacagcaacgacgccagcggcaacaccuggaacuggcuguacuucaucccccugaucaucaucggcagcuucuucaugcugaaccuggugcugggcgugcugagcggcgaguucgccaaggagagagagagaguggagaacagaagagccuuccugaagcugagaagacagcagcagaucgagagagagcugaacggcuacauggaguggaucagcaaggccgaggaggugauccuggccgaggacgagaccgacggcgagcagagacaccccuucgacggcgcccugagaagaaccaccaucaagaagagcaagaccgaccugcugaaccccgaggaggccgaggaccagcuggccgacaucgccagcgugggcagccccuucgccagagccagcaucaagagcgccaagcuggagaacagcaccuucuuccacaagaaggagagaagaaugagauucuacaucagaagaauggugaagacccaggccuucuacuggaccgugcugagccugguggcccugaacacccugugcguggccaucgugcacuacaaccagcccgaguggcugagcgacuuccuguacuacgccgaguucaucuuccugggccuguucaugagcgagauguucaucaagauguacggccugggcaccagacccuacuuccacagcagcuucaacugcuucgacugcggcgugaucaucggcagcaucuucgaggugaucugggccgugaucaagcccggcaccagcuucggcaucagcgugcugagagcccugagacugcugagaaucuucaaggugaccaaguacugggccagccugagaaaccugguggugagccugcugaacagcaugaagagcaucaucagccugcuguuccugcuguuccuguucaucgugguguucgcccugcugggcaugcagcuguucggcggccaguucaacuucgacgagggcaccccccccaccaacuucgacaccuuccccgccgccaucaugaccguguuccagauccugaccggcgaggacuggaacgaggugauguacgacggcaucaagagccagggcggcgugcagggcggcaugguguucagcaucuacuucaucgugcugacccuguucggcaacuacacccugcugaacguguuccuggccaucgccguggacaaccuggccaacgcccaggagcugaccaaggacgagcaggaggaggaggaggccgccaaccagaagcuggcccugcagaaggccaaggagguggccgaggugagcccccugagcgccgccaacaugagcaucgccgugaaggagcagcagaagaaccagaagcccgccaagagcgugugggagcagagaaccagcgagaugagaaagcagaaccugcuggccagcagagaggcccuguacaacgagauggaccccgacgagagauggaaggccgccuacaccagacaccugagacccgacaugaagacccaccuggacagaccccuggugguggacccccaggagaacagaaacaacaacaccaacaagagcagagccgccgagcccaccguggaccagagacugggccagcagagagccgaggacuuccugagaaagcaggccagauaccacgacagagccagagaccccagcggcagcgccggccuggacgccagaagacccugggccggcagccaggaggccgagcugagcagagagggccccuacggcagagagagcgaccaccacgccagagagggcagccuggagcagcccggcuucugggagggcgaggccgagagaggcaaggccggcgacccccacagaagacacgugcacagacagggcggcagcagagagagcagaagcggcagccccagaaccggcgccgacggcgagcacagaagacacagagcccacagaagacccggcgaggagggccccgaggacaaggccgagagaagagccagacacagagagggcagcagacccgccagaggcggcgagggcgagggcgagggccccgacggcggcgagagaagaagaagacacagacacggcgcccccgccaccuacgagggcgacgccagaagagaggacaaggagagaagacacagaagaagaaaggagaaccagggcagcggcgugcccgugagcggccccaaccugagcaccaccagacccauccagcaggaccugggcagacaggaccccccccuggccgaggacaucgacaacaugaagaacaacaagcuggccaccgccgagagcgccgccccccacggcagccugggccacgccggccugccccagagccccgccaagaugggcaacagcaccgaccccggccccaugcuggccauccccgccauggccaccaacccccagaacgccgccagcagaagaacccccaacaaccccggcaaccccagcaaccccggcccccccaagacccccgagaacagccugaucgugaccaaccccagcggcacccagaccaacagcgccaagaccgccagaaagcccgaccacaccaccguggacaucccccccgccugcccccccccccugaaccacaccguggugcaggugaacaagaacgccaaccccgacccccugcccaagaaggaggaggagaagaaggaggaggaggaggacgacagaggcgaggacggccccaagcccaugccccccuacagcagcauguucauccugagcaccaccaacccccugagaagacugugccacuacauccugaaccugagauacuucgagaugugcauccugauggugaucgccaugagcagcaucgcccuggccgccgaggaccccgugcagcccaacgcccccagaaacaacgugcugagauacuucgacuacguguucaccggcguguucaccuucgagauggugaucaagaugaucgaccugggccuggugcugcaccagggcgccuacuucagagaccuguggaacauccuggacuucaucguggugagcggcgcccugguggccuucgccuucaccggcaacagcaagggcaaggacaucaacaccaucaagagccugagagugcugagagugcugagaccccugaagaccaucaagagacugcccaagcugaaggccguguucgacugcguggugaacagccugaagaacguguucaacauccugaucguguacaugcuguucauguucaucuucgccgugguggccgugcagcuguucaagggcaaguucuuccacugcaccgacgagagcaaggaguucgagaaggacugcagaggcaaguaccugcuguacgagaagaacgaggugaaggccagagacagagaguggaagaaguacgaguuccacuacgacaacgugcugugggcccugcugacccuguucaccgugagcaccggcgagggcuggccccaggugcugaagcacagcguggacgccaccuucgagaaccagggccccagccccggcuacagaauggagaugagcaucuucuacgugguguacuucgugguguuccccuucuucuucgugaacaucuucguggcccugaucaucaucaccuuccaggagcagggcgacaagaugauggaggaguacagccuggagaagaacgagagagccugcaucgacuucgccaucagcgccaagccccugaccagacacaugccccagaacaagcagagcuuccaguacagaauguggcaguucguggugagcccccccuucgaguacaccaucauggccaugaucgcccugaacaccaucgugcugaugaugaaguucuacggcgccagcguggccuacgagaacgcccugagaguguucaacaucguguucaccagccuguucagccuggagugcgugcugaaggugauggccuucggcauccugaacuacuucagagacgccuggaacaucuucgacuucgugaccgugcugggcagcaucaccgacauccuggugaccgaguucggcaacaacuucaucaaccugagcuuccugagacuguucagagccgccagacugaucaagcugcugagacagggcuacaccaucagaauccugcuguggaccuucgugcagagcuucaaggcccugcccuacgugugccugcugaucgccaugcuguucuucaucuacgccaucaucggcaugcagguguucggcaacaucggcaucgacguggaggacgaggacagcgacgaggacgaguuccagaucaccgagcacaacaacuucagaaccuucuuccaggcccugaugcugcuguucagaagcgccaccggcgaggccuggcacaacaucaugcugagcugccugagcggcaagcccugcgacaagaacagcggcauccugaccagagagugcggcaacgaguucgccuacuucuacuucgugagcuucaucuuccugugcagcuuccugaugcugaaccuguucguggccgugaucauggacaacuucgaguaccugaccagagacagcagcauccugggcccccaccaccuggacgaguacgugagagugugggccgaguacgaccccgccgccugcggcagaauccacuacaaggacauguacagccugcugagagugaucagccccccccugggccugggcaagaagugcccccacagaguggccugcaagagacugcugagaauggaccugcccguggccgacgacaacaccgugcacuucaacagcacccugauggcccugaucagaaccgcccuggacaucaagaucgccaagggcggcgccgacaagcagcagauggacgccgagcugagaaaggagaugauggccaucuggcccaaccugagccagaagacccuggaccugcuggugaccccccacaagagcaccgaccugaccgugggcaagaucuacgccgccaugaugaucauggaguacuacagacagagcaaggccaagaagcugcaggccaugagagaggagcaggacagaaccccccugauguuccagagaauggagccccccagccccacccaggagggcggccccggccagaacgcccugcccagcacccagcuggaccccggcggcgcccugauggcccacgagagcggccugaaggagagccccagcugggugacccagagagcccaggagauguuccagaagaccggcaccuggagccccgagcagggcccccccaccgacaugcccaacagccagcccaacagccagagcguggagaugagagagaugggcagagacggcuacagcgacagcgagcacuaccugcccauggagggccagggcagagccgccagcaugcccagacugcccgccgagaaccagagaagaagaggcagacccagaggcaacaaccugagcaccaucagcgacaccagccccaugaagagaagcgccagcgugcugggccccaaggccagaagacuggacgacuacagccuggagagagugccccccgaggagaaccagagacaccaccagagaagaagagacagaagccacagagccagcgagagaagccugggcagauacaccgacguggacaccggccugggcaccgaccugagcaugaccacccagagcggcgaccugcccagcaaggagagagaccaggagagaggcagacccaaggacagaaagcacagacagcaccaccaccaccaccaccaccaccaccacccccccccccccgacaaggacagauacgcccaggagagacccgaccacggcagagccagagccagagaccagagauggagcagaagccccagcgagggcagagagcacauggcccacagacaguaa

SEQ ID NO: 14550 - RNA, 7020 nt, Artificial Sequence
  CACNA1B__Homo_sapiens__NP_000709
auggugagauucggcgacgagcugggcggcagauacggcggccccggcggcggcgagagagccagaggcggcggcgccggcggcgccggcggccccggccccggcggccugcagcccggccagagagugcuguacaagcagagcaucgcccagagagccagaaccauggcccuguacaaccccauccccgugaagcagaacugcuucaccgugaacagaagccuguucguguucagcgaggacaacguggugagaaaguacgccaagagaaucaccgaguggccccccuucgaguacaugauccuggccaccaucaucgccaacugcaucgugcuggcccuggagcagcaccugcccgacggcgacaagacccccaugagcgagagacuggacgacaccgagcccuacuucaucggcaucuucugcuucgaggccggcaucaagaucaucgcccugggcuucguguuccacaagggcagcuaccugagaaacggcuggaacgugauggacuucgugguggugcugaccggcauccuggccaccgccggcaccgacuucgaccugagaacccugagagccgugagagugcugagaccccugaagcuggugagcggcauccccagccugcagguggugcugaagagcaucaugaaggccauggugccccugcugcagaucggccugcugcuguucuucgccauccugauguucgccaucaucggccuggaguucuacaugggcaaguuccacaaggccugcuuccccaacagcaccgacgccgagcccgugggcgacuuccccugcggcaaggaggcccccgccagacugugcgagggcgacaccgagugcagagaguacuggcccggccccaacuucggcaucaccaacuucgacaacauccuguucgccauccugaccguguuccagugcaucaccauggagggcuggaccgacauccuguacaacaccaacgacgccgccggcaacaccuggaacuggcuguacuucaucccccugaucaucaucggcagcuucuucaugcugaaccuggugcugggcgugcugagcggcgaguucgccaaggagagagagagaguggagaacagaagagccuuccugaagcugagaagacagcagcagaucgagagagagcugaacggcuaccuggaguggaucuucaaggccgaggaggugaugcuggccgaggaggacagaaacgccgaggagaagagcccccuggacgugcugaagagagccgccaccaagaagagcagaaacgaccugauccacgccgaggagggcgaggacagauucgccgaccugugcgccgugggcagccccuucgccagagccagccugaagagcggcaagaccgagagcagcagcuacuucagaagaaaggagaagauguucagauucuucaucagaagaauggugaaggcccagagcuucuacuggguggugcugugcgugguggcccugaacacccugugcguggccauggugcacuacaaccagcccagaagacugaccaccacccuguacuucgccgaguucguguuccugggccuguuccugaccgagaugagccugaagauguacggccugggccccagaagcuacuucagaagcagcuucaacugcuucgacuucggcgugaucgugggcagcguguucgagguggugugggccgccaucaagcccggcagcagcuucggcaucagcgugcugagagcccugagacugcugagaaucuucaaggugaccaaguacuggagcagccugagaaaccugguggugagccugcugaacagcaugaagagcaucaucagccugcuguuccugcuguuccuguucaucgugguguucgcccugcugggcaugcagcuguucggcggccaguucaacuuccaggacgagacccccaccaccaacuucgacaccuuccccgccgccauccugaccguguuccagauccugaccggcgaggacuggaacgccgugauguaccacggcaucgagagccagggcggcgugagcaagggcauguucagcagcuucuacuucaucgugcugacccuguucggcaacuacacccugcugaacguguuccuggccaucgccguggacaaccuggccaacgcccaggagcugaccaaggacgaggaggagauggaggaggccgccaaccagaagcuggcccugcagaaggccaaggagguggccgaggugagccccaugagcgccgccaacaucagcaucgccgccagacagcagaacagcgccaaggccagaagcgugugggagcagagagccagccagcugagacugcagaaccugagagccagcugcgaggcccuguacagcgagauggaccccgaggagagacugagauucgccaccaccagacaccugagacccgacaugaagacccaccuggacagaccccuggugguggagcugggcagagacggcgccagaggccccgugggcggcaaggccagacccgaggccgccgaggcccccgagggcguggacccccccagaagacaccacagacacagagacaaggacaagacccccgccgccggcgaccaggacagagccgaggcccccaaggccgagagcggcgagcccggcgccagagaggagagacccagaccccacagaagccacagcaaggaggccgccggcccccccgaggccagaagcgagagaggcagaggccccggccccgagggcggcagaagacaccacagaagaggcagccccgaggaggccgccgagagagagcccagaagacacagagcccacagacaccaggaccccagcaaggagugcgccggcgccaagggcgagagaagagccagacacagaggcggccccagagccggccccagagaggccgagagcggcgaggagcccgccagaagacacagagccagacacaaggcccagcccgcccacgaggccguggagaaggagaccaccgagaaggaggccaccgagaaggaggccgagaucguggaggccgacaaggagaaggagcugagaaaccaccagcccagagagccccacugcgaccuggagaccagcggcaccgugaccgugggccccaugcacacccugcccagcaccugccugcagaagguggaggagcagcccgaggacgccgacaaccagagaaacgugaccagaaugggcagccagccccccgaccccaacaccaucgugcacauccccgugaugcugaccggcccccugggcgaggccaccguggugcccagcggcaacguggaccuggagagccaggccgagggcaagaaggagguggaggccgacgacgugaugagaagcggccccagacccaucgugcccuacagcagcauguucugccugagccccaccaaccugcugagaagauucugccacuacaucgugaccaugagauacuucgagguggugauccugguggugaucgcccugagcagcaucgcccuggccgccgaggaccccgugagaaccgacagccccagaaacaacgcccugaaguaccuggacuacaucuucaccggcguguucaccuucgagauggugaucaagaugaucgaccugggccugcugcugcaccccggcgccuacuucagagaccuguggaacauccuggacuucaucguggugagcggcgcccugguggccuucgccuucagcggcagcaagggcaaggacaucaacaccaucaagagccugagagugcugagagugcugagaccccugaagaccaucaagagacugcccaagcugaaggccguguucgacugcguggugaacagccugaagaacgugcugaacauccugaucguguacaugcuguucauguucaucuucgccgugaucgccgugcagcuguucaagggcaaguucuucuacugcaccgacgagagcaaggagcuggagagagacugcagaggccaguaccuggacuacgagaaggaggagguggaggcccagcccagacaguggaagaaguacgacuuccacuacgacaacgugcugugggcccugcugacccuguucaccgugagcaccggcgagggcuggcccauggugcugaagcacagcguggacgccaccuacgaggagcagggccccagccccggcuacagaauggagcugagcaucuucuacgugguguacuucgugguguuccccuucuucuucgugaacaucuucguggcccugaucaucaucaccuuccaggagcagggcgacaaggugaugagcgagugcagccuggagaagaacgagagagccugcaucgacuucgccaucagcgccaagccccugaccagauacaugccccagaacagacagagcuuccaguacaagaccuggaccuucguggugagcccccccuucgaguacuucaucauggccaugaucgcccugaacaccguggugcugaugaugaaguucuacgacgcccccuacgaguacgagcugaugcugaagugccugaacaucguguucaccagcauguucagcauggagugcgugcugaagaucaucgccuucggcgugcugaacuacuucagagacgccuggaacguguucgacuucgugaccgugcugggcagcaucaccgacauccuggugaccgagaucgccgagaccaacaacuucaucaaccugagcuuccugagacuguucagagccgccagacugaucaagcugcugagacagggcuacaccaucagaauccugcuguggaccuucgugcagagcuucaaggcccugcccuacgugugccugcugaucgccaugcuguucuucaucuacgccaucaucggcaugcagguguucggcaacaucgcccuggacgacgacaccagcaucaacagacacaacaacuucagaaccuuccugcaggcccugaugcugcuguucagaagcgccaccggcgaggccuggcacgagaucaugcugagcugccugagcaaccaggccugcgacgagcaggccaacgccaccgagugcggcagcgacuucgccuacuucuacuucgugagcuucaucuuccugugcagcuuccugaugcugaaccuguucguggccgugaucauggacaacuucgaguaccugaccagagacagcagcauccugggcccccaccaccuggacgaguucaucagagugugggccgaguacgaccccgccgccugcggcagaaucagcuacaacgacauguucgagaugcugaagcacaugagccccccccugggccugggcaagaagugccccgccagaguggccuacaagagacuggugagaaugaacaugcccaucagcaacgaggacaugaccgugcacuucaccagcacccugauggcccugaucagaaccgcccuggagaucaagcuggcccccgccggcaccaagcagcaccagugcgacgccgagcugagaaaggagaucagcguggugugggccaaccugccccagaagacccuggaccugcuggugcccccccacaagcccgacgagaugaccgugggcaagguguacgccgcccugaugaucuucgacuucuacaagcagaacaagaccaccagagaccagaugcagcaggcccccggcggccugagccagaugggccccgugagccuguuccacccccugaaggccacccuggagcagacccagcccgccgugcugagaggcgccagaguguuccugagacagaagagcagcaccagccugagcaacggcggcgccauccagaaccaggagagcggcaucaaggagagcgugagcuggggcacccagagaacccaggacgccccccacgaggccagacccccccuggagagaggccacagcaccgagauccccgugggcagaagcggcgcccuggccguggacgugcagaugcagagcaucaccagaagaggccccgacggcgagccccagcccggccuggagagccagggcagagccgccagcaugcccagacuggccgccgagacccagcccgugaccgacgccagccccaugaagagaagcaucagcacccuggcccagagacccagaggcacccaccugugcagcaccacccccgacagacccccccccagccaggccagcagccaccaccaccaccacagaugccacagaagaagagacagaaagcagagaagccuggagaagggccccagccugagcgccgacauggacggcgcccccagcagcgccgugggccccggccugccccccggcgagggccccaccggcugcagaagagagagagagagaagacaggagagaggcagaagccaggagagaagacagcccagcagcagcagcagcgagaagcagagauucuacagcugcgacagauucggcggcagagagccccccaagcccaagcccagccugagcagccaccccaccagccccaccgccggccaggagcccggcccccacccccagggcagcggcagcgugaacggcagcccccugcugagcaccagcggcgccagcacccccggcagaggcggcagaagacagcugccccagaccccccugacccccagacccagcaucaccuacaagaccgccaacagcagccccauccacuucgccggcgcccagaccagccugcccgccuucagccccggcagacugagcagaggccugagcgagcacaacgcccugcugcagagagacccccugagccagccccuggcccccggcagcagaaucggcagcgaccccuaccugggccagagacuggacagcgaggccagcgugcacgcccugcccgaggacacccugaccuucgaggaggccguggccaccaacagcggcagaagcagcagaaccagcuacgugagcagccugaccagccagagccacccccugagaagagugcccaacggcuaccacugcacccugggccugagcagcggcggcagagccagacacagcuaccaccaccccgaccaggaccacuggugcuaa

SEQ ID NO: 14551 - RNA, 6417 nt, Artificial Sequence
  CACNA1C__Homo_sapiens__NP_000710
auggugaacgagaacaccagaauguacauccccgaggagaaccaccagggcagcaacuacggcagccccagacccgcccacgccaacaugaacgccaacgccgccgccggccuggcccccgagcacauccccacccccggcgccgcccugagcuggcaggccgccaucgacgccgccagacaggccaagcugaugggcagcgccggcaacgccaccaucagcaccgugagcagcacccagagaaagagacagcaguacggcaagcccaagaagcagggcagcaccaccgccaccagaccccccagagcccugcugugccugacccugaagaaccccaucagaagagccugcaucagcaucguggaguggaagcccuucgagaucaucauccugcugaccaucuucgccaacugcguggcccuggccaucuacauccccuuccccgaggacgacagcaacgccaccaacagcaaccuggagagaguggaguaccuguuccugaucaucuucaccguggaggccuuccugaaggugaucgccuacggccugcuguuccaccccaacgccuaccugagaaacggcuggaaccugcuggacuucaucaucgugguggugggccuguucagcgccauccuggagcaggccaccaaggccgacggcgccaacgcccugggcggcaagggcgccggcuucgacgugaaggcccugagagccuucagagugcugagaccccugagacuggugagcggcgugcccagccugcagguggugcugaacagcaucaucaaggccauggugccccugcugcacaucgcccugcuggugcuguucgugaucaucaucuacgccaucaucggccuggagcuguucaugggcaagaugcacaagaccugcuacaaccaggagggcaucgccgacgugcccgccgaggacgaccccagccccugcgcccuggagaccggccacggcagacagugccagaacggcaccgugugcaagcccggcugggacggccccaagcacggcaucaccaacuucgacaacuucgccuucgccaugcugaccguguuccagugcaucaccauggagggcuggaccgacgugcuguacugggugaacgacgccgugggcagagacuggcccuggaucuacuucgugacccugaucaucaucggcagcuucuucgugcugaaccuggugcugggcgugcugagcggcgaguucagcaaggagagagagaaggccaaggccagaggcgacuuccagaagcugagagagaagcagcagcuggaggaggaccugaagggcuaccuggacuggaucacccaggccgaggacaucgaccccgagaacgaggacgagggcauggacgaggagaagcccagaaacaugagcaugcccaccagcgagaccgagagcgugaacaccgagaacguggccggcggcgacaucgagggcgagaacugcggcgccagacuggcccacagaaucagcaagagcaaguucagcagauacuggagaagauggaacagauucugcagaagaaagugcagagccgccgugaagagcaacguguucuacuggcuggugaucuuccugguguuccugaacacccugaccaucgccagcgagcacuacaaccagcccaacuggcugaccgaggugcaggacaccgccaacaaggcccugcuggcccuguucaccgccgagaugcugcugaagauguacagccugggccugcaggccuacuucgugagccuguucaacagauucgacugcuucguggugugcggcggcauccuggagaccauccugguggagaccaagaucaugagcccccugggcaucagcgugcugagaugcgugagacugcugagaaucuucaagaucaccagauacuggaacagccugagcaaccugguggccagccugcugaacagcgugagaagcaucgccagccugcugcugcugcuguuccuguucaucaucaucuucagccugcugggcaugcagcuguucggcggcaaguucaacuucgacgagaugcagaccagaagaagcaccuucgacaacuucccccagagccugcugaccguguuccagauccugaccggcgaggacuggaacagcgugauguacgacggcaucauggccuacggcggccccagcuuccccggcaugcuggugugcaucuacuucaucauccuguucaucugcggcaacuacauccugcugaacguguuccuggccaucgccguggacaaccuggccgacgccgagagccugaccagcgcccagaaggaggaggaggaggagaaggagagaaagaagcuggccagaaccgccagccccgagaagaagcaggagcugguggagaagcccgccgugggcgagagcaaggaggagaagaucgagcugaagagcaucaccgccgacggcgagagcccccccgccaccaagaucaacauggacgaccugcagcccaacgagaacgaggacaagagccccuaccccaaccccgagaccaccggcgaggaggacgaggaggagcccgagaugcccgugggccccagacccagaccccugagcgagcugcaccugaaggagaaggccgugcccaugcccgaggccagcgccuucuucaucuucagcagcaacaacagauucagacugcagugccacagaaucgugaacgacaccaucuucaccaaccugauccuguucuucauccugcugagcagcaucagccuggccgccgaggaccccgugcagcacaccagcuucagaaaccacauccuguucuacuucgacaucguguucaccaccaucuucaccaucgagaucgcccugaagaugaccgccuacggcgccuuccugcacaagggcagcuucugcagaaacuacuucaacauccuggaccugcugguggugagcgugagccugaucagcuucggcauccagagcagcgccaucaacguggugaagauccugagagugcugagagugcugagaccccugagagccaucaacagagccaagggccugaagcacguggugcagugcguguucguggccaucagaaccaucggcaacaucgugaucgugaccacccugcugcaguucauguucgccugcaucggcgugcagcuguucaagggcaagcuguacaccugcagcgacagcagcaagcagaccgaggccgagugcaagggcaacuacaucaccuacaaggacggcgagguggaccaccccaucauccagcccagaagcugggagaacagcaaguucgacuucgacaacgugcuggccgccaugauggcccuguucaccgugagcaccuucgagggcuggcccgagcugcuguacagaagcaucgacagccacaccgaggacaagggccccaucuacaacuacagaguggagaucagcaucuucuucaucaucuacaucaucaucaucgccuucuucaugaugaacaucuucgugggcuucgugaucgugaccuuccaggagcagggcgagcaggaguacaagaacugcgagcuggacaagaaccagagacagugcguggaguacgcccugaaggccagaccccugagaagauacauccccaagaaccagcaccaguacaaggugugguacguggugaacagcaccuacuucgaguaccugauguucgugcugauccugcugaacaccaucugccuggccaugcagcacuacggccagagcugccuguucaagaucgccaugaacauccugaacaugcuguucaccggccuguucaccguggagaugauccugaagcugaucgccuucaagcccaagcacuacuucugcgacgccuggaacaccuucgacgcccugaucguggugggcagcaucguggacaucgccaucaccgaggugaaccccgccgagcacacccagugcagccccagcaugaacgccgaggagaacagcagaaucagcaucaccuucuucagacuguucagagugaugagacuggugaagcugcugagcagaggcgagggcaucagaacccugcuguggaccuucaucaagagcuuccaggcccugcccuacguggcccugcugaucgugaugcuguucuucaucuacgccgugaucggcaugcagguguucggcaagaucgcccugaacgacaccaccgagaucaacagaaacaacaacuuccagaccuucccccaggccgugcugcugcuguucagaugcgccaccggcgaggccuggcaggacaucaugcuggccugcaugcccggcaagaagugcgcccccgagagcgagcccagcaacagcaccgagggcgagacccccugcggcagcagcuucgccguguucuacuucaucagcuucuacaugcugugcgccuuccugaucaucaaccuguucguggccgugaucauggacaacuucgacuaccugaccagagacuggagcauccugggcccccaccaccuggacgaguucaagagaaucugggccgaguacgaccccgaggccaagggcagaaucaagcaccuggacguggugacccugcugagaagaauccagcccccccugggcuucggcaagcugugcccccacagaguggccugcaagagacuggugagcaugaacaugccccugaacagcgacggcaccgugauguucaacgccacccuguucgcccuggugagaaccgcccugagaaucaagaccgagggcaaccuggagcaggccaacgaggagcugagagccaucaucaagaagaucuggaagagaaccagcaugaagcugcuggaccagguggugccccccgccggcgacgacgaggugaccgugggcaaguucuacgccaccuuccugauccaggaguacuucagaaaguucaagaagagaaaggagcagggccuggugggcaagcccagccagagaaacgcccugagccugcaggccggccugagaacccugcacgacaucggccccgagaucagaagagccaucagcggcgaccugaccgccgaggaggagcuggacaaggccaugaaggaggccgugagcgccgccagcgaggacgacaucuucagaagagccggcggccuguucggcaaccacgugagcuacuaccagagcgacggcagaagcgccuucccccagaccuucaccacccagagaccccugcacaucaacaaggccggcagcagccagggcgacaccgagagccccagccacgagaagcugguggacagcaccuucacccccagcagcuacagcagcaccggcagcaacgccaacaucaacaacgccaacaacaccgcccugggcagacugcccagacccgccggcuaccccagcaccgugagcaccguggagggccacggccccccccugagccccgccaucagagugcaggagguggccuggaagcugagcagcaacagaugccacagcagagagagccaggccgccauggccggccaggaggagaccagccaggacgagaccuacgaggugaagaugaaccacgacaccgaggccugcagcgagcccagccugcugagcaccgagaugcugagcuaccaggacgacgagaacagacagcugacccugcccgaggaggacaagagagacaucagacagagccccaagagaggcuuccugagaagcgccagccugggcagaagagccagcuuccaccuggagugccugaagagacagaaggacagaggcggcgacaucagccagaagaccgugcugccccugcaccuggugcaccaccaggcccuggccguggccggccugagcccccugcugcagagaagccacagccccgccagcuuccccagacccuucgccaccccccccgccacccccggcagcagaggcuggcccccccagcccgugcccacccugagacuggagggcguggagagcagcgagaagcugaacagcagcuuccccagcauccacugcggcagcugggccgagaccacccccggcggcggcggcagcagcgccgccagaagagugagacccgugagccugauggugcccagccaggccggcgcccccggcagacaguuccacggcagcgccagcagccugguggaggccgugcugaucagcgagggccugggccaguucgcccaggaccccaaguucaucgaggugaccacccaggagcuggccgacgccugcgacaugaccaucgaggagauggagagcgccgccgacaacauccugagcggcggcgccccccagagccccaacggcgcccugcugcccuucgugaacugcagagacgccggccaggacagagccggcggcgaggaggacgccggcugcgugagagccagaggcagacccagcgaggaggagcugcaggacagcagaguguacgugagcagccuguaa

SEQ ID NO: 14552 - RNA, 6546 nt, Artificial Sequence
  CACNA1D__Homo_sapiens__NP_000711
augaugaugaugaugaugaugaagaagaugcagcaccagagacagcagcaggccgaccacgccaacgaggccaacuacgccagaggcaccagacugccccugagcggcgagggccccaccagccagcccaacagcagcaagcagaccgugcugagcuggcaggccgccaucgacgccgccagacaggccaaggccgcccagaccaugagcaccagcgcccccccccccgugggcagccugagccagagaaagagacagcaguacgccaagagcaagaagcagggcaacagcagcaacagcagacccgccagagcccuguucugccugagccugaacaaccccaucagaagagccugcaucagcaucguggaguggaagcccuucgacaucuucauccugcuggccaucuucgccaacugcguggcccuggccaucuacauccccuuccccgaggacgacagcaacagcaccaaccacaaccuggagaagguggaguacgccuuccugaucaucuucaccguggagaccuuccugaagaucaucgccuacggccugcugcugcaccccaacgccuacgugagaaacggcuggaaccugcuggacuucgugaucgugaucgugggccuguucagcgugauccuggagcagcugaccaaggagaccgagggcggcaaccacagcagcggcaagagcggcggcuucgacgugaaggcccugagagccuucagagugcugagaccccugagacuggugagcggcgugcccagccugcagguggugcugaacagcaucaucaaggccauggugccccugcugcacaucgcccugcuggugcuguucgugaucaucaucuacgccaucaucggccuggagcuguucaucggcaagaugcacaagaccugcuucuucgccgacagcgacaucguggccgaggaggaccccgcccccugcgccuucagcggcaacggcagacagugcaccgccaacggcaccgagugcagaagcggcugggugggccccaacggcggcaucaccaacuucgacaacuucgccuucgccaugcugaccguguuccagugcaucaccauggagggcuggaccgacgugcuguacugggugaacgacgccaucggcugggaguggcccuggguguacuucgugagccugaucauccugggcagcuucuucgugcugaaccuggugcugggcgugcugagcggcgaguucagcaaggagagagagaaggccaaggccagaggcgacuuccagaagcugagagagaagcagcagcuggaggaggaccugaagggcuaccuggacuggaucacccaggccgaggacaucgaccccgagaacgaggaggagggcggcgaggagggcaagagaaacaccagcaugcccaccagcgagaccgagagcgugaacaccgagaacgugagcggcgagggcgagaacagaggcugcugcggcagccuguggugcugguggagaagaagaggcgccgccaaggccggccccagcggcugcagaagauggggccaggccaucagcaagagcaagcugagcagaagauggagaagauggaacagauucaacagaagaagaugcagagccgccgugaagagcgugaccuucuacuggcuggugaucgugcugguguuccugaacacccugaccaucagcagcgagcacuacaaccagcccgacuggcugacccagauccaggacaucgccaacaaggugcugcuggcccuguucaccugcgagaugcuggugaagauguacagccugggccugcaggccuacuucgugagccuguucaacagauucgacugcuucguggugugcggcggcaucaccgagaccauccugguggagcuggagaucaugagcccccugggcaucagcguguucagaugcgugagacugcugagaaucuucaaggugaccagacacuggaccagccugagcaaccugguggccagccugcugaacagcaugaagagcaucgccagccugcugcugcugcuguuccuguucaucaucaucuucagccugcugggcaugcagcuguucggcggcaaguucaacuucgacgagacccagaccaagagaagcaccuucgacaacuucccccaggcccugcugaccguguuccagauccugaccggcgaggacuggaacgccgugauguacgacggcaucauggccuacggcggccccagcagcagcggcaugaucgugugcaucuacuucaucauccuguucaucugcggcaacuacauccugcugaacguguuccuggccaucgccguggacaaccuggccgacgccgagagccugaacaccgcccagaaggaggaggccgaggagaaggagagaaagaagaucgccagaaaggagagccuggagaacaagaagaacaacaagcccgaggugaaccagaucgccaacagcgacaacaaggugaccaucgacgacuacagagaggaggacgaggacaaggaccccuacccccccugcgacgugcccgugggcgaggaggaggaggaggaggaggaggacgagcccgaggugcccgccggccccagacccagaagaaucagcgagcugaacaugaaggagaagaucgcccccauccccgagggcagcgccuucuucauccugagcaagaccaaccccaucagagugggcugccacaagcugaucaaccaccacaucuucaccaaccugauccugguguucaucaugcugagcagcgccgcccuggccgccgaggaccccaucagaagccacagcuucagaaacaccauccugggcuacuucgacuacgccuucaccgccaucuucaccguggagauccugcugaagaugaccaccuucggcgccuuccugcacaagggcgccuucugcagaaacuacuucaaccugcuggacaugcugguggugggcgugagccuggugagcuucggcauccagagcagcgccaucagcguggugaagauccugagagugcugagagugcugagaccccugagagccaucaacagagccaagggccugaagcacguggugcagugcguguucguggccaucagaaccaucggcaacaucaugaucgugaccacccugcugcaguucauguucgccugcaucggcgugcagcuguucaagggcaaguucuacagaugcaccgacgaggccaagagcaaccccgaggagugcagaggccuguucauccuguacaaggacggcgacguggacagccccguggugagagagagaaucuggcagaacagcgacuucaacuucgacaacgugcugagcgccaugauggcccuguucaccgugagcaccuucgagggcuggcccgcccugcuguacaaggccaucgacagcaacggcgagaacaucggccccaucuacaaccacagaguggagaucagcaucuucuucaucaucuacaucaucaucguggccuucuucaugaugaacaucuucgugggcuucgugaucgugaccuuccaggagcagggcgagaaggaguacaagaacugcgagcuggacaagaaccagagacagugcguggaguacgcccugaaggccagaccccugagaagauacauccccaagaaccccuaccaguacaaguucugguacguggugaacagcagccccuucgaguacaugauguucgugcugaucaugcugaacacccugugccuggccaugcagcacuacgagcagagcaagauguucaacgacgccauggacauccugaacaugguguucaccggcguguucaccguggagauggugcugaaggugaucgccuucaagcccaagggcuacuucagcgacgccuggaacaccuucgacagccugaucgugaucggcagcaucaucgacguggcccugagcgaggccgaccccaccgagagcgagaacgugcccgugcccaccgccacccccggcaacagcgaggagagcaacagaaucagcaucaccuucuucagacuguucagagugaugagacuggugaagcugcugagcagaggcgagggcaucagaacccugcuguggaccuucaucaagagcuuccaggcccugcccuacguggcccugcugaucgccaugcuguucuucaucuacgccgugaucggcaugcagauguucggcaagguggccaugagagacaacaaccagaucaacagaaacaacaacuuccagaccuucccccaggccgugcugcugcuguucagaugcgccaccggcgaggccuggcaggagaucaugcuggccugccugcccggcaagcugugcgaccccgagagcgacuacaaccccggcgaggaguacaccugcggcagcaacuucgccaucguguacuucaucagcuucuacaugcugugcgccuuccugaucaucaaccuguucguggccgugaucauggacaacuucgacuaccugaccagagacuggagcauccugggcccccaccaccuggacgaguucaagagaaucuggagcgaguacgaccccgaggccaagggcagaaucaagcaccuggacguggugacccugcugagaagaauccagcccccccugggcuucggcaagcugugcccccacagaguggccugcaagagacugguggccaugaacaugccccugaacagcgacggcaccgugauguucaacgccacccuguucgcccuggugagaaccgcccugaagaucaagaccgagggcaaccuggagcaggccaacgaggagcugagagccgugaucaagaagaucuggaagaagaccagcaugaagcugcuggaccagguggugccccccgccggcgacgacgaggugaccgugggcaaguucuacgccaccuuccugauccaggacuacuucagaaaguucaagaagagaaaggagcagggccuggugggcaaguaccccgccaagaacaccaccaucgcccugcaggccggccugagaacccugcacgacaucggccccgagaucagaagagccaucagcugcgaccugcaggacgacgagcccgaggagaccaagagagaggaggaggacgacguguucaagagaaacggcgcccugcugggcaaccacgugaaccacgugaacagcgacagaagagacagccugcagcagaccaacaccacccacagaccccugcacgugcagagacccagcaucccccccgccagcgacaccgagaagccccuguucccccccgccggcaacagcgugugccacaaccaccacaaccacaacagcaucggcaagcaggugcccaccagcaccaacgccaaccugaacaacgccaacaugagcaaggccgcccacggcaagagacccagcaucggcaaccuggagcacgugagcgagaacggccaccacagcagccacaagcacgacagagagccccagagaagaagcagcgugaagagaaccagauacuacgagaccuacaucagaagcgacagcggcgacgagcagcugcccaccaucugcagagaggaccccgagauccacggcuacuucagagacccccacugccugggcgagcaggaguacuucagcagcgaggagugcuacgaggacgacagcagccccaccuggagcagacagaacuacggcuacuacagcagauaccccggcagaaacaucgacagcgagagacccagaggcuaccaccacccccagggcuuccuggaggacgacgacagccccgugugcuacgacagcagaagaagccccagaagaagacugcugccccccacccccgccagccacagaagaagcagcuucaacuucgagugccugagaagacagagcagccaggaggaggugcccagcagccccaucuucccccacagaaccgcccugccccugcaccugaugcagcagcagaucauggccguggccggccuggacagcagcaaggcccagaaguacagccccagccacagcaccagaagcugggccaccccccccgccaccccccccuacagagacuggacccccugcuacaccccccugauccagguggagcagagcgaggcccuggaccaggugaacggcagccugcccagccugcacagaagcagcugguacaccgacgagcccgacaucagcuacagaaccuucacccccgccagccugaccgugcccagcagcuucagaaacaagaacagcgacaagcagagaagcgccgacagccugguggaggccgugcugaucagcgagggccugggcagauacgccagagaccccaaguucgugagcgccaccaagcacgagaucgccgacgccugcgaccugaccaucgacgagauggagagcgccgccagcacccugcugaacggcaacgugagacccagagccaacggcgacgugggcccccugagccacagacaggacuacgagcugcaggacuucggccccggcuacagcgacgaggagcccgaccccggcagagacgaggaggaccuggccgacgagaugaucugcaucaccacccuguaa

SEQ ID NO: 14553 - RNA, 6813 nt, Artificial Sequence
  CACNA1E__Homo_sapiens__NP_000712
auggccagauucggcgaggccgugguggccagacccggcagcggcgacggcgacagcgaccagagcagaaacagacagggcacccccgugcccgccagcggccaggccgccgccuacaagcagaccaaggcccagagagccagaaccauggcccuguacaaccccauccccgugagacagaacugcuucaccgugaacagaagccuguucaucuucggcgaggacaacaucgugagaaaguacgccaagaagcugaucgacuggccccccuucgaguacaugauccuggccaccaucaucgccaacugcaucgugcuggcccuggagcagcaccugcccgaggacgacaagacccccaugagcagaagacuggagaagaccgagcccuacuucaucggcaucuucugcuucgaggccggcaucaagaucguggcccugggcuucaucuuccacaagggcagcuaccugagaaacggcuggaacgugauggacuucaucguggugcugagcggcauccuggccaccgccggcacccacuucaacacccacguggaccugagaacccugagagccgugagagugcugagaccccugaagcuggugagcggcauccccagccugcagaucgugcugaagagcaucaugaaggccauggugccccugcugcagaucggccugcugcuguucuucgccauccugauguucgccaucaucggccuggaguucuacagcggcaagcugcacagagccugcuucaugaacaacagcggcauccuggagggcuucgaccccccccaccccugcggcgugcagggcugccccgccggcuacgagugcaaggacuggaucggccccaacgacggcaucacccaguucgacaacauccuguucgccgugcugaccguguuccagugcaucaccauggagggcuggaccaccgugcuguacaacaccaacgacgcccugggcgccaccuggaacuggcuguacuucaucccccugaucaucaucggcagcuucuucgugcugaaccuggugcugggcgugcugagcggcgaguucgccaaggagagagagagaguggagaacagaagagccuucaugaagcugagaagacagcagcagaucgagagagagcugaacggcuacagagccuggaucgacaaggccgaggaggugaugcuggccgaggagaacaagaacgccggcaccagcgcccuggaggugcugagaagagccaccaucaagagaagcagaaccgaggccaugaccagagacagcagcgacgagcacugcguggacaucagcagcgugggcaccccccuggccagagccagcaucaagagcgccaagguggacggcgugagcuacuucagacacaaggagagacugcugagaaucagcaucagacacauggugaagagccagguguucuacuggaucgugcugagccugguggcccugaacaccgccugcguggccaucgugcaccacaaccagccccaguggcugacccaccugcuguacuacgccgaguuccuguuccugggccuguuccugcuggagaugagccugaagauguacggcaugggccccagacuguacuuccacagcagcuucaacugcuucgacuucggcgugaccgugggcagcaucuucgagguggugugggccaucuucagacccggcaccagcuucggcaucagcgugcugagagcccugagacugcugagaaucuucaagaucaccaaguacugggccagccugagaaaccugguggugagccugaugagcagcaugaagagcaucaucagccugcuguuccugcuguuccuguucaucgugguguucgcccugcugggcaugcagcuguucggcggcagauucaacuucaacgacggcacccccagcgccaacuucgacaccuuccccgccgccaucaugaccguguuccagauccugaccggcgaggacuggaacgaggugauguacaacggcaucagaagccagggcggcgugagcagcggcauguggagcgccaucuacuucaucgugcugacccuguucggcaacuacacccugcugaacguguuccuggccaucgccguggacaaccuggccaacgcccaggagcugaccaaggacgagcaggaggaggaggaggccuucaaccagaagcacgcccugcagaaggccaaggaggugagccccaugagcgcccccaacaugcccagcaucgagagagacagaagaagaagacaccacaugagcaugugggagcccagaagcagccaccugagagagagaagaagaagacaccacaugagcgugugggagcagagaaccagccagcugagaaagcacaugcagaugagcagccaggaggcccugaacagagaggaggcccccaccaugaacccccugaacccccugaacccccugagcagccugaacccccugaacgcccaccccagccuguacagaagacccagagccaucgagggccuggcccugggccuggcccuggagaaguucgaggaggagagaaucagcagaggcggcagccugaagggcgacggcggcgacagaagcagcgcccuggacaaccagagaaccccccugagccugggccagagagagccccccuggcuggccagacccugccacggcaacugcgaccccacccagcaggaggccggcggcggcgaggccguggugaccuucgaggacagagccagacacagacagagccagagaagaagcagacacagaagagugagaaccgagggcaaggagagcagcagcgccagcagaagcagaagcgccagccaggagagaagccuggacgaggccaugcccaccgagggcgagaaggaccacgagcugagaggcaaccacggcgccaaggagcccaccauccaggaggagagagcccaggaccugagaagaaccaacagccugauggugagcagaggcagcggccuggccggcggccuggacgaggccgacaccccccuggugcugccccaccccgagcuggaggugggcaagcacguggugcugaccgagcaggagcccgagggcagcagcgagcaggcccugcugggcaacgugcagcuggacaugggcagagugaucagccagagcgagcccgaccugagcugcaucaccgccaacaccgacaaggccaccaccgagagcaccagcgugaccguggccauccccgacguggacccccugguggacagcaccguggugcacaucagcaacaagaccgacggcgaggccagcccccugaaggaggccgagaucagagaggacgaggaggagguggagaagaagaagcagaagaaggagaagagagagaccggcaaggccauggugccccacagcagcauguucaucuucagcaccaccaaccccaucagaagagccugccacuacaucgugaaccugagauacuucgagaugugcauccugcuggugaucgccgccagcagcaucgcccuggccgccgaggaccccgugcugaccaacagcgagagaaacaaggugcugagauacuucgacuacguguucaccggcguguucaccuucgagauggugaucaagaugaucgaccagggccugauccugcaggacggcagcuacuucagagaccuguggaacauccuggacuucguggugguggugggcgcccugguggccuucgcccuggccaacgcccugggcaccaacaagggcagagacaucaagaccaucaagagccugagagugcugagagugcugagaccccugaagaccaucaagagacugcccaagcugaaggccguguucgacugcguggugaccagccugaagaacguguucaacauccugaucguguacaagcuguucauguucaucuucgccgugaucgccgugcagcuguucaagggcaaguucuucuacugcaccgacagcagcaaggacaccgagaaggagugcaucggcaacuacguggaccacgagaagaacaagauggaggugaagggcagagaguggaagagacacgaguuccacuacgacaacaucaucugggcccugcugacccuguucaccgugagcaccggcgagggcuggccccaggugcugcagcacagcguggacgugaccgaggaggacagaggccccagcagaagcaacagaauggagaugagcaucuucuacgugguguacuucgugguguuccccuucuucuucgugaacaucuucguggcccugaucaucaucaccuuccaggagcagggcgacaagaugauggaggagugcagccuggagaagaacgagagagccugcaucgacuucgccaucagcgccaagccccugaccagauacaugccccagaacagacacaccuuccaguacagaguguggcacuucguggugagccccagcuucgaguacaccaucauggccaugaucgcccugaacaccguggugcugaugaugaaguacuacagcgcccccugcaccuacgagcuggcccugaaguaccugaacaucgccuucaccaugguguucagccuggagugcgugcugaaggugaucgccuucggcuuccugaacuacuucagagacaccuggaacaucuucgacuucaucaccgugaucggcagcaucaccgagaucauccugaccgacagcaagcuggugaacaccagcggcuucaacaugagcuuccugaagcuguucagagccgccagacugaucaagcugcugagacagggcuacaccaucagaauccugcuguggaccuucgugcagagcuucaaggcccugcccuacgugugccugcugaucgccaugcuguucuucaucuacgccaucaucggcaugcagguguucggcaacaucaagcuggacgaggagagccacaucaacagacacaacaacuucagaagcuucuucggcagccugaugcugcuguucagaagcgccaccggcgaggccuggcaggagaucaugcugagcugccugggcgagaagggcugcgagcccgacaccaccgcccccagcggccagaacgagaacgagagaugcggcaccgaccuggccuacguguacuucgugagcuucaucuucuucugcagcuuccugaugcugaaccuguucguggccgugaucauggacaacuucgaguaccugaccagagacagcagcauccugggcccccaccaccuggacgaguucgugagagugugggccgaguacgacagagccgccugcggcagaauccacuacaccgagauguacgagaugcugacccugaugagccccccccugggccugggcaagagaugccccagcaagguggccuacaagagacuggugcugaugaacaugcccguggccgaggacaugaccgugcacuucaccagcacccugauggcccugaucagaaccgcccuggacaucaagaucgccaagggcggcgccgacagacagcagcuggacagcgagcugcagaaggagacccuggccaucuggccccaccugagccagaagaugcuggaccugcuggugcccaugcccaaggccagcgaccugaccgugggcaagaucuacgccgccaugaugaucauggacuacuacaagcagagcaaggugaagaagcagagacagcagcuggaggagcagaagaacgcccccauguuccagagaauggagcccagcagccugccccaggagaucaucgccaacgccaaggcccugcccuaccugcagcaggaccccgugagcggccugagcggcagaagcggcuaccccagcaugagcccccugagcccccaggacaucuuccagcuggccugcauggaccccgccgacgacggccaguuccaggagagacagagccugguggugaccgaccccagcagcaugagaagaagcuucagcaccaucagagacaagagaagcaacagcagcuggcuggaggaguucagcauggagagaagcagcgagaacaccuacaagagcagaagaagaagcuaccacagcagccugagacugagcgcccacagacugaacagcgacagcggccacaagagcgacacccacagaagcggcggcagagagagaggcagaagcaaggagagaaagcaccugcugagccccgacgugagcagaugcaacagcgaggagagaggcacccaggccgacugggagagccccgagagaagacagagcagaagccccagcgagggcagaagccagacccccaacagacagggcaccggcagccugagcgagagcagcauccccagcgugagcgacaccagcacccccagaagaagcagaagacagcugccccccgugccccccaagcccagaccccugcugagcuacagcagccugaucagacacgccggcagcaucagcccccccgccgacggcagcgaggagggcagcccccugaccagccaggcccuggagagcaacaacgccugccugaccgagagcagcaacagcccccacccccagcagagccagcacgccagcccccagagauacaucagcgagcccuaccuggcccugcacgaggacagccacgccagcgacugcggcgaggaggagacccugaccuucgaggccgccguggccaccagccugggcagaagcaacaccaucggcagcgcccccccccugagacacagcuggcagaugcccaacggccacuacagaagaagaagaagaggcggccccggccccggcaugaugugcggcgccgugaacaaccugcugagcgacaccgaggaggacgacaagugcuaa

SEQ ID NO: 14554 - RNA, 5901 nt, Artificial Sequence
  CACNA1F__Homo_sapiens__NP_001243718
augagcgagagcgagggcggcaaggacaccacccccgagcccagccccgccaacggcgccggccccggccccgaguggggccugugccccggcccccccgccguggagggcgagagcagcggcgccagcggccugggcacccccaagagaagaaaccagcacagcaagcacaagaccguggccguggccagcgcccagagaagccccagagcccuguucugccugacccuggccaacccccugagaagaagcugcaucagcaucguggaguggaagcccuucgacauccugauccugcugaccaucuucgccaacugcguggcccugggcguguacauccccuuccccgaggacgacagcaacaccgccaaccacaaccuggagcagguggaguacguguuccuggugaucuucaccguggagaccgugcugaagaucguggccuacggccuggugcugcaccccagcgccuacaucagaaacggcuggaaccugcuggacuucaucaucgugguggugggccuguucagcgugcugcuggagcagggccccggcagacccggcgacgccccccacaccggcggcaagcccggcggcuucgacgugaaggcccugagagccuucagagugcugagaccccugagacuggugagcggcgugcccagccugcacaucgugcugaacagcaucaugaaggcccuggugccccugcugcacaucgcccugcuggugcuguucgugaucaucaucuacgccaucaucggccuggagcuguuccugggcagaaugcacaagaccugcuacuuccugggcagcgacauggaggccgaggaggaccccagccccugcgccagcagcggcagcggcagagccugcacccugaaccagaccgagugcagaggcagauggcccggccccaacggcggcaucaccaacuucgacaacuucuucuucgccaugcugaccguguuccagugcgugaccauggagggcuggaccgacgugcuguacuggaugcaggacgccaugggcuacgagcugcccuggguguacuucgugagccuggugaucuucggcagcuucuucgugcugaaccuggugcugggcgugcugagcggcgaguucagcaaggagagagagaaggccaaggccagaggcgacuuccagaagcagagagagaagcagcagauggaggaggaccugagaggcuaccuggacuggaucacccaggccgaggagcuggacauggaggaccccagcgccgacgacaaccugggcccccagcuggccgagcugaccaacagaagaagaggcagacugagaugguucagccacagcaccagaagcacccacagcaccagcagccacgccagccugcccgccagcgacaccggcagcaugaccgagacccagggcgacgaggacgaggaggagggcgcccuggccagcugcaccagaugccugaacaagaucaugaagaccagagugugcagaagacugagaagagccaacagagugcugagagccagaugcagaagagccgugaagagcaacgccugcuacugggccgugcugcugcugguguuccugaacacccugaccaucgccagcgagcaccacggccagcccguguggcugacccagauccaggaguacgccaacaaggugcugcugugccuguucaccguggagaugcugcugaagcuguacggccugggccccagcgccuacgugagcagcuucuucaacagauucgacugcuucguggugugcggcggcauccuggagaccacccugguggaggugggcgccaugcagccccugggcaucagcgugcugagaugcgugagacugcugagaaucuucaaggugaccagacacugggccagccugagcaaccugguggccagccugcugaacagcaugaagagcaucgccagccugcugcugcugcuguuccuguucaucaucaucuucagccugcugggcaugcagcuguucggcggcaaguucaacuucgaccagacccacaccaagagaagcaccuucgacaccuucccccaggcccugcugaccguguuccagauccugaccggcgaggacuggaacguggugauguacgacggcaucauggccuacggcggccccuucuuccccggcaugcuggugugcaucuacuucaucauccuguucaucugcggcaacuacauccugcugaacguguuccuggccaucgccguggacaaccuggccagcggcgacgccggcaccgccaaggacaagggcggcgagaagagcaacgagaaggaccugccccaggagaacgagggccuggugcccggcguggagaaggaggaggaggagggcgccagaagagagggcgccgacauggaggaggaggaggaggaggaggaggaggaggaggaggaggaggaggaggagggcgccggcggcguggagcugcugcaggagguggugcccaaggagaagguggugcccauccccgagggcagcgccuucuucugccugagccagaccaacccccugagaaagggcugccacacccugauccaccaccacguguucaccaaccugauccugguguucaucauccugagcagcgugagccuggccgccgaggaccccaucagagcccacagcuucagaaaccacauccugggcuacuucgacuacgccuucaccagcaucuucaccguggagauccugcugaagaugaccguguucggcgccuuccugcacagaggcagcuucugcagaagcugguucaacaugcuggaccugcugguggugagcgugagccugaucagcuucggcauccacagcagcgccaucagcguggugaagauccugagagugcugagagugcugagaccccugagagccaucaacagagccaagggccugaagcacguggugcagugcguguucguggccaucagaaccaucggcaacaucaugaucgugaccacccugcugcaguucauguucgccugcaucggcgugcagcuguucaagggcaaguucuacaccugcaccgacgaggccaagcacaccccccaggagugcaagggcagcuuccugguguaccccgacggcgacgugagcagaccccuggugagagagagacugugggugaacagcgacuucaacuucgacaacgugcugagcgccaugauggcccuguucaccgugagcaccuucgagggcuggcccgcccugcuguacaaggccaucgacgccuacgccgaggaccacggccccaucuacaacuacagaguggagaucagcguguucuucaucguguacaucaucaucaucgccuucuucaugaugaacaucuucgugggcuucgugaucaucaccuucagagcccagggcgagcaggaguaccagaacugcgagcuggacaagaaccagagacagugcguggaguacgcccugaaggcccagccccugagaagauacauccccaagaacccccaccaguacagagugugggccaccgugaacagcgccgccuucgaguaccugauguuccugcugauccugcugaacaccguggcccuggccaugcagcacuacgagcagaccgcccccuucaacuacgccauggacauccugaacaugguguucaccggccuguucaccaucgagauggugcugaagaucaucgccuucaagcccaagcacuacuucaccgacgccuggaacaccuucgacgcccugaucguggugggcagcaucguggacaucgccgugaccgaggugaacaacggcggccaccugggcgagagcagcgaggacagcagcagaaucagcaucaccuucuucagacuguucagagugaugagacuggugaagcugcugagcaagggcgagggcaucagaacccugcuguggaccuucaucaagagcuuccaggcccugcccuacguggcccugcugaucgccaugaucuucuucaucuacgccgugaucggcaugcagauguucggcaagguggcccugcaggacggcacccagaucaacagaaacaacaacuuccagaccuucccccaggccgugcugcugcuguucagaugcgccaccggcgaggccuggcaggagaucaugcuggccagccugcccggcaacagaugcgaccccgagagcgacuucggccccggcgaggaguucaccugcggcagcaacuucgccaucgccuacuucaucagcuucuucaugcugugcgccuuccugaucaucaaccuguucguggccgugaucauggacaacuucgacuaccugaccagagacuggagcauccugggcccccaccaccuggacgaguucaagagaaucuggagcgaguacgaccccggcgccaagggcagaaucaagcaccuggacgugguggcccugcugagaagaauccagcccccccugggcuucggcaagcugugcccccacagaguggccugcaagagacugguggccaugaacaugccccugaacagcgacggcaccgugaccuucaacgccacccuguucgcccuggugagaaccagccugaagaucaagaccgagggcaaccuggagcaggccaaccaggagcugagaaucgugaucaagaagaucuggaagagaaugaagcagaagcugcuggacgaggugauccccccccccgacgaggaggaggugaccgugggcaaguucuacgccaccuuccugauccaggacuacuucagaaaguucagaagaagaaaggagaagggccugcugggcaacgacgccgcccccagcaccagcagcgcccugcaggccggccugagaagccugcaggaccugggccccgagaugagacaggcccugaccugcgacaccgaggaggaggaggaggagggccaggagggcguggaggaggaggacgagaaggaccuggagaccaacaaggccaccauggugagccagcccagcgccagaagaggcagcggcaucagcgugagccugcccgugggcgacagacugcccgacagccugagcuucggccccagcgacgacgacagaggcacccccaccagcagccagcccagcgugccccaggccggcagcaacacccacagaagaggcagcggcgcccugaucuucaccauccccgaggagggcaacagccagcccaagggcaccaagggccagaacaagcaggacgaggacgaggaggugcccgacagacugagcuaccuggacgagcaggccggcaccccccccugcagcgugcugcugcccccccacagagcccagagauacauggacggccaccuggugcccagaagaagacugcugccccccacccccgccggcagaaagcccagcuucaccauccagugccugcagagacagggcagcugcgaggaccugcccauccccggcaccuaccacagaggcagaaacagcggccccaacagagcccagggcagcugggccacccccccccagagaggcagacugcuguacgccccccugcugcugguggaggagggcgccgccggcgagggcuaccugggcagaagcagcggcccccugagaaccuucaccugccugcacgugcccggcacccacagcgaccccagccacggcaagagaggcagcgccgacagccugguggaggccgugcugaucagcgagggccugggccuguucgccagagaccccagauucguggcccuggccaagcaggagaucgccgacgccugcagacugacccuggacgagauggacaacgccgccagcgaccugcuggcccagggcaccagcagccuguacagcgacgaggagagcauccugagcagauucgacgaggaggaccugggcgacgagauggccugcgugcacgcccuguaa

SEQ ID NO: 14555 - RNA, 6945 nt, Artificial Sequence
  CACNA1G__Homo_sapiens__NP_001243253
auggacgaggaggaggacggcgccggcgccgaggagagcggccagcccagaagcuucaugagacugaacgaccugagcggcgccggcggcagacccggccccggcagcgccgagaaggaccccggcagcgccgacagcgaggccgagggccugcccuaccccgcccuggcccccgugguguucuucuaccugagccaggacagcagacccagaagcuggugccugagaaccgugugcaaccccugguucgagagaaucagcaugcuggugauccugcugaacugcgugacccugggcauguucagacccugcgaggacaucgccugcgacagccagagaugcagaauccugcaggccuucgacgacuucaucuucgccuucuucgccguggagaugguggugaagaugguggcccugggcaucuucggcaagaagugcuaccugggcgacaccuggaacagacuggacuucuucaucgugaucgccggcaugcuggaguacagccuggaccugcagaacgugagcuucagcgccgugagaaccgugagagugcugagaccccugagagccaucaacagagugcccagcaugagaauccuggugacccugcugcuggacacccugcccaugcugggcaacgugcugcugcugugcuucuucguguucuucaucuucggcaucgugggcgugcagcugugggccggccugcugagaaacagaugcuuccugcccgagaacuucagccugccccugagcguggaccuggagagauacuaccagaccgagaacgaggacgagagccccuucaucugcagccagcccagagagaacggcaugagaagcugcagaagcgugcccacccugagaggcgacggcggcggcggcccccccugcggccuggacuacgaggccuacaacagcagcagcaacaccaccugcgugaacuggaaccaguacuacaccaacugcagcgccggcgagcacaaccccuucaagggcgccaucaacuucgacaacaucggcuacgccuggaucgccaucuuccaggugaucacccuggagggcuggguggacaucauguacuucgugauggacgcccacagcuucuacaacuucaucuacuucauccugcugaucaucgugggcagcuucuucaugaucaaccugugccugguggugaucgccacccaguucagcgagaccaagcagagagagagccagcugaugagagagcagagagugagauuccugagcaacgccagcacccuggccagcuucagcgagcccggcagcugcuacgaggagcugcugaaguaccugguguacauccugagaaaggccgccagaagacuggcccaggugagcagagccgccggcgugagagugggccugcugagcagccccgccccccugggcggccaggagacccagcccagcagcagcugcagcagaagccacagaagacugagcgugcaccaccuggugcaccaccaccaccaccaccaccaccacuaccaccugggcaacggcacccugagagcccccagagccagccccgagauccaggacagagacgccaacggcagcagaagacugaugcugcccccccccagcacccccgcccugagcggcgccccccccggcggcgccgagagcgugcacagcuucuaccacgccgacugccaccuggagcccgugagaugccaggcccccccccccagaagccccagcgaggccagcggcagaaccgugggcagcggcaagguguaccccaccgugcacaccagccccccccccgagacccugaaggagaaggcccugguggagguggccgccagcagcggcccccccacccugaccagccugaacaucccccccggccccuacagcagcaugcacaagcugcuggagacccagagcaccggcgccugccagagcagcugcaagaucagcagccccugccugaaggccgacagcggcgccugcggccccgacagcugccccuacugcgccagagccggcgccggcgagguggagcuggccgacagagagaugcccgacagcgacagcgaggccguguacgaguucacccaggacgcccagcacagcgaccugagagacccccacagcagaagacagagaagccugggccccgacgccgagcccagcagcgugcuggccuucuggagacugaucugcgacaccuucagaaagaucguggacagcaaguacuucggcagaggcaucaugaucgccauccuggugaacacccugagcaugggcaucgaguaccacgagcagcccgaggagcugaccaacgcccuggagaucagcaacaucguguucaccagccuguucgcccuggagaugcugcugaagcugcugguguacggccccuucggcuacaucaagaaccccuacaacaucuucgacggcgugaucguggugaucagcgugugggagaucgugggccagcagggcggcggccugagcgugcugagaaccuucagacugaugagagugcugaagcuggugagauuccugcccgcccugcagagacagcugguggugcugaugaagaccauggacaacguggccaccuucugcaugcugcugaugcuguucaucuucaucuucagcauccugggcaugcaccuguucggcugcaaguucgccagcgagagagacggcgacacccugcccgacagaaagaacuucgacagccugcugugggccaucgugaccguguuccagauccugacccaggaggacuggaacaaggugcuguacaacggcauggccagcaccagcagcugggccgcccuguacuucaucgcccugaugaccuucggcaacuacgugcuguucaaccugcugguggccauccugguggagggcuuccaggccgaggagaucagcaagagagaggacgccagcggccagcugagcugcauccagcugcccguggacagccagggcggcgacgccaacaagagcgagagcgagcccgacuucuucagccccagccuggacggcgacggcgacagaaagaagugccuggcccuggugagccugggcgagcaccccgagcugagaaagagccugcugcccccccugaucauccacaccgccgccacccccaugagccugcccaagagcaccagcaccggccugggcgaggcccugggccccgccagcagaagaaccagcagcagcggcagcgccgagcccggcgccgcccacgagaugaagagcccccccagcgccagaagcagcccccacagccccuggagcgccgccagcagcuggaccagcagaagaagcagcagaaacagccugggcagagcccccagccugaagagaagaagccccagcggcgagagaagaagccugcugagcggcgagggccaggagagccaggacgaggaggagagcagcgaggaggagagagccagccccgccggcagcgaccacagacacagaggcagccuggagagagaggccaagagcagcuucgaccugcccgacacccugcaggugcccggccugcacagaaccgccagcggcagaggcagcgccagcgagcaccaggacugcaacggcaagagcgccagcggcagacuggccagagcccugagacccgacgaccccccccuggacggcgacgacgccgacgacgagggcaaccugagcaagggcgagagagugagagccuggaucagagccagacugcccgccugcugccuggagagagacagcuggagcgccuacaucuuccccccccagagcagauucagacugcugugccacagaaucaucacccacaagauguucgaccacguggugcuggugaucaucuuccugaacugcaucaccaucgccauggagagacccaagaucgacccccacagcgccgagagaaucuuccugacccugagcaacuacaucuucaccgccguguuccuggccgagaugaccgugaaggugguggcccugggcuggugcuucggcgagcaggccuaccugagaagcagcuggaacgugcuggacggccugcuggugcugaucagcgugaucgacauccuggugagcauggugagcgacagcggcaccaagauccugggcaugcugagagugcugagacugcugagaacccugagaccccugagagugaucagcagagcccagggccugaagcuggugguggagacccugaugagcagccugaagcccaucggcaacaucguggugaucugcugcgccuucuucaucaucuucggcauccugggcgugcagcuguucaagggcaaguucuucgugugccagggcgaggacaccagaaacaucaccaacaagagcgacugcgccgaggccagcuacagaugggugagacacaaguacaacuucgacaaccugggccaggcccugaugagccuguucgugcuggccagcaaggacggcuggguggacaucauguacgacggccuggacgccgugggcguggaccagcagcccaucaugaaccacaaccccuggaugcugcuguacuucaucagcuuccugcugaucguggccuucuucgugcugaacauguucgugggcguggugguggagaacuuccacaagugcagacagcaccaggaggaggaggaggccagaagaagagaggagaagagacugagaagacuggagaagaagagaagaaaggcccagugcaagcccuacuacagcgacuacagcagauucagacugcuggugcaccaccugugcaccagccacuaccuggaccuguucaucaccggcgugaucggccugaacguggugaccauggccauggagcacuaccagcagccccagauccuggacgaggcccugaagaucugcaacuacaucuucaccgugaucuucgugcuggagagcguguucaagcugguggccuucggcuucagaagauucuuccaggacagauggaaccagcuggaccuggccaucgugcugcugagcaucaugggcaucacccuggaggagaucgaggugaacgccagccugcccaucaaccccaccaucaucagaaucaugagagugcugagaaucgccagagugcugaagcugcugaagauggccgugggcaugagagcccugcuggacaccgugaugcaggcccugccccaggugggcaaccugggccugcuguucaugcugcuguucuucaucuucgccgcccugggcguggagcuguucggcgaccuggagugcgacgagacccaccccugcgagggccugggcagacacgccaccuucagaaacuucggcauggccuuccugacccuguucagagugagcaccggcgacaacuggaacggcaucaugaaggacacccugagagacugcgaccaggagagcaccugcuacaacaccgugaucagccccaucuacuucgugagcuucgugcugaccgcccaguucgugcuggugaacguggugaucgccgugcugaugaagcaccuggaggagagcaacaaggaggccaaggaggaggccgagcuggaggccgagcuggagcuggagaugaagacccugagcccccagccccacagcccccugggcagccccuuccuguggcccggcguggagggccccgacagccccgacagccccaagcccggcgcccugcaccccgccgcccacgccagaagcgccagccacuucagccuggagcaccccaccgacagacagcuguucgacaccaucagccugcugauccagggcagccuggagugggagcugaagcugauggacgagcuggccggccccggcggccagcccagcgccuuccccagcgcccccagccugggcggcagcgacccccagaugcagccccaccccaccgagcugcccggccccgaccugcugaccgugagaaagagcggcgugagcagaacccacagccugcccaacgacagcuacaugugcagacacggcagcaccgccgagggcccccugggccacagaggcuggggccugcccaaggcccagagcggcagcgugcugagcgugcacagccagcccgccgacaccagcuacauccugcagcugcccaaggacgccccccaccugcugcagccccacagcgcccccaccuggggcaccauccccaagcugcccccccccggcagaagcccccuggcccagagaccccugagaagacaggccgccaucagaaccgacagccuggacgugcagggccugggcagcagagaggaccugcuggccgaggugagcggccccagccccccccuggccagagccuacagcuucuggggccagagcagcacccaggcccagcagcacagcagaagccacagcaagaucagcaagcacaugaccccccccgcccccugccccggccccgagcccaacuggggcaagggcccccccgagaccagaagcagccuggagcuggacaccgagcugagcuggaucagcggcgaccugcugccccccggcggccaggaggagccccccagccccagagaccugaagaagugcuacagcguggaggcccagagcugccagagaagacccaccagcuggcuggacgagcagagaagacacagcaucgccgugagcugccuggacagcggcagccagccccaccugggcaccgaccccagcaaccugggcggccagccccugggcggccccggcagcagacccaagaagaagcugagcccccccagcaucaccaucgacccccccgagagccagggccccagaaccccccccagccccggcaucugccugagaagaagagcccccagcagcgacagcaaggacccccuggccagcggcccccccgacagcauggccgccagccccagccccaagaaggacgugcugagccugagcggccugagcagcgaccccgccgaccuggaccccuaa

SEQ ID NO: 14556 - RNA, 7044 nt, Artificial Sequence
  CACNA1H__Homo_sapiens__NP_001005407
augaccgagggcgccagagccgccgacgaggugagagugccccugggcgcccccccccccggccccgccgcccuggugggcgccagccccgagagccccggcgcccccggcagagaggccgagagaggcagcgagcugggcgugagccccagcgagagccccgccgccgagagaggcgccgagcugggcgccgacgaggagcagagagugcccuaccccgcccuggccgccaccguguucuucugccugggccagaccaccagacccagaagcuggugccugagacuggugugcaaccccugguucgagcacgugagcaugcuggugaucaugcugaacugcgugacccugggcauguucagacccugcgaggacguggagugcggcagcgagagaugcaacauccuggaggccuucgacgccuucaucuucgccuucuucgccguggagauggugaucaagaugguggcccugggccuguucggccagaagugcuaccugggcgacaccuggaacagacuggacuucuucaucgugguggccggcaugauggaguacagccuggacggccacaacgugagccugagcgccaucagaaccgugagagugcugagaccccugagagccaucaacagagugcccagcaugagaauccuggugacccugcugcuggacacccugcccaugcugggcaacgugcugcugcugugcuucuucguguucuucaucuucggcaucgugggcgugcagcugugggccggccugcugagaaacagaugcuuccuggacagcgccuucgugagaaacaacaaccugaccuuccugagacccuacuaccagaccgaggagggcgaggagaaccccuucaucugcagcagcagaagagacaacggcaugcagaagugcagccacauccccggcagaagagagcugagaaugcccugcacccugggcugggaggccuacacccagccccaggccgagggcgugggcgccgccagaaacgccugcaucaacuggaaccaguacuacaacgugugcagaagcggcgacagcaacccccacaacggcgccaucaacuucgacaacaucggcuacgccuggaucgccaucuuccaggugaucacccuggagggcuggguggacaucauguacuacgugauggacgcccacagcuucuacaacuucaucuacuucauccugcugaucaucgugggcagcuucuucaugaucaaccugugccugguggugaucgccacccaguucagcgagaccaagcagagagagagccagcugaugagagagcagagagccagacaccugagcaacgacagcacccuggccagcuucagcgagcccggcagcugcuacgaggagcugcugaaguacgugggccacaucuucagaaaggugaagagaagaagccugagacuguacgccagauggcagagcagauggagaaagaagguggaccccagcgccgugcagggccagggccccggccacagacagagaagagccggcagacacaccgccagcgugcaccaccugguguaccaccaccaccaccaccaccaccaccacuaccacuucagccacggcagccccagaagacccggccccgagcccggcgccugcgacaccagacuggugagagccggcgccccccccagcccccccagccccggcagaggcccccccgacgccgagagcgugcacagcaucuaccacgccgacugccacaucgagggcccccaggagagagccagaguggcccacgccgccgccaccgccgccgccagccugagacuggccaccggccugggcaccaugaacuaccccaccauccugcccagcggcgugggcagcggcaagggcagcaccagccccggccccaagggcaagugggccggcggcccccccggcaccggcggccacggcccccugagccugaacagccccgaccccuacgagaagaucccccacguggugggcgagcacggccugggccaggcccccggccaccugagcggccugagcgugcccugcccccugcccagcccccccgccggcacccugaccugcgagcugaagagcugccccuacugcaccagagcccuggaggaccccgagggcgagcugagcggcagcgagagcggcgacagcgacggcagaggcguguacgaguucacccaggacgugagacacggcgacagaugggaccccaccagaccccccagagccaccgacacccccggccccggccccggcagcccccagagaagagcccagcagagagccgcccccggcgagcccggcuggaugggcagacugugggugaccuucagcggcaagcugagaagaaucguggacagcaaguacuucagcagaggcaucaugauggccauccuggugaacacccugagcaugggcguggaguaccacgagcagcccgaggagcugaccaacgcccuggagaucagcaacaucguguucaccagcauguucgcccuggagaugcugcugaagcugcuggccugcggcccccugggcuacaucagaaaccccuacaacaucuucgacggcaucaucguggugaucagcgugugggagaucgugggccaggccgacggcggccugagcgugcugagaaccuucagacugcugagagugcugaagcuggugagauuccugcccgcccugagaagacagcugguggugcuggugaagaccauggacaacguggccaccuucugcacccugcugaugcuguucaucuucaucuucagcauccugggcaugcaccuguucggcugcaaguucagccugaagaccgacaccggcgacaccgugcccgacagaaagaacuucgacagccugcugugggccaucgugaccguguuccagauccugacccaggaggacuggaacguggugcuguacaacggcauggccagcaccagcagcugggccgcccuguacuucguggcccugaugaccuucggcaacuacgugcuguucaaccugcugguggccauccugguggagggcuuccaggccgagggcgacgccaacagaagcgacaccgacgaggacaagaccagcgugcacuucgaggaggacuuccacaagcugagagagcugcagaccaccgagcugaagaugugcagccuggccgugacccccaacggccaccuggagggcagaggcagccugagccccccccugaucaugugcaccgccgccacccccaugcccacccccaagagcagccccuuccuggacgccgcccccagccugcccgacagcagaagaggcagcagcagcagcggcgaccccccccugggcgaccagaagccccccgccagccugagaagcagccccugcgcccccuggggccccagcggcgccuggagcagcagaagaagcagcuggagcagccugggcagagcccccagccugaagagaagaggccagugcggcgagagagagagccugcugagcggcgagggcaagggcagcaccgacgacgaggccgaggacggcagagccgcccccggccccagagccaccccccugagaagagccgagagccuggaccccagaccccugagacccgccgcccugccccccaccaagugcagagacagagacggccaggugguggcccugcccagcgacuucuuccugagaaucgacagccacagagaggacgccgccgagcuggacgacgacagcgaggacagcugcugccugagacugcacaaggugcuggagcccuacaagccccaguggugcagaagcagagaggccugggcccuguaccuguucagcccccagaacagauucagagugagcugccagaaggugaucacccacaagauguucgaccacguggugcugguguucaucuuccugaacugcgugaccaucgcccuggagagacccgacaucgaccccggcagcaccgagagaguguuccugagcgugagcaacuacaucuucaccgccaucuucguggccgagaugauggugaaggugguggcccugggccugcugagcggcgagcacgccuaccugcagagcagcuggaaccugcuggacggccugcuggugcuggugagccugguggacaucgugguggccauggccagcgccggcggcgccaagauccugggcgugcugagagugcugagacugcugagaacccugagaccccugagagugaucagcagagcccccggccugaagcuggugguggagacccugaucagcagccugagacccaucggcaacaucgugcugaucugcugcgccuucuucaucaucuucggcauccugggcgugcagcuguucaagggcaaguucuacuacugcgagggccccgacaccagaaacaucagcaccaaggcccagugcagagccgcccacuacagaugggugagaagaaaguacaacuucgacaaccugggccaggcccugaugagccuguucgugcugagcagcaaggacggcugggugaacaucauguacgacggccuggacgccgugggcguggaccagcagcccgugcagaaccacaaccccuggaugcugcuguacuucaucagcuuccugcugaucgugagcuucuucgugcugaacauguucgugggcguggugguggagaacuuccacaagugcagacagcaccaggaggccgaggaggccagaagaagagaggagaagagacugagaagacuggagagaagaagaagaaaggcccagagaagacccuacuacgccgacuacagccccaccagaagaagcauccacagccugugcaccagccacuaccuggaccuguucaucaccuucaucaucugcgugaacgugaucaccaugagcauggagcacuacaaccagcccaagagccuggacgaggcccugaaguacugcaacuacguguucaccaucguguucguguucgaggccgcccugaagcugguggccuucggcuucagaagauucuucaaggacagauggaaccagcuggaccuggccaucgugcugcugagccugaugggcaucacccuggaggagaucgagaugagcgccgcccugcccaucaaccccaccaucaucagaaucaugagagugcugagaaucgccagagugcugaagcugcugaagauggccaccggcaugagagcccugcuggacaccguggugcaggcccugccccaggugggcaaccugggccugcuguucaugcugcuguucuucaucuacgccgcccugggcguggagcuguucggcagacuggagugcagcgaggacaaccccugcgagggccugagcagacacgccaccuucagcaacuucggcauggccuuccugacccuguucagagugagcaccggcgacaacuggaacggcaucaugaaggacacccugagagagugcagcagagaggacaagcacugccugagcuaccugcccgcccugagccccguguacuucgugaccuucgugcugguggcccaguucgugcuggugaacguggugguggccgugcugaugaagcaccuggaggagagcaacaaggaggccagagaggacgccgagcuggacgccgagaucgagcuggagauggcccagggccccggcagcgccagaagaguggacgccgacagacccccccugccccaggagagccccggcgccagagacgcccccaaccugguggccagaaaggugagcgugagcagaaugcugagccugcccaacgacagcuacauguucagacccguggugcccgccagcgccccccaccccagaccccugcaggagguggagauggagaccuacggcgccggcaccccccugggcagcguggccagcgugcacagcccccccgccgagagcugcgccagccugcagaucccccuggccgugagcagccccgccagaagcggcgagccccugcacgcccugagccccagaggcaccgccagaagccccagccugagcagacugcugugcagacaggaggccgugcacaccgacagccuggagggcaagaucgacagccccagagacacccuggaccccgccgagcccggcgagaagacccccgugagacccgugacccagggcggcagccugcagagcccccccagaagccccagacccgccagcgugagaaccagaaagcacaccuucggccagagaugcgugagcagcagacccgccgcccccggcggcgaggaggccgaggccagcgaccccgccgacgaggaggugagccacaucaccagcagcgccugccccuggcagcccaccgccgagccccacggccccgaggccagccccguggccggcggcgagagagaccugagaagacuguacagcguggacgcccagggcuuccuggacaagcccggcagagccgacgagcaguggagacccagcgccgagcugggcagcggcgagcccggcgaggccaaggccuggggccccgaggccgagcccgcccugggcgccagaagaaagaagaagaugagcccccccugcaucagcguggagccccccgccgaggacgagggcagcgccagacccagcgccgccgagggcggcagcaccacccugagaagaagaacccccagcugcgaggccaccccccacagagacagccuggagcccaccgagggcagcggcgccggcggcgaccccgccgccaagggcgagagauggggccaggccagcugcagagccgagcaccugaccgugcccagcuucgccuucgagccccuggaccugggcgugcccagcggcgaccccuuccuggacggcagccacagcgugacccccgagagcagagccagcagcagcggcgccaucgugccccuggagccccccgagagcgagccccccaugcccgugggcgacccccccgagaagagaagaggccuguaccugaccgugccccagugcccccuggagaagcccggcagccccagcgccacccccgcccccggcggcggcgccgacgaccccguguaa

SEQ ID NO: 14557 - RNA, 6672 nt, Artificial Sequence
  CACNA1I__Homo_sapiens__NP_066919
auggccgagagcgccagcccccccagcagcagcgccgccgcccccgccgccgagcccggcgugaccaccgagcagcccggccccagaagcccccccagcagcccccccggccuggaggagccccuggacggcgccgacccccacgugccccaccccgaccuggcccccaucgccuucuucugccugagacagaccaccagccccagaaacuggugcaucaagauggugugcaaccccugguucgagugcgugagcaugcuggugauccugcugaacugcgugacccugggcauguaccagcccugcgacgacauggacugccugagcgacagaugcaagauccugcagguguucgacgacuucaucuucaucuucuucgccauggagauggugcugaagaugguggcccugggcaucuucggcaagaagugcuaccugggcgacaccuggaacagacuggacuucuucaucgugauggccggcaugguggaguacagccuggaccugcagaacaucaaccugagcgccaucagaaccgugagagugcugagaccccugaaggccaucaacagagugcccagcaugagaauccuggugaaccugcugcuggacacccugcccaugcugggcaacgugcugcugcugugcuucuucguguucuucaucuucggcaucaucggcgugcagcugugggccggccugcugagaaacagaugcuuccuggaggagaacuucaccauccagggcgacguggcccugccccccuacuaccagcccgaggaggacgacgagaugcccuucaucugcagccugagcggcgacaacggcaucaugggcugccacgagauccccccccugaaggagcagggcagagagugcugccugagcaaggacgacguguacgacuucggcgccggcagacaggaccugaacgccagcggccugugcgugaacuggaacagauacuacaacgugugcagaaccggcagcgccaacccccacaagggcgccaucaacuucgacaacaucggcuacgccuggaucgugaucuuccaggugaucacccuggagggcuggguggagaucauguacuacgugauggacgcccacagcuucuacaacuucaucuacuucauccugcugaucaucgugggcagcuucuucaugaucaaccugugccugguggugaucgccacccaguucagcgagaccaagcagagagagcacagacugaugcuggagcagagacagagauaccugagcagcagcaccguggccagcuacgccgagcccggcgacugcuacgaggagaucuuccaguacgugugccacauccugagaaaggccaagagaagagcccugggccuguaccaggcccugcagagcagaagacaggcccugggccccgaggcccccgcccccgccaagcccggcccccacgccaaggagcccagacacuaccacggcaagaccaagggccagggcgacgagggcagacaccugggcagcagacacugccagacccugcacggccccgccagccccggcaacgaccacagcggcagagagcugugcccccagcacagcccccuggacgccaccccccacacccuggugcagcccauccccgccacccuggccagcgaccccgccagcugccccugcugccagcacgaggacggcagaagacccagcggccugggcagcaccgacagcggccaggagggcagcggcagcggcagcagcgccggcggcgaggacgaggccgacggcgacggcgccagaagcagcgaggacggcgccagcagcgagcugggcaaggaggaggaggaggaggagcaggccgacggcgccguguggcugugcggcgacguguggagagagaccagagccaagcugagaggcaucguggacagcaaguacuucaacagaggcaucaugauggccauccuggugaacaccgugagcaugggcaucgagcaccacgagcagcccgaggagcugaccaacauccuggagaucugcaacgugguguucaccagcauguucgcccuggagaugauccugaagcuggccgccuucggccuguucgacuaccugagaaaccccuacaacaucuucgacagcaucaucgugaucaucagcaucugggagaucgugggccaggccgacggcggccugagcgugcugagaaccuucagacugcugagagugcugaagcuggugagauucaugcccgcccugagaagacagcugguggugcugaugaagaccauggacaacguggccaccuucugcaugcugcugaugcuguucaucuucaucuucagcauccugggcaugcacaucuucggcugcaaguucagccugagaaccgacaccggcgacaccgugcccgacagaaagaacuucgacagccugcugugggccaucgugaccguguuccagauccugacccaggaggacuggaacguggugcuguacaacggcauggccagcaccagccccugggccagccuguacuucguggcccugaugaccuucggcaacuacgugcuguucaaccugcugguggccauccugguggagggcuuccaggccgagggcgacgccaacagaagcuacagcgacgaggaccagagcagcagcaacaucgaggaguucgacaagcugcaggagggccuggacagcagcggcgaccccaagcugugccccauccccaugacccccaacggccaccuggaccccagccugccccugggcggccaccugggccccgccggcgccgccggccccgcccccagacugagccugcagcccgaccccaugcugguggcccugggcagcagaaagagcagcgugaugagccugggcagaaugagcuacgaccagagaagccugagcagcagcagaagcagcuacuacggccccuggggcagaagcgccgccugggccagcagaagaagcagcuggaacagccugaagcacaagccccccagcgccgagcacgagagccugcugagcgccgagagaggcggcggcgccagagugugcgagguggccgccgacgagggcccccccagagccgccccccugcacaccccccacgcccaccacauccaccacggcccccaccuggcccacagacacagacaccacagaagaacccugagccuggacaacagagacagcguggaccuggccgagcuggugcccgccgugggcgcccaccccagagccgccuggagagccgccggccccgcccccggccacgaggacugcaacggcagaaugcccagcaucgccaaggacguguucaccaagaugggcgacagaggcgacagaggcgaggacgaggaggagaucgacuacacccugugcuucagagugagaaagaugaucgacguguacaagcccgacuggugcgaggugagagaggacuggagcguguaccuguucagccccgagaacagauucagagugcugugccagaccaucaucgcccacaagcuguucgacuacguggugcuggccuucaucuuccugaacugcaucaccaucgcccuggagagaccccagaucgaggccggcagcaccgagagaaucuuccugaccgugagcaacuacaucuucaccgccaucuucgugggcgagaugacccugaagguggugagccugggccuguacuucggcgagcaggccuaccugagaagcagcuggaacgugcuggacggcuuccugguguucgugagcaucaucgacaucguggugagccuggccagcgccggcggcgccaagauccugggcgugcugagagugcugagacugcugagaacccugagaccccugagagugaucagcagagcccccggccugaagcuggugguggagacccugaucagcagccugaagcccaucggcaacaucgugcugaucugcugcgccuucuucaucaucuucggcauccugggcgugcagcuguucaagggcaaguucuaccacugccugggcguggacaccagaaacaucaccaacagaagcgacugcauggccgccaacuacagaugggugcaccacaaguacaacuucgacaaccugggccaggcccugaugagccuguucgugcuggccagcaaggacggcugggugaacaucauguacaacggccuggacgccguggccguggaccagcagcccgugaccaaccacaaccccuggaugcugcuguacuucaucagcuuccugcugaucgugagcuucuucgugcugaacauguucgugggcguggugguggagaacuuccacaagugcagacagcaccaggaggccgaggaggccagaagaagagaggagaagagacugagaagacuggagaagaagagaagaaaggcccagagacugcccuacuacgccaccuacugccacaccagacugcugauccacagcaugugcaccagccacuaccuggacaucuucaucaccuucaucaucugccugaacguggugaccaugagccuggagcacuacaaccagcccaccagccuggagaccgcccugaaguacugcaacuacauguucaccaccguguucgugcuggaggccgugcugaagcugguggccuucggccugagaagauucuucaaggacagauggaaccagcuggaccuggccaucgugcugcugagcgugaugggcaucacccuggaggagaucgagaucaacgccgcccugcccaucaaccccaccaucaucagaaucaugagagugcugagaaucgccagagugcugaagcugcugaagauggccaccggcaugagagcccugcuggacaccguggugcaggcccugccccaggugggcaaccugggccugcuguucaugcugcuguucuucaucuacgccgcccugggcguggagcuguucggcaagcuggugugcaacgacgagaaccccugcgagggcaugagcagacacgccaccuucgagaacuucggcauggccuuccugacccuguuccaggugagcaccggcgacaacuggaacggcaucaugaaggacacccugagagacugcacccacgacgagagaagcugccugagcagccugcaguucgugagcccccuguacuucgugagcuucgugcugaccgcccaguucgugcugaucaacguggugguggccgugcugaugaagcaccuggacgacagcaacaaggaggcccaggaggacgccgagauggacgccgagcuggagcuggagauggcccacggccugggccccggccccagacugcccaccggcagccccggcgcccccggcagaggccccggcggcgccggcggcggcggcgacaccgagggcggccugugcagaagaugcuacagccccgcccaggagaaccuguggcuggacagcgugagccugaucaucaaggacagccuggagggcgagcugaccaucaucgacaaccugagcggcagcaucuuccaccacuacagcagccccgccggcugcaagaagugccaccacgacaagcaggaggugcagcuggccgagaccgaggccuucagccugaacagcgacagaagcagcagcauccugcugggcgacgaccugagccuggaggaccccaccgccugcccccccggcagaaaggacagcaagggcgagcuggacccccccgagcccaugagagugggcgaccugggcgagugcuucuucccccugagcagcaccgccgugagccccgaccccgagaacuuccugugcgagauggaggagauccccuucaaccccgugagaagcuggcugaagcacgacagcagccaggccccccccagccccuucagccccgacgccagcagcccccugcugcccaugcccgccgaguucuuccaccccgccgugagcgccagccagaagggccccgagaagggcaccggcaccggcacccugcccaagaucgcccugcagggcagcugggccagccugagaagccccagagugaacugcacccugcugagacaggccaccggcagcgacaccagccuggacgccagccccagcagcagcgccggcagccugcagaccacccuggaggacagccugacccugagcgacagccccagaagagcccugggcccccccgcccccgcccccggccccagagccggccugagccccgccgccagaagaagacugagccugagaggcagaggccuguucagccugagaggccugagagcccaccagagaagccacagcagcggcggcagcaccagccccggcugcacccaccacgacagcauggaccccagcgacgaggagggcagaggcggcgccggcggcggcggcgccggcagcgagcacagcgagacccugagcagccugagccugaccagccuguucugcccccccccccccccccccgcccccggccugacccccgccagaaaguucagcagcaccagcagccuggccgcccccggcagaccccacgccgccgcccuggcccacggccuggccagaagccccagcugggccgccgacagaagcaaggacccccccggcagagccccccugcccaugggccugggcccccuggccccccccccccagccccugcccggcgagcuggagcccggcgacgccgccagcaagagaaagagauaa

SEQ ID NO: 14558 - RNA, 5622 nt, Artificial Sequence
  CACNA1S__Homo_sapiens__NP_000060
auggagcccagcagcccccaggacgagggccugagaaagaagcagcccaagaagcccgugcccgagauccugcccagaccccccagagcccuguucugccugacccuggagaacccccugagaaaggccugcaucagcaucguggaguggaagcccuucgagaccaucauccugcugaccaucuucgccaacugcguggcccuggccguguaccugcccaugcccgaggacgacaacaacagccugaaccugggccuggagaagcuggaguacuucuuccugaucguguucagcaucgaggccgccaugaagaucaucgccuacggcuuccuguuccaccaggacgccuaccugagaagcggcuggaacgugcuggacuucaccaucguguuccugggcguguucaccgugauccuggagcaggugaacgugauccagagccacaccgcccccaugagcagcaagggcgccggccuggacgugaaggcccugagagccuucagagugcugagaccccugagacuggugagcggcgugcccagccugcagguggugcugaacagcaucuucaaggccaugcugccccuguuccacaucgcccugcuggugcuguucauggugaucaucuacgccaucaucggccuggagcuguucaagggcaagaugcacaagaccugcuacuucaucggcaccgacaucguggccaccguggagaacgaggagcccagccccugcgccagaaccggcagcggcagaagaugcaccaucaacggcagcgagugcagaggcggcuggcccggccccaaccacggcaucacccacuucgacaacuucggcuucagcaugcugaccguguaccagugcaucaccauggagggcuggaccgacgugcuguacugggugaacgacgccaucggcaacgaguggcccuggaucuacuucgugacccugauccugcugggcagcuucuucauccugaaccuggugcugggcgugcugagcggcgaguucaccaaggagagagagaaggccaagagcagaggcaccuuccagaagcugagagagaagcagcagcuggacgaggaccugagaggcuacaugagcuggaucacccagggcgaggugauggacguggaggacuucagagagggcaagcugagccuggacgagggcggcagcgacaccgagagccuguacgagaucgccggccugaacaagaucauccaguucaucagacacuggagacaguggaacagaaucuucagauggaagugccacgacaucgugaagagcaagguguucuacuggcuggugauccugaucguggcccugaacacccugagcaucgccagcgagcaccacaaccagccccuguggcugaccagacugcaggacaucgccaacagagugcugcugagccuguucaccaccgagaugcugaugaagauguacggccugggccugagacaguacuucaugagcaucuucaacagauucgacugcuucguggugugcagcggcauccuggagauccugcugguggagagcggcgccaugaccccccugggcaucagcgugcugagaugcaucagacugcugagaaucuucaagaucaccaaguacuggaccagccugagcaaccugguggccagccugcugaacagcaucagaagcaucgccagccugcugcugcugcuguuccuguucaucgugaucuucgcccugcugggcaugcagcuguucggcggcagauacgacuucgaggacaccgaggugagaagaagcaacuucgacaacuucccccaggcccugaucagcguguuccaggugcugaccggcgaggacuggaccagcaugauguacaacggcaucauggccuacggcggccccagcuaccccggcaugcuggugugcaucuacuucaucauccuguucgugugcggcaacuacauccugcugaacguguuccuggccaucgccguggacaaccuggccgaggccgagagccugaccagcgcccagaaggccaaggccgaggagaagaagagaagaaagaugagcaagggccugcccgacaagagcgaggaggagaagagcaccauggccaagaagcuggagcagaagcccaagggcgagggcauccccaccaccgccaagcugaagaucgacgaguucgagagcaacgugaacgaggugaaggaccccuaccccagcgccgacuuccccggcgacgacgaggaggacgagcccgagaucccccugagccccagacccagaccccuggccgagcugcagcugaaggagaaggccgugcccauccccgaggccagcagcuucuucaucuucagccccaccaacaagaucagagugcugugccacagaaucgugaacgccaccugguucaccaacuucauccugcuguucauccugcugagcagcgccgcccuggccgccgaggaccccaucagagccgacagcaugagaaaccagauccugaagcacuucgacaucggcuucaccagcguguucaccguggagaucgugcugaagaugaccaccuacggcgccuuccugcacaagggcagcuucugcagaaacuacuucaacaugcuggaccugcuggugguggccgugagccugaucagcaugggccuggagagcagcgccaucagcguggugaagauccugagagugcugagagugcugagaccccugagagccaucaacagagccaagggccugaagcacguggugcagugcauguucguggccaucagcaccaucggcaacaucgugcuggugaccacccugcugcaguucauguucgccugcaucggcgugcagcuguucaagggcaaguucuucagaugcaccgaccugagcaagaugaccgaggaggagugcagaggcuacuacuacguguacaaggacggcgaccccaugcagaucgagcugagacacagagagugggugcacagcgacuuccacuucgacaacgugcugagcgccaugaugagccuguucaccgugagcaccuucgagggcuggccccagcugcuguacaaggccaucgacagcaacgccgaggacgugggccccaucuacaacaacagaguggagauggccaucuucuucaucaucuacaucauccugaucgccuucuucaugaugaacaucuucgugggcuucgugaucgugaccuuccaggagcagggcgagaccgaguacaagaacugcgagcuggacaagaaccagagacagugcgugcaguacgcccugaaggccagaccccugagaugcuacauccccaagaaccccuaccaguaccaggugugguacaucgugaccagcagcuacuucgaguaccugauguucgcccugaucaugcugaacaccaucugccugggcaugcagcacuacaaccagagcgagcagaugaaccacaucagcgacauccugaacguggccuucaccaucaucuucacccuggagaugauccugaagcugauggccuucaaggccagaggcuacuucggcgaccccuggaacguguucgacuuccugaucgugaucggcagcaucaucgacgugauccugagcgagaucgacaccuuccuggccagcagcggcggccuguacugccugggcggcggcugcggcaacguggaccccgacgagagcgccagaaucagcagcgccuucuucagacuguucagagugaugagacugaucaagcugcugagcagagccgagggcgugagaacccugcuguggaccuucaucaagagcuuccaggcccugcccuacguggcccugcugaucgugaugcuguucuucaucuacgccgugaucggcaugcagauguucggcaagaucgcccugguggacggcacccagaucaacagaaacaacaacuuccagaccuucccccaggccgugcugcugcuguucagaugcgccaccggcgaggccuggcaggagauccugcuggccugcagcuacggcaagcugugcgaccccgagagcgacuacgcccccggcgaggaguacaccugcggcaccaacuucgccuacuacuacuucaucagcuucuacaugcugugcgccuuccuggugaucaaccuguucguggccgugaucauggacaacuucgacuaccugaccagagacuggagcauccugggcccccaccaccuggacgaguucaaggccaucugggccgaguacgaccccgaggccaagggcagaaucaagcaccuggacguggugacccugcugagaagaauccagcccccccugggcuucggcaaguucugcccccacagaguggccugcaagagacuggugggcaugaacaugccccugaacagcgacggcaccgugaccuucaacgccacccuguucgcccuggugagaaccgcccugaagaucaagaccgagggcaacuucgagcaggccaacgaggagcugagagccaucaucaagaagaucuggaagagaaccagcaugaagcugcuggaccaggugaucccccccaucggcgacgacgaggugaccgugggcaaguucuacgccaccuuccugauccaggagcacuucagaaaguucaugaagagacaggaggaguacuacggcuacagacccaagaaggacaucgugcagauccaggccggccugagaaccaucgaggaggaggccgcccccgagaucugcagaaccgugagcggcgaccuggccgccgaggaggagcuggagagagccaugguggaggccgccauggaggagggcaucuucagaagaaccggcggccuguucggccagguggacaacuuccuggagagaaccaacagccugccccccgugauggccaaccagagaccccugcaguucgccgagaucgagauggaggagauggagagccccguguuccuggaggacuucccccaggaccccagaaccaacccccuggccagagccaacaccaacaacgccaacgccaacguggccuacggcaacagcaaccacagcaacagccacguguucagcagcgugcacuacgagagagaguuccccgaggagaccgagacccccgccaccagaggcagagcccugggccagcccugcagagugcugggcccccacagcaagcccugcguggagaugcugaagggccugcugacccagagagccaugcccagaggccaggccccccccgcccccugccagugccccagaguggagagcagcaugcccgaggacagaaagagcagcacccccggcagccugcacgaggagaccccccacagcagaagcaccagagagaacaccagcagaugcagcgcccccgccaccgcccugcugauccagaaggcccuggugagaggcggccugggcacccuggccgccgacgccaacuucaucauggccaccggccaggcccuggccgacgccugccagauggagcccgaggagguggagaucauggccaccgagcugcugaagggcagagaggcccccgagggcauggccagcagccugggcugccugaaccugggcagcagccugggcagccuggaccagcaccagggcagccaggagacccugaucccccccagacuguaa

SEQ ID NO: 14559 - RNA, 3276 nt, Artificial Sequence
  CACNA2D1__Homo_sapiens__NP_000713
auggccgccggcugccugcuggcccugacccugacccuguuccagagccugcugaucggccccagcagcgaggagcccuuccccagcgccgugaccaucaagagcuggguggacaagaugcaggaggaccuggugacccuggccaagaccgccagcggcgugaaccagcugguggacaucuacgagaaguaccaggaccuguacaccguggagcccaacaacgccagacagcugguggagaucgccgccagagacaucgagaagcugcugagcaacagaagcaaggcccuggugagacuggcccuggaggccgagaaggugcaggccgcccaccaguggagagaggacuucgccagcaacgaggugguguacuacaacgccaaggacgaccuggaccccgagaagaacgacagcgagcccggcagccagagaaucaagcccguguucaucgaggacgccaacuucggcagacagaucagcuaccagcacgccgccgugcacauccccaccgacaucuacgagggcagcaccaucgugcugaacgagcugaacuggaccagcgcccuggacgagguguucaagaagaacagagaggaggaccccagccugcuguggcagguguucggcagcgccaccggccuggccagauacuaccccgccagccccuggguggacaacagcagaacccccaacaagaucgaccuguacgacgugagaagaagacccugguacauccagggcgccgccagccccaaggacaugcugauccugguggacgugagcggcagcgugagcggccugacccugaagcugaucagaaccagcgugagcgagaugcuggagacccugagcgacgacgacuucgugaacguggccagcuucaacagcaacgcccaggacgugagcugcuuccagcaccuggugcaggccaacgugagaaacaagaaggugcugaaggacgccgugaacaacaucaccgccaagggcaucaccgacuacaagaagggcuucagcuucgccuucgagcagcugcugaacuacaacgugagcagagccaacugcaacaagaucaucaugcuguucaccgacggcggcgaggagagagcccaggagaucuucaacaaguacaacaaggacaagaaggugagaguguucaccuucagcgugggccagcacaacuacgacagaggccccauccaguggauggccugcgagaacaagggcuacuacuacgagauccccagcaucggcgccaucagaaucaacacccaggaguaccuggacgugcugggcagacccauggugcuggccggcgacaaggccaagcaggugcaguggaccaacguguaccuggacgcccuggagcugggccuggugaucaccggcacccugcccguguucaacaucaccggccaguucgagaacaagaccaaccugaagaaccagcugauccugggcgugaugggcguggacgugagccuggaggacaucaagagacugacccccagauucacccugugccccaacggcuacuacuucgccaucgaccccaacggcuacgugcugcugcaccccaaccugcagcccaagaaccccaagagccaggagcccgugacccuggacuuccuggacgccgagcuggagaacgacaucaagguggagaucagaaacaagaugaucgacggcgagagcggcgagaagaccuucagaacccuggugaagagccaggacgagagauacaucgacaagggcaacagaaccuacaccuggacccccgugaacggcaccgacuacagccuggcccuggugcugcccaccuacagcuucuacuacaucaaggccaagcuggaggagaccaucacccaggccagaagcaagaagggcaagaugaaggacagcgagacccugaagcccgacaacuucgaggagagcggcuacaccuucaucgcccccagagacuacugcaacgaccugaagaucagcgacaacaacaccgaguuccugcugaacuucaacgaguucaucgacagaaagacccccaacaaccccagcugcaacgccgaccugaucaacagagugcugcuggacgccggcuucaccaacgagcuggugcagaacuacuggagcaagcagaagaacaucaagggcgugaaggccagauucguggugaccgacggcggcaucaccagaguguaccccaaggaggccggcgagaacuggcaggagaaccccgagaccuacgaggacagcuucuacaagagaagccuggacaacgacaacuacguguucaccgcccccuacuucaacaagagcggccccggcgccuacgagagcggcaucauggugagcaaggccguggagaucuacauccagggcaagcugcugaagcccgccguggugggcaucaagaucgacgugaacagcuggaucgagaacuucaccaagaccagcaucagagaccccugcgccggccccgugugcgacugcaagagaaacagcgacgugauggacugcgugauccuggacgacggcggcuuccugcugauggccaaccacgacgacuacaccaaccagaucggcagauucuucggcgagaucgaccccagccugaugagacaccuggugaacaucagcguguacgccuucaacaagagcuacgacuaccagagcgugugcgagcccggcgccgcccccaagcagggcgccggccacagaagcgccuacgugcccagcguggccgacauccugcagaucggcuggugggccaccgccgccgccuggagcauccugcagcaguuccugcugagccugaccuuccccagacugcuggaggccguggagauggaggacgacgacuucaccgccagccugagcaagcagagcugcaucaccgagcagacccaguacuucuucgacaacgacagcaagagcuucagcggcgugcuggacugcggcaacugcagcagaaucuuccacggcgagaagcugaugaacaccaaccugaucuucaucaugguggagagcaagggcaccugccccugcgacaccagacugcugauccaggccgagcagaccagcgacggccccaaccccugcgacauggugaagcagcccagauacagaaagggccccgacgugugcuucgacaacaacgugcuggaggacuacaccgacugcggcggcgugagcggccugaaccccagccugugguacaucaucggcauccaguuccugcugcuguggcuggugagcggcagcacccacagacugcuguaa

SEQ ID NO: 14560 - RNA, 3438 nt, Artificial Sequence
  CACNA2D2__Homo_sapiens__NP_001005505
auggccgugcccgccagaaccugcggcgccagcagacccggccccgccagaaccgccagacccuggcccggcugcggcccccaccccggccccggcaccagaagacccaccagcggcccccccagaccccuguggcugcugcugccccugcugccccugcuggccgcccccggcgccagcgccuacagcuucccccagcagcacaccaugcagcacugggccagaagacuggagcaggagguggacggcgugaugagaaucuucggcggcgugcagcagcugagagagaucuacaaggacaacagaaaccuguucgaggugcaggagaacgagccccagaagcugguggagaagguggccggcgacaucgagagccugcuggacagaaaggugcaggcccugaagagacuggccgacgccgccgagaacuuccagaaggcccacagauggcaggacaacaucaaggaggaggacaucguguacuacgacgccaaggccgacgccgagcuggacgaccccgagagcgaggacguggagagaggcagcaaggccagcacccugagacuggacuucaucgaggaccccaacuucaagaacaaggugaacuacagcuacgccgccgugcagauccccaccgacaucuacaagggcagcaccgugauccugaacgagcugaacuggaccgaggcccuggagaacguguucauggagaacagaagacaggaccccacccugcuguggcagguguucggcagcgccaccggcgugaccagauacuaccccgccacccccuggagagcccccaagaagaucgaccuguacgacgugagaagaagacccugguacauccagggcgccagcagccccaaggacauggugaucaucguggacgugagcggcagcgugagcggccugacccugaagcugaugaagaccagcgugugcgagaugcuggacacccugagcgacgacgacuacgugaacguggccagcuucaacgagaaggcccagcccgugagcugcuucacccaccuggugcaggccaacgugagaaacaagaagguguucaaggaggccgugcagggcaugguggccaagggcaccaccggcuacaaggccggcuucgaguacgccuucgaccagcugcagaacagcaacaucaccagagccaacugcaacaagaugaucaugauguucaccgacggcggcgaggacagagugcaggacguguucgagaaguacaacuggcccaacagaaccgugagaguguucaccuucagcgugggccagcacaacuacgacgugaccccccugcaguggauggccugcgccaacaagggcuacuacuucgagauccccagcaucggcgccaucagaaucaacacccaggaguaccuggacgugcugggcagacccauggugcuggccggcaaggaggccaagcaggugcaguggaccaacguguacgaggacgcccugggccugggccugguggugaccggcacccugcccguguucaaccugacccaggacggccccggcgagaagaagaaccagcugauccugggcgugaugggcaucgacguggcccugaacgacaucaagagacugacccccaacuacacccugggcgccaacggcuacguguucgccaucgaccugaacggcuacgugcugcugcaccccaaccugaagccccagaccaccaacuucagagagcccgugacccuggacuuccuggacgccgagcuggaggacgagaacaaggaggagaucagaagaagcaugaucgacggcaacaagggccacaagcagaucagaacccuggugaagagccuggacgagagauacaucgacgaggugaccagaaacuacaccugggugcccaucagaagcaccaacuacagccugggccuggugcugccccccuacagcaccuucuaccugcaggccaaccugagcgaccagauccugcaggugaaguacuucgaguuccugcugcccagcagcuucgagagcgagggccacguguucaucgcccccagagaguacugcaaggaccugaacgccagcgacaacaacaccgaguuccugaagaacuucaucgagcugauggagaaggugacccccgacagcaagcagugcaacaacuuccugcugcacaaccugauccuggacaccggcaucacccagcagcugguggagagaguguggagagaccaggaccugaacaccuacagccugcuggccguguucgccgccaccgacggcggcaucaccagaguguuccccaacaaggccgccgaggacuggaccgagaaccccgagcccuucaacgccagcuucuacagaagaagccuggacaaccacggcuacguguucaagcccccccaccaggacgcccugcugagaccccuggagcuggagaacgacaccgugggcauccuggugagcaccgccguggagcugagccugggcagaagaacccugagacccgccguggugggcgugaagcuggaccuggaggccugggccgagaaguucaaggugcuggccagcaacagaacccaccaggaccagccccagaagugcggccccaacagccacugcgagauggacugcgaggugaacaacgaggaccugcugugcgugcugaucgacgacggcggcuuccuggugcugagcaaccagaaccaccagugggaccaggugggcagauucuucagcgagguggacgccaaccugaugcuggcccuguacaacaacagcuucuacaccagaaaggagagcuacgacuaccaggccgccugcgccccccagccccccggcaaccugggcgccgcccccagaggcguguucgugcccaccguggccgacuuccugaaccuggccugguggaccagcgccgccgccuggagccuguuccagcagcugcuguacggccugaucuaccacagcugguuccaggccgaccccgccgaggccgagggcagccccgagaccagagagagcagcugcgugaugaagcagacccaguacuacuucggcagcgugaacgccagcuacaacgccaucaucgacugcggcaacugcagcagacuguuccacgcccagagacugaccaacaccaaccugcuguucgugguggccgagaagccccugugcagccagugcgaggccggcagacugcugcagaaggagacccacugccccgccgacggccccgagcagugcgagcuggugcagagacccagauacagaagaggcccccacaucugcuucgacuacaacgccaccgaggacaccagcgacugcggcagaggcgccagcuucccccccagccugggcgugcuggugagccugcagcugcugcugcugcugggccugccccccagaccccagccccaggugcuggugcacgccagcagaagacuguaa

SEQ ID NO: 14561 - RNA, 3276 nt, Artificial Sequence
  CACNA2D3__Homo_sapiens__NP_060868
auggccggccccggcagccccagaagagccagcagaggcgccagcgcccugcuggccgccgcccugcuguacgccgcccugggcgacguggugagaagcgagcagcagaucccccugagcguggugaagcugugggccagcgccuucggcggcgagaucaagagcaucgccgccaaguacagcggcagccagcugcugcagaagaaguacaaggaguacgagaaggacguggccaucgaggagaucgacggccugcagcuggugaagaagcuggccaagaacauggaggagauguuccacaagaagagcgaggccgugagaagacugguggaggccgccgaggaggcccaccugaagcacgaguucgacgccgaccugcaguacgaguacuucaacgccgugcugaucaacgagagagacaaggacggcaacuuccuggagcugggcaaggaguucauccuggcccccaacgaccacuucaacaaccugcccgugaacaucagccugagcgacgugcaggugcccaccaacauguacaacaaggaccccgccaucgugaacggcguguacuggagcgagagccugaacaagguguucguggacaacuucgacagagaccccagccugaucuggcaguacuucggcagcgccaagggcuucuucagacaguaccccggcaucaagugggagcccgacgagaacggcgugaucgccuucgacugcagaaacagaaagugguacauccaggccgccaccagccccaaggacguggugauccugguggacgugagcggcagcaugaagggccugagacugaccaucgccaagcagaccgugagcagcauccuggacacccugggcgacgacgacuucuucaacaucaucgccuacaacgaggagcugcacuacguggagcccugccugaacggcacccuggugcaggccgacagaaccaacaaggagcacuucagagagcaccuggacaagcuguucgccaagggcaucggcaugcuggacaucgcccugaacgaggccuucaacauccugagcgacuucaaccacaccggccagggcagcaucugcagccaggccaucaugcugaucaccgacggcgccguggacaccuacgacaccaucuucgccaaguacaacuggcccgacagaaaggugagaaucuucaccuaccugaucggcagagaggccgccuucgccgacaaccugaaguggauggccugcgccaacaagggcuucuucacccagaucagcacccuggccgacgugcaggagaacgugauggaguaccugcacgugcugagcagacccaaggugaucgaccaggagcacgacgugguguggaccgaggccuacaucgacagcacccugccccaggcccagaagcugaccgacgaccagggccccgugcugaugaccaccguggccaugcccguguucagcaagcagaacgagaccagaagcaagggcauccugcugggcguggugggcaccgacgugcccgugaaggagcugcugaagaccauccccaaguacaagcugggcauccacggcuacgccuucgccaucaccaacaacggcuacauccugacccaccccgagcugagacugcuguacgaggagggcaagaagagaagaaagcccaacuacagcagcguggaccugagcgagguggagugggaggacagagacgacgugcugagaaacgccauggugaacagaaagaccggcaaguucagcauggaggugaagaagaccguggacaagggcaagagagugcuggugaugaccaacgacuacuacuacaccgacaucaagggcacccccuucagccugggcguggcccugagcagaggccacggcaaguacuucuucagaggcaacgugaccaucgaggagggccugcacgaccuggagcaccccgacgugagccuggccgacgaguggagcuacugcaacaccgaccugcaccccgagcacagacaccugagccagcuggaggccaucaagcuguaccugaagggcaaggagccccugcugcagugcgacaaggagcugauccaggaggugcuguucgacgccguggugagcgcccccaucgaggccuacuggaccagccuggcccugaacaagagcgagaacagcgacaagggcguggagguggccuuccugggcaccagaaccggccugagcagaaucaaccuguucgugggcgccgagcagcugaccaaccaggacuuccugaaggccggcgacaaggagaacaucuucaacgccgaccacuucccccugugguacagaagagccgccgagcagauccccggcagcuucguguacagcauccccuucagcaccggccccgugaacaagagcaacguggugaccgccagcaccagcauccagcugcuggacgagagaaagagccccgugguggccgccgugggcauccagaugaagcuggaguucuuccagagaaaguucuggaccgccagcagacagugcgccagccuggacggcaagugcagcaucagcugcgacgacgagaccgugaacugcuaccugaucgacaacaacggcuucauccuggugagcgaggacuacacccagaccggcgacuucuucggcgagaucgagggcgccgugaugaacaagcugcugaccaugggcagcuucaagagaaucacccuguacgacuaccaggccaugugcagagccaacaaggagagcagcgacggcgcccacggccugcuggaccccuacaacgccuuccugagcgccgugaaguggaucaugaccgagcuggugcuguuccugguggaguucaaccugugcagcugguggcacagcgacaugaccgccaaggcccagaagcugaagcagacccuggagcccugcgacaccgaguaccccgccuucgugagcgagagaaccaucaaggagaccaccggcaacaucgccugcgaggacugcagcaagagcuucgugauccagcagauccccagcagcaaccuguucaugguggugguggacagcagcugccugugcgagagcguggcccccaucaccauggcccccaucgagaucagauacaacgagagccugaagugcgagagacugaaggcccagaagaucagaagaagacccgagagcugccacggcuuccaccccgaggagaacgccagagagugcggcggcgcccccagccugcaggcccagaccgugcugcugcugcugccccugcugcugaugcuguucagcagauaa

SEQ ID NO: 14562 - RNA, 3414 nt, Artificial Sequence
  CACNA2D4__Homo_sapiens__NP_758952
auggugugcggcugcagcgcccugcugccccugcccaaccccagacccaccaugcccgccacccccaacuuccuggccaaccccagcagcagcagcagauggaucccccugcagcccaugcccguggccugggccuucgugcagaagaccagcgcccugcuguggcugcugcugcugggcaccagccugagccccgccuggggccaggccaagaucccccuggagaccgugaagcugugggccgacaccuucggcggcgaccuguacaacaccgugaccaaguacagcggcagccugcugcugcagaagaaguacaaggacguggagagcagccugaagaucgaggagguggacggccuggagcuggugagaaaguucagcgaggacauggagaacaugcugagaagaaagguggaggccgugcagaaccugguggaggccgccgaggaggccgaccugaaccacgaguucaacgagagccugguguucgacuacuacaacagcgugcugaucaacgagagagacgagaagggcaacuucguggagcugggcgccgaguuccugcuggagagcaacgcccacuucagcaaccugcccgugaacaccagcaucagcagcgugcagcugcccaccaacguguacaacaaggaccccgacauccugaacggcguguacaugagcgaggcccugaacgccguguucguggagaacuuccagagagaccccacccugaccuggcaguacuucggcagcgccaccggcuucuucagaaucuaccccggcaucaaguggacccccgacgagaacggcgugaucaccuucgacugcagaaacagaggcugguacauccaggccgccaccagccccaaggacaucgugauccugguggacgugagcggcagcaugaagggccugagaaugaccaucgccaagcacaccaucaccaccauccuggacacccugggcgagaacgacuucaucaacaucaucgccuacaacgacuacgugcacuacaucgagcccugcuucaagggcauccuggugcaggccgacagagacaacagagagcacuucaagcugcugguggaggagcugauggugaagggcgugggcgugguggaccaggcccugagagaggccuuccagauccugaagcaguuccaggaggccaagcagggcagccugugcaaccaggccaucaugcugaucagcgacggcgccguggaggacuacgagcccguguucgagaaguacaacuggcccgacugcaaggugagaguguucaccuaccugaucggcagagaggugagcuucgccgacagaaugaaguggaucgccugcaacaacaagggcuacuacacccagaucagcacccuggccgacacccaggagaacgugauggaguaccugcacgugcugagcagacccauggugaucaaccacgaccacgacaucaucuggaccgaggccuacauggacagcaagcugcugagcagccaggcccagagccugacccugcugaccaccguggccaugcccguguucagcaagaagaacgagaccagaagccacggcauccugcugggcguggugggcagcgacguggcccugagagagcugaugaagcuggcccccagauacaagcugggcgugcacggcuacgccuuccugaacaccaacaacggcuacauccugagccaccccgaccugagaccccuguacagagagggcaagaagcugaagcccaagcccaacuacaacagcguggaccugagcgagguggagugggaggaccaggccgagagccugagaaccgccaugaucaacagagagaccggcacccugagcauggacgugaaggugcccauggacaagggcaagagagugcuguuccugaccaacgacuacuucuucaccgacaucagcgacacccccuucagccugggcguggugcugagcagaggccacggcgaguacauccugcugggcaacaccagcguggaggagggccugcacgaccugcugcaccccgaccuggcccuggccggcgacuggaucuacugcaucaccgacaucgaccccgaccacagaaagcugagccagcuggaggccaugaucagauuccugaccagaaaggaccccgaccuggagugcgacgaggagcuggugagagaggugcuguucgacgccguggugaccgcccccauggaggccuacuggaccgcccuggcccugaacaugagcgaggagagcgagcacgugguggacauggccuuccugggcaccagagccggccugcugagaagcagccuguucgugggcagcgagaaggugagcgacagaaaguuccugacccccgaggacgaggccagcguguucacccuggacagauucccccugugguacagacaggccagcgagcaccccgccggcagcuucguguucaaccugagaugggccgagggccccgagagcgccggcgagcccaugguggugaccgccagcaccgccguggccgugaccguggacaagagaaccgccaucgccgccgccgccggcgugcagaugaagcuggaguuccugcagagaaaguucugggccgccaccagacagugcagcaccguggacggccccugcacccagagcugcgaggacagcgaccuggacugcuucgugaucgacaacaacggcuucauccugaucagcaagagaagcagagagaccggcagauuccugggcgagguggacggcgccgugcugacccagcugcugagcaugggcguguucagccaggugaccauguacgacuaccaggccaugugcaagcccagcagccaccaccacagcgccgcccagccccuggugagccccaucagcgccuuccugaccgccaccagauggcugcugcaggagcuggugcuguuccugcuggaguggagcguguggggcagcugguacgacagaggcgccgaggccaagagcguguuccaccacagccacaagcacaagaagcaggacccccugcagcccugcgacaccgaguaccccguguucguguaccagcccgccaucagagaggccaacggcaucguggagugcggccccugccagaagguguucguggugcagcagauccccaacagcaaccugcugcugcuggugaccgaccccaccugcgacugcagcaucuucccccccgugcugcaggaggccaccgaggugaaguacaacgccagcgugaagugcgacagaaugagaagccagaagcugagaagaagacccgacagcugccacgccuuccaccccgaggagaacgcccaggacugcggcggcgccagcgacaccagcgccagccccccccugcugcugcugcccgugugcgccuggggccugcugccccagcugcugagauaa

SEQ ID NO: 14563 - RNA, 1797 nt, Artificial Sequence
  CACNB1__Homo_sapiens__NP_000714
auggugcagaagaccagcaugagcagaggccccuacccccccagccaggagauccccauggagguguucgaccccagcccccagggcaaguacagcaagagaaagggcagauucaagagaagcgacggcagcaccagcagcgacaccaccagcaacagcuucgugagacagggcagcgccgagagcuacaccagcagacccagcgacagcgacgugagccuggaggaggacagagaggcccugagaaaggaggccgagagacaggcccuggcccagcuggagaaggccaagaccaagcccguggccuucgccgugagaaccaacgugggcuacaaccccagccccggcgacgaggugcccgugcagggcguggccaucaccuucgagcccaaggacuuccugcacaucaaggagaaguacaacaacgacugguggaucggcagacuggugaaggagggcugcgaggugggcuucauccccagccccgugaagcuggacagccugagacugcugcaggagcagaagcugagacagaacagacugggcagcagcaagagcggcgacaacagcagcagcagccugggcgacguggugaccggcaccagaagacccaccccccccgccagcgccaagcagaagcagaagagcaccgagcacgugccccccuacgacguggugcccagcaugagacccaucauccuggugggccccagccugaagggcuacgaggugaccgacaugaugcagaaggcccuguucgacuuccugaagcacagauucgacggcagaaucagcaucaccagagugaccgccgacaucagccuggccaagagaagcgugcugaacaaccccagcaagcacaucaucaucgagagaagcaacaccagaagcagccuggccgaggugcagagcgagaucgagagaaucuucgagcuggccagaacccugcagcugguggcccuggacgccgacaccaucaaccaccccgcccagcugagcaagaccagccuggcccccaucaucguguacaucaagaucaccagccccaaggugcugcagagacugaucaagagcagaggcaagagccagagcaagcaccugaacgugcagaucgccgccagcgagaagcuggcccagugcccccccgagauguucgacaucauccuggacgagaaccagcuggaggacgccugcgagcaccuggccgaguaccuggaggccuacuggaaggccacccacccccccagcagcaccccccccaacccccugcugaacagaaccauggccaccgccgcccuggccgccagccccgcccccgugagcaaccugcagggccccuaccuggccagcggcgaccagccccuggagagagccaccggcgagcacgccagcaugcacgaguaccccggcgagcugggccagccccccggccuguaccccagcagccacccccccggcagagccggcacccugagagcccugagcagacaggacaccuucgacgccgacacccccggcagcagaaacagcgccuacaccgagcugggcgacagcugcguggacauggagaccgaccccagcgagggccccggccugggcgaccccgccggcggcggcaccccccccgccagacagggcagcugggaggacgaggaggaggacuacgaggaggagcugaccgacaacagaaacagaggcagaaacaaggccagauacugcgccgagggcggcggccccgugcugggcagaaacaagaacgagcuggagggcuggggcagaggcguguacaucagauaa

SEQ ID NO: 14564 - RNA, 1818 nt, Artificial Sequence
  CACNB2__Homo_sapiens__NP_000715
augcagugcugcggccuggugcacagaagaagagugagagugagcuacggcagcgccgacagcuacaccagcagacccagcgacagcgacgugagccuggaggaggacagagaggccgugagaagagaggccgagagacaggcccaggcccagcuggagaaggccaagaccaagcccguggccuucgccgugagaaccaacgugagcuacagcgccgcccacgaggacgacgugcccgugcccggcauggccaucagcuucgaggccaaggacuuccugcacgugaaggagaaguucaacaacgacugguggaucggcagacuggugaaggagggcugcgagaucggcuucauccccagccccgugaagcuggagaacaugagacugcagcacgagcagagagccaagcagggcaaguucuacagcagcaagagcggcggcaacagcagcagcagccugggcgacaucgugcccagcagcagaaagagcaccccccccagcagcgccaucgacaucgacgccaccggccuggacgccgaggagaacgacauccccgccaaccacagaagccccaagcccagcgccaacagcgugaccagcccccacagcaaggagaagagaaugcccuucuucaagaagaccgagcacaccccccccuacgacguggugcccagcaugagacccguggugcuggugggccccagccugaagggcuacgaggugaccgacaugaugcagaaggcccuguucgacuuccugaagcacagauucgagggcagaaucagcaucaccagagugaccgccgacaucagccuggccaagagaagcgugcugaacaaccccagcaagcacgccaucaucgagagaagcaacaccagaagcagccuggccgaggugcagagcgagaucgagagaaucuucgagcuggccagaacccugcagcugguggugcuggacgccgacaccaucaaccaccccgcccagcugagcaagaccagccuggcccccaucaucguguacgugaagaucagcagccccaaggugcugcagagacugaucaagagcagaggcaagagccaggccaagcaccugaacgugcagaugguggccgccgacaagcuggcccagugcccccccgagcuguucgacgugauccuggacgagaaccagcuggaggacgccugcgagcaccuggccgacuaccuggaggccuacuggaaggccacccacccccccagcagcagccugcccaacccccugcugagcagaacccuggccaccagcagccugccccugagccccacccuggccagcaacagccagggcagccagggcgaccagagaaccgacagaagcgcccccaucagaagcgccagccaggccgaggaggagcccagcguggagcccgugaagaagagccagcacagaagcagcagcagcgccccccaccacaaccacagaagcggcaccagcagaggccugagcagacaggagaccuucgacagcgagacccaggagagcagagacagcgccuacguggagcccaaggaggacuacagccacgaccacguggaccacuacgccagccacagagaccacaaccacagagacgagacccacggcagcagcgaccacagacacagagagagcagacacagaagcagagacguggacagagagcaggaccacaacgagugcaacaagcagagaagcagacacaagagcaaggacagauacugcgagaaggacggcgaggugaucagcaagaagagaaacgaggccggcgaguggaacagagacguguacaucagacaguaa

SEQ ID NO: 14565 - RNA, 1455 nt, Artificial Sequence
  CACNB3__Homo_sapiens__NP_000716
auguacgacgacagcuacgugcccggcuucgaggacagcgaggccggcagcgccgacagcuacaccagcagacccagccuggacagcgacgugagccuggaggaggacagagagagcgccagaagagagguggagagccaggcccagcagcagcuggagagagccaagcacaagcccguggccuucgccgugagaaccaacgugagcuacugcggcgugcuggacgaggagugccccgugcagggcagcggcgugaacuucgaggccaaggacuuccugcacaucaaggagaaguacagcaacgacugguggaucggcagacuggugaaggagggcggcgacaucgccuucauccccagcccccagagacuggagagcaucagacugaagcaggagcagaaggccagaagaagcggcaaccccagcagccugagcgacaucggcaacagaagaagccccccccccagccuggccaagcagaagcagaagcaggccgagcacgugccccccuacgacguggugcccagcaugagacccguggugcuggugggccccagccugaagggcuacgaggugaccgacaugaugcagaaggcccuguucgacuuccugaagcacagauucgacggcagaaucagcaucaccagagugaccgccgaccugagccuggccaagagaagcgugcugaacaaccccggcaagagaaccaucaucgagagaagcagcgccagaagcagcaucgccgaggugcagagcgagaucgagagaaucuucgagcuggccaagagccugcagcugguggugcuggacgccgacaccaucaaccaccccgcccagcuggccaagaccagccuggcccccaucaucguguucgugaaggugagcagccccaaggugcugcagagacugaucagaagcagaggcaagagccagaugaagcaccugaccgugcagaugauggccuacgacaagcuggugcagugcccccccgagagcuucgacgugauccuggacgagaaccagcuggaggacgccugcgagcaccuggccgaguaccuggagguguacuggagagccacccaccaccccgcccccggccccggccugcugggcccccccagcgccauccccggccugcagaaccagcagcugcugggcgagagaggcgaggagcacagcccccuggagagagacagccugaugcccagcgacgaggccagcgagagcagcagacaggccuggaccggcagcagccagagaagcagcagacaccuggaggaggacuacgccgacgccuaccaggaccuguaccagccccacagacagcacaccagcggccugcccagcgccaacggccacgacccccaggacagacugcuggcccaggacagcgagcacaaccacagcgacagaaacuggcagagaaacagacccuggcccaaggacagcuacuaa

SEQ ID NO: 14566 - RNA, 1563 nt, Artificial Sequence
  CACNB4__Homo_sapiens__NP_000717
augagcagcagcagcuacgccaagaacggcaccgccgacggcccccacagccccaccagccagguggccagaggcaccaccaccagaagaagcagacugaagagaagcgacggcagcaccaccagcaccagcuucauccugagacagggcagcgccgacagcuacaccagcagacccagcgacagcgacgugagccuggaggaggacagagaggccaucagacaggagagagagcagcaggccgccauccagcuggagagagccaagagcaagcccguggccuucgccgugaagaccaacgugagcuacugcggcgcccuggacgaggacgugcccgugcccagcaccgccaucagcuucgacgccaaggacuuccugcacaucaaggagaaguacaacaacgacugguggaucggcagacuggugaaggagggcugcgagaucggcuucauccccagcccccugagacuggagaacaucagaauccagcaggagcagaagagaggcagauuccacggcggcaagagcagcggcaacagcagcagcagccugggcgagauggugagcggcaccuucagagccacccccaccagcaccgccaagcagaagcagaaggugaccgagcacaucccccccuacgacguggugcccagcaugagacccguggugcuggugggccccagccugaagggcuacgaggugaccgacaugaugcagaaggcccuguucgacuuccugaagcacagauucgacggcagaaucagcaucaccagagugaccgccgacaucagccuggccaagagaagcgugcugaacaaccccagcaagagagccaucaucgagagaagcaacaccagaagcagccuggccgaggugcagagcgagaucgagagaaucuucgagcuggccagaagccugcagcugguggugcuggacgccgacaccaucaaccaccccgcccagcugaucaagaccagccuggcccccaucaucgugcacgugaaggugagcagccccaaggugcugcagagacugaucaagagcagaggcaagagccagagcaagcaccugaacgugcagcugguggccgccgacaagcuggcccagugcccccccgagauguucgacgugauccuggacgagaaccagcuggaggacgccugcgagcaccugggcgaguaccuggaggccuacuggagagccacccacaccaccagcagcacccccaugaccccccugcugggcagaaaccugggcagcaccgcccugagccccuaccccaccgccaucagcggccugcagagccagagaaugagacacagcaaccacagcaccgagaacagccccaucgagagaagaagccugaugaccagcgacgagaacuaccacaacgagagagccagaaagagcagaaacagacugagcagcagcagccagcacagcagagaccacuacccccugguggaggaggacuaccccgacagcuaccaggacaccuacaagccccacagaaacagaggcagccccggcggcuacagccacgacagcagacacagacuguaa

SEQ ID NO: 14567 - RNA, 972 nt, Artificial Sequence
  CACNG2__Homo_sapiens__NP_006069
augggccuguucgacagaggcgugcagaugcugcugaccaccgugggcgccuucgccgccuucagccugaugaccaucgccgugggcaccgacuacuggcuguacagcagaggcgugugcaagaccaagagcgugagcgagaacgagaccagcaagaagaacgaggaggugaugacccacagcggccuguggagaaccugcugccuggagggcaacuucaagggccugugcaagcagaucgaccacuuccccgaggacgccgacuacgaggccgacaccgccgaguacuuccugagagccgugagagccagcagcaucuuccccauccugagcgugauccugcuguucaugggcggccugugcaucgccgccagcgaguucuacaagaccagacacaacaucauccugagcgccggcaucuucuucgugagcgccggccugagcaacaucaucggcaucaucguguacaucagcgccaacgccggcgaccccagcaagagcgacagcaagaagaacagcuacagcuacggcuggagcuucuacuucggcgcccugagcuucaucaucgccgagauggugggcgugcuggccgugcacauguucaucgacagacacaagcagcugagagccaccgccagagccaccgacuaccugcaggccagcgccaucaccagaauccccagcuacagauacagauaccagagaagaagcagaagcagcagcagaagcaccgagcccagccacagcagagacgccagccccgugggcaucaagggcuucaacacccugcccagcaccgagaucagcauguacacccugagcagagacccccugaaggccgccaccacccccaccgccaccuacaacagcgacagagacaacagcuuccugcaggugcacaacugcauccagaaggagaacaaggacagccugcacagcaacaccgccaacagaagaaccacccccguguaa

SEQ ID NO: 14568 - RNA, 948 nt, Artificial Sequence
  CACNG3__Homo_sapiens__NP_006530
augagaaugugcgacagaggcauccagaugcugaucaccaccgugggcgccuucgccgccuucagccugaugaccaucgccgugggcaccgacuacuggcuguacagcagaggcgugugcagaaccaagagcaccagcgacaacgagaccagcagaaagaacgaggaggugaugacccacagcggccuguggagaaccugcugccuggagggcgccuucagaggcgugugcaagaagaucgaccacuuccccgaggacgccgacuacgagcaggacaccgccgaguaccugcugagagccgugagagccagcagcguguuccccauccugagcgugacccugcuguucuucggcggccugugcguggccgccagcgaguuccacagaagcagacacaacgugauccugagcgccggcaucuucuucgugagcgccggccugagcaacaucaucggcaucaucguguacaucagcgccaacgccggcgaccccggccagagagacagcaagaagagcuacagcuacggcuggagcuucuacuucggcgccuucagcuucaucaucgccgagaucgugggcgugguggccgugcacaucuacaucgagaagcaccagcagcugagagccaagagccacagcgaguuccugaagaagagcaccuucgccagacugccccccuacagauacagauucagaagaagaagcagcagcagaagcaccgagcccagaagcagagaccugagccccaucagcaagggcuuccacaccauccccagcaccgacaucagcauguucacccugagcagagaccccagcaagaucaccaugggcacccugcugaacagcgacagagaccacgccuuccugcaguuccacaacagcacccccaaggaguucaaggagagccugcacaacaaccccgccaacagaagaaccacccccguguaa

SEQ ID NO: 14569 - RNA, 984 nt, Artificial Sequence
  CACNG4__Homo_sapiens__NP_055220
auggugagaugcgacagaggccugcagaugcugcugaccaccgccggcgccuucgccgccuucagccugauggccaucgccaucggcaccgacuacuggcuguacagcagcgcccacaucugcaacggcaccaaccugaccauggacgacggccccccccccagaagagccagaggcgaccugacccacagcggccuguggagagugugcugcaucgagggcaucuacaagggccacugcuucagaaucaaccacuuccccgaggacaacgacuacgaccacgacagcagcgaguaccugcugagaaucgugagagccagcagcguguuccccauccugagcaccauccugcugcugcugggcggccugugcaucggcgccggcagaaucuacagcagaaagaacaacaucgugcugagcgccggcauccuguucguggccgccggccugagcaacaucaucggcaucaucguguacaucagcagcaacaccggcgaccccagcgacaagagagacgaggacaagaagaaccacuacaacuacggcuggagcuucuacuucggcgcccugagcuucaucguggccgagaccgugggcgugcuggccgugaacaucuacaucgagaagaacaaggagcugagauucaagaccaagagagaguuccugaaggccagcagcagcagccccuacgccagaaugcccagcuacagauacagaagaagaagaagcagaagcagcagcagaagcaccgaggccagccccagcagagacgugagccccaugggccugaagaucaccggcgccauccccaugggcgagcugagcauguacacccugagcagagagccccugaaggugaccaccgccgccagcuacagccccgaccaggaggccagcuuccugcaggugcacgacuucuuccagcaggaccugaaggagggcuuccacgugagcaugcugaacagaagaaccacccccguguaa

SEQ ID NO: 14570 - RNA, 828 nt, Artificial Sequence
  CACNG5__Homo_sapiens__XP_011522915
augagcgccugcggcagaaaggcccugacccugcugagcagcguguucgccgugugcggccugggccugcugggcaucgccgugagcaccgacuacuggcuguaccuggaggagggcgugaucgugccccagaaccagagcaccgagaucaagaugagccugcacagcggccuguggagagugugcuuccuggccggcgaggagagaggcagaugcuucaccaucgaguacgugaugcccaugaacacccagcugaccagcgagagcaccgugaacgugcugaagaugaucagaagcgccacccccuucccccuggugagccuguucuucauguucaucggcuucauccugaacaacaucggccacaucagaccccacagaaccauccuggccuucgugagcggcaucuucuucauccugagcggccugagccugguggugggccuggugcuguacaucagcagcaucaacgacgagaugcugaacagaaccaaggacgccgagaccuacuucaacuacaaguacggcuggagcuucgccuucgccgccaucagcuuccugcugaccgagagcgccggcgugaugagcguguaccuguucaugaagagauacaccgccgaggacauguacagaccccaccccggcuucuacagacccagacugagcaacugcagcgacuacagcggccaguuccugcaccccgacgccugggugagaggcagaagccccagcgacaucagcagcgaggccagccugcagaugaacagcaacuaccccgcccugcugaagugccccgacuacgaccagaugagcagcagccccugcuaa

SEQ ID NO: 14571 - RNA, 570 nt, Artificial Sequence
  CACNG6__Homo_sapiens__NP_114103
augauguggagcaacuucuuccugcaggaggagaacagaagaagaggcgccgccggcagaagaagagcccacggccagggcagaagcggccugacccccgagagagagggcaaggugaagcuggcccugcugcuggccgccgugggcgccacccuggccgugcugagcgugggcaccgaguucuggguggagcugaacaccuacaaggccaacggcagcgccgugugcgaggccgcccaccugggccuguggaaggccugcaccaagagacuguggcaggccgacgugcccguggacagagacaccugcggccccgccgagcugcccggcggccugcugcugcuggugagccuggagguguucagacacagcgugagagcccugcugcagagagugagccccgagcccccccccgcccccagacugaccuacgaguacagcuggagccugggcugcggcgugggcgccggccugauccugcugcugggcgccggcugcuuccugcugcugacccugcccagcuggcccuggggcagccugugccccaagagaggccacagagccaccuaa

SEQ ID NO: 14572 - RNA, 1110 nt, Artificial Sequence
  CACUL1__Homo_sapiens__NP_722517
auggaggagagcauggaggaggaggagggcggcagcuacgaggccaugauggacgaccagaaccacaacaacugggaggccgccguggacggcuucagacagccccugccccccccccccccccccagcagcauccccgcccccgccagagagccccccggcggccagcugcuggccgugcccgccgugagcguggacagaaagggccccaaggagggccugcccaugggcccccagcccccccccgaggccaacggcgugaucaugaugcugaagagcugcgacgccgccgccgccguggccaaggccgcccccgcccccaccgccagcagcaccaucaacaucaacaccagcaccagcaaguuccugaugaacgugaucaccaucgaggacuacaagagcaccuacuggcccaagcuggacggcgccaucgaccagcugcugacccagagccccggcgacuacauccccaucagcuacgagcagaucuacagcugcguguacaagugcgugugccagcagcacagcgagcagauguacagcgaccugaucaagaagaucaccaaccaccuggagagagugagcaaggagcugcaggccagcccccccgaccuguacaucgagagauucaacaucgcccugggccaguacaugggcgcccugcagagcaucgugccccuguucaucuacaugaacaaguucuacaucgagaccaagcugaacagagaccugaaggacgaccugaucaagcuguucaccgagcacguggccgagaagcacaucuacagccugaugccccugcugcuggaggcccagagcacccccuuccaggugacccccagcaccauggccaacaucgugaagggccuguacacccugagacccgagugggugcagauggcccccacccuguucagcaaguucauccccaacauccugccccccgccguggagagcgagcugagcgaguacgccgcccaggaccagaaguuccagagagagcugauccagaacggcuucaccagaggcgaccagagcagaaagagagccggcgacgagcuggccuacaacagcagcagcgccugcgccagcagcagaggcuacagauaa

SEQ ID NO: 14573 - RNA, 558 nt, Artificial Sequence
  CACYBP__Homo_sapiens__NP_001007215
augcagcagaagagccagaagaaggccgagcugcuggacaacgagaagcccgccgccgugguggcccccaucaccaccggcuacaccgugaagaucagcaacuacggcugggaccagagcgacaaguucgugaagaucuacaucacccugaccggcgugcaccaggugcccaccgagaacgugcaggugcacuucaccgagagaagcuucgaccugcuggugaagaaccugaacggcaagagcuacagcaugaucgugaacaaccugcugaagcccaucagcguggagggcagcagcaagaaggugaagaccgacaccgugcugauccugugcagaaagaagguggagaacaccagaugggacuaccugacccagguggagaaggagugcaaggagaaggagaagcccagcuacgacaccgagaccgaccccagcgagggccugaugaacgugcugaagaagaucuacgaggacggcgacgacgacaugaagagaaccaucaacaaggccuggguggagagcagagagaagcaggccaagggcgacaccgaguucuaa

SEQ ID NO: 14574 - RNA, 6678 nt, Artificial Sequence
  CAD__Homo_sapiens__NP_004332
auggccgcccuggugcuggaggacggcagcgugcugagaggccagcccuucggcgccgccgugagcaccgccggcgaggugguguuccagaccggcauggugggcuaccccgaggcccugaccgaccccagcuacaaggcccagauccuggugcugaccuacccccugaucggcaacuacggcaucccccccgacgagauggacgaguucggccugugcaagugguucgagagcagcggcauccacguggccgcccugguggugggcgagugcugccccacccccagccacuggagcgccaccagaacccugcacgaguggcugcagcagcacggcauccccggccugcagggcguggacaccagagagcugaccaagaagcugagagagcagggcagccugcugggcaagcuggugcagaacggcaccgagcccagcagccugcccuuccuggaccccaacgccagaccccuggugcccgaggugagcaucaagacccccagaguguucaacaccggcggcgcccccagaauccuggcccuggacugcggccugaaguacaaccagaucagaugccugugccagagaggcgccgaggugaccguggugcccugggaccacgcccuggacagccaggaguacgagggccuguuccugagcaacggccccggcgaccccgccagcuaccccagcguggugagcacccugagcagagugcugagcgagcccaaccccagacccguguucggcaucugccugggccaccagcugcuggcccuggccaucggcgccaagaccuacaagaugagauacggcaacagaggccacaaccagcccugccugcuggugggcagcggcagaugcuuccugaccagccagaaccacggcuucgccguggagaccgacagccugcccgccgacugggccccccuguucaccaacgccaacgacggcagcaacgagggcaucgugcacaacagccugcccuucuucagcgugcaguuccaccccgagcaccaggccggccccagcgacauggagcugcuguucgacaucuuccuggagaccgugaaggaggccaccgccggcaaccccggcggccagaccgugagagagagacugaccgagagacugugcccccccggcauccccacccccggcagcggccugcccccccccagaaaggugcugauccugggcagcggcggccugagcaucggccaggccggcgaguucgacuacagcggcagccaggccaucaaggcccugaaggaggagaacauccagacccugcugaucaaccccaacaucgccaccgugcagaccagccagggccuggccgacaagguguacuuccugcccaucaccccccacuacgugacccaggugaucagaaacgagagacccgacggcgugcugcugaccuucggcggccagaccgcccugaacugcggcguggagcugaccaaggccggcgugcuggccagauacggcgugagagugcugggcacccccguggagaccaucgagcugaccgaggacagaagagccuucgccgccagaauggccgagaucggcgagcacguggcccccagcgaggccgccaacagccuggagcaggcccaggccgccgccgagagacugggcuaccccgugcuggugagagccgccuucgcccugggcggccugggcagcggcuucgccagcaacagagaggagcugagcgcccugguggcccccgccuucgcccacaccagccaggugcugguggacaagagccugaagggcuggaaggagaucgaguacgagguggugagagacgccuacggcaacugcgugaccgugugcaacauggagaaccuggacccccugggcauccacaccggcgagagcaucgugguggcccccagccagacccugaacgacagagaguaccagcugcugagacagaccgccaucaaggugacccagcaccugggcaucgugggcgagugcaacgugcaguacgcccugaaccccgagagcgagcaguacuacaucaucgaggugaacgccagacugagcagaagcagcgcccuggccagcaaggccaccggcuacccccuggccuacguggccgccaagcuggcccugggcaucccccugcccgagcugagaaacagcgugaccggcggcaccgccgccuucgagcccagcguggacuacugcguggugaagauccccagaugggaccugagcaaguuccugagagugagcaccaagaucggcagcugcaugaagagcgugggcgaggugaugggcaucggcagaagcuucgaggaggccuuccagaaggcccugagaaugguggacgagaacugcgugggcuucgaccacaccgugaagcccgugagcgacauggagcuggagacccccaccgacaagagaaucuucgugguggccgccgcccugugggccggcuacagcguggacagacuguacgagcugaccagaaucgacagaugguuccugcacagaaugaagagaaucaucgcccacgcccagcugcuggagcagcacagaggccagccccugccccccgaccugcugcagcaggccaagugccugggcuucagcgacaagcagaucgcccuggccgugcugagcaccgagcuggccgugagaaagcugagacaggagcugggcaucugccccgccgugaagcagaucgacaccguggccgccgaguggcccgcccagaccaacuaccuguaccugaccuacuggggcaccacccacgaccugaccuucagaaccccccacgugcuggugcugggcagcggcguguacagaaucggcagcagcguggaguucgacuggugcgccgugggcugcauccagcagcugagaaagaugggcuacaagaccaucauggugaacuacaaccccgagaccgugagcaccgacuacgacaugugcgacagacuguacuucgacgagaucagcuucgagguggugauggacaucuacgagcuggagaaccccgagggcgugauccugagcaugggcggccagcugcccaacaacauggccauggcccugcacagacagcagugcagagugcugggcaccagccccgaggccaucgacagcgccgagaacagauucaaguucagcagacugcuggacaccaucggcaucagccagccccaguggagagagcugagcgaccuggagagcgccagacaguucugccagaccgugggcuaccccugcguggugagacccagcuacgugcugagcggcgccgccaugaacguggccuacaccgacggcgaccuggagagauuccugagcagcgccgccgccgugagcaaggagcaccccguggugaucagcaaguucauccaggaggccaaggagaucgacguggacgccguggccagcgacggcgugguggccgccaucgccaucagcgagcacguggagaacgccggcgugcacagcggcgacgccacccuggugacccccccccaggacaucaccgccaagacccuggagagaaucaaggccaucgugcacgccgugggccaggagcugcaggugaccggccccuucaaccugcagcugaucgccaaggacgaccagcugaaggugaucgagugcaacgugagagugagcagaagcuuccccuucgugagcaagacccugggcguggaccugguggcccuggccaccagagugaucaugggcgaggagguggagcccgugggccugaugaccggcagcggcguggugggcgugaaggugccccaguucagcuucagcagacuggccggcgccgacguggugcugggcguggagaugaccagcaccggcgagguggccggcuucggcgagagcagaugcgaggccuaccugaaggccaugcugagcaccggcuucaagauccccaagaagaacauccugcugaccaucggcagcuacaagaacaagagcgagcugcugcccaccgugagacugcuggagagccugggcuacagccuguacgccagccugggcaccgccgacuucuacaccgagcacggcgugaaggugaccgccguggacuggcacuucgaggaggccguggacggcgagugccccccccagagaagcauccuggagcagcuggccgagaagaacuucgagcuggugaucaaccugagcaugagaggcgccggcggcagaagacugagcagcuucgugaccaagggcuacagaaccagaagacuggccgccgacuucagcgugccccugaucaucgacaucaagugcaccaagcuguucguggaggcccugggccagaucggccccgcccccccccugaaggugcacguggacugcaugaccagccagaagcuggugagacugcccggccugaucgacgugcacgugcaccugagagagcccggcggcacccacaaggaggacuucgccagcggcaccgccgccgcccuggccggcggcaucaccauggugugcgccaugcccaacaccagaccccccaucaucgacgcccccgcccuggcccuggcccagaagcuggccgaggccggcgccagaugcgacuucgcccuguuccugggcgccagcagcgagaacgccggcacccugggcaccguggccggcagcgccgccggccugaagcuguaccugaacgagaccuucagcgagcugagacuggacagcguggugcaguggauggagcacuucgagaccuggcccagccaccugcccaucguggcccacgccgagcagcagaccguggccgccgugcugaugguggcccagcugacccagagaagcgugcacaucugccacguggccagaaaggaggagauccugcugaucaaggccgccaaggccagaggccugcccgugaccugcgagguggccccccaccaccuguuccugagccacgacgaccuggagagacugggccccggcaagggcgaggugagacccgagcugggcagcagacaggacguggaggcccugugggagaacauggccgugaucgacugcuucgccagcgaccacgccccccacacccuggaggagaagugcggcagcagacccccccccggcuuccccggccuggagaccaugcugccccugcugcugaccgccgugagcgagggcagacugagccuggacgaccugcugcagagacugcaccacaaccccagaagaaucuuccaccugcccccccaggaggacaccuacguggagguggaccuggagcacgaguggaccauccccagccacaugcccuucagcaaggcccacuggacccccuucgagggccagaaggugaagggcaccgugagaagaguggugcugagaggcgagguggccuacaucgacggccaggugcuggugccccccggcuacggccaggacgugagaaaguggccccagggcgccgugccccagcugccccccagcgcccccgccaccagcgagaugaccaccacccccgagagacccagaagaggcauccccggccugcccgacggcagauuccaccugccccccagaauccacagagccagcgaccccggccugcccgccgaggagcccaaggagaagagcagcagaaagguggccgagcccgagcugaugggcacccccgacggcaccugcuacccccccccccccgugcccagacaggccagcccccagaaccugggcacccccggccugcugcacccccagaccagcccccugcugcacagccuggugggccagcacauccugagcgugcagcaguucaccaaggaccagaugagccaccuguucaacguggcccacacccugagaaugauggugcagaaggagagaagccuggacauccugaagggcaaggugauggccagcauguucuacgaggugagcaccagaaccagcagcagcuucgccgccgccauggccagacugggcggcgccgugcugagcuucagcgaggccaccagcagcgugcagaagggcgagagccuggccgacagcgugcagaccaugagcugcuacgccgacgugguggugcugagacacccccagcccggcgccguggagcuggccgccaagcacugcagaagacccgugaucaacgccggcgacggcgugggcgagcaccccacccaggcccugcuggacaucuucaccaucagagaggagcugggcaccgugaacggcaugaccaucaccauggugggcgaccugaagcacggcagaaccgugcacagccuggccugccugcugacccaguacagagugagccugagauacguggccccccccagccugagaaugccccccaccgugagagccuucguggccagcagaggcaccaagcaggaggaguucgagagcaucgaggaggcccugcccgacaccgacgugcuguacaugaccagaauccagaaggagagauucggcagcacccaggaguacgaggccugcuucggccaguucauccugaccccccacaucaugaccagagccaagaagaagaugguggugaugcaccccaugcccagagugaacgagaucagcguggagguggacagcgaccccagagccgccuacuucagacaggccgagaacggcauguacaucagaauggcccugcuggccaccgugcugggcagauucuaa

SEQ ID NO: 14575 - RNA, 1245 nt, Artificial Sequence
  CADM1__Homo_sapiens__NP_001091987
auggccagcguggugcugcccagcggcagccagugcgccgccgccgccgccgccgccgccccccccggccugagacugagacugcugcugcugcuguucagcgccgccgcccugauccccaccggcgacggccagaaccuguucaccaaggacgugaccgugaucgagggcgagguggccaccaucagcugccaggugaacaagagcgacgacagcgugauccagcugcugaaccccaacagacagaccaucuacuucagagacuucagaccccugaaggacagcagauuccagcugcugaacuucagcagcagcgagcugaaggugagccugaccaacgugagcaucagcgacgagggcagauacuucugccagcuguacaccgaccccccccaggagagcuacaccaccaucaccgugcuggugccccccagaaaccugaugaucgacauccagaaggacaccgccguggagggcgaggagaucgaggugaacugcaccgccauggccagcaagcccgccaccaccaucagaugguucaagggcaacaccgagcugaagggcaagagcgagguggaggaguggagcgacauguacaccgugaccagccagcugaugcugaaggugcacaaggaggacgacggcgugcccgugaucugccagguggagcaccccgccgugaccggcaaccugcagacccagagauaccuggaggugcaguacaagccccaggugcacauccagaugaccuacccccugcagggccugaccagagagggcgacgcccuggagcugaccugcgaggccaucggcaagccccagcccgugauggugaccugggugagaguggacgacgagaugccccagcacgccgugcugagcggccccaaccuguucaucaacaaccugaacaagaccgacaacggcaccuacagaugcgaggccagcaacaucgugggcaaggcccacagcgacuacaugcuguacguguacgacagcagagccggcgaggagggcagcaucagagccguggaccacgccgugaucggcggcgugguggccguggugguguucgccaugcugugccugcugaucauccugggcagauacuucgccagacacaagggcaccuacuucacccacgaggccaagggcgccgacgacgccgccgacgccgacaccgccaucaucaacgccgagggcggccagaacaacagcgaggagaagaaggaguacuucaucuaa

SEQ ID NO: 14576 - RNA, 1308 nt, Artificial Sequence
  CADM2__Homo_sapiens__NP_001161146
augaucuggaagagaagcgccgugcugagauucuacagcgugugcggccugcugcugcagggcagccagggccaguucccccugacccagaacgugaccgugguggagggcggcaccgccauccugaccugcagaguggaccagaacgacaacaccagccugcaguggagcaaccccgcccagcagacccuguacuucgacgacaagaaggcccugagagacaacagaaucgagcuggugagagccagcuggcacgagcugagcaucagcgugagcgacgugagccugagcgacgagggccaguacaccugcagccuguucaccaugcccgugaagaccagcaaggccuaccugaccgugcugggcgugcccgagaagccccagaucagcggcuucagcagccccgugauggagggcgaccugaugcagcugaccugcaagaccagcggcagcaagcccgccgccgacaucagaugguucaagaacgacaaggagaucaaggacgugaaguaccugaaggaggaggacgccaacagaaagaccuucaccgugagcagcacccuggacuucagaguggacagaagcgacgacggcguggccgugaucugcagaguggaccacgagagccugaacgccaccccccagguggccaugcaggugcuggagauccacuacacccccagcgugaagaucauccccagcacccccuucccccaggagggccagccccugauccugaccugcgagagcaagggcaagccccugcccgagcccgugcuguggaccaaggacggcggcgagcugcccgaccccgacagaaugguggugagcggcagagagcugaacauccuguuccugaacaagaccgacaacggcaccuacagaugcgaggccaccaacaccaucggccagagcagcgccgaguacgugcugaucgugcacgacgugcccaacacccugcugcccaccaccaucauccccagccugaccaccgccaccgugaccaccaccguggccaucaccaccagccccaccaccagcgccaccaccagcagcaucagagaccccaacgcccuggccggccagaacggccccgaccacgcccugaucggcggcaucguggccguggugguguucgugacccugugcagcaucuuccugcugggcagauaccuggccagacacaagggcaccuaccugaccaacgaggccaagggcgccgaggacgcccccgacgccgacaccgccaucaucaacgccgagggcagccaggugaacgccgaggagaagaaggaguacuucaucuaa

SEQ ID NO: 14577 - RNA, 1197 nt, Artificial Sequence
  CADM3__Homo_sapiens__NP_001120645
augggcgcccccgccgccagccugcugcugcugcugcugcuguucgccugcugcugggcccccggcggcgccaaccugagccaggacgacagccagcccuggaccagcgacgagaccgugguggccggcggcaccguggugcugaagugccaggugaaggaccacgaggacagcagccugcaguggagcaaccccgcccagcagacccuguacuucggcgagaagagagcccugagagacaacagaauccagcuggugaccagcaccccccacgagcugagcaucagcaucagcaacguggcccuggccgacgagggcgaguacaccugcagcaucuucaccaugcccgugagaaccgccaagagccuggugaccgugcugggcaucccccagaagcccaucaucaccggcuacaagagcagccugagagagaaggacaccgccacccugaacugccagagcagcggcagcaagcccgccgccagacugaccuggagaaagggcgaccaggagcugcacggcgagcccaccagaauccaggaggaccccaacggcaagaccuucaccgugagcagcagcgugaccuuccaggugaccagagaggacgacggcgccagcaucgugugcagcgugaaccacgagagccugaagggcgccgacagaagcaccagccagagaaucgaggugcuguacacccccaccgccaugaucagacccgaccccccccaccccagagagggccagaagcugcugcugcacugcgagggcagaggcaaccccgugccccagcaguaccugugggagaaggagggcagcgugcccccccugaagaugacccaggagagcgcccugaucuuccccuuccugaacaagagcgacagcggcaccuacggcugcaccgccaccagcaacaugggcagcuacaaggccuacuacacccugaacgugaacgaccccagccccgugcccagcagcagcagcaccuaccacgccaucaucggcggcaucguggccuucaucguguuccugcugcugaucaugcugaucuuccugggccacuaccugaucagacacaagggcaccuaccugacccacgaggccaagggcagcgacgacgcccccgacgccgacaccgccaucaucaacgccgagggcggccagagcggcggcgacgacaagaaggaguacuucaucuaa

SEQ ID NO: 14578 - RNA, 1167 nt, Artificial Sequence
  CADM4__Homo_sapiens__NP_660339
augggcagagccagaagauuccaguggccccugcugcugcugugggccgccgccgccggccccggcgccggccaggaggugcagaccgagaacgugaccguggccgagggcggcguggccgagaucaccugcagacugcaccaguacgacggcagcaucguggugauccagaaccccgccagacagacccuguucuucaacggcaccagagcccugaaggacgagagauuccagcuggaggaguucagccccagaagagugagaaucagacugagcgacgccagacuggaggacgagggcggcuacuucugccagcuguacaccgaggacacccaccaccagaucgccacccugaccgugcugguggcccccgagaaccccgugguggaggugagagagcaggccguggagggcggcgagguggagcugagcugccuggugcccagaagcagacccgccgccacccugagaugguacagagacagaaaggagcugaagggcgugagcagcagccaggagaacggcaagguguggagcguggccagcaccgugagauucagaguggacagaaaggacgacggcggcaucaucaucugcgaggcccagaaccaggcccugcccagcggccacagcaagcagacccaguacgugcuggacgugcaguacagccccaccgccagaauccacgccagccaggccguggugagagagggcgacacccuggugcugaccugcgccgugaccggcaaccccagacccaaccagaucagauggaacagaggcaacgagagccugcccgagagagccgaggccgugggcgagacccugacccugcccggccuggugagcgccgacaacggcaccuacaccugcgaggccagcaacaagcacggccacgccagagcccuguacgugcuggugguguacgaccccggcgccgugguggaggcccagaccagcgugcccuacgccaucgugggcggcauccuggcccugcugguguuccugaucaucugcgugcuggugggcaugguguggugcagcgugagacagaagggcagcuaccugacccacgaggccagcggccuggacgagcagggcgaggccagagaggccuuccugaacggcagcgacggccacaagagaaaggaggaguucuucaucuaa

SEQ ID NO: 14579 - RNA, 3768 nt, Artificial Sequence
  CADPS2__Homo_sapiens__NP_001009571
augcuggaccccagcagcagcgaggaggagagcgacgagggccuggaggaggagagcagagacgugcugguggccgccggcagcagccagagagccccccccgcccccaccagagagggcagaagagacgcccccggcagagccggcggcggcggcgccgccagaagcgugagccccagccccagcgugcugagcgagggcagagacgagccccagagacagcuggacgacgagcaggagagaagaaucagacugcagcuguacguguucguggugagaugcaucgccuaccccuucaacgccaagcagcccaccgacauggccagaagacagcagaagcugaacaagcagcagcugcagcugcugaaggagagauuccaggccuuccugaacggcgagacccagaucguggccgacgaggccuucugcaacgccgugagaagcuacuacgagguguuccugaagagcgacagaguggccagaauggugcagagcggcggcugcagcgccaacgacuucagagagguguucaagaagaacaucgagaagagagugagaagccugcccgagaucgacggccugagcaaggagaccgugcugagcagcuggaucgccaaguacgacgccaucuacagaggcgaggaggaccugugcaagcagcccaacagaauggcccugagcgccgugagcgagcugauccugagcaaggagcagcuguacgagauguuccagcagauccugggcaucaagaagcuggagcaccagcugcuguacaacgccugccagcuggacaacgccgacgagcaggccgcccagaucagaagagagcuggacggcagacugcagcuggccgacaagauggccaaggagagaaaguuccccaaguucaucgccaaggacauggagaacauguacaucgaggagcugagaagcagcgugaaccugcugauggccaaccuggagagccugcccgugagcaagggcggccccgaguucaagcugcagaagcugaagagaagccagaacagcgccuuccuggacaucggcgacgagaacgagauccagcugagcaagagcgacguggugcugagcuucacccuggagaucgugaucauggaggugcagggccugaagagcguggcccccaacagaaucguguacugcaccauggagguggagggcgagaagcugcagaccgaccaggccgaggccagcagaccccaguggggcacccagggcgacuucaccaccacccaccccagacccguggugaaggugaagcuguucaccgagagcaccggcgugcuggcccuggaggacaaggagcugggcagagugauccuguaccccaccagcaacagcagcaagagcgccgagcugcacagaaugguggugcccaagaacagccaggacagcgaccugaagaucaagcuggccgugagaauggacaagcccgcccacaugaagcacagcggcuaccuguacgcccugggccagaagguguggaagagauggaagaagagauacuucgugcuggugcaggugagccaguacaccuucgccaugugcagcuacagagagaagaagagcgagccccaggagcugaugcagcuggagggcuacaccguggacuacaccgacccccaccccggccugcagggcggcugcauguucuucaacgccgugaaggagggcgacaccgugaucuucgccagcgacgacgagcaggacagaauccugugggugcaggccauguacagagccaccggccagagcuacaagcccgugcccgccauccagacccagaagcugaaccccaagggcggcacccugcacgccgacgcccagcuguacgccgacagauuccagaagcacggcauggacgaguucaucagcgccaaccccugcaagcuggaccacgccuuccuguucagaauccugcagagacagacccuggaccacagacugaacgacagcuacagcugccugggcugguucagccccggccagguguucgugcuggacgaguacugcgccagauacggcgugagaggcugccacagacaccugugcuaccuggccgagcugauggagcacagcgagaacggcgccgugaucgaccccacccugcugcacuacagcuucgccuucugcgccagccacgugcacggcaacagacccgacggcaucggcaccgugagcguggaggagaaggagagauucgaggagaucaaggagagacugagcagccugcuggagaaccagaucagccacuucagauacugcuuccccuucggcagacccgagggcgcccugaaggccacccugagccugcuggagagagugcugaugaaggacaucgccacccccauccccgccgaggaggugaagaagguggugagaaagugccuggagaaggccgcccugaucaacuacaccagacugaccgaguacgccaagaucgaggagaccaugaaccaggccagccccgccagaaagcuggaggagauccugcaccuggccgagcugugcaucgaggugcugcagcagaacgaggagcaccacgccgaggccuucgccugguggcccgaccugcuggccgagcacgccgagaaguucugggcccuguucaccguggacauggacaccgcccuggaggcccagccccaggacagcugggacagcuucccccuguuccagcugcugaacaacuuccugagaaacgacacccugcugugcaacggcaaguuccacaagcaccugcaggagaucuucgugccccugguggugagauacguggaccugauggagagcagcaucgcccagagcauccacagaggcuucgagcaggagaccuggcagcccgugaacaacggcagcgccaccagcgaggaccuguucuggaagcuggacgcccugcagauguucguguucgaccugcacuggcccgagcaggaguucgcccaccaccuggagcagagacugaagcugauggccagcgacaugcuggaggccugcgugaagagaaccagaaccgccuucgagcugaagcugcagaaggccagcaagaccaccgaccugagaauccccgccagcgugugcaccauguucaacgugcugguggacgccaagaagcagagcaccaagcugugcgcccuggacggcggccaggaguucggcagccaguggcagcaguaccacagcaagaucgacgaccugaucgacaacagcgugaaggagaucaucagccugcuggugagcaaguucgugagcgugcuggagggcgugcugagcaagcugagcagauacgacgagggcaccuucuucagcagcauccugagcuucaccgugaaggccgccgccaaguacguggacgugcccaagcccggcauggaccuggccgacaccuacaucauguucgugagacagaaccaggacauccugagagagaaggugaacgaggagauguacaucgagaagcuguucgaccagugguacagcagcagcaugaaggugaucugcguguggcugaccgacagacuggaccugcagcugcacaucuaccagcugaagacccugaucaagaucgugaagaagaccuacagagacuucagacugcagggcgugcuggagggcacccugaacagcaagaccuacgacaccgugcacagaagacugaccguggaggaggccaccgccagcgugagcgagggcggcggccugcagggcaucaccaugaaggacagcgacgaggaggaggagggcuaa

SEQ ID NO: 14580 - RNA, 4062 nt, Artificial Sequence
  CADPS__Homo_sapiens__NP_003707
augcuggaccccagcagcagcgaggaggagagcgacgagaucguggaggaggagagcggcaaggaggugcugggcagcgcccccagcggcgccagacugagccccagcagaaccagcgagggcagcgccggcagcgccggccugggcggcggcggcgccggcgccggcgccggcgugggcgccggcggcggcggcggcagcggcgccagcagcggcggcggcgccggcggccugcagcccagcagcagagccggcggcggcagacccagcagccccagccccagcguggugagcgagaaggagaaggaggagcuggagagacugcagaaggaggaggaggagagaaagaagagacugcagcuguacguguucgugaugagaugcaucgccuaccccuucaacgccaagcagcccaccgacauggccagaagacagcagaagaucagcaagcagcagcugcagaccgugaaggacagauuccaggccuuccugaacggcgagacccagaucauggccgacgaggccuucaugaacgccgugcagagcuacuacgagguguuccugaagagcgacagaguggccagaauggugcagagcggcggcugcagcgccaacgacagcagagagguguucaagaagcacaucgagaagagagugagaagccugcccgagaucgacggccugagcaaggagaccgugcugagcagcuggauggccaaguucgacgccaucuacagaggcgaggaggaccccagaaagcagcaggccagaaugaccgccagcgccgccagcgagcugauccugagcaaggagcagcuguacgagauguuccagaacauccugggcaucaagaaguucgagcaccagcugcuguacaacgccugccagcuggacaaccccgacgagcaggccgcccagaucagaagagagcuggacggcagacugcagauggccgaccagaucgccagagagagaaaguuccccaaguucgugagcaaggagauggagaacauguacaucgaggagcugaagagcagcgugaaccugcugauggccaaccuggagagcaugcccgugagcaagggcggcgaguucaagcugcagaagcugaagagaagccacaacgccagcaucaucgacaugggcgaggagagcgagaaccagcugagcaagagcgacguggugcugagcuucagccuggagguggugaucauggaggugcagggccugaagagccuggcccccaacagaaucguguacugcaccauggagguggagggcggcgagaagcugcagaccgaccaggccgaggccagcaagcccaccuggggcacccagggcgacuucagcaccacccacgcccugcccgccgugaaggugaagcuguucaccgagagcaccggcgugcuggcccuggaggacaaggagcugggcagagugauccugcaccccacccccaacagccccaagcagagcgaguggcacaagaugaccgugagcaagaacugccccgaccaggaccugaagaucaagcuggccgugagaauggacaagccccagaacaugaagcacagcggcuaccugugggccaucggcaagaacguguggaagagauggaagaagagauucuucgugcuggugcaggugagccaguacaccuucgccaugugcagcuacagagagaagaaggccgagccccaggagcugcugcagcuggacggcuacaccguggacuacaccgacccccagcccggccuggagggcggcagagccuucuucaacgccgugaaggagggcgacaccgugaucuucgccagcgacgacgagcaggacagaauccugugggugcaggccauguacagagccaccggccagagccacaagcccgugccccccacccaggugcagaagcugaacgccaagggcggcaacgugccccagcuggacgcccccaucagccaguucuacgccgacagagcccagaagcacggcauggacgaguucaucagcagcaaccccugcaacuucgaccacgccagccuguucgagauggugcagagacugacccuggaccacagacugaacgacagcuacagcugccugggcugguucagccccggccagguguucgugcuggacgaguacugcgccagaaacggcgugagaggcugccacagacaccugugcuaccugagagaccugcuggagagagccgagaacggcgccaugaucgaccccacccugcugcacuacagcuucgccuucugcgccagccacgugcacggcaacagacccgacggcaucggcaccgugaccguggaggagaaggagagauucgaggagaucaaggagagacugagagugcugcuggagaaccagaucacccacuucagauacugcuuccccuucggcagacccgagggcgcccugaaggccacccugagccugcuggagagagugcugaugaaggacaucgugacccccgugccccaggaggaggugaagaccgugaucagaaagugccuggagcaggccgcccuggugaacuacagcagacugagcgaguacgccaagaucgaggagaaccagaaggacgccgagaacgugggcagacugaucacccccgccaagaagcuggaggacaccaucagacuggccgagcuggugaucgaggugcugcagcagaacgaggagcaccacgccgagccccacguggacaagggcgaggccuucgccugguggagcgaccugaugguggagcacgccgagaccuuccugagccuguucgccguggacauggacgccgcccuggaggugcagccccccgacaccugggacagcuucccccuguuccagcugcugaacgacuuccugagaaccgacuacaaccugugcaacggcaaguuccacaagcaccugcaggaccuguucgccccccugguggugagauacguggaccugauggagagcagcaucgcccagagcauccacagaggcuucgagagagagagcugggagcccgugaagagccugaccagcaaccugcccaacgugaaccugcccaacgugaaccugcccaaggugcccaaccugcccgugaacaucccccugggcaucccccagaugcccaccuucagcgcccccagcuggauggccgccaucuacgacgccgacaacggcagcggcaccagcgaggaccuguucuggaagcuggacgcccugcagaccuucaucagagaccugcacuggcccgaggaggaguucggcaagcaccuggagcagagacugaagcugauggccagcgacaugaucgagagcugcgugaagagaaccagaaucgccuucgaggugaagcugcagaagaccagcagaagcaccgacuucagagugccccagagcaucugcaccauguucaacgugaugguggacgccaaggcccagagcaccaagcugugcagcauggagaugggccaggagcaccaguaccacagcaagaucgacgagcugaucgaggagaccgugaaggagaugaucacccugcugguggccaaguucgugaccauccuggagggcgugcuggccaagcugagcagauacgacgagggcacccuguucagcagcuuccugagcuucaccgugaaggccgccagcaaguacguggacgugcccaagcccggcauggacguggccgacgccuacgugaccuucgugagacacagccaggacgugcugagagacaaggugaacgaggagauguacaucgagagacuguucgaccagugguacaacagcagcaugaacgugaucugcaccuggcugaccgacagaauggaccugcagcugcacaucuaccagcugaagacccugaucagaauggugaagaagaccuacagagacuucagacugcagggcgugcuggacagcacccugaacagcaagaccuacgagaccaucagaaacagacugaccguggaggaggccaccgccagcgugagcgagggcggcggccugcagggcaucagcaugaaggacagcgacgaggaggacgaggaggacgacuaa

SEQ ID NO: 14581 - RNA, 2520 nt, Artificial Sequence
  CAGE1__Homo_sapiens__NP_001164163
augaacaaggacuaccagaaguucuggagcagccccagcgaccccgugcacuucgagguggacaccagccacgagaagguggagagcaugagcgagagcgacaccaugaacgugagcaaccugagccagggcgugaugcugagccacagccccaucugcauggagaccaccggcaccaccugcgaccugccccagaacgagaucaagaacuucgagagagagaacgaguacgagagcacccugugcgaggacgccuacggcacccuggacaaccugcugaacgacaacaacaucgagaacuacagcaccaacgcccugauccagcccguggacaccaucagcaucagcagccugagacaguucgagaccgugugcaaguuccacuggguggaggccuucgacgacgagaugaccgagaagcccgaguuccagagccagguguacaacuacgccaaggacaacaacaucaagcaggacagcuucaaggaggagaaccccauggagaccagcgugagcgccaacaccgaccagcugggcaacgaguacuucagacagcccccccccagaagccccccccugauccacugcagcggcgagaugcugaaguucaccgagaagagccuggccaagagcaucgccaaggagagcgcccugaaccccagccagccccccagcuuccugugcaagaccgccgugcccagcaaggagauccagaacuacggcgagauccccgagaugagcgugagcuacgagaaggaggugaccgccgagggcguggagagacccgagaucgugagcaccuggagcagcgccggcaucagcuggagaagcgaggccugcagagagaacugcgagaugcccgacugggagcagagcgccgagagccugcagcccgugcaggaggacauggcccugaacgaggugcugcagaagcugaagcacaccaacagaaagcaggaggugagaauccaggagcugcagugcagcaaccuguaccuggagaagagagugaaggagcugcagaugaagaucaccaagcagcagguguucaucgacgugaucaacaagcugaaggagaacguggaggagcugaucgaggacaaguacaagaucauccuggagaagaacgacaccaagaagacccugcagaaccuggaggaggugcuggccaacacccagaagcaccugcaggagagcagaaacgacaaggagaugcugcagcugcaguucaagaagaucaaggccaacuacgugugccugcaggagagauacaugaccgagaugcagcagaagaacaagagcgugagccaguaccuggagauggacaagacccugagcaagaaggaggaggagguggagagacugcagcagcugaagaaggagcuggagaaggccaccgccagcgcccuggaccugcugaagagagagaaggaggcccaggagcaggaguuccugagccugcaggaggaguuccagaagcuggagaaggagaaccuggaggagagacagaagcugaagagcagacuggagaagcugcugacccaggugagaaaccugcaguucaugagcgagaacgagagaaccaagaacaucaagcugcagcagcagaucaacgaggugaagaacgagaacgccaagcugaagcagcagguggccagaagcgaggagcagaacuacgugcccaaguucgagaccgcccagcugaaggaccagcuggaggaggugcugaagagcgacaucaccaaggacaccaagaccacccacagcaaccugcugcccgacugcagccccugcgaggagagacugaaccccgccgacaucaagagagccagccagcuggccagcaagaugcacagccugcuggcccugauggugggccugcugaccugccaggacaucaucaacagcgacgccgagcacuucaaggagagcgagaaggugagcgacaucaugcugcagaagcugaagagccugcaccugaagaagaagacccuggacaaggagcugcugaagcacaaggacagaaucaccaccuucagagagcugaucgccaaggagaaggccuuccaggaccacgccaucaaggugaucgacugcgacagcgacgaggccaagagcaucagagacgugcccacccugcugggcgccaagcuggacaaguaccacagccugaacgaggagcuggacuuccugaucaccaagcugggccaccugcuggagagcaaggagaaccacugcaacagacugaucgaggagaacgacaaguaccagagacaccugggcaaccugaucaagaaggugaccagcuacgaggagaucaucgagugcgccgaccagagacuggccaucagccacagccagaucgcccaccuggaggagagaaacaagcaccuggaggaccugaucagaaagcccagagagaaggccagaaagcccagaagcaagagccuggagaaccaccccaagagcaugaccaugaugcccgcccuguucaaggagaacagaaacgaccuggacuaa

SEQ ID NO: 14582 - RNA, 786 nt, Artificial Sequence
  CALB1__Homo_sapiens__NP_004920
auggccgagagccaccugcagagcagccugaucaccgccagccaguucuucgagaucuggcugcacuucgacgccgacggcagcggcuaccuggagggcaaggagcugcagaaccugauccaggagcugcagcaggccagaaagaaggccggccuggagcugagccccgagaugaagaccuucguggaccaguacggccagagagacgacggcaagaucggcaucguggagcuggcccacgugcugcccaccgaggagaacuuccugcugcuguucagaugccagcagcugaagagcugcgaggaguucaugaagaccuggagaaaguacgacaccgaccacagcggcuucaucgagaccgaggagcugaagaacuuccugaaggaccugcuggagaaggccaacaagaccguggacgacaccaagcuggccgaguacaccgaccugaugcugaagcuguucgacagcaacaacgacggcaagcuggagcugaccgagauggccagacugcugcccgugcaggagaacuuccugcugaaguuccagggcaucaagaugugcggcaaggaguucaacaaggccuucgagcuguacgaccaggacggcaacggcuacaucgacgagaacgagcuggacgcccugcugaaggaccugugcgagaagaacaagcaggaccuggacaucaacaacaucaccaccuacaagaagaacaucauggcccugagcgacggcggcaagcuguacagaaccgaccuggcccugauccugugcgccggcgacaacuaa

SEQ ID NO: 14583 - RNA, 816 nt, Artificial Sequence
  CALB2__Homo_sapiens__NP_001731
auggccggcccccagcagcagccccccuaccugcaccuggccgagcugaccgccagccaguuccuggagaucuggaagcacuucgacgccgacggcaacggcuacaucgagggcaaggagcuggagaacuucuuccaggagcuggagaaggccagaaagggcagcggcaugaugagcaagagcgacaacuucggcgagaagaugaaggaguucaugcagaaguacgacaagaacagcgacggcaagaucgagauggccgagcuggcccagauccugcccaccgaggagaacuuccugcugugcuucagacagcacgugggcagcagcgccgaguucauggaggccuggagaaaguacgacaccgacagaagcggcuacaucgaggccaacgagcugaagggcuuccugagcgaccugcugaagaaggccaacagacccuacgacgagcccaagcugcaggaguacacccagaccauccugagaauguucgaccugaacggcgacggcaagcugggccugagcgagaugagcagacugcugcccgugcaggagaacuuccugcugaaguuccagggcaugaagcugaccagcgaggaguucaacgccaucuucaccuucuacgacaaggacagaagcggcuacaucgacgagcacgagcuggacgcccugcugaaggaccuguacgagaagaacaagaaggagaugaacauccagcagcugaccaacuacagaaagagcgugaugagccuggccgaggccggcaagcuguacagaaaggaccuggagaucgugcugugcagcgagccccccauguaa

SEQ ID NO: 14584 - RNA, 387 nt, Artificial Sequence
  CALCA__Homo_sapiens__NP_001029125
augggcuuccagaaguucagccccuuccuggcccugagcauccuggugcugcugcaggccggcagccugcacgccgcccccuucagaagcgcccuggagagcagccccgccgaccccgccacccugagcgaggacgaggccagacugcugcuggccgcccuggugcaggacuacgugcagaugaaggccagcgagcuggagcaggagcaggagagagagggcagcagaaucaucgcccagaagagagccugcgacaccgccaccugcgugacccacagacuggccggccugcugagcagaagcggcggcguggugaagaacaacuucgugcccaccaacgugggcagcaaggccuucggcagaagaagaagagaccugcaggccuaa

SEQ ID NO: 14585 - RNA, 384 nt, Artificial Sequence
  CALCB__Homo_sapiens__NP_000719
augggcuucagaaaguucagccccuuccuggcccugagcauccuggugcuguaccaggccggcagccugcaggccgcccccuucagaagcgcccuggagagcagccccgaccccgccacccugagcaaggaggacgccagacugcugcuggccgcccuggugcaggacuacgugcagaugaaggccagcgagcugaagcaggagcaggagacccagggcagcagcagcgccgcccagaagagagccugcaacaccgccaccugcgugacccacagacuggccggccugcugagcagaagcggcggcauggugaagagcaacuucgugcccaccaacgugggcagcaaggccuucggcagaagaagaagagaccugcaggccuaa

SEQ ID NO: 14586 - RNA, 1821 nt, Artificial Sequence
  CALCOCO1__Homo_sapiens__NP_001137154
auggaggagagcccccugagcagagcccccagcagaggcggcgugaacuuccugaacguggccagaaccuacauccccaacaccaagguggagugccacuacacccugccccccggcaccaugcccagcgccagcgacuggaucggcaucuucaagguggaggccgccugcgugagagacuaccacaccuucguguggagcagcgugcccgagagcaccaccgacggcagccccauccacaccagcgugcaguuccaggagcccagacccauggacgagcuggugacccuggaggaggccgacggcggcagcgacauccugcugguggugcccaaggccaccgugcugcagaaccagcuggacgagagccagcaggagagaaacgaccugaugcagcugaagcugcagcuggagggccaggugaccgagcugagaagcagagugcaggagcuggagagagcccuggccaccgccagacaggagcacaccgagcugauggagcaguacaagggcaucagcagaagccacggcgagaucaccgaggagagagacauccugagcagacagcagggcgaccacguggccagaauccuggagcuggaggacgacauccagaccaucagcgagaaggugcugaccaaggagguggagcuggacagacugagagacaccgugaaggcccugaccagagagcaggagaagcugcugggccagcugaaggaggugcaggccgacaaggagcagagcgaggccgagcuggagccccugaaggagcagcugagaggcgcccaggagcuggccgccagcagccagcagaaggccacccugcugggcgaggagcuggccagcgccgccgccgccagagacagaaccaucgccgagcugcacagaagcagacuggagguggccgaggugaacggcagacuggccgagcugggccugcaccugaaggaggagaagugccaguggagcaaggagagagccggccugcugcagagcguggaggccgagaaggacaagauccugaagcugagcgccgagauccugagacuggagaaggccgugcaggaggagagaacccagaaccagguguucaagaccgagcuggccagagagaaggacagcagccuggugcagcugagcgagagcaagagagagcugaccgagcugagaagcgcccugagagugcugcagaaggagaaggagcagcugcaggaggagaagcaggagcugcuggaguacaugagaaagcuggaggccagacuggagaagguggccgacgagaaguggaacgaggacgccaccaccgaggacgaggaggccgccgugggccugagcugccccgccgcccugaccgacagcgaggacgagagccccgaggacaugagacugccccccuacggccugugcgagagaggcgaccccggcagcagccccgccggccccagagaggccagcccccugguggugaucagccagcccgcccccaucagcccccaccugagcggccccgccgaggacagcagcagcgacagcgaggccgaggacgagaagagcgugcugauggccgccgugcagagcggcggcgaggaggccaaccugcugcugcccgagcugggcagcgccuucuacgacauggccagcggcuucaccgugggcacccugagcgagaccagcaccggcggccccgccacccccaccuggaaggagugccccaucugcaaggagagauuccccgccgagagcgacaaggacgcccuggaggaccacauggacggccacuucuucuucagcacccaggaccccuucaccuucgaguaa

SEQ ID NO: 14587 - RNA, 1413 nt, Artificial Sequence
  CALCOCO2__Homo_sapiens__NP_001248319
auggaggagaccaucaaggacccccccaccagcgccgugcugcuggaccacugccacuucagccaggugaucuucaacagcguggagaaguucuacauccccggcggcgacgugaccugccacuacaccuucacccagcacuucauccccagaagaaaggacuggaucggcaucuucagagccuucaagugcuuccaggacaagcuggagcaggagcugcugaaguggagaagccagggccagaagcugcaggugggcuggaagaccaccagagaguacuacaccuucaugugggugacccugcccaucgaccugaacaacaagagcgccaagcagcaggaggugcaguucaaggccuacuaccugcccaaggacgacgaguacuaccaguucugcuacguggacgaggacggcguggugagaggcgccagcauccccuuccaguucagacccgagaacgaggaggacauccugguggugaccacccagggcgagguggaggagaucgagcagcacaacaaggagcugugcaaggagaaccaggagcugaaggacagcugcaucagccugcagaagcagaacagcgacaugcaggccgagcugcagaagaagcaggaggagcuggagacccugcagagcaucaacaagaagcuggagcugaaggugaaggagcagaaggacuacugggagaccgagcugcugcagcugaaggagcagaaccagaagaugagcagcgagaacgagaagaugggcaucagaguggaccagcugcaggcccagcugagcacccaggagaaggagauggagaagcuggugcagggcgaccaggacaagaccgagcagcuggagcagcugaagaaggagaacgaccaccuguuccugagccugaccgagcagagaaaggaccagaagaagcuggagcagaccguggagcagaugaagcagaacgagaccaccgccaugaagaagcagcaggagcugauggacgagaacuucgaccugagcaagagacugagcgagaacgagaucaucugcaacgcccugcagagacagaaggagagacuggagggcgagaacgaccugcugaagagagagaacagcagacugcugagcuacaugggccuggacuucaacagccugcccuaccaggugcccaccagcgacgagggcggcgccagacagaaccccggccuggccuacggcaaccccuacagcggcauccaggagagcagcagccccagcccccugagcaucaagaagugccccaucugcaaggccgacgacaucugcgaccacacccuggagcagcagcagaugcagccccugugcuucaacugccccaucugcgacaagaucuuccccgccaccgagaagcagaucuucgaggaccacguguucugccacagccuguaa

SEQ ID NO: 14588 - RNA, 1527 nt, Artificial Sequence
  CALCR__Homo_sapiens__NP_001158209
augcaguucagcggcgagaagaucagcggccagagagaccugcagaagagcaagaugagauucaccuucaccagcagaugccuggcccuguuccugcugcugaaccaccccacccccauccugcccgccuucagcaaccagaccuaccccaccaucgagcccaagcccuuccuguacguggugggcagaaagaagaugauggacgcccaguacaagugcuacgacagaaugcagcagcugcccgccuaccagggcgagggccccuacugcaacagaaccugggacggcuggcugugcugggacgacacccccgccggcgugcugagcuaccaguucugccccgacuacuuccccgacuucgaccccagcgagaaggugaccaaguacugcgacgagaagggcgugugguucaagcaccccgagaacaacagaaccuggagcaacuacaccaugugcaacgccuucacccccgagaagcugaagaacgccuacgugcuguacuaccuggccaucgugggccacagccugagcaucuucacccuggugaucagccugggcaucuucguguucuucagaaagcugaccaccaucuucccccugaacuggaaguacagaaaggcccugagccugggcugccagagagugacccugcacaagaacauguuccugaccuacauccugaacagcaugaucaucaucauccaccugguggagguggugcccaacggcgagcuggugagaagagaccccgugagcugcaagauccugcacuucuuccaccaguacaugauggccugcaacuacuucuggaugcugugcgagggcaucuaccugcacacccugaucgugguggccguguucaccgagaagcagagacugagaugguacuaccugcugggcuggggcuucccccuggugcccaccaccauccacgccaucaccagagccguguacuucaacgacaacugcuggcugagcguggagacccaccugcuguacaucauccacggccccgugauggccgcccugguggugaacuucuucuuccugcugaacaucgugagagugcuggugaccaagaugagagagacccacgaggccgagagccacauguaccugaaggccgugaaggccaccaugauccuggugccccugcugggcauccaguucgugguguuccccuggagacccagcaacaagaugcugggcaagaucuacgacuacgugaugcacagccugauccacuuccagggcuucuucguggccaccaucuacugcuucugcaacaacgaggugcagaccaccgugaagagacagugggcccaguucaagauccaguggaaccagagauggggcagaagacccagcaacagaagcgccagagccgccgccgccgccgccgaggccggcgacauccccaucuacaucugccaccaggagcugagaaacgagcccgccaacaaccagggcgaggagagcgccgagaucaucccccugaacaucaucgagcaggagagcagcgccuaa

SEQ ID NO: 14589 - RNA, 1386 nt, Artificial Sequence
  CALCRL__Homo_sapiens__NP_005786
auggagaagaagugcacccuguacuuccuggugcugcugcccuucuucaugauccuggugaccgccgagcuggaggagagccccgaggacagcauccagcugggcgugaccagaaacaagaucaugaccgcccaguacgagugcuaccagaagaucaugcaggaccccauccagcaggccgagggcguguacugcaacagaaccugggacggcuggcugugcuggaacgacguggccgccggcaccgagagcaugcagcugugccccgacuacuuccaggacuucgaccccagcgagaaggugaccaagaucugcgaccaggacggcaacugguucagacaccccgccagcaacagaaccuggaccaacuacacccagugcaacgugaacacccacgagaaggugaagaccgcccugaaccuguucuaccugaccaucaucggccacggccugagcaucgccagccugcugaucagccugggcaucuucuucuacuucaagagccugagcugccagagaaucacccugcacaagaaccuguucuucagcuucgugugcaacagcguggugaccaucauccaccugaccgccguggccaacaaccaggcccugguggccaccaaccccgugagcugcaaggugagccaguucauccaccuguaccugaugggcugcaacuacuucuggaugcugugcgagggcaucuaccugcacacccugaucgugguggccguguucgccgagaagcagcaccugaugugguacuacuuccugggcuggggcuucccccugauccccgccugcauccacgccaucgccagaagccuguacuacaacgacaacugcuggaucagcagcgacacccaccugcuguacaucauccacggccccaucugcgccgcccugcuggugaaccuguucuuccugcugaacaucgugagagugcugaucaccaagcugaaggugacccaccaggccgagagcaaccuguacaugaaggccgugagagccacccugauccuggugccccugcugggcaucgaguucgugcugauccccuggagacccgagggcaagaucgccgaggagguguacgacuacaucaugcacauccugaugcacuuccagggccugcuggugagcaccaucuucugcuucuucaacggcgaggugcaggccauccugagaagaaacuggaaccaguacaagauccaguucggcaacagcuucagcaacagcgaggcccugagaagcgccagcuacaccgugagcaccaucagcgacggccccggcuacagccacgacugccccagcgagcaccugaacggcaagagcauccacgacaucgagaacgugcugcugaagcccgagaaccuguacaacuaa

SEQ ID NO: 14590 - RNA, 1617 nt, Artificial Sequence
  CALD1__Homo_sapiens__NP_004333
auggacgacuucgagagaagaagagagcugagaagacagaagagagaggagaugagacuggaggccgagagaaucgccuaccagagaaacgacgacgacgaggaggaggccgccagagagagaagaagaagagccagacaggagagacugagacagaagcaggaggaggagagccugggccaggugaccgaccagguggaggugaacgcccagaacagcgugcccgacgaggaggccaagaccaccaccaccaacacccagguggagggcgacgacgaggccgccuuccuggagagacuggccagaagagaggagagaagacagaagagacugcaggaggcccuggagagacagaaggaguucgaccccaccaucaccgacgccagccugagccugcccagcagaagaaugcagaacgacaccgccgagaacgagaccaccgagaaggaggagaagagcgagagcagacaggagagauacgagaucgaggagaccgagaccgugaccaagagcuaccagaagaacgacuggagagacgccgaggagaacaagaaggaggacaaggagaaggaggaggaggaggaggagaagcccaagagaggcagcaucggcgagaaccagaucaaggacgagaagaucaagaaggacaaggagcccaaggaggaggugaagagcuucauggacagaaagaagggcuucaccgaggugaagagccagaacggcgaguucaugacccacaagcugaagcacaccgagaacaccuucagcagacccggcggcagagccagcguggacaccaaggaggccgagggcgccccccagguggaggccggcaagagacuggaggagcugagaagaagaagaggcgagaccgagagcgaggaguucgagaagcugaagcagaagcagcaggaggccgcccuggagcuggaggagcugaagaagaagagagaggagagaagaaaggugcuggaggaggaggagcagagaagaaagcaggaggaggccgacagaaagcugagagaggaggaggagaagagaagacugaaggaggagaucgagagaagaagagccgaggccgccgagaagagacagaagaugcccgaggacggccugagcgacgacaagaagcccuucaagugcuucacccccaagggcagcagccugaagaucgaggagagagccgaguuccugaacaagagcgugcagaagagcagcggcgugaagagcacccaccaggccgccaucgugagcaagaucgacagcagacuggagcaguacaccagcgccaucgagggcaccaagagcgccaagcccaccaagcccgccgccagcgaccugcccgugcccgccgagggcgugagaaacaucaagagcaugugggagaagggcaacguguucagcagccccaccgccgccggcacccccaacaaggagaccgccggccugaaggugggcgugagcagcagaaucaacgaguggcugaccaagacccccgacggcaacaagagccccgcccccaagcccagcgaccugagacccggcgacgugagcagcaagagaaaccugugggagaagcagagcguggacaaggugaccagccccaccaagguguaa

SEQ ID NO: 14591 - RNA, 1041 nt, Artificial Sequence
  CALHM1__Homo_sapiens__NP_001001412
augauggacaaguucagaaugaucuuccaguuccugcagagcaaccaggagagcuucaugaacggcaucugcggcaucauggcccuggccagcgcccagauguacagcgccuucgacuucaacugccccugccugcccggcuacaacgccgccuacagcgccggcauccugcuggcccccccccuggugcuguuccugcugggccuggugaugaacaacaacgugagcaugcuggccgaggaguggaagagaccccugggcagaagagccaaggaccccgccgugcugagauacauguucugcagcauggcccagagagcccugaucgcccccgugguguggguggccgugacccugcuggacggcaagugcuuccugugcgccuucugcaccgccgugcccgugagcgcccugggcaacggcagccuggcccccggccugcccgcccccgagcuggccagacugcuggccagagugcccugccccgagaucuacgacggcgacuggcugcuggccagagagguggccgugagauaccugagaugcaucagccaggcccugggcuggagcuucgugcugcugaccacccugcuggccuucguggugagaagcgugagacccugcuucacccaggccgccuuccugaagagcaaguacuggagccacuacaucgacaucgagagaaagcuguucgacgagaccugcaccgagcacgccaaggccuucgccaaggugugcauccagcaguucuucgaggccaugaaccacgaccuggagcugggccacacccacggcacccuggccaccgcccccgccagcgccgccgcccccaccacccccgacggcgccgaggaggagagagagaagcugagaggcaucaccgaccagggcaccaugaacagacugcugaccagcuggcacaagugcaagcccccccugagacugggccaggaggagcccccccugaugggcaacggcugggccggcggcggccccagaccccccagaaaggagguggccaccuacuucagcaagguguaa

SEQ ID NO: 14592 - RNA, 972 nt, Artificial Sequence
  CALHM2__Homo_sapiens__XP_006717946
auggccgcccugaucgccgagaacuucagauuccugagccuguucuucaagagcaaggacgugaugaucuucaacggccugguggcccugggcaccgugggcagccaggagcuguucagcgugguggccuuccacugccccugcagccccgccagaaacuaccuguacggccuggccgccaucggcgugcccgcccuggugcuguucaucaucggcaucauccugaacaaccacaccuggaaccugguggccgagugccagcacagaagaaccaagaacugcagcgccgcccccaccuuccugcugcugagcagcauccugggcagagccgccguggcccccgugaccuggagcgugaucagccugcugagaggcgaggccuacgugugcgcccugagcgaguucguggaccccagcagccugaccgccagagaggagcacuuccccagcgcccacgccaccgagauccuggccagauuccccugcaaggagaaccccgacaaccugagcgacuucagagaggaggugagcagaagacugagauacgagagccagcuguucggcuggcugcugaucggcgugguggccauccugguguuccugaccaagugccugaagcacuacugcagcccccugagcuacagacaggaggccuacugggcccaguacagagccaacgaggaccagcuguuccagagaaccgccgaggugcacagcagagugcuggccgccaacaacgugagaagauucuucggcuucguggcccugaacaaggacgacgaggagcugaucgccaacuuccccguggagggcacccagcccagaccccaguggaacgccaucaccggcguguaccuguacagagagaaccagggccugccccuguacagcagacugcacaagugggcccagggccuggccggcaacggcgccgcccccgacaacguggagauggcccugcugcccagcuaa

SEQ ID NO: 14593 - RNA, 1035 nt, Artificial Sequence
  CALHM3__Homo_sapiens__NP_001123214
auggacaaguucagaaugcuguuccagcacuuccagagcagcagcgagagcgugaugaacggcaucugccugcugcuggccgccgugaccgugaagcuguacagcagcuucgacuucaacugccccugccuggugcacuacaacgcccuguacggccugggccugcugcugacccccccccuggcccuguuccugugcggccugcuggccaacagacagagcguggugaugguggaggaguggagaagacccgccggccacagaagaaaggaccccggcaucaucagauacaugugcagcagcgugcugcagagagcccuggccgccccccugguguggauccugcuggcccugcuggacggcaagugcuucgugugcgccuucagcagcagcguggaccccgagaaguuccuggacuucgccaacaugacccccagccaggugcagcuguuccuggccaaggugcccugcaaggaggacgagcuggugagagacagccccgccagaaaggccgugagcagauaccugagaugccugagccaggccaucggcuggagcgugacccugcugcugaucaucgccgccuuccuggccagaugccugagacccugcuucgaccagaccguguuccugcagagaagauacuggagcaacuacguggaccuggagcagaagcuguucgacgagaccugcugcgagcacgccagagacuucgcccacagaugcgugcugcacuucuucgccagcaugagaagcgagcugcaggccagaggccugagaagaggcaacgccggcagaagacuggagcugcccgccgugcccgagccccccgagggccuggacagcggcagcggcaaggcccaccugagagccaucagcagcagagagcagguggacagacugcugagcaccugguacagcagcaagcccccccuggaccuggccgccagccccggccugugcggcggcggccugagccacagagcccccacccuggcccugggcaccagacugagccagcacaccgacguguaa

SEQ ID NO: 14594 - RNA, 450 nt, Artificial Sequence
  CALM2__Homo_sapiens__NP_001734
auggccgaccagcugaccgaggagcagaucgccgaguucaaggaggccuucagccuguucgacaaggacggcgacggcaccaucaccaccaaggagcugggcaccgugaugagaagccugggccagaaccccaccgaggccgagcugcaggacaugaucaacgagguggacgccgacggcaacggcaccaucgacuuccccgaguuccugaccaugauggccagaaagaugaaggacaccgacagcgaggaggagaucagagaggccuucagaguguucgacaaggacggcaacggcuacaucagcgccgccgagcugagacacgugaugaccaaccugggcgagaagcugaccgacgaggagguggacgagaugaucagagaggccgacaucgacggcgacggccaggugaacuacgaggaguucgugcagaugaugaccgccaaguaa

SEQ ID NO: 14595 - RNA, 450 nt, Artificial Sequence
  CALML3__Homo_sapiens__NP_005176
auggccgaccagcugaccgaggagcaggugaccgaguucaaggaggccuucagccuguucgacaaggacggcgacggcugcaucaccaccagagagcugggcaccgugaugagaagccugggccagaaccccaccgaggccgagcugagagacaugaugagcgagaucgacagagacggcaacggcaccguggacuuccccgaguuccugggcaugauggccagaaagaugaaggacaccgacaacgaggaggagaucagagaggccuucagaguguucgacaaggacggcaacggcuucgugagcgccgccgagcugagacacgugaugaccagacugggcgagaagcugagcgacgaggagguggacgagaugaucagagccgccgacaccgacggcgacggccaggugaacuacgaggaguucgugagagugcuggugagcaaguaa

SEQ ID NO: 14596 - RNA, 441 nt, Artificial Sequence
  CALML5__Homo_sapiens__NP_059118
auggccggcgagcugacccccgaggaggaggcccaguacaagaaggccuucagcgccguggacaccgacggcaacggcaccaucaacgcccaggagcugggcgccgcccugaaggccaccggcaagaaccugagcgaggcccagcugagaaagcugaucagcgagguggacagcgacggcgacggcgagaucagcuuccaggaguuccugaccgccgccaagaaggccagagccggccuggaggaccugcagguggccuucagagccuucgaccaggacggcgacggccacaucaccguggacgagcugagaagagccauggccggccugggccagccccugccccaggaggagcuggacgccaugaucagagaggccgacguggaccaggacggcagagugaacuacgaggaguucgccagaaugcuggcccaggaguaa

SEQ ID NO: 14597 - RNA, 660 nt, Artificial Sequence
  CALN1__Homo_sapiens__NP_001017440
augcccuuccaccacgugaccgccggccugcuguacaagggcaacuaccugaacagaagccugagcgccggcagcgacagcgagcagcuggccaacaucagcguggaggagcuggacgagaucagagaggccuucagagugcuggacagagacggcaacggcuucaucagcaagcaggagcugggcauggccaugagaagccugggcuacaugcccagcgagguggagcuggccaucaucaugcagagacuggacauggacggcgacggccagguggacuucgacgaguucaugaccauccugggccccaagcuggugagcagcgagggcagagacggcuuccugggcaacaccaucgacagcaucuucuggcaguucgacaugcagagaaucacccuggaggagcugaagcacauccuguaccacgccuucagagaccaccugaccaugaaggacaucgagaacaucaucaucaacgaggaggagagccugaacgagaccagcggcaacugccagaccgaguucgagggcgugcacagccagaagcagaacagacagaccugcgugagaaagagccugaucugcgccuucgccauggccuucaucaucagcgugaugcugaucgccgccaaccagauccugagaagcggcauggaguaa

SEQ ID NO: 14598 - RNA, 1155 nt, Artificial Sequence
  CALR3__Homo_sapiens__NP_659483
auggccagagcccuggugcagcugugggccaucugcaugcugagaguggcccuggccaccguguacuuccaggaggaguuccuggacggcgagcacuggagaaacagauggcugcagagcaccaacgacagcagauucggccacuucagacugagcagcggcaaguucuacggccacaaggagaaggacaagggccugcagaccacccagaacggcagauucuacgccaucagcgccagauucaagcccuucagcaacaagggcaagacccuggugauccaguacaccgugaagcacgagcagaagauggacugcggcggcggcuacaucaagguguuccccgccgacaucgaccagaagaaccugaacggcaagagccaguacuacaucauguucggccccgacaucugcggcuucgacaucaagaaggugcacgugauccugcacuucaagaacaaguaccacgagaacaagaagcugaucagaugcaagguggacggcuucacccaccuguacacccugauccugagacccgaccugagcuacgacgugaagaucgacggccagagcaucgagagcggcagcaucgaguacgacuggaaccugaccagccugaagaaggagaccagccccgccgagagcaaggacugggagcagaccaaggacaacaaggcccaggacugggagaagcacuuccuggacgccagcaccagcaagcagagcgacuggaacggcgaccuggacggcgacuggcccgcccccaugcugcagaagccccccuaccaggacggccugaagcccgagggcauccacaaggacguguggcugcacagaaagaugaagaacaccgacuaccugacccaguacgaccugagcgaguucgagaacaucggcgccaucggccuggagcuguggcaggugagaagcggcaccaucuucgacaacuuccugaucaccgacgacgaggaguacgccgacaacuucggcaaggccaccuggggcgagaccaagggccccgagagagagauggacgccauccaggccaaggaggagaugaagaaggccagagaggaggaggaggaggagcugcugagcggcaagaucaacagacacgagcacuacuucaaccaguuccacagaagaaacgagcuguaa

SEQ ID NO: 14599 - RNA, 1254 nt, Artificial Sequence
  CALR__Homo_sapiens__NP_004334
augcugcugagcgugccccugcugcugggccugcugggccuggccguggccgagcccgccguguacuucaaggagcaguuccuggacggcgacggcuggaccagcagauggaucgagagcaagcacaagagcgacuucggcaaguucgugcugagcagcggcaaguucuacggcgacgaggagaaggacaagggccugcagaccagccaggacgccagauucuacgcccugagcgccagcuucgagcccuucagcaacaagggccagacccugguggugcaguucaccgugaagcacgagcagaacaucgacugcggcggcggcuacgugaagcuguuccccaacagccuggaccagaccgacaugcacggcgacagcgaguacaacaucauguucggccccgacaucugcggccccggcaccaagaaggugcacgugaucuucaacuacaagggcaagaacgugcugaucaacaaggacaucagaugcaaggacgacgaguucacccaccuguacacccugaucgugagacccgacaacaccuacgaggugaagaucgacaacagccagguggagagcggcagccuggaggacgacugggacuuccugccccccaagaagaucaaggaccccgacgccagcaagcccgaggacugggacgagagagccaagaucgacgaccccaccgacagcaagcccgaggacugggacaagcccgagcacauccccgaccccgacgccaagaagcccgaggacugggacgaggagauggacggcgagugggagccccccgugauccagaaccccgaguacaagggcgaguggaagcccagacagaucgacaaccccgacuacaagggcaccuggauccaccccgagaucgacaaccccgaguacagccccgaccccagcaucuacgccuacgacaacuucggcgugcugggccuggaccuguggcaggugaagagcggcaccaucuucgacaacuuccugaucaccaacgacgaggccuacgccgaggaguucggcaacgagaccuggggcgugaccaaggccgccgagaagcagaugaaggacaagcaggacgaggagcagagacugaaggaggaggaggaggacaagaagagaaaggaggaggaggaggccgaggacaaggaggacgacgaggacaaggacgaggacgaggaggacgaggaggacaaggaggaggacgaggaggaggacgugcccggccaggccaaggacgagcuguaa

SEQ ID NO: 14600 - RNA, 948 nt, Artificial Sequence
  CALU__Homo_sapiens__NP_001124146
auggaccugagacaguuccugaugugccugagccugugcaccgccuucgcccugagcaagcccaccgagaagaaggacagagugcaccacgagccccagcugagcgacaaggugcacaacgacgcccagagcuucgacuacgaccacgacgccuuccugggcgccgaggaggccaagaccuucgaccagcugacccccgaggagagcaaggagagacugggcaugaucguggacaagaucgacgccgacaaggacggcuucgugaccgagggcgagcugaagagcuggaucaagcacgcccagaagaaguacaucuacgacaacguggagaaccaguggcaggaguucgacaugaaccaggacggccugaucagcugggacgaguacagaaacgugaccuacggcaccuaccuggacgaccccgaccccgacgacggcuucaacuacaagcagaugauggugagagacgagagaagauucaagauggccgacaaggacggcgaccugaucgccaccaaggaggaguucaccgccuuccugcaccccgaggaguacgacuacaugaaggacaucguggugcaggagaccauggaggacaucgacaagaacgccgacggcuucaucgaccuggaggaguacaucggcgacauguacagccacgacggcaacaccgacgagcccgagugggugaagaccgagagagagcaguucguggaguucagagacaagaacagagacggcaagauggacaaggaggagaccaaggacuggauccugcccagcgacuacgaccacgccgaggccgaggccagacaccugguguacgagagcgaccagaacaaggacggcaagcugaccaaggaggagaucguggacaaguacgaccuguucgugggcagccaggccaccgacuucggcgaggcccuggugagacacgacgaguucuaa

SEQ ID NO: 14601 - RNA, 654 nt, Artificial Sequence
  CALY__Homo_sapiens__NP_056537
auggugaagcugggcugcagcuucagcggcaagcccggcaaggaccccggcgaccaggacggcgccgccauggacagcgugccccugaucagcccccuggacaucagccagcugcagcccccccugcccgaccagguggugaucaagacccagaccgaguaccagcugagcagccccgaccagcagaacuuccccgaccuggagggccagagacugaacugcagccaccccgaggagggcagaagacugcccaccgccagaaugaucgccuucgccauggcccugcugggcugcgugcugaucauguacaaggccaucugguacgaccaguucaccugccccgacggcuuccugcugagacacaagaucugcaccccccugacccuggagauguacuacaccgagauggaccccgagagacacagaagcauccuggccgccaucggcgccuacccccugagcagaaagcacggcaccgagacccccgccgccuggggcgacggcuacagagccgccaaggaggagagaaagggccccacccaggccggcgccgccgccgccgccaccgagccccccggcaagcccagcgccaaggccgagaaggaggccgccagaaaggccgccggcagcgccgcccccccccccgcccaguaa

SEQ ID NO: 14602 - RNA, 1074 nt, Artificial Sequence
  CAMK1D__Homo_sapiens__NP_065130
auggccagagagaacggcgagagcagcagcagcuggaagaagcaggccgaggacaucaagaagaucuucgaguucaaggagacccugggcaccggcgccuucagcgagguggugcuggccgaggagaaggccaccggcaagcuguucgccgugaagugcauccccaagaaggcccugaagggcaaggagagcagcaucgagaacgagaucgccgugcugagaaagaucaagcacgagaacaucguggcccuggaggacaucuacgagagccccaaccaccuguaccuggugaugcagcuggugagcggcggcgagcuguucgacagaaucguggagaagggcuucuacaccgagaaggacgccagcacccugaucagacaggugcuggacgccguguacuaccugcacagaaugggcaucgugcacagagaccugaagcccgagaaccugcuguacuacagccaggacgaggagagcaagaucaugaucagcgacuucggccugagcaagauggagggcaagggcgacgugaugagcaccgccugcggcacccccggcuacguggcccccgaggugcuggcccagaagcccuacagcaaggccguggacugcuggagcaucggcgugaucgccuacauccugcugugcggcuacccccccuucuacgacgagaacgacagcaagcuguucgagcagauccugaaggccgaguacgaguucgacagccccuacugggacgacaucagcgacagcgccaaggacuucaucagaaaccugauggagaaggaccccaacaagagauacaccugcgagcaggccgccagacaccccuggaucgccggcgacaccgcccugaacaagaacauccacgagagcgugagcgcccagaucagaaagaacuucgccaagagcaaguggagacaggccuucaacgccaccgccguggugagacacaugagaaagcugcaccugggcagcagccuggacagcagcaacgccagcgugagcagcagccugagccuggccagccagaaggacugcgccuacguggccaagcccgagagccugagcuaa

SEQ ID NO: 14603 - RNA, 1431 nt, Artificial Sequence
  CAMK1G__Homo_sapiens__NP_065172
augggcagaaaggaggaggacgacugcagcagcuggaagaagcagaccaccaacaucagaaagaccuucaucuucauggaggugcugggcagcggcgccuucagcgagguguuccuggugaagcagagacugaccggcaagcuguucgcccugaagugcaucaagaagagccccgccuucagagacagcagccuggagaacgagaucgccgugcugaagaagaucaagcacgagaacaucgugacccuggaggacaucuacgagagcaccacccacuacuaccuggugaugcagcuggugagcggcggcgagcuguucgacagaauccuggagagaggcguguacaccgagaaggacgccagccuggugauccagcaggugcugagcgccgugaaguaccugcacgagaacggcaucgugcacagagaccugaagcccgagaaccugcuguaccugacccccgaggagaacagcaagaucaugaucaccgacuucggccugagcaagauggagcagaacggcaucaugagcaccgccugcggcacccccggcuacguggcccccgaggugcuggcccagaagcccuacagcaaggccguggacugcuggagcaucggcgugaucaccuacauccugcugugcggcuacccccccuucuacgaggagaccgagagcaagcuguucgagaagaucaaggagggcuacuacgaguucgagagccccuucugggacgacaucagcgagagcgccaaggacuucaucugccaccugcuggagaaggaccccaacgagagauacaccugcgagaaggcccugagccaccccuggaucgacggcaacaccgcccugcacagagacaucuaccccagcgugagccugcagauccagaagaacuucgccaagagcaaguggagacaggccuucaacgccgccgccguggugcaccacaugagaaagcugcacaugaaccugcacagccccggcgugagacccgagguggagaacagaccccccgagacccaggccagcgagaccagcagacccagcagccccgagaucaccaucaccgaggcccccgugcuggaccacagcguggcccugcccgcccugacccagcugcccugccagcacggcagaagacccaccgcccccggcggcagaagccugaacugccuggugaacggcagccugcacaucagcagcagccuggugcccaugcaccagggcagccuggccgccggccccugcggcugcugcagcagcugccugaacaucggcagcaagggcaagagcagcuacugcagcgagcccacccugcugaagaaggccaacaagaagcagaacuucaagagcgaggugauggugcccgugaaggccagcggcagcagccacugcagagccggccagaccggcgugugccugaucauguaa

SEQ ID NO: 14604 - RNA, 1113 nt, Artificial Sequence
  CAMK1__Homo_sapiens__NP_003647
augcugggcgccguggagggccccagauggaagcaggccgaggacaucagagacaucuacgacuucagagacgugcugggcaccggcgccuucagcgaggugauccuggccgaggacaagagaacccagaagcugguggccaucaagugcaucgccaaggaggcccuggagggcaaggagggcagcauggagaacgagaucgccgugcugcacaagaucaagcaccccaacaucguggcccuggacgacaucuacgagagcggcggccaccuguaccugaucaugcagcuggugagcggcggcgagcuguucgacagaaucguggagaagggcuucuacaccgagagagacgccagcagacugaucuuccaggugcuggacgccgugaaguaccugcacgaccugggcaucgugcacagagaccugaagcccgagaaccugcuguacuacagccuggacgaggacagcaagaucaugaucagcgacuucggccugagcaagauggaggaccccggcagcgugcugagcaccgccugcggcacccccggcuacguggcccccgaggugcuggcccagaagcccuacagcaaggccguggacugcuggagcaucggcgugaucgccuacauccugcugugcggcuacccccccuucuacgacgagaacgacgccaagcuguucgagcagauccugaaggccgaguacgaguucgacagccccuacugggacgacaucagcgacagcgccaaggacuucaucagacaccugauggagaaggaccccgagaagagauucaccugcgagcaggcccugcagcaccccuggaucgccggcgacaccgcccuggacaagaacauccaccagagcgugagcgagcagaucaagaagaacuucgccaagagcaaguggaagcaggccuucaacgccaccgccguggugagacacaugagaaagcugcagcugggcaccagccaggagggccagggccagaccgccagccacggcgagcugcugacccccguggccggcggccccgccgccggcugcugcugcagagacugcugcguggagcccggcaccgagcugagccccacccugccccaccagcuguaa

SEQ ID NO: 14605 - RNA, 1470 nt, Artificial Sequence
  CAMK2A__Homo_sapiens__NP_057065
auggccaccaucaccugcaccagauucaccgaggaguaccagcuguucgaggagcugggcaagggcgccuucagcguggugagaagaugcgugaaggugcuggccggccaggaguacgccgccaagaucaucaacaccaagaagcugagcgccagagaccaccagaagcuggagagagaggccagaaucugcagacugcugaagcaccccaacaucgugagacugcacgacagcaucagcgaggagggccaccacuaccugaucuucgaccuggugaccggcggcgagcuguucgaggacaucguggccagagaguacuacagcgaggccgacgccagccacugcauccagcagauccuggaggccgugcugcacugccaccagaugggcguggugcacagagaccugaagcccgagaaccugcugcuggccagcaagcugaagggcgccgccgugaagcuggccgacuucggccuggccaucgagguggagggcgagcagcaggccugguucggcuucgccggcacccccggcuaccugagccccgaggugcugagaaaggaccccuacggcaagcccguggaccugugggccugcggcgugauccuguacauccugcuggugggcuacccccccuucugggacgaggaccagcacagacuguaccagcagaucaaggccggcgccuacgacuuccccagccccgagugggacaccgugacccccgaggccaaggaccugaucaacaagaugcugaccaucaaccccagcaagagaaucaccgccgccgaggcccugaagcaccccuggaucagccacagaagcaccguggccagcugcaugcacagacaggagaccguggacugccugaagaaguucaacgccagaagaaagcugaagggcgccauccugaccaccaugcuggccaccagaaacuucagcggcggcaagagcggcggcaacaagaagagcgacggcgugaagaagagaaagagcagcagcagcgugcagcugauggagagcagcgagagcaccaacaccaccaucgaggacgaggacaccaaggugagaaagcaggagaucaucaaggugaccgagcagcugaucgaggccaucagcaacggcgacuucgagagcuacaccaagaugugcgaccccggcaugaccgccuucgagcccgaggcccugggcaaccugguggagggccuggacuuccacagauucuacuucgagaaccuguggagcagaaacagcaagcccgugcacaccaccauccugaacccccacauccaccugaugggcgacgagagcgccugcaucgccuacaucagaaucacccaguaccuggacgccggcggcauccccagaaccgcccagagcgaggagaccagaguguggcacagaagagacggcaaguggcagaucgugcacuuccacagaagcggcgcccccagcgugcugccccacuaa

SEQ ID NO: 14606 - RNA, 2001 nt, Artificial Sequence
  CAMK2B__Homo_sapiens__NP_001211
auggccaccaccgugaccugcaccagauucaccgacgaguaccagcuguacgaggacaucggcaagggcgccuucagcguggugagaagaugcgugaagcugugcaccggccacgaguacgccgccaagaucaucaacaccaagaagcugagcgccagagaccaccagaagcuggagagagaggccagaaucugcagacugcugaagcacagcaacaucgugagacugcacgacagcaucagcgaggagggcuuccacuaccugguguucgaccuggugaccggcggcgagcuguucgaggacaucguggccagagaguacuacagcgaggccgacgccagccacugcauccagcagauccuggaggccgugcugcacugccaccagaugggcguggugcacagagaccugaagcccgagaaccugcugcuggccagcaagugcaagggcgccgccgugaagcuggccgacuucggccuggccaucgaggugcagggcgaccagcaggccugguucggcuucgccggcacccccggcuaccugagccccgaggugcugagaaaggaggccuacggcaagcccguggacaucugggccugcggcgugauccuguacauccugcuggugggcuacccccccuucugggacgaggaccagcacaagcuguaccagcagaucaaggccggcgccuacgacuuccccagccccgagugggacaccgugacccccgaggccaagaaccugaucaaccagaugcugaccaucaaccccgccaagagaaucaccgcccacgaggcccugaagcaccccugggugugccagagaagcaccguggccagcaugaugcacagacaggagaccguggagugccugaagaaguucaacgccagaagaaagcugaagggcgccauccugaccaccaugcuggccaccagaaacuucagcgugggcagacagaccaccgcccccgccaccaugagcaccgccgccagcggcaccaccaugggccugguggagcaggccaagagccugcugaacaagaaggccgacggcgugaagccccagaccaacagcaccaagaacagcgccgccgccaccagccccaagggcacccugccccccgccgcccuggagccccagaccaccgugauccacaaccccguggacggcaucaaggagagcagcgacagcgccaacaccaccaucgaggacgaggacgccaaggcccccagagugcccgacauccugagcagcgugagaagaggcagcggcgcccccgaggccgagggcccccugcccugccccagccccgcccccuucagcccccugcccgcccccagccccagaaucagcgacauccugaacagcgugagaagaggcagcggcacccccgaggccgagggcccccugagcgccggccccccccccugccugagccccgcccugcugggcccccugagcagccccagccccagaaucagcgacauccugaacagcgugagaagaggcagcggcacccccgaggccgagggccccagccccgugggccccccccccugccccagccccaccauccccggcccccugcccacccccagcagaaagcaggagaucaucaagaccaccgagcagcugaucgaggccgugaacaacggcgacuucgaggccuacgccaagaucugcgaccccggccugaccagcuucgagcccgaggcccugggcaaccugguggagggcauggacuuccacagauucuacuucgagaaccugcuggccaagaacagcaagcccauccacaccaccauccugaacccccacgugcacgugaucggcgaggacgccgccugcaucgccuacaucagacugacccaguacaucgacggccagggcagacccagaaccagccagagcgaggagaccagaguguggcacagaagagacggcaaguggcagaacgugcacuuccacugcagcggcgcccccguggccccccugcaguaa

SEQ ID NO: 14607 - RNA, 1500 nt, Artificial Sequence
  CAMK2D__Homo_sapiens__NP_001212
auggccagcaccaccaccugcaccagauucaccgacgaguaccagcuguucgaggagcugggcaagggcgccuucagcguggugagaagaugcaugaagauccccaccggccaggaguacgccgccaagaucaucaacaccaagaagcugagcgccagagaccaccagaagcuggagagagaggccagaaucugcagacugcugaagcaccccaacaucgugagacugcacgacagcaucagcgaggagggcuuccacuaccugguguucgaccuggugaccggcggcgagcuguucgaggacaucguggccagagaguacuacagcgaggccgacgccagccacugcauccagcagauccuggagagcgugaaccacugccaccugaacggcaucgugcacagagaccugaagcccgagaaccugcugcuggccagcaagagcaagggcgccgccgugaagcuggccgacuucggccuggccaucgaggugcagggcgaccagcaggccugguucggcuucgccggcacccccggcuaccugagccccgaggugcugagaaaggaccccuacggcaagcccguggacaugugggccugcggcgugauccuguacauccugcuggugggcuacccccccuucugggacgaggaccagcacagacuguaccagcagaucaaggccggcgccuacgacuuccccagccccgagugggacaccgugacccccgaggccaaggaccugaucaacaagaugcugaccaucaaccccgccaagagaaucaccgccagcgaggcccugaagcaccccuggaucugccagagaagcaccguggccagcaugaugcacagacaggagaccguggacugccugaagaaguucaacgccagaagaaagcugaagggcgccauccugaccaccaugcuggccaccagaaacuucagcgccgccaagagccugcugaagaagcccgacggcgugaaggagagcaccgagagcagcaacaccaccaucgaggacgaggacgugaaggccagaaagcaggagaucaucaaggugaccgagcagcugaucgaggccaucaacaacggcgacuucgaggccuacaccaagaucugcgaccccggccugaccgccuucgagcccgaggcccugggcaaccugguggagggcauggacuuccacagauucuacuucgagaacgcccugagcaagagcaacaagcccauccacaccaucauccugaacccccacgugcaccuggugggcgacgacgccgccugcaucgccuacaucagacugacccaguacauggacggcagcggcaugcccaagaccaugcagagcgaggagaccagaguguggcacagaagagacggcaaguggcagaacgugcacuuccacagaagcggcagccccaccgugcccaucaagccccccugcauccccaacggcaaggagaacuucagcggcggcaccagccuguggcagaacaucuaa

SEQ ID NO: 14608 - RNA, 1488 nt, Artificial Sequence
  CAMK2G__Homo_sapiens__NP_001213
auggccaccaccgccaccugcaccagauucaccgacgacuaccagcuguucgaggagcugggcaagggcgccuucagcguggugagaagaugcgugaagaagaccagcacccaggaguacgccgccaagaucaucaacaccaagaagcugagcgccagagaccaccagaagcuggagagagaggccagaaucugcagacugcugaagcaccccaacaucgugagacugcacgacagcaucagcgaggagggcuuccacuaccugguguucgaccuggugaccggcggcgagcuguucgaggacaucguggccagagaguacuacagcgaggccgacgccagccacugcauccaccagauccuggagagcgugaaccacauccaccagcacgacaucgugcacagagaccugaagcccgagaaccugcugcuggccagcaagugcaagggcgccgccgugaagcuggccgacuucggccuggccaucgaggugcagggcgagcagcaggccugguucggcuucgccggcacccccggcuaccugagccccgaggugcugagaaaggaccccuacggcaagcccguggacaucugggccugcggcgugauccuguacauccugcuggugggcuacccccccuucugggacgaggaccagcacaagcuguaccagcagaucaaggccggcgccuacgacuuccccagccccgagugggacaccgugacccccgaggccaagaaccugaucaaccagaugcugaccaucaaccccgccaagagaaucaccgccgaccaggcccugaagcaccccugggugugccagagaagcaccguggccagcaugaugcacagacaggagaccguggagugccugagaaaguucaacgccagaagaaagcugaagggcgccauccugaccaccaugcuggugagcagaaacuucagcgccgccaagagccugcugaacaagaagagcgacggcggcgugaaggagccccagaccaccguggugcacaacgccaccgacggcaucaagggcagcaccgagagcugcaacaccaccaccgaggacgaggaccugaaggugagaaagcaggagaucaucaagaucaccgagcagcugaucgaggccaucaacaacggcgacuucgaggccuacaccaagaucugcgaccccggccugaccagcuucgagcccgaggcccugggcaaccugguggagggcauggacuuccacaaguucuacuucgagaaccugcugagcaagaacagcaagcccauccacaccaccauccugaacccccacgugcacgugaucggcgaggacgccgccugcaucgccuacaucagacugacccaguacaucgacggccagggcagacccagaaccagccagagcgaggagaccagaguguggcacagaagagacggcaaguggcugaacgugcacuaccacugcagcggcgcccccgccgccccccugcaguaa

SEQ ID NO: 14609 - RNA, 1422 nt, Artificial Sequence
  CAMK4__Homo_sapiens__NP_001735
augcugaaggugaccgugcccagcugcagcgccagcagcugcagcagcgugaccgccagcgccgcccccggcaccgccagccuggugcccgacuacuggaucgacggcagcaacagagacgcccugagcgacuucuucgagguggagagcgagcugggcagaggcgccaccagcaucguguacagaugcaagcagaagggcacccagaagcccuacgcccugaaggugcugaagaagaccguggacaagaagaucgugagaaccgagaucggcgugcugcugagacugagccaccccaacaucaucaagcugaaggagaucuucgagacccccaccgagaucagccuggugcuggagcuggugaccggcggcgagcuguucgacagaaucguggagaagggcuacuacagcgagagagacgccgccgacgccgugaagcagauccuggaggccguggccuaccugcacgagaacggcaucgugcacagagaccugaagcccgagaaccugcuguacgccacccccgcccccgacgccccccugaagaucgccgacuucggccugagcaagaucguggagcaccaggugcugaugaagaccgugugcggcacccccggcuacugcgcccccgagauccugagaggcugcgccuacggccccgagguggacauguggagcgugggcaucaucaccuacauccugcugugcggcuucgagcccuucuacgacgagagaggcgaccaguucauguucagaagaauccugaacugcgaguacuacuucaucagccccuggugggacgaggugagccugaacgccaaggaccuggugagaaagcugaucgugcuggaccccaagaagagacugaccaccuuccaggcccugcagcaccccugggugaccggcaaggccgccaacuucgugcacauggacaccgcccagaagaagcugcaggaguucaacgccagaagaaagcugaaggccgccgugaaggccgugguggccagcagcagacugggcagcgccagcagcagccacggcagcauccaggagagccacaaggccagcagagaccccagccccauccaggacggcaacgaggacaugaaggccauccccgagggcgagaagauccagggcgacggcgcccaggccgccgugaagggcgcccaggccgagcugaugaaggugcaggcccuggagaaggugaagggcgccgacaucaacgccgaggaggcccccaagauggugcccaaggccguggaggacggcaucaagguggccgaccuggagcuggaggagggccuggccgaggagaagcugaagaccguggaggaggccgccgcccccagagagggccagggcagcagcgccgugggcuucgaggugccccagcaggacgugauccugcccgaguacuaa

SEQ ID NO: 14610 - RNA, 1518 nt, Artificial Sequence
  CAMKK1__Homo_sapiens__NP_757343
auggagggcggccccgccgugugcugccaggaccccagagccgagcugguggagagaguggccgccaucgacgugacccaccuggaggaggccgacggcggccccgagcccaccagaaacggcguggaccccccccccagagccagagccgccagcgugauccccggcagcaccagcagacugcugcccgccagacccagccugagcgccagaaagcugagccugcaggagagacccgccggcagcuaccuggaggcccaggccggccccuacgccaccggccccgccagccacaucagccccagagccuggagaagacccaccaucgagagccaccacguggccaucagcgacgccgaggacugcgugcagcugaaccaguacaagcugcagagcgagaucggcaagggcgccuacggcguggugagacuggccuacaacgagagcgaggacagacacuacgccaugaaggugcugagcaagaagaagcugcugaagcaguacggcuuccccagaagacccccccccagaggcagccaggccgcccagggcggccccgccaagcagcugcugccccuggagagaguguaccaggagaucgccauccugaagaagcuggaccacgugaacguggugaagcugaucgaggugcuggacgaccccgccgaggacaaccuguaccugguguucgaccugcugagaaagggccccgugauggaggugcccugcgacaagcccuucagcgaggagcaggccagacuguaccugagagacgugauccugggccuggaguaccugcacugccagaagaucgugcacagagacaucaagcccagcaaccugcugcugggcgacgacggccacgugaagaucgccgacuucggcgugagcaaccaguucgagggcaacgacgcccagcugagcagcaccgccggcacccccgccuucauggcccccgaggccaucagcgacagcggccagagcuucagcggcaaggcccuggacgugugggccaccggcgugacccuguacugcuucguguacggcaagugccccuucaucgacgacuucauccuggcccugcacagaaagaucaagaacgagcccgugguguuccccgaggagcccgagaucagcgaggagcugaaggaccugauccugaagaugcuggacaagaaccccgagaccagaaucggcgugcccgacaucaagcugcaccccugggugaccaagaacggcgaggagccccugcccagcgaggaggagcacugcagcgugguggaggugaccgaggaggaggugaagaacagcgugagacugauccccagcuggaccaccgugauccuggugaagagcaugcugagaaagagaagcuucggcaaccccuucgagccccaggccagaagagaggagagaagcaugagcgcccccggcaaccugcuggugaaggagggcuucggcgagggcggcaagagccccgagcugcccggcgugcaggaggacgaggccgccagcuaa

SEQ ID NO: 14611 - RNA, 1767 nt, Artificial Sequence
  CAMKK2__Homo_sapiens__NP_001257414
augagcagcugcgugagcagccagcccagcagcaacagagccgccccccaggacgagcugggcggcagaggcagcagcagcagcgagagccagaagcccugcgaggcccugagaggccugagcagccugagcauccaccugggcauggagagcuucaucguggugaccgagugcgagcccggcugcgccguggaccugggccuggccagagacagaccccuggaggccgacggccaggaggugccccuggacaccagcggcagccaggccagaccccaccugagcggcagaaagcugagccugcaggagagaagccagggcggccuggccgccggcggcagccuggacaugaacggcagaugcaucugccccagccugcccuacagccccgugagcagcccccagagcagccccagacugcccagaagacccaccguggagagccaccacgugagcaucaccggcaugcaggacugcgugcagcugaaccaguacacccugaaggacgagaucggcaagggcagcuacggcguggugaagcuggccuacaacgagaacgacaacaccuacuacgccaugaaggugcugagcaagaagaagcugaucagacaggccggcuuccccagaagacccccccccagaggcaccagacccgcccccggcggcugcauccagcccagaggccccaucgagcagguguaccaggagaucgccauccugaagaagcuggaccaccccaacguggugaagcugguggaggugcuggacgaccccaacgaggaccaccuguacaugguguucgagcuggugaaccagggccccgugauggaggugcccacccugaagccccugagcgaggaccaggccagauucuacuuccaggaccugaucaagggcaucgaguaccugcacuaccagaagaucauccacagagacaucaagcccagcaaccugcuggugggcgaggacggccacaucaagaucgccgacuucggcgugagcaacgaguucaagggcagcgacgcccugcugagcaacaccgugggcacccccgccuucauggcccccgagagccugagcgagaccagaaagaucuucagcggcaaggcccuggacgugugggccaugggcgugacccuguacugcuucguguucggccagugccccuucauggacgagagaaucaugugccugcacagcaagaucaagagccaggcccuggaguuccccgaccagcccgacaucgccgaggaccugaaggaccugaucaccagaaugcuggacaagaaccccgagagcagaaucguggugcccgagaucaagcugcaccccugggugaccagacacggcgccgagccccugcccagcgaggacgagaacugcacccugguggaggugaccgaggaggagguggagaacagcgugaagcacauccccagccuggccaccgugauccuggugaagaccaugaucagaaagagaagcuucggcaaccccuucgagggcagcagaagagaggagagaagccugagcgcccccggcaaccugcugaccaagaagcccaccagagagugcgagagccugagcgagcugaaggaggccagacagagaagacagccccccggccacagacccgcccccagaggcggcggcggcagcgcccuggugagaggcagccccugcguggagagcugcugggcccccgcccccggcagccccgccagaaugcacccccugagacccgaggaggccauggagcccgaguaa

SEQ ID NO: 14612 - RNA, 972 nt, Artificial Sequence
  CAMKMT__Homo_sapiens__NP_079042
auggagagcagaguggccgacgccggcaccggcgagaccgccagagccgccggcggcagccccgccgugggcugcaccaccagaggccccguggugagcgccccccugggcgccgccagauggaagcugcugagacaggugcugaagcagaagcaccuggacgacugccugagacacgugagcgugagaagauucgagagcuucaaccuguucagcgugaccgagggcaaggagagagagaccgaggaggaggugggcgccugggugcaguacaccagcaucuucugccccgaguacagcaucagccugagacacaacagcggcagccugaacguggaggacgugcugaccagcuucgacaacaccggcaacgugugcaucuggcccagcgaggaggugcuggccuacuacugccugaagcacaacaacaucuucagagcccuggccgugugcgagcugggcggcggcaugaccugccuggccggccugaugguggccaucagcgccgacgugaaggaggugcugcugaccgacggcaacgagaaggccaucagaaacgugcaggacaucaucaccagaaaccagaaggccggcguguucaagacccagaagaucagcagcugcgugcugagaugggacaacgagaccgacgugagccagcuggagggccacuucgacaucgugaugugcgccgacugccuguuccuggaccaguacagagccagccugguggacgccaucaagagacugcugcagcccagaggcaaggccaugguguucgcccccagaagaggcaacacccugaaccaguucugcaaccuggccgagaaggccggcuucugcauccagagacacgagaacuacgacgagcacaucagcaacuuccacagcaagcugaagaaggagaaccccgacaucuacgaggagaaccugcacuacccccugcugcugauccugaccaagcacggcuaa

SEQ ID NO: 14613 - RNA, 891 nt, Artificial Sequence
  CAMLG__Homo_sapiens__NP_001736
auggagagcauggccguggccaccgacggcggcgagagacccggcgugcccgccggcagcggccugagcgccagccagagaagagccgagcugagaagaagaaagcugcugaugaacagcgagcagagaaucaacagaaucaugggcuuccacagacccggcagcggcgccgaggaggagagccagaccaagagcaagcagcaggacagcgacaagcugaacagccugagcgugcccagcgugagcaagagaguggugcugggcgacagcgugagcaccggcaccaccgaccagcagggcggcguggccgaggugaagggcacccagcugggcgacaagcuggacagcuucaucaagccccccgagugcagcagcgacgugaaccuggagcugagacagagaaacagaggcgaccugaccgccgacagcgugcagagaggcagcagacacggccuggagcaguaccugagcagauucgaggaggccaugaagcugagaaagcagcugaucagcgagaagcccagccaggaggacggcaacaccaccgaggaguucgacagcuucagaaucuucagacuggugggcugcgcccugcuggcccugggcgugagagccuucgugugcaaguaccugagcaucuucgcccccuuccugacccugcagcuggccuacaugggccuguacaaguacuuccccaagagcgagaagaagaucaagaccaccgugcugaccgccgcccugcugcugagcggcauccccgccgaggugaucaacagaagcauggacaccuacagcaagaugggcgagguguucaccgaccugugcguguacuucuucaccuucaucuucugccacgagcugcuggacuacuggggcagcgaggugcccuaa

SEQ ID NO: 14614 - RNA, 522 nt, Artificial Sequence
  CAMP__Homo_sapiens__NP_004336
augggcaccaugaagacccagagagacggccacagccugggcagauggagccuggugcugcugcugcugggccuggugaugccccuggccaucaucgcccaggugcugagcuacaaggaggccgugcugagagccaucgacggcaucaaccagagaagcagcgacgccaaccuguacagacugcuggaccuggaccccagacccaccauggacggcgaccccgacacccccaagcccgugagcuucaccgugaaggagaccgugugccccagaaccacccagcagagccccgaggacugcgacuucaagaaggacggccuggugaagagaugcaugggcaccgugacccugaaccaggccagaggcagcuucgacaucagcugcgacaaggacaacaagagauucgcccugcugggcgacuucuucagaaagagcaaggagaagaucggcaaggaguucaagagaaucgugcagagaaucaaggacuuccugagaaaccuggugcccagaaccgagagcuaa

SEQ ID NO: 14615 - RNA, 4809 nt, Artificial Sequence
  CAMSAP1__Homo_sapiens__NP_056262
augguggacgccagcggcagagccgccgccgagggcuggagaaagauggaggccccccccgacggcgccgccgaccuggugccccuggacagauacgacgccgccagagccaagaucgccgccaaccugcaguggaucugcgccaaggccuacggcagagacaacauccccgaggaccugagagaccccuucuacguggaccaguacgagcaggagcacaucaagccccccgugaucaagcugcugcugagcagcgagcuguacugcagagugugcagccugauccugaagggcgaccagguggccgcccugcagggccaccagagcgugauccaggcccugagcagaaagggcaucuacgugauggagagcgacgacacccccgugaccgagagcgaccugagcagagcccccaucaagaugagcgcccacauggccaugguggacgcccugaugauggccuacaccguggagaugaucagcaucgagaaggugguggccagcgugaagagauucagcaccuucagcgccagcaaggagcugcccuacgaccuggaggacgccaugguguucuggaucaacaaggugaaccugaagaugagagagaucaccgagaaggaggugaagcugaagcagcagcugcuggagagccccgcccaccagaaggugagauacagaagagagcaccugagcgccagacagagccccuacuucccccugcuggaggaccugaugagagacggcagcgacggcgccgcccugcuggccgugauccacuacuacugccccgagcagaugaagcuggacgacaucugccugaaggaggugaccagcauggccgacagccuguacaacaucagacugcugagagaguucagcaacgaguaccugaacaagugcuucuaccugacccuggaggacaugcuguacgccccccuggugcugaagcccaacgugaugguguucaucgccgagcuguucuggugguucgagaacgugaagcccgacuucgugcagcccagagacgugcaggagcugaaggacgccaagaccgugcugcaccagaagagcagcagaccccccgugcccaucagcaacgccaccaagagaagcuuccugggcagccccgccgccggcacccuggccgagcugcagccccccgugcagcugcccgccgagggcugccacagacacuaccugcaccccgaggagcccgaguaccugggcaagggcaccgccgccuucagccccagccacccccugcugccccugagacagaagcagcagaagagcauccagggcgaggacauccccgaccagagacacagaagcaacagccugaccagaguggacggccagcccagaggcgccgccaucgccuggcccgagaagaagaccagacccgccagccagcccacccccuucgcccugcaccacgccgccagcugcgagguggaccccagcagcggcgacagcaucagccuggccagaagcaucagcaaggacagccuggccagcaacaucgugaaccugaccccccagaaccagccccaccccaccgccaccaagagccacggcaagagccugcugagcaacgugagcaucgaggacgaggaggaggagcugguggccaucgugagagccgacguggugccccagcaggccgaccccgaguuccccagagccagccccagagcccugggccugaccgccaacgccagaagcccccagggccagcuggacaccagcgagagcaagcccgacagcuucuuccuggagccccugaugcccgccgugcugaagcccgccaaggagaagcaggugaucaccaaggaggacgagagaggcgagggcagacccagaagcaucgugagcagaagacccagcgagggcccccagccccuggugagaagaaagaugaccggcagcagagaccugaacagaaccuucacccccauccccugcagcgaguuccccaugggcaucgaccccaccgagaccggcccccugagcguggagaccgccggcgaggugugcggcggcccccuggcccugggcggcuucgaccccuucccccagggccccagcaccgacggcuucuuccugcacgugggcagagccgacgaggacaccgagggcagacuguacgugagcugcagcaagagccccaacagccacgacagcgagcccuggacccugcugagacaggacagcgacagcgacgugguggacaucgaggaggccgagcacgacuucaugggcgaggcccaccccgugguguucagcagauacaucggcgaggaggagagcgccaagcugcaggaggacaugaaggugaaggagcacgaggacaaggacgacgccagcggcagaagcagccccugccugagcaccgccagccagaugagcagcgugagcauggccagcggcagcgugaagaugaccagcuucgccgagagaaagcugcagagacugaacagcugcgagaccaagagcagcaccagcagcagccagaagaccacccccgacgccagcgagagcugccccgccccccugaccaccuggagacagaagagagagcagagccccagccagcacggcaaggaccccgccagccugcuggccagcgagcuggugcagcugcacaugcagcuggaggagaagagaagagccaucgaggcccagaagaagaagauggaggcccugagcgccagacagagacugaagcugggcaaggccgccuuccugcacguggugaagaagggcaaggccgaggccgcccccccccugagacccgagcacuucgccaaggaguacagccagcacaacggcgaggacugcggcgacgccgugagcaagaccgaggacuuccuggugaaggaggagcagagagaggagcugcugcacgagccccaggacguggacaaggagagccuggccuucgcccagcagcacaaggccaaggaccccguggcccugcacgagcuggagagaaacaaggugaucagcgccgcccugcuggaggacaccgugggcgaggugguggacgugaacgagugcgaccugagcaucgagaagcugaacgagaccaucagcacccugcagcaggccauccugaagaucagccagcagcaggagcagcugcugaugaagagccccaccgugcccgugcccggcagcaagaacaacagccaggaccacaaggugaaggcccccgugcacuucguggagccccugagccccaccggcguggccggccacagaaaggcccccagacugggccagggcagaaacagcagaagcggcagacccgccgagcugaaggugcccaaggacagaccccagggcagcagcagaagcaagacccccacccccagcguggagacccugccccaccugagacccuuccccgccagcagccaccccagaacccccaccgaccccggccuggacagcgcccuggagcccagcggcgacccccacggcaagugccuguucgacagcuacagacugcacgacgagagcaaccagagaacccugacccugagcagcagcaaggacgccaacauccugagcgagcagaugagccugaaggaggugcuggacgccagcgugaaggaggugggcagcagcagcagcgacgugagcggcaaggagagcgugcccguggaggagccccugagaagcagagccagccugaucgagguggaccugagcgaccugaaggcccccgacgaggacggcgagcuggugagccuggacggcagcgccgaccuggugagcgagggcgaccagaagcccggcgugggcuucuucuucaaggacgagcagaaggccgaggacgagcuggccaagaagagagccgccuuccugcugaagcagcagagaaaggccgaggaggccagagugagaaagcagcagcuggaggccgagguggagcugaagagagacgaggccagaagaaaggccgaggaggacagagugagaaaggaggaggagaaggccagaagagagcugaucaagcaggaguaccugagaagaaagcagcagcagauccuggaggagcagggccugggcaagcccaagagcaagcccaagaagcccagacccaagagcgugcacagagaggagagcugcagcgacagcggcaccaagugcagcagcacccccgacaaccugagcagaacccagagcggcagcagccugagccuggccagcgccgccaccaccgagcccgagagcgugcacagcggcggcacccccagccagagaguggagagcauggaggcccugcccauccugagcagaaaccccagcagaagcaccgacagagacugggagaccgccagcgccgccagcagccuggccagcguggccgaguacaccggccccaagcuguucaaggagcccagcagcaagagcaacaagcccaucauccacaacgccaucagccacugcugccuggccggcaaggugaacgagccccacaagaacagcauccuggaggagcuggagaagugcgacgccaaccacuacaucauccuguucagagacgccggcugccaguucagagcccuguacugcuacuaccccgacaccgaggagaucuacaagcugaccggcaccggccccaagaacaucaccaagaagaugaucgacaagcuguacaaguacagcagcgacagaaagcaguucaaccugauccccgccaagaccaugagcgugagcguggacgcccugaccauccacaaccaccuguggcagcccaagagacccgccgugcccaagaaggcccagaccagaaaguaa

SEQ ID NO: 14616 - RNA, 4470 nt, Artificial Sequence
  CAMSAP2__Homo_sapiens__NP_001284636
augggcgacgccgccgaccccagagagaugagaaagaccuucaucgugcccgccaucaagcccuucgaccacuacgacuucagcagagccaagaucgccugcaaccuggccuggcugguggccaaggccuucggcaccgagaacgugcccgaggagcugcaggagcccuucuacaccgaccaguacgaccaggagcacaucaagccccccguggugaaccugcugcugagcgccgagcuguacugcagagccggcagccugauccugaagagcgacgccgccaagccccugcugggccacgacgccgugauccaggcccuggcccagaagggccuguacgugaccgaccaggagaagcuggugaccgagagagaccugcacaagaagcccauccagaugagcgcccaccuggccaugaucgacacccugaugauggccuacaccguggagauggugagcaucgagaaggugaucgccugcgcccagcaguacagcgccuucuuccaggccaccgaccugcccuacgacaucgaggacgccgugauguacuggaucaacaaggugaacgagcaccugaaggacaucauggagcaggagcagaagcugaaggagcaccacaccguggaggcccccggcggccagaagagccccagcaagugguucuggaagcuggugcccgccagauacagaaaggagcagacccugcugaagcagcugcccugcaucccccugguggagaaccugcugaaggacggcaccgacggcugcgcccuggccgcccugauccacuucuacugccccgacguggugagacuggaggacaucugccugaaggagaccaugagccuggccgacagccuguacaaccugcagcugauccaggaguucugccaggaguaccugaaccagugcugccacuucacccuggaggacaugcuguacgccgccagcagcaucaagagcaacuaccugguguucauggccgagcuguucuggugguucgagguggugaagcccagcuucgugcagcccagaguggugagaccccagggcgccgagcccgugaaggacaugcccagcauccccgugcugaacgccgccaagagaaacgugcuggacagcagcagcgacuuccccagcagcggcgagggcgccaccuucacccagagccaccaccaccugcccagcagauacagcagaccccaggcccacagcagcgccagcggcggcaucagaagaagcagcagcaugagcuacguggacggcuucaucggcaccuggcccaaggagaagagaagcagcgugcacggcgugagcuucgacaucagcuucgacaaggaggacagcgugcagagaagcacccccaacagaggcaucaccagaagcaucagcaacgagggccugacccugaacaacagccacgugagcaagcacaucagaaagaaccugagcuucaagcccaucaacggcgaggaggaggccgagagcaucgaggaggagcugaacaucgacagccacagcgaccugaagagcugcgugccccugaacaccaacgagcugaacagcaacgagaacauccacuacaagcugcccaacggcgcccugcagaacagaauccugcuggacgaguucggcaaccagaucgagacccccagcaucgaggaggcccugcagaucauccacgacaccgagaagagcccccacaccccccagcccgaccagaucgccaacggcuucuuccugcacagccaggagaugagcauccugaacagcaacaucaagcugaaccagagcagccccgacaacgugaccgacaccaagggcgcccugagccccaucaccgacaacaccgagguggacaccggcauccacgugcccagcgaggacauccccgagaccauggacgaggacagcagccugagagacuacaccgugagccuggacagcgacauggacgacgccagcaaguuccugcaggacuacgacaucagaaccggcaacaccagagaggcccugagccccugccccagcaccgugagcaccaagagccagcccggcagcagcgccagcagcagcagcggcgugaagaugaccagcuucgccgagcagaaguucagaaagcugaaccacaccgacggcaagagcagcggcagcagcagccagaagaccacccccgagggcagcgagcugaacaucccccacgugguggccugggcccagauccccgaggagaccggccugccccagggcagagacaccacccagcugcuggccagcgagauggugcaccugagaaugaagcuggaggagaagagaagagccaucgaggcccagaagaagaagauggaggccgccuucaccaagcagagacagaagaugggcagaaccgccuuccugaccguggugaagaagaagggcgacggcaucagcccccugagagaggaggccgccggcgccgaggacgagaagguguacaccgacagagccaaggagaaggagagccagaagaccgacggccagagaagcaagagccuggccgacaucaaggagagcauggagaacccccaggccaaguggcugaagagccccaccacccccaucgaccccgagaagcaguggaaccuggccagccccagcgaggagacccugaacgagggcgagauccuggaguacaccaagagcaucgagaagcugaacagcagccugcacuuccugcagcaggagaugcagagacugagccugcagcaggagaugcugaugcagaugagagagcagcagagcugggugaucagccccccccagcccagcccccagaagcagaucagagacuucaagcccagcaagcaggccggccugagcagcgccaucgcccccuucagcagcgacagccccagacccacccaccccagcccccagagcagcaacagaaagagcgccagcuucagcgugaagagccagagaacccccagacccaacgagcugaagaucaccccccugaacagaacccugaccccccccagaagcguggacagccugcccagacugagaagauucagccccagccaggugcccauccagaccagaagcuucgugugcuucggcgacgacggcgagccccagcugaaggagagcaagcccaaggaggaggugaagaaggaggagcuggagagcaagggcacccuggagcagagaggccacaaccccgaggagaaggagaucaagcccuucgagagcaccgugagcgaggugcugagccugcccgugaccgagaccgugugccugacccccaacgaggaccagcugaaccagcccaccgagcccccccccaagcccguguucccccccaccgcccccaagaacgugaaccugaucgaggugagccugagcgaccugaagccccccgagaaggccgacgugcccguggagaaguacgacggcgagagcgacaaggagcaguucgacgacgaccagaaggugugcugcggcuucuucuucaaggacgaccagaaggccgagaacgacauggccaugaagagagccgcccugcuggagaagagacugagaagagagaaggagacccagcugagaaagcagcagcuggaggccgagauggagcacaagaaggaggagaccagaagaaagaccgaggaggagagacagaagaaggaggacgagagagccagaagagaguucaucagacaggaguacaugagaagaaagcagcugaagcugauggaggacauggacaccgugaucaagcccagaccccagguggugaagcagaagaagcagagacccaagagcauccacagagaccacaucgagagccccaagacccccaucaagggcccccccgugagcagccugagccuggccagccugaacaccggcgacaacgagagcgugcacagcggcaagagaacccccagaagcgagagcguggagggcuuccugagccccagcagaugcggcagcagaaacggcgagaaggacugggagaacgccagcaccaccagcagcguggccagcggcaccgaguacaccggccccaagcuguacaaggagcccagcgccaagagcaacaagcacaucauccagaacgcccuggcccacugcugccuggccggcaaggugaacgagggccagaagaagaagauccuggaggagauggagaagagcgacgccaacaacuuccugauccuguucagagacagcggcugccaguucagaagccuguacaccuacugccccgagaccgaggagaucaacaagcugaccggcaucggccccaagagcaucaccaagaagaugaucgagggccuguacaaguacaacagcgacagaaagcaguucagccacauccccgccaagacccugagcgccagcguggacgccaucaccauccacagccaccuguggcagaccaagagacccgugacccccaagaagcugcugcccaccaaggccuaa

SEQ ID NO: 14617 - RNA, 5022 nt, Artificial Sequence
  CAMTA1__Homo_sapiens__XP_011539388
auguggagagccgagggcaaguggcugcccaagaccagcagaaagagcgugagccagagcguguucugcggcaccagcaccuacugcgugcugaacaccgugccccccaucgaggacgaccacggcaacagcaacagcagccacgugaagaucuuccugcccaagaagcugcuggagugccugcccaagugcagcagccugcccaaggagagacacagauggaacaccaacgaggagaucgccgccuaccugaucaccuucgagaagcacgaggaguggcugaccaccagccccaagaccagaccccagaacggcagcaugauccuguacaacagaaagaaggugaaguacagaaaggacggcuacugcuggaagaagagaaaggacggcaagaccaccagagaggaccacaugaagcugaaggugcagggcguggagugccuguacggcugcuacgugcacagcagcaucauccccaccuuccacagaagaugcuacuggcugcugcagaaccccgacaucgugcuggugcacuaccugaacgugcccgccaucgaggacugcggcaagcccugcggccccauccugugcagcaucaacaccgacaagaaggagugggccaaguggaccaaggaggagcugaucggccagcugaagcccauguuccacggcaucaaguggaccugcagcaacggcaacagcagcagcggcuucagcguggagcagcuggugcagcagauccuggacagccaccagaccaagccccagcccagaacccacaacugccugugcaccggcagccugggcgccggcggcagcgugcaccacaagugcaacagcgccaagcacagaaucaucagccccaagguggagcccagaaccggcggcuacggcagccacagcgaggugcagcacaacgacgugagcgagggcaagcacgagcacagccacagcaagggcagcagcagagagaagagaaacggcaagguggccaagcccgugcugcugcaccagagcagcaccgaggugagcagcaccaaccagguggaggugcccgacaccacccagagcagccccgugagcaucagcagcggccugaacagcgaccccgacaugguggacagccccguggugaccggcgugagcggcauggccguggccagcgugaugggcagccugagccagagcgccaccguguucaugagcgaggugaccaacgaggccguguacaccaugagccccaccgccggccccaaccaccaccugcugagccccgacgccagccagggccuggugcuggccgugagcagcgacggccacaaguucgccuuccccaccaccggcagcagcgagagccugagcaugcugcccaccaacgugagcgaggagcuggugcugagcaccacccuggacggcggcagaaagauccccgagaccaccaugaacuucgaccccgacugcuuccugaacaaccccaagcagggccagaccuacggcggcggcggccugaaggccgagauggugagcagcaacaucagacacagcccccccggcgagagaagcuucagcuucaccaccgugcugaccaaggagaucaagaccgaggacaccagcuucgagcagcagauggccaaggaggccuacagcagcagcgccgccgccguggccgccagcagccugacccugaccgccggcagcagccugcugcccagcggcggcggccugagccccagcaccacccuggagcagauggacuucagcgccaucgacagcaacaaggacuacaccagcagcuucagccagaccggccacagcccccacauccaccagacccccagccccagcuucuuccugcaggacgccagcaagccccugcccguggagcagaacacccacagcagccugagcgacagcggcggcaccuucgugaugcccaccgugaagaccgaggccagcagccagaccagcagcugcagcggccacguggagaccagaaucgagagcaccagcagccugcaccugaugcaguuccaggccaacuuccaggccaugaccgccgagggcgaggugaccauggagaccagccaggccgccgagggcagcgaggugcugcugaagagcggcgagcugcaggccugcagcagcgagcacuaccugcagcccgagaccaacggcgugaucagaagcgccggcggcgugcccauccugcccggcaacguggugcagggccuguaccccguggcccagcccagccugggcaacgccagcaacauggagcugagccuggaccacuucgacaucagcuucagcaaccaguucagcgaccugaucaacgacuucaucagcguggagggcggcagcagcaccaucuacggccaccagcuggugagcggcgacagcaccgcccugagccagagcgaggacggcgccagagcccccuucacccaggccgagaugugccugcccugcugcagcccccagcagggcagccugcagcugagcagcagcgagggcggcgccagcaccauggccuacaugcacguggccgagguggugagcgccgccagcgcccagggcacccugggcaugcugcagcagagcggcagaguguucauggugaccgacuacagccccgaguggagcuaccccgagggcggcgugaaggugcugaucaccggccccuggcaggaggccagcaacaacuacagcugccuguucgaccagaucagcgugcccgccagccugauccagcccggcgugcugagaugcuacugccccgcccacgacaccggccuggugacccugcagguggccuucaacaaccagaucaucagcaacagcgugguguucgaguacaaggccagagcccugcccacccugcccagcagccagcacgacuggcugagccuggacgacaaccaguucagaaugagcauccuggagagacuggagcagauggagagaagaauggccgagaugaccggcagccagcagcacaagcaggccagcggcggcggcagcagcggcggcggcagcggcagcggcaacggcggcagccaggcccagugcgccagcggcaccggcgcccugggcagcugcuucgagagcagaguggugguggugugcgagaagaugaugagcagagccugcugggccaagagcaagcaccugauccacagcaagaccuucagaggcaugacccugcugcaccuggccgccgcccagggcuacgccacccugauccagacccugaucaaguggagaaccaagcacgccgacagcaucgaccuggagcuggagguggacccccugaacguggaccacuucagcugcaccccccugaugugggccugcgcccugggccaccuggaggccgccguggugcuguacaagugggacagaagagccaucagcauccccgacagccugggcagacugccccugggcaucgccagaagcagaggccacgugaagcuggccgagugccuggagcaccugcagagagacgagcaggcccagcugggccagaaccccagaauccacugccccgccagcgaggagcccagcaccgagagcuggauggcccaguggcacagcgaggccaucagcagccccgagauccccaagggcgugaccgugaucgccagcaccaaccccgagcugagaagacccagaagcgagcccagcaacuacuacagcagcgagagccacaaggacuaccccgcccccaagaagcacaagcugaaccccgaguacuuccagaccagacaggagaagcugcugcccaccgcccugagccuggaggagcccaacaucagaaagcagagccccagcagcaagcagagcgugcccgagacccugagccccagcgagggcgugagagacuucagcagagagcugagcccccccacccccgagaccgccgccuuccaggccagcggcagccagcccgugggcaaguggaacagcaaggaccuguacaucggcgugagcaccgugcaggugaccggcaaccccaagggcaccagcgugggcaaggaggccgcccccagccaggugagacccagagagcccaugagcgugcugaugauggccaacagagagguggugaacaccgagcugggcagcuacagagacagcgccgagaacgaggagugcggccagcccauggacgacauccaggugaacaugaugacccuggccgagcacaucaucgaggccacccccgacagaaucaagcaggagaacuucgugcccauggagagcagcggccuggagagaaccgaccccgccaccaucagcagcaccaugagcuggcuggccagcuaccuggccgacgccgacugccugcccagcgccgcccagaucagaagcgccuacaacgagccccugacccccagcagcaacaccagccugagccccgugggcagccccgugagcgagaucgccuucgagaagcccaaccugcccagcgccgccgacuggagcgaguuccugagcgccagcaccagcgagaagguggagaacgaguucgcccagcugacccugagcgaccacgagcagagagagcuguacgaggccgccagacuggugcagaccgccuucagaaaguacaagggcagaccccugagagagcagcaggagguggccgccgccgugauccagagaugcuacagaaaguacaagcaguacgcccuguacaagaagaugacccaggccgccauccugauccagagcaaguucagaagcuacuacgagcagaagaaguuccagcagagcagaagagccgccgugcugauccagaaguacuacagaagcuacaagaagugcggcaagagaagacaggccagaagaaccgccgugaucgugcagcagaagcugagaagcagccugcugaccaagaagcaggaccaggccgccagaaagaucaugagauuccugagaagaugcagacacagagugaaggagcugaagaaggccaaggagcuggaggacauccagcagcacccccuggccauguaa

SEQ ID NO: 14618 - RNA, 3693 nt, Artificial Sequence
  CAND1__Homo_sapiens__NP_060918
auggccagcgccagcuaccacaucagcaaccugcuggagaagaugaccagcagcgacaaggacuucagauucauggccaccaacgaccugaugaccgagcugcagaaggacagcaucaagcuggacgacgacagcgagagaaagguggugaagaugauccugaagcugcuggaggacaagaacggcgaggugcagaaccuggccgugaagugccugggcccccuggugagcaaggugaaggaguaccagguggagaccaucguggacacccugugcaccaacaugcugagcgacaaggagcagcugagagacaucagcagcaucggccugaagaccgugaucggcgagcugccccccgccagcagcggcagcgcccuggccgccaacgugugcaagaagaucaccggcagacugaccagcgccaucgccaagcaggaggacgugagcgugcagcuggaggcccuggacaucauggccgacaugcugagcagacagggcggccugcuggugaacuuccaccccagcauccugaccugccugcugccccagcugaccagccccagacuggccgugagaaagagaaccaucaucgcccugggccaccuggugaugagcugcggcaacaucguguucguggaccugaucgagcaccugcugagcgagcugagcaagaacgacagcaugagcaccaccagaaccuacauccagugcaucgccgccaucagcagacaggccggccacagaaucggcgaguaccuggagaagaucaucccccugguggugaaguucugcaacguggacgacgacgagcugagagaguacugcauccaggccuucgagagcuucgugagaagaugccccaaggagguguacccccacgugagcaccaucaucaacaucugccugaaguaccugaccuacgaccccaacuacaacuacgacgacgaggacgaggacgagaacgccauggacgccgacggcggcgacgacgacgaccagggcagcgacgacgaguacagcgacgacgacgacaugagcuggaaggugagaagagccgccgccaagugccuggacgccguggugagcaccagacacgagaugcugcccgaguucuacaagaccgugagccccgcccugaucagcagauucaaggagagagaggagaacgugaaggccgacguguuccacgccuaccugagccugcugaagcagaccagacccgugcagagcuggcugugcgaccccgacgccauggagcagggcgagaccccccugaccaugcugcagagccaggugcccaacaucgugaaggcccugcacaagcagaugaaggagaagagcgugaagaccagacagugcugcuucaacaugcugaccgagcuggugaacgugcugcccggcgcccugacccagcacauccccgugcuggugcccggcaucaucuucagccugaacgacaagagcagcagcagcaaccugaagaucgacgcccugagcugccuguacgugauccugugcaaccacagcccccagguguuccacccccacgugcaggcccuggugccccccgugguggccugcgugggcgaccccuucuacaagaucaccagcgaggcccugcuggugacccagcagcuggugaaggugaucagaccccuggaccagcccagcagcuucgacgccacccccuacaucaaggaccuguucaccugcaccaucaagagacugaaggccgccgacaucgaccaggaggugaaggagagagccaucagcugcaugggccagaucaucugcaaccugggcgacaaccugggcagcgaccugcccaacacccugcagaucuuccuggagagacugaagaacgagaucaccagacugaccaccgugaaggcccugacccugaucgccggcagcccccugaagaucgaccugagacccgugcugggcgagggcgugcccauccuggccagcuuccugagaaagaaccagagagcccugaagcugggcacccugagcgcccuggacauccugaucaagaacuacagcgacagccugaccgccgccaugaucgacgccgugcuggacgagcugcccccccugaucagcgagagcgacaugcacgugagccagauggccaucagcuuccugaccacccuggccaagguguaccccagcagccugagcaagaucagcggcagcauccugaacgagcugaucggccuggugagaagcccccugcugcagggcggcgcccugagcgccaugcuggacuucuuccaggcccugguggugaccggcaccaacaaccugggcuacauggaccugcugagaaugcugaccggccccguguacagccagagcaccgcccugacccacaagcagagcuacuacagcaucgccaagugcguggccgcccugaccagagccugccccaaggagggccccgccguggugggccaguucauccaggacgugaagaacagcagaagcaccgacagcaucagacugcuggcccugcugagccugggcgaggugggccaccacaucgaccugagcggccagcuggagcugaagagcgugauccuggaggccuucagcagccccagcgaggaggugaagagcgccgccagcuacgcccugggcagcaucagcgugggcaaccugcccgaguaccugcccuucgugcugcaggagaucaccagccagcccaagagacaguaccugcugcugcacagccugaaggagaucaucagcagcgccagcguggugggccugaagcccuacguggagaacaucugggcccugcugcugaagcacugcgagugcgccgaggagggcaccagaaacgugguggccgagugccugggcaagcugacccugaucgaccccgagacccugcugcccagacugaagggcuaccugaucagcggcagcagcuacgccagaagcagcguggugaccgccgugaaguucaccaucagcgaccacccccagcccaucgacccccugcugaagaacugcaucggcgacuuccugaagacccuggaggaccccgaccugaacgugagaagaguggcccuggugaccuucaacagcgccgcccacaacaagcccagccugaucagagaccugcuggacaccgugcugccccaccuguacaacgagaccaaggugagaaaggagcugaucagagagguggagaugggccccuucaagcacaccguggacgacggccuggacaucagaaaggccgccuucgagugcauguacacccugcuggacagcugccuggacagacuggacaucuucgaguuccugaaccacguggaggacggccugaaggaccacuacgacaucaagaugcugaccuuccugaugcuggugagacugagcacccugugccccagcgccgugcugcagagacuggacagacugguggagccccugagagccaccugcaccaccaaggugaaggccaacagcgugaagcaggaguucgagaagcaggacgagcugaagagaagcgccaugagagccguggccgcccugcugaccauccccgaggccgagaagagcccccugaugagcgaguuccagagccagaucagcagcaaccccgagcuggccgccaucuucgagagcauccagaaggacagcagcagcaccaaccuggagagcauggacaccagcuaa

SEQ ID NO: 14619 - RNA, 3711 nt, Artificial Sequence
  CAND2__Homo_sapiens__NP_001155971
augagcaccgccgccuuccacaucagcagccugcuggagaagaugaccagcagcgacaaggacuucagauucauggccaccagcgaccugaugagcgagcugcagaaggacagcauccagcuggacgaggacagcgagagaaagguggugaagaugcugcugagacugcuggaggacaagaacggcgaggugcagaaccuggccgugaagugccugggcccccugguggugaaggugaaggaguaccagguggagaccaucguggacacccugugcaccaacaugagaagcgacaaggagcagcugagagacaucgccggcaucggccugaagaccgugcugagcgagcugccccccgccgccaccggcagcggccuggccaccaacgugugcagaaagaucaccggccagcugaccagcgccaucgcccagcaggaggacguggccgugcagcuggaggcccuggacauccugagcgacaugcugagcagacugggcgugccccugggcgccuuccacgccagccugcugcacugccugcugccccagcugagcagccccagacuggccgugagaaagagagccgugggcgcccugggccaccuggccgccgccugcagcaccgaccuguucguggagcuggccgaccaccugcuggacagacugcccggccccagagugcccaccagccccaccgccaucagaacccugauccagugccugggcagcgugggcagacaggccggccacagacugggcgcccaccuggacagacuggugccccugguggaggacuucugcaaccuggacgacgacgagcugagagagagcugccugcaggccuucgaggccuuccugagaaagugccccaaggagaugggcccccacgugcccaacgugaccagccugugccugcaguacaucaagcacgaccccaacuacaacuacgacagcgacgaggacgaggagcagauggagaccgaggacagcgaguucagcgagcaggagagcgaggacgaguacagcgacgacgacgacaugagcuggaaggugagaagagccgccgccaagugcaucgccgcccugaucagcagcagacccgaccugcugcccgacuuccacugcacccuggcccccgugcugaucagaagauucaaggagagagaggagaacgugaaggccgacguguucaccgccuacaucgugcugcugagacagacccagccccccaagggcuggcuggaggccauggaggagcccacccagaccggcagcaaccugcacaugcugagaggccaggugccccugguggugaaggcccugcagagacagcugaaggacagaagcgugagagccagacagggcugcuucagccugcugaccgagcuggccggcgugcugcccggcagccuggccgagcacaugcccgugcuggugagcggcaucaucuucagccuggccgacagaagcagcagcagcaccaucagaauggacgcccuggccuuccugcagggccugcugggcaccgagcccgccgaggccuuccacccccaccugcccauccugcugccccccgugauggccugcguggccgacagcuucuacaagaucgccgccgaggcccugguggugcugcaggagcuggugagagcccuguggccccugcacagacccagaaugcuggaccccgagcccuacgugggcgagaugagcgccgugacccuggccagacugagagccaccgaccuggaccaggaggugaaggagagagccaucagcugcaugggccaccuggugggccaccugggcgacagacugggcgacgaccuggagcccacccugcugcugcugcuggacagacugagaaacgagaucaccagacugcccgccaucaaggcccugacccugguggccgugagcccccugcagcuggaccugcagcccauccuggccgaggcccugcacauccuggccagcuuccugagaaagaaccagagagcccugagacuggccacccuggccgcccuggacgcccuggcccagagccagggccugagccugccccccagcgccgugcaggccgugcuggccgagcugcccgcccuggugaacgagagcgacaugcacguggcccagcuggccguggacuuccuggccaccgugacccaggcccagcccgccagccugguggaggugagcggccccgugcugagcgagcugcugagacugcugagaagcccccugcugcccgccggcgugcuggccgccgccgagggcuuccugcaggcccuggugggcaccagaccccccugcguggacuacgccaagcugaucagccugcugaccgcccccguguacgagcaggccguggacggcggccccggccugcacaagcagguguuccacagccuggccagaugcguggccgcccugagcgccgccugcccccaggaggccgccagcaccgccagcagacuggugugcgacgccagaagcccccacagcagcaccggcgugaaggugcuggccuuccugagccuggccgaggugggccagguggccggccccggccaccagagagagcugaaggccgugcugcuggaggcccugggcagccccagcgaggacgugagagccgccgccagcuacgcccugggcagagugggcgccggcagccugcccgacuuccugcccuuccugcuggagcagaucgaggccgagcccagaagacaguaccugcugcugcacagccugagagaggcccugggcgccgcccagcccgacagccugaagcccuacgccgaggacaucugggcccugcuguuccagagaugcgagggcgccgaggagggcaccagaggcgugguggccgagugcaucggcaagcuggugcuggugaaccccagcuuccugcugcccagacugagaaagcagcuggccgccggcagaccccacaccagaagcaccgugaucaccgccgugaaguuccugaucagcgaccagccccaccccaucgacccccugcugaagagcuucaucggcgaguucauggagagccugcaggaccccgaccugaacgugagaagagccacccuggccuucuucaacagcgccgugcacaacaagcccagccuggugagagaccugcuggacgacauccugccccugcuguaccaggagaccaagaucagaagagaccugaucagagagguggagaugggccccuucaagcacaccguggacgacggccuggacgugagaaaggccgccuucgagugcauguacagccugcuggagagcugccugggccagcuggacaucugcgaguuccugaaccacguggaggacggccugaaggaccacuacgacaucagaaugcugaccuucaucaugguggccagacuggccacccugugccccgcccccgugcugcagagaguggacagacugaucgagccccugagagccaccugcaccgccaaggugaaggccggcagcgugaagcaggaguucgagaagcaggacgagcugaagagaagcgccaugagagccguggccgcccugcugaccauccccgaggugggcaagagccccaucauggccgacuucagcagccagaucagaagcaaccccgagcuggccgcccuguucgagagcauccagaaggacagcgccagcgcccccagcaccgacagcauggagcugagcuaa

SEQ ID NO: 14620 - RNA, 1206 nt, Artificial Sequence
  CANT1__Homo_sapiens__XP_005257079
augcccgugcagcugagcgagcaccccgaguggaacgagagcaugcacagccugagaaucagcgugggcggccugcccgugcuggccagcaugaccaaggccgccgaccccagauucagacccagauggaaggugauccugaccuucuucgugggcgccgccauccuguggcugcugugcagccacagacccgcccccggcagaccccccacccacaacgcccacaacuggagacugggccaggcccccgccaacugguacaacgacaccuacccccugagccccccccagagaacccccgccggcaucagauacagaaucgccgugaucgccgaccuggacaccgagagcagagcccaggaggagaacaccugguucagcuaccugaagaagggcuaccugacccugagcgacagcggcgacaagguggccguggagugggacaaggaccacggcgugcuggagagccaccuggccgagaagggcagaggcauggagcugagcgaccugaucguguucaacggcaagcuguacagcguggacgacagaaccggcgugguguaccagaucgagggcagcaaggccgugcccugggugauccugagcgacggcgacggcaccguggagaagggcuucaaggccgaguggcuggccgugaaggacgagagacuguacgugggcggccugggcaaggaguggaccaccaccaccggcgacguggugaacgagaaccccgagugggugaagguggugggcuacaagggcagcguggaccacgagaacugggugagcaacuacaacgcccugagagccgccgccggcauccagccccccggcuaccugauccacgagagcgccugcuggagcgacacccugcagagaugguucuuccugcccagaagagccagccaggagagauacagcgagaaggacgacgagagaaagggcgccaaccugcugcugagcgccagccccgacuucggcgacaucgccgugagccacgugggcgccguggugcccacccacggcuucagcagcuucaaguucauccccaacaccgacgaccagaucaucguggcccugaagagcgaggaggacagcggcagaguggccagcuacaucauggccuucacccuggacggcagauuccugcugcccgagaccaagaucggcagcgugaaguacgagggcaucgaguucaucuaa

SEQ ID NO: 14621 - RNA, 1941 nt, Artificial Sequence
  CANX__Homo_sapiens__XP_011532966
auguaccagaaggagaacacccaguggcugagaaaccuggccgugaccgcccccauccuggaggccagcaaccccgugggcgagggccagggcgugaagagcagaaaggcccccgagagcagcagcaagugcaucagcuuccacaccggcggccuggagaucauggagggcaaguggcugcugugcaugcugcuggugcugggcaccgccaucguggaggcccacgacggccacgacgacgacgugaucgacaucgaggacgaccuggacgacgugaucgaggagguggaggacagcaagcccgacaccaccgccccccccagcagccccaaggugaccuacaaggcccccgugcccaccggcgagguguacuucgccgacagcuucgacagaggcacccugagcggcuggauccugagcaaggccaagaaggacgacaccgacgacgagaucgccaaguacgacggcaagugggagguggaggagaugaaggagagcaagcugcccggcgacaagggccuggugcugaugagcagagccaagcaccacgccaucagcgccaagcugaacaagcccuuccuguucgacaccaagccccugaucgugcaguacgaggugaacuuccagaacggcaucgagugcggcggcgccuacgugaagcugcugagcaagacccccgagcugaaccuggaccaguuccacgacaagacccccuacaccaucauguucggccccgacaagugcggcgaggacuacaagcugcacuucaucuucagacacaagaaccccaagaccggcaucuacgaggagaagcacgccaagagacccgacgccgaccugaagaccuacuucaccgacaagaagacccaccuguacacccugauccugaaccccgacaacagcuucgagauccugguggaccagagcguggugaacagcggcaaccugcugaacgacaugaccccccccgugaaccccagcagagagaucgaggaccccgaggacagaaagcccgaggacugggacgagagacccaagauccccgaccccgaggccgugaagcccgacgacugggacgaggacgcccccgccaagauccccgacgaggaggccaccaagcccgagggcuggcuggacgacgagcccgaguacgugcccgaccccgacgccgagaagcccgaggacugggacgaggacauggacggcgagugggaggccccccagaucgccaaccccagaugcgagagcgcccccggcugcggcguguggcagagacccgugaucgacaaccccaacuacaagggcaaguggaagccccccaugaucgacaaccccagcuaccagggcaucuggaagcccagaaagauccccaaccccgacuucuucgaggaccuggagcccuucagaaugacccccuucagcgccaucggccuggagcuguggagcaugaccagcgacaucuucuucgacaacuucaucaucugcgccgacagaagaaucguggacgacugggccaacgacggcuggggccugaagaaggccgccgacggcgccgccgagcccggcguggugggccagaugaucgaggccgccgaggagagacccuggcugugggugguguacauccugaccguggcccugcccguguuccuggugauccuguucugcugcagcggcaagaagcagaccagcggcauggaguacaagaagaccgacgccccccagcccgacgugaaggaggaggaggaggagaaggaggaggagaaggacaagggcgacgaggaggaggagggcgaggagaagcuggaggagaagcagaagagcgacgccgaggaggacggcggcaccgugagccaggaggaggaggacagaaagcccaaggccgaggaggacgagauccugaacagaagccccagaaacagaaagcccagaagagaguaa

SEQ ID NO: 14622 - RNA, 1428 nt, Artificial Sequence
  CAP1__Homo_sapiens__XP_011538812
auggccgacaugcagaaccugguggagagacuggagagagccgugggcagacuggaggccgugagccacaccagcgacaugcacagaggcuacgccgacagccccagcaaggccggcgccgcccccuacgugcaggccuucgacagccugcuggccggccccguggccgaguaccugaagaucagcaaggagaucggcggcgacgugcagaagcacgccgagauggugcacaccggccugaagcuggagagagcccugcuggugaccgccagccagugccagcagcccgccgagaacaagcugagcgaccugcuggcccccaucagcgagcagaucaaggaggugaucaccuucagagagaagaacagaggcagcaagcuguucaaccaccugagcgccgugagcgagagcauccaggcccugggcuggguggccauggcccccaagcccggccccuacgugaaggagaugaacgacgccgccauguucuacaccaacagagugcugaaggaguacaaggacguggacaagaagcacguggacugggugaaggccuaccugagcaucuggaccgagcugcaggccuacaucaaggaguuccacaccaccggccuggccuggagcaagaccggccccguggccaaggagcugagcggccugcccagcggccccagcgccggcagcugcccccccccccccccccccugccccccccccccccccgugagcaccaucagcugcagcuacgagagcgccagcagaagcagccuguucgcccagaucaaccagggcgagagcaucacccacgcccugaagcacgugagcgacgacaugaagacccacaagaaccccgcccugaaggcccagagcggccccgugagaagcggccccaagcccuucagcgcccccaagccccagaccagccccagccccaagagagccaccaagaaggagcccgccgugcuggagcuggagggcaagaaguggagaguggagaaccaggagaacgugagcaaccuggugaucgaggacaccgagcugaagcagguggccuacaucuacaagugcgugaacaccacccugcagaucaagggcaagaucaacagcaucaccguggacaacugcaagaagcugggccugguguucgacgacguggugggcaucguggagaucaucaacagcaaggacgugaaggugcaggugaugggcaaggugcccaccaucagcaucaacaagaccgacggcugccacgccuaccugagcaagaacagccuggacugcgagaucgugagcgccaagagcagcgagaugaacgugcugauccccaccgagggcggcgacuucaacgaguuccccgugcccgagcaguucaagacccuguggaacggccagaagcuggugaccaccgugaccgagaucgccggcuaa

SEQ ID NO: 14623 - RNA, 1434 nt, Artificial Sequence
  CAP2__Homo_sapiens__NP_006357
auggccaacaugcagggccugguggagagacuggagagagccgugagcagacuggagagccugagcgccgagagccacagaccccccggcaacugcggcgaggugaacggcgugaucgccggcguggcccccagcguggaggccuucgacaagcugauggacagcaugguggccgaguuccugaagaacagcagaauccuggccggcgacguggagacccacgccgagauggugcacagcgccuuccaggcccagagagccuuccugcugauggccagccaguaccagcagccccacgagaacgacguggccgcccugcugaagcccaucagcgagaagauccaggagauccagaccuucagagagagaaacagaggcagcaacauguucaaccaccugagcgccgugagcgagagcauccccgcccugggcuggaucgccgugagccccaagcccggccccuacgugaaggagaugaacgacgccgccaccuucuacaccaacagagugcugaaggacuacaagcacagcgaccugagacacguggacugggugaagagcuaccugaacaucuggagcgagcugcaggccuacaucaaggagcaccacaccaccggccugaccuggagcaagaccggccccguggccagcaccgugagcgccuucagcgugcugagcagcggccccggccugcccccccccccccccccccugcccccccccggcccccccccccuguucgagaacgagggcaagaaggaggagagcagccccagcagaagcgcccuguucgcccagcugaaccagggcgaggccaucaccaagggccugagacacgugaccgacgaccagaagaccuacaagaaccccagccugagagcccagggcggccagacccagagccccaccaagagccacacccccagccccaccagccccaagagcuaccccagccagaagcacgcccccgugcuggagcuggagggcaagaaguggagaguggaguaccaggaggacagaaacgaccuggugaucagcgagaccgagcugaagcagguggccuacaucuucaagugcgagaagagcaccauccagaucaagggcaaggugaacagcaucaucaucgacaacugcaagaagcugggccugguguucgacaacguggugggcaucguggaggugaucaacagccaggacauccagauccaggugaugggcagagugcccaccaucagcaucaacaagaccgagggcugccacaucuaccugagcgaggacgcccuggacugcgagaucgugagcgccaagagcagcgagaugaacauccugaucccccaggacggcgacuacagagaguuccccauccccgagcaguucaagaccgccugggacggcagcaagcugaucaccgagcccgccgagaucauggccuaa

SEQ ID NO: 14624 - RNA, 1002 nt, Artificial Sequence
  CAPG__Homo_sapiens__NP_001243069
auguacaccgccaucccccagagcggcagccccuuccccggcagcgugcaggaccccggccugcacguguggagaguggagaagcugaagcccgugcccguggcccaggagaaccagggcguguucuucagcggcgacagcuaccuggugcugcacaacggccccgaggaggugagccaccugcaccuguggaucggccagcagagcagcagagacgagcagggcgccugcgccgugcuggccgugcaccugaacacccugcugggcgagagacccgugcagcacagagaggugcagggcaacgagagcgaccuguucaugagcuacuuccccagaggccugaaguaccaggagggcggcguggagagcgccuuccacaagaccagcaccggcgcccccgccgccaucaagaagcuguaccaggugaagggcaagaagaacaucagagccaccgagagagcccugaacugggacagcuucaacaccggcgacugcuucauccuggaccugggccagaacaucuucgccuggugcggcggcaagagcaacauccuggagagaaacaaggccagagaccuggcccuggccaucagagacagcgagagacagggcaaggcccaggugcugggccccaagcccgcccugaaggagggcaaccccgaggaggaccugaccgccgacaaggccaacgcccaggccgccgcccuguacaaggugagcgacgccaccggccagaugaaccugaccaagguggccgacagcagccccuucgcccuggagcugcugaucagcgacgacugcuucgugcuggacaacggccugugcggcaagaucuacaucuggaagggcagaaaggccaacgagaaggagagacaggccgcccugcagguggccgagggcuucaucagcagaaugcaguacgcccccaacacccagguggagauccugccccagggccacgagagccccaucuucaagcaguucuucaaggacuggaaguaa

SEQ ID NO: 14625 - RNA, 2019 nt, Artificial Sequence
  CAPN10__Homo_sapiens__NP_075571
augagagccggcagaggcgccacccccgccagagagcuguucagagacgccgccuuccccgccgccgacagcagccuguucugcgaccugagcaccccccuggcccaguucagagaggacaucaccuggagaagaccccaggagaucugcgccacccccagacuguuccccgacgaccccagagagggccaggugaagcagggccugcugggcgacugcugguuccugugcgccugcgccgcccugcagaagagcagacaccugcuggaccaggugaucccccccggccagcccagcugggccgaccaggaguacagaggcagcuucaccugcagaaucuggcaguucggcagauggguggaggugaccaccgacgacagacugcccugccuggccggcagacugugcuucagcagaugccagagagaggacguguucuggcugccccugcuggagaagguguacgccaaggugcacggcagcuacgagcaccugugggccggccagguggccgacgcccugguggaccugaccggcggccuggccgagagauggaaccugaagggcguggccggcagcggcggccagcaggacagacccggcagaugggagcacagaaccugcagacagcugcugcaccugaaggaccagugccugaucagcugcugcgugcugagccccagagccggcgccagagagcugggcgaguuccacgccuucaucgugagcgaccugagagagcugcagggccaggccggccagugcauccugcugcugagaauccagaaccccuggggcagaagaugcuggcagggccuguggagagagggcggcgagggcuggagccagguggacgccgccguggccagcgagcugcugagccagcugcaggagggcgaguucuggguggaggaggaggaguuccugagagaguucgacgagcugaccgugggcuaccccgugaccgaggccggccaccugcagagccuguacaccgagagacugcugugccacaccagagcccugcccggcgccugggugaagggccagagcgccggcggcugcagaaacaacagcggcuuccccagcaaccccaaguucuggcugagagugagcgagcccagcgagguguacaucgccgugcugcagagaagcagacugcacgccgccgacugggccggcagagccagagcccuggugggcgacagccacaccagcuggagccccgccagcauccccggcaagcacuaccaggccgugggccugcaccuguggaagguggagaagagaagagugaaccugcccagagugcugagcaugccccccguggccggcaccgccugccacgccuacgacagagaggugcaccugagaugcgagcugagccccggcuacuaccuggccgugcccagcaccuuccugaaggacgcccccggcgaguuccugcugagaguguucagcaccggcagagugagccugagcgccaucagagccguggccaagaacaccacccccggcgccgcccugcccgccggcgaguggggcaccgugcagcugagaggcagcuggagagugggccagaccgccggcggcagcagaaacuucgccagcuaccccaccaaccccugcuuccccuucagcgugcccgagggccccggccccagaugcgugagaaucacccugcaccagcacugcagacccagcgacaccgaguuccaccccaucggcuuccacaucuuccaggugcccgagggcggcagaagccaggacgcccccccccugcugcugcaggagccccugcugagcugcgugccccacagauacgcccaggaggugagcagacugugccugcugcccgccggcaccuacaagguggugcccagcaccuaccugcccgacaccgagggcgccuucaccgugaccaucgccaccagaaucgacagacccagcauccacagccaggagaugcugggccaguuccugcaggaggugagcgugauggccgugaugaagaccuaa

SEQ ID NO: 14626 - RNA, 2010 nt, Artificial Sequence
  CAPN13__Homo_sapiens__NP_653176
auggccuacuaccaggagcccagcguggagaccagcaucaucaaguucaaggaccaggacuucaccacccugagagaccacugccugagcaugggcagaaccuucaaggacgagaccuuccccgccgccgacagcagcaucggccagaagcugcugcaggagaagagacugagcaacgugaucuggaagagaccccaggaccugcccggcggccccccccacuucauccuggacgacaucagcagauucgacauccagcagggcggcgccgccgacugcugguuccuggccgcccugggcagccugacccagaacccccaguacagacagaagauccugauggugcagagcuucagccaccaguacgccggcaucuucagauucagauucuggcagugcggccaguggguggagguggugaucgacgacagacugcccgugcagggcgacaagugccuguucgugagacccagacaccagaaccaggaguucuggcccugccugcuggagaaggccuacgccaagcugcugggcagcuacagcgaccugcacuacggcuuccuggaggacgcccugguggaccugaccggcggcgugaucaccaacauccaccugcacagcagccccguggaccuggugaaggccgugaagaccgccaccaaggccggcagccugaucaccugcgccacccccagcggccccaccgacaccgcccaggccauggagaacggccuggugagccugcacgccuacaccgugaccggcgccgagcagauccaguacagaagaggcugggaggagaucaucagccuguggaaccccuggggcuggggcgaggccgaguggagaggcagauggagcgacggcagccaggagugggaggagaccugcgaccccagaaagagccagcugcacaagaagagagaggacggcgaguucuggaugagcugccaggacuuccagcagaaguucaucgccauguucaucugcagcgagauccccaucacccuggaccacggcaacacccugcacgagggcuggagccagaucauguucagaaagcaggugauccugggcaacaccgccggcggccccagaaacgacgcccaguucaacuucagcgugcaggagcccauggagggcaccaacgugguggugugcgugaccguggccgugacccccagcaaccugaaggccgaggacgccaaguucccccuggacuuccaggugauccuggccggcagccagagauucagagagaaguucccccccguguucuucagcagcuucagaaacaccgugcagagcagcaacaacaaguucagaagaaacuucaccaugaccuaccaccugagccccggcaacuacguggugguggcccagaccagaagaaagagcgccgaguuccugcugagaaucuuccugaagaugcccgacagcgacagacaccugagcagccacuucaaccugagaaugaagggcagccccagcgagcacggcagccagcagagcaucuucaacagauacgcccagcagagacuggacaucgacgccacccagcugcagggccugcugaaccaggagcugcugaccggcccccccggcgacauguucagccuggacgagugcagaagccugguggcccugauggagcugaaggugaacggcagacuggaccaggaggaguucgccagacuguggaagagacuggugcacuaccagcacguguuccagaaggugcagaccagccccggcgugcugcugagcagcgaccuguggaaggccaucgagaacaccgacuuccugagaggcaucuucaucagcagagagcugcugcaccuggugacccugagauacagcgacagcgugggcagagugagcuuccccagccuggugugcuuccugaugagacuggaggccauggccaagaccuucagaaaccugagcaaggacggcaagggccuguaccugaccgagauggaguggaugagccuggugauguacaacuaa

SEQ ID NO: 14627 - RNA, 2055 nt, Artificial Sequence
  CAPN14__Homo_sapiens__NP_001138594
augagccuguggccccccuucagaugcagauggaagcuggcccccagauacagcagaagagccagcccccagcagccccagcaggacuucgaggcccugcuggccgagugccugagaaacggcugccuguucgaggacaccagcuuccccgccacccugagcagcaucggcagcggcagccugcugcagaagcugccccccagacugcaguggaagagaccccccgagcugcacagcaacccccaguucuacuucgccaaggccaagagacuggaccugugccagggcaucgugggcgacugcugguuccuggccgcccugcaggcccuggcccugcaccaggacauccugagcagaguggugccccugaaccagagcuucaccgagaaguacgccggcaucuucagauucugguucuggcacuacggcaacugggugcccguggugaucgacgacagacugcccgugaacgaggccggccagcugguguucgugagcagcaccuacaagaaccuguucuggggcgcccugcuggagaaggccuacgccaagcugagcggcagcuacgaggaccugcagagcggccaggugagcgaggcccugguggacuucaccggcggcgugaccaugaccaucaaccuggccgaggcccacggcaaccugugggacauccugaucgaggccaccuacaacagaacccugaucggcugccagacccacagcggcgagaagauccuggagaacggccugguggagggccacgccuacacccugaccggcaucagaaaggugaccugcaagcacagacccgaguaccuggugaagcugagaaaccccuggggcaagguggaguggaagggcgacuggagcgacagcagcagcaagugggagcugcugagccccaaggagaagauccugcugcugagaaaggacaacgacggcgaguucuggaugacccugcaggacuucaagacccacuucgugcugcuggugaucugcaagcugacccccggccugcugagccaggaggccgcccagaaguggaccuacaccaugagagagggcagaugggagaagagaagcaccgccggcggccagagacagcugcugcaggacaccuucuggaagaacccccaguuccugcugagcguguggagacccgaggagggcagaagaagccugagacccugcagcgugcuggugagccugcugcagaagcccagacacagaugcagaaagagaaagccccugcuggccaucggcuucuaccuguacagaaugaacaaguaccacgacgaccagagaagacugccccccgaguucuuccagagaaacaccccccugagccagcccgacagauuccugaaggagaaggaggugagccaggagcugugccuggagcccggcaccuaccugaucgugcccugcauccuggaggcccaccagaagagcgaguucgugcugagaguguucagcagaaagcacaucuucuacgagaucggcagcaacagcggcgugguguucagcaaggagaucgaggaccagaacgagagacaggacgaguucuucaccaaguucuucgagaagcaccccgagaucaacgccgugcagcugcagaaccugcugaaccagaugaccuggagcagccugggcagcagacagcccuucuucagccuggaggccugccagggcauccuggcccugcuggaccugaacgccagcggcaccaugagcauccaggaguucagagaccuguggaagcagcugaagcugagccagaagguguuccacaagcaggacagaggcagcggcuaccugaacugggagcagcugcacgccgccaugagagaggccggcaucaugcugagcgacgacgugugccagcugaugcugaucagauacggcggccccagacugcagauggacuucgugagcuucauccaccugaugcugagaguggagaacauggaggacguguuccagaaccugacccaggacggcaagggcaucuaccugcagaagcccgaguggaugaugauggcccuguacagcuaa

SEQ ID NO: 14628 - RNA, 2145 nt, Artificial Sequence
  CAPN1__Homo_sapiens__XP_011543594
augagcgaggagaucaucacccccguguacugcaccggcgugagcgcccaggugcagaagcagagagccagagagcugggccugggcagacacgagaacgccaucaaguaccugggccaggacuacgagcagcugagagugagaugccugcagagcggcacccuguucagagacgaggccuucccccccgugccccagagccugggcuacaaggaccugggccccaacagcagcaagaccuacggcaucaaguggaagagacccaccgagcugcugagcaacccccaguucaucguggacggcgccaccagaaccgacaucugccagggcgcccugggcgacugcuggcugcuggccgccaucgccagccugacccugaacgacacccugcugcacagaguggugccccacggccagagcuuccagaacggcuacgccggcaucuuccacuuccagcuguggcaguucggcgaguggguggacguggugguggacgaccugcugcccaucaaggacggcaagcugguguucgugcacagcgccgagggcaacgaguucuggagcgcccugcuggagaaggccuacgccaaggugaacggcagcuacgaggcccugagcggcggcagcaccagcgagggcuucgaggacuucaccggcggcgugaccgagugguacgagcugagaaaggcccccagcgaccuguaccagaucauccugaaggcccuggagagaggcagccugcugggcugcagcaucgacaucagcagcgugcuggacauggaggccaucaccuucaagaagcuggugaagggccacgccuacagcgugaccggcgccaagcaggugaacuacagaggccagguggugagccugaucagaaugagaaaccccuggggcgagguggaguggaccggcgccuggagcgacagcagcagcgaguggaacaacguggaccccuacgagagagaccagcugagagugaagauggaggacggcgaguucuggaugagcuucagagacuucaugagagaguucaccagacuggagaucugcaaccugacccccgacgcccugaagagcagaaccaucagaaaguggaacaccacccuguacgagggcaccuggagaagaggcagcaccgccggcggcugcagaaacuaccccgccaccuucugggugaacccccaguucaagaucagacuggacgagaccgacgaccccgacgacuacggcgacagagagagcggcugcagcuucgugcuggcccugaugcagaagcacagaagaagagagagaagauucggcagagacauggagaccaucggcuucgccguguacgaggugccccccgagcuggugggccagcccgccgugcaccugaagagagacuucuuccuggccaacgccagcagagccagaagcgagcaguucaucaaccugagagaggugagcaccagauucagacugccccccggcgaguacgugguggugcccagcaccuucgagcccaacaaggagggcgacuucgugcugagauucuucagcgagaagagcgccggcaccguggagcuggacgaccagauccaggccaaccugcccgacgagcaggugcugagcgaggaggagaucgacgagaacuucaaggcccuguucagacagcuggccggcgaggacauggagaucagcgugaaggagcugagaaccauccugaacagaaucaucagcaagcacaaggaccugagaaccaagggcuucagccuggagagcugcagaagcauggugaaccugauggacagagacggcaacggcaagcugggccugguggaguucaacauccuguggaacagaaucagaaacuaccugagcaucuucagaaaguucgaccuggacaagagcggcagcaugagcgccuacgagaugagaauggccaucgagagcgccggcuucaagcugaacaagaagcuguacgagcugaucaucaccagauacagcgagcccgaccuggccguggacuucgacaacuucgugugcugccuggugagacuggagaccauguucagauucuucaagacccuggacaccgaccuggacggcguggugaccuucgaccuguucaaguggcugcagcugaccauguucgccuaa

SEQ ID NO: 14629 - RNA, 1869 nt, Artificial Sequence
  CAPN2__Homo_sapiens__NP_001139540
auggagaucugcgccgacccccaguucaucaucggcggcgccaccagaaccgacaucugccagggcgcccugggcgacugcuggcugcuggccgccaucgccagccugacccugaacgaggagauccuggccagaguggugccccugaaccagagcuuccaggagaacuacgccggcaucuuccacuuccaguucuggcaguacggcgaguggguggagguggugguggacgacagacugcccaccaaggacggcgagcugcuguucgugcacagcgccgagggcagcgaguucuggagcgcccugcuggagaaggccuacgccaagaucaacggcugcuacgaggcccugagcggcggcgccaccaccgagggcuucgaggacuucaccggcggcaucgccgagugguacgagcugaagaagcccccccccaaccuguucaagaucauccagaaggcccugcagaagggcagccugcugggcugcagcaucgacaucaccagcgccgccgacagcgaggccaucaccuuccagaagcuggugaagggccacgccuacagcgugaccggcgccgaggagguggagagcaacggcagccugcagaagcugaucagaaucagaaaccccuggggcgagguggaguggaccggcagauggaacgacaacugccccagcuggaacaccaucgaccccgaggagagagagagacugaccagaagacacgaggacggcgaguucuggaugagcuucagcgacuuccugagacacuacagcagacuggagaucugcaaccugacccccgacacccugaccagcgacaccuacaagaaguggaagcugaccaagauggacggcaacuggagaagaggcagcaccgccggcggcugcagaaacuaccccaacaccuucuggaugaacccccaguaccugaucaagcuggaggaggaggacgaggacgaggaggacggcgagagcggcugcaccuuccuggugggccugauccagaagcacagaagaagacagagaaagaugggcgaggacaugcacaccaucggcuucggcaucuacgaggugcccgaggagcugagcggccagaccaacauccaccugagcaagaacuucuuccugaccaacagagccagagagagaagcgacaccuucaucaaccugagagaggugcugaacagauucaagcugccccccggcgaguacauccuggugcccagcaccuucgagcccaacaaggacggcgacuucugcaucagaguguucagcgagaagaaggccgacuaccaggccguggacgacgagaucgaggccaaccuggaggaguucgacaucagcgaggacgacaucgacgacggcuucagaagacuguucgcccagcuggccggcgaggacgccgagaucagcgccuucgagcugcagaccauccugagaagagugcuggccaagagacaggacaucaagagcgacggcuucagcaucgagaccugcaagaucaugguggacaugcuggacagcgacggcagcggcaagcugggccugaaggaguucuacauccuguggaccaagauccagaaguaccagaagaucuacagagagaucgacguggacagaagcggcaccaugaacagcuacgagaugagaaaggcccuggaggaggccggcuucaagaugcccugccagcugcaccaggugaucguggccagauucgccgacgaccagcugaucaucgacuucgacaacuucgugagaugccuggugagacuggagacccuguucaagaucuucaagcagcuggaccccgagaacaccggcaccaucgagcuggaccugaucagcuggcugugcuucagcgugcuguaa

SEQ ID NO: 14630 - RNA, 2466 nt, Artificial Sequence
  CAPN3__Homo_sapiens__NP_000061
augcccaccgugaucagcgccagcguggcccccagaaccgccgccgagcccagaagccccggccccgugccccaccccgcccagagcaaggccaccgaggccggcggcggcaaccccagcggcaucuacagcgccaucaucagcagaaacuuccccaucaucggcgugaaggagaagaccuucgagcagcugcacaagaagugccuggagaagaaggugcuguacguggaccccgaguucccccccgacgagaccagccuguucuacagccagaaguuccccauccaguucguguggaagagaccccccgagaucugcgagaaccccagauucaucaucgacggcgccaacagaaccgacaucugccagggcgagcugggcgacugcugguuccuggccgccaucgccugccugacccugaaccagcaccugcuguucagagugaucccccacgaccagagcuucaucgagaacuacgccggcaucuuccacuuccaguucuggagauacggcgaguggguggacguggugaucgacgacugccugcccaccuacaacaaccagcugguguucaccaagagcaaccacagaaacgaguucuggagcgcccugcuggagaaggccuacgccaagcugcacggcagcuacgaggcccugaagggcggcaacaccaccgaggccauggaggacuucaccggcggcguggccgaguucuucgagaucagagacgcccccagcgacauguacaagaucaugaagaaggccaucgagagaggcagccugaugggcugcagcaucgacgacggcaccaacaugaccuacggcaccagccccagcggccugaacaugggcgagcugaucgccagaauggugagaaacauggacaacagccugcugcaggacagcgaccuggaccccagaggcagcgacgagagacccaccagaaccaucauccccgugcaguacgagaccagaauggccugcggccuggugagaggccacgccuacagcgugaccggccuggacgaggugcccuucaagggcgagaaggugaagcuggugagacugagaaaccccuggggccagguggaguggaacggcagcuggagcgacagauggaaggacuggagcuucguggacaaggacgagaaggccagacugcagcaccaggugaccgaggacggcgaguucuggaugagcuacgaggacuucaucuaccacuucaccaagcuggagaucugcaaccugaccgccgacgcccugcagagcgacaagcugcagaccuggaccgugagcgugaacgagggcagaugggugagaggcugcagcgccggcggcugcagaaacuuccccgacaccuucuggaccaacccccaguacagacugaagcugcuggaggaggacgacgaccccgacgacagcgaggugaucugcagcuuccugguggcccugaugcagaagaacagaagaaaggacagaaagcugggcgccagccuguucaccaucggcuucgccaucuacgaggugcccaaggagaugcacggcaacaagcagcaccugcagaaggacuucuuccuguacaacgccagcaaggccagaagcaagaccuacaucaacaugagagaggugagccagagauucagacugccccccagcgaguacgugaucgugcccagcaccuacgagccccaccaggagggcgaguucauccugagaguguucagcgagaagagaaaccugagcgaggagguggagaacaccaucagcguggacagacccgugaagaagaagaagaccaagcccaucaucuucgugagcgacagagccaacagcaacaaggagcugggcguggaccaggagagcgaggagggcaagggcaagaccagccccgacaagcagaagcagagcccccagccccagcccggcagcagcgaccaggagagcgaggagcagcagcaguucagaaacaucuucaagcagaucgccggcgacgacauggagaucugcgccgacgagcugaagaaggugcugaacaccguggugaacaagcacaaggaccugaagacccacggcuucacccuggagagcugcagaagcaugaucgcccugauggacaccgacggcagcggcaagcugaaccugcaggaguuccaccaccuguggaacaagaucaaggccuggcagaagaucuucaagcacuacgacaccgaccagagcggcaccaucaacagcuacgagaugagaaacgccgugaacgacgccggcuuccaccugaacaaccagcuguacgacaucaucaccaugagauacgccgacaagcacaugaacaucgacuucgacagcuucaucugcugcuucgugagacuggagggcauguucagagccuuccacgccuucgacaaggacggcgacggcaucaucaagcugaacgugcuggaguggcugcagcugaccauguacgccuaa

SEQ ID NO: 14631 - RNA, 1923 nt, Artificial Sequence
  CAPN5__Homo_sapiens__NP_004046
auguucagcugcgugaagcccuacgaggaccagaacuacagcgcccugagaagagacugcagaagaagaaaggugcuguucgaggacccccuguuccccgccaccgacgacagccuguacuacaagggcacccccggccccgccgugagauggaagagacccaagggcaucugcgaggaccccagacuguucguggacggcaucagcagccacgaccugcaccagggccaggugggcaacugcugguucguggccgccugcagcagccuggccagcagagagagccuguggcagaaggugauccccgacuggaaggagcaggagugggaccccgagaagcccaacgccuacgccggcaucuuccacuuccacuucuggagauucggcgaguggguggacguggugaucgacgacagacugcccaccgugaacaaccagcugaucuacugccacagcaacagcagaaacgaguucuggugcgcccugguggagaaggccuacgccaagcuggccggcugcuaccaggcccuggacggcggcaacaccgccgacgcccugguggacuucaccggcggcgugagcgagcccaucgaccugaccgagggcgacuucgccaacgacgagaccaagagaaaccagcuguucgagagaaugcugaaggugcacagcagaggcggccugaucagcgccagcaucaaggccgugaccgccgccgacauggaggccagacuggccugcggccuggugaagggccacgccuacgccgugaccgacgugagaaaggugagacugggccacggccugcuggccuucuucaagagcgagaagcuggacaugaucagacugagaaaccccuggggcgagagagaguggaacggccccuggagcgacaccagcgaggaguggcagaaggugagcaagagcgagagagagaagaugggcgugaccgugcaggacgacggcgaguucuggaugaccuucgaggacgugugcagauacuucaccgacaucaucaagugcagagugaucaacaccagccaccugagcauccacaagaccugggaggaggccagacugcacggcgccuggacccugcacgaggaccccagacagaacagaggcggcggcugcaucaaccacaaggacaccuucuuccagaacccccaguacaucuucgaggugaagaagcccgaggacgaggugcugaucugcauccagcagagacccaagagaagcaccagaagagagggcaagggcgagaaccuggccaucggcuucgacaucuacaagguggaggagaacagacaguacagaaugcacagccugcagcacaaggccgccagcagcaucuacaucaacagcagaagcguguuccugagaaccgaccagcccgagggcagauacgugaucauccccaccaccuucgagcccggccacaccggcgaguuccugcugagaguguucaccgacgugcccagcaacugcagagagcugagacuggacgagcccccccacaccugcuggagcagccugugcggcuacccccagcuggugacccaggugcacgugcugggcgccgccggccugaaggacagccccaccggcgccaacagcuacgugaucaucaagugcgagggcgacaaggugagaagcgccgugcagaagggcaccagcacccccgaguacaacgugaagggcaucuucuacagaaagaagcugagccagcccaucaccgugcagguguggaaccacagagugcugaaggacgaguuccugggccaggugcaccugaaggccgaccccgacaaccugcaggcccugcacacccugcaccugagagacagaaacagcagacagcccagcaaccugcccggcaccguggccgugcacauccugagcagcaccagccugauggccguguaa

SEQ ID NO: 14632 - RNA, 1926 nt, Artificial Sequence
  CAPN6__Homo_sapiens__NP_055104
augggccccccccugaagcuguucaagaaccagaaguaccaggagcugaagcaggagugcaucaaggacagcagacuguucugcgaccccaccuuccugcccgagaacgacagccuguucuacaacagacugcugcccggcaaggugguguggaagagaccccaggacaucugcgacgacccccaccugaucgugggcaacaucagcaaccaccagcugacccagggcagacugggccacaagcccauggugagcgccuucagcugccuggccgugcaggagagccacuggaccaagaccauccccaaccacaaggagcaggagugggacccccagaagaccgagaaguacgccggcaucuuccacuucagauucuggcacuucggcgaguggaccgagguggugaucgacgaccugcugcccaccaucaacggcgaccugguguucagcuucagcaccagcaugaacgaguucuggaacgcccugcuggagaaggccuacgccaagcugcugggcugcuacgaggcccuggacggccugaccaucaccgacaucaucguggacuucaccggcacccuggccgagaccguggacaugcagaagggcagauacaccgagcugguggaggagaaguacaagcuguucggcgagcuguacaagaccuucaccaagggcggccugaucugcugcagcaucgagagccccaaccaggaggagcaggagguggagaccgacuggggccugcugaagggccacaccuacaccaugaccgacaucagaaagaucagacugggcgagagacugguggagguguucagcgccgagaagguguacauggugagacugagaaacccccugggcagacaggaguggagcggccccuggagcgagaucagcgaggaguggcagcagcugaccgccagcgacagaaagaaccugggccuggugaugagcgacgacggcgaguucuggaugagccuggaggacuucugcagaaacuuccacaagcugaacgugugcagaaacgugaacaaccccaucuucggcagaaaggagcuggagagcgugcugggcugcuggaccguggacgacgacccccugaugaacagaagcggcggcugcuacaacaacagagacaccuuccugcagaacccccaguacaucuucaccgugcccgaggacggccacaaggugaucaugagccugcagcagaaggaccugagaaccuacagaagaaugggcagacccgacaacuacaucaucggcuucgagcuguucaagguggagaugaacagaaaguucagacugcaccaccuguacauccaggagagagccggcaccagcaccuacaucgacaccagaaccguguuccugagcaaguaccugaagaagggcaacuacgugcuggugcccaccauguuccagcacggcagaaccagcgaguuccugcugagaaucuucagcgaggugcccgugcagcugagagagcugacccuggacaugcccaagaugagcugcuggaaccuggccagaggcuaccccaagguggugacccagaucaccgugcacagcgccgaggaccuggagaagaaguacgccaacgagaccgugaaccccuaccuggugaucaagugcggcaaggaggaggugagaagccccgugcagaagaacaccgugcacgccaucuucgacacccaggccaucuucuacagaagaaccaccgacauccccaucaucgugcagguguggaacagcagaaaguucugcgaccaguuccugggccaggugacccuggacgccgaccccagcgacugcagagaccugaagagccuguaccugagaaagaagggcggccccaccgccaaggugaagcagggccacaucagcuucaaggugaucagcagcgacgaccugaccgagcuguaa

SEQ ID NO: 14633 - RNA, 2442 nt, Artificial Sequence
  CAPN7__Homo_sapiens__NP_055111
auggacgccaccgcccuggagagagacgccgugcaguucgccagacuggccgugcagagagaccacgagggcagauacagcgaggccguguucuacuacaaggaggccgcccaggcccugaucuacgccgagauggccggcagcagccuggagaacauccaggagaagaucaccgaguaccuggagagagugcaggcccugcacagcgccgugcagagcaagagcgccgacccccugaagagcaagcaccagcuggaccuggagagagcccacuuccuggugacccaggccuucgacgaggacgagaaggagaacguggaggacgccaucgagcuguacaccgaggccguggaccugugccugaagaccagcuacgagaccgccgacaaggugcugcagaacaagcugaagcagcuggccagacaggcccuggacagagccgaggcccugagcgagccccugaccaagcccgugggcaagaucagcagcaccagcgugaagcccaagcccccccccgugagagcccacuucccccugggcgccaaccccuuccuggagagaccccagagcuucaucagcccccagagcugcgacgcccagggccagagauacaccgccgaggagaucgaggugcugagaaccaccagcaagaucaacggcaucgaguacgugcccuucaugaacguggaccugagagagagauucgccuaccccaugcccuucugcgacagauggggcaagcugccccugagccccaagcagaagaccaccuucagcaagugggugagacccgaggaccugaccaacaaccccaccaugaucuacaccgugagcagcuucagcaucaagcagaccaucgugagcgacugcagcuucguggccagccuggccaucagcgccgccuacgagagaagauucaacaagaagcugaucaccggcaucaucuacccccagaacaaggacggcgagcccgaguacaaccccugcggcaaguacauggugaagcugcaccugaacggcgugcccagaaaggugaucaucgacgaccagcugcccguggaccacaagggcgagcugcugugcagcuacagcaacaacaagagcgagcugugggugagccugaucgagaaggccuacaugaaggugaugggcggcuacgacuuccccggcagcaacagcaacaucgaccugcacgcccugaccggcuggauccccgagagaaucgccaugcacagcgacagccagaccuucagcaaggacaacagcuucagaaugcuguaccagagauuccacaagggcgacgugcugaucaccgccagcaccggcaugaugaccgaggccgagggcgagaaguggggccuggugcccacccacgccuacgccgugcuggacaucagagaguucaagggccugagauucauccagcugaagaaccccuggagccaccugagauggaagggcagauacagcgagaacgacgugaagaacuggacccccgagcugcagaaguaccugaacuucgaccccagaaccgcccagaagaucgacaacggcaucuucuggaucagcugggacgaccugugccaguacuacgacgugaucuaccugagcuggaaccccggccuguucaaggagagcaccugcauccacagcaccugggacgccaagcagggccccgugaaggacgccuacagccuggccaacaacccccaguacaagcuggaggugcagugcccccagggcggcgccgccgugugggugcugcugagcagacacaucaccgacaaggacgacuucgccaacaacagagaguucaucaccauggugguguacaagaccgacggcaagaagguguacuaccccgccgaccccccccccuacaucgacggcaucagaaucaacagcccccacuaccugaccaagaucaagcugaccacccccggcacccacaccuucacccugguggugagccaguacgagaagcagaacaccauccacuacaccgugagaguguacagcgccugcagcuucaccuucagcaagauccccagccccuacacccugagcaagagaaucaacggcaaguggagcggccagagcgccggcggcugcggcaacuuccaggagacccacaagaacaaccccaucuaccaguuccacaucgagaagaccggcccccugcugaucgagcugagaggccccagacaguacagcgugggcuucgagguggugaccgugagcacccugggcgaccccggcccccacggcuuccugagaaagagcagcggcgacuacagaugcggcuucugcuaccuggagcuggagaacauccccagcggcaucuucaacaucauccccagcaccuuccugcccaagcaggagggccccuucuuccuggacuucaacagcaucauccccaucaagaucacccagcugcaguaa

SEQ ID NO: 14634 - RNA, 2073 nt, Artificial Sequence
  CAPN9__Homo_sapiens__NP_006606
augcccuaccuguacagagcccccggcccccaggcccaccccgugcccaaggacgccagaaucacccacagcagcggccagagcuucgagcagaugagacaggagugccugcagagaggcacccuguucgaggacgccgacuuccccgccagcaacagcagccuguucuacagcgagagaccccagauccccuucguguggaagagacccggcgagaucgugaagaaccccgaguucauccugggcggcgccaccagaaccgacaucugccagggcgagcugggcgacugcuggcugcuggccgccaucgccagccugacccugaaccagaaggcccuggccagagugaucccccaggaccagagcuucggccccggcuacgccggcaucuuccacuuccaguucuggcagcacagcgaguggcuggacguggugaucgacgacagacugcccaccuucagagacagacugguguuccugcacagcgccgaccacaacgaguucuggagcgcccugcuggagaaggccuacgccaagcugaacggcagcuacgaggcccugaagggcggcagcgccaucgaggccauggaggacuucaccggcggcguggccgagaccuuccagaccaaggaggcccccgagaacuucuacgagauccuggagaaggcccugaagagaggcagccugcugggcugcuucaucgacaccagaagcgccgccgagagcgaggccagaacccccuucggccugaucaagggccacgccuacagcgugaccggcaucgaccaggugagcuucagaggccagagaaucgagcugaucagaaucagaaaccccuggggccagguggaguggaacggcagcuggagcgacagcagccccgaguggagaagcgugggccccgccgagcagaagagacugugccacaccgcccuggacgacggcgaguucuggauggccuucaaggacuucaaggcccacuucgacaagguggagaucugcaaccugacccccgacgcccuggaggaggacgccauccacaagugggaggugaccgugcaccagggcagcugggugagaggcagcaccgccggcggcugcagaaacuuccuggacaccuucuggaccaacccccagaucaagcugagccugaccgagaaggacgagggccaggaggagugcagcuuccugguggcccugaugcagaaggacagaagaaagcugaagagauucggcgccaacgugcugaccaucggcuacgccaucuacgagugccccgacaaggacgagcaccugaacaaggacuucuucagauaccacgccagcagagccagaagcaagaccuucaucaaccugagagaggugagcgacagauucaagcugccccccggcgaguacauccugauccccagcaccuucgagccccaccaggaggccgacuucugccugagaaucuucagcgagaagaaggccaucaccagagacauggacggcaacguggacaucgaccugcccgagccccccaagcccaccccccccgaccaggagaccgaggaggagcagagauucagagcccuguucgagcagguggccggcgaggacauggaggugaccgccgaggagcuggaguacgugcugaacgccgugcugcagaagaagaaggacaucaaguucaagaagcugagccugaucagcugcaagaacaucaucagccugauggacaccagcggcaacggcaagcuggaguucgacgaguucaagguguucugggacaagcugaagcaguggaucaaccuguuccugagauucgacgccgacaagagcggcaccaugagcaccuacgagcugagaaccgcccugaaggccgccggcuuccagcugagcagccaccugcugcagcugaucgugcugagauacgccgacgaggagcugcagcuggacuucgacgacuuccugaacugccuggugagacuggagaacgccagcagaguguuccaggcccugagcaccaagaacaaggaguucauccaccugaacaucaacgaguucauccaccugaccaugaacaucuaa

SEQ ID NO: 14635 - RNA, 807 nt, Artificial Sequence
  CAPNS1__Homo_sapiens__NP_001289561
auguuccuggugaacagcuuccugaagggcggcggcggcggcggcggcggcggcggcggccugggcggcggccugggcaacgugcugggcggccugaucagcggcgccggcggcggcggcggcggcggcggcggcggcggcggcggcggcggcggcggcggcggcggcaccgccaugagaauccugggcggcgugaucagcgccaucagcgaggccgccgcccaguacaaccccgagccccccccccccagaacccacuacagcaacaucgaggccaacgagagcgaggaggugagacaguucagaagacuguucgcccagcuggccggcgacgacauggaggugagcgccaccgagcugaugaacauccugaacaagguggugaccagacaccccgaccugaagaccgacggcuucggcaucgacaccugcagaagcaugguggccgugauggacagcgacaccaccggcaagcugggcuucgaggaguucaaguaccuguggaacaacaucaagagauggcaggccaucuacaagcaguucgacaccgacagaagcggcaccaucugcagcagcgagcugcccggcgccuucgaggccgccggcuuccaccugaacgagcaccuguacaacaugaucaucagaagauacagcgacgagagcggcaacauggacuucgacaacuucaucagcugccuggugagacuggacgccauguucagagccuucaagagccuggacaaggacggcaccggccagauccaggugaacauccaggaguggcugcagcugaccauguacagcuaa

SEQ ID NO: 14636 - RNA, 2130 nt, Artificial Sequence
  CAPRIN1__Homo_sapiens__NP_005889
augcccagcgccaccagccacagcggcagcggcagcaagagcagcggcccccccccccccagcggcagcagcggcagcgaggccgccgccggcgccggcgccgccgcccccgccagccagcaccccgccaccggcaccggcgccgugcagaccgaggccaugaagcagauccugggcgugaucgacaagaagcugagaaaccuggagaagaagaagggcaagcuggacgacuaccaggagagaaugaacaagggcgagagacugaaccaggaccagcuggacgccgugagcaaguaccaggaggugaccaacaaccuggaguucgccaaggagcugcagagaagcuucauggcccugagccaggacauccagaagaccaucaagaagaccgccagaagagagcagcugaugagagaggaggccgagcagaagagacugaagaccgugcuggagcugcaguacgugcuggacaagcugggcgacgacgaggugagaaccgaccugaagcagggccugaacggcgugcccauccugagcgaggaggagcugagccugcuggacgaguucuacaagcugguggaccccgagagagacaugagccugagacugaacgagcaguacgagcacgccagcauccaccugugggaccugcuggagggcaaggagaagcccgugugcggcaccaccuacaaggugcugaaggagaucguggagagaguguuccagagcaacuacuucgacagcacccacaaccaccagaacggccugugcgaggaggaggaggccgccagcgcccccgccguggaggaccaggugcccgaggccgagcccgagcccgccgaggaguacaccgagcagagcgagguggagagcaccgaguacgugaacagacaguucauggccgagacccaguucaccagcggcgagaaggagcagguggacgaguggaccguggagaccguggagguggugaacagccugcagcagcagccccaggccgccagccccagcgugcccgagccccacagccugacccccguggcccaggccgacccccuggugagaagacagagagugcaggaccugauggcccagaugcagggccccuacaacuucauccaggacagcaugcuggacuucgagaaccagacccuggaccccgccaucgugagcgcccagcccaugaaccccacccagaacauggacaugccccagcuggugugcccccccgugcacagcgagagcagacuggcccagcccaaccaggugcccgugcagcccgaggccacccaggugccccuggugagcagcaccagcgagggcuacaccgccagccagccccuguaccagcccagccacgccaccgagcagagaccccagaaggagcccaucgaccagauccaggccaccaucagccugaacaccgaccagaccaccgccagcagcagccugcccgccgccagccagccccagguguuccaggccggcaccagcaagccccugcacagcagcggcaucaacgugaacgccgcccccuuccagagcaugcagaccguguucaacaugaacgcccccgugccccccgugaacgagcccgagacccugaagcagcagaaccaguaccaggccagcuacaaccagagcuucagcagccagccccaccagguggagcagaccgagcugcagcaggagcagcugcagaccguggugggcaccuaccacggcagccccgaccagagccaccaggugaccggcaaccaccagcagcccccccagcagaacaccggcuuccccagaagcaaccagcccuacuacaacagcagaggcgugagcagaggcggcagcagaggcgccagaggccugaugaacggcuacagaggccccgccaacggcuucagaggcggcuacgacggcuacagacccagcuucagcaacacccccaacagcggcuacacccagagccaguucagcgcccccagagacuacagcggcuaccagagagacggcuaccagcagaacuucaagagaggcagcggccagagcggccccagaggcgcccccagaggcagaggcggcccccccagacccaacagaggcaugccccagaugaacacccagcaggugaacuaa

SEQ ID NO: 14637 - RNA, 3384 nt, Artificial Sequence
  CAPRIN2__Homo_sapiens__NP_001002259
auggaggugcaggugagccaggccagccugggcuucgagcugaccagcguggagaagagccugagagaguggagcagacugagcagagaggugaucgccuggcugugccccagcagccccaacuucauccugaacuucccccccccccccagcgccagcagcgugagcauggugcagcuguucagcagccccuucggcuaccagagccccagcggccacagcgaggaggagagagagggcaacaugaagagcgccaagccccaggugaaccacagccagcacggcgagagccagagagcccugagcccccugcagagcacccugagcagcgccgccagccccagccaggccuacgagaccuacaucgagaacggccugaucugccugaagcacaagaucagaaacaucgagaagaagaagcugaagcuggaggacuacaaggacagacugaagagcggcgagcaccugaaccccgaccagcuggaggccguggagaaguacgaggaggugcugcacaaccuggaguucgccaaggagcugcagaagaccuucagcggccugagccuggaccugcugaaggcccagaagaaggcccagagaagagagcacaugcugaagcuggaggccgagaagaagaagcugagaaccauccugcaggugcaguacgugcugcagaaccugacccaggagcacgugcagaaggacuucaagggcggccugaacggcgccguguaccugcccagcaaggagcuggacuaccugaucaaguucagcaagcugaccugccccgagagaaacgagagccugagcguggaggaccagauggagcagagcagccuguacuucugggaccugcuggagggcagcgagaaggccguggugggcaccaccuacaagcaccugaaggaccugcugagcaagcugcugaacagcggcuacuucgagagcauccccgugcccaagaacgccaaggagaaggaggugccccuggaggaggagaugcugauccagagcgagaagaagacccagcugagcaagaccgagagcgugaaggagagcgagagccugauggaguucgcccagcccgagauccagccccaggaguuccugaacagaagauacaugaccgagguggacuacagcaacaagcagggcgaggagcagcccugggaggccgacuacgccagaaagcccaaccugcccaagagaugggacaugcugaccgagcccgacggccaggagaagaagcaggagagcuucaagagcugggaggccagcggcaagcaccaggaggugagcaagcccgccgugagccuggagcagagaaagcaggacaccagcaagcugagaagcacccugcccgaggagcagaagaagcaggagaucagcaagagcaagcccagccccagccaguggaagcaggacacccccaagagcaaggccggcuacgugcaggaggagcagaagaagcaggagacccccaagcuguggcccgugcagcugcagaaggagcaggaccccaagaagcagacccccaagagcuggacccccagcaugcagagcgagcagaacaccaccaagagcuggaccacccccaugugcgaggagcaggacagcaagcagcccgagacccccaagagcugggagaacaacguggagagccagaagcacagccugaccagccagagccagaucagccccaagagcuggggcguggccaccgccagccugauccccaacgaccagcugcugcccagaaagcugaacaccgagcccaaggacgugcccaagcccgugcaccagcccgugggcagcagcagcacccugcccaaggaccccgugcugagaaaggagaagcugcaggaccugaugacccagauccagggcaccugcaacuucaugcaggagagcgugcuggacuucgacaagcccagcagcgccauccccaccagccagccccccagcgccacccccggcagccccguggccagcaaggagcagaaccugagcagccagagcgacuuccugcaggagccccugcaggccaccagcagccccgugaccugcagcagcaacgccugccuggugaccaccgaccaggccagcagcggcagcgagaccgaguucaugaccagcgagacccccgaggccgccaucccccccggcaagcagcccagcagccuggccagccccaacccccccauggccaagggcagcgagcagggcuuccagagcccccccgccagcagcagcagcgugaccaucaacaccgcccccuuccaggccaugcagaccguguucaacgugaacgccccccugccccccagaaaggagcaggagaucaaggagagccccuacagccccggcuacaaccagagcuucaccaccgccagcacccagacccccccccagugccagcugcccagcauccacguggagcagaccgugcacagccaggagaccgccgccaacuaccaccccgacggcaccauccaggugagcaacggcagccuggccuucuaccccgcccagaccaacguguuccccagacccacccagcccuucgugaacagcagaggcagcgugagaggcugcaccagaggcggcagacugaucaccaacagcuacagaagccccggcggcuacaagggcuucgacaccuacagaggccugcccagcaucagcaacggcaacuacagccagcugcaguuccaggccagagaguacagcggcgcccccuacagccagagagacaacuuccagcagugcuacaagagaggcggcaccagcggcggccccagagccaacagcagagccggcuggagcgacagcagccaggugagcagccccgagagagacaacgagaccuucaacagcggcgacagcggccagggcgacagcagaagcaugacccccguggacgugcccgugaccaaccccgccgccaccauccugcccgugcacguguacccccugccccagcagaugagaguggccuucagcgccgccagaaccagcaaccuggcccccggcacccuggaccagcccaucguguucgaccugcugcugaacaaccugggcgagaccuucgaccugcagcugggcagauucaacugccccgugaacggcaccuacguguucaucuuccacaugcugaagcuggccgugaacgugccccuguacgugaaccugaugaagaacgaggaggugcuggugagcgccuacgccaacgacggcgcccccgaccacgagaccgccagcaaccacgccauccugcagcuguuccagggcgaccagaucuggcugagacugcacagaggcgccaucuacggcagcagcuggaaguacagcaccuucagcggcuaccugcuguaccaggacuaa

SEQ ID NO: 14638 - RNA, 1428 nt, Artificial Sequence
  CAPS2__Homo_sapiens__NP_001273476
augaucaacaccggcacccagauggaccuggaggugaagggcguggccgccaccagcagaagccagauccagcccuucuucggcagaaagaagccccugcagcagagauggaccagcgagagcuggaccaaccagaacagcugcccccccguggugcccagacuggaccugggcagccugguggacagcgacgacgaggaccagaacaucauccccgagaaccugcccgcccccaccgacaagugcaagcugaaguaccagcagugcaagaccgagaucaaggagggcuacaagcaguacagccagagaaacgccgagaacaccaagagcaacgugacccacaagcagagccccagaaacaagaucgacgagaagugcgugcaggacgaggaggccaacaccgacgaccugaccacccuggacagaaaggccauccugcagcagggcuacgccgacaacagcugcgacaagcagcagagagccagaaagcuggacgccgagaucguggccgccgagaagaagaagcagaucguggccgagcaggugaugaucgaccaccugagcagagccgugaucagcgaccccgagcagaaccuggccaucgagcagaaggagagcgaccacauccugcccgacagcaagaugaccccccugagauucagaaagagaacccugcacgagaccaagaucagaacccacagcacccugaccgagaacgugcugagccacaagcugcaguucgacggcagaaucgugagcagaaccaacgugcugcccuucauccagaagagcaucuacagccaccagugcggcagaagaaagggcaagcaguacagacugggcgacuucuacgugggcgccacccugaccuuccugagcagcgaccaccugagccugcccgagagcaucaaggagaacacccugcugaagcugagaaucaccaacaucgaccagaucgcccuggacagccugaagaccgccagcauggagcaggaggacgacaucaucauccaggagaccaacgacagacugguguucaaggccauccaggacgugcugaaggagaagcugcacaagagaggcgugagaauccugaccggccugggcaaguacuuccagcagcuggacaaggagggcaacggccugcuggacaaggccgacuucaagcaggcccugaagguguuccaccuggaggugagcgagaaggacuucgagagcgccuggcugauccugaacgacaacggcaacggcaagguggacuacggcgaguucaagagaggcaucaucggcgagaugaacgaguacagaaagagcuacgugagaaaggccuucaugaagcuggacuucaacaagagcggcagcgugcccaucaucaacaucagaaagugcuacugcgccaagaagcacagccaggugaucagcggcuaa

SEQ ID NO: 14639 - RNA, 828 nt, Artificial Sequence
  CAPS__Homo_sapiens__NP_004049
augcagugccacagagaccuggcccugagccaggcccuguggggcuggcagcugagcaagcagagcggcugggcccaccccagccugccccacagcccccugcccagcaccgugcacagcugcagcugggcccccccccaccugcagagacaccugccccuggccaccgugagccccggcaccacccagcugacccagggccccgccggcagaacccugggccagacccaggccagcugccccgagcccagacccagcauggacgccguggacgccaccauggagaagcugagagcccagugccugagcagaggcgccagcggcauccagggccuggccagauucuucagacagcuggacagagacggcagcagaagccuggacgccgacgaguucagacagggccuggccaagcugggccuggugcuggaccaggccgaggccgagggcgugugcagaaagugggacagaaacggcagcggcacccuggaccuggaggaguuccugagagcccugagaccccccaugagccaggccagagaggccgugaucgccgccgccuucgccaagcuggacagaagcggcgacggcguggugaccguggacgaccugagaggcguguacagcggcagagcccaccccaaggugagaagcggcgaguggaccgaggacgaggugcugagaagauuccuggacaacuucgacagcagcgagaaggacggccaggugacccuggccgaguuccaggacuacuacagcggcgugagcgccagcaugaacaccgacgaggaguucguggccaugaugaccagcgccuggcagcuguaa

SEQ ID NO: 14640 - RNA, 627 nt, Artificial Sequence
  CAPSL__Homo_sapiens__NP_001036090
auggccggcaccgccagacacgacagagagauggccauccaggccaagaagaagcugaccaccgccaccgaccccaucgagagacugagacugcagugccuggccagaggcagcgccggcaucaagggccugggcagaguguucagaaucauggacgacgacaacaacagaacccuggacuucaaggaguucaugaagggccugaacgacuacgccguggugauggagaaggaggagguggaggagcuguucagaagauucgacaaggacggcaacggcaccaucgacuucaacgaguuccugcugacccugagaccccccaugagcagagccagaaaggaggugaucaugcaggccuucagaaagcuggacaagaccggcgacggcgugaucaccaucgaggaccugagagagguguacaacgccaagcaccaccccaaguaccagaacggcgaguggagcgaggagcagguguucagaaaguuccuggacaacuucgacagccccuacgacaaggacggccuggugacccccgaggaguucaugaacuacuacgccggcgugagcgccagcaucgacaccgacguguacuucaucaucaugaugagaaccgccuggaagcuguaa

SEQ ID NO: 14641 - RNA, 861 nt, Artificial Sequence
  CAPZA2__Homo_sapiens__NP_006127
auggccgaccuggaggagcagcugagcgacgaggagaaggugagaaucgccgccaaguucaucauccacgccccccccggcgaguucaacgagguguucaacgacgugagacugcugcugaacaacgacaaccugcugagagagggcgccgcccacgccuucgcccaguacaaccuggaccaguucacccccgugaagaucgagggcuacgaggaccaggugcugaucaccgagcacggcgaccugggcaacggcaaguuccuggaccccaagaacagaaucugcuucaaguucgaccaccugagaaaggaggccaccgaccccagacccugcgagguggagaacgccguggagagcuggagaaccagcguggagaccgcccugagagccuacgugaaggagcacuaccccaacggcgugugcaccguguacggcaagaagaucgacggccagcagaccaucaucgccugcaucgagagccaccaguuccaggccaagaacuucuggaacggcagauggagaagcgaguggaaguucaccaucacccccagcaccacccagguggugggcauccugaagauccaggugcacuacuacgaggacggcaacgugcagcuggugagccacaaggacauccaggacagccugaccgugagcaacgaggugcagaccgccaaggaguucaucaagaucguggaggccgccgagaacgaguaccagaccgccaucagcgagaacuaccagaccaugagcgacaccaccuucaaggcccugagaagacagcugcccgugaccagaaccaagaucgacuggaacaagauccugagcuacaagaucggcaaggagaugcagaacgccuaa

SEQ ID NO: 14642 - RNA, 900 nt, Artificial Sequence
  CAPZA3__Homo_sapiens__NP_201585
augacccugagcgugcugagcagaaaggacaaggagagagugaucagaagacugcugcugcaggccccccccggcgaguucgugaacgccuucgacgaccugugccugcugaucagagacgagaagcugaugcaccaccagggcgagugcgccggccaccagcacugccagaaguacagcgugccccugugcaucgacggcaaccccgugcugcugagccaccacaacgugaugggcgacuacagauucuucgaccaccagagcaagcugagcuucaaguacgaccugcugcagaaccagcugaaggacauccagagccacggcaucauccagaacgaggccgaguaccugagaguggugcugcugugcgcccugaagcuguacgugaacgaccacuaccccaagggcaacugcaacaugcugagaaagaccgugaagagcaaggaguaccugaucgccugcaucgaggaccacaacuacgagaccggcgagugcuggaacggccuguggaagagcaaguggaucuuccaggugaaccccuuccugacccaggugaccggcagaaucuucgugcaggcccacuucuucagaugcgugaaccugcacaucgagaucagcaaggaccugaaggagagccuggagaucgugaaccaggcccagcuggcccugagcuucgccagacugguggaggagcaggagaacaaguuccaggccgccgugcuggaggagcugcaggagcugagcaacgaggcccugagaaagauccugagaagagaccugcccgugaccagaacccugaucgacuggcacagaauccugagcgaccugaaccuggugauguaccccaagcugggcuacgugaucuacagcagaagcgugcugugcaacuggaucaucuaa

SEQ ID NO: 14643 - RNA, 3099 nt, Artificial Sequence
  CARD10__Homo_sapiens__NP_055365
augcccggcagagccgaggccggcgaggccgaggaggaggccggcgccggcagcggcagcgaggccgaggaggacgcccugugggagagaaucgagggcgugagacacagacuggccagagcccugaaccccgccaagcugacccccuaccugagacagugcagagugaucgacgagcaggacgaggaggaggugcugagcaccuacagauuccccugcagagugaacagaaccggcagacugauggacauccugagaugcagaggcaagagaggcuacgaggccuuccuggaggcccuggaguucuacuaccccgagcacuucacccugcugaccggccaggagcccgcccagagaugcagcaugauccuggacgaggagggccccgagggccugacccaguuccugaugaccgaggugagaagacugagagaggccagaaagagccagcugcagagagagcagcagcugcaggccagaggcagagugcuggaggaggagagagccggccuggagcagagacugagagaccagcagcaggcccaggagagaugccagagacugagagaggacugggaggccggcagccuggagcugcugagacugaaggacgagaacuacaugaucgccaugagacuggcccagcugagcgaggagaagaacagcgccgugcugagaagcagagaccugcagcuggccguggaccagcugaagcugaaggugagcagacuggaggaggagugcgcccugcugagaagagccagaggccccccccccggcgccgaggagaaggagaaggagaaggagaaggagaaggagcccgacaacguggaccuggugagcgagcugagagccgagaaccagagacugaccgccagccugagagagcugcaggagggccugcagcaggaggccagcagacccggcgcccccggcagcgagagaauccugcuggacauccuggagcacgacuggagagaggcccaggacagcagacaggagcugugccagaagcugcacgccgugcagggcgagcugcagugggccgaggagcugagagaccaguaccugcaggagauggaggaccugagacugaagcacagaacccugcagaaggacugcgaccuguacaagcacagaauggccaccgugcuggcccagcuggaggagaucgagaaggagagagaccaggccauccagagcagagacagaauccagcugcaguacagccagagccugaucgagaaggaccaguacagaaagcaggugagaggccuggaggccgagagagacgagcugcugaccacccugaccagccuggagggcaccaaggcccugcuggaggugcagcugcagagagcccagggcggcaccugccugaaggccugcgccagcagccacagccugugcagcaaccugagcagcaccuggagccugagcgaguuccccagcccccugggcggccccgaggccaccggcgaggccgccgugaugggcggccccgagccccacaacagcgaggaggccaccgacagcgagaaggagaucaacagacugagcauccugcccuucccccccagcgccggcagcauccugagaagacagagagaggaggaccccgccccccccaagagaagcuucagcagcaugagcgacaucaccggcagcgugacccugaagcccuggagccccggccugagcagcagcagcagcagcgacagcguguggccccugggcaagcccgagggccugcuggccagaggcugcggccuggacuuccugaacagaagccuggccaucagagugagcggcagaagcccccccggcggccccgagccccaggacaagggccccgacggccugagcuucuacggcgacagauggagcggcgccguggugagaagagugcugagcggccccggcagcgccagaauggagcccagagagcagagaguggaggccgccggccuggagggcgccugccuggaggccgaggcccagcagagaacccugcuguggaaccagggcagcacccugcccagccugauggacagcaaggccugccagagcuuccacgaggcccuggaggccugggccaagggccccggcgccgagcccuucuacaucagagccaaccugacccugcccgagagagccgacccccacgcccugugcgugaaggcccaggagauccugagacugguggacagcgccuacaagagaagacaggagugguucugcaccagaguggacccccugacccugagagaccuggacagaggcaccgugcccaacuaccagagagcccagcagcugcuggaggugcaggagaagugccugcccagcagcagacacagaggccccagaagcaaccugaagaagagagcccuggaccagcugagacuggugagacccaagcccgugggcgcccccgccggcgacagccccgaccagcugcugcuggagcccugcgccgagcccgagagaagccugagacccuacagccuggugagaccccugcuggugagcgcccugagacccguggugcugcugcccgagugccuggcccccagacugaucagaaaccugcuggaccugcccagcagcagacuggacuuccaggugugccccgccgagagccugagcggcgaggagcugugccccagcagcgcccccggcgcccccaaggcccagcccgccacccccggccugggcagcagaaucagagccauccaggagagcgugggcaagaagcacugccugcuggagcugggcgccagaggcgugagagagcuggugcagaacgagaucuaccccaucgugauccacguggaggugaccgagaagaacgugagagaggugagaggccugcugggcagacccggcuggagagacagcgagcugcugagacagugcagaggcagcgagcaggugcuguggggccugcccugcagcugggugcaggugcccgcccacgaguggggccacgccgaggagcuggccaagguggugagaggcagaauccugcaggagcaggccagacugguguggguggagugcggcagcagcagaggcugccccagcagcagcgaggccuaa

SEQ ID NO: 14644 - RNA, 3465 nt, Artificial Sequence
  CARD11__Homo_sapiens__NP_115791
augcccggcggcggccccgagauggacgacuacauggagacccugaaggacgaggaggacgcccugugggagaacguggagugcaacagacacaugcugagcagauacaucaaccccgccaagcugacccccuaccugagacagugcaaggugaucgacgagcaggacgaggacgaggugcugaacgcccccaugcugcccagcaagaucaacagagccggcagacugcuggacauccugcacaccaagggccagagaggcuacgugguguuccuggagagccuggaguucuacuaccccgagcuguacaagcuggugaccggcaaggagcccaccagaagauucagcaccaucgugguggaggagggccacgagggccugacccacuuccugaugaacgaggugaucaagcugcagcagcagaugaaggccaaggaccugcagagaugcgagcugcuggccagacugagacagcuggaggacgagaagaagcagaugacccugaccagaguggagcugcugaccuuccaggagagauacuacaagaugaaggaggagagagacagcuacaacgacgagcuggugaaggugaaggacgacaacuacaaccuggccaugagauacgcccagcugagcgaggagaagaacauggccgugaugagaagcagagaccugcagcuggagaucgaccagcugaagcacagacugaacaagauggaggaggagugcaagcuggagagaaaccagagccugaagcugaagaacgacaucgagaacagacccaagaaggagcaggugcuggagcuggagagagagaacgagaugcugaagaccaagaaccaggagcugcagagcaucauccaggccggcaagagaagccugcccgacagcgacaaggccauccuggacauccuggagcacgacagaaaggaggcccuggaggacagacaggagcuggugaacagaaucuacaaccugcaggaggaggccagacaggccgaggagcugagagacaaguaccuggaggagaaggaggaccuggagcugaagugcagcacccugggcaaggacugcgagauguacaagcacagaaugaacaccgugaugcugcagcuggaggagguggagagagagagagaccaggccuuccacagcagagacgaggcccagacccaguacagccagugccugaucgagaaggacaaguacagaaagcagaucagagagcuggaggagaagaacgacgagaugagaaucgagauggugagaagagaggccugcaucgugaaccuggagagcaagcugagaagacugagcaaggacagcaacaaccuggaccagagccugcccagaaaccugcccgugaccaucaucagccaggacuucggcgacgccagccccagaaccaacggccaggaggccgacgacagcagcaccagcgaggagagccccgaggacagcaaguacuuccugcccuaccaccccccccagagaagaaugaaccugaagggcauccagcugcagagagccaagagccccaucagccugaagagaaccagcgacuuccaggccaagggccacgaggaggagggcaccgacgccagccccagcagcugcggcagccugcccaucaccaacagcuucaccaagaugcagccccccagaagcagaagcagcaucaugagcaucaccgccgagccccccggcaacgacagcaucgugagaagauacaaggaggacgccccccacagaagcaccguggaggaggacaacgacagcggcggcuucgacgcccuggaccuggacgacgacagccacgagagauacagcuucggccccagcagcauccacagcagcagcagcagccaccagagcgagggccuggacgccuacgaccuggagcaggugaaccugauguucagaaaguucagccuggagagacccuucagacccagcgugaccagcgugggccacgugagaggccccggccccagcgugcagcacaccacccugaacggcgacagccugaccagccagcugacccugcugggcggcaacgccagaggcagcuucgugcacagcgugaagcccggcagccuggccgagaaggccggccugagagagggccaccagcugcugcugcuggagggcugcaucagaggcgagagacagagcgugccccuggacaccugcaccaaggaggaggcccacuggaccauccagagaugcagcggccccgugacccugcacuacaaggugaaccacgagggcuacagaaagcuggugaaggacauggaggacggccugaucaccagcggcgacagcuucuacaucagacugaaccugaacaucagcagccagcuggacgccugcaccaugagccugaagugcgacgacguggugcacgugagagacaccauguaccaggacagacacgaguggcugugcgccagaguggaccccuucaccgaccacgaccuggacaugggcaccauccccagcuacagcagagcccagcagcugcugcuggugaagcugcagagacugaugcacagaggcagcagagaggagguggacggcacccaccacacccugagagcccugagaaacacccugcagcccgaggaggcccugagcaccagcgaccccagagugagccccagacugagcagagccagcuuccuguucggccagcugcugcaguucgugagcagaagcgagaacaaguacaagagaaugaacagcaacgagagagugagaaucaucagcggcagcccccugggcagccuggccagaagcagccuggacgccaccaagcugcugaccgagaagcaggaggagcuggaccccgagagcgagcugggcaagaaccugagccugauccccuacagccuggugagagccuucuacugcgagagaagaagacccgugcuguucacccccaccgugcuggccaagacccuggugcagagacugcugaacagcggcggcgccauggaguucaccaucugcaagagcgacaucgugaccagagacgaguuccugagaagacagaagaccgagaccaucaucuacagcagagagaagaaccccaacgccuucgagugcaucgcccccgccaacaucgaggccguggccgccaagaacaagcacugccugcuggaggccggcaucggcugcaccagagaccugaucaagagcaacaucuaccccaucgugcuguucaucagagugugcgagaagaacaucaagagauucagaaagcugcugcccagacccgagaccgaggaggaguuccugagagugugcagacugaaggagaaggagcuggaggcccugcccugccuguacgccaccguggagcccgacauguggggcagcguggaggagcugcugagaguggugaaggacaagaucggcgaggagcagagaaagaccaucuggguggacgaggaccagcuguaa

SEQ ID NO: 14645 - RNA, 2223 nt, Artificial Sequence
  CARD14__Homo_sapiens__NP_001244899
augggcgagcugugcagaagagacagcgcccugaccgcccuggacgaggagacccugugggagaugauggagagccacagacacagaaucgugagaugcaucugccccagcagacugacccccuaccugagacaggccaaggugcugugccagcuggacgaggaggaggugcugcacagccccagacugaccaacagcgccaugagagccggccaccugcuggaccugcugaagaccagaggcaagaacggcgccaucgccuuccuggagagccugaaguuccacaaccccgacguguacacccuggugaccggccugcagcccgacguggacuucagcaacuucagcggccugauggagaccagcaagcugaccgagugccuggccggcgccaucggcagccugcaggaggagcugaaccaggagaagggccagaaggaggugcugcugagaagaugccagcagcugcaggagcaccugggccuggccgagaccagagccgagggccugcaccagcuggaggccgaccacagcagaaugaagagagaggugagcgcccacuuccacgaggugcugagacugaaggacgagaugcugagccugagccugcacuacagcaacgcccugcaggagaaggagcuggccgccagcagaugcagaagccugcaggaggagcuguaccugcugaagcaggagcugcagagagccaacauggugagcagcugcgagcuggagcugcaggagcagagccugagaaccgccagcgaccaggagagcggcgacgaggagcugaacagacugaaggaggagaacgagaagcugagaagccugaccuucagccuggccgagaaggacauccuggagcagagccuggacgaggccagaggcagcagacaggagcugguggagagaauccacagccugagagagagagccguggccgccgagagacagagagagcaguacugggaggagaaggagcagacccugcugcaguuccagaagagcaagauggccugccagcuguacagagagaaggugaacgcccugcaggcccaggugugcgagcugcagaaggagagagaccaggccuacagcgccagagacagcgcccagagagagaucagccagagccugguggagaaggacagccugagaagacagguguucgagcugaccgaccaggugugcgagcugagaacccagcugagacagcugcaggccgagccccccggcgugcugaagcaggaggccagaaccagagagcccugccccagagagaagcagagacuggugagaaugcacgccaucugccccagagacgacagcgacugcagccuggugagcagcaccgagagccagcugcugagcgaccugagcgccaccagcagcagagagcugguggacagcuucagaagcagcagccccgccccccccagccagcagagccuguacaagagaguggccgaggacuucggcgaggagcccuggagcuucagcagcugccuggagauccccgagggcgaccccggcgcccugcccggcgccaaggccggcgacccccaccuggacuacgagcugcuggacaccgccgaccugccccagcuggagagcagccugcagcccgugagccccggcagacuggacgugagcgagagcggcgugcugaugagaagaagacccgccagaagaauccugagccaggugaccaugcuggccuuccagggcgacgcccugcuggagcagaucagcgugaucggcggcaaccugaccggcaucuucauccacagagugacccccggcagcgccgccgaccagauggcccugagacccggcacccagaucgugaugguggacuacgaggccagcgagccccuguucaaggccgugcuggaggacaccacccuggaggaggccgugggccugcugagaagaguggacggcuucugcugccugagcgugaaggugaacaccgacggcuacaagagacugcugcaggaccuggaggccaagguggccaccagcggcgacagcuucuacaucagagugaaccuggccauggagggcagagccaagggcgagcugcaggugcacugcaacgaggugcugcacgugaccgacaccauguuccagggcugcggcugcuggcacgcccacagagugaacagcuacaccaugaaggacaccgccgcccacggcaccauccccaacuacagcagauaa

SEQ ID NO: 14646 - RNA, 594 nt, Artificial Sequence
  CARD16__Homo_sapiens__NP_001017534
auggccgacaaggugcugaaggagaagagaaagcuguucauccacagcaugggcgagggcaccaucaacggccugcuggacgagcugcugcagaccagagugcugaaccaggaggagauggagaaggugaagagagagaacgccaccgugauggacaagaccagagcccugaucgacagcgugauccccaagggcgcccaggccugccagaucugcaucaccuacaucugcgaggaggacagcuaccuggccgagacccugggccugagcgccgcccugcaggccgugcaggacaaccccgccaugcccaccugcagcagccccgagggcagaaucaagcugugcuuccuggaggacgcccagagaaucuggaagcagaagcugcagagaugccacgugcagaacaccaucaucaaguggagcgagagauacaccagcggcagcuucgagaugcaguggcuguuccugagaaccaacuucaucgagagauucuggagaaacauccugcugcugccccugcacaagggcagccuguaccccagaauccccggccugggcaaggagcugcagaccggcacccacaagcugagcuaa

SEQ ID NO: 14647 - RNA, 3114 nt, Artificial Sequence
  CARD6__Homo_sapiens__NP_115976
auggccaccgagagcacccccagcgagaucaucgagagagagagaaagaagcugcuggagauccugcagcacgaccccgacagcauccuggacacccugaccagcagaagacugaucagcgaggaggaguacgagacccuggagaacgugaccgaccugcugaagaagagcagaaagcugcugauccuggugcagaagaagggcgaggccaccugccagcacuuccugaagugccuguucagcaccuucccccagagcgccgccaucugcggccugagacacgaggugcugaagcacgagaacaccgugcccccccagagcaugggcgccagcagcaacagcgaggacgccuucagccccggcaucaagcagcccgaggcccccgagaucaccguguucuucagcgagaaggagcaccuggaccuggagaccagcgaguucuucagagacaagaagaccagcuacagagagaccgcccugagcgccagaaagaacgagaaggaguacgacacccccgaggugacccugagcuacagcguggagaaggugggcugcgaggugcccgccaccaucaccuacaucaaggacggccagagauacgaggagcuggacgacagccuguaccugggcaaggaggaguaccugggcagcguggacacccccgaggacgccgaggccaccguggaggaggagguguacgacgaccccgagcacgugggcuacgacggcgaggaggacuucgagaacagcgagaccaccgaguucagcggcgaggagcccagcuacgagggcagcgagaccagccugagccuggaggaggagcaggagaagagcaucgaggagagaaagaagguguucaaggacgugcugcugugccugaacauggacagaagcagaaaggugcugcccgacuucgugaagcaguucagccuggacagaggcugcaaguggacccccgagagccccggcgaccuggccuggaacuuccugaugaaggugcaggccagagacgugaccgccagagacagcauccugagccacaaggugcuggacgaggacagcaaggaggaccugcuggccggcguggagaaccuggagaucagagacauccagaccaucaacccccuggacgugcugugcgccaccaugcugugcagcgacagcagccugcagagacaggugaugagcaacauguaccagugccaguucgcccugccccugcugcugcccgacgccgagaacaacaagagcauccugaugcugggcgccaugaaggacaucgugaagaagcagagcacccaguucagcggcggccccaccgaggacaccgagaaguuccugacccugaugaagaugcccgugaucagcuucgugagacugggcuacugcagcuucagcaagagcagaauccugaacacccugcugagccccgcccagcugaagcugcacaagaucuuccugcaccaggaccugccccugcuggugcugcccagacagaucagcgacggccugguggagaucaccuggugcuuccccgacagcgacgacagaaaggagaaccccuucuuccagaagcccguggcccuggccaaccugagaggcaaccuggagagcuucuggacccaguucggcuuccugauggaggugagcagcgccguguucuucuucaccgacugccugggcgagaaggagugggaccugcugauguuccugggcgaggccgccaucgagagaugcuacuucgugcugagcagccaggccagagagagcgaggaggcccagaucuuccagagaauccugaaccugaagcccgcccagcugcuguucugggagagaggcgacgccggcgacagaagaaagaacauggagggccugcaggccgcccugcaggaggugauguucagcagcugccugagaugcgugagcguggaggacauggccgcccuggccagagagcugggcauccagguggacgaggacuucgagaacacccagagaauccaggugagcagcggcgagaacauggccggcaccgccgagggcgagggccagcagagacacagccagcugaagagcagcagcaagagccaggcccugaugcccauccaggagcccggcacccagugcgagcugagccagaaccugcagaaccuguacggcacccccguguucagacccgugcuggagaacagcuggcuguuccccaccagaaucggcggcaacuucaaccacgugagccugaaggccagcugggugaugggcagacccuucggcagcgagcagagacccaagugguuccacccccugcccuuccagaacgccggcgcccagggcagaggcaagagcuucggcauccagagcuuccacccccagaucuucuacagcggcgagagauucaugaaguucagcagaguggccagaggcugccacagcaacggcaccuucggcagacugcccagacccaucugccagcacgugcaggccugccccgagagaccccagaugaugggcacccuggagagaagcagagccguggccagcaagaucggccacagcuacagccuggacagccagcccgccagagccgugggcaagcccuggccccagcaggccugcaccagagugaccgagcugaccgaggccaccggcaagcugaucagaaccagccacaucggcaagccccacccccagagcuuccagcccgccgccgccacccagaagcugagacccgccagccagcagggcgugcagaugaagacccagggcggcgccagcaaccccgcccugcagaucggcagccaccccaugugcaagagcagccaguucaagagcgaccagagcaaccccagcaccgugaagcacagccagcccaagcccuuccacagcgugcccagccagcccaagagcagccagaccaagagcugccagagccagcccagccagaccaagcccagccccugcaagagcacccagcccaagcccagccagcccuggcccccccagagcaagcccagccagcccagacccccccagcccaagagcagcagcaccaaccccagccaggccaaggcccaccacagcaaggccggccagaagagaggcggcaagcacuaa

SEQ ID NO: 14648 - RNA, 1614 nt, Artificial Sequence
  CARD8__Homo_sapiens__NP_001171829
auggagaagaaggagugccccgagaagagcagcagcagcgaggaggagcugcccagaagagacagcggcagcagcagaaacaucgacgccagcaagcugaucagacugcagggcagcagaaagcugcugguggacaacagcaucagagagcugcaguacaccaagaccggcaucuucuuccaggccgaggccugcgugaccaacgacaccguguacagagagcugcccugcgugagcgagacccugugcgacaucagccacuucuuccaggaggacgacgagaccgaggccgagccccugcuguucagagccgugcccgagugccagcugagcggcggcgacauccccagcgugagcgaggagcaggagagcagcgagggccaggacagcggcgacaucugcagcgaggagaaccagaucgugagcagcuacgccagcaaggugugcuucgagaucgaggaggacuacaagaacagacaguuccugggccccgagggcaacguggacguggagcugaucgacaagagcaccaacagauacagcgugugguuccccaccgccggcugguaccuguggagcgccaccggccugggcuuccuggugagagacgaggugaccgugaccaucgccuucggcagcuggagccagcaccuggcccuggaccugcagcaccacgagcaguggcuggugggcggcccccuguucgacgugaccgccgagcccgaggaggccguggccgagauccaccugccccacuucaucagccugcaggccggcgagguggacgugagcugguuccugguggcccacuucaagaacgagggcauggugcuggagcaccccgccagaguggagcccuucuacgccgugcuggagagccccagcuucagccugaugggcauccugcugagaaucgccagcggcaccagacugagcauccccaucaccagcaacacccugaucuacuaccacccccaccccgaggacaucaaguuccaccuguaccuggugcccagcgacgcccugcugaccaaggccaucgacgacgaggaggacagauuccacggcgugagacugcagaccagcccccccauggagccccugaacuucggcagcagcuacaucgugagcaacagcgccaaccugaaggugaugcccaaggagcugaagcugagcuacagaagccccggcgagauccagcacuucagcaaguucuacgccggccagaugaaggagcccauccagcuggagaucaccgagaagagacacggcacccuggugugggacaccgaggugaagcccguggaccugcagcugguggccgccagcgcccccccccccuucagcggcgccgccuucgugaaggagaaccacagacagcugcaggccagaaugggcgaccugaagggcgugcuggacgaccugcaggacaacgaggugcugaccgagaacgagaaggagcugguggagcaggagaagaccagacagagcaagaacgaggcccugcugagcaugguggagaagaagggcgaccuggcccuggacgugcuguucagaagcaucagcgagagagaccccuaccuggugagcuaccugagacagcagaaccuguaa

SEQ ID NO: 14649 - RNA, 1611 nt, Artificial Sequence
  CARD9__Homo_sapiens__NP_434700
augagcgacuacgagaacgacgacgagugcuggagcgugcuggagggcuucagagugacccugaccagcgugaucgaccccagcagaaucacccccuaccugagacagugcaaggugcugaaccccgacgacgaggagcaggugcugagcgaccccaaccuggugaucagaaagagaaaggugggcgugcugcuggacauccugcagagaaccggccacaagggcuacguggccuuccuggagagccuggagcuguacuacccccagcuguacaagaaggugaccggcaaggagcccgccagaguguucagcaugaucaucgacgccagcggcgagagcggccugacccagcugcugaugaccgaggugaugaagcugcagaagaaggugcaggaccugaccgcccugcugagcagcaaggacgacuucaucaaggagcugagagugaaggacagccugcugagaaagcaccaggagagagugcagagacugaaggaggagugcgaggccggcagcagagagcugaagagaugcaaggaggagaacuacgaccuggccaugagacuggcccaccagagcgaggagaagggcgccgcccugaugagaaacagagaccugcagcuggagaucgaccagcugaagcacagccugaugaaggccgaggacgacugcaagguggagagaaagcacacccugaagcugagacacgccauggagcagagacccagccaggagcugcugugggagcugcagcaggagaaggcccugcugcaggccagagugcaggagcuggaggccagcgugcaggagggcaagcuggacagaagcagccccuacauccaggugcuggaggaggacuggagacaggcccugagagaccaccaggagcaggccaacaccaucuucagccugagaaaggaccugagacagggcgaggccagaagacugagaugcauggaggagaaggagauguucgagcugcagugccuggcccugagaaaggacagcaagauguacaaggacagaaucgaggccauccugcugcagauggaggagguggccaucgagagagaccaggccaucgccaccagagaggagcugcacgcccagcacgccagaggccugcaggagaaggacgcccugagaaagcaggugagagagcugggcgagaaggccgacgagcugcagcugcagguguuccagugcgaggcccagcugcuggccguggagggcagacugagaagacagcagcuggagacccuggugcugagcagcgaccuggaggacggcagccccagaagaagccaggagcugagccugccccaggaccuggaggacacccagcugagcgacaagggcugccuggccggcggcggcagccccaagcagcccuucgccgcccugcaccaggagcaggugcugagaaacccccacgacgccggccugagcagcggcgagccccccgagaaggagagaagaagacugaaggagagcuucgagaacuacagaagaaagagagcccugagaaagaugcagaagggcuggagacagggcgaggaggacagagagaacaccaccggcagcgacaacaccgacaccgagggcagcuaa

SEQ ID NO: 14650 - RNA, 2178 nt, Artificial Sequence
  CARF__Homo_sapiens__NP_001098056
auggagcagagcaacgacagccugagagugaaccacaacgacggcgaggagagcaagaccagcgcccagguguucgagcaccugaucugcauggacagcagagacagcagcuucggccagaacgacagccccaccgugcugcccaucaccaccagagaggccaacaacagccugaucagccagaacauccccggcccccugacccagacccagacccugagcgccgagcaguuccaccugguggaccagaacggccaggccauccaguacgagcugcagagccugggcgagagcaacgcccagaugaugaucguggccagccccaccgagaacggccaggugcugagagugaucccccccacccagaccggcauggcccaggugaucaucccccagggccagcugguggacgugaacagccccagagacgugcccgaggagaagcccagcaacagaaaccugcccaccgugagaguggacacccuggccgacaacaccagcaacuacauccugcacccccagaccagcuucccccugcccaagaagagcgugaccggcaugcuggaggagccccugcugggcccccugcagccccugagcagcaacacccccaucugggccugcagacugagaagcugcgagaagaucggcgacagcuacagaggcuacugcgugagcgagaccgagcuggagagcgugcugaccuuccacaagcagcagacccagagcguguggggcaccagacagagccccagccccgccaagcccgccaccagacugauguggaagagccaguacgugcccuacgacggcauccccuucgugaacgccggcagcagagccguggugauggagugccaguacggccccagaagaaagggcuuccagcugaagaaggugagcgagcaggagagcagaagcugccagcuguacaaggccaccugccccgccagaaucuacaucaagaaggugcagaaguuccccgaguacagagugcccaccgaccccaagaucgacaagaagaucaucagaauggagcaggagaaggccuucaacaugcugaagaagaaccugguggacgccggcggcgugcugagaugguacgugcagcugcccacccagcaggcccaccaguaccacgagcuggagacccccugccugacccugagccccagccccuuccccgugagcagccuggaggaggaggagaccgccgugagagacgagaacugcgcccugcccagcagacugcacccccagguggcccacaagauccaggagcuggugagccagggcaucgagcagguguacgccgugagaaagcagcugagaaaguucguggagagagagcuguucaagcccgacgaggugcccgagagacacaaccugagcuucuuccccaccgugaacgacaucaagaaccacauccacgaggugcagaagagccugagaaacggcgacaccguguacaacagcgagaucauccccgccacccugcaguggaccaccgacagcggcaacauccugaaggagaccaugaccgugaccuucgccgagggcaacagccccggcgagagcaucaccaccaagguggagaccaaccagaccagaggcagccugagccccgagcccacccaccugcugagcagccugagcagcuuccagcccaagaucuucacccagcugcagggccugcagcugcagcccagauacaccagccccgacgagagccccgccguggugagcgugaacaaccagcccagcagcagccccagcggccugcuggacaccaucggcagcgccgugaugaacaacaacagccugcugcugggccagagccacagccugcagagagacaccugccugacccagaacaacagcaccgccagcaccaugggcaaccugcccgagcccgaccagaaccugguggccauggacgagcugguggaggugggcgacguggaggacaccggcaaccuggagggcaccgugcacagaauccugcugggcgacgugcagaccauccccauccagaucaucgacaaccacagcgcccugaucgaggagaaccccgagagcaccaucagcgugagccaggugaagcaggagcccaaggagcccgcccugagcauggaggccaagaagaccguggacuacaagaagcugagcgccaccuaa

SEQ ID NO: 14651 - RNA, 1044 nt, Artificial Sequence
  CARKD__Homo_sapiens__NP_001229810
auggugaccagagccggcgccggcaccgccguggccggcgccguggugguggcccugcugagcgccgcccuggcccuguacggccccccccuggacgccgugcuggagagagccuucagccugagaaaggcccacagcaucaaggacauggagaacacccugcagcuggugagaaacaucauccccccccugagcagcaccaagcacaagggccaggacggcagaaucggcguggugggcggcugccaggaguacaccggcgcccccuacuucgccgccaucagcgcccugaaggugggcgccgaccugagccacguguucugcgccagcgccgccgcccccgugaucaaggccuacagccccgagcugaucgugcaccccgugcuggacagccccaacgccgugcacgagguggagaaguggcugcccagacugcacgcccugguggugggccccggccugggcagagacgacgcccugcugagaaacgugcagggcauccuggaggugagcaaggccagagacauccccguggugaucgacgccgacggccuguggcugguggcccagcagcccgcccugauccacggcuacagaaaggccgugcugacccccaaccacguggaguucagcagacuguacgacgccgugcugagaggccccauggacagcgacgacagccacggcagcgugcugagacugagccaggcccugggcaacgugaccguggugcagaagggcgagagagacauccugagcaacggccagcaggugcuggugugcagccaggagggcagcagcagaagaugcggcggccagggcgaccugcugagcggcagccugggcgugcuggugcacugggcccugcuggccggcccccagaagaccaacggcagcagcccccugcugguggccgccuucggcgccugcagccugaccagacagugcaaccaccaggccuuccagaagcacggcagaagcaccaccaccagcgacaugaucgccgaggugggcgccgccuucagcaagcuguucgagaccuaa

SEQ ID NO: 14652 - RNA, 1827 nt, Artificial Sequence
  CARM1__Homo_sapiens__NP_954592
auggccgccgccgccgccgccgugggccccggcgccggcggcgccggcagcgccgugcccggcggcgccggccccugcgccaccgugagcguguuccccggcgccagacugcugaccaucggcgacgccaacggcgagauccagagacacgccgagcagcaggcccugagacuggaggugagagccggccccgacagcgccggcaucgcccuguacagccacgaggacgugugcguguucaagugcagcgugagcagagagaccgagugcagcagagugggcaagcagagcuucaucaucacccugggcugcaacagcgugcugauccaguucgccacccccaacgacuucugcagcuucuacaacauccugaagaccugcagaggccacacccuggagagaagcguguucagcgagagaaccgaggagagcagcgccgugcaguacuuccaguucuacggcuaccugagccagcagcagaacaugaugcaggacuacgugagaaccggcaccuaccagagagccauccugcagaaccacaccgacuucaaggacaagaucgugcuggacgugggcugcggcagcggcauccugagcuucuucgccgcccaggccggcgccagaaagaucuacgccguggaggccagcaccauggcccagcacgccgaggugcuggugaagagcaacaaccugaccgacagaaucguggugauccccggcaagguggaggaggugagccugcccgagcagguggacaucaucaucagcgagcccaugggcuacaugcuguucaacgagagaaugcuggagagcuaccugcacgccaagaaguaccugaagcccagcggcaacauguuccccaccaucggcgacgugcaccuggcccccuucaccgacgagcagcuguacauggagcaguucaccaaggccaacuucugguaccagcccagcuuccacggcguggaccugagcgcccugagaggcgccgccguggacgaguacuucagacagcccgugguggacaccuucgacaucagaauccugauggccaagagcgugaaguacaccgugaacuuccuggaggccaaggagggcgaccugcacagaaucgagauccccuucaaguuccacaugcugcacagcggccuggugcacggccuggccuucugguucgacguggccuucaucggcagcaucaugaccguguggcugagcaccgcccccaccgagccccugacccacugguaccaggugagaugccuguuccagagcccccuguucgccaaggccggcgacacccugagcggcaccugccugcugaucgccaacaagagacagagcuacgacaucagcaucguggcccagguggaccagaccggcagcaagagcagcaaccugcuggaccugaagaaccccuucuucagauacaccggcaccacccccagccccccccccggcagccacuacaccagccccagcgagaacauguggaacaccggcagcaccuacaaccugagcagcggcauggccguggccggcaugcccaccgccuacgaccugagcagcgugaucgccagcggcagcagcgugggccacaacaaccugaucccccuggccaacaccggcaucgugaaccacacccacagcagaaugggcagcaucaugagcaccggcaucgugcagggcagcagcggcgcccagggcagcggcggcggcagcaccagcgcccacuacgccgugaacagccaguucaccaugggcggccccgccaucagcauggccagccccaugagcauccccaccaacaccaugcacuacggcagcuaa

SEQ ID NO: 14653 - RNA, 2496 nt, Artificial Sequence
  CARS__Homo_sapiens__NP_001014437
auggccgacagcagcggccagcaggcccccgacuacagaagcauccugagcaucagcgacgaggccgccagagcccaggcccugaacgagcaccugagcaccagaagcuacgugcagggcuacagccugagccaggccgacguggacgccuucagacagcugagcgccccccccgccgacccccagcuguuccacguggccagaugguucagacacaucgaggcccugcugggcagccccugcggcaagggccagcccugcagacugcaggccagcaagggcagaagagugcagccccaguggagcccccccgccggcacccagcccugcagacugcaccuguacaacagccugaccagaaacaaggagguguucaucccccaggacggcaagaaggugaccugguacugcugcggccccaccguguacgacgccagccacaugggccacgccagaagcuacaucagcuucgacauccugagaagagugcugaaggacuacuucaaguucgacguguucuacugcaugaacaucaccgacaucgacgacaagaucaucaagagagccagacagaaccaccuguucgagcaguacagagagaagagacccgaggccgcccagcugcuggaggacgugcaggccgcccugaagcccuucagcgugaagcugaacgagaccaccgaccccgacaagaagcagaugcuggagagaauccagcacgccgugcagcuggccaccgagccccuggagaaggccgugcagagcagacugaccggcgaggaggugaacagcugcguggaggugcugcuggaggaggccaaggaccugcugagcgacuggcuggacagcacccugggcugcgacgugaccgacaacagcaucuucagcaagcugcccaaguucugggagggcgacuuccacagagacauggaggcccugaacgugcugccccccgacgugcugaccagagugagcgaguacgugcccgagaucgugaacuucgugcagaagaucguggacaacggcuacggcuacgugagcaacggcagcguguacuucgacaccgccaaguucgccagcagcgagaagcacagcuacggcaagcuggugcccgaggccgugggcgaccagaaggcccugcaggagggcgagggcgaccugagcaucagcgccgacagacugagcgagaagagaagccccaacgacuucgcccuguggaaggccagcaagcccggcgagcccagcuggcccugccccuggggcaagggcagacccggcuggcacaucgagugcagcgccauggccggcacccugcugggcgccagcauggacauccacggcggcggcuucgaccugagauucccccaccacgacaacgagcuggcccagagcgaggccuacuucgagaacgacugcugggugagauacuuccugcacaccggccaccugaccaucgccggcugcaagaugagcaagagccugaagaacuucaucaccaucaaggacgcccugaagaagcacagcgccagacagcugagacuggccuuccugaugcacagcuggaaggacacccuggacuacagcagcaacaccauggagagcgcccugcaguacgagaaguuccugaacgaguucuuccugaacgugaaggacauccugagagcccccguggacaucaccggccaguucgagaaguggggcgaggaggaggccgagcugaacaagaacuucuacgacaagaagaccgccauccacaaggcccugugcgacaacguggacaccagaaccgugauggaggagaugagagcccuggugagccagugcaaccuguacauggccgccagaaaggccgugagaaagagacccaaccaggcccugcuggagaacaucgcccuguaccugacccacaugcugaagaucuucggcgccguggaggaggacagcagccugggcuuccccgugggcggccccggcaccagccugagccuggaggccaccgugaugcccuaccugcaggugcugagcgaguucagagagggcgugagaaagaucgccagagagcagaaggugcccgagauccugcagcugagcgacgcccugagagacaacauccugcccgagcugggcgugagauucgaggaccacgagggccugcccaccguggugaagcugguggacagaaacacccugcugaaggagagagaggagaagagaagaguggaggaggagaagagaaagaagaaggaggaggccgccagaagaaagcaggagcaggaggccgccaagcuggccaagaugaagaucccccccagcgagauguuccugagcgagaccgacaaguacagcaaguucgacgagaacggccugcccacccacgacauggagggcaaggagcugagcaagggccaggccaagaagcugaagaagcuguucgaggcccaggagaagcuguacaaggaguaccugcagauggcccagaacggcagcuuccaguaa

SEQ ID NO: 14654 - RNA, 351 nt, Artificial Sequence
  CARTPT__Homo_sapiens__NP_004282
auggagagcagcagagugagacugcugccccugcugggcgccgcccugcugcugaugcugccccugcugggcaccagagcccaggaggacgccgagcugcagcccagagcccuggacaucuacagcgccguggacgacgccagccacgagaaggagcugaucgaggcccugcaggaggugcugaagaagcugaagagcaagagagugcccaucuacgagaagaaguacggccaggugcccaugugcgacgccggcgagcagugcgccgugagaaagggcgccagaaucggcaagcugugcgacugccccagaggcaccagcugcaacagcuuccugcugaagugccuguaa

SEQ ID NO: 14655 - RNA, 2073 nt, Artificial Sequence
  CASC1__Homo_sapiens__NP_001076441
augagacagaccggcggcggcgccaccaccgacagcgccagccccgugcugaacaacgugaucaagagccagagcuacuucaccgccaagagagugggccugggcaacaacagcuaccugggcgugggcagacccagcagccagcaguggcugagccugcccggccccggcggccagggccccaaggccaagaagagcggcagcaagaagaagaaggugaccaaggccgagagacugaagcugcugcaggaggaggaggagagaagacugaaggaggaggaggaggccagacugaaguacgagaaggaggagauggagagacuggagauccagagaaucgagaaggagaaguggcacagacuggaggccaaggaccuggagagaagaaacgaggagcuggaggagcuguaccugcuggagagaugcuuccccgaggccgagaagcugaagcaggagaccaagcugcugagccaguggaagcacuacauccagugcgacggcagccccgaccccagcguggcccaggagaugaacaccuucaucagccuguggaaggagaagaccaacgagaccuucgaggaggugaucgagaagagcaagguggugcugaaccugaucgagaagcugaaguucauccugcuggagaccccccccugcgaccugcaggacaagaacaucauccaguaccaggagagcauccugcagcugcaggagcugcugcaccugaaguucggcguggccaccgagauccugcugaagcaggccagcacccuggccgaccuggacagcggcaacauggagaaggugaucaaggacgagaacgugacccuguacgugugggccaaccugaagaagaaccccagacacagaagcgugagauucagcgagacccagaucggcuucgagauccccagaauccuggccaccagcgacaucgccgugagacugcugcacacccacuacgaccacgugagcgcccugcaccccgugagcacccccagcaaggaguacaccagcgccgugaccgagcuggugaaggacgacgugaagaacguggagaaggccaucagcaaggagguggaggaggagagcaagcagcaggagagaggcagccaccugauccaggaggaggagaucaagguggaggaggagcagggcgacaucgaggugaagaugagcagcgccgaggaggagagcgaggccaucaagugcgagagagagaugaaggugcugagcgagaccgugagcgccgcccagcugcugcugguggagaacagcagcgagaagcccgacuucuucgaggacaacgugguggaccugugccaguucaccacccugggcggcguguaccaccuggacauccuggagcugcccccccagugcaagcccgugaagggcuggaugaucguggagauccugaaggagggccugcagaaguacaccuacccccccgagaccaccgaggaguucgagaccgagaacgccuucccccccaucgaggugacccuggaggugcacgagaacgugaucuucuucgaggaccccgugguggugagaugggacgccgagggcaagcacuggagaaccgacggcaucagcaacgugagcuacaagcccaaggagagacuggugaccuucagccuggacaccuucggccccgugacccugauccaggacgcccacaucaacaugcccuaccagagcugggagcugagaccccuggacgugaacaaggugcugcugaccgugaccaccguguucaccgagauccagauccagaucaaggagaaccugugcaugcugagcagcaucaagcugaaggacaagaagcacaucagcauccuggagggcaccuggaugacccccauccccuucaucaucgcccugaaggaggccggccugaacaucuuccccaccagacacagccacuucuacgugaucaucaacaacaaggugccccugguggaggugaaggccuacagacagauggcccugcugagcagcgccuucgccuucggcuggagcaaguggaaccugcugugcaacagcaccaaggugguguucaagugguaa

SEQ ID NO: 14656 - RNA, 2112 nt, Artificial Sequence
  CASC3__Homo_sapiens__XP_005257220
auggccgacagaagaagacagagagccagccaggacaccgaggacgaggagagcggcgccagcggcagcgacagcggcggcagcccccugagaggcggcggcagcugcagcggcagcgccggcggcggcggcagcggcagccugcccagccagagaggcggcagaaccggcgcccugcaccugagaagaguggagagcggcggcgccaagagcgccgaggagagcgagugcgagagcgaggacggcaucgagggcgacgccgugcugagcgacuacgagagcgccgaggacagcgagggcgaggagggcgaguacagcgaggaggagaacagcaagguggagcugaagagcgaggccaacgacgccgugaacagcagcaccaaggaggagaagggcgaggagaagcccgacaccaagagcaccgugaccggcgagagacagagcggcgacggccaggagagcaccgagcccguggagaacaaggugggcaagaagggccccaagcaccuggacgacgacgaggacagaaagaaccccgccuacauccccagaaagggccuguucuucgagcacgaccugagaggccagacccaggaggaggaggugagacccaagggcagacagagaaagcuguggaaggacgagggcagaugggagcacgacaaguucagagaggacgagcaggcccccaagagcagacaggagcugaucgcccuguacggcuacgacaucagaagcgcccacaaccccgacgacaucaagcccagaagaaucagaaagcccagauacggcagccccccccagagagaccccaacuggaacggcgagagacugaacaagagccacagacaccagggccugggcggcacccugccccccagaaccuucaucaacagaaacgccgccggcaccggcagaaugagcgcccccagaaacuacagcagaagcggcggcuucaaggagggcagagccggcuucagacccguggaggccggcggccagcacggcggcagaagcggcgagaccgugaagcacgagaucagcuacagaagcagaagacuggagcagaccagcgugagagaccccagccccgaggccgacgcccccgugcugggcagccccgagaaggaggaggccgccagcgagccccccgccgccgcccccgacgccgccccccccccccccgacagacccaucgagaagaagagcuacagcagagccagaagaaccagaaccaaggugggcgacgccgugaagcuggccgaggaggugccccccccccccgagggccugauccccgccccccccgugcccgagaccacccccaccccccccaccaagaccggcaccugggaggcccccguggacagcagcaccagcggccuggagcaggacguggcccagcugaacaucgccgagcagaacuggagccccggccagcccagcuuccugcagcccagagagcugagaggcaugcccaaccacauccacaugggcgccggcccccccccccaguucaacagaauggaggagaugggcgugcagggcggcagagccaagagauacagcagccagagacagagacccgugcccgagccccccgccccccccgugcacaucagcaucauggagggccacuacuacgacccccugcaguuccagggccccaucuacacccacggcgacagccccgccccccugcccccccagggcaugcuggugcagcccggcaugaaccugccccaccccggccugcacccccaccagacccccgccccccugcccaaccccggccuguaccccccccccgugagcaugagccccggccagccccccccccagcagcugcuggcccccaccuacuucagcgcccccggcgugaugaacuucggcaaccccagcuaccccuacgcccccggcgcccugcccccccccccccccccccaccuguaccccaacacccaggcccccagccagguguacggcggcgugaccuacuacaaccccgcccagcagcaggugcagcccaagcccagcccccccagaagaaccccccagcccgugaccaucaagccccccccccccgagguggugagcagaggcagcagcuaa

SEQ ID NO: 14657 - RNA, 1311 nt, Artificial Sequence
  CASC4__Homo_sapiens__NP_612432
auggugggcuucggcgccaacagaagagccggcagacugcccagccuggugcugguggugcugcugguggugaucguggugcuggccuucaacuacuggagcaucagcagcagacacgugcugcugcaggaggagguggccgagcugcagggccaggugcagagaaccgagguggccagaggcagacuggagaagagaaacagcgaccugcugcugcugguggacacccacaagaagcagaucgaccagaaggaggccgacuacggcagacugagcagcagacugcaggccagagagggccugggcaagagaugcgaggacgacaaggugaagcugcagaacaacaucagcuaccagauggccgacauccaccaccugaaggagcagcuggccgagcugagacaggaguuccugagacaggaggaccagcugcaggacuacagaaagaacaacaccuaccuggugaagagacuggaguacgagagcuuccagugcggccagcagaugaaggagcugagagcccagcacgaggagaacaucaagaagcuggccgaccaguuccuggaggagcagaagcaggagacccagaagauccagagcaacgacggcaaggagcuggacaucaacaaccagguggugcccaagaacauccccaagguggccgagaacguggccgacaagaacgaggagcccagcagcaaccacaucccccacggcaaggagcagaucaagagaggcggcgacgccggcaugcccggcaucgaggagaacgaccuggccaagguggacgaccugccccccgcccugagaaagccccccaucagcgugagccagcacgagagccaccaggccaucagccaccugcccaccggccagccccugagccccaacaugccccccgacagccacaucaaccacaacggcaaccccggcaccagcaagcagaaccccagcagcccccugcagagacugauccccggcagcaaccuggacagcgagcccagaauccagaccgacauccugaagcaggccaccaaggacagagugagcgacuuccacaagcugaagcagagcagauucuucgacgagaacgagagccccguggacccccagcacggcagcaagcuggccgacuacaacggcgacgacggcaacgugggcgaguacgaggccgacaagcaggccgagcuggccuacaacgaggaggaggacggcgacggcggcgaggaggacgugcaggacgacgaggagagagagcugcagauggaccccgccgacuacggcaagcagcacuucaacgacgugcuguaa

SEQ ID NO: 14658 - RNA, 6951 nt, Artificial Sequence
  CASC5__Homo_sapiens__NP_653091
auggacggcgugagcagcgaggccaacgaggagaacgacaacaucgagagacccgugagaagaagacacagcagcauccugaagccccccagaagcccccugcaggaccugagaggcggcaacgagagagugcaggagagcaacgcccugagaaacaagaagaacagcagaagagugagcuucgccgacaccaucaagguguuccagaccgagagccacaugaagaucgugagaaagagcgagauggaggagaccgagaccggcgagaaccugcugcugauccagaacaagaagcuggaggacaacuacugcgagaucaccggcaugaacacccugcugagcgcccccauccacacccagaugcagcagaaggaguucagcaucaucgagcacaccagagagagaaagcacgccaacgaccagaccgugaucuucagcgacgagaaccagauggaccugaccagcagccacaccgugaugaucaccaagggccugcuggacaaccccaucagcgagaagagcaccaagaucgacaccaccagcuuccuggccaaccugaagcugcacaccgaggacagcagaaugaagaaggaggugaacuucagcguggaccagaacaccagcagcgagaacaagaucgacuucaacgacuucaucaagagacugaagaccggcaagugcagcgccuuccccgacgugcccgacaaggagaacuucgagauccccaucuacagcaaggagcccaacagcgccagcagcacccaccagaugcacgugagccugaaggaggacgagaacaacagcaacaucaccagacuguucagagagaaggacgacggcaugaacuucacccagugccacaccgccaacauccagacccugauccccaccagcagcgagaccaacagcagagagagcaagggcaacgacaucaccaucuacggcaacgacuucauggaccugaccuucaaccacacccugcagauccugcccgccaccggcaacuucagcgagaucgagaaccagacccagaacgccauggacgugaccaccggcuacggcaccaaggccagcggcaacaagaccguguucaagagcaagcagaacaccgccuuccaggaccugagcaucaacagcgccgacaagauccacaucaccagaagccacaucaugggcgccgagacccacaucgugagccagaccugcaaccaggacgccagaauccuggccaugacccccgagagcaucuacagcaaccccagcauccagggcugcaagaccguguucuacagcagcugcaacgacgccauggagaugaccaagugccugagcaacaugagagaggagaagaaccugcugaagcacgacagcaacuacgccaagauguacugcaaccccgacgccaugagcagccugaccgagaagaccaucuacagcggcgaggagaacauggacaucaccaagagccacaccguggccaucgacaaccagaucuucaagcaggaccagagcaacgugcagaucgccgccgcccccacccccgagaaggagaugaugcugcagaaccugaugaccaccagcgaggacggcaagaugaacgugaacugcaacagcgugccccacgugagcaaggagagaauccagcagagccugagcaacccccugagcaucagccugaccgacagaaagaccgagcugcugagcggcgagaacauggaccugaccgagagccacaccagcaaccugggcagccaggugccccuggccgccuacaaccuggcccccgagagcaccagcgagagccacagccagagcaagagcagcagcgacgagugcgaggagaucaccaagagcagaaacgagcccuuccagagaagcgacaucaucgccaagaacagccugaccgacaccuggaacaaggacaaggacugggugcugaagauccugcccuaccuggacaaggacagcccccagagcgccgacugcaaccaggagaucgccaccagccacaacaucguguacugcggcggcgugcuggacaagcagaucaccaacagaaacaccgugagcugggagcagagccuguucagcaccaccaagccccuguucagcagcggccaguucagcaugaagaaccacgacaccgccaucagcagccacaccgugaagagcgugcugggccagaacagcaagcuggccgagccccugagaaagagccugagcaaccccacccccgacuacugccacgacaagaugaucaucugcagcgaggaggagcagaacauggaccugaccaagagccacaccguggugaucggcuucggccccagcgagcugcaggagcugggcaagaccaaccuggagcacaccaccggccagcugaccaccaugaacagacagaucgccgugaagguggagaagugcggcaagagccccaucgagaagagcggcgugcugaagagcaacugcaucauggacgugcuggaggacgagagcgugcagaagcccaaguuccccaaggagaagcagaacgugaagaucuggggcagaaagagcgugggcggccccaagaucgacaagaccaucguguucagcgaggacgacaagaacgacauggacaucaccaagagcuacaccaucgagaucaaccacagaccccugcuggagaagagagacugccaccuggugccccuggccggcaccagcgagaccauccuguacaccugcagacaggacgacauggagaucaccagaagccacaccaccgcccuggagugcaagaccgugagccccgacgagaucaccaccagacccauggacaagaccgugguguucguggacaaccacguggagcuggagaugaccgagagccacaccguguucaucgacuaccaggagaaggagagaaccgacagacccaacuucgagcugagccagagaaagagccugggcacccccaccgugaucugcacccccaccgaggagagcguguucuuccccggcaacggcgagagcgacagacugguggccaacgacagccagcugaccccccuggaggaguggagcaacaacagaggccccguggagguggccgacaacauggagcugagcaagagcgccaccugcaagaacaucaaggacgugcagagccccggcuuccugaacgagccccugagcagcaagagccagagaagaaagagccugaagcugaagaacgacaagaccaucguguucagcgagaaccacaagaacgacauggacaucacccagagcugcaugguggagaucgacaacgagagcgcccuggaggacaaggaggacuuccaccuggccggcgccagcaagaccauccuguacagcugcggccaggacgacauggagaucaccagaagccacaccaccgcccuggagugcaagacccugcugcccaacgagaucgccaucagacccauggacaagaccgugcuguucaccgacaacuacagcgaccuggaggugaccgacagccacaccguguucaucgacugccaggccaccgagaagauccuggaggagaaccccaaguucggcaucggcaagggcaagaaccugggcgugagcuuccccaaggacaacagcugcgugcaggagaucgccgagaagcaggcccuggccgugggcaacaagaucgugcugcacaccgagcagaagcagcagcuguucgccgccaccaacagaaccaccaacgagaucaucaaguuccacagcgccgccauggacgagaaggugaucggcaaggugguggaccaggccugcacccuggagaaggcccagguggagagcugccagcugaacaacagagacagaagaaacguggacuucaccagcagccacgccaccgccgugugcggcagcagcgacaacuacagcugccugcccaacgugaucagcugcaccgacaaccuggagggcagcgccaugcugcugugcgacaaggacgaggagaaggccaacuacugccccgugcagaacgaccuggccuacgccaacgacuucgccagcgaguacuaccuggagagcgagggccagccccugagcgcccccugcccccugcuggagaaggaggaggugauccagaccagcaccaagggccagcuggacugcgugaucacccugcacaaggaccaggaccugaucaaggaccccagaaaccugcuggccaaccagacccugguguacagccaggaccugggcgagaugaccaagcugaacagcaagagagugagcuucaagcugcccaaggaccagaugaagguguacguggacgacaucuacgugaucccccagccccacuucagcaccgaccagcccccccugcccaagaagggccagagcagcaucaacaaggaggaggugauccugagcaaggccggcaacaagagccugaacaucaucgagaacagcagcgcccccaucugcgagaacaagcccaagauccugaacagcgaggagugguucgccgccgccugcaagaaggagcugaaggagaacauccagaccaccaacuacaacaccgcccuggacuuccacagcaacagcgacgugaccaagcaggugauccagacccacgugaacgccggcgaggcccccgaccccgugaucaccagcaacgugcccugcuuccacagcaucaagcccaaccugaacaaccugaacggcaagaccggcgaguuccuggccuuccagaccgugcaccugcccccccugcccgagcagcugcuggagcugggcaacaaggcccacaacgacaugcacaucgugcaggccaccgagauccacaacaucaacaucaucagcagcaacgccaaggacagcagagacgaggagaacaagaagagccacaacggcgccgagaccaccagccugccccccaagaccguguucaaggacaaggugagaagaugcagccugggcaucuuccugcccagacugcccaacaagagaaacugcagcgugaccggcaucgacgaccuggagcagauccccgccgacaccaccgacaucaaccaccuggagacccagcccgugagcagcaaggacagcggcaucggcagcguggccggcaagcugaaccugagccccagccaguacaucaacgaggagaaccugcccguguaccccgacgagaucaacagcagcgacagcaucaacaucgagaccgaggagaaggcccugaucgagaccuaccagaaggagaucagccccuacgagaacaagaugggcaagaccugcaacagccagaagagaaccugggugcaggaggaggaggacauccacaaggagaagaagaucagaaagaacgagaucaaguucagcgacaccacccaggacagagagaucuucgaccaccacaccgaggaggacaucgacaagagcgccaacagcgugcugaucaagaaccugagcagaacccccagcagcugcagcagcagccuggacagcaucaaggccgacggcaccagccuggacuucagcaccuacagaagcagccagauggagagccaguuccugagagacaccaucugcgaggagagccugagagagaagcugcaggacggcagaaucaccaucagagaguucuucauccugcugcaggugcacauccugauccagaagcccagacagagcaaccugcccggcaacuucaccgugaacaccccccccacccccgaggaccugaugcugagccaguacguguacagacccaagauccagaucuacagagaggacugcgaggccagaagacagaagaucgaggagcugaagcugagcgccagcaaccaggacaagcugcugguggacaucaacaagaaccugugggagaagaugagacacugcagcgacaaggagcugaaggccuucggcaucuaccugaacaagaucaagagcugcuucaccaagaugaccaagguguucacccaccagggcaagguggcccuguacggcaagcuggugcagagcgcccagaacgagagagagaagcugcagaucaagaucgacgagauggacaagauccugaagaagaucgacaacugccugaccgagauggagaccgagaccaagaaccuggaggacgaggagaagaacaaccccguggaggagugggacagcgagaugagagccgccgagaaggagcuggagcagcugaagaccgaggaggaggagcugcagagaaaccugcuggagcuggaggugcagaaggagcagacccuggcccagaucgacuucaugcagaagcagagaaacagaaccgaggagcugcuggaccagcugagccugagcgagugggacgugguggaguggagcgacgaccaggccguguucaccuucguguacgacaccauccagcugaccaucaccuucgaggagagcguggugggcuuccccuuccuggacaagagauacagaaagaucguggacgugaacuuccagagccugcuggacgaggaccaggccccccccagcagccugcuggugcacaagcugaucuuccaguacguggaggagaaggagagcuggaagaagaccugcaccacccagcaccagcugcccaagaugcuggaggaguucagccugguggugcaccacugcagacugcugggcgaggagaucgaguaccugaagagauggggccccaacuacaaccugaugaacaucgacaucaacaacaacgagcugagacugcuguucagcagcagcgccgccuucgccaaguucgagaucacccuguuccugagcgccuacuaccccagcgugccccugcccagcaccauccagaaccacgugggcaacaccagccaggacgacaucgccaccauccugagcaaggugccccuggagaacaacuaccugaagaacguggugaagcagaucuaccaggaccuguuccaggacugccacuucuaccacuaa

SEQ ID NO: 14659 - RNA, 2394 nt, Artificial Sequence
  CASD1__Homo_sapiens__NP_075051
auggccgcccuggccuacaaccugggcaagagagagaucaaccacuacuucagcgugagaagcgccaaggugcuggcccugguggccgugcugcugcuggccgccugccaccuggccagcagaagauacagaggcaacgacagcugcgaguaccugcugagcagcggcagauuccugggcgagaagguguggcagccccacagcugcaugaugcacaaguacaagaucagcgaggccaagaacugccugguggacaagcacaucgccuucaucggcgacagcagaaucagacagcuguucuacagcuucgugaagaucaucaacccccaguucaaggaggagggcaacaagcacgagaacauccccuucgaggacaagaccgccagcgugaagguggacuuccuguggcaccccgaggugaacggcagcaugaagcagugcaucaagguguggaccgaggacagcaucgccaagccccacgugaucguggccggcgccgccaccuggagcaucaagauccacaacggcagcagcgaggcccugagccaguacaagaugaacaucaccagcaucgccccccugcuggagaagcuggccaagaccagcgacguguacugggugcugcaggaccccguguacgaggaccugcugagcgagaacagaaagaugaucaccaacgagaagaucgacgccuacaacgaggccgccgugagcauccugaacagcagcaccagaaacagcaagagcaacgugaagauguucagcgugagcaagcugaucgcccaggagaccaucauggagagccuggacggccugcaccugcccgagagcagcagagagaccaccgccaugauccugaugaacguguacugcaacaagauccugaagcccguggacggcagcugcugccagcccagaccccccgugacccugauccagaagcuggccgccugcuucuucacccugagcaucaucggcuaccugaucuucuacaucauccacagaaacgcccacagaaagaacaagcccugcaccgaccuggagagcggcgaggagaagaagaacaucaucaacacccccgugagcagccuggagauccugcugcagagcuucugcaagcugggccugaucauggccuacuucuacaugugcgacagagccaaccuguucaugaaggagaacaaguucuacacccacagcagcuucuucauccccaucaucuacauccuggugcugggcguguucuacaacgagaacaccaaggagaccaaggugcugaacagagagcagaccgacgaguggaagggcuggaugcagcuggugauccugaucuaccacaucagcggcgccagcaccuuccugcccguguacaugcacaucagagugcugguggccgccuaccuguuccagaccggcuacggccacuucagcuacuucuggaucaagggcgacuucggcaucuacagagugugccaggugcuguucagacugaacuuccuggugguggugcugugcaucgugauggacagacccuaccaguucuacuacuucgugccccuggugaccgugugguucauggugaucuacgugacccuggcccuguggccccagaucauccagaagaaggccaacggcaacugcuucuggcacuucggccugcugcugaagcugggcuuccugcugcuguucaucugcuuccuggccuacagccagggcgccuucgagaagaucuucagccuguggccccugagcaagugcuucgagcugaagggcaacguguacgaguggugguucagauggagacuggacagauacgugguguuccacggcaugcuguucgccuucaucuaccuggcccugcagaagagacagauccugagcgagggcaagggcgagccccuguucagcaacaagaucagcaacuuccugcuguucaucagcguggugagcuuccugaccuacagcaucugggccagcagcugcaagaacaaggccgagugcaacgagcugcaccccagcgugagcguggugcagauccuggccuucauccugaucagaaacauccccggcuacgccagaagcguguacagcagcuucuucgccugguucggcaagaucagccuggagcuguucaucugccaguaccacaucuggcuggccgccgacaccagaggcauccuggugcugauccccggcaaccccaugcugaacaucaucgugagcaccuucaucuucgugugcguggcccacgagaucagccagaucaccaacgaccuggcccagaucaucauccccaaggacaacagcagccugcugaagagacuggccugcaucgccgccuucuucugcggccugcugauccugagcagcauccaggacaagagcaagcacuaa

SEQ ID NO: 14660 - RNA, 2697 nt, Artificial Sequence
  CASK__Homo_sapiens__NP_001119526
auggccgacgacgacgugcuguucgaggacguguacgagcugugcgaggugaucggcaagggccccuucagcguggugagaagaugcaucaacagagagaccggccagcaguucgccgugaagaucguggacguggccaaguucaccagcagccccggccugagcaccgaggaccugaagagagaggccagcaucugccacaugcugaagcacccccacaucguggagcugcuggagaccuacagcagcgacggcaugcuguacaugguguucgaguucauggacggcgccgaccugugcuucgagaucgugaagagagccgacgccggcuucguguacagcgaggccguggccagccacuacaugagacagauccuggaggcccugagauacugccacgacaacaacaucauccacagagacgugaagccccacugcgugcugcuggccagcaaggagaacagcgcccccgugaagcugggcggcuucggcguggccauccagcugggcgagagcggccugguggccggcggcagagugggcaccccccacuucauggcccccgagguggugaagagagagcccuacggcaagcccguggacguguggggcugcggcgugauccuguucauccugcugagcggcugccugcccuucuacggcaccaaggagagacuguucgagggcaucaucaagggcaaguacaagaugaaccccagacaguggagccacaucagcgagagcgccaaggaccuggugagaagaaugcugaugcuggaccccgccgagagaaucaccguguacgaggcccugaaccaccccuggcugaaggagagagacagauacgccuacaagauccaccugcccgagaccguggagcagcugagaaaguucaacgccagaagaaagcugaagggcgccgugcuggccgccgugagcagccacaaguucaacagcuucuacggcgacccccccgaggagcugcccgacuucagcgaggaccccaccagcagcggccugcuggccgccgagagagccgugagccaggugcuggacagccuggaggagauccacgcccugaccgacugcagcgagaaggaccuggacuuccugcacagcguguuccaggaccagcaccugcacacccugcuggaccuguacgacaagaucaacaccaagagcagcccccagaucagaaacccccccagcgacgccgugcagagagccaaggaggugcuggaggagaucagcugcuaccccgagaacaacgacgccaaggagcugaagagaauccugacccagccccacuucauggcccugcugcagacccacgacgugguggcccacgagguguacagcgacgaggcccugagagugacccccccccccaccagccccuaccugaacggcgacagccccgagagcgccaacggcgacauggacauggagaacgugaccagagugagacuggugcaguuccagaagaacaccgacgagcccaugggcaucacccugaagaugaacgagcugaaccacugcaucguggccagaaucaugcacggcggcaugauccacagacagggcacccugcacgugggcgacgagaucagagagaucaacggcaucagcguggccaaccagaccguggagcagcugcagaagaugcugagagagaugagaggcagcaucaccuucaagaucgugcccagcuacagaacccagagcagcagcugcgaggaccugcccagcaccacccagcccaagggcagacagaucuacgugagagcccaguucgaguacgaccccgccaaggacgaccugauccccugcaaggaggccggcaucagauucagagugggcgacaucauccagaucaucagcaaggacgaccacaacugguggcagggcaagcuggagaacagcaagaacggcaccgccggccugauccccagccccgagcugcaggaguggagaguggccugcaucgccauggagaagaccaagcaggagcagcaggccagcugcaccugguucggcaagaagaagaagcaguacaaggacaaguaccuggccaagcacaacgccgaccuggugaccuacgaggagguggugaagcugcccgccuucaagagaaagacccuggugcugcugggcgcccacggcgugggcagaagacacaucaagaacacccugaucaccaagcaccccgacagauucgccuaccccaucccccacaccaccagaccccccaagaaggacgaggagaacggcaagaacuacuacuucgugagccacgaccagaugaugcaggacaucagcaacaacgaguaccuggaguacggcagccacgaggacgccauguacggcaccaagcuggagaccaucagaaagauccacgagcagggccugaucgccauccuggacguggagccccaggcccugaaggugcugagaaccgccgaguucgcccccuucgugguguucaucgccgcccccaccaucacccccggccugaacgaggacgagagccugcagagacugcagaaggagagcgacauccugcagagaaccuacgcccacuacuucgaccugaccaucaucaacaacgagaucgacgagaccaucagacaccuggaggaggccguggagcuggugugcaccgccccccagugggugcccgugagcuggguguacuaa

SEQ ID NO: 14661 - RNA, 1368 nt, Artificial Sequence
  CASP10__Homo_sapiens__NP_001193453
augaagagccagggccagcacugguacagcagcagcgacaagaacugcaaggugagcuucagagagaagcugcugaucaucgacagcaaccugggcgugcaggacguggagaaccugaaguuccugugcaucggccuggugcccaacaagaagcuggagaagagcagcagcgccagcgacguguucgagcaccugcuggccgaggaccugcugagcgaggaggaccccuucuuccuggccgagcugcuguacaucaucagacagaagaagcugcugcagcaccugaacugcaccaaggaggagguggagagacugcugcccaccagacagagagugagccuguucagaaaccugcuguacgagcugagcgagggcaucgacagcgagaaccugaaggacaugaucuuccugcugaaggacagccugcccaagaccgagaugaccagccugagcuuccuggccuuccuggagaagcagggcaagaucgacgaggacaaccugaccugccuggaggaccugugcaagaccguggugcccaagcugcugagaaacaucgagaaguacaagagagagaaggccauccagaucgugaccccccccguggacaaggaggccgagagcuaccagggcgaggaggagcuggugagccagaccgacgugaagaccuuccuggaggcccugccccaggagagcuggcagaacaagcacgccggcagcaacgagauccugagccacguguuccaguggcugggcuucaccgugcacauccacaacaacgugaccaagguggagauggagauggugcugcagaagcagaagugcaaccccgcccacgccgacggcgacugcuucguguucugcauccugacccacggcagauucggcgccguguacagcagcgacgaggcccugauccccaucagagagaucaugagccacuucaccgcccugcagugccccagacuggccgagaagcccaagcuguucuucauccaggccugccagggcgaggagauccagcccagcgugagcaucgaggccgacgcccugaaccccgagcaggcccccaccagccugcaggacagcauccccgccgaggccgacuuccugcugggccuggccaccgugcccggcuacgugagcuucagacacguggaggagggcagcugguacauccagagccugugcaaccaccugaagaagcuggugcccagacacgaggacauccugagcauccugaccgccgugaacgacgacgugagcagaagaguggacaagcagggcaccaagaagcagaugccccagcccgccuucacccugagaaagaagcugguguuccccgugccccuggacgcccugagccuguaa

SEQ ID NO: 14662 - RNA, 729 nt, Artificial Sequence
  CASP14__Homo_sapiens__NP_036246
augagcaaccccagaagccuggaggaggagaaguacgacaugagcggcgccagacuggcccugauccugugcgugaccaaggccagagagggcagcgaggaggaccuggacgcccuggagcacauguucagacagcugagauucgagagcaccaugaagagagaccccaccgccgagcaguuccaggaggagcuggagaaguuccagcaggccaucgacagcagagaggaccccgugagcugcgccuucguggugcugauggcccacggcagagagggcuuccugaagggcgaggacggcgagauggugaagcuggagaaccuguucgaggcccugaacaacaagaacugccaggcccugagagccaagcccaagguguacaucauccaggccugcagaggcgagcagagagaccccggcgagaccgugggcggcgacgagaucgugauggugaucaaggacagcccccagaccauccccaccuacaccgacgcccugcacguguacagcaccguggagggcuacaucgccuacagacacgaccagaagggcagcugcuucauccagacccugguggacguguucaccaagagaaagggccacauccuggagcugcugaccgaggugaccagaagaauggccgaggccgagcuggugcaggagggcaaggccagaaagaccaaccccgagauccagagcacccugagaaagagacuguaccugcaguaa

SEQ ID NO: 14663 - RNA, 1152 nt, Artificial Sequence
  CASP1__Homo_sapiens__NP_001244048
auggccgacaaggugcugaaggagaagagaaagcuguucaucagaagcaugggcgagggcaccaucaacggccugcuggacgagcugcugcagaccagagugcugaacaaggaggagauggagaaggugaagagagagaacgccaccgugauggacaagaccagagcccugaucgacagcgugauccccaagggcgcccaggccugccagaucugcaucaccuacaucugcgaggaggacagcuaccuggccggcacccugggccugagcgccgccccccaggccgugcaggacaaccccgccaugcccaccagcagcggcagcgagggcaacgugaagcugugcagccuggaggaggcccagagaaucuggaagcagaagagcgccgagaucuaccccaucauggacaagagcagcagaaccagacuggcccugaucaucugcaacgaggaguucgacagcauccccagaagaaccggcgccgagguggacaucaccggcaugaccaugcugcugcagaaccugggcuacagcguggacgugaagaagaaccugaccgccagcgacaugaccaccgagcuggaggccuucgcccacagacccgagcacaagaccagcgacagcaccuuccugguguucaugagccacggcaucagagagggcaucugcggcaagaagcacagcgagcaggugcccgacauccugcagcugaacgccaucuucaacaugcugaacaccaagaacugccccagccugaaggacaagcccaaggugaucaucauccaggccugcagaggcgacagccccggcguggugugguucaaggacagcgugggcgugagcggcaaccugagccugcccaccaccgaggaguucgaggacgacgccaucaagaaggcccacaucgagaaggacuucaucgccuucugcagcagcacccccgacaacgugagcuggagacaccccaccaugggcagcguguucaucggcagacugaucgagcacaugcaggaguacgccugcagcugcgacguggaggagaucuucagaaaggugagauucagcuucgagcagcccgacggcagagcccagaugcccaccaccgagagagugacccugaccagaugcuucuaccuguuccccggccacuaa

SEQ ID NO: 14664 - RNA, 939 nt, Artificial Sequence
  CASP2__Homo_sapiens__NP_001215
augcacccccaccaccaggagacccugaagaagaacagaguggugcuggccaagcagcugcugcugagcgagcugcuggagcaccugcuggagaaggacaucaucacccuggagaugagagagcugauccaggccaaggugggcagcuucagccagaacguggagcugcugaaccugcugcccaagagaggcccccaggccuucgacgccuucugcgaggcccugagagagaccaagcagggccaccuggaggacaugcugcugaccacccugagcggccugcagcacgugcugcccccccugagcugcgacuacgaccugagccugcccuuccccgugugcgagagcugcccccuguacaagaagcugagacugagcaccgacaccguggagcacagccuggacaacaaggacggccccgugugccugcaggugaagcccugcacccccgaguucuaccagacccacuuccagcuggccuacagacugcagagcagacccagaggccuggcccuggugcugagcaacgugcacuucaccggcgagaaggagcuggaguucagaagcggcggcgacguggaccacagcacccuggugacccuguucaagcugcugggcuacgacgugcacgugcugugcgaccagaccgcccaggagaugcaggagaagcugcagaacuucgcccagcugcccgcccacagagugaccgacagcugcaucguggcccugcugagccacggcguggagggcgccaucuacggcguggacggcaagcugcugcagcugcaggagguguuccagcuguucgacaacgccaacugccccagccugcagaacaagcccaagauguucuucauccaggccugcagaggcggcgccaucggcagccugggccaccugcugcuguucaccgccgccaccgccagccuggcccuguaa

SEQ ID NO: 14665 - RNA, 834 nt, Artificial Sequence
  CASP3__Homo_sapiens__XP_011530603
auggagaacaccgagaacagcguggacagcaagagcaucaagaaccuggagcccaagaucauccacggcagcgagagcauggacagcggcaucagccuggacaacagcuacaagauggacuaccccgagaugggccugugcaucaucaucaacaacaagaacuuccacaagagcaccggcaugaccagcagaagcggcaccgacguggacgccgccaaccugagagagaccuucagaaaccugaaguacgaggugagaaacaagaacgaccugaccagagaggagaucguggagcugaugagagacgugagcaaggaggaccacagcaagagaagcagcuucgugugcgugcugcugagccacggcgaggagggcaucaucuucggcaccaacggccccguggaccugaagaagaucaccaacuucuucagaggcgacagaugcagaagccugaccggcaagcccaagcuguucaucauccaggccugcagaggcaccgagcuggacugcggcaucgagaccgacagcggcguggacgacgacauggccugccacaagauccccguggaggccgacuuccuguacgccuacagcaccgcccccggcuacuacagcuggagaaacagcaaggacggcagcugguucauccagagccugugcgccaugcugaagcaguacgccgacaagcuggaguucaugcacauccugaccagagugaacagaaagguggccaccgaguucgagagcuucagcuucgacgccaccuuccacgccaagaagcagauccccugcaucgugagcaugcugaccaaggagcuguacuucuaccacuaa

SEQ ID NO: 14666 - RNA, 1134 nt, Artificial Sequence
  CASP4__Homo_sapiens__NP_001216
auggccgagggcaaccacagaaagaagccccugaaggugcuggagagccugggcaaggacuuccugaccggcgugcuggacaaccugguggagcagaacgugcugaacuggaaggaggaggagaagaagaaguacuacgacgccaagaccgaggacaaggugagagugauggccgacagcaugcaggagaagcagagaauggccggccagaugcugcugcagaccuucuucaacaucgaccagaucagccccaacaagaaggcccaccccaacauggaggccggcccccccgagagcggcgagagcaccgacgcccugaagcugugcccccacgaggaguuccugagacugugcaaggagagagccgaggagaucuaccccaucaaggagagaaacaacagaaccagacuggcccugaucaucugcaacaccgaguucgaccaccugccccccagaaacggcgccgacuucgacaucaccggcaugaaggagcugcuggagggccuggacuacagcguggacguggaggagaaccugaccgccagagacauggagagcgcccugagagccuucgccaccagacccgagcacaagagcagcgacagcaccuuccuggugcugaugagccacggcauccuggagggcaucugcggcaccgugcacgacgagaagaagcccgacgugcugcuguacgacaccaucuuccagaucuucaacaacagaaacugccugagccugaaggacaagcccaaggugaucaucgugcaggccugcagaggcgccaacagaggcgagcugugggugagagacagccccgccagccuggagguggccagcagccagagcagcgagaaccuggaggaggacgccguguacaagacccacguggagaaggacuucaucgccuucugcagcagcaccccccacaacgugagcuggagagacagcaccaugggcagcaucuucaucacccagcugaucaccugcuuccagaaguacagcuggugcugccaccuggaggagguguucagaaaggugcagcagagcuucgagacccccagagccaaggcccagaugcccaccaucgagagacugagcaugaccagauacuucuaccuguuccccggcaacuaa

SEQ ID NO: 14667 - RNA, 1131 nt, Artificial Sequence
  CASP5__Homo_sapiens__NP_001129581
auggccgaggacaaccacaagaagaagaccgugaagaugcuggaguaccugggcaaggacgugcugcacggcguguucaacuaccuggccaagcacgacgugcugacccugaaggaggaggagaagaagaaguacuacgacaccaagaucgaggacaaggcccugauccugguggacagccugagaaagaacagaguggcccaccagauguucacccagacccugcugaacauggaccagaagaucaccagcgugaagccccugcugcagaucgaggccggcccccccgagagcgccgagagcaccaacauccugaagcugugccccagagaggaguuccugagacugugcaagaagaaccacgacgagaucuaccccaucaagaagagagaggacagaagaagacuggcccugaucaucugcaacaccaaguucgaccaccugcccgccagaaacggcgcccacuacgacaucgugggcaugaagagacugcugcagggccugggcuacaccgugguggacgagaagaaccugaccgccagagacauggagagcgugcugagagccuucgccgccagacccgagcacaagagcagcgacagcaccuuccuggugcugaugagccacggcauccuggagggcaucugcggcaccgcccacaagaagaagaagcccgacgugcugcuguacgacaccaucuuccagaucuucaacaacagaaacugccugagccugaaggacaagcccaaggugaucaucgugcaggccugcagaggcgagaagcacggcgagcugugggugagagacagccccgccagccuggcccugaucagcagccagagcagcgagaaccuggaggccgacagcgugugcaagauccacgaggagaaggacuucaucgccuucugcagcagcaccccccacaacgugagcuggagagacagaaccagaggcagcaucuucaucaccgagcugaucaccugcuuccagaaguacagcugcugcugccaccugauggagaucuucagaaaggugcagaagagcuucgaggugccccaggccaaggcccagaugcccaccaucgagagagccacccugaccagagacuucuaccuguuccccggcaacuaa

SEQ ID NO: 14668 - RNA, 882 nt, Artificial Sequence
  CASP6__Homo_sapiens__NP_001217
augagcagcgccagcggccugagaagaggccaccccgccggcggcgaggagaacaugaccgagaccgacgccuucuacaagagagagauguucgaccccgccgagaaguacaagauggaccacagaagaagaggcaucgcccugaucuucaaccacgagagauucuucuggcaccugacccugcccgagagaagaggcaccugcgccgacagagacaaccugaccagaagauucagcgaccugggcuucgaggugaagugcuucaacgaccugaaggccgaggagcugcugcugaagauccacgaggugagcaccgugagccacgccgacgccgacugcuucgugugcguguuccugagccacggcgagggcaaccacaucuacgccuacgacgccaagaucgagauccagacccugaccggccuguucaagggcgacaagugccacagccuggugggcaagcccaagaucuucaucauccaggccugcagaggcaaccagcacgacgugcccgugaucccccuggacgugguggacaaccagaccgagaagcuggacaccaacaucaccgagguggacgccgccagcguguacacccugcccgccggcgccgacuuccugaugugcuacagcguggccgagggcuacuacagccacagagagaccgugaacggcagcugguacauccaggaccugugcgagaugcugggcaaguacggcagcagccuggaguucaccgagcugcugacccuggugaacagaaaggugagccagagaagaguggacuucugcaaggaccccagcgccaucggcaagaagcaggugcccugcuucgccagcaugcugaccaagaagcugcacuucuuccccaagagcaacuaa

SEQ ID NO: 14669 - RNA, 912 nt, Artificial Sequence
  CASP7__Homo_sapiens__NP_001218
auggccgacgaccagggcugcaucgaggagcagggcguggaggacagcgccaacgaggacagcguggacgccaagcccgacagaagcagcuucgugcccagccuguucagcaagaagaagaagaacgugaccaugagaagcaucaagaccaccagagacagagugcccaccuaccaguacaacaugaacuucgagaagcugggcaagugcaucaucaucaacaacaagaacuucgacaaggugaccggcaugggcgugagaaacggcaccgacaaggacgccgaggcccuguucaagugcuucagaagccugggcuucgacgugaucguguacaacgacugcagcugcgccaagaugcaggaccugcugaagaaggccagcgaggaggaccacaccaacgccgccugcuucgccugcauccugcugagccacggcgaggagaacgugaucuacggcaaggacggcgugacccccaucaaggaccugaccgcccacuucagaggcgacagaugcaagacccugcuggagaagcccaagcuguucuucauccaggccugcagaggcaccgagcuggacgacggcauccaggccgacagcggccccaucaacgacaccgacgccaaccccagauacaagauccccguggaggccgacuuccuguucgccuacagcaccgugcccggcuacuacagcuggagaagccccggcagaggcagcugguucgugcaggcccugugcagcauccuggaggagcacggcaaggaccuggagaucaugcagauccugaccagagugaacgacagaguggccagacacuucgagagccagagcgacgacccccacuuccacgagaagaagcagauccccugcguggugagcaugcugaccaaggagcuguacuucagccaguaa

SEQ ID NO: 14670 - RNA, 5949 nt, Artificial Sequence
  CASP8AP2__Homo_sapiens__NP_001131140
auggccgccgacgacgacaacggcgacggcaccagccuguucgacguguucagcgccagcccccugaagaacaacgacgagggcagccuggacaucuacgccggccuggacagcgccgugagcgacagcgccagcaagagcugcgugcccagcagaaacugccuggaccuguacgaggagauccugaccgaggagggcaccgccaaggaggccaccuacaacgaccugcagguggaguacggcaagugccagcugcagaugaaggagcugaugaagaaguucaaggagauccagacccagaacuucagccugaucaacgagaaccagagccugaagaagaacaucagcgcccugaucaagaccgccagaguggagaucaacagaaaggacgaggagaucagcaaccugcaccagagacugagcgaguucccccacuucagaaacaaccacaagaccgccagaaccuucgacaccgugaagaccaaggaccugaagagcagaagcccccaccuggacgacugcagcaagaccgaccacagagccaagagcgacgugagcaaggacgugcaccacagcaccagccugcccaaccuggagaaggagggcaagccccacagcgacaagagaagcaccagccaccugcccaccagcguggagaagcacugcaccaacggcguguggagcagaagccacuaccaggugggcgagggcagcagcaacgaggacagcagaagaggcagaaaggacaucagacacagccaguucaacagaggcaccgagagagugagaaaggaccugagcaccggcugcggcgacggcgagcccagaauccuggaggccagccagagacugcagggccaccccgagaaguacggcaagggcgagcccaagaccgagagcaagagcagcaaguucaagagcaacagcgacagcgacuacaagggcgagagaaucaacagcagcugggagaaggagacccccggcgagagaagccacagcagaguggacagccagagcgacaagaagcuggagagacagagcgagagaagccagaacaucaacagaaaggaggugaagagccaggacaaggaggagagaaagguggaccagaagcccaagagcguggugaaggaccaggaccacuggagaagaagcgagagagccagccugccccacagcaagaacgagaucaccuucagccacaacagcagcaaguaccaccuggaggagagaagaggcugggaggacugcaagagagacaagagcgugaacagccacagcuuccaggacggcagaugccccagcagccugagcaacagcagaacccacaagaacaucgacagcaaggagguggacgccaugcaccagugggagaacaccccccugaaggccgagagacacagaaccgaggacaagagaaagagagagcaggagagcaaggaggagaacagacacaucagaaacgagaagagagugcccaccgagcaccugcagaagaccaacaaggagaccaagaagaccaccaccgaccugaagaagcagaacgagcccaagaccgacaagggcgaggugcuggacaacggcgugagcgagggcgccgacaacaaggagcuggccaugaaggccgagagcggccccaacgagaccaagaacaaggaccugaagcugagcuucaugaagaagcugaaccugacccugagccccgccaagaagcagcccgugagccaggacaaccagcacaagaucaccgacauccccaagagcagcggcgugugcgacagcgagagcagcaugcaggugaagaccguggccuacgugcccagcaucagcgagcacauccugggcgaggccgccgugagcgagcacaccaugggcgagaccaagagcacccugcuggagcccaagguggcccugcuggccgugaccgagcccagaaucggcaucagcgagaccaacaaggaggacgagaacagccugcuggugagaagcguggacaacaccaugcacugcgaggagcccaucugcggcaccgagaccagcuuccccagccccauggagauccagcagaccgagagccuguuccccagcaccggcaugaagcagaccaucaacaacggcagagccgccgcccccguggugauggacgugcugcagaccgacgugagccagaacuucggccuggagcuggacaccaagagaaacgacaacagcgacuacugcggcaucagcgagggcauggagaugaagguggcccugagcaccaccgugagcgagaccaccgagagcauccugcagcccagcaucgaggaggccgacauccugcccaucaugcugagcgaggacaacaaccccaaguucgagcccagcgugaucgugaccccccugguggagagcaagagcugccaccuggagcccugccugcccaaggagacccuggacagcagccugcagcagaccgagcugauggaccacagaauggccaccggcgagaccaacagcguguaccacgacgacgacaacagcgugcugagcaucgaccugaaccaccugagacccauccccgaggccaucagcccccugaacagccccgugagacccguggccaaggugcugagaaacgagagccccccccaggugcccguguacaacaacagccacaaggacguguuccugcccaacagcgcccacagcaccagcaagagccagagcgaccugaacaaggagaaccagaagcccaucuacaagagcgacaagugcaccgaggccgacaccugcaagaacagcccccuggacgagcuggaggagggcgagaucagaagcgacagcgagaccagcaagccccaggagagcuucgagaagaacagcaagagaagagugagcgccgacgugagaaagagcaagaccauccccagaagaggcaagagcaccgugugccuggacaaggacagcagaaagacccacgugagaauccaccagaccaacaacaaguggaacaagagacccgacaagagcagcagaagcagcaagaccgagaagaaggacaaggugaugagcaccagcagccuggagaagaucgugcccaucaucgccgugcccagcagcgagcaggagaucaugcacaugcugagaaugaucagaaagcacgugagaaagaacuacaugaaguucaaggccaaguucagccugauccaguuccacagaaucaucgagagcgccauccugagcuucaccagccugaucaagcaccugaaccugcacaagaucagcaagagcgugaccacccugcagaagaaccugugcgacaucaucgagagcaagcugaagcaggugaagaagaacggcaucguggacagacuguucgagcagcagcugcccgacaugaagaagaagcuguggaaguucguggacgaccagcuggacuaccuguucgccaagcugaagaagauccuggugugcgacagcaagagcuucggcagagacagcgacgagggcaagcuggagaagaccagcaagcagaacgcccaguacagcaacagccagaagagaagcguggacaacagcaacagagagcugcugaaggagaagcugagcaagagcgaggaccccgugcacuacaagagccuggugggcugcaagaagagcgaggagaacuaccaggaccagaacaacagcagcaucaacaccgugaagcacgacaucaagaagaacuucaacaucugcuucgacaacaucaagaacagccagagcgaggagagaagccuggaggugcacugccccagcacccccaagagcgagaagaacgagggcagcagcaucgaggacgcccagaccagccagcacgccacccugaagcccgagagaagcuucgagauccugaccgagcagcaggccagcagccugaccuucaaccuggugagcgacgcccagaugggcgagaucuucaagagccugcugcagggcagcgaccugcuggacagcagcgugaacugcaccgagaagagcgagugggagcugaagacccccgagaagcagcugcuggagacccugaagugcgagagcauccccgccugcaccaccgaggagcuggugagcggcguggccagccccugccccaagaugaucagcgacgacaacuggagccugcugagcagcgagaagggccccagccugagcagcggccugagccugcccgugcaccccgacgugcuggacgagagcugcauguucgaggugagcaccaaccugccccugagcaaggacaacgugugcagcguggagaagagcaagcccugcgugagcagcauccugcuggaggaccuggccgugagccugaccgugcccagcccccugaagagcgacggccaccugagcuuccugaagcccgacaugagcagcagcagcacccccgaggaggugaucagcgcccacuucagcgaggacgcccugcuggaggaggaggacgccagcgagcaggacauccaccuggcccuggagagcgacaacagcagcagcaagagcagcugcagcagcagcuggaccagcagaagcguggcccccggcuuccaguaccaccccaaccugcccaugcacgccgugaucauggagaagagcaacgaccacuucaucgugaagaucagaagagccacccccagcaccagcagcggccugaagcagagcaugaugcccgacgagcugcugaccagccugcccagacacggcaaggaggccgacgagggccccgagaaggaguacaucagcugccagaacaccguguucaagagcguggaggagcuggagaacagcaacaagaacguggacggcagcaagagcacccacgaggagcagagcagcaugauccagacccaggugcccgacaucuacgaguuccugaaggacgccagcgacaagaugggccacagcgacgagguggccgacgagugcuucaagcugcaccaggugugggagaccaaggugcccgagagcaucgaggagcugcccagcauggaggagaucagccacagcgugggcgagcaccugcccaacaccuacguggaccugaccaaggaccccgugaccgagaccaagaaccugggcgaguucaucgaggugaccgugcugcacaucgaccagcugggcugcagcggcggcaaccugaaccagagcgcccagauccuggacaacagccugcaggccgacaccgugggcgccuucaucgaccugacccaggacgccagcagcgaggccaagagcgagggcaaccaccccgcccuggccguggaggaccugggcugcggcgugauccagguggacgaggacaacugcaaggaggagaaggcccagguggccaacagaccccugaagugcaucguggaggagaccuacaucgaccugaccaccgagagccccagcagcugcgaggugaagaaggacgagcugaagagcgagcccggcagcaacugcgacaacagcgagcugcccggcacccugcacaacagccacaagaagagaagaaacaucagcgaccugaaccacccccacaagaagcagagaaaggagaccgaccugaccaacaaggagaagaccaagaagcccacccaggacagcugcgagaacaccgaggcccaccagaagaaggccagcaagaagaaggccccccccgugaccaaggaccccagcagccugaaggccacccccggcaucaaggacagcagcgccgcccuggccaccagcaccagccugagcgccaagaacgugaucaagaagaagggcgagaucaucauccuguggaccagaaacgacgacagagagauccugcuggagugccagaagagaggccccagcuucaagaccuucgccuaccuggccgccaagcuggacaagaaccccaaccaggugagcgagagauuccagcagcugaugaagcuguucgagaagagcaagugcagauaa

SEQ ID NO: 14671 - RNA, 1617 nt, Artificial Sequence
  CASP8__Homo_sapiens__NP_001073594
auggagggcggcagaagagccagaguggugaucgagagcaagagaaacuucuuccugggcgccuuccccacccccuuccccgccgagcacguggagcugggcagacugggcgacagcgagaccgccauggugcccggcaagggcggcgccgacuacauccugcugcccuucaagaagauggacuucagcagaaaccuguacgacaucggcgagcagcuggacagcgaggaccuggccagccugaaguuccugagccuggacuacaucccccagagaaagcaggagcccaucaaggacgcccugaugcuguuccagagacugcaggagaagagaaugcuggaggagagcaaccugagcuuccugaaggagcugcuguucagaaucaacagacuggaccugcugaucaccuaccugaacaccagaaaggaggagauggagagagagcugcagacccccggcagagcccagaucagcgccuacagagugaugcuguaccagaucagcgaggaggugagcagaagcgagcugagaagcuucaaguuccugcugcaggaggagaucagcaagugcaagcuggacgacgacaugaaccugcuggacaucuucaucgagauggagaagagagugauccugggcgagggcaagcuggacauccugaagagagugugcgcccagaucaacaagagccugcugaagaucaucaacgacuacgaggaguucagcaaggagagaagcagcagccuggagggcagccccgacgaguucagcaacggcgaggagcugugcggcgugaugaccaucagcgacagccccagagagcaggacagcgagagccagacccuggacaagguguaccagaugaagagcaagcccagaggcuacugccugaucaucaacaaccacaacuucgccaaggccagagagaaggugcccaagcugcacagcaucagagacagaaacggcacccaccuggacgccggcgcccugaccaccaccuucgaggagcugcacuucgagaucaagccccacgacgacugcaccguggagcagaucuacgagauccugaagaucuaccagcugauggaccacagcaacauggacugcuucaucugcugcauccugagccacggcgacaagggcaucaucuacggcaccgacggccaggaggcccccaucuacgagcugaccagccaguucaccggccugaagugccccagccuggccggcaagcccaagguguucuucauccaggccugccagggcgacaacuaccagaagggcauccccguggagaccgacagcgaggagcagcccuaccuggagauggaccugagcagcccccagaccagauacauccccgacgaggccgacuuccugcugggcauggccaccgugaacaacugcgugagcuacagaaaccccgccgagggcaccugguacauccagagccugugccagagccugagagagagaugccccagaggcgacgacauccugaccauccugaccgaggugaacuacgaggugagcaacaaggacgacaagaagaacaugggcaagcagaugccccagcccaccuucacccugagaaagaagcugguguuccccagcgacuaa

SEQ ID NO: 14672 - RNA, 1089 nt, Artificial Sequence
  CASP9__Homo_sapiens__XP_011540572
auggacgaggccgacagaagacugcugagaagaugcagacugagacugguggaggagcugcagguggaccagcugugggacgcccugcugagcagagagcuguucagaccccacaugaucgaggacauccagagagccggcagcggcagcagaagagaccaggccagacagcugaucaucgaccuggagaccagaggcagccaggcccugccccuguucaucagcugccuggaggacaccggccaggacaugcuggccagcuuccugagaaccaacagacaggccgccaagcugagcaagcccacccuggagaaccugacccccguggugcugagacccgagaucagaaagcccgaggugcugagacccgagacccccagacccguggacaucggcagcggcggcuucggcgacgugggcgcccuggagagccugagaggcaacgccgaccuggccuacauccugagcauggagcccugcggccacugccugaucaucaacaacgugaacuucugcagagagagcggccugagaaccagaaccggcagcaacaucgacugcgagaagcugagaagaagauucagcagccugcacuucaugguggaggugaagggcgaccugaccgccaagaagauggugcuggcccugcuggagcuggcccagcaggaccacggcgcccuggacugcugcgugguggugauccugagccacggcugccaggccagccaccugcaguuccccggcgccguguacggcaccgacggcugccccgugagcguggagaagaucgugaacaucuucaacggcaccagcugccccagccugggcggcaagcccaagcuguucuucauccaggccugcggcggcggcugccaggccgaccccgcccccagccacagcagacugagaccccccugcugcgccgugagcagacacagccagacccccggcgccgacagcggcgugagcaccaagaagaccaccagaagcaacgagccccagaaccuggagaagaacauggccgugaccgaccagagaggccccccccuggaggccggcggccugagagagaagcagugggacagcuaa

SEQ ID NO: 14673 - RNA, 1191 nt, Artificial Sequence
  CASQ1__Homo_sapiens__NP_001222
augagcgccaccgacagaaugggccccagagccgugcccggccugagacuggcccugcugcugcugcuggugcugggcacccccaagagcggcgugcagggccaggagggccuggacuuccccgaguacgacggcguggacagagugaucaacgugaacgccaagaacuacaagaacguguucaagaaguacgaggugcuggcccugcuguaccacgagccccccgaggacgacaaggccagccagagacaguucgagauggaggagcugauccuggagcuggccgcccaggugcuggaggacaagggcgugggcuucggccugguggacagcgagaaggacgccgccguggccaagaagcugggccugaccgagguggacagcauguacguguucaagggcgacgaggugaucgaguacgacggcgaguucagcgccgacaccaucguggaguuccugcuggacgugcuggaggaccccguggagcugaucgagggcgagagagagcugcaggccuucgagaacaucgaggacgagaucaagcugaucggcuacuucaagagcaaggacagcgagcacuacaaggccuucgaggacgccgccgaggaguuccaccccuacauccccuucuucgccaccuucgacagcaagguggccaagaagcugacccugaagcugaacgagaucgacuucuacgaggccuucauggaggagcccgugaccauccccgacaagcccaacagcgaggaggagaucgugaacuucguggaggagcacagaagaagcacccugagaaagcugaagcccgagagcauguacgagaccugggaggacgacauggacggcauccacaucguggccuucgccgaggaggccgaccccgacggcuucgaguuccuggagacccugaaggccguggcccaggacaacaccgagaaccccgaccugagcaucaucuggaucgaccccgacgacuucccccugcuggugcccuacugggagaagaccuucgacaucgaccugagcgccccccagaucggcguggugaacgugaccgacgccgacagcguguggauggagauggacgacgaggaggaccugcccagcgccgaggagcuggaggacuggcuggaggacgugcuggagggcgagaucaacaccgaggacgacgacgacgacgacgacgacuaa

SEQ ID NO: 14674 - RNA, 3267 nt, Artificial Sequence
  CASR__Homo_sapiens__NP_001171536
auggccuucuacagcugcugcugggugcugcuggcccugaccuggcacaccagcgccuacggccccgaccagagagcccagaagaagggcgacaucauccugggcggccuguuccccauccacuucggcguggccgccaaggaccaggaccugaagagcagacccgagagcguggagugcaucagauacaacuucagaggcuucagauggcugcaggccaugaucuucgccaucgaggagaucaacagcagccccgcccugcugcccaaccugacccugggcuacagaaucuucgacaccugcaacaccgugagcaaggcccuggaggccacccugagcuucguggcccagaacaagaucgacagccugaaccuggacgaguucugcaacugcagcgagcacauccccagcaccaucgccguggugggcgccaccggcagcggcgugagcaccgccguggccaaccugcugggccuguucuacaucccccaggugagcuacgccagcagcagcagacugcugagcaacaagaaccaguucaagagcuuccugagaaccauccccaacgacgagcaccaggccaccgccauggccgacaucaucgaguacuucagauggaacugggugggcaccaucgccgccgacgacgacuacggcagacccggcaucgagaaguucagagaggaggccgaggagagagacaucugcaucgacuucagcgagcugaucagccaguacagcgacgaggaggagauccagcacgugguggaggugauccagaacagcaccgccaaggugaucgugguguucagcagcggccccgaccuggagccccugaucaaggagaucgugagaagaaacaucaccggcaagaucuggcuggccagcgaggccugggccagcagcagccugaucgccaugccccaguacuuccacguggugggcggcaccaucggcuucgcccugaaggccggccagauccccggcuucagagaguuccugaagaaggugcaccccagaaagagcgugcacaacggcuucgccaaggaguucugggaggagaccuucaacugccaccugcaggagggcgccaagggcccccugcccguggacaccuuccugagaggccacgaggagagcggcgacagauucagcaacagcagcaccgccuucagaccccugugcaccggcgacgagaacaucagcagcguggagacccccuacaucgacuacacccaccugagaaucagcuacaacguguaccuggccguguacagcaucgcccacgcccugcaggacaucuacaccugccugcccggcagaggccuguucaccaacggcagcugcgccgacaucaagaagguggaggccuggcaggugcugaagcaccugagacaccugaacuucaccaacaacaugggcgagcaggugaccuucgacgagugcggcgaccuggugggcaacuacagcaucaucaacuggcaccugagccccgaggacggcagcaucguguucaaggaggugggcuacuacaacguguacgccaagaagggcgagagacuguucaucaacgaggagaagauccuguggagcggcuucagcagagagccccugaccuucgugcugagcgugcugcaggugcccuucagcaacugcagcagagacugccuggccggcaccagaaagggcaucaucgagggcgagcccaccugcugcuucgagugcguggagugccccgacggcgaguacagcgacgagaccgacgccagcgccugcaacaagugccccgacgacuucuggagcaacgagaaccacaccagcugcaucgccaaggagaucgaguuccugagcuggaccgagcccuucggcaucgcccugacccuguucgccgugcugggcaucuuccugaccgccuucgugcugggcguguucaucaaguucagaaacacccccaucgugaaggccaccaacagagagcugagcuaccugcugcuguucagccugcugugcugcuucagcagcagccuguucuucaucggcgagccccaggacuggaccugcagacugagacagcccgccuucggcaucagcuucgugcugugcaucagcugcauccuggugaagaccaacagagugcugcugguguucgaggccaagauccccaccagcuuccacagaaagugguggggccugaaccugcaguuccugcugguguuccugugcaccuucaugcagaucgugaucugcgugaucuggcuguacaccgccccccccagcagcuacagaaaccaggagcuggaggacgagaucaucuucaucaccugccacgagggcagccugauggcccugggcuuccugaucggcuacaccugccugcuggccgccaucugcuucuucuucgccuucaagagcagaaagcugcccgagaacuucaacgaggccaaguucaucaccuucagcaugcugaucuucuucaucguguggaucagcuucauccccgccuacgccagcaccuacggcaaguucgugagcgccguggaggugaucgccauccuggccgccagcuucggccugcuggccugcaucuucuucaacaagaucuacaucauccuguucaagcccagcagaaacaccaucgaggaggugagaugcagcaccgccgcccacgccuucaagguggccgccagagccacccugagaagaagcaacgugagcagaaagagaagcagcagccugggcggcagcaccggcagcacccccagcagcagcaucagcagcaagagcaacagcgaggaccccuucccccagcccgagagacagaagcagcagcagccccuggcccugacccagcaggagcagcagcagcagccccugacccugccccagcagcagagaagccagcagcagcccagaugcaagcagaaggugaucuucggcagcggcaccgugaccuucagccugagcuucgacgagccccagaagaacgccauggcccacagaaacagcacccaccagaacagccuggaggcccagaagagcagcgacacccugaccagacaccagccccugcugccccugcagugcggcgagaccgaccuggaccugaccgugcaggagaccggccugcagggccccgugggcggcgaccagagacccgagguggaggaccccgaggagcugagccccgcccugguggugagcagcagccagagcuucgugaucagcggcggcggcagcaccgugaccgagaacguggugaacagcuaa

SEQ ID NO: 14675 - RNA, 1050 nt, Artificial Sequence
  CASS4__Homo_sapiens__NP_001157587
augaagggcaccggcaucauggacugcgcccccaaggcccugcuggccagagcccuguacgacaacugccccgacugcagcgacgagcuggccuucagcagaggcgacauccugaccauccuggagcagcacgugcccgagagcgagggcugguggaagugccugcugcacggcagacagggccuggcccccgccaacagacugcagauccugaccgagguggccgccgacagacccugcccccccuuccugagaggccuggaggaggcccccgccagcagcgaggagaccuaccaggugcccacccugcccagaccccccacccccggccccguguacgagcagaugagaagcugggccgagggcccccagccccccaccgcccagguguacgaguuccccgacccccccaccagcgccagaaucaucugcgagaagacccugagcuuccccaagcaggccauccugacccugcccagacccgugagagccagccugcccacccugcccagccagguguacgacgugcccacccagcacagaggccccguggugcugaaggagcccgagaagcagcagcuguacgacauccccgccagccccaagaaggccggccugcacccccccgacagccaggccagcaaccccggcccccugaucccccagcccagcagccagcagacccccgagagaaagcccagacugagcgagcacugcagacuguacuucggcgcccuguucaaggccaucagcgccuuccacggcagccugagcagcagccagcccgccgagaucaucacccagagcaagcuggugaucauggugggccagaagcugguggacacccugugcauggagacccaggagagagacgugagaaacgagauccugagaggcagcagccaccugugcagccugcugaaggacguggcccuggccaccaagaacgccgugcugaccuaccccagccccgccgcccugggccaccugcaggccgaggccgagaagcuggagcagcacaccagacaguucagaggcacccugggcuaa

SEQ ID NO: 14676 - RNA, 2253 nt, Artificial Sequence
  CAST__Homo_sapiens__NP_001035905
augagccagcccggccagaagcccgccgccagccccagacccagaagagccgccgccgccagaagaacccacgagcacgugagcgagaagaccagcgagagccccagcaagcccggcgagaagaagggcagcgacgagaagaaggccgccagccugggcagcagccagagcagcagaaccuacgccggcggcaccgccagcgccaccaaggugagcgccagcagcggcgccaccagcaagagcagcagcaugaaccccaccgagaccaaggccgugaagaccgagcccgagaagaagagccagagcaccaagcccaagagccugcccaagcaggccagcgacaccggcagcaacgacgcccacaacaagaaggccgugagcagaagcgccgagcagcagcccagcgagaagagcaccgagcccaagaccaagccccaggacaugaucagcgccggcggcgagagcguggccggcaucaccgccaucagcggcaagcccggcgacaagaagaaggagaagaagagccugacccccgccgugcccguggagagcaagcccgacaagcccagcggcaagagcggcauggacgccgcccuggacgaccugaucgacacccugggcggccccgaggagaccgaggaggagaacaccaccuacaccggccccgaggugagcgaccccaugagcagcaccuacaucgaggagcugggcaagagagaggugaccaucccccccaaguacagagagcugcuggccaagaaggagggcaucaccggcccccccgccgacagcagcaagcccaucggccccgacgacgccaucgacgcccugagcagcgacuucaccugcggcagccccaccgccgccggcaagaagaccgagaaggaggagagcaccgaggugcugaaggcccagagcgccggcaccgugagaagcgccgcccccccccaggagaagaagagaaagguggagaaggacaccaugagcgaccaggcccuggaggcccugagcgccagccugggcaccagacaggccgagcccgagcuggaccugagaagcaucaaggagguggacgaggccaaggccaaggaggagaagcuggagaagugcggcgaggacgacgagaccauccccagcgaguacagacugaagcccgccaccgacaaggacggcaagccccugcugcccgagcccgaggagaagcccaagcccagaagcgagagcgagcugaucgacgagcugagcgaggacuucgacagaagcgagugcaaggagaagcccagcaagcccaccgagaagaccgaggagagcaaggccgccgcccccgcccccgugagcgaggccgugugcagaaccagcaugugcagcauccagagcgccccccccgagcccgccacccugaagggcaccgugcccgacgacgccguggaggcccuggccgacagccugggcaagaaggaggccgaccccgaggacggcaagcccgugauggacaaggugaaggagaaggccaaggaggaggacagagagaagcugggcgagaaggaggagaccaucccccccgacuacagacuggaggaggugaaggacaaggacggcaagccccugcugcccaaggagagcaaggagcagcugccccccaugagcgaggacuuccugcuggacgcccugagcgaggacuucagcggcccccagaacgccagcagccugaaguucgaggacgccaagcuggccgccgccaucagcgagguggugagccagacccccgccagcaccacccaggccggcgccccccccagagacaccagccagagcgacaaggaccuggacgacgcccuggacaagcugagcgacagccugggccagagacagcccgaccccgacgagaacaagcccauggaggacaaggugaaggagaaggccaaggccgagcacagagacaagcugggcgagagagacgacaccaucccccccgaguacagacaccugcuggacgacaacggccaggacaagcccgugaagccccccaccaagaagagcgaggacagcaagaagcccgccgacgaccaggaccccaucgacgcccugagcggcgaccuggacagcugccccagcaccaccgagaccagccagaacaccgccaaggacaagugcaagaaggccgccagcagcagcaaggcccccaagaacggcggcaaggccaaggacagcgccaagaccaccgaggagaccagcaagcccaaggacgacuaa

SEQ ID NO: 14677 - RNA, 3573 nt, Artificial Sequence
  CASZ1__Homo_sapiens__XP_011539937
augaagguggacuaccugagcgaguucggcuucagacugagcgacuacgaguucggcaccaaggagaagagaauggaccugggcaccgccgagggcaccagaugcaccgacccccccgccggcaagcccgccauggcccccaagagaaagggcggccugaagcugaacgccaucugcgccaagcugagcagacagguggugguggagaagagagccgacgccggcagccacaccgagggcagccccagccagcccagagaccaggagagaagcggccccgagagcggcgccgccagagcccccagaagcgaggaggacaagagaagagccgugaucgagaagugggugaacggcgaguacagcgaggagcccgcccccacccccgugcugggcagaaucgccagagagggccuggagcugccccccgagggcguguacauggugcagccccagggcugcagcgacgaggaggaccacgccgaggagcccagcaaggacggcggcgcccuggaggagaaggacagcgacggcgccgccagcaaggaggacagcggccccagcaccagacaggccagcggcgaggccagcagccugagagacuacgccgccagcaccaugaccgaguuccugggcauguucggcuacgacgaccagaacaccagagacgagcuggccagaaagaucagcuucgagaagcugcacgccggcagcacccccgaggccgccaccagcagcaugcugcccaccagcgaggacacccugagcaagagagccagauucagcaaguacgaggaguacaucagaaagcugaaggccggcgagcagcugagcuggcccgcccccagcaccaagaccgaggagagagugggcaaggagguggugggcacccugcccggccugagacugcccagcagcaccgcccaccuggagaccaaggccaccauccugccccugcccagccacagcagcgugcagaugcagaaccugguggccagagccagcaaguacgacuucuucauccagaagcugaagaccggcgagaaccugagaccccagaacggcagcaccuacaagaagcccagcaaguacgaccuggagaacgugaaguaccugcaccuguucaagcccggcgagggcagccccgacaugggcggcgccaucgccuucaagaccggcaaggugggcagacccagcaaguacgacgugagaggcauccagaagcccggccccgccaaggugccccccacccccagccuggcccccgccccccuggccagcgugcccagcgcccccagcgcccccggccccggccccgagccccccgccagccugagcuucaacacccccgaguaccugaagagcaccuucagcaagaccgacagcaucaccaccggcaccgugagcaccgugaagaacggccugcccaccgacaagcccgccgugaccgaggacgugaacaucuaccagaaguacaucgccagauucagcggcagccagcacugcggccacauccacugcgccuaccaguacagagagcacuaccacugccuggaccccgagugcaacuaccagagauucaccagcaagcaggacgugaucagacacuacaacaugcacaagaagagagacaacagccugcagcacggcuucaugagauucagcccccuggacgacugcagcguguacuaccacggcugccaccugaacggcaagagcacccacuaccacugcaugcaggugggcugcaacaagguguacaccagcaccagcgacgugaugacccacgagaacuuccacaagaagaacacccagcugaucaacgacggcuuccagagauucagagccaccgaggacugcggcaccgccgacugccaguucuacggccagaagaccacccacuuccacugcagaagacccggcugcaccuucaccuucaagaacaagugcgacaucgagaagcacaagagcuaccacaucaaggacgacgccuacgccaaggacggcuucaagaaguucuacaaguacgaggagugcaaguacgagggcugcguguacagcaaggccaccaaccacuuccacugcaucagagccggcugcggcuucaccuucaccagcaccagccagaugaccagccacaagagaaagcacgagagaagacacaucagaagcagcggcgcccugggccugccccccagccugcugggcgccaaggacaccgagcacgaggagagcagcaacgacgaccugguggacuucagcgcccugagcagcaagaacagcagccugagcgccagccccaccagccagcagagcagcgccagccuggccgccgccaccgccgccaccgaggccggccccagcgccaccaagccccccaacagcaagaucagcggccugcugccccagggccugcccggcagcaucccccuggcccuggcccugagcaacagcggccugcccacccccacccccuacuuccccauccuggccggcagaggcagcaccagccugcccgugggcacccccagccugcugggcgccgugagcagcggcagcgccgccagcgccacccccgacacccccacccugguggccagcggcgccggcgacagcgcccccguggccgccgccagcgugcccgccccccccgccagcaucauggagagaaucagcgccagcaagggccugaucagccccaugauggccagacuggccgccgccgcccugaagcccagcgccaccuucgaccccggcagcggccagcaggugacccccgccagauucccccccgcccaggugaagcccgagcccggcgagagcaccggcgcccccggcccccacgaggccagccaggacagaagccuggaccugaccgugaaggagcccagcaacgagagcaacggccacgccgugcccgccaacagcagccugcugagcagccugaugaacaagaugagccagggcaaccccggccugggcagccugcugaacaucaaggccgaggccgagggcagccccgccgccgagcccagccccuuccugggcaaggccgugaaggcccuggugcaggagaagcuggccgagcccuggaagguguaccugagaagauucggcaccaaggacuucugcgacggccagugcgacuuccugcacaaggcccacuuccacugcgugguggaggagugcggcgcccuguucagcacccuggacggcgccaucaagcacgccaacuuccacuucagaaccgagggcggcgccgccaagggcaacaccgaggccgccuuccccgccagcgccgccgagaccaagccccccauggcccccagcagcccccccgugccccccgugaccaccgccaccgugagcagccuggagggccccgcccccagccccgccagcgugcccagcacccccacccugcuggccuggaagcagcuggccagcaccaucccccagaugccccagauccccgccagcgugccccaccugcccgccagcccccuggccaccaccagccuggagaacgccaagccccaggugaagcccggcuuccugcaguuccaggagaaguaa

SEQ ID NO: 14678 - RNA, 1584 nt, Artificial Sequence
  CAT__Homo_sapiens__NP_001743
auggccgacagcagagaccccgccagcgaccagaugcagcacuggaaggagcagagagccgcccagaaggccgacgugcugaccaccggcgccggcaaccccgugggcgacaagcugaacgugaucaccgugggccccagaggcccccugcuggugcaggacgugguguucaccgacgagauggcccacuucgacagagagagaauccccgagagaguggugcacgccaagggcgccggcgccuucggcuacuucgaggugacccacgacaucaccaaguacagcaaggccaagguguucgagcacaucggcaagaagacccccaucgccgugagauucagcaccguggccggcgagagcggcagcgccgacaccgugagagaccccagaggcuucgccgugaaguucuacaccgaggacggcaacugggaccuggugggcaacaacacccccaucuucuucaucagagaccccauccuguuccccagcuucauccacagccagaagagaaacccccagacccaccugaaggaccccgacauggugugggacuucuggagccugagacccgagagccugcaccaggugagcuuccuguucagcgacagaggcauccccgacggccacagacacaugaacggcuacggcagccacaccuucaagcuggugaacgccaacggcgaggccguguacugcaaguuccacuacaagaccgaccagggcaucaagaaccugagcguggaggacgccgccagacugagccaggaggaccccgacuacggcaucagagaccuguucaacgccaucgccaccggcaaguaccccagcuggaccuucuacauccaggugaugaccuucaaccaggccgagaccuuccccuucaaccccuucgaccugaccaagguguggccccacaaggacuacccccugauccccgugggcaagcuggugcugaacagaaaccccgugaacuacuucgccgagguggagcagaucgccuucgaccccagcaacaugccccccggcaucgaggccagccccgacaagaugcugcagggcagacuguucgccuaccccgacacccacagacacagacugggccccaacuaccugcacauccccgugaacugccccuacagagccagaguggccaacuaccagagagacggccccaugugcaugcaggacaaccagggcggcgcccccaacuacuaccccaacagcuucggcgcccccgagcagcagcccagcgcccuggagcacagcauccaguacagcggcgaggugagaagauucaacaccgccaacgacgacaacgugacccaggugagagccuucuacgugaacgugcugaacgaggagcagagaaagagacugugcgagaacaucgccggccaccugaaggacgcccagaucuucauccagaagaaggccgugaagaacuucaccgaggugcaccccgacuacggcagccacauccaggcccugcuggacaaguacaacgccgagaagcccaagaacgccauccacaccuucgugcagagcggcagccaccuggccgccagagagaaggccaaccuguaa

SEQ ID NO: 14679 - RNA, 2343 nt, Artificial Sequence
  CATSPER1__Homo_sapiens__NP_444282
auggaccagaacagcgugcccgagaaggcccagaacgaggccgacaccaacaacgccgacagauucuucagaagccacagcagccccccccaccacagacccggccacagcagagcccugcaccacuacgagcugcaccaccacggcgugccccaccagagaggcgagagccaccacccccccgaguuccaggacuuccacgaccaggcccugagcagccacgugcaccagagccaccaccacagcgaggccagaaaccacggcagagcccacggccccaccggcuucggccuggcccccagccagggcgccgugcccagccacagaagcuacggcgaggacuaccacgacgagcugcagagagacggcagaagacaccacgacggcagccaguacggcggcuuccaccagcagagcgacagccacuaccacagaggcagccaccacggcagaccccaguaccugggcgagaaccugagccacuacagcagcggcgugccccaccacggcgaggccagccaccacggcggcagcuaccugccccacggccccaaccccuacagcgagagcuuccaccacagcgaggccagccaccugagcggccugcagcacgacgagagccagcaccaccaggugccccacagaggcuggccccaccaccaccaggugcaccaccacggcagaagcagacaccacgaggcccaccagcacggcaagagcccccaccacggcgagaccaucagcccccacagcagcgugggcagcuaccagagaggcaucagcgacuaccacagcgaguaccaccagggcgaccaccaccccagcgaguaccaccacggcgaccacccccaccacacccagcaccacuaccaccagacccacagacacagagacuaccaccagcaccaggaccaccacggcgccuaccacagcagcuaccugcacggcgacuacgugcagagcaccagccagcugagcaucccccacaccagcagaagccugauccacgacgcccccggccccgccgccagcagaaccggcguguuccccuaccacguggcccaccccagaggcagcgcccacagcaugaccagaagcagcagcaccaucagaagcagagugacccagaugagcaagaaggugcacacccaggacaucagcaccaagcacagcgaggacuggggcaaggaggagggccaguuccagaagagaaagaccggcagacugcagagaaccagaaagaagggccacagcaccaaccuguuccaguggcugugggagaagcugaccuuccugauccagggcuucagagagaugaucagaaaccugacccagagccuggccuucgagaccuucaucuucuucguggugugccugaacaccgugaugcugguggcccagaccuucgccgagguggagaucagaggcgagugguacuucauggcccuggacagcaucuucuucugcaucuacgugguggaggcccugcugaagaucaucgcccugggccugagcuacuucuucgacuucuggaacaaccuggacuucuucaucauggccauggccgugcuggacuuccugcugaugcagacccacagcuucgccaucuaccaccagagccuguucagaauccugaagguguucaagagccugagagcccugagagccaucagagugcugagaagacugagcuuccugaccagcgugcaggaggugaccggcacccugggccagagccugcccagcaucgccgccauccugauccugauguucaccugccuguuccuguucagcgccgugcugagagcccuguucagaaagagcgaccccaagagauuccagaacaucuucaccaccaucuucacccuguucacccugcugacccuggacgacuggagccugaucuacauggacagcagagcccagggcgccugguacaucauccccauccuggugaucuacaucaucauccaguacuucaucuuccugaaccuggugaucaccgugcugguggacagcuuccagaccgcccuguucaagggccuggagaaggccaagcaggagagagccgccagaauccaggagaagcugcuggaggacagccugaccgagcugagagccgccgagcccaaggagguggccagcgagggcaccaugcugaagagacugaucgagaagaaguucggcaccaugaccgagaagcagcaggagcugcuguuccacuaccugcagcugguggccagcguggagcaggagcagcagaaguucagaagccaggccgccgugaucgacgagaucguggacaccaccuucgaggccggcgaggaggacuucagaaacuaa

SEQ ID NO: 14680 - RNA, 1587 nt, Artificial Sequence
  CATSPER2__Homo_sapiens__NP_001269238
auggccgccuaccagcaggaggagcagaugcagcugcccagagccgacgccaucagaagcagacugaucgacaccuucagccugaucgagcaccugcagggccugagccaggccgugcccagacacaccaucagagagcugcuggaccccagcagacagaagaagcuggugcugggcgaccagcaccagcuggugagauucagcaucaagccccagagaaucgagcagaucagccacgcccagagacugcugagcagacugcacgugagaugcagccagagacccccccugagccugugggccggcugggugcuggagugcccccuguucaagaacuucaucaucuuccugguguuccugaacaccaucauccugaugguggagaucgagcugcuggagagcaccaacaccaagcuguggccccugaagcugacccuggagguggccgccugguucauccugcugaucuucauccuggagauccugcugaaguggcugagcaacuucagcguguucuggaagagcgccuggaacguguucgacuucguggugaccaugcugagccugcugcccgaggugguggugcuggugggcgugaccggccagagcguguggcugcagcugcugagaaucugcagagugcugagaagccugaagcugcuggcccaguucagacagauccagaucaucauccuggugcuggugagagcccugaagagcaugaccuuccugcugaugcugcugcugaucuucuucuacaucuucgccgugaccggcguguacguguucagcgaguacaccagaagccccagacaggaccuggaguaccacguguucuucagcgaccugcccaacagccuggugaccguguucauccuguucacccuggaccacugguacgcccugcugcaggacguguggaaggugcccgaggugagcagaaucuucagcagcaucuacuucauccuguggcugcugcugggcagcaucaucuucagaagcaucaucguggccaugauggugaccaacuuccagaacaucagaaaggagcugaacgaggagauggccagaagagaggugcagcugaaggccgacauguucaagagacagaucauccagagaagaaagaacaugagccacgaggcccugaccagcagccacagcaagaucgaggacagaggcgccagccagcagagagagagccuggaccugagcgaggugagcgagguggagagcaacuacggcgccaccgaggaggaccugaucaccagcgccagcaagaccgaggagacccugagcaagaagagagaguaccagagcagcagcugcgugagcagcaccagcagcagcuacagcagcagcagcgagagcagauucagcgagagcaucggcagacuggacugggagacccuggugcacgagaaccugcccggccugauggagauggaccaggacgacagaguguggcccagagacagccuguucagauacuucgagcugcuggagaagcugcaguacaaccuggaggagagaaagaagcugcaggaguucgccgugcaggcccugaugaaccuggaggacaaguaa

SEQ ID NO: 14681 - RNA, 444 nt, Artificial Sequence
  CAV1__Homo_sapiens__NP_001166366
auggccgacgagcugagcgagaagcagguguacgacgcccacaccaaggagaucgaccuggugaacagagaccccaagcaccugaacgacgacguggugaagaucgacuucgaggacgugaucgccgagcccgagggcacccacagcuucgacggcaucuggaaggccagcuucaccaccuucaccgugaccaaguacugguucuacagacugcugagcgcccuguucggcauccccauggcccugaucuggggcaucuacuucgccauccugagcuuccugcacaucugggccguggugcccugcaucaagagcuuccugaucgagauccagugcaucagcagaguguacagcaucuacgugcacaccgugugcgacccccuguucgaggccgugggcaagaucuucagcaacgugagaaucaaccugcagaaggagaucuaa

SEQ ID NO: 14682 - RNA, 489 nt, Artificial Sequence
  CAV2__Homo_sapiens__NP_001224
augggccuggagaccgagaaggccgacgugcagcuguucauggacgacgacagcuacagccaccacagcggccuggaguacgccgaccccgagaaguucgccgacagcgaccaggacagagacccccacagacugaacagccaccugaagcugggcuucgaggacgugaucgccgagcccgugaccacccacagcuucgacaagguguggaucugcagccacgcccuguucgagaucagcaaguacgugauguacaaguuccugaccguguuccuggccaucccccuggccuucaucgccggcauccuguucgccacccugagcugccugcacaucuggauccugaugcccuucgugaagaccugccugauggugcugcccagcgugcagaccaucuggaagagcgugaccgacgugaucaucgccccccugugcaccagcgugggcagaugcuucagcagcgugagccugcagcugagccaggacuaa

SEQ ID NO: 14683 - RNA, 456 nt, Artificial Sequence
  CAV3__Homo_sapiens__NP_001225
augauggccgaggagcacaccgaccuggaggcccagaucgugaaggacauccacugcaaggagaucgaccuggugaacagagaccccaagaacaucaacgaggacaucgugaagguggacuucgaggacgugaucgccgagcccgugggcaccuacagcuucgacggcguguggaaggugagcuacaccaccuucaccgugagcaaguacuggugcuacagacugcugagcacccugcugggcgugccccuggcccugcuguggggcuuccuguucgccugcaucagcuucugccacaucugggccguggugcccugcaucaagagcuaccugaucgagauccagugcaucagccacaucuacagccugugcaucagaaccuucugcaacccccuguucgccgcccugggccaggugugcagcagcaucaagguggugcugagaaaggagguguaa

SEQ ID NO: 14684 - RNA, 1788 nt, Artificial Sequence
  CBFA2T2__Homo_sapiens__NP_001028171
auggugggcgugcccggcgccgccgccuuccagcugggccccgagaagagagugcccgccaugcccggcagccccguggaggugaagauccagagcagaagcagcccccccaccaugcccccccugccccccaucaaccccggcggccccagacccgugagcuucacccccaccgcccugagcaacggcaucaaccacagcccccccacccugaacggcgcccccagccccccccagagauucagcaacggccccgccagcagcaccagcagcgcccugaccaaccagcagcugcccgccaccugcggcgccagacagcugagcaagcugaagagauuccugaccacccugcagcaguucggcaacgacaucagccccgagaucggcgagaaggugagaacccuggugcuggcccuggugaacagcaccgugaccaucgaggaguuccacugcaagcugcaggaggccaccaacuucccccugagacccuucgugauccccuuccugaaggccaaccugccccugcugcagagagagcugcugcacugcgccagagccgccaagcagacccccagccaguaccuggcccagcacgagcaccugcugcugaacaccagcaucgccagccccgccgacagcagcgagcugcugauggaggugcacggcaacggcaagagacccagccccgagagaagagaggagaacagcuucgacagagacaccaucgcccccgagccccccgccaagagagugugcaccaucagccccgcccccagacacagccccgcccugaccgugccccugaugaaccccggcggccaguuccaccccaccccccccccccugcagcacuacacccuggaggacaucgccaccagccaccuguacagagagcccaacaagaugcuggagcacagagaggugagagacagacaccacagccugggccugaacggcggcuaccaggacgagcugguggaccacagacugaccgagagagagugggccgacgaguggaagcaccuggaccacgcccugaacugcaucauggagaugguggagaagaccagaagaagcauggccgugcugagaagaugccaggagagcgacagagaggagcugaacuacuggaagagaagauacaacgagaacaccgagcugagaaagaccggcaccgagcuggugagcagacagcacagccccggcagcgccgacagccugagcaacgacagccagagagaguucaacagcagacccggcaccggcuacgugcccguggaguucuggaagaagaccgaggaggccgugaacaaggugaagauccaggccaugagcgaggugcagaaggccguggccgaggccgagcagaaggccuucgaggugaucgccaccgagagagccagaauggagcagaccaucgccgacgugaagagacaggccgccgaggacgccuuccuggugaucaacgagcaggaggagagcaccgagaacugcuggaacugcggcagaaaggccagcgagaccugcagcggcugcaacaucgccagauacugcggcagcuucugccagcacaaggacugggagagacaccacagacugugcggccagaaccugcacggccagagcccccacggccagggcagaccccugcugcccgugggcagaggcagcagcgccagaagcgccgacugcagcgugcccagccccgcccuggacaagaccagcgccaccaccagcagaagcagcacccccgccagcgugaccgccaucgacaccaacggccuguaa

SEQ ID NO: 14685 - RNA, 1962 nt, Artificial Sequence
  CBFA2T3__Homo_sapiens__NP_005178
augcccgccagcagacugagagacagagccgccagcagcgccagcggcagcaccugcggcagcaugagccagacccaccccgugcuggagagcggccugcuggccagcgccggcugcagcgcccccagaggccccagaaagggcggccccgcccccguggacagaaaggccaaggccagcgccaugcccgacagccccgccgaggugaagacccagcccagaagcaccccccccagcaugcccccccccccccccgccgccagccagggcgccaccagaccccccagcuucaccccccacacccacagagaggacggccccgccacccugccccacggcagauuccacggcugccugaaguggagcauggugugccugcugaugaacggcagcagccacagccccaccgccaucaacggcgcccccugcacccccaacggcuucagcaacggccccgccaccagcagcaccgccagccugagcacccagcaccugccccccgccugcggcgccagacagcugagcaagcugaagagauuccugaccacccugcagcaguucggcagcgacaucagccccgagaucggcgagagagugagaacccuggugcugggccuggugaacagcacccugaccaucgaggaguuccacagcaagcugcaggaggccaccaacuucccccugagacccuucgugauccccuuccugaaggccaaccugccccugcugcagagagagcugcugcacugcgccagacuggccaagcagacccccgcccaguaccuggcccagcacgagcagcugcugcuggacgccagcgccagcagccccaucgacagcagcgagcugcugcuggaggugaacgagaacggcaagagaagaacccccgacagaaccaaggagaacggcagcgacagagacccccugcaccccgagcaccugagcaagagacccugcacccugaaccccgcccagagauacagccccagcaacggccccccccagcccaccccccccccccacuacagacuggaggacaucgccauggcccaccacuucagagacgccuacagacaccccgaccccagagagcugagagagagacacagaccccugguggugcccggcagcagacaggaggaggugaucgaccacaagcugaccgagagagagugggccgaggaguggaagcaccugaacaaccugcugaacugcaucauggacaugguggagaagaccagaagaagccugaccgugcugagaagaugccaggaggccgacagagaggagcugaaccacugggccagaagauacagcgacgccgaggacaccaagaagggccccgcccccgccgccgccagacccagaagcagcagcgccggccccgagggcccccagcuggacgugcccagagaguuccugcccagaacccugaccggcuacgugcccgaggacaucuggagaaaggccgaggaggccgugaacgaggugaagagacaggccaugagcgagcugcagaaggccgugagcgacgccgagagaaaggcccacgagcugaucaccaccgagagagccaagauggagagagcccuggccgaggccaagagacaggccagcgaggacgcccugaccgugaucaaccagcaggaggacagcagcgagagcugcuggaacugcggcagaaaggccagcgagaccugcagcggcugcaacgccgccagauacugcggcagcuucugccagcacagagacugggagaagcaccaccacgugugcggccagagccugcagggccccaccgccgugguggccgaccccgugcccggcccccccgaggccgcccacagccugggccccagccugcccgugggcgccgccagccccagcgaggccggcagcgccggccccagcagacccggcagccccagcccccccggcccccuggacaccgugcccagauaa

SEQ ID NO: 14686 - RNA, 549 nt, Artificial Sequence
  CBFB__Homo_sapiens__NP_001746
augcccagaguggugcccgaccagagaagcaaguucgagaacgaggaguucuucagaaagcugagcagagagugcgagaucaaguacaccggcuucagagacagaccccacgaggagagacaggccagauuccagaacgccugcagagacggcagaagcgagaucgccuucguggccaccggcaccaaccugagccugcaguucuuccccgccagcuggcagggcgagcagagacagacccccagcagagaguacguggaccuggagagagaggccggcaagguguaccugaaggcccccaugauccugaacggcgugugcgugaucuggaagggcuggaucgaccugcagagacuggacggcaugggcugccuggaguucgacgaggagagagcccagcaggaggacgcccuggcccagcaggccuucgaggaggccagaagaagaaccagagaguucgaggacagagacagaagccacagagaggagauggaggugagagugagccagcugcuggccgugaccggcaagaagaccaccagacccuaa

SEQ ID NO: 14687 - RNA, 2949 nt, Artificial Sequence
  CBLB__Homo_sapiens__NP_733762
auggccaacagcaugaacggcagaaaccccggcggcagaggcggcaaccccagaaagggcagaauccugggcaucaucgacgccauccaggacgccgugggcccccccaagcaggccgccgccgacagaagaaccguggagaagaccuggaagcugauggacaagguggugagacugugccagaaccccaagcugcagcugaagaacagcccccccuacauccuggacauccugcccgacaccuaccagcaccugagacugauccugagcaaguacgacgacaaccagaagcuggcccagcugagcgagaacgaguacuucaagaucuacaucgacagccugaugaagaagagcaagagagccaucagacuguucaaggagggcaaggagagaauguacgaggagcagagccaggacagaagaaaccugaccaagcugagccugaucuucagccacaugcuggccgagaucaaggccaucuuccccaacggccaguuccagggcgacaacuucagaaucaccaaggccgacgccgccgaguucuggagaaaguucuucggcgacaagaccaucgugcccuggaagguguucagacagugccugcacgaggugcaccagaucagcagcggccuggaggccauggcccugaagagcaccaucgaccugaccugcaacgacuacaucagcguguucgaguucgacaucuucaccagacuguuccagcccuggggcagcauccugagaaacuggaacuuccuggccgugacccaccccggcuacauggccuuccugaccuacgacgaggugaaggccagacugcagaaguacagcaccaagcccggcagcuacaucuucagacugagcugcaccagacugggccagugggccaucggcuacgugaccggcgacggcaacauccugcagaccaucccccacaacaagccccuguuccaggcccugaucgacggcagcagagagggcuucuaccuguaccccgacggcagaagcuacaaccccgaccugaccggccugugcgagcccaccccccacgaccacaucaaggugacccaggagcaguacgagcuguacugcgagaugggcagcaccuuccagcugugcaagaucugcgccgagaacgacaaggacgugaagaucgagcccugcggccaccugaugugcaccagcugccugaccgccuggcaggagagcgacggccagggcugccccuucugcagaugcgagaucaagggcaccgagcccaucaucguggaccccuucgaccccagagacgagggcagcagaugcugcagcaucaucgaccccuucggcaugcccaugcuggaccuggacgacgacgacgacagagaggagagccugaugaugaacagacuggccaacgugagaaagugcaccgacagacagaacagccccgugaccagccccggcagcagcccccuggcccagagaagaaagccccagcccgacccccugcagaucccccaccugagccugccccccgugccccccagacuggaccugauccagaagggcaucgugagaagccccugcggcagccccaccggcagccccaagagcagccccugcauggugagaaagcaggacaagccccugcccgcccccccccccccccugagagacccccccccccccccccccgagagacccccccccaucccccccgacaacagacugagcagacacauccaccacguggagagcgugcccagcagagacccccccaugccccuggaggccuggugccccagagacguguucggcaccaaccagcuggugggcugcagacugcugggcgagggcagccccaagcccggcaucaccgccagcagcaacgugaacggcagacacagcagagugggcagcgaccccgugcugaugagaaagcacagaagacacgaccugccccuggagggcgccaagguguucagcaacggccaccugggcagcgaggaguacgacgugccccccagacugagcccccccccccccgugaccacccugcugcccagcaucaagugcaccggcccccuggccaacagccugagcgagaagaccagagaccccguggaggaggacgacgacgaguacaagauccccagcagccaccccgugagccugaacagccagcccagccacugccacaacgugaagccccccgugagaagcugcgacaacggccacugcaugcugaacggcacccacggccccagcagcgagaagaagagcaacauccccgaccugagcaucuaccugaagggcgacguguucgacagcgccagcgaccccgugccccugccccccgccagaccccccaccagagacaaccccaagcacggcagcagccugaacagaacccccagcgacuacgaccugcugauccccccccugggcgaggacgccuucgacgcccugccccccagccugccccccccccccccccccgccagacacagccugaucgagcacagcaagccccccggcagcagcagcagacccagcagcggccaggaccuguuccugcugcccagcgaccccuucguggaccuggccagcggccaggugccccugccccccgccagaagacugcccggcgagaacgugaagaccaacagaaccagccaggacuacgaccagcugcccagcugcagcgacggcagccaggcccccgccagaccccccaagcccagacccagaagaaccgcccccgagauccaccacagaaagccccacggccccgaggccgcccuggagaacguggacgccaagaucgccaagcugaugggcgagggcuacgccuucgaggaggugaagagagcccuggagaucgcccagaacaacguggagguggccagaagcauccugagagaguucgccuuccccccccccgugagccccagacugaaccuguaa
